United States Patent 7,090,973 (NUCLEIC ACID SEQUENCES RELATING TO BACTEROIDES FRAGILIS FOR DIAGNOSTICS AND THERAPEUTICS) - sequence listing, part 3

SEQ ID NO: 4712 - DNA, 1623 bp, B.fragilis
caactaaaattaacctttttatttatgtttactgatttattgcactcctcttatttctctctcttccttattgttgcgttgggcttcatgttgggaagaatcaagattaaggggctatcgctcgacgtgtcggcggttatcttcattgcccttcttttcgggcatttcggtgtgattattcccaaggaactggggaacttcggattggtactttttatctttaccatcggtatccaggcggggccgggattcttcgattctttccgcagtaaggggaagacgctgatcattattaccatgcttatcatcagttctgcctgtctgactgctgtcgggttaaagtatgcgtttggcatcgatacaccgagtgtggtggggctggtagccggagcgctgaccagtacaccgggtttggccgttgccatcgacagcaccaactctccgttggcttctatcgcttatggtattgcctatccgtttggcgtgattggtgtcatcctgtttgtgaagttgctgccgaagataatgcgtatcgaccttgacaaagaggcccgtcgtcttgagatagagcgtcgcggacagtttccggaactgggaacctgcatttatcgtatcacgaatccgagtgtattcggccgtagcctgatgcagatcaatgcacgtgccatgacaggagccgttatctcacgcctgaagcatcaggaagagatatccattccgacagcccatacggtactccatgaaggggactacattcaggcagtgggtagcgaagaagctctgacacaacttgccgtgttggtaggtgaacgtgaagaaggtgaacttccgttggaaaacacgcaagaaatcgaatcattgctgttgaccaagaaggatatgatcaataagcagttgggcgacctgaacctgatgaagaatttcggttgtaccgtgacacgtgtccgtcgaagcggtatcgacctctctccgtcacccgacctggcattgaagtttggcgataaactgatggtcgttggtgagaaagaaggcatcaagggagtagcccgtctgctgggtaataatgccaagaagctttccgacacggatttcttccccattgctatgggtattgtgctgggagttctgtttggcaaactcaatatctcgttcccgggcggattatccttttcgccgggattgacaggtggtgtgctgatggtggctttgctgctgagcgcaataggcaagaccgggcctatcctttggtctatgtccggacctgccaaccaattgcttcgtcagttgggactgttgcttttccttgccgaggtaggtacgtcggcaggtaagaatctggtcgctactttccaggagagcggtctgctgctgttcggagtaggtgccgccattactttagtgccgatgctgattgctgcgttcgtcggacgtctggtgtttaagatcagcttgcttgatttgctgggtaccattaccggcggtatgaccagtacgccgggacttgcggctgccgactcgatggtagacagcaatatcccgagtgtagcctatgcgacggtatatccgattgcaatggtattcctgatcctgtttatacaggtgattgcgacagtggtgtactaa

SEQ ID NO: 4713 - DNA, 198 bp, B.fragilis
gtagaatatcctgacgctgggcatggagcgagatggaaaagagaagtaggaaaagaaaagtacttaaacctttttctcgacccctccaccacaaggagggaaaatagttacatttctgctgtttcatatgttcttgattatgtattgattaatgatgttattattgagatcatcggtatttctctatccgttttgtaa

SEQ ID NO: 4714 - DNA, 228 bp, B.fragilis
tatacagatccatctctattgagagttacaggattgagacattttccgcttgcttcgatggtgtcgatggccaaaccgagttgtgctttggcaaattctacattttctgttataaaagacggtactgtgggtttgtggtttgagcaagccacacatatcattgcgcaggctgctcccaataagggttttaagttcatgttttattgtttttttatggtaaaagaataa

SEQ ID NO: 4715 - DNA, 204 bp, B.fragilis
ttgggcctgtttaagcaggtcgacgagatcccggtcattaacgaccatgaaggtttccccttgcctgatttccctgttccggacggagtcggtatattcatgcgtgaaatggtattcttcacagaatgcgcaaagcccgttatagcgctcgatcggttctttttcttctttctgaaccattatgatatgatcatatttctttag

SEQ ID NO: 4716 - DNA, 1560 bp, B.fragilis
attttcttcccgtcgatgtcaaagatacctcctcagcgcatcagtgcgctctttcacgtctttaagttgttcaatagtaatcatacttcttttttatggttttcattaattatggggagcaaagatatacaaaattttgtgttcttactcctcatacattttatcaattacctctttatagttgcgtgccactaccggacgtttcaacttcagggtattagtcagttcccctttttccatgctgaacggttcgggaagcaacgtaaatcgtttaatctgttcgtaatgggcaaactgctgctgcaacgtatcgatacgtgcgcggaacaaagcagtaattttaggatgctccaacaattcggccatatctttgtattcgatgcctttctctttggcatactgtttcacaaaaccgtataccggtacaatcagtgcagatacaaacttacgctggtcggcaataatagctatctgatcgatataacggtcgataaccaatttggtttccaatgcctgaggagcgatatattttccgttcgatgtcttaaacaggtctttgatacgctctgtcagatacaactgcccatttttaaaatagccggcatcaccggtatgaaaccaaccttcttcatcgatggctgcagccgtcgcttccgcctttttataataccctttcgtgatggtctttccacgaagcagaatctcgttatcttcgccgatcttcacttctacctccggcatcacctgacctaccgaaccaatatcataacccgtcttcgaagtacacgaaacagttgccgtagattctgtcaaaccatatccgaccagcatatcgatacccaccgaatgtacaaactcgcaaatttcatcgggaacagcagcaccggctgtcgggaagaagttaccgttctctattccgatggtctttttcagcagagcatagatagtcttctcataaaacttatatttcagctgaatcattcggggaggcgtcttacccacccgcaaataatccaaattatggatacggcctactttaatagcatccagcatcagcattttttttattccggtggtctcggctattttttcctgaacgccggcgtacaccttctcccaaaaacgagggacactacacatcaatgtcggacggatttctttaatggttgtctggatatcggccggacgaagattgatgcagacctgtacgcccttatgcacacagagataagtccatgccttctcaaacacatgggtcagcggcaggaagttcatcgaaacatccttatcggtcatatctaccagacggatatcatgaatacggaatgcttccaaatagcaagaatgatgcaacatgactcctttaggttcgcccgtagtaccggacgtatacaggatgtttgccaaatcctcggcactggcacgtgccgtacgttcttccactacttcattgtgtggcaaatcttttcctttagccaaaaactcgtcatagtaaatagaactcatatcacgcggatctttcactaccgccggatcaaaaatgatcaattgtacaagtga

SEQ ID NO: 4717 - DNA, 2208 bp, B.fragilis
aaatacataccagttcgtatcagttacgataggtttcattatctttgcactgttgctcggattgtaaagattcacaggcaaaaaaaggagcggaagaaacaacaaactaaaaataaaacaatgagaacgtacagatttatgtttccggtactacttgcaatgactgcaaccggaagtttgacggcagggccgtctgataaagggagctccggtattcggtttccggaagtaaaccaagtgaaaatagaagatacattctggaaacccaaattgaatctttggcagaaagtaacggtaaacgatgttttcgataagtttgaaggaaagcatctggaacatccgggagaattctgtaatacgttcgaaaacttcgatcgtgtggcgaaaggtgaacgcaatatcggacggcatgcaggagctccctggttcgatgggcttgtttacgagactatccgtggagtggcagacctgatggcaaggcaatcggatgcggctttggaaaaacgggtggacggatatatcgatcggattgctgtggcacaggcgtctgaacctaacgggtatatcgatacttacactcaactgatggaagccgaccatcagtggggagagcggggaggaatgctccgttggcaacacgatgtatacaacgccggtatgttggtggaagcgggcgtacactattataatgcgaccggaaaaacaaaattactggaagtggcaactcgctgtgccaatttgatggctgaatatatggggacttttcctaaaaagaatgtggttcctgcacattcgggtccggaagaggctttggtgaaactgtataccttatatagagacaatccgggactgaagaaacagatcaatgttccggtagttgagcgggaatatctcaggttggctgaattctggatcgaaggtagaggaaaacattgcggattcccgttgtgggggacatggggtaaccctgctgccgaacaatggatacgcgaccggaaatacgaggctcctgagtttggcaatcatacccgtccgtcatggggagactatgcacaggattctattccgcttttcgagcagaagacaatcgaggggcatgctgttcgtgccaccttgtttgctaccggagcaacggctgctgcacttgaaaatcgttcaccggagtatatagctgccgtcagccgtttatgggataatatgattggtaaacgtatgtttatcaccggtggggtaggtgctgttcactttgacgaaaagttcgggcctgattatttcttgcctacggatgcttatctggaaacttgtgctgctgtcggtgccggctttttcagccagagaatgaatgaactgaccggtgatgctaaatatatggacgagctggaacgtactttatataataatgtcctgacaggcatttctctttcgggtacacaatatacttatcagaatccgttgaattccgccaagcacgcccgttggggatggcatgattgtccttgctgtccgcccatgttcttgaaaatgatgtccgcaatgcccggatttatctattcacagaagggggatgatatctatgtaaacctctttatcggcagtgaaacggaactgagcctatcggatcagagtcggatacggttgacgcaaaagaccggatatccatgggatggttctgttgtcatgactgttgaaccggagaaagaaaaaacttttttattaaaagtacggatcccgggatgggcacagggagtcgagaatccatacgatttgtatcgttcgggagtgaagtctgctgtcaatctgaaagtaaacggcaaatctatcgcaatgaaaatatttaaaggatatgccgaaattcagcggaagtggaaaaagggagatagagtagaattgacattacctgttcagccgcggttggtaacggccaatgaagctgtagcggatctgcaaaataaggtggccattgctgccggtccttttgtatattgcctggaaggatgtgacaatgaaggggtggctgatctgagactcgatacgcgcgctcctttatcgatgacttttgaaaaagaactgctgaatggagttaatgtaattaaaggccaggcactggataagacaggaaagaaagtgtcggtttcggctattccttattatgctctgggcaatcgtcaggataaaggctatgtcgtttggatgcccgcaaataaatga

SEQ ID NO: 4718 - DNA, 195 bp, B.fragilis
acaaatacgtttaagctactgattcttataaaccaaagggctgtgtcaaaaactcttttcaccacagattacacggattatcacagattatcaacatggataatcaatgacttagaactcattttgtgttactcagtgtcctctgtggtgagtttcgacacacgccctctattccatctgaaaagaaagttctaa

SEQ ID NO: 4719 - DNA, 267 bp, B.fragilis
gaaccccagccgtccaacccaatcaaaactacatgtttggctttccacttgctgccggcatggcaattgggaactatcgttaataaacagataattaaacaggctaatttaaacacttgtgttttcatgatacttttttataataaaattatttatctaaatcttttctacgcttcagggcttcaagaaagtagtagtctgcatagttcagaggtacgtcgatttcactattatgcggaatactgcctacgctatgcatcaggataa

SEQ ID NO: 4720 - DNA, 210 bp, B.fragilis
atagatgctactcccatagtacaaaagttttcgttgctccacatactgcccgatgatgctttatcatatggctttgtgtccagtaaatctccttggcaactgcttatagcaattgctgtggctgttaatatgaataatttatttaatagtttcataagatttcaagatttatttagaatgttatattggcacctattgcaattgtcctaa

SEQ ID NO: 4721 - DNA, 1092 bp, B.fragilis
ctgatacgaactggtatgtatttttattatgttacaaaacatatacgatatccggacagtagctgtacccttttacgttttttatcctatctttgcagcaccaaaaacaaaagtatgaaaaggaacgaatcaaaatacaaacaggtagtaaaccacgtaatagacggtatcaataacggtagttataagaaaggtgactggattctctctatcaacgaattcaggaaaaactataatctatccagagatacggtattcgccggtttaagcgaactgaaatcaaaaggaatcattgattcgactccgggtgtaggttattatatagcgacgacccgcatcgcacaaaagctgaatatattccttcttttcaacgaattcaatgaattcaaagaagatctttacaattcatttatttcatccatcaggaaaaccgccaatgtagatctatattttcataattacaaccgaaaggtttttgaaactctgatcaacgaagccaattataaatacacaacctatattctgatgcccggtaaattcactaatatagccccactattggaaagcctatcgggtcgtgtctttttactcgaccatttccatcccgaactggccggaaaatactcttctgtcgcacagaattttgaaaaagacacctacgaagccttggtatacggacttccccacctaaagaaatatgatcatatcataatggttcagaaagaagaaaaagaaccgatcgagcgctataacgggctttgcgcattctgtgaagaataccatttcacgcatgaatataccgactccgtccggaacagggaaatcaggcaaggggaaaccttcatggtcgttaatgaccgggatctcgtcgacctgcttaaacaggcccaactacagaatttcgcaccgggaaaagacttcggaatcatttcttacaacgacaccccgcttaaagaaatattggccggaggaatcaccactttgtctaccgacttcaaacaaatgggacaaacaatggcttcactcattacacaaaaagaaataaagaccatcgagaatccctggaagttggatatccggaactcactttaa

SEQ ID NO: 4722 - DNA, 1926 bp, B.fragilis
aatcttaattttattacgatgaagaaattattaatattcactctcttgctatgctgtactgtaaaagctctcagctatacagaacggaactatcttcaaaaacaggccaacgtaagcagtttgcaggaagtgcttatattaaatcaacaatgggtcacttatcctgcttataccgaccgaaccggatgggacacttttttaggctctttcaagaatgaatgtatccttcgcggagagaagcagttgaattatcaatggcaggttgtgaaagctactgattatatggaatttgaacgcagcggcaaccgtagcattatggaaactcctttcgccaataataacaatgccatagccgacctgctactcgctgaactcgcagaagggaaaggacgatttatcgatcagctgatcaacggtgtatatcattcctgcgagatgacttcctgggcattggccgcccatttgaatgcacaacagtctcaccgctcattacccgattttaaagaaaacatcatagacctgacagcaggtgacttaggctctttactcgcatggacctattattacatgcacaaagagtttgacaaactcaatcctgctatatccgaacgtttacggcatacgctccaacagcgtatattggatccttacatgaataacgatcacttctggtggatggcagtgaactatagaccgggaatgttggtcaacaactggaatccttggtgtaacagcaacgccttaatgtgttttatgctgcttgaaaatgataaagaaatgttagcgaaggcaatataccgcagtatggtttcggtagataaattcatcaactatacccataccgacggtgcatgtgaggaaggcccctcctattggggacatgccgccggaaaaatgtttgattatctggaattactgtcagccgttaccgggggaactgtctccatcttcgataatcccatgataaagaatatgggcgaatatatatcacgttcatacgtgggcaaaggatgggtggttaatttcgctgatgcttcggcgaaaggcagtggagacgctcccttgatattccggtatggcaaggctgtaaacagtaacgaaatgaaaggattcgctgctatgattaacaccaataaactcccttccggacgcgatatataccgtacgcttgctgctataaagattgcgaacgaactaaaagaaactcaagcggcacatctgactcccccattctcctggtatccggaaaccgaattctgctatataactgacaataaaggaaactttctggccgctaaaggaggatataacgacgagagccataatcataatgacgcaggtaccttctctttctggatagaccaaactccttttcttattgatgccggagtagggacctatacacgccagacattcagcaaggatcgctacaccatttggactatgcagagcaactatcacaatctccccctgattaatggcgtccctcagaaatacggagcaacatataaagcaacacacgtacaagctgacaagaggaaaaacacattcacagccaatatagcgacagcctatccggccgaagcagaagtggaatcatggatacgttcctattcacttcagaaaggacaattacggatttcagattctttccgtctgacaacagccaaacagcctaatcaaatcaatttcatgacatgggggcaggtgaatactgaaataccgggaaaaattcaattggaagtaaaaggaaagaaagccgtcatagaatatgataaacaactgttcgatgtgaaaacagaaataatcccattaacagatacccggctatccaatgtatggggtaaatcgatttgtcgcattacactcacagcaacaaacatctataaaacaggaaattattcttttaccataaaaaaacaataa

SEQ ID NO: 4723 - DNA, 474 bp, B.fragilis
tatatgtcacaggaaatagaacgtaaatttctcgttagtggagattataagtcacaggcttttgatcagagccgcatcgttcagggatatatcagtagtgcccgtggaagaacggtccgcgtacgcatacgtgacggaaaaggctatctgactattaaaggagcttcggatgcttcgggaataagccgttacgagtgggagaaggaactgtctctcgccgaggctgaggaactgatgaagctttgcgaaccgggagtgatcgataagacccgttatctggtgcgtagcgggaaacatatcttcgaggtagatgagttctatggagagaatgaaggacttgttgtggctgaggtggaattgggttcggaagacgaagtgtttgtaaaacccggctttatcggagaagaggttacgggtgacattcgttactataattcgcagttgatgaaaaaaccgtatactacctggttgtag

SEQ ID NO: 4724 - DNA, 1182 bp, B.fragilis
ccggatgggcaacaatccccttgcctttgggcacagtcacgcacaggaactgccgatcgggagatctgggtaaaaactcttgtacgcctggccgatcccgtactcagtaacctggccaatgaaacactgaaaaaggaaatgccttacgaatcgcttgctcccaaccggcaacgtttttcttatctggaggcagtgggacgaaccgtatgcggcattgctccatggctggaactaggagaagacgatactcccgaaggacaattacgtaaaaaatatatcgaactgacggcgaaagggatcagcaatgcagtgaatccgtcctcacccgattacctgatcttcggagaaccttcacaacccttggtagatgccgcatttctggcagaaggattattgcgtgcacctaaacaattatggggcaacctctcacccactgcccgcaagcaagtggtgacggagttaaaacgaagccgtgttatcaagcccaatgaaagcaactggctgctgtttgcctccatcgtggaagcagccctgcaagaattcaccggagaatgtgatacaacgcggctcaattatggggtacgcaagttcagagatctttggtataaaggagacgcccagtatggagacggagcagaattccacctcgattattacaatagcttcgtgattcatcctatgcttaccgatgtattagttgtcatgcagaagcaccggatgccggaaagtgaatttctgaatgtacagcaaaaacgcttgggacgctatgccgaacaattggagcgtttcatttctccggaaggaacatatccggtaatcggacgttcgattgtctatcgtaccggagtatttcacgcattgggacaagcagctttactgcatctccttccgcaacaaattgttcccgcacaggtacgctgcggcatgacgaaagttatagagaaccaattccgatctgctgccaatttcgacacaaagggttggttgaagataggtttctccggtaatcaggttcaaatgtcggagtcctacattaatacaggaagtacttacttgtgcctgaccggtttcttgccattgggactacccgccgacgatcctttctggagtgcccctcctgccgaatggaccaacctgaaagcctggtcggggaaagaggtgccgacagatcattctttataa

SEQ ID NO: 4725 - DNA, 2091 bp, B.fragilis
tcaatacataatcaagaacatatgaaacagcagaaatgtaactattttccctccttgtggtggaggggtcgagaaaaaggtttaagtacttttcttttcctacttctcttttccatctcgctccatgcccagcgtcaggatattctactcaacaataactggaatttccgtttttcgcatcaggtacagggagacacccggcgggtggacttgccgcacacctggaatgcacaagacgcacttgccggcaaaatagattataaacgaggtattggcaactacgagaaagctttgtacatccgccccgaatggaaaggtaaacgtctttttcttcgtttcgacggagtaaacagtatagccgatgtatttattaatcgcaagcatataggtgagcaccgaggcggatacggagccttcatcttcgaaatcacggacttggtgaaatatggagaaaagaactctgtcctggtacgcgccaacaatggtgaacagttagacatcatgccgctggtgggtgacttcaatttttatggaggaatctatcgggacgtacatctgttgataaccgacgagacttgtatctcacctttggactacgcttcgccgggagtttatctggtacaggaggtcgtcagcccgcaggaagcgaaagtatgcgctaaagttaacctatccaaccgtgcagccgacggaactgccgaacttcaggtcctggtaacggatggcaccaaggtgatttgcaaagagagccgcaacgtgtcattgaaacagggggctgatattcaggaacaactccctctactgattcagaaaccacgtctctggaatggttgcgaagatccctttatgtatcaggtcagtatcagtcttcacaaagacggcaaacaaatcgacagtgtaacgcagccattaggattgcgctattatcataccgatccggataaaggattctttctgaatggcaaacacctgccgcttcatggagtctgtcgccatcaggaccgcgcagaagtaggcaatgcactccgcccgcagcatcacgaagaggatgtggcactgatgcgcgaaatgggagtcaatgccatccgcctggcacactaccctcaagctacctatatgtacgacctgatggataaacacggtattgtaacctgggccgagattccgtttgtaggtcccggaggatatgcagataaaggttttgtagaccaagcttccttccgcgaaaatggtaaacaacaattgatcgaactgatccggcagcactacaaccacccttccatctgcttctggggactattcaatgagctgaaagaggtgggtgacaatcccgtagaatatgtaaaagaactgaatgtactggcaaaacaggaagaccctacccgcccgacaacttcggccagtaaccaggacggcaatttgaacttcattaccgaaaacatagcctggaaccgttacgacggttggtatggaagtactccgaaaacactggcaacctttttggaccgtacacataaaaaacaccccgaactacgcatcggcatcagtgaatatggggcaggagccagcatctatcatcagcaggactcactcaaacaaccgtcggcttcaggctggtggcatcccgagaactggcagacttactaccacatggagaattggaaaatcattgccgaacgtcccttcgtatggggtactttcgtttggaacatgttcgatttcggggcagctcatcgtacggaaggcgaccgtccgggtatcaacgataaaggacttgtcaccttcgacagaaaagtgagaaaagatgctttctacttctacaaagctaactggaataaacaggaaccgatgatctatctggcggaaaaacgctgtcggctccgctatcagccggaacagaccttcatggctttcaccactgccccggaagccgaactatttgtaaacggtatcagttgtggtaaacaaaaggcggacacctactcaaccgttgtgtggaaaaatgtcaaactcacctcgggaggagaatatcattcgtgtgactactccccggcagaaaccacttacagacgaagtgacagtagaatataa

SEQ ID NO: 4726 - DNA, 1173 bp, B.fragilis
ctaactaataaaacacagatgtcgaatatttcttcaacagtttttgcagataccaagccgcattatcatctactggacgggctccggggagtagccgctcttatggttatatggtatcatgtattcgaaggctatgcttttgccggtggtaccactatcgataccttcaaccacggatatttagcagtagatttcttctttatcctttcaggtttcgttatcggttatgcttatgatgatcgttggggtaagaatttcaccatgaaagatttcattaaacgccgtttgatacgtcttcatccgatggtaatcatgggtgccgtagtgggtgctatcacattctatatccagggttctgtacaatgggacggaacacatatcggcatatcgatggtgatgttgtctcttctttgtaccatctttttcatccctgcaatgccgggtgtaggttacgaggttcgcggcaatggcgaaatgttcccattgaacggcccctgctggtcattattcttcgagtacataggcaatatcctttacgctttgttcattcgtcgtctgtcaaataaagcgttgaccatagttgtagtattactgggagtagcattggcttcatttgccatcttcaatgtctcgggttatggaaacataggagtcggctggacactggacggtgtaaactttataggcggattattaagaatgcttttccccttctccatgggtatgcttttatcgcgtaacttcaagcccatgaagttgagaggtgcattctggatatgtacccttgtaatgatcgccttgttcgcagtgccttatttggaaggaacggaatcaatctgcacaaacggcatttatgaagcattctgtattatcatagctttccccatcctgctttggataggagcatcgggaaccaccacggataagaagtcaacccaaatatgtaaattcctgggagatatatcttatccgatctatgtgatacattatccattcatgtatttgttctatgcatggttgatcaaaaatcaacttttcacattaggagagacctggcaagttgccttatgcgtttacgcatggaacatattgtttgcttatctatgcttgaagctatacgatgaaccggtacgcaaatatctggctaaacgcttcctgaataagaaacaataa

SEQ ID NO: 4727 - DNA, 615 bp, B.fragilis
gaattgataaaattatgtaagtttgtaaacagaataatgaattcctctccaatgaaaaacatcataaacaaaatcaggcagttatacccggtttcggatgaagcgctccaggcattacaggcaaacatgcaggtaaagtattatcccaaagatacttatatagtgcaatcgggaataacggatcgcctggtttatttcatcgaagaaggtgtcacccgttctgtatttcatcacaacgggcaagataccaccacctggttcagccaagaaggtgacgttactttcggcatggattcgttatattataaacagccgtccatagagagtattgaaaccctttcggattgtaaaatctacgttctccatatagacgaactgaacgccctttacgaaaagtatatcgatatagccaactggggaaggatcttgcatcaggacgtcaacaaagaactcagtcacatgtttgtggaaagactccagctttctcccaaggaacgatacgaacagttcaacagacgctaccccggactgatcaatcgggtaaagctgaagtatgtcgctgcatttctgggtatttccatttatacactcagccgggtacgcgctaaaaaatag

SEQ ID NO: 4728 - DNA, 1821 bp, B.fragilis
ctaacaacaaaggatatgacttatcatcatttatctgtcttggtccatcgtcaggctgaaaagtatggcgacaagacagccctgaaataccgtgactatgagaaggcgcagtggatacctatctcttggaatgaattttcgcaaactgtaaggcaagccgccagtgctatggtggaattgggagtacaggaagaagaaaatatcggtattttctctcaaaataagccggaatgtctgtttacggattttgccgcttttgccaaccgtgcagtaactattccgctttatgcaaccagttctccggcacaggctcaatatatcatcaatgatgcccagatacgtttcttatttgtaggcgagcagttccagtatgatgccgctttcagtgtgttcggtttctgcccttcacttgtacaattgatcatttttgatccggcggtagtgaaagatccgcgtgatatgagttctatttactatgacgagtttttggctaaaggaaaagatttgccacacaatgaagtagtggaagaacgtacggcacgtgccagtgccgaggatttggcaaacatcctgtatacgtccggtactacgggcgaacctaaaggagtcatgttgcatcattcttgctatttggaagcattccgtattcatgatatccgtctggtagatatgaccgataaggatgtttcgatgaacttcctgccgctgacccatgtgtttgagaaggcatggacttatctctgtgtgcataagggcgtacaggtctgcatcaatcttcgtccggccgatatccagacaaccattaaagaaatccgtccgacattgatgtgtagtgtccctcgtttttgggagaaggtgtacgccggcgttcaggaaaaaatagccgagaccaccggaataaaaaaaatgctgatgctggatgctattaaagtaggccgtatccataatttggattatttgcgggtgggtaagacgcctccccgaatgattcagctgaaatataagttttatgagaagactatctatgctctgctgaaaaagaccatcggaatagagaacggtaacttcttcccgacagccggtgctgctgttcccgatgaaatttgcgagtttgtacattcggtgggtatcgatatgctggtcggatatggtttgacagaatctacggcaactgtttcgtgtacttcgaagacgggttatgatattggttcggtaggtcaggtgatgccggaggtagaagtgaagatcggcgaagataacgagattctgcttcgtggaaagaccatcacgaaagggtattataaaaaggcggaagcgacggctgcagccatcgatgaagaaggttggtttcataccggtgatgccggctattttaaaaatgggcagttgtatctgacagagcgtatcaaagacctgtttaagacatcgaacggaaaatatatcgctcctcaggcattggaaaccaaattggttatcgaccgttatatcgatcagatagctattattgccgaccagcgtaagtttgtatctgcactgattgtaccggtatacggttttgtgaaacagtatgccaaagagaaaggcatcgaatacaaagatatggccgaattgttggagcatcctaaaattactgctttgttccgcgcacgtatcgatacgttgcagcagcagtttgcccattacgaacagattaaacgatttacgttgcttcccgaaccgttcagcatggaaaaaggggaactgactaataccctgaagttgaaacgtccggtagtggcacgcaactataaagaggtaattgataaaatgtatgaggagtaa

SEQ ID NO: 4729 - DNA, 1410 bp, B.fragilis
ctttgtctgaaacataaaaaccacgcaactatgaaatctttttatcctgtcctttacttatgtttcttattcggattacttccgtttctgggcagttgttcggaggagaatgaatcttccggtacaatcgaaatgaatcaactgccgggcactgcacaatcttttttatctaattactttccgggacaaaccccggagaaaatagaaagaacgaataccgatcaggaaaatgccccgttgctttatcgtgttgtttttcccaatgaagttaaagtggaatttagtgaaaatggaggatggaaaagattgatgattccggatcaaaagttacccgggtccttagaccctctttggggaaagattattgaatatgtacagcaactttttcccgatgatccgtttatcggtatagagaatgcctgttatggggattgtgtgttgttaagtagcggtaagaaaatagcgttctattatgacggaacgtgtattggctatgaaatggatataaaagatgaatccggagtgccgcaacctgtacgtgattttgttgcaacgtattttcctgatggagttttccaggtggtggagcacattccgaataagaatgttactgccggctattcattctggttggagaatggatttaaatgtgtgctgaatgatcgtggtcagtggacagaagtgaatggaggtacagagttgctgccggtttcgattctggaggctttacctgcaaaagtaaccgaacaattgcatcgggattatccggctgcacaagttacttacattcgtttggagggtacctgttataccattcaggtcagtaagacggtgtatgtgactatcgatccggaaaacaaaccgatagtagtacctgtgatgcaggcacaagctttggctgaagagtactttggcaaactgcgttccatttccatcagtcatccgcttcatacggatgttttgaatttcaaggtctgtttgccgaacggatttaatatgcttgtcaacgaagatgccagcgaatggttgaatatagatgggaacggatttgcatttcctgaaaagctggtagcatcgcttcctgaaaagattaccgaatatatttcggcacattcgaactccgaaattacgagagtcgatcgttcggttgcagcttcatttttggtggagttgacgaatggtgacggactgatgtttgattcccagggaggttttcttggaaaagaaaaaatagaattgagcatttccgagaaaacatacagatatatgcgacatcaatttccggatgacctcaatatgtatttctcttcttatagcatagaggggtggatttataaattgggagacggatcacaggtcaggttcgatcgggatggtaactttgtggaaatgatcgctgcggcgaagtag

SEQ ID NO: 4730 - DNA, 1143 bp, B.fragilis
aatcttatgaaactattaaataaattattcatattaacagccacagcaattgctataagcagttgccaaggagatttactggacacaaagccatatgataaagcatcatcgggcagtatgtggagcaacgaaaacttttgtactatgggagtagcatctatctacgctaccctgcgcgaaggttatgtagcaaaagaggcttatctaatggaggcattcagcgtgggagcaacctgccgtgacaacgattatccgctactggccggtacagcttccatcggttccggaatattctcagactattggaaacaacattatgcaggtatctaccgtgccaatgatgccattgtacatctacccgacgcaccgataagtgaaagcgtaaaaggtaaattattatccgaagcaaaagtattgcgtgcattttattattacaaactgaatgcagttttcaggggtgttccttattataatacgcctatggaacttgatcaggcagacaaaccacgtgaaagcgaagagaatatatggaatttctgcatacaagatttaaccgacgcaataaatgatccgaattttcccgaccgtatcgctgccggtaaagcagaatggggtcatgtcaccaaatcagtggcttatgcattacgtggaaaaatctatctatggaccaaagaatggagcaaagcggaagcagatttccgtaaagtaggtgaattgggacattcattatttcaggatggttacaagcaactcttcaaagaagctaatgaacagagtgatgaagctatcttctctttgcagtgtatcgataataatggtagcacttacggaaattccatgagtttccgttatggtggtcgtactacatttggttcttgctggaacactatgttagccagtgtggattttgtagaaacctacgaaaatatagacggcagtaaatttaactgggatgaatacattccaggattctcaagcttagatattaaagaccgtgaagtattcttcttgcgtaataccgatccggaaacagtaaaagcacagtataagcgaaatcggctttgccggcacggaagaggcattagacgacatggtaaaaaaaataaaagccaaagtagacggacgtctggagaagttgagtga

SEQ ID NO: 4731 - DNA, 1302 bp, B.fragilis
agatatatggaacaactgtacaactacttgccggaaaagctggtgacctttatcctggttaccttgttttcacttttaataggactttcgcaacgtaaaatcagtctgaaacgtgaaggagaaaccactcttttcggtactgaccgcacctttacgtttatcggaatgctggggtatcttttgtatatcctcgatccggaagagatgcaccttttcatgggaggtggtttgatactcggcattcttttagggctcaactattatgtgaagcagtcccaattccatgtattcggggtgacgactattatcatcgcactgatcacctactgcattgctccgattgtgtctacacagccttcatggttttacgtcatggtgattgttactgttttattgcttaccgaactgaagcatacttttacggagatcgcacagcgaatgaaaaacgatgaaatgattacgttggccaagttcttggctatcagtggtatcatccttccgatgttgcctaatgaaaatattatccctgacatcaacctgacgccttataccatctggctggccacagtagtggtttcgggtatttcatatctttcctatttgctgaagcggtatgtctttcgtgaatcgggggtattggtgtccggcattatcggcgggctctacagtagtacggctacaatctcggtactcgcccgtaaaagccgtaatgcacattcgcaggaagcatccgaatatgttgccgccatgcttttggctgtcagcatgatgtttttgcgcttcatgattctaattcttattttcagctccactatttttacttctatctatccttatctattgattatggccgccgttgcagccgttgtagcctggtttatccacactcgtcggaagcggacacccgacgctgaccttgtggaagaagaagatgacagcagtaatccgttggagttcaaggtggctttgatttttgcagggttatttgttatatttaccgtactgacacactataccttgatttatgccgggacaggagggttgaacctgctgtcgttcgtttccggttttagtgatattactccttttatcctaaacttattgcagggcacgggaagtgtagcggctactgtggtgatggcttgtaccatgcaggccattatcagtaacattgtggtcaacatgtgttatgcgcttttcttctcgggtaagcagagtaaattgcgctcgtggatattgggcggattcggatgtgtaatcgcagcaaatgttgtcgtactttttttcttttatctgatttaa

SEQ ID NO: 4732 - DNA, 189 bp, B.fragilis
ctaatgtattgttcggactctcggaagttccggttgaacaatttatgcaatcatcaaatgccttttccgagattggattcttccataatgagagttgcagtgaattcacttaaggcctaccttaaagtgatttcactgcaactcttctatctcagctatgtgtttatgtttgtggcgctacttatatag

SEQ ID NO: 4733 - DNA, 2547 bp, B.fragilis
ttaaaggccaggcactggataagacaggaaagaaagtgtcggtttcggctattccttattatgctctgggcaatcgtcaggataaaggctatgtcgtttggatgcccgcaaataaatgacatgaacgaacataaacacaattacaacatgaaaataaactgtcttttagccttggcattgtctgcttcatcattggcggcacaagatgccgttatccgggtggatgccggtaaggttgaaaataaaataactccctatttgtacggagcttgtatggaagacgtaaatcatgagatttacggtggtctttatgaccagaaaattttcggtgagagttttgaagaacctgtttccatggataattttatcgggtttacccgttgtgaaggggtgtggaaactacaagatggccaactttccgtacaggcacatccgggagcaaaactggtatatgatgacacgcagctttccgacggaacggtcggggtcgatcttaaatttacgaacggtacttcatcctccaacaatgccggacttttactgcgtgtcggtgaatatggaggcggagccgataacttcgatggatatgaggtcagtctgtttgctgatggaaagcgcttgctgttagggaaacacttgcataactggcaagagttgaaaacgactccggtagatgtagatccgacgcaatggaaccgtatggaagtgaaactggatggagatgaactggtgattctgctgaatgactgtgaggtgttgcgtttcgaagatcgggataccggtttgcgtaatgggaaagtcgctttccgaaactggggagccgatgtatcttatcgtagtttgactatcggaagcaatactcctgtcaagctgttgaccaaagcaactccacaagtcagcgggatgtgggatgcttttgctgacctggctgccgctgctgtttacaaacaaattgcagataaaccttttcatggccggtatgcgcaggagatagagtatctggcaggaaccggtaaagtgggtattgctaaccggagcctgaatcgttggggaatatctgtacgtcagggagagaaaaagaccggcagcctttatttaaagggaaaagcagaagtccgggtagccttgcagagtgtggatggtgaaaaagaatatgctgtgcagtgcattcgggccaatgccggtgactggaagaaatatacgtttgagctaactcctgataaaaccgatgaaaatgcacgccttgctatttatctggaagagaaaggacgcattcaggtagacatggtcacccttatgaacggcgcggaccgtcagttttgcgggttgccgctgcgtaatgacatcgggcaggcaatggtggatcagggtttacgctttctccgctatggcggcaccatggtcaatgcacctgaataccgttttaagaagatgattggagaccgtgcggaaagacctccttataaaggtcattggtatacgtattctaccaacggtttcggaattgaggatttccttcatttttgtgagaaagccggatttatgcctgcttatgcagtgaatgtagaagagtcggcgcaggatatggaggatatgatcgaatacctgaacggatcggtagatacgaagtggggtaagaagcgtgcagagaacggacatcctgagccttacgggttaaaatatctggaaattggaaatgaagaagttatctggggggatattgaagccgattatcagcattatatcgatcgatttaatgatatttatgaggctgttcatgccaaagatccggaagtgcagtttattcattctgcctggtggcgtcccgaatcacctaatatggagaaagtatttaaagcacttgatggtaaagcagcctattgggattaccatccttggacggatgatcttggcagtcacgtaaatatagaccgggagttgacggatatgaaagccaaattcctgaaatggaatccgaagacaagtatgcgttgtgctattttcgaagaaaacggtaatctgcacaacgttcagcgcgccattgtgcatgctactgttcagaatgtggttcgtcgccatggtgattttattctgaccacctgtgcggccaatgctcttcaaccctatttgcaaaatgacaacggctgggatcagggacaaatttttttcactccgggacaggtttggggtatgccgactttctatgcacagcagatgtcttcggcccatcaccatccgctgcgattgtggagtgagacagtgggagaactggatatgacggccactacgaacgaggcacgcgatgaggtgattcttcatgtagtcaacacttcctctgaagtgcgggagactcaggttagtctgtccggtttcattccgaaagggaatatggaaatatatacgctgagtggagagttgaatgatgagaaccttccggatacgcctacacggattctgccgaaagctacctggaagcaggctcccggatctgattttacctattcattccccggttattcgtatacgattgttgtacttaaaaagtga

SEQ ID NO: 4734 - DNA, 1335 bp, B.fragilis
tcactaaaaagacggatgaacaagcaactgattactattttttctatcttctcaattacttgtctgggaatggtttctgcccaggagtctaaatcttttcttcctgaggtgaagaaagagtcattaaccttcagttcggaggacaataagtttaaactgactttcaatgggcgcatccaggcagacggagctatgttctttggagaagactaccagcccataggcaacggtgtcggattcaggcgtgtacgtttgggagctactgctgcttttggcaaaaggttgtccggtaagatagaaatggatcttaccgacggtggcttttcattgaaggactgtttcattaaatatgctttcccgaatgggctttattttagggccggtaattttaaagagagttttggcatggctgcaatgacctcctcgggcgatttgtggttcatggaaaaggcgaacgtggtatctgcatttgctccggaatatcatatcggtgtacagggaacctgggaacatgaccagtttctgggagtagcgggtgtacattttaaaaagatagaaggtaacaaagagaaagactattccgaaagtaataataaagcgggggaggatgaaggaatatcggttacagcccgtgctgtctggcaaccggtttcggcagataaggtaaaaggttttcatttgggaatagccgcatcttatcgtactccgaagacaacagtcggttcgctgatgccgaatactgtgagatatagtacaagatcactttcttatattaacaaaatcaagtttctggatacatcgccgattgcttctgtcagtcacgattggttggccggtgccgaactggccggattttacagaggttttcgctttcagggagagtatatcatgaacaatacggtgcgtatggaagggttggcaacagagaagttcaacggcttctatgtgcaggcggcttatcttttgttcggtgggcagcaacgatatagtaaatcgcgtggagccttctcgcagccatcgttcggacgcagttggggggatatagaattggcagcccgttttgaccgtatcgacctgaacggaacagaagtgatggggggatcgtccaacggatggacattcggagtgaattattatgctacccggaatcttaaatttcagctcaattattcatatgtagataatgataaatatgccaatgccttcggacaggcagcggtagggtataaatcgaacggagagattgcctataaacccgaggaagttgatgaatcgttgggtaaaggagggaatgcttatggtattctggggcttcgtattcaattgaatttttaa

SEQ ID NO: 4735 - DNA, 255 bp, B.fragilis
ctaagtagaagttccagaagaactttggcgatgtcgctggagaaagaacgtattgaaaaggaacatattgaagagatgaaccaagctaaactacgattctttaccaatgtgagccatgagtttcgcactcctttaactcttattataagtcaggtagagcttatgttacaaaagaatacgatacctccatctttgcataatagtattttcaggataaggaagcatgcccaacaaatgaaacttctaatttcataa

SEQ ID NO: 4736 - DNA, 3360 bp, B.fragilis
agtattatgagaaaaagcaaattacatttgctacccttatcttctaaaagggtacttgtaagtacatcgttaataatgcttttaagcggtagcgcttgggctgtttcttcacaagagacagttgaaaacggagatgcgatcacagcagtcccccaacagcgcagaacggttaaaggtattgtaaaagatgcaaatggagaaccgattatcggagccaacgtcattgtgaaaggtaataaaactattggcgtcatcacaaacctgaacggagaatttagtctcgaagtaccgtccaacgcaacactgcaaatctcttacatcggctatcttaataaagaagtcaaagtaagtggcaaccaggtgtctttcaacatccaattggaagaagacagcaaaacactcgatgaggtagtagtagttggatatggcacacagaaaaaggccaatttaacaggtgccgtatcttccgttgattttgaagaacaaactaaatcacgccccattacgacagtatcttcggcattagccggtctaagtccgggacttcaagccagttcaggctcggcaatgccgggagaagataacacaaccttacgggtacgtggtaacggcacaatgaataatgcctcacctttgattatcatagatggtatggaaggttcattgaatgctattaaccctcaggacatagaaaatatctctattctaaaagatgcagcttcctgtgctatttatggtgcccgtgctgccaatggagtcatcttagtcacaacaaaaagcggtgatcgagacaaaatacaggtaaactatagtggacgcatctctttcaacagcccgacacgcatgatcgaaacgatgagtaactatgcggattatatggaattaatgaacgaatcttgcgaaaatgttggctccggtactctttttgaccaaaagtatatcgatttatggagagagaaatcaaaagatcccaatggagtaaatgaaaacggtgttcctaattacatcgcatacccaaataccaactggctgaaagaattatactcaggaggtatgatacacgaacataacctttcagtctcaggaggatctaacaaaattcgtttcctattgtcagcccgctatcaggataatgaaggtattgtagacaatacagccaacaagacctattctgtacgtgccaatattgaagccaatccaactcaatggttgactttaggtacgcgtacttatgcttcacaaatggatcgtgaagtgggtgactttagcaatgccaatactttcctccgacaatctacagccggtacttatcccgaatggaacggaagtttcggctacccggaatgtccggacgaacgtgcaacagccaataacccactatataaactggcacggaatgatggcttcaaacgctacaaccgtttcaacacgaccctatttagcaaggtcaagttctttaaagatttaagctgggatttcaatttcaattacaaccgttacatctacgaaacccgccaatggggggtacctgcttatcagacacgtttcagtgacggggtaattgtcgatggtatcactcctccttctcaattaagcacaagtttcggttatgagtccaattactcttatacattggaaaacctgttaaactaccatcatacatttgctcagaaacacgatgtatccgcgctgttaggctatcaggaattctataagaattactatactgtagatgccgcaaagaaaggtttgatcgacgaatcactgaaccagtttgatgaagcaaccgaaatgacaagtaccaaaggtgcaacccaggattatgccacacgttctgtatttggacgcgtgaactatgcatataattcccggtatttatttgaggcaaatttccgttatgacggctcctcacgtttccacaaagatcatcgttggggattcttcccttccttatcaggtgcatggcgcatctcagaagaaagcttcatggaaaatacccgtacctggctggataacctgaaagtccgtgcatcctggggtaaattaggtaactctgaaattggtaactacgaatacatgtcggtatacagtaccaccaacgcagtatttggaaatgccttaaattctgcattgtatatgggtgccatcgccaatagcttactgaaatgggaatctaccacctctgtcaactttggtattgatgttaatttattaaagaaccgtctgagcataagtgccgacctgtatcaaaagaaaactgacggtatcttataccgcccgactattccttatgtattcggaacaatgactgccccccgtcagaacctcgccaaagtgagcaataagggagtcgagttatcactgggatggcgtgataacataggaggggtaagctactccattaacggcaacttctcatacaacaaaagcaatatcgatgcctataacggcacttatgaaagaacatgggtagaagatccgaataacaaactgaccggtggtaaatgggaagataatatcggaaaagtgtccagtggtggcacaacacccattgttgaaggccgcatgatgaacgaatactatttacggaacgtttatcatggcaatggctcttactacaatgcggatggcagcgtaaaccctcaaggaggacctaagaccggtatgatccgtacagaaaaagatatggcatgggtgaaagatatgatcgcagccggatatgaatttcaaccggggaaaacggttgctaaaaacaagatctggtatggtgattacatctatgccgactccaataataatggagtatatggcgatgataatgactatactttccaaaaaacttccaataagcctaaatacaatttcggttttcaggcctctgccgcatggaaaggattcgacctctctatggtatgggcaggagctgccggattcagcatatattggggggcaaccacaggatacaacgccgcatctactgaatggggtagtactatcgcacaacgggttgctgagaatcattatttctacaatcccgaaaatccggatgatccacgtaccaacatcaacgcaaaatatccgcgtatggcttatatagacggctatgtacaaaatcgtcatggcaatacaaccttatggctgtacaaaggtgattacattaaattgaagaacctgtctctaggctacactctaccgaaaaactgggtttcaaaaattgctatgcaaaatgcacgtatttatgtttcagctgaaaatctgctgacaattaccggatttgaaggccaagacccggaatctgctaccggtatgggctattctccgtttaggacaattgcaataggtgccaatataacattctaa

SEQ ID NO: 4737 - DNA, 2583 bp, B.fragilis
cttcacatgagaaacaaactactactattgttgctgttgatgttcatgacatccggcatgatgtatgcccaacagcaaaaaacacagcaatcccaacaacgtacggcagctccatcttatacattgaaaggcgtgcttcttgattcgttgactcaggaaggcgaaccttatgctacaattaagatcgcaaaaaagaatgctcctcaaaaagctcttaaaatggctgtaaccgatttgaatggtaaattccaggagaaactgactgttgctcccggagagtatattattaccttatcgtctgtaggtaaagtcacgatcgtgaaagactttactgtcaaagcgagtgaaaaggtgatcgatctgggaaaattaaatatggccgaggctactaacgaactgaaaggtatagaagtcgttgctcagaagccactggtaaaggtggatgtagacaaaattgaatataacatcgaagacgatcctgactcgaagaccaataccgtaatggaaatgcttcgtaaagtaccgttggtaacagtggacggcgaagataacattaaggtaaatggcagcagcagttttaaaatccatgtaaacggtaagcctaataatatgatgagcaataacccgaaagacgtgctcaagagtatgccggccaataccattaaacatattgaggtaatcacttctccgggagctaaatatgatgcagaaggtgtgggcggtatcctgaatattgtaactgtcggtggtggattcgaaggttatactgcaactttccgtgccagtggtagcaatcgtggtgccggtgccggtggatatgctactatcaaatccggaaaactgactattacaggaaattataattataactacgatacatcgcctaaaagctattcggacagttaccgtgaaaattatgattcggaagatcagaagtatctggaatcgaaaagctcttccgattataacggcagtttccagtacggcaatcttgaggccagttacgaaattgatacattacgtttgctgacagcgtcattcggtatgtacggcggtgccaatgataataagagcgacgggttgactacaatgtggaatgcccagagagaccgattggcttatcaataccgctcgttgagcgacggagatggttcctggtattctatgcgtggtaatgtcgattatcagcgtacctctaaaaagaacaaggaccgtatgatcactctctcgtacaagatcagtacacagccgcagaactctgactattatacggactataaagatatcaaagatccgtttgaaatggatatcgttaagaaattcttgctgaataactctcattcggatggcaagaccaatactaccgaacatacattccaggtggattatactactccaatcggaaaattgcatactattgaagccggagctaaatatatcatccgtaataaccttagtgataacaaactgttcgaagccgagggcgtcagtgacaactacgaatacaacaacgaccgtagtagcaagtataaacatctgaatgacattcttgccgcttatctgggatacacacttcgttataaaacattctcattcaagccgggagtacgttatgaatatacgtcacaggatgtgaagtatctggcaggagccatcggacctgaagcggatttcagtaccagttataacgactttgttccttctgtaaccatgggcatcaagatcggtaagacacagaacttgcgcggtggatacaacatgcgtatctggcgtccgggtatctggaacttgaatccttattttgacgaccgcaacccgatgtttatcagccagggtaattcgaatctggaaagtgaaaagagccactcgttcaacctgagctatagtatgttcagcatgaagtttaatgtcaatatctctctgcgccactcattcggaaacaacggtatcgaacgggtcagccgtttgattggtaagggtggtgaagagttccccggaggacatcatgctcccgaaggtgcattgtatagcacttacgaaaatatcggtaagaaccgcaatacaggtctgagcctttacggtaactggaacgcttctcccaacacccgtatctatctgaacggtgatggcagctacgttgatattaagagtccggctcagggattgcataactatggatggaatgcctctttatacggtggtatccagcacaccttcccattgaagatacgtgccagtctgaatgccggaggaagtactccttacatcagcctgcaaggtaagggatcgggatattattactatagtctgggtgtgaaccgctctttcatcaaggaccgctttacagtgagtgcctatgtaagcaatatcttcgagaagtatcgttcgtataataataccactatgggtgaaaacttcttgtcgaagagcagcagccgttatcagagccgtagctttggtatcagccttagctaccgtatcggcgagttgaaggccagtgtgaagaaagccgctcgcagtatcaataacgatgacgtgaaaggtggcggcggacaaggcggtcaaggtggtggcgctaattag

SEQ ID NO: 4738 - DNA, 2649 bp, B.fragilis
gttgcttttatgaaaataggatatcttaaaccgggtattctgcttctcgtcctgttattctctttccgtcaagatctttttgccaagaagagaatcacttcgttgaagtgtgaatacattgaagcgcctttaggactcgatgtgcagcgcccgcgtctgatgtggaaagtggacacttccgatgtgcccagtaggcaaacggcctataggattttggtctcttctaccccggaactgttgcgacaaggagaggctgatatctgggattccggcaaacagaagtcggatgagcaattggtttcttacgccgggagcacgttgcgtcctcacacccgatactggtggagggtagaagtgtggctgaataataagaaggtcgtttcggaacctgtgtggtttgaaaccggaaaattttcggcaacggattgggaagcttcctggattaccgatgggtatgataaagactacgaaccctctccgatgtttcgtaaagtgttcgatgtttccaaagaggttgcttctgcccgttgctatataagcggtttggggtattacaggctgtcctttaacgggaaggctgtcaatgatcatgcactcgatccggggtttacggattatagtaagcgggtgctttatctcacgtatgatatttccggactgctccggcatggtaaaaactgtataggggttcagttgggcaatggctggttcaatgagcaaactcctgccgtgtggtactttcatgaggcaccctggcgaaagcgcccgcaaatgattgctgagatacatctctgttatactgatggcagcaaggatatcataacgaccgatacttcatggaagacatctacagggccgctcctgtttgataatctttatgtaggctctttctatgatgcccgtctggaacagaaagggtgggatacggaactttttgatgatgtctcttggcaacatgctaaattgactgcggcacctgccccactgatcgaagcacagaagatgccttccattactacagcagatactctttctgtagtgtctgtcaactgtatcagtgatacttgctacgtgttcgatatgggtatcaacacagccggagttccccgtttggagataaaaggagaacgcggaacccggattcgtttaaggcattccgagatgcttcagaaagatgggaatatcgaccagcgtaatattgacatgcacttacgtcctcgcaacaaacgtgaaattatccagacggatgaatatgtcctgaaaggagagggggtggaaacttttattccaccattcacgtatcacggattccgctatatagaactgacctccgatcgtccccttactgttgcggacgtgaaacttcaaaccctcaggatgcatagtgatgtggctgaagtggggagtttcaaatgttccgatcagttactcaatactattttcaatatttgccgaaactcatatctgagtaatctgttcgggataccgaccgattgccccactcgtgaaaagaatggatggatggcggatggctttatggtgcaggaggcgggtatgttcaattatgacagccggaatgtatatgccaagtgggtgaaagatatgatcgatacgcaggaggcgaatggcaatgtagccggtattgccccgacttcccggaggtgggattccaactgggcggggccgctttgggatgcggccatcttcattgtgccctcttatctttatcgttataccggtgatatcgaaaccatgcgtcaggtgtatccggctgccgaacgttatctgaagtatatcgaaacgacggaagatgaacggggattgattaatcatggattgggtgactggttgttctataaggctgaaacaccagtcgatttcatggctaccggttttgtgtattgggataacctgatgatggcacagatggctgaacttaccggacgtgtagaagacagacaaaagtatctggcaaaagccgaagagcttaagaaacggattaacgatcatttttttgaccctcagactgtgtcttatgctaataaaacgcaactttcatatgccttgccgctttatcttcatattgttcccgaagcatatagggaacgtcttgccgagaatctgcataagatcatagcagccaatgactacagtcttgatttcgggtttatcggcagcgtaatggtacctgatgtattggcggagaccggttatgcggaaacggcctataggatgttgacaaaaactatattaccttcatggggatattggatcaaagaaaccggggcgacttctttgtacgaaacctgggacgtgacccgccgtatcggagatgcgtctctgaatcatccttcaatgggggctgtcagtgcctggatgtataagtatccggcaggtatacgtctttcaccggatgcaccggcttttaagaaaatattaattcagccgtgtttcctgtccgatcttgattttgtagaagccagccatgaatcgatgtatggcactatccgggttgattggagacgggaagaagggaagatccggttacatctggttctgccttcaacggctatggctactgttgttttgcccgggcagaagccgaaagctgtgaaggggggcgaacacatttttgtcattcccgaatag

SEQ ID NO: 4739 - DNA, 819 bp, B.fragilis
aagcacagtataagcgaaatcggctttgccggcacggaagaggcattagacgacatggtaaaaaaaataaaagccaaagtagacggacgtctggagaagttgagtgacaaggcaaaagcattatatctcccggcaggaaacgaggctcgtatcaaagctgcttatgacagccgtgatcctcgtttatcccaaactgtcatcactccatatgctacatatgacggttcgggaaacagtgtagaccacaccttcacttcacgctggccctactatggtgctgacaccgattatccttatgacttacgtactgacactcagagccatttatactatttgttccgcaaatttgttgctgaaggttcaagtgagatgaccaatcgtgaacaatctccgattgacctgccaattatccgctacgcaactgtcgtcataggattggcagaagcattgaatgagcagggtaaaaccgatgaggccatcgaatggctgaataaagtacgccaacgtgccggtgttgcactgttgaacagcaatactgccactatggttcagggacaggaagatatgcgcgttcgtatccagaatgaattccgctgggaaacagcaggtgaaggagttgacttttacgaagaactccgttggaaaacatggaaagaaagtaaatttaataatgctgatggtacagccgggatgaaagatgtatgggggactatcacctatccttacacatggggaggagaccaatattatgtatggccaatcccaaaacatgaaactgatatgaacaaatccctgacccagaattcgggctggaattaa

SEQ ID NO: 4740 - DNA, 1065 bp, B.fragilis
ggaggtatctttgacatcgacgggaagaaaattcaggtcgaagaagaacaattaagaacgcaggctccgggtttctgggatgaccagaagaaagccgaagcacaaatgaaactggtgaagggactgcaaaagtggattgagggatacaatgatgtcaagacactgacagacgaactggaactggctttcgatttttataaagacgaactggttaccgaacaagaagtagacgaggcctatgcaaaggcattagagcatgtcgagaatctggaattgcagaacatgcttcgtgatgaggctgaccaaatgagttgcgtactgaagattaactccggtgccggtggtacggagagtcaggattgggcatcgatgctgatgcgtatgtatctccgttatgccgagaccaatggttataaagcaaccatggccaacttgcaggaaggtgatgaagcgggtattaaaacttgtaccatacagattgaaggcgactatgcctacgggtatttgaaaggtgagaacggtgtacatcgtttggttcgtgtttccccttataatgcgcagggtaagcgtatgacttcttttgcttccgtatttgtcactccattggtggatgacagcatcgaggtaaatattttgccggcctgtatctcttgggatactttccgttcgggaggtgccggtggacagaacgttaataaggtagagtccggcgttcgtttacgctatcaatacaaggatccttataccggtgaggaagaggaaatcctgatagagaataccgaaacccgtgaccaacccaaaaatcgtgaaaatgcaatgcgtcagttgcgttctattctttacgataaagaattgcagcaccgcatggcagaacaggctaaagtggaagccggtaagaaaaaaatcgaatgggggtcacagatacgaagctatgtctttgacgaccgtcgtgtaaaagaccatcgcactaacttccagacctctgatgtaaacggagtgatggatggaaaaatagaaggatttatcaaagcctatctgatggaattttcttcggaagaagcttaa

SEQ ID NO: 4741 - DNA, 921 bp, B.fragilis
aaaagtatcatgaaaacacaagtgtttaaattagcctgtttaattatctgtttattaacgatagttcccaattgccatgccggcagcaagtggaaagccaaacatgtagttttgattgggttggacggctggggttcctacagtgtagagaaagctaatattccccatatcaaacaattaatgaatgatggttcttacacactgaccaaacgctctgtactcccttcgtccagtgcagtgaactgggcatctatgttcatgggagcaggcccggagctacacggatacacgacttggaattcaagcaccccggatcttccttcgaaagaattaagtaaagatggcatttttccaactatattccaattgctccgcgaagctgatccgaaagctgaaattggcactttctacgaatgggtcggcatcaaatatctggtggatacgctggcagtaaacaaatacaaccaagggattaactacgaaaaacatcctacggaactatgcgaaacagccgtgaagtatattaaagagaaaaagccggctttaacacttattgcctgggataatccggatcatgtgggacataaggaaggtcatgatacaccagcctattatcacaaactcgaagaaatagacggatacatcggcaaagtaatgaatgcggtgaaagaagccggaatactggatgaaacgatttttataataacatccgaccatggcggaatcaataaagggcacggaggaaagacaatgcaggagatggagactccgttcatcatctcggggaaaaatatcaagaaagggcatgaaattcaggccagcatgatgcagtttgacgtagctgctaccgtggctgccattttcaaactcaagcagccacaagtatggatcggaaggcccataatggaagtatttaagtaa

SEQ ID NO: 4742 - DNA, 408 bp, B.fragilis
agttgtttaatggtaaatcaagatgcaaaggcagcttgtatgggattgctgaatctgaactctctctgtttttatgatttaaaaggaaatctgatgaaagaaatagtgatagggaaagagttgaaattcccggagtatgaccctgagtttcttgattttccgaatgcacttaaatatttcatttctctttgtggtactcccaattatctttatgccctttataacggtttcccgggtacttcgggtgaatcaaagattatggtctttacctggcaaggtgctccggatgccatctatcagacagatgtaaaattggaaagaattgctgatgctccatccggtagatatgtattgggactgaatataacggaagaagtagggagtgatgtgctgaagtttgaactttag

SEQ ID NO: 4743 - DNA, 1545 bp, B.fragilis
agacataggatgaaacgaaccaacagaacattattcattcataatacagcaagagggagaataaaatttcttcttcttgctctatttgcttttcaaggcttacaagcacaaaagctattccccgctccttctgcgatagagacacataaaggtacattctcttatgacgaagtttcggctaagtgtgtacgaactactatctctaagtctctacctgctatcggcatagaatactcggatgaagcatatcaactggaaattacaccggattctatcttcattgatgccacttctgcgaaaggagcattttatgcccgccaagccattaaacaactggcacggcacgaacggggcaaaatccgctgttgccggatttacagttcgccacgctacgcatggcgcggatttatgctcgatgaaagccgccacttcttcggtaaagagaaagttaaacaatacctcgacttaatggctttactccatctcaatgtattccactggcatctgacagacgaaccgggatggcgaattgaaatcaaaaaataccctaagctgacgaaaataggggccgttggcaattggcatgatgcccaagcaactccgcagttctatacacaggacgatatacgagagattgtggcttatgcggccgaacgccagattatggtggttcctgagttcgatatgcccggacatgccacagcggtctgccgcgcttatcccgaagtatcgggcggaggagaaggacgctggaagcatttcacattccatccttgcaaagaagaaacttatcgttttatcagcgatgtactcgatgaaatagtagccctcttcccggctccctatatccatattggaggtgatgaagtgcactacggcaatcagaactggttcacagatcctgaaatccagaacttcataaaggaaaaagggctgatcaatgaaaccggactggagcattacttcatccgccgtgctgccgatctggtagcggccaaaggtaaaaaaatgattggttgggacgaaatagtggacgccggtatctccccctccaaagcgttggttatgtggtggcgccacgaccgtaagtaccagttgctgaaagcgcttgagcaaggctatcaggtagtcctgactccacgtcgcccgctgtatggcgatttcgtacaggatgcctcacataaagtgggacgctattgggatggattcaatccgttgcaagacatatatgccttgcccgaaccgatcagtcatctttttaaaggatacgaagatcagatactgggtatgcagttcacactttggaccgaacggattgcagacggaaaacggttggacttcatgaccttcccacgcctgatagcactggcagaatctgcgtggacatcgtccaaagagaaagactggagtcgtttctgcatgcggttaccgtctttcctggaatatctgaaggagcaaggcatctattatttcgatgtgattcacccacaagaaactcccgaaccgggcggaccggagaaagcggacgtattacaaaacggatag

SEQ ID NO: 4744 - DNA, 1215 bp, B.fragilis
aacatgaacttaaaacccttattgggagcagcctgcgcaatgatatgtgtggcttgctcaaaccacaaacccacagtaccgtcttttataacagaaaatgtagaatttgccaaagcacaactcggtttggccatcgacaccatcgaagcaagcggaaaatgtctcaatcctgtaactctcaatagagatggatctgtatattactgcggatatgccgattggcgcagtggattttttcccggtagcatctggtatctgtacgaactgacaggtgacaccagctatcttccactggccagaaaatatactgaagccattcgcccggccgagcacctgacctggcatcacgatataggattcatcattaattgcagttttggtaacggcctgaggctcgctcccgatacagcttcatataaagacgtaatggtacaggcagccaaatcactttgtacgcgtttccgccccaatgccggagtcattcaaagctgggatgtaaagggtaatagctggcaaagtgaaagaggctgggaatgtccggttatcattgacaacatgatgaacctggaacttctgttcgaagcaaccaaactgtccggtgattccactttccataaagtagcggtagcacatgccgaccgtactctttccgagcatttccgtcctgatggaagttgctatcacgtagtggactacaatatttcggacggctccgtacgccataaacaaacagcacaaggatatgctgatgaatcggtttggtcacgcgggcaggcatgggccatctacggcttcactatttgctatcgtgaaacgaaagaccgcaaatatctggatcaggcactgaaaacattcaataggatgaaaaatgatccgcacatgcccgaagatctgataccttactgggacatggacgcacccaatatacccgatgaaccccgggacgtctcttccgcatcctgcatcgcttctgccctgtacgagatcagcacatatgacgtccccgatgccgcttcttacagggaatatgcagaccgcatcatgcatagtctcgcatcacctgactatcgggccgcattgggcactaacggcaattttatcctgatgcatagcgtaggcagtattccgcataatagtgaaatcgacgtacctctgaactatgcagactactactttcttgaagccctgaagcgtagaaaagatttagataaataa

SEQ ID NO: 4745 - DNA, 1425 bp, B.fragilis
  unsure (1175): Identity of nucleotide sequences at the above locations are unknown.
ttgcttgactttcggaaattcgatcagaactatatccaattaaaactatcggaacaaagtctgaatacatttttagaagaagtctatctttctttttctgcttatgcctctcagaagtccatttcttaccatctgaagctgttggagcaggatatatctatttggatagatgactggcaaatgcgaaaagttttgtttaatttgctttcgaacgcatttaaacatgttccggataaaggagaaataagcatattaacctctaccacaccggatcaggttgttattgcagttaaggattccgggaatggcattagtaaagaagaacaggaacggatatttgatcgtttttatcaggcggacaatcggaataaagcgattcatgttggcactggtatcggacttgcattaacgaaaagtatcattcagctacatcatggtacaattgaggtagaaagtgagttaaatgaaggaagctgttttattgtgaagttacctaaaacccgtgattgttttgaaaaggatactgaagtcgtttttctggaatctccggaaaaggaacctatggtacaagagaataccataccggatgagaattttatgaaaaaggatgattctacattcgaaactcccttgatagatgaacgggaagggaaacggaaagtattattggtagaagataatgtggagcttttgcaggtactcaaagaaatattttcatcactttatcaggtggtgacggctgctaatggcgaggagggactgaaacaggcttttgcagaagttcccgatttgatagtgagtgatgttatgatgccggtaatgacaggaacggagatgtgtctgaaaataaagaataacataaacctgtgtcacattccggttgtgttgttgacagcacttgacactgtagatcaaaatatagaagggctacgccgtggagcagacgattatatcaccaagcctttcaatgcaaaaatcttaataacccgttgcaataatttgattcgtaaccgcttgttgatgcaaagccgttttgccaaagatcagattttagaaatcaacctgttggcagctaatccaatagataaaggtttcttggatagagtgattaaggtggtagataaacatattgataatgaggattttgatattgggtatgtatgtcaggaacttgnaatggggcgaacattgttgcacaccaattttaaagcattgacagggatgacacccaatgaatttattctaaatcaccggttgaaaatagcatcgctgatgttaaagaacgaaccttatttacaggtagcagaaatatccgatagattaggtttcggttctccacgctatttcagccgttgttttaaaaatcaatataacgttactccgatggaatatcgcaaaggagctaaacaggaaaatcttaaatga

SEQ ID NO: 4746 - DNA, 1113 bp, B.fragilis
aagattcaagtattatttgtacatttgcatccattcaaagcaaaaaaagaaatgatagacgaatccattacatccgaagctgtcggcttgctgaaatctcttatcagcatcccttcgctcagccgcgaagaagaaaaagcagccgactatctgcaaaattatatcgaggccgaaggcatgaccacgggccgtaaaggaaacaatatctggtgcctgagccctatgttcgacctgaaaaagccgacaatcctgctcaactcccatattgacactgtaaagccggtcaacggttggcggaaagatccgttcactccacgcgaagagaatggaaaactttatggattgggcagcaatgatgccggtgccagtgtagtaacactcctacaggtgtttctgcaactatgccgcaagcaacaaagttataaccttatttatctggcttcctgcgaagaagaggtatccggaaaaggcggtatcgaaagtgtattaccgggacttccccccatcagttttgccgtagtaggagaacccaccgaaatgcaacctgccattgccgaaaaaggcctgatggtgctcgatgtcacagctaccggaaaagcaggacacgccgcccgcaatgaaggtgacaatgcgatatataaagtactggacgatattgcctggttccgcgactaccgctttgcaaaagaatcaccattactgggacctgtcaaaatgagtgttacggtgatcaatgccggtacgcagcacaatgtcattcccgaccgttgcagttttgtagtagatgtgcgtagcaacgaactgtactctaacgaagagttgtttactgaaatacaaaagcatatctcttgtaaagctgaagcccgttcgttccgcctcaactcttcacgtatcgaagaaagccacccgtttgtacagaaagcaaagaaactgggacgcgtgcctttcggctctcctactctctcggatcaagctttaatggtgttcccctcagtcaagataggccccggccgttcttcacgttcgcatacggccgatgaatatatcatgattaaagaaatagaagaggcattggaattgtatttgaagatactggacggactggaaatctga

SEQ ID NO: 4747 - DNA, 513 bp, B.fragilis
gtgactatgtccattgatttttttatagcaaagtgtcagacagagaacatcgttgataaggaatttggcatttgcgatgatgaagacgaagaaaaaaagacccctgcttatgtagataggaatcaaccggataaatgggttgctgtggtaaagaaccaaacgaatcaatctatcaactttacagcagtcgataattgcgtagagatgaatcgaagtgacggaacaatggactttcgttgtgatgccatgttaaccaatgatgacaatattgttttcgttgaactgaaagtacaagcagccgattggatctttcatgcggtggacgaacaattacaaactaccattgatcatttcaaggctaaccacgatttatcgagatataaatataagcgtgcatttgtatgtaataaaaggcatcctaactttagggtcagctataaggacaaaatgacatcattttcgatgaaaaacggtattcgtttgaatctggttagagaaattatttttaagtaa

SEQ ID NO: 4748 - DNA, 897 bp, B.fragilis
cttcttcctacttctttttgtatctcttttcactcccttcataatcactgcccctttcctctccataacaccttttttcttttttctactgcacttctcccaccttttccacattataacattttcctctttttcataaaaattttctttactttccccttcttttcttttccccccttcactcttctaccatctcttttcctttttctccgtttttccttcatttctttctccttatcctttttcctcctttttttcctttccttccctcatccccctctccctttattgcttttatctcttttttctcttcttattccaactcctctcttcttttcccatttattcctcttttcttctctctcctttctttctatttcctttcctctcattctttccttcctatcatcttacttcctcttttctttcccccttcttatcactttctcttcagaaactctcctccttttccttctcctttttctttctttcctctctctccttaccttttttttccactctcacccctctcctcccttccttttccatctttgccttttctacccgtctctttttctttccttaccttctccttcttctccctctcttattccttcactctattcccctctgctctgtccccctcctcctccttcctcctcctcctatttcacccctattcctctcctccttttatctttccttttccatatcttccatcctcctttttcttcctccttaactttcccctccctttcccctttccttattctccatcttttcctcttattctctccccttccacttcttttttgttatctcccctcttctttccccttctcttctttcccatataattactctctctttcttctctctcactctccactatctttc

SEQ ID NO: 4749 - DNA, 210 bp, B.fragilis
gagacgtatacactattgctgaaaagatataaatctgatgatgtagaaggggaatatcaaaattatatcgtttctgctgtaatacagataaaaagcaataaaattcttctttttacagactcgtacttttctttctccggatcaactaggacggtagaagtgagaaatggctggtttctttggcgaagaaccgctcttttgagtcggtag

SEQ ID NO: 4750 - DNA, 1218 bp, B.fragilis
gacgtatctgctgtcggaactttccgaagaaagatcggcgggctttgggctgctgtgaatattgtcttgcccgatctgactgcaggaagtactgagggagttatcgactttgccggagtaacttccggcatgctgactcacgatggaggacaggatacggataatataatagccgttcgggtaaaagcaaatgaccgttggagtgatgccggtatgtataccatccggactgtgaaacctgtctttaaagtgggttattatccgggcaatgtttggacgaaagagtttactttgaacacactcactgccgatagcgtgaaaaccggcaatttagataagtttaccgatattgcttacgaatttagtgccgatggtaatagttgggaggcgatgcccggagatttgcgaaaggcagggctgagtccgggaacctcttattatgtgagagcgaagtataggggagaagtgccgggagagaaagtggaggtgaaaacgtatgaggcgctatccatacccaattctgattttaatgctggatatgatgttacatatcccaagagtgagaatccattatacacatttaaaggcgattggattggtacgcgaaatcctttgacctgtcatactgatggagctaacgcattctatgtatctaaatcaagtacgcttccggtagttgatggtgagcgtaatgttgctcatatgatgacattagggtggggagcaggaaacacttgttctttcggtaataaagattattggcttggaaatagtgttattaatcatatcagtgcgggtatcgtttgcgtaggagattatgaggctgctggagatgtagttaatggtaaagcggcttatattcgtccaacgtctatgagttttgtgtacaaagctgctccatataaagatgatgagtatttgattgaagcctatttggaaaatattacaggagaagtagaaaccataattggcaaagcttatttgaaatccggtactgcatattcatcctatcaaactcaaaccttgaattttgagtataataatgaacatagaaacttaccgatctctcatgtgaagattatatttaaggccggtactaaagaagatcgtgatcacttggaagataagtttagggatgcaaaagttccatatggtgatgcttatatcataggttcacagttctggctcgattcattcactttacattacgacaaataa

SEQ ID NO: 4751 - DNA, 741 bp, B.fragilis
tgcttatatcataggttcacagttctggctcgattcattcactttacattacgacaaataaatatgaaaacctatatatacctctttctcctcttgcttgctacggcttcctgtagcgagcaaactgctcccgatcattccgtcggttatctccgtgtagaaaatatcatcctcagttgtgataccgaaacgctgcccattactcgtgccgtcgatgccggacttaagcttgagatctggcaaggttctgagtgtgtacgtagttatgatccgggagcagcggaactttccaaaaggatcgttcttccggttggtgaatataccctgaaggcctttactcccgatcagaccgaggcgccggacaatgaatcgggtacacccatctacagcgtcgactatcctttcgctattgtatcggaggatgttactctgatttcggtgaaagcgccccaaattaatatcggggttggcgttgagtattcggatgaatttatggcaaactttacagacttctccgttaccgtaagtagtcctacaggacgtcaggcaagcctggcaggtaatgtgacagaccttttatattttaatgtcccgaccggtggaacccatttaagttatacgcttaccgccaccaatgccgatggagaaacaatgacttccgaagcgcgttccatccttcaggaatcgggagcggaacttacttccggaaattataaagtccggatcggcctggttcagtaa

SEQ ID NO: 4752 - DNA, 600 bp, B.fragilis
ttctgcaagcatatacgtattccttatattctatttttaagcaaagtaatattcattttattcatcttattccattttttcgtatatttgcttcgaacggaacattttaacggaaatcgttgttcaaaaagcaaaaagaacatggaaacagaagaagaaatacagaatgtaaatgtccatcacggacataacataaggcgcacccggatcgagaaaaacatcaagcaggacgcattggcagcactcgtaaacatgacacaaccgaatgtatccaaatacgagaagatgcgggtgattgaggatgaaatgctaaatagattcgcaagggcactgaatgtgccggtagaatatctgaaaacgctggaagaggatgcaccttctgtagtatttgagaatatcacaaataatgtgcatgacaataaagacagctcagtgcccattacgggttataaaggacaagatgccaccaccaacagctttaatccgattgataaaatcaccgaactctacgagcgtcttctcgaagagaaagatgaaaaatatgccgcgcttgaaaaacggattcaaggtctggaacagcaaaataacagcggaaagtaa

SEQ ID NO: 4753 - DNA, 258 bp, B.fragilis
gagatatttaaaaaagaagtaagcaaattaggaaaatgtaaccgtctttcaaggcaaatgcttacttgttttgaggtaaatgcttacttgttttccggaaaagcaaggctctaccgactcaaaagagcggttcttcgccaaagaaaccagccatttctcacttctaccgtcctagttgatccggagaaagaaaagtacgagtctgtaaaaagaagaattttattgctttttatctgtattacagcagaaacgatataa

SEQ ID NO: 4754 - DNA, 735 bp, B.fragilis
  unsure (81),(211),(277),(388),(511),(522),(601),(607): Identity of nucleotide sequences at the above locations are unknown.
agactagtcgaagtcgagaaccaggccttacctgccatcatcgatgataagaatcacacggtattggtgtatgtctcgcanaaacaggatttgtctgctgtcaagataacaaagatgattctgggaggcagtaaggctaccatcactcccgatccgtccactgtaaccaatttcaggagaccgcaagagtttgttgtcaaccgtttcgatnaagaagagctatggacggtcgatgtggtacgtaccacatcgacaggtaccacgggaagtgccgatntgtgggctacaagagccacattgaacgggggtatgaagcaaggaaccactccccgtgtggaatacaggaagaagtcggaagatacctggaccgttgtacccgaaacagatntgaaactggaaagtggtacaactttcagtacgacacttaccggattgcaagatggtaccgattacgtttggcgggtagtggtcgaggaagttcctagtacggaatctggatttactaccgaanagatacagganatacctaacttaaacttcgatacctggtcgcagaatcccacaggaacctttaagaagagttggtatcctaatgccgatngctcanattctttctgggcaaccggaaatgatggagtgacctcttcactggcgggcagccgtgattcgagtacccgccccggaagaaaagagcgttgtgaacggaaaggcggcttatatggtcactttatgtag

SEQ ID NO: 4755 - DNA, 552 bp, B.fragilis
cctcttcactggcgggcagccgtgattcgagtacccgccccggaagaaaagagcgttgtgaacggaaaggcggcttatatggtcactttatgtagtgtgccgcttgtaggggtggctgccggcaatctgtttatcggtgattataaaacgaatgcccaaagtcccaaggatagccccaagtttggacgttcgtttacgggggcacgtcccaccggattgaaggggtggtataaatatacttctaaaccggtggattatgtcggtaatccggataatctgaaaaatgatgaatgccatatctatctccgtctgtgggacgataaagataacgagatcggttacggagagttcatcggaaaagagacggtgacccaatatactcagttccggttcgatgtgacttataccaataaaacggcgaagcctgccaagataacgattgttgccacttcgagccattatggcggtgactttaccgggatgaaggtgaccggttcggtaggtgtaggcagtgaactgtgggtcgatgaatttgaattattgtatgaataa

SEQ ID NO: 4756 - DNA, 990 bp, B.fragilis
ataagaaagagagctatgcataaatctgttttatctttagtgtgttgtttgttctttttcctgtcgtgtcaggaagaaatagaaacgatgcctaacggcagtttgaatatcgtattgacggatgaagcggcggttacccggactttgccggaggctttgtcagatgaattgcggcaacagttcacgattgagttgctgcgtgacagagaagggacaatcgtgcccgaatacaaaggtgcattgagagatttcggagatcaaagggtattcaaggtaggcagttatcaactgaaggcttatcttggagagaatccgtcactggcattggatgcaccctattattatggagaagttcaagacattgccatcgagaagggtaaagcaacgacggttactgtcggctgtaaggtagccaatgcgctggctacttttgagattgtgaatcaagaggtctttgataaacgtctgaaagattattatgtggaagtcagcgcagggggggagtcggttacttggaaaccgggagacgccacacatccctactttaaagccggaggccgggtgacaatggcattgatcggtacttctgtagagacagggcaggagggaagttatgctttgaatccgatcgagacagtgaaagcgggtgttaagtataattataagctctccatgaaggcttccaatgtaagtctagaggtcactacggaaactcaacaggaacctattactatcaacgaaaccgtacccgacagctggttgccgaaggctaaggtatttagtgaggatttcgatgaaaatcatgtgttgacttataccgagacggcagatgctttgtcgagagccggcattgcgtatacagctttgcgtccggttcaggatgtggagtttgcctttaactttgcggataagcatttggaacatctgaataagacgtatctgctgtcggaactttccgaagaaagatcggcgggctttgggctgctgtga

SEQ ID NO: 4757 - DNA, 198 bp, B.fragilis
aagagtgaaggggggaaaagaaaagaaggggaaagtaaagaaaatttttatgaaaaagaggaaaatgttataatgtggaaaaggtgggagaagtgcagtagaaaaaagaaaaaaggtgttatggagaggaaaggggcagtgattatgaagggagtgaaaagagatacaaaaagaagtaggaagaagttaaaagggtga

SEQ ID NO: 4758 - DNA, 402 bp, B.fragilis
ggaatacgtatatgcttgcagaatcaactgttttacgcttattttacagctattgaaataacaacaatactattacacactatgatcggactactgacaactaaagaacttgatttcctcaccaaactggctgaacttttaaaagaatacagtgccataatatcttacggtcattgtagcgaactgcgtattcttgtttgtgctggtgacagcgaagatgtggaaaaatatcccattatatttgaggacagctttgatgaaaatgagatttatgatctgttgcgcaaaaacagaaaacggatcgaggagattatcgaacgtgaggtagctgaggctgttcccgaaggagaactatctcagccggacgatcaggccggatcaatggcagaccattttcactaa

SEQ ID NO: 4759 - DNA, 1269 bp, B.fragilis
tgtatttttgtagtatatttgaatgtaaatatcaataggggtttatttatgaatgaaacagttaatcttactgtatatcagtttggacctatatccgaggcggatgtcgtgttcgacaaatatacggttttgataggaaaacagggatcgggaaaaagtaccattgccaaattatactccatgtttacgtggttggagaaggggctggcacgccgtatcaccagtgaaaaatacattacccaatattcacgattccagaaaatatattgtgcctatcaccgtttggaatcatactttaagagagaaacggttatccgtttttatggattacattataacttcttctatgaaaatgaaaagtttcatgtcgaagccaaaggacttccggagtcttataaggtagcgaaggtaatgtatgttccagctgaacgaaattttttgagtacagccgatgatacggatggattgaaaagtctgccggaatctttagaaaccctgcttgaagagtttgataaggctaaggaggcattcaaaaccggatatcggcttccattcaatgacactgattttgaatatgacgcactcaataagatatcgtggattaaaggcagcgattacaagattcgtttgtcggcagcttccagtggttatcagtctgttttacctctttctttaattaccagattcctatccgacctagtgctggacaatgccaataaagaggacctgagcattaaagagaagaagcagattgaaaaggaagtgaataaagttatgaatgataaatcacttacggatggggtaaagttcgctatgttgcgcaatatctcatcccggttcaaatattcctgctttgtgaacattgttgaagagatggaactgaatctctatccggagtcacagcgaagtgtacttttcgatttattaagttatgccaataagatagagttgaaccgccttgtgcttactacgcatagtccttatgtcatcaattatctcactttagccgcaaaagcttttttgctgactcaaaaagtatctgcaaatgaaactttgcaagagagaataaaagaggtagttcctgcggacagtacgatagatccggcgcgactccggatttacgaactgaaagacggaggagtatttaggttaagtacttacgagggcttgccttctgacgagaactttttgaatatccaattgggagtgactaatgaattgttcgatcagttacttgaaatagaacaagagtttgattataaaaactaa

SEQ ID NO: 4760 - DNA, 2046 bp, B.fragilis
ttttccgttccccaccagcctatggtgatgtacgaccgtcagaatataacccgccaggctcaacatcagggatatccggtgactatggagaagaaccccgatggtacttggaccgaggcagccgtatatatcggatgggcaggttttgtagaaggaacttcctggcaaaaggacaataaactggatgtacgcaatacgacgaccttaacgtatacacctataaaacagcaattgatcttcaaaggtgactttacttattacagcagcaagtctactcggctaagagccgagaaccagtacaattactatacgggaccggaaataatgggaactcgtaatacattcagttctctggaaaatatggattataacagggaatatatatcaagcaatattactggtaactatattcctaaattttctaattccgatcattacctaaatgtactgttgggctggaatcttgagcaccaggattataaaacgatacaaacttatcgccgtggtctgattagtgccactaagccgagttttgctcttatggatggtgattattatactacgggacaaggcggaaatgagtgggcttatgtgggtttcctctatcgtttgaactataattataagagtcgttacctggcagaagtaagtggacgttatgatgcctcttccaagtttcccgagaatcaacagtggggattcttcccttccggatcactgggctggcgtatttctgaggagccttttatgaaatctacccgcaattggctggataacctgaaggtccgtgcttccgtcggtagcctaggcaacggtaatgtaagtccttacctctatctttctacaattcccattaagaaaacctctgttattctgggggatgcattgcagacgtatgccactactccgaatatcgttcccaacagtctgacttgggagaaatcgacaacttatgatattgggctggatgttgatatgctgtctaaccgtttgtcgatggtgttcgactactatcaacgctatacaacggatatgtatacagtaggtcctactttacctgccgtactgggagccgctacgcctaagggtaacaatgcagagatgaaaaccaagggctgggaactttcggtcatgtggcgtgacaactttacactggctaataagccatttaattacagtgtaaaagctatgttgtgggataaccgtacttgggttactaaattcaataatcctacgaaactactctccacttattatgagggacaggagatcggtactatctggggatatcatatcgaaggattatttaaagatcaggctgaaatagatgctcatgcagaccagtccaaactaaaagtatccgctacgaatattctgaaaccgggtgatttgaaatttgccgatctcgataagagcggtacggtggataatggtcagaatacattggatgatcacggtgacctgaaggttatcggaaacactacgcctcgctatcagttcggtctcaatttgagtgccaactggaatggtattggcatctgtgctttctttcagggtgtaggcaagcgaaactggtatccgcatcgcgagtcagctttcttctgggggcaatatgaccgtccttacagctatatgctgaaggagcataccggaaataatgtatggacagaagaaaaccaaaacactgatgcttattggccccgctaccgcggctatctggcgaatggttctacaaaggcgctgggtatccaggccaatgaccgctatttacagaatatagcttatgtccgtttgaagaatcttcagatagattatacttttaataagaagttttgcgataaactgcacttgcaggatttgaagatttaccttgctggtgagaatctgttgacatggacaccgctgaacaagcataccaaaatgtatgaccccgaaggtatcagtgccggtgatgcagatttccgttctactgccaatactgatggagacggatatggttatcctattttgagcagttatacaatcggtattaatgtaaccttttaa

SEQ ID NO: 4761 - DNA, 573 bp, B.fragilis
  unsure (140),(188): Identity of nucleotide sequences at the above locations are unknown.
gattatcaagctcaggctgccattgcacggctgaccaggaatgcggcattccgctataaggcctatcttgaacagattgactatgccacaaacagggggctggagcgcaatcagatggaacgcctcgccacccttgattntgtgcataaaggacagaacctttttatcacaggttcttcaggaacggngaaaagctatctggcttgtgcgcttggtcacgaggcatgcaagaagggattccgcactttatatgccaatgccccaaaactgcttggcgcactgaaagtggccaaggtcaaaggtacacaggaaacagaactcaagaagatcgagcgctgtcagttgctcattcttgacgacttgttccttgtacctcttgatgccaaggaacgtcccatactgctcgaaattattgaagacaggcatgaacgaaaatccatcatcataacttcgcagtatccatcgttcaattggtatgacatggtaggtgacccgacaatagcagatgccatccttgaccgcatcattcacacggctcataccatagaattatacggtgaaagcatgcgttag

SEQ ID NO: 4762 - DNA, 267 bp, B.fragilis
tgtaaccttttaacacagaagatgagtatgaaaaaatattggttgataggtctgtatgctttggctctgacctcttgtgatagttttttgaattgtgagcccgagaacagtttttcttccgaaggctttctggagtcgcaatcggatttacggctttatacaaatggttttttacaaagtttcctgcccagcgaagaaacaatagcttggggtggcgaccagtatgcgtcttcaccacggggctggaaggatcagcgcggtgcaaaa

SEQ ID NO: 4763 - DNA, 393 bp, B.fragilis
tctcattcgcgtacaaggagcatggaaaggaaagtgtccgcggtacaggtcggcggatcgttgggtagaagccattatgtgaacggtaagttcatagcaagtaacctgggtatcatacttacaccgacaaataatcccgaataccccataaacgtgcggttctatagcatgtattcaaatgccataagaaagcagattgttaacgagcttgcgaacggaacatccaagctcaccattccggtaaatgacctgatgaactattatgtggagtattttcacataagcaaacagaacgggctggttgaatattgcaataaggcgattgttactttacaacagaaattggataaagaaaaagataattttaataaaagaatcaacagtttgctatag

SEQ ID NO: 4764 - DNA, 624 bp, B.fragilis; identical to SEQ ID NO: 3062

SEQ ID NO: 4765 - DNA, 240 bp, B.fragilis
gatgaaccgggcacttgggccaaaaaagggaagggggggggggggggcaaagttggacaggaaagctttttgacatcctccaaatcccccatactggatttctgcaaatggatggaggaacatcccggaacaggcaatcctttcaaggggaccggccgctctgcaattaccgcacggatgaattacaactcctcatataccgatatcatgctttacaacaatatggcttgtactgcctga

SEQ ID NO: 4766 - DNA, 279 bp, B.fragilis
aaagacaatatgacagaacaggaagtcagaagatatctacggaaaatgagcgagcaggactcccagtctgctttccgagaattctatgatatgacgtacgaccgcctgttccgcattgcttactactatacccatcacgaagaatggtcacaaaagatcgtactcgatgttttcatgaaactttgggaactggaaaagccactttactttgccccttttgggcaaataggatttaccacccttggccgcgatatgattgaccctttaaaatcctggtga

SEQ ID NO: 4767 - DNA, 471 bp, B.fragilis
agacagaagatggtatcgttagtaatggtttgcagtggaccgatggctggtatacagcttatttgtaaggtcaagaggcgccctccgggaggtatcaataatgtatttaagtattctaccgactggtataatgaattggtaagacgcgatgccgatccttcactggataaagtgcgtgtcaatgataagggggaatatgaatactttggtaatactaactggctggatatcatttataaagatcagaactattccactgaacataatgtcagcattagtgggggaaatgaacgtgcccggtattatgtgtcaggacgttactacaatcaggatggcatttacaatgccggagacgaaaagtatacgcagtataatatccgttcaaaaggagaaatacaaatcaataaatctcttttgttggagaataatacggaatgtcatgattttccgttccccaccagcctatggtga

SEQ ID NO: 4768 - DNA, 900 bp, B.fragilis
ctcccatctttgcgcctcgaaaggattcttaatttattttatcaattgaacagtatgaaagtgaaaagatgttttttagaatggagtttggtaagcaggcgttttgccgttgcccttacctttgtattagagggagggatgttgcttgctgctaatctaattccagtgaaaggtgtagtaaaagacacctcaggagaaccgctggccggcgttacggtgagaatcaaagacggaaagtcgggaacaatcactgatgtgaacgggtattttgtcttggatgtagaaaaaggaaaaaaactgttgttgagctatatcggatattcagaaacagaagtactggtaaaagatgatcagcaaatgcagatcgtacttaaggaagatgtgcaacagttgcaggaagtggtggtcgtaggttacggtacggcaaagaaagtaaatttggtgggtgctgtggaccagattgatagcaagcggattgcagagcgcagcaacagtaacatttcccgttcgttgcaaggcatggtaccgggactgaacattacattcagtgacggtaaaccttcgcgtacgccatccatcaatcttcgtggaacaggaagtattggtgcgggtggtagtgcccttgtgttgataaacggagtggagggtgatctcaactcggtgaatccagcggatgtggaaagtgtatctgtattgaaggacgcttcttctgctgctatctatggtgcacgtggtgctttctgcgtgatattggtaactactaagaacgctactgccggaaagacgaaaatcaattataacggaagtttctccatgcatcagcgtacggtgaagacagaagatggtatcgttagtaatggtttgcagtggaccgatggctggtatacagcttatttgtaa

SEQ ID NO: 4769 - DNA, 1803 bp, B.fragilis
gcggcgatgactttctgtagtatgcttgtattctgctccttccctacattggcaggggaggcagaggcaagagtggtgttgaacatgaataccggttgggcttttcatcggggagaagttgaaagcggtgggcagcccggtttggatgattccggttggatagcagctaccatccctcatattatgcaattagagaagaagcattgtggaggagatattatttatgatggagtcgggtggtatcgacgtactttcagagtaccgtcacaatacaaagacaaacaaataaaaatttcgtttgaaggagtcatgaatgcttgtgaagtctatttgaacggacagaagattagtgctcatcggggaggttatgtcggttttgtaacagatattactactcggataaactgggaccgggacaatctgctggcagttcgggtttctgccgaatatgatccacttacacctcctggaaaaccacaggcaggtatggacttctattactatagcgggatttatagagatgtggaaatggttatcagtgatccgttacatatcactcatgctttagaagaggaagaggtagctggaggaggcatctttgttacttatccggtagtcggaaaagaaaaagccgtgacccatgttaaggctcatgtcagaaacgaagggaaacgaaagaggaaagcccaacttcgtacgcaattgatagataagagtggaaaaatagtggcctgtcaattgactccttttcggttgtcagccggtgaggccattcatctggagcaaaatctggaaatagtacatccatcgttatggcatccctatgatccaaacttgtatacgttgcaaaatgagattgttgaaaacggtaaggttgtagattgtcatactgaatccataggtatacgtactattgcttatacccgcgacggaggtttctatattaatggcgaatcactttatctgcgtggagccaatcgccatcaagcatttgcacatataggagatgcagctgctaattctatgcaagaaagagatgtgatcgatttgaagcggggcggatgcaatgccgtcagagcagctcattatccgcaggatcctgcatttttggctgcttgtgataagtacgggttgctggtagtggagtgtatccccggatggcagtatttcaagaacgattctacattcatttcccgtctttatgaagttgggaagcaaatgattcgtcgggataggaatcacccttccgtcatactatgggaaacagcgcttaatgaaagccgctatccggcagagatagcccggaatctatatgctatagcacataccgaatatcccggagatcagatgtacactgccggcgactactttggacatgcagaccgggtagactgtttcgatgttttttataaacaggtatcccgttttccaaaagacggtgatgtgatgagtaattatccggaggaccagatcgcagtgaaacctttgttttgtcgtgagtggggtgacggagtaggagaaaaacctagggtaagcctgatggaaaatgaagaagagcaattgaaacagtgcagagggcgttttttgcaacttaacgggcatggatatttcgactggtgcatgcttgatgctaatcccagaatgggaggacattttttgtggagttataatgattatgcacgtggagcagatcatgaaaccatgttttgtgggatagtcgatataaacagaattcccaggtgcaggtactatatgatgcagagcatttttcgtcaagaaatatccctccccgcgaatatataa

SEQ ID NO: 4770 - DNA, 1125 bp, B.fragilis
aatgtgggatcagggagtcgctccctggaaagtgtggtaagccgtatgggaattgatatatttgataatttttatcggggcaaacgtgtccttgtcaccggtcatacgggttttaaaggtagctggctctccatctggttgcatgaattgggggccgaggtgattggtgtggctcaagacccttttacggctcgagacaatttcgtactttccggtatcggcgagaaaattaaggccgaccttcgtgccgatatccgcgatggtgagcgtataaaggctatctttcaggaatatcaacctgagattgtttttcatcttgctgcccaacctctggttcgcttgagttatgacatccctgttgaaacctacgaaaccaatgtaatgggaacaatccatgttcttgaggcagtccgttctacggatagcgtgaaggtaggtgtgatgattaccacagataaatgttacgagaataaggagcaaatctggggctatcgtgaaaacgagcctatgggcggttatgacccttattccagtagcaagggagccgctgagattgctattgcttcatggcgtcgctctttctttcaccccgagcaatacgataaacacggaaaatccatcgccagtgtaagagctggtaacgttatcggtggtggagactgggctttagaccgtatcattccggactgcatcaaggctttggaatcgggacggacaatcgatatccgcagcccgaaggctgtccgtccctggcagcatgtgcttgaaccgttgagcggttatatgctgctcgcacaaaagatgtggagtgatcctacgagatactgtgaaggctggaacttcggtccgagagccgagtcaatctctactgtatgggatgtggctacgaaagtagtgaataattacggttccggtgaacttcgtgacctttctgatccgcatgcgttgcatgaagcgaagttgttgatgctggatatttcgaaggcaaaattccgtttaggttgggaaccgaagatgaatattgagcagacggttgagttgacggtggactggtataaaagataccgggaagaagaggtatatgatgtttgtgttgaacagatagttaattttatacagaaataa

SEQ ID NO: 4771 - DNA, 894 bp, B.fragilis
ttatttaaaacaataactatgaagtatttgataaccggcggatgcggttttatagggagcaatcttgcagccgaggtgctgaagagaggtgaagaactctttgtcttggacaatttatttcgttatgggagtggttccaatcttgagtggttacgtacgaaaggtgactttacatattatccttatgacacccgcaataccaacgatgtcgaaacggtaataaaggaggtacagccggattatatttttcatttggcgggtcaggttgcgatgaccacctccatctccaatccccggttggactacgaaacaaacgctttggggacattcaatttactggatgctgtccgtaagtattctccggattctgtgatcctgtattcttcgacgaataaggtttacggtgattttgagtatttgcatttcagggaagagtctacccgttatgtttgcgaagaataccctaatggctttcctgaatcgatttctttggattttcactctccttacggttgttcaaagggttgtgccgaccaatacctgctggacttccatcgtatctatggcttaaagacgattgttttccgccattcttccatgtacggcagtaatcagcacgctacctacgatcagggatggattggctggttctgtcagaaagctctggagatcaagaatcatactttgcaaaaaccttttacaatctcgggtaccggtaaacaggtccgtgatgttcttcatggtgaggatgttgtgaatttgtattttacagcaaaggacattgacaaagcttatggcgaggtgtttaatattggaggtggtatagaaaacagtctttctttgtcttcaccacggggctgcaatgagcgctgccattggggaatggggggtcga

SEQ ID NO: 4772 - DNA, 921 bp, B.fragilis
ttaattttatacagaaataagatggaaacagtatttctgattggagggagtggctttatcggcaagaacctggcacaatacctgtctcaaaaatatcatgtgcatgtatttgataagtatatcgatcagcccttctttacatcttatccctccattgaaacaacggaactggatttggtaagtcaacggattccacaggatatgccatcacctgattatatcataaatcttgcttcggtggtgacagcggagcggaacatgtccttgtttgatgaactgatttcgtccaacttgaagattcttctcaatctgtatgaacgtttcaaagaagaatcctcgttgaaactttttattcagttcggcagttctgaagagtatggttctgaacaatccccctttcgggaggaagaccgtgagtgccctaactctccgtatgccttggtcaagcaattgacaaccaatacctccatgatgctgtatcggaattatggctttccgataatggttgtccgccccggtaatttgtttggcccgcttcagaataaggataaattcatcccctatgttgtcggacaactgagatccgggcttcctttgaatgtttccccctgtgaacagaaaagagattttatttatgtggatgacttctcttgtgcaatagaatcccttttacagaactatttcaaatgtcttggggagattgtgaacgtgagtagcggagaaagtatttctttgaaacagattatcgagcattgtaaagcatctcttcattcgtcatcggatgtgaattacggtgctttaccctatcgggagaatgaagctatggatcttaaatgctccatagctaaactatcatcaataacaggatgcaatatccattttgataacgaaaaaagactaactgattatttaaaacaataa

SEQ ID NO: 4773 - DNA, 261 bp, B.fragilis
  unsure (33),(71): Identity of nucleotide sequences at the above locations are unknown.
gagacaaaatattcattcggccggggtgccacngtcacctcttttcatatcgcaagcggtcgggggcaaanaaagacatatctgtggggtcgatttcgaccacaagacattacattcgatccgatacggggagaccaacaattagcataccccccgatccgttttattgggacgcgtacctctgatacaaccccggccgacaaaaaggcacatcatacgcgtcgagtcaatgcaacaatcgagttacttgatcgagcttag

SEQ ID NO: 4774 - DNA, 246 bp, B.fragilis
gtcagcaggaaacgttcgttcccgagatatttctgtacacgccggatacgcccgcccgtttgggtgttcagcccggtatcaaccatcgagactttccagcactcggaatggttgttcacaatggtggtcgtattgctggaaaggcacaccgccatttcggtgttattgcggaaaaaagttggcgaaacactccttgatgaaaaatggggtctggccgcgacattctccaaaaggggggggtggtga

SEQ ID NO: 4775 - DNA, 210 bp, B.fragilis
  unsure (56): Identity of nucleotide sequences at the above locations are unknown.
cccactttcttttttggagcgggctggataaccgaagaaagacgaggggtgggacncaccgccgatgtaataaacaatcgctctttgatttttttcccgatcgatggaatgttgtattggatttcgggaatctgcctcccgtccccatccaagagagagattgggggttttgttgctaagctcgatcaagtaactcgattgttgcattga

SEQ ID NO: 4776 - DNA, 858 bp, B.fragilis
  unsure (11),(50): Identity of nucleotide sequences at the above locations are unknown.
ttcttcggggngggaagcccaccaccaaagaggtcgcccaaaatcattgnctgtcccgagaagcgaaataagggaaaaaaggcccccccccgtgttacttcaactcggccccccccccaaaatatgtggtggtgggttataaaaaccaccaaaaagttttctttcggtgaaaacaccttctcgtgctcacattttttcaaaaaagcaattcaccaccccccccttttggagaatgtcgcggccagaccccatttttcatcaaggagtgtttcgccaacttttttccgcaataacaccgaaatggcggtgtgcctttccagcaatacgaccaccattgtgaacaaccattccgagtgctggaaagtctcgatggttgataccgggctgaacacccaaacgggcgggcgtatccggcgtgtacagaaatatctcgggaacgaacgtttcctgctgacctatggtgacggtgtcaccgacctgaacatcggtgataccctgaaggctcacgagtcttcggactgcctcctttcccttacggcctacaaacccggtggtaagttcggcgccctgcagctcgatctcgatacggacaaggtcctctctttccaggagaagcccgacggggaccgtaactggatcaatgcgggctattttgtgtgtgaacccgaagtgttcgattatatccctgagggtgactccaccatctttgagcggcaacccctcgagtctatagccaaggcgggccggatgcatgctttccgtcatacgggtttctggaaaccgatggatactctgagagacaatacagaattgaatgaaatgtgggatcagggagtcgctccctggaaagtgtggtaa

SEQ ID NO: 4777 - DNA, 2538 bp, B.fragilis
  unsure (1253),(1893): Identity of nucleotide sequences at the above locations are unknown.
tgcagacagccaatccgctttcgacaattaatccgtcggatatcgaatctattgagatctttgaaagatgcctctgccacagccatctatggatcgcgtggcgcaaatggtgtggtattgattactaccaaacgtggtgcaaaaggaaaagataatatcagcttcagtgctaatttcggaatatcgaaagtagtgaagaaattggatatgttggatggatatgcatatgcgatgtataggaatgaagcagcgcagatgtttaatgaatacgagaatgcgaatgaagcaattccatatccgggtacttccaaagtagatcccagtaccggtgaatctgtttattctcctggaccggaggactatcggaatggtacatatcctagcgtaaattggcaggatgaagtatttgaaacagcattttcccaggaatacaatctgagcgtgaacggttcgaatgataaaggatattatgcaatctccggtaatattttggatcagagtggtatcattcataactccggatacaaacgttattcattccgtgcgaacttggctcgtaaagtacatgaatggattgaaataggtacgaatatgagttttaccaattcgctgaataaacttgctaaaacgaattctgtcagtgacggtattattcgtggtgctttattttatccggctaccgctccgctggatgatgaaacgaataatgctcagttgaactggttctcttctaatccttatgtatatacacgtgctgctaaagatgaactgacaacgaacagtttcttttcttcttcatttgtagagatcactccgtacaaagatttgaaggttcgtcagaatgttggtttctcctacaatatcaatgaacgtgatgtgtattacaacagggaaacagtagaaggtaaagatccgacaaacggatatgcttccaaggcagataactggtcgaaaaacctggtacttgaaacgatggcaacttataataagacctttaataggaatcattcgctaaatgtagtcgcagctttctcttatgaaagaggggattatggtaataaggcaatggtagctaccggatttccgcaagacttgacagaagattttgatatgagtgctgctgtgaatcctcagaaaccgactagcgggcgaggaatgacttctttggtttcctttttgggacgtgccaactataatctgatgaataaatatctgtttactgcctctttccgccgagatggttccagtaagtntgcgcctggtaataaatggtcgaactttgcttcaggggctattgcctggagagcatcagaagaacagtttattaaagatctgaatgtgtttagtaacctgaaattccgtgcaagttatggacaaacaggtaatcaggcgattggggcatatgctacccgtgactatctgactgtggccaattatccaattaatggtgcacttgccagtggatttgccaatctgacttggagaggaccggccaatccggacctgaagtgggaaactaccagccagtataatgtaggagtggatatgggtttcttccagaatagaattaatctgactattgatctgtattataagaaaacatctgatttgttacagaatatacagataccccaaagtacaggtttttcaaatatgacgacaaattttggtaacgtaaccaataaaggacttgaaattacgggaaaattttatgcaatcaccggaaagaatctcaattgggactttgatgctaatatttcttttaatcgtaataaaatcagtggtcttccgggcgatcagtttgctcaaggatggagtaaggctgataatgtgttcttacagcgtaacggaatgccgatcggaaccatttatggatttgtggaagacggcttntatgataatatagttgaggtgagagctgatccgttctatgcgaaagagtcggaggctgtatgtaaagcaatggtaggtgaggtaaaatataaggattttgatggggtagccggtattacgaatgccgatcgtcaggtaattggtgaaacgaatccggactttacgtttggtatgactcacaattttacttataagaatttctctttgagttttttcctgcaaggctgtgtcggaggtgatatttttaatgcaaacttgcttgaagtgactatgagtggtattggtaatattcctcagaatatatatgaatcccgttggacacccgaaaatcgggagaatgccaaatggccgaaagcttatgccggctatgggagaacaatgaagttgtccgaccgctatgtagaagatggatcttatctgagaatgaagaacattaatctgggctataagtttatttctccattcaaaggaatcgaatctatcaatctgtttgcttccgttagtaatgtatttaccatttcgggatatagttggtatgatccggatgtaaattctttcggaagtgatgcttcccgtcgtggtgtagacttattctcatatccaagcagtcgcaccttctcatttggtttacaatgtacattctga

SEQ ID NO: 4778 - DNA, 795 bp, B.fragilis
  unsure (21),(40),(45): Identity of nucleotide sequences at the above locations are unknown.
atgacgcccatcgcacccctnccaatgataccatggaacntgcanaacatgatgatgcttctgatggcactcttaatgagtggccatatgatggctcagcaaaccattgttacaggtgtaattaccgatgctaacgatggatcttcattgatcggagccaatgttctggttaaaggtgccggaaccggttctattgccaatgtggacggtaagtatagtgttaacgtcccaaatggtaagaatgtattggtcttttcgtgtgtaggttataaagaacatgagatcactttaaaacccggacaaaaagtgctcaatgtgatcatgaaagaggatactgaactactggatgaagtagtagttataggctatggctctatgaagaagagtgacttgactggttcggtcaccagcatcaaaagtgaagatttaatgaaaacaaacccgattagtattaatcagggactccaagggcgtattgcaggtgtgcaggttaaccagaatgatggtgctcccggagccggggtaagtattcagattcgtggtgctaattcattctccacctctaccgaaccgctttatatcgtggatggtattccttttaccagtagtggaatgccgggaacaggcaaagacggtatgatgcagacagccaatccgctttcgacaattaatccgtcggatatcgaatctattgagatctttgaaagatgcctctgccacagccatctatggatcgcgtggcgcaaatggtgtggtattgattactaccaaacgtggtgcaaaaggaaaagataa

SEQ ID NO: 4779 - DNA, 1260 bp, B.fragilis
caaaagtcatctacatcaccctgtgccctcaagggagagtctctacttgcccagcagatagctcttgaaatcagcaaactccttcgtcatcggcaaacttttcttttcgcctttcataaaagcccggagcttagcaggtatttcgacctcggtaccaatgatgctctccaccgtttgcaggaatttggccggatgggccgtttcgaggaatacgcctgtctcacccggctgcaagccttcctccaatgcacggtaaccgcatgctccatgaggatcgagcagataacccgtctgctgccagcacgctttcacgctttcacgaatctgctcgtcggtgtacgtcgttccggatatctcggcagcgatggctgcatgcgaaccgccatacaggtcgagcacacgggcaaagttgctcggatcacccacatccatcgcattggcaatggtggcaacggacggacggggattgtactgtcctgtctgcaaatattgatagaaaatatcattcttattgttggcggcgataaaacggcggacgggcaagcccatctttttgccgaacaagcctgcagtaatgttaccaaagtttccgctcggcacacagatgacgacattctctgcccggccggccttcttcaattgcgcataggcataaaaataatagaatgcctgcggcaggaaacgtgccacgttgatagagttagccgaggtcagcaacaactgttcgttcagttcctgatccataaaggctgctttcaccagcgcctggcagtcatcaaacgttccgtccacctccagggctgtaatattccgccccagcgtagtgaactgtttttcctgtatctcgctgacttttcccttcggatagagcacatacacatgaataccctctacccccaaaaagccattggctaccgcactaccggtatctccggaagtggcaacgagcacattcacctgtttccgcccctctttccggatgaagtatcccaacaaacgggccataaaccgtccacctacatctttaaaagccaatgtaggaccgtggaaaagctccagggaatagatgttctccttcaccggcaccaacgggacatcaaaattcaacgtatcataaacgatctctttcagcgtttccgccggaacatcttctccaaagaaagcatctgccacccggtaagcgatttcccggaaagaaagattctctatctcgtcataaaactcttgaggcaagggcttgatggtcatgggcatgaatag

SEQ ID NO: 4780 - DNA, 813 bp, B.fragilis
gtggctactccgcctaccgtaacttcatcaagcaactcttcacgttttactcccatcacatccatcgacatttggcaagcaataaactccaccccgttctccagagcctgctgccgcagggattccagtgagtcgatgcctttccggtgcatgatgtatcgcatcatctttccacccatacctcccatgctcattttagaaagtttcagtttcagcgaactggatgggagcattgtaccaaacatcttgccgaaaatgtctttctccactttgggcttatgcaatttcttaatcacattcagcccccagaaagtaaagaagatagttaccttttgtccggtggcagctgcgccgttggccaggacgaaagtggcaagtgccttgtccaagtcgtcactgaacataatcagagttttacctttgctgtcacatgtcgtagtcaggttacaagcctggggttcgcctttctcaatgactactaccgatttccctccggtactatccttggagataaatttatttccggtagagttgcaccatgcggcagcatcccgcgagaatcccgggtctgtagccacaatttcaactctctcgcccggaacaagcgtatccattgttttcttcatctttaggaccgggcccggacattgtaatccgcaggcatccacccggattgtcttaggatttgcagccgttgtagtttggggtgcctcagctgtcacagaaggtttcgccgggctgtcttgcgcagaaggcgtgtcgtctgtttcttcattttcgtgcaagatgatgggagcggtagcagcacgatag

SEQ ID NO: 4781 - DNA, 966 bp, B.fragilis
aaaaataaccctcgtatgatgaagaataagaaagtggaggccaatctgagtatggtggtttccaaaacctttagcggattgaacatgaatgcgttgaaatatctgcttcccgtatgggtcagtcccctttcgggagttaccctccggtgcgtgtttgccgccattgctttctggatcatcgggatgtttgtcaagcccgaaatttccacccggaaagaaaaaatattcctttttctcctgggagccttgggcatctatggtttcatgtttctttatctgatggggttgagtaaaacgactccggtctcgagttccattttcaccagtttgcagcctatctgggtgtttgtgatcgccgtggtcttcttcaaggagaagatcagtgcgatgaagatagccggtatctccctcggactcggcggagccattctttgcattctggctcagaagagtgacgatctggcttcggacgccctgacaggcaatatgctctgcctgttgagttcgatcgcctatgctgtctatctggtggcaagtaaccgaatactgaagtcggtcggaatgtttacagtattgaagtatacctttgccggagcggctttttcaagcatcgtcgtttcggctgtcaccggtttccatgctccggtattttccgggccgttacactggtttccgctgtcggtgctcctctttgtcctgatattccctacggttgtcagctacctgttggtaccgatcggactgaaatatctgaagactaccgtggtggccatctatgggtatttgatactgatcgtggcaaccatcgtctctctactcgtaggacaggaccgcttcagctggtcgcagaccattgccatcggcatgatctgcgtcagtgtctatctggtcgaagtggccgagacgaaggagaaaccagtcagtaattcagataaaccaagtagtctccctccgcatggatcgtaa

SEQ ID NO: 4782 - DNA, 939 bp, B.fragilis
ttattaaatacgtatgcaattatgcctttaaatttacccgataagcttcctgcgatagaactattaaaagaggagaatatctttgtgatagataactcccgcgcaacacaacaagacatccgtccgctacgaattgttatcctcaacctgatgccgttgaagattacgacagaaacagacttggtgcgtttactctcaaacactccgcttcaggtggaaatttcttttatgaagattaaaagccacacctcgaagaatacaccgatagagcacatgaaaacattttataccgacttcgacaagatgagagaagacaggtatgacggtatgattatcactggtgcaccggtagagcaaatggattttgaggaagtgaactattgggatgaaataacggagatattcgactgggcacgtacccatgtcacctccacactctatatttgttgggcagcacaggcgggactgtatcatcattacggtatccccaagtatgctttggataagaaaatgttcggcattttcaagcatcgcacgctgcttccgctgcatcccatcttccgtggcttcgatgatgaattctatgtgccccatagccggcatacggaagtgcgaaaggaagatatactgaaagtaccggaattgacattactttccgagtcggatgattcgggggtatatatggtggtagcccgtggcggacgtgagttttttgttaccgggcactccgagtactctccactgacactggatacggaatatcgccgggatgtttcgaaagggcttcccatcgagattccccgtaactattacgtgaatgatgatccggacaaaggaccgctggtgcgttggcgcggacatgccaacctgttgttctccaattggctgaactatttcgtctatcaggagactccttataatattgaagatatccgatga

SEQ ID NO: 4783 - DNA, 336 bp, B.fragilis
tcgctgaataccaaccccattccttgttgtgcttttatagaagacagtattttttctaccttctcattattaaaatccaaagaaactttttgtgaccatgccgaaacagtgaagccaaataaaagaactcctaagagcaacagcattttcgttctggttcttgttttcatttcatacagtattaaattaattatttttatagtttataaaaaggcctttctatataagctaacacaccatcgaaaagaaggtatgagtgctatttttatttttctgcaaaaaaagatgcagggaaatgataggtcttgcccttatgtagttgtacatgccttctaa

SEQ ID NO: 4784 - DNA, 444 bp, B.fragilis
ccggattggttgccgacttggggtggggcaggacagggagcacgtaaatactttaattttaagagtcatgaaacggctcaccactttgaggcaggagtggcttatactgtgcagtccgaaacatttcctttgtctgttgcatggtataccatgtttgcagggcaagataagaatgcggagggaggccagaattattcgtcttatgttgaattcaactatcccttcagagtgagaatggtggatttaaacgtaacgtgtggaatggttccttatgccgctccccaatacaattgtgatgggtttgccgtaaccaatgttgctttgaaaggaactactcagatcaggttcactgataagtttgctttgcctgtatttgcacaggctgtttggaatccccgtatggaagatgcgcatttagtgtttggtattactttaaagccatga

SEQ ID NO: 4785 - DNA, 261 bp, B.fragilis
aatcttaaaacaataacggttatggagaaatatcttattcacagtaatgagctgcacctgatcgatcaagaaagaatccaccaggcagtagagcagatggtagagtcattggatatggccgccggatctacattcagttttgacctttacaaagtggtggaaacctatttcaaggatctggataaacggagagagataaaccatctgttaggcatcacagacaacacgtatgatcctacagaagatttcggagtgtgttaa

SEQ ID NO: 4786 - DNA, 1929 bp, B.fragilis
ttgcatgaaactattaagatgctacgcataaaaagattagatatttttataataaagagttttttattactctttgtcggtacatttttcatctgcctcttcatcttcatgatgcagtttttgtggaagtatgtagacgaattggtgggaaaagggttggagatgagtgtactggctcaattcttcttttattctgcgttgagtctggtaccgatgtcactacccttggcagtgttgttggcttctttgataacgtttggtaattttggtgaacgttttgagttgcttgccatgaaagcggcggggatttcattacttaaaatcatgcgcccgcttattgttctcgtctttgccatttgttgtgtatccttttatttccagaacgtcatcggtccgcaggcgcaagccaagttgggaaccctgcttatttcgatgaagcagaaatctcctgaagttgatattcccgaaggagttttctatgatgaaatagatggttataacctgaaagtacaaaggaaagaccgtaaaacgggtatgctttatgatgtgatcatttatgatttctccaacaactttgataatgctcgcattatagttgctgattcgggacgtttggaaatgaccgctgataaacagcatctctacttgcatctgtacagcggcgagatgtttgagaatctgaaagcacagagcatgagttcgaagaatgttccttaccgtcgtgagtctttccgggaaaagcattcgattattcagttcgactcagattttaatatggctgatgccagcatcatgagcaatcagtccactaccaaagatatgataaaaatacaggcatctatcgattctatgaccgtattggccgatagtatcggaagacagtattttgttgaagcaagtaagggaccctatcgtacagcagtcggattgacgaaagaagataccttgaaaatgcaggaagcgcagattcgtgactataatgtagatagtctgtttgaggctgctacgttgatgaataagcagaagattatagcatcagctgttgggcgtacagagaatctgtcgagtgactggggatttaagagctttacgatgacccagaatgacttcagtataaggaaacataaaatagaatggcaccggaagatcacgatttctctatcctgtcttttattctttttcattggtgcacctttgggagggattattcgtaaaggtggattgggaatgcctgttattgtttccgtacttacctttattatttactatataatagacaacacgggttataaaatggcccgtgatggaaagtggattgtgtggatggggatgtggatgagttctgccattctggctccgcttggatatttcctgacttataaatcgaataaagactccgttgtattgaatacggatgtatatatctcttggttcaaaagagtgtttggggtacgtagtgtccgacatctgtccaagaaggaagttattattcatgatccggattatcaacgtcttccgttcgatttgaatggcctttcagaggagtgtagggcttatatgcaaaagaaccgattggccaaggcacccaattattttagcctgtggatgtccggcgggcaagatcaggaaattatcgctataaacaaccgtatggaagcattggttgatgagatgtctaatacccgttcactgatactacttcagaagttggaaaaatatccgattatccctgtaaatgcgcatgtgcgcccattccataattattggcttaatatggcaataggaattgtgattcctattggtctgttcttttatttccggatttgggcttttcgtatacgtctgaataaagacatggagcggattatcgcattgaaccgggatgtggaattgacaataaaagatattaataacgaaaacaagatataa

SEQ ID NO: 4787 - DNA, 186 bp, B.fragilis
tggttttctgctacaacgcaaatgatcggactgctgaaaaataaaattccgaatggcatgtcttttgaacttttattcatgactcagcgcccgataatcttccctaccccttttctgatcgctcagaagcggtttttaacgggtaaggaatcatctgaacaggcaagtgccaccttttcattttga

SEQ ID NO: 4788 - DNA, 225 bp, B.fragilis
aaactctatttttgtacctacaaattagtactaataattaaaatatcaaacaaaatggcttacgtaattagtgaagattgtattgcttgcggaacttgtattgacgagtgtccggttggcgctatctctgaaggtgatatttactcaattgatcctgagcagtgtacagattgtggtacttgcgcagatgtatgtccttctgaagcaattcacccagctgaataa

SEQ ID NO: 4789 - DNA, 204 bp, B.fragilis
aacatagaagctgacatcttatttttcataactttattatcctgctattcttataaacttaaatgttcggcgattgtactcaacgcatgtacagggaagaaagacaaagctgcaacaatgaaaatgacggcaaaagtcattactgcaaaagtcacagtatccgttttcaaggtaccggcactctcgggaataaactttttttga

SEQ ID NO: 4790 - DNA, 1296 bp, B.fragilis; identical to SEQ ID NO: 845

SEQ ID NO: 4791 - DNA, 2604 bp, B.fragilis
ttgaattattattctatagatagatgcagaccctgttcaggagctgcatctatttttttagataagctcttatatggaaactcatactttctttcggatggggtgttagcttatgtagtaaaagggcctttaagaatatttaatttcaagtatgaaccggatatctatacacaagagatatcacagcaaatatgtgtttatatgaaatatctgtttacacttttgatggcctgtctgtcattgtcaactacttacggtacggtacatcatccatcttcttctgtttcgtccggacgatgggtggtttgggcggagaaacctgccacatcatggcaggatgcatttgtcaccggcaatggtcgccacgggacgatggtgatggggcaaccgggatcggaacgaataatctgtgtccacgaggaattgtttataagaggatgggatcgtcataaagtagcggttccttcaacagcttcgcttcttccggaagtgcgccggttgatagaatccgggagaagcgatgcagcagatgagttgatgaccggtgaagctgaccggcaattggttgctatgggagccgtacagcgctggcctcttataccccatccagcttttgatctgtgcattcggtataccgataccactctacaggcagagaatggctatagaagacaacttgatctggaaacgggtgagacttccgccttttggggtggaagaggaggagtgacggaatctgtattctcatccagagagcataatgtcaatgtgctccgtctgaaagcaaccggacaaagaaagataaatttagtgttggggcttaaggagactccgggacgtgaaggagttcattttgagcataatctggatagtgctttctcatcggtgagtacagaagtattttcaggatggttatcttaccgtgccgcttacaaatatgatgccggtggttatgagggattggcccgagtgtctcttaaagggggaagtatgattaccgaaggtgattctttgagaatagcagacgctgacgaggtactcgttcttgtgagaattactccgttggagaatgcaaatttgtcggtacgcccttccgtgcaaagggagttgtcacgtttaccgctcgattataatactctgttgttacctcacagtcggaaacatgccgaaatgtttcgccgcatgcaattggatttaggctgttcttccgattggaaaacgacttcgacagagaaaatgctttccgatattcataagcatggggttactcctttgtttcttgagcagattcatgctatgggacgttatttgcttatttcttcatccggcaagtatcctcctcctttacagggaatctggggaggaggatggaaacccggatggatcggtggctttgtatgggattcaaatatcaacttggccgtctcggcagcatctatgggcaatttgcatgaatgtgcggaatcttatattggttatgtggagagtctgcttcccggatggagactgaacgcgcgaaattatctggggtgcagaggctttattgttgcccattataatgatccggaaagtggatatctcacccatttcggacggtcttttccctggatgtgctggcccggtggtgccggctggaatatacgtcctttttatgagtatgccatgctgaccggtaatgaggcttttcttaagaaacatgtgttcccgctatacagggaaatggccgacttctatgaagactacttgactatggatggtgatagcttatatcacatttgccccagtgtttctcccgagaatgctcctccggggactgacacctggttgagcaaagatgctacaatggatgttgctattgctaaagaagtgttccgtttgcttcttgagatggggcgtacatttcgtgctgacaaaaaagaattggctaaatggaataattacctgcaacggttgccttcctaccggattaatgacgaaggagccttggccgaatggattgatgaagcttatcaggacgtatataatcacagacatctttcgcatctctatccggtttttcccggttcgcagttgggtaagtcggagggagatcctcgtcttatacatgcagcacgtatcgcattaaacaaacgttttgctttcgataccggttctgcccatggattaattcatgtggctcttcaggcagtgcgtctgggcgatatagataaggtaaaaacaaatctggaccgtttcagtcgtcgtcattatttatatgacggattggtcacttcacatgatccggaacatcaagtatacaatttggatgcagtcttgagcatcccacgcctgctaatggagatgctggtttataccgagaagggaaaaatagaacttttgccggcctggccttgtgattatgccgatggttctataaaaggtataaaaatctatggaggacatactttggacattacctggaaagcgggaaaattgatagaagctgttttgtatgcacggcaaaatgaacggtacgaggtggtttgtggggatgttagaaggcatgtacaactacataagggcaagacctatcatttccctgcatctttttttgcagaaaaataa

SEQ ID NO: 4792 - DNA, 651 bp, B.fragilis
cctaaacattataaagatatgaagagattaattcccatcttattggcggtctttgcattcgcagcctgcgaaaaagaccctgacatggacaaattggacaatgactatttggtttacaccaactacgacaagaaagctgacttcaaacaattcagcacgtactacatccctgacagcgttctcgtcatcggagataaaaaagatccggaatactggaaaggtgaagcagcagaagctatcatcaatgcgtacaaagaaaacctgaatagcaaaggttttacatatacagacaataaagatgctgccgacctgggtatacaggtaagttacgttcaaagtacttattacttcaccgattacggacaacctgagtggtggtggaactatcccggatactgggatgcaccttactggggtaattggggcggctggtattatccgtatgttgtaaactatagcattacaaccaactcattccttactgagattatgaacctgaaagctcctgagggtgaaaaacaaaaactccccgttttgtggagcagcttcctgagcggacctgcaagctattccggtaaagtgaaccaaactctggttgttcgcgcaatcaatcagtcgtttgcacagtcaccctatctcactaacaaataa

SEQ ID NO: 4793 - DNA, 1170 bp, B.fragilis
cgatactgttacgggttatgcagtataaaaattgaagaaaagatggatagagaagaaagtgtacagcatttcctcgacttgataaaaaaatcccgtcgtggcaagtttaaggtttatatcggtatgattgccggtgtaggcaaatcgtaccggatgctccaggaagcacatgatctgattgataacggggtggatgtccggatcggatatattgagacacatggtcgtgccgggacggaagccctgttgaaaggtttacctgttatccggcgcaggaaactgttttataaggggaaagagctcgaggagatggatctggaagcgattatccgtattcatcccgaaattgtaattgtagacgaactggcacataccaatgtggaaggaagcttgaatgagaaacgttggcaagatgtgatgacactgcttgatgaagggattaacgtgatttcggcagtcaacattcagcacatcgagagtgtgaatgaagaggtgcaagatatcgcaggtattgaagtgaaggagcgtattcccgatagcgttcttcaagaggctgatgaggtcgtaaatattgatcttacggccgaagaactgataaccagacttaaagctggaaagatatataagccggaaaaaatacagactgcactcaataatttctttaagaccgagaatatcctgcaactccgtgaacttgcactgaaggaggttgccttgcgagtggaaaagaaagtagagaatgaggttgtgatgggtattggtttgggagttcgtcatgaaaagtttatggcgtgcatcagtagccaagagaagacgccccgccgtattataaggaaagtagcccgtttggctacccgatataatacctcgtttgtcgctctttacgtacaagttcccaaagaaagcatggaacgtatcgatttggctagccagagacatctgctgaatcattttaagttggtgactgagttgggtggggaagtcgtccaggtacagtcgaaagatatattatgcagcattgtgcaggtttgtaaggagaaacagatatccactgtttgcatgggttccccaggccttcgcctgccgggagcattgtgtagcgtgctgaaatatcgcagaattttaaataatctggcacaagcgaacgtagatttgattatacttgcataa

SEQ ID NO: 4794 - DNA, 576 bp, B.fragilis
gccatgaactatctcgaaatcacaggtgcccttgtcgggctgatttacctttggctggaataccgggcaagcatttatctctggatagcgggcatcatcatgccggccatctatatatttgtatactaccaagcaggattgtatgccgacttcggcatcaatatctactatctgctcgcggccgcctacggctggatggtctggatgcggggaagcgaaaaagagacccgggccgagctgcccatcacgcacacacccttgaaaagatacctccccctattgctggtattcctggcggccttcttcggcatcgcctggatactgatccggtttacggacagcaacgtcccctggctcgactcgttcaccacggcgctgagcatcatcggcatgtggatgctggcacgcaagtacgtcgaacagtggtgggcatggatcgtggtcgacgtggtatgttgcggactctacatctataaagagctttatttcacatccgctctttacggactttactcaataatcgctatctttggctactttaaatggaaacaaatgatgcattatgaaagtaaatga

SEQ ID NO: 4795 - DNA, 195 bp, B.fragilis
aaaaatgatttagtcttagttatccattatgaatataaaaaccaaactactttttggcattggaatattggccggaatgaatattttactggttacactttccagtgtaaacctttagattttaaccggcacggaaacctgatagttccggtgccctgcctggttttgagcgggcgcctctatggatctccgtaa

SEQ ID NO: 4796 - DNA, 189 bp, B.fragilis
ctatatatacaaaagaggctgttatatcacatgacagcctcttcctttttaaaagcaatacatagtatgcttgcctttcatttgacaactttatcaatcactatttatctaaataaaggccaattggaatcttctatatgggcttctttcataatcgctttcaattcatccgctttctcgggatattga

SEQ ID NO: 4797 - DNA, 1593 bp, B.fragilis
accatgatacaagaataccaactccgcatcctccccgaaattgccgccagcgagcagcaactcaaagcatacctttcacaggagaaaggactgaatcagcgcgatattaccgccctgcgtacactgaaacggagtatcgatgcccgccaacgcacgatctacgtcaatctcaaagttcgggtatacctgaacgaaatgcctaaggacgatgagtacgaacatactatatataataatgtggaaagaaaaccgcaggttattgtggtaggtgcaggccccggaggactgtttgccgcattacggctgatagaactggggctgcgtcctgtcgtcgtggagcgtggcaagaatgtgcgcgaacgtaagaaagacctggcacagatcagccgggagcatcgggtagacccagaatcgaactacagtttcggtgaaggaggagccggtgcatactcggacggaaagctgtatacccgaagcaagaagcgcgggaatgtggacaagatactcaatgtattctgccaacatggtgcttctacggccattctggtagacgcccatccgcatatcggcacggacaagctgccacgggtgatagagaatatgcgcaatacgattattgaatgtggaggcgaagtacacttcaagacacggatggatgcattgatcatcgaacagggagaagtgaaaggaatagagacgaatacgggcgaaacattcctcggtccggtcatcctggcaacaggtcattcggcaagagatgtatatcgctggctggccgccaacaacgtgactatcgaagccaaaggaatagccgtcggagtgcgtctggaacatcctgcaggattgatagaccaaatacaataccacaaccggagcggaagaggtaaatacctgccggctgccgaatacagtttcgtcacacaagtggacggccgcggagtatacagtttctgcatgtgtcccgggggattcatcgtaccggcggccagcggtcccgaacaggtggtagtcaacggaatgtcgccatccaatcgcggatcccggtggagtaactcgggaatggtagtggagatacaaccggaagacatcatcaacgataaacggttaacggtaaacaatgaagcagaagaaaccttccccgaactggctgtgctgcacttccaggaagagttggaacgccagtgttggttgcaaggaggcagacgccaaacggcacccgcacaacgcatggtggactttacacgcaagaaactgagttacgacttgccggagtcttcgtacagccccggattgatatcctctcccttgcatttctggatgccggaattcattgccggacgactgtcacaaggcttccaacagttcgggcgcagcagccacggtttcctgaccaacgaagccgtgatgataggggtagaaacccgtacctcttctccggtccgcatcgtacgagacaaggataccctgcaacacatcaccttacgcggtctcttcccctgtggcgaaggagccggttatgcgggcggcatcgtctcggcgggaatcgatggagaacgatgcgcagaagcagtagcacaatttatgaatccatag

SEQ ID NO: 4798 - DNA, 252 bp, B.fragilis; identical to SEQ ID NO: 860

SEQ ID NO: 4799 - DNA, 1248 bp, B.fragilis
cattatgagcattgcaaacgtataaaaaagaagcttatgaaacacatcatcatactgggtgacggaatggccgactgggctgtaaagtcgttgggagacaagacgctcctgcaatatgcaaaaacgccttatatggataaactggcccgtatgggacggaacggacggttgataaccgtagccgacgggttccatccgggaagtgaagtagccaatatgtcggtcctgggatacaatcttccgaaagtatacgaagggcgcggaccactcgaggctgccagcatcggtgtcgatttgcagccgggcgagatggcaatgcgttgcaatctgatttgtacggaaggagatatcctgaagaatcattcggcagggcatatcacaacagaagaggcggatgtgttgattcaataccttcaggagaaactgggggacgaccgggtgaggtttcataccggggtgcaataccgccatctgctggtggtgaaaggcggaaacaagcaactcgactgcacccctccgcacgatgtgcctttgaagcctttccgtccgctgatggtgaaacctttggtaccggaggccgaagagactgctagcctgctcaatgaactgatcctgaagtctcaggaactgctgaaagatcatccgctgaacctgaagcggatggctgaggggaaagaccctgccaacagcatctggccgtggagcccgggttaccgtccgcaaatggaacgtctgtccgacaccttcccgcaagtgaagaggggagctgtcatctcggccgtcgatctgatcaacggcatcggatattatgccgggctacgccgtattgcggtagaaggggcaacggggctgtacgataccaattacgagaataaagtggccgccgcactggaggccctgaaaacggacgactttgtctatctgcacattgaagccagtgacgaagccggtcatgagggtgatgtggcgctgaaactgaaaacgattgaaaacctggatagccgtgccgtaggtcctatctacgaggctgtgaaggagtgggaagagccggtagcgattgccgtattacccgatcatcctactccctgtgaactgcgtacgcataccaacgagccggtcccgttttttatctggtatccgggtatcgagccggacagcgtgcagaccttcgatgaagttgcagcagtggagggcagttacggattgctgaaagaggatgaatttattaaagagtttatgaaccgttaa

SEQ ID NO: 4800 - DNA, 2064 bp, B.fragilis
caggataataaagttatgaaaaataagatgtcagcttctatgtttcaaaaggagcaagtaatagaaagtatcaggcagtcgtttgtgaagttgaatccgcgaatgatgataaagaacccgattatgtttacggtagaagtggttaccgttattatgctggtggtaacgttactctctctcttcactccggaatatggtactttcggatataatttgtgtgtgttcttaattttgtttgtgaccttgttgtttgccaattttgctgaagcaatagccgaagcccgtggtaaagcacaagccgacagcttacgcaaaacgcgtgaagagactcctgctaaactggtaataggagacaaggttcagaccgtaagtagttctaaactgaaaaagggggatgtttttgtttgtgaagccggtgatacgatccctgccgatggagagattattgaaggattggcttccattgacgaaagtgccattaccggtgaatctgctccggtgatccgtgaggcgggtggagataaaagctctgtgaccggtggtaccaaagtgctttcagatcatatcaaggtattggtcacacagcaaccgggcgaaagctttcttgacaaaatgattgcgttggtcgaaggcgcaagcaggcagaagacgccgaacgagatagccctgaccattttgttggcaggctttacactggtctttgtcatcgtatgtgttactctgatcccgtttgctgactataccagtcttgaacatccgggaacagctatctcgattgcagccatcctctctctgtttgtctgtttgattccgactactatcggaggattactttctgccatcggtattgccggtatggatcgtgcattgcgtgccaatgtgattacaaagtcgggtaaagcggtggagacggcaggagatatcgatacactgttgcttgataaaaccggtactattacgattggtaaccgcagggcaacgaaattccattcggcacctggagtcggtccgcgggagtttgtaacaacctgtctgttggcttcgctttcggacgagacgcccgagggtaaatctattgtagagttaggacgtgaatcgggggtacggatgcggagtcttcagacggccggtgcccggatgattcagtttacggctgaaaccaaatgttcgggtgttgatctggccgatggcacacagatacgtaaaggagcgttcgatgcgatccgtaagattacggaagcagccgggaataaattcccgaaagaaatagaagaagtgatcagtgagatctctggtaatggaggtacaccgctggtagtgtgtgtcgaccggaaggtgaccggggttatcgagttgcaggatattataaaaccgggcattcaggaacgttttgaacgtctgcgcaagatgggagtgaagacagtgatggtaaccggtgacaatcctttgaccgccaagtacattgccgaaaaggcgggagtggacgactttatagctgaggcaaagcctgaagacaagatggaatacatccgtaaagaacaacagtccggtaagttggtggcgatgatgggagacggaacgaatgatgctcctgcattggcgcaggcaaatgtcggtgtggcaatgaatagcggtacgcaggcagccaaggaggccggcaatatggtcgacctcgataatgacccaactaaattgatagagattgtggaaatcggaaagcagttgctgatgactcgtggaaccctgactactttctctattgccaacgatgtggcaaaatactttgccattgtacctgctttgtttatggtggccattccagagttgggtgcactcaatattatgaatctgcatagtccggaaagtgctatactctctgctgtcatattcaatgccatcattatcccgatcctgataccattggcgctgaaaggagtacaatataaaccgatcggtgcatcggctttgctccgtcggaaccttttaatctatgggttaggaggagtgattgttccctttgtcggaatcaagttaatcgatttggttgtcagtttattcttttaa

SEQ ID NO: 4801 - DNA, 1722 bp, B.fragilis
tttgaaaataaagcaatgaatacagaaattttaggagtggcggtgcagattgtcctgatggtggtattagcttatccgttgggacgttacatagcccgggtttataagggagagaagacttggtcggacttcatagcgcctatagagcgagtgatttataagatatgtggtattaatccgcaggaggagatgaactggaaacagttcctcaaggcgttactgatcctgaatgcattttggtttgtatggggaatggtgttactggtatcgcaaggttggcttccgctcaatcccgacggaaacggggctcaaacacctgaccaggcattcaatacttgcatcagttttatggtaaactgtaatttgcaacactacagcggtgagagtggtctgacttatttcactcaattgtttgtcatcatgctgttccagtttatcactgctgccacaggaatggctgccatggccggagttatgaaaagtatggctgccaagagcactcaaacgattggtaacttttggcactttctggtgatcagttgcacacgtattctgttaccgctttcattggtggtaggtttcattctgattttgcagggaacaccgatgggctttgacggtcggatgcaactgactacactcgaaggacaggagcagatggtatcccagggacctacggctgcgattgttcccattaagcaattaggaaccaatggtggtggttattttggtgtcaattcttcgcatccgttggagaatcctacctatctgactaatatggtagagtgttggtcgatcctgatcattccgatggcgatggtattggccttgggcttttataccaatcgcaggaagttgggatatagtatctttggagtgatgctgtttgcttatctggcaggtgtctttatcaatgtcggtcaggagatgggaggtaatccgcgtatcagcgaaatgggaattgcccaggatcatggtgcgatggaaggaaaagaggtacggcttggagccggagccacagccctatggagtgtcaccacaacggttacttccaatggttcggtcaatgggatgcacgattcgactatgccgctcagtggaatggtcgagatgctgaatatgcagatcaatacttggtttggcggtgttggtgtaggatggctgaactattatacctttattatcatggccgtttttatcagcggactgatggtggggcgtacgccggaatttctaggtaagaaggtagaagcccgggaaatgaaaatagcaaccttcgtcgctttgttgcatccgtttgtaattctggtatttactgccatctcaagttatgtctatacacatcaccccgattttgtggagagtgagggcggatggctgaacaatctcggatttcatggtctcagcgagcagctttacgaatacacctcatcggctgccaacaatggttcgggtttcgagggactgggtgataatacatatttctggaactggacatgtggcattgtacttatcctgagtcggtttattccgatcgtcggacaggtagccattgcaggactattggctcaaaaaaagtttattcccgagagtgccggtaccttgaaaacggatactgtgacttttgcagtaatgacttttgccgtcattttcattgttgcagctttgtctttcttccctgtacatgcgttgagtacaatcgccgaacatttaagtttataa

SEQ ID NO: 4802 - DNA, 2865 bp, B.fragilis
gattcagccaatcagataaaaaaggagggtgttatctgtgaaaaggtgcatccttctttacttttagagtatttggtttcgatactctgttctctaaagagacattacaacacaaaatatacacaacacatgaagaacattttttttatctgcttattcttaagcatgagcctcgccgtatccggtaagaaggctcaagtgagtatctcctgtctgaaaaccgagatgcttgtaaatccccaaaacattgattgtccctctccccgtttgagttgggagattttatctgatgtgagagatgtaagacaagtctcctaccatatcctcgtatccacttcgttggagaaattaaaccgggaagaaggtgatttgtgggatacgggtgatgtggcgtccgatcagtccgcatatgtttcgtatggcggcgatatgctcgatagccgtacccaatgttattggaaagtgagggtaaaaaccaataaaggtatttccgcttggagtgaacctgccagttgggagatgggactgttgcatccgtcggactggcaggctgtgtggatagggagagcttttccacaagataaactggaggggaatacgcgagtccctgcccgttatctgcgcaaacctttcaatttgaactcgaagaaagtgagaaaggctaccctgtacatttgcggattaggattttatgaggcctatattaacggaaagaagattggagatcaggtattggctcctacgcctacggattattccaaatcggtgaagtataatcggtttgatgtgaccggacaattattaaagggagctaatgccatcggtgtcatcttgggcaacggacggtatacttcgatgcgtatgccgggagtgcggcattttgatgtacctaaaatgattgcccaacttgaggtatactatgaagatggagagaaacgggtgattgcgagcgatgcttcctggaaaataacggccgaaggtcccatcggaacaaataatgagtttgacggtgaagagtatgatgcaagaaaagagatgccgggatggaatacatatccgtttgatgatacgaaatggcttcaggcagaagttgtaagcctgccgggaggaaagttggaggcccaactcaatcgtaatatgaaagtgatggataccgtgaaacctatcggtattaccgaatcggctcccggagtatatattctggatatgggacaaaatatggtcggttggcttcgcatgaaagtaaaggggcaatccggcgatacgttaaaactgcgttttgccgagttgttgcagaaagacggttctatttatacggcaaatctgcgaacggcacattcggcagatacctatatcttaaagggaaattctatggaagagtggcaaccgacttttacttatcatggatttcgttttgttgaattgacgggtttcagggaaaaaccttctctatccgacttcgagggacaagtgatttatgatgaaatggagactacgggtaatctggaaacctccgacccgatgatcaaccggatttacaagaacgcttattggggtatacgtggtaattatcgcggcatgcctaccgactgtccgcagcgtgacgaacgtatggggtggctgggtgaccgtgcggttggttcgcaaggagaaagttatatttttaataatcatcttctttacgccaaatggctcgatgatattgaacaggcgcagaaagaaaatggagctgtacccgatgtggctcctaactactgggacgtttgcactgacaatatgacctggcccggtgcctatttaatcatagcaaatatgctttatgatcagtttggcgataaacaacccatcatcaaacattatccttcgatgaagaagtggatgcgttatatgaaagataagtatatggtagatcatattatgacgaaagatatttttggagactggtgtatgccttcccaatcttccgaactgatccactctaaagatccttcacgtatcacggaagctgaggtgctgggaacaaccttttattattatttgtccaatttgatggtacggtttgcagcgttggccggttatccgcaggatgctgaagattttcggaaagagagtgaactggctaaagaagcttttaattcaaaataccttcatacggaattggggtattatagcaacaatacagttactgcaaatatcctttccctgcggttcggcatggttcctgaggcttataaggaagtcgtgttccggaatatagttgagaaaacaatgaaagatttcaatgggcatgtcagtaccggcctggtcggtatccagcagttgatgcgcggactatcggattatggaagaattgacctcgcctatcggatagcgactaaccggacttatccgagttggggatatatggtagataatggagcaaccacaatctgggagctgtggaatggtaatacagctgacccggctatgaattctgccaaccatgtgatgctgttgggcgatctgattgtatgggcatatggctatctgggaggtatcagcaatgctcccgggagtgtcggttttaaacagatacagctaaagccttacccggtagatggcctcgattttgtgaatacttcgtttcactctatctacggtgaggtgagaagtcattggaaaaaagaggacggttcgttctgttgggatatctcggtgccgtgcaatacttctgctttggtttatgtgccggtagcagataaaagtattgatccgaaagaaaagaagcggatcgtcggagagggggggacttttctccggatggaaggtagttatgctgtctttagttttccttcgggaagttatcgattgaagacgcggttataa

SEQ ID NO: 4803 - DNA, 2961 bp, B.fragilis
cataaacacaaaatgagacatttatttttattggcagcacttttttgtgcctgcatttcttatgcacagattcgtgtacaagaacgacttcctaaaagtaaaaccggttttgctttgactactgcgaaagcacgggctaagatttattacgatgcgaatgatgcgcttgttatcaagagatcggcagaattgtttgcccgcgatattcaaatggtgaccggtcaaaagcctgaactgatccaaaaaagggaaagagccaaagctctggttattgtcggaaccattgaaaagaatcaatggatttgtgaattggcgcaaaaaggaaaaattgatatccggccattgcagggtgcttgggaacggtatttgattcaaactgtcgacaacccttctccaggagtagccaaagcattggttatagcagggagtgatcggcggggagcggcttatggcctgttctctatttccgaaatgatgggagtatccccttggtattggtggggtgatgtcccggtaaaaacgcacaaggctttgtatgtagatgctccgcccacatattctaaaacaccttccgtgaaatataggggtattttcctgaacgatgaagattgggggctgaaaccctgggctgctaagacctttgagaaagaacgcggtaatattggtccccgtacctatgcgaagatttgtgaactgttactgcgtttgaaagctaatcatctggctccggcaatgcatcccgtatctaccgctttttatcagattcccgagaataagctcgtagcagatacgtttgccattgttatgggctccagccattgtgaacccttattgttgaatacggccagcgagtggcatagcaagactatgggaccctgggattataatgctaataaggataagattaatgaagttttgggcaatcgtgtgaaagaaaattgtgcttatgagaatgtatacacattagccttgagaggattgcacgatgctgccatgggtggaggagacgtaccgatgaaagagaaagtgaaaatgctggagaatgctttgaaagaccagaggagcctgctaacccggcatattgataagcctgccgaaaccatcccgcaggcattcaccccttataaagaggtgctggaaatctactcgaacggattggaactgccggatgatgtgaccattatctgggcggatgataattttggctatatgaagcgtttgagtggccctcaagaacaaaaacgtacaggacgtgcaggtgtatactatcatatttcttacctcggtgtaccccatagctatttatggtttagtaccactcctccggcattaatgtacgaagagcttcgcaaagcgtatgatactacggccgaccgtatctggttggcaaactgtggagacctgaaaggggctgaggcacaagtatcgttttttctcgatatggcttatgacatcgaccaattcaacgaaaataatgtacatacttatcctgcccgttggttggcaaaaatcttcggagaacaatattacgatacattgaaagacattacctgctcacatataaatttggctttttccagaaaaccggaatacatggggtggggatactggaataactattggggtggaggtgaaaaacgtaccgataccgagttttcttttataaattacaatgaagccgggaggcgtctggctgagtaccggcggatcggtaaaaaagcagaggaaatgttggcaactgtagataaaaaggcaaaaccggcgctgtatcagttgttgtattatccggtgaaaggggccgaactgatgaatcgtatgaatatgaccggtcagctttatcggcaatatgttcgtcagaaacgtgctgctgccgatgatctgaagagagaaacaacgacttgtcacgatagtttggagattattaccgacggatataattcgctcttggacggcaaatggaaatacatgatgtcactaagacaaaattatgatggaagcagttcctattttatgcttccattgatggaagaaagttatgtggcaacgggcgatccgaagttggccgttcaggtagaaagtgagcaattgaatcggggaggttttagtttccgggctttacccgtgttcaatacttactcccgtaaaagtcactggatcgatgtttataatcaggggggaggaatgttggactggaaatcggaactttctgacgagtggatcgttttgtctcgtcagtcgggcagtactcgtactgaagatcgtatccaagtatcgatcgattggaataaagtaccatcaggagagaaagtcacaggatttattgagttctcttccggaatgcagaaagaacgggtgcttgtttccgtattcaatccgaagactccggtacgcgacgaattacaaggacttttcatagaggaaaatggctacgtatctctgcccgctacagccttccaccgtaagtttgagagtgaagatgtcaagatgagtgtacttcccggtttgggctttgaaggtgctgccttgcaaataggaagtccgatagctcccttacaaatgtatcgttcgtccgaggtgcctagagtggaatatgatttttatactttcaatgctggaatggttgatgtgtatacctacgtgctgcccactttccctttgcatgctgatcgggattataaactaccggagcataccaattcggataccaaatatagtgtccgtatcgatgatggatctatttctactccatccacttcagccatagaatattcccagatctggtatgacagtgtgctgaaaaattgtagagtgaataaatccactctttatgtaaaggcccccggtaagcatacattgcagattcgctgtggagatcccggaactgtgattcagaaaatcgttattgatatgggtgggctcaaaaggtcatatttaggacctgaaacaactctttgccgttaa

SEQ ID NO: 4804 - DNA, 1002 bp, B.fragilis
gaactgccaaatgaaagtgaatgccgtatgagagagaaggtccggttctgcgtagccttgtgttgttcggtggtcatggttctgttggcctcttgccgttattccctgcccgatcttccggcggagggaatgagccggaagaccaaagactctctgacttacctttccaagtatcattatacgtggaatacgaacctggaggtgttggacgattcggttcgtctggaatatcttccgttgaaggatgcctatgtcaatctgtataaaggtgaccgtgtggttgtggcagagttttctgtccatccgcaggacagtgtagacagtatctgggtaaaagtagcccattcacaggaggtgcaggggtgggtacgcaataaagagttggtgcgttcgttcgtaccgactgatagtatttcgcagttcatccatctgttcagcgatacccacgcttcatatttcgttttcatattcgccttgtttgtcggggtctatctgctccgtgcttttatgaagaagcggttacagatggtttactttaatgatatcgacagcgtctatccgttgtttctttgcctgttgatggcattcagcgctacagtctacgagacgatgcaggtgtttgtacccgacacctgggagcatttttacttcaatcccaccttgtcgccgttcaaggtgcctttcattctttcggtattcctgaccggcatttggctgtttatcatcgtcactttggccgtacttgatgatctgttccgtcagcttactccagccgttgctgttttctacttgctgggactgatgtcgtgctgcattttatgttactttttatttattctcaccactcacatctatatcggctatttctttgtggcctgtttcatctggctttttgtaaagaaagtacgtaggggttccggctataaataccgttgtggaaactgtggacacaagcttcgggataagggacaatgtcctcactgtggggctgttaacgaataa

SEQ ID NO: 4805 - DNA, 3459 bp, B.fragilis
aagccgccaaaggacggctattgtttaactaaaaaaaataatattatgaacaaaaatcgatcaatccgagtggcagctttttgccttggtttgatgttggcgggttctctgcaagtacatgcccaaaaagtaacatttcgggatggaacagtgtcgttgaaacaagcgtttgaaaagatcgaagcatcttcgaagtataaaatcgcttataatgattcacacctgaatgtttctcgtaaagtttcgttgaatcaaaaagaaaccgaagtactggagatattggcaactatcctgaaagatacgggttatacgtacaaaaagagcggtaactacattgtgattgttcccgtggaacaaaagccggcttcaaaagtcaaaaaggtaaaaggagttgtgaaagatgccagcggtgaagcgattatcggagcaaacgtattggtaaagggtacggcaacaggcgtgatcaccgatatgaacggaagttttgagttggaagtgccgggtaacgcagtattgcagatcacctatattggatatgtacagcaggatgttgctgtaaaaaaccgggaccaattggctgtgttactgaaagaagatactaaaaccttggatgaggttgttgtcgtaggttatggtacaatgaagaaaaaggacctgaccggtgcagtagcatcagtgaagatggacgatactcccctaagtacgatatctacagtgagccatgcgttagccggaaaagcagcaggtttacaggtaaatacaatcagtgcccagcctggtggcggcacaacgtttcggattcgtggagctgcttcgaccggagcaggcaatgatccgttgattattgtggatggatttcctgtaagtaatgcaggtaatgtgagtgtcggttataacagtgataatggtacgactgacaatatattggcctcgatcaaccccaatgatatcgaatcaattgaagtattgaaggatgccagttctactgctatttacggtgcacgtgcgggcagtggtgttattatcattacaaccaaacggggaaaagagggtaaaccgaaagttacctattcaggatctgccactgtgcagactatggctactaaatatgaaatgctggatgcacaggattttatgattcagtctaaccgttggtttaaagaaaagtggatgtatgataataaagtcggcatttatggtggtaaaaatgaatcggaggccggcagtgcatatcatcccaaatattcggatgcggatattgcgaatccggtaaatgatacagattggtatgatcgtattactcgtacgggttttcagacacagcataatatctcaatcaatggaggtacggagtataccaaatatctgatttctggtaacttctttaatcaaaagggcattgtaaagaataatggcatgtcgcgttatactggccgtgtaaatctagatcagaagctcagtaaatatgcaaaagtaggtatcaacctgacagtgagtcgtaatacattggacaatgttccgttgggagcagggcaaaatgaatatgccagtattttagtgtctgctgctcagtttagtccactattgtctgtgaaagatgaaaatggtgattacagtctgaaccaacaggctgcttatattccaaatcctgtttcgctacttgagatcagtgatcagacgactaaagaacgtttcctggccactccgtttgttgaaatcaaaccaatcaatgagctcacattgaaagccagttttggtatcgatcgtaactatcagcgtcgtgaggtatacatgcctaaaacaactctttacggagaaaaggctgatggccgtgcagacattgggcaatatgacaggtctgattatttgttagaactgactgccaattatgcaaaacgtttgggtgatcataatctgaatgctttggttggatactcttttcaaagattcaccagtaagtatctcaatgcgggtaaccaaggatttctgacagatgcctttctgtttaataatctgggtgcaggtacttatgaaaaaccatgggttggttcttccgcttctaaaagtgaaatggcctctttcttcggtcgtgtaaattatacctataaagatcgttacttggtgaccgccactcttcgtgctgatggtgcctctaactttgcaaaaaataaccgttggggatatttcccttctgtggctctgggctggagatttacggaggaaaactttgcccggtctttgaatttggataaagtgctctctaacggtaagttaagattaagttacggacaaacaggtaactcgaatatcggagataaatcagtcacttattatggtacaggatataataaagttttcggtaataaagaatatacaggagtctatgtcagtcagatcggtaatccggatttaaaatgggagacgacaaccgagtggaatgtaggattggatctggggttcttaaacaatcgttttaatgtaactgcagaatactttcataaggtagtttctgatttgcttagttcccgtagtgtactttcgtataatgaagtaggttcgattgctgccaatatcggtaaaactcagagtcagggatttgagttgacaatcaatacaaagaattttgatacaaaagattttagttggaataccgattttactttctcgttctatcgtgataagtggaaagaacgtgatgagaattggagcccgaatccatacgatatgtataatgctccgttgagaggatactatatgtatttgtctgacgggttgattcagccgggggaggaagtatcctggatgccgggagctctaccgggacaggtgaaattaaaagatattgatggatacgcatacaatgaagacggaacttataagaccgacaaacatggcattccattgaggactggaaagcccgatggaaagatagattatgcggacgctgtgtttaaaggttgtagtgatccgggttatttactgggattgaataatactttccgttataagaatttcgacttgaatgtttatttctatggtcagttggatttattaaagagtggttcttataaagattattggattgtcggttcaggaacaatgaccggggtgaataacttatatcgcggttataacatgcctacttcggccaaagaagtgtggtcgcatgacaatacatcgggtaagatgccgggttattttcagtatatgagtaattatggatatggagactatttcctggaaaagagctggtttattcgctgtcgcaatattacgctgggatatacattgcctgttaagtcggcaaagaaactggtttccaatgtacgtatctacgccgatgtgaacaacttgtttactattactccgtatgatggtttggatgtggaaacagatgattcttattgggcatatcccaatgtacgtagttttagtattggtctggatattactttctaa

SEQ ID NO: 4806 - DNA, 669 bp, B.fragilis
agaataacaaaaatggagatatttagaaatttaaccgttgtccttgccataactaccttggtggcttgtaatgatgttacgatagaaggctcttgggtggaaccggttcccggaatatctaatttaaaacaaggattcacgcttgaagcaaacggaagtgcttcttccatcaatatggccactttgaaatatgagaaatggaagaaagaaggaaacttattactcctttccggtataagcatcggcaaccaccaaagtatatcctttacagatacactaacagtagagcaattgactcaggacagtttgattctcaaaaaaggcgagttggttttgaggtattccaagacgaatgaaataccagacgaagaagctataccgacaccggacactcctacccagaaacttttgtccgtaaaaggtaaattgatcatcggacatgaaacacgttctttcacttcagaaggggattccactgattattggattgttgataaaacaggagaactcctacaaaagtatgatggtgaaacaaaaggaatcaaaaatggaacacctgtatatgtggaattagaagttattgatatgggtaaatcagacgaaggctttgccgccgattatgccggtgtttatcatgtcatgaaaatcaataaaataactgtaaaataa

SEQ ID NO: 4807 - DNA, 630 bp, B.fragilis
tgcattatgaaagtaaatgatatcgatatggacgccgtcatactgggcaacggcgaatatccgacccactcaatgccggaaaccatgctgattatggcgccttacgtggtgtgctgcgacgggtccgccgacgaacacatccgaaggggatttacacccgatgccatcatcggcgacggagactcgctctcaccggagaacaaggaacggttcaggaccatcttccaccagatagacgaccaggagacgaacgatcagaccaaagcggtacacttcctgctcgaccaaggcaaaaaaacaatcatcctcgtgggtgcaaccggtaaacgggaagaccataccctgggaaacatcagtctgctgatagactatatgaaagcaggagcgcaggtaacgatgctgacggaccacggaatgtttattccggcatcggggcggaactgtttcaagtcatatcccggacagcaaatctccatcttcaacttcaacgccaccggactgagggccgatgggctggtatatccgctcagtgacttcagtaactggtggcagggtacgctgaacgaagcgacaggcaccgaatttacgatccatgcggagggagactacttggtttatctgaattactga

SEQ ID NO: 4808 - DNA, 357 bp, B.fragilis
ggaagtatgaatacaatatgtaagatgcgcgatatctacaaagcactctccattttcgaaacggcatttgaagaggtgtatggaatatcgctgaacgaagcaatggtgctatgtgcgttgcgcgaagccggaaaggaaattacctcgactgctatagccgaacgaacggaaatggctccgtcgcatacgtcgaaagtcatccgtgcggtagaagataaaggactcatccgacgggcattgggtgaagtagacaaacgccagatgtacttcagcctcacagaggcaggcaagaagcgtttaaacgaactggatctggacaaagtagagataccggaaatgttaaaaccactgatataa

SEQ ID NO: 4809 - DNA, 774 bp, B.fragilis
cgaaaaaagaaatttattatgaagatctgttcatgcttgaataaaggagttatgattgcagtggcagttgtttgttctgccggtttacagtcttgtctggatgacaatgataagtactattatgtggaaggatttcccaatgctcttgttacggtaaaaaatgcgactgatggttcattcttcttacagctgaatgatagcacgactttgttgccgaccaatatgtcctcttcaccttttggagataaagaagtcagggcattggtgaattatgatgaagtgagtgagtctggtggcagatatgataaggcggtacaggtgaactggatagatagtattttgacgaaatcgattgccccggatttaggatcagaaaatgacgttgtttatggaacagatcccgtggaaatagtaaacgattgggtgactattgcggaagatggttatttgaccctacgattcagaacaaaatggggtgattataataaagcccatttcgtaaatttattgttggggcaaaatccgtctgacccatatgaggttgagtttcgccataatgcatatggcgatacatatggtacggttggtgatggtttggtagcctttaagctggtgggacttccggatacgaatggaaaaacggttccgttgactttgaaatggaagtcatttagtggagataaatcggctgtatttgattattgtactcaaaaaaacgttacaccggctaaaccggccattgtttctgtaaggagcaatttaaatttaaaatag

SEQ ID NO: 4810 - DNA, 873 bp, B.fragilis
ctgaaagagaagggagtggacagttcgctggatactatacgtgacgagattatcggcatgaatatattcaattcggtatttgtggattgtacggccagtccggacattgcctctctatataaggacttcctgcaacataacatttctgtggtggcggccaataagattgctgcttcatcggcttacgagaattaccgtgaactgaagctgatagcccgccagcgtggtgtgaaatatctgtttgaaaccaacgtgggggccggacttccgattatcaataccatcaatgacctgatacatagcggtgataagattctgaagatcgaggcagtgctttcgggtacgctgaactatattttcaataagatcagtgccgatgttcccttcagccgtaccatcaagatggcgcaggaagagcgttattcggaacccgatccgcgcatcgacctgagcggtaaggacgtgatccgtaagctcgtgattctggcgcgtgaggccggatacaagctggaacaggaagacgtggtgaagaatcttttcgtaccgaatgacttctttgaaggttcgctggaagacttctggaaaaaagtgcctagtctggatgctgatttcgaagctcgccgcaaggtgctcgagagtgagaataaacattggcgtttcgttgccaagctggagaacggcaaagcatccgtcggtttgcaggaagtggaccgcaaccatcctttctacggactggaaggcagcaataacatcattttgctcaccaccgaacgctataaagaatatccgatgatgattcagggatacggtgcgggtgccggagtgacggcggccggtgtatttgctgacattatgagcattgcaaacgtataa

SEQ ID NO: 4811 - DNA, 1344 bp, B.fragilis
ccggcacggaaacctgatagttccggtgccctgcctggttttgagcgggcgcctctatggatctccgtaacaggtggcatttgtatcctcacgggtttggtcctgcttgtctggctaccccgttctattaataggccggtaaaagaactgacttgtggtatcttggaaatagccaatcataattatgaaaagagattggatatgagaggatacgaagagttcagggaagtttcggatagttttaaccgcatggctgaaaaactgacagagtatcgtgacagtacattggctgatattctttctgcaaaaaaattccttgaagccgttgttaacagtattcatgagccgattatcggcttaaataccgaacgggaaattctttttatcaataatgaagcattgaatgtactcaatatgaagcgtgagaatgtaatccggaagtccgccgaagaactttctctgaagaatgatttgcttcgcaggctgatacgtgagttggtgactcccggtgagaagaatgaacctttaaaaatctatgcggacaataaagaaagctatttccaagcctcgtatattccgattgagaatgcggcggcagaagaaggagaggctcgaaacctgggagacgttatcttgctgaaaaatattacagagttcaaagaactcgattctgcaaaaaccacttttatctctaccatctcccacgaactgaagactcctatttctgccataatgatgagtcttcaattgctggaggacaaaagagtaggctctttgaatggcgaacaagaacaattatcgaagaatataagggacaatagccagcgcttactcgatattaccggagagttactgaacatgacgcaggtggaagccggcaagcttcaaatgatgcctaaaattacgaaacctatcgaactgattgagtacgccatcaaggccaatcaggtacaggctgataagtttaatatacaaatagaagttgactatcctcaagagaagataccgaaactgtttgtagatagtgaaaaaatagcttgggtacttactaatcttttaagcaatgcgattcgctattcgaaagagaatggccgggtagtgattggcgtaaggcataaaaaagagtatatcgagctctatgtgcaagactttggcaaaggaatcgatccaagatatcaccaaagcatttttgatcgttatttccgtgtaccgggaactaaagttcagggtagcggtttgggattgtccatttcgaaagactttgtagaagcacatggagggacattgaccgtacagagcgaaccgggtaaggggagttgctttgtgataaggttgaaggcatga

SEQ ID NO: 4812 - DNA, 2397 bp, B.fragilis
atcatgctttttaagagaatacgtgttacaatcttattgctcggaatgttgagctttagcttgagggtgtcggcacaaattgttttgaagcactctgattgggagtggaaaatttcagaaaccggatgtgccgaacaactaatatttaaaggtggaaaacgaaatgataccatacctttctttcgtgaaggagaacatgccggtccatccttttatgcaaaacgggaaggtaaagaagtgcgtgcatcctggattccggatggatacgcctcctatcggagcgagatagacggagttctttgccggatatcatatataaaagatcatggtcaacctgcattaagggtaaagctgacaaacaactcaccggtgccttatcaacctcagaaggccggtctgaagttgggcatcgatacatatatggataaatttccggattggtttggtaaatactttccaaccttgatgagaaacgaaaagacccatttttatggctatcttcaaaccccttccggacatacattgggacttgtatcacagcagcctgtagcatcctggagtgtagattataatctgggctatcaggatccggtcccattttggtttatggggcatcgcatcgaatcattaaatctcgatttattgaatgaattacctttgccggcacgtcatccgcagaatctgtatgaactgaaacagggggaaagtaaagagtggatttttacatttgtcaatgtgggtaatttggacaatctggaacgtgccattgctcgagtttcggacattcctttgattgatatccgtcagacttcgcatgctgcacgtgaggaagcatcgttcacacttactgccgataatcctaacgtaaaggtgaccaatgatgccggaaaagaactgcctgtcgtactgactaaaaccaaagggaatcgttggataggaaaagtccggttggaagatgcaggtctctataccctttctgtccgttcgggcaataaagttgccgaagcgatatggacagtacatcatccttggcaatgggtgatggaaaaggcacgtgagaatgcagcccgttatcatcagaaaccgacgtcacatgctgagagttggtatgggttctattcggcttttcttgctgcccgttatttcccgaatgagtcattggataagcaattgagcaattattttgatcggctttacaacaaattgcatgattcggtaaaagtggaaccgttgtattttaagacacgtattcaaaatacctctactactattggaatgttggtagataaatatgaggcacagggagatttggaagatctgaaaaaggcgtcgaagttggctgactggatgatcgcgacctcccagcgcgaaaatggtgcatattataatcatggaacagtctataccagtgtgatctatatcgctaaaagtgttttggaactggctgtcctcgaacgtaaattgggtgaacaggatttgttttggagaacatgtgccgaccgtcatttcctgtctgcaaaaaaggcggttgaccaactggttgcgtcacaaggagattttcagacagagggagaattgacctttgaagacggcatgatttcttgttcagctttacagataggtatgatgggagtcatcgagcaagatgctgttgcacgcaaatattataccgatgcaatgttgaagatactgaacagccatgattgccttactcaactccgtgtacccgatgggcgccgtcggcaaggaactatgcgttattgggaagcgcaatacgatgtacagatgcttcccaatatgtttaattcaccccatggctggagcggatggcgtgcgtatgctacttattatgcttatctgctgacaggcgacgagaaatggctggaacaaacatttaatgcgatgggagcttttgccaatttgattgattataaaacggggcagttgcgttgggcttttgttgtcgatccgcatcttgaagtagaacaggcgtgtagcgctgatactaaactggatttttctgatcttagttttggtaatccgcatccgaaattatatgatacccgtaagtttgttattggtgagcaatatgtcaatatgattagcgattggcagacggtcaatactcaggataatgatgtgcacgaattatttaaatgtatcggtgaagctgttctgactaacgcttttgtcatagaacgtccgaatggagaagtcgtaggatacaattgccgtgtaacccggaaggggaatacattgactgtaaaggcagacgagaaacagatcgtgaatctacattgcaacttgaagcattctttctctgtgtctttcgatggtaaaacctgttctttgcctgaaggatattgcgattgggcttttgggcagtccggttattga

SEQ ID NO: 4813 - DNA, 627 bp, B.fragilis
aagcaggaccttagatcaccaagtgagaaatattcgataatgaatcaatttttagattttgaccagaaactgtatgctgaactccgtaaaggcagcgagcacgcttttgttactgttttcgaacggtataaccgcttgttgtatgcgctggcttatcggtattttaaatcaggtgaagaggctgaagacgcagtgcaatatacttttatgaaattgtgggagcaacgttccagttttgaatttcaatccggcatcagaagcctgttgttcaccatcctgaaaaactacattatgaacgagttgagacatcggcagattgtctttgaaaagcattacgagatggctcaacggaacgaagaagcggacgacagttttctgaagaattttgaagataaagatttcagggaacatcttcggactgccatcggtaaactacctcctcaaaaacagaaaatatgccgcctgaaaatagaaaaaggactttctaaccaggaaatagcggacgagatgcatatcacggtgcctaccgtaaagtcccattatactcaggccattaagatactccgtgcggagattgaatcgttaattgtattacttcatgtattgtggattcattttttagagtga

SEQ ID NO: 4814 - DNA, 1011 bp, B.fragilis
agaaaagtcgaaatgaaaatagatgatgcgattatagataaagtgctcaataacgaagcttctgtggaagaagcgggattggttgcggaatggtttgctacagaagagggtagcgaatatttgtcggggcgtttggagagcgagtctgcacggctcaccgaagaacgggcccgggaatggttagaccatccggtgccggaagaacggatgcgggaacgcttcatcgggcaaataaaacctgagaaaaaaatagtttcttatcgtcgcgtactgatagcggcagcggtattgattccttttttattccttagtatatctctttggtttctggctgacagaaccggagtcttttctgccacagaatatgctgaattaaaggttccttgcggagagcaaatgcaggttgttctgcaagatggaacagttatacagttgaattcggatacccgtttgcggtatcccaagaagttcggtctgttcagtcggagtgtggagttatggggagaaggcttttttgtggtcgctaaggataagaagcgtccgtttatcatcgatttgaaaggtgttgaagtaaaggtcaccggaactaaatttaatgtaaaggcatatccgtcagaacccaatgtatgggtcaccttggaagaaggaggcgtgctgttgaaagataccaagaacaaggaatatcctcttgtaccgggtgaaagtgccgaatacaaccggacatccggaatttgccagataaccaaaccggatgatatgagccagatttcatcctggcgttccaatagcctgaatttttatcttactccgctgagagatattataaaggtcatggaacggcagtatgatgttcattttgtggtgcgtgattccaccctattgaataacaggtttactctatctaccagcaaagtgaatgtggacgatgtattgcgtgatttggaagcggtttcatggatacgtttcttgcaaacggaagatggggtattcgaaattcagaaggaaaaatag

SEQ ID NO: 4815 - DNA, 1206 bp, B.fragilis
aatagatacgaaatgaaccaactatcagaccgtttgaacagcttgtcgccctcggcgactcttgctatgtcgcaaaaaagtgctgagctgaaagctcagggtgttgatgtaattaacctcagtgtgggagaacctgacttcaatactcccgaccacatcaaagaagctgccaagaaagcggtagatgacaacttctctcgctactctccggttccgggttatccggctttgcgtaatgctatcgtagagaaactgaagaaagaaaacggtctggaatatacagccgctcagatttcttgtgcaaatggggcaaaacaatctgtatgtaacactattatggtgttggtgaatccgggtgacgaggtcattgtacctgctccttattgggtaagctatcctgaaatggtgaaactggcagaaggtacgccggtgattgtgactgccggtatcgaacaggatttcaaaattactcctgcgcaactggaagctgccattactcccaaaaccaaagcattgatactttgctcaccgtctaacccgaccggttcggtttacagcaaagaagaattggccggtttggctgctgtgttggcaaagtatccacaaatcatagtcgttgccgacgagatctatgaacacatcaattatatcggaaaacatcagagcattgctcagttccccgaaatgaaagaccgtaccgtgattgttaacggtgtgtcaaaggcgtatgcgatgaccggatggagaattgggttcatagccggtccggaatggattgtgaaggcttgcaataaacttcagggacagtatacttcaggcccttgttcggtatctcagaaggctgccgaggctgcttatacaggttctcaggctccggttgaggagatgcgtcaagccttcgaacgtcgtcgtgacctgattgtaaaattggcaaaggaagttcccggatttgaggtaaatgtaccggaaggtgctttctacctgttccctaaatgcagttctttctttggtaaatcagcgggtgaccgtaagattgagaattcggatgatctggcgatgtatctgcttgaagatgctcacgtagcatgtgtaggcggtacttctttcggagctcctgaatgcattcgcatgagttatgctaccagcgatgaaaatatcgttgaagcaattcgccgtattaaagaagcattggcgaagttgaaataa

SEQ ID NO: 4816 - DNA, 1584 bp, B.fragilis
ataagtatctgcatgaaagtaatgaaattcggcggaacgtccgtaggttccgtgaacagcattttaagcgtaaagaaaatcgtagagtctgccggtgaaccggtaatcgtagtagtgtctgcattgggcgggatcactgaccagttgatcagtacctcccgaatggccgccatgggcgatgcagcttacgaaggggcataccgggaaatagttcgccgccacgaagagatggtgcagggagtgattcctgccggagagactcagaccctgttgcactatcaggtgaatgaattgctcgacgaactgaaagatatctttcagggtatttatctgattaaagatctttctccgaaaacgtccgataccattgtcagttatggtgaacgtctgtcttcactgattgcgtcaagactgatccaaggggctgtatggttcgactcacgtacttttatcaagacagaaaagaaacataataaacataataaacatacactggacacggaactgaccaatcggttggtgcgggaagctttcaaagaaatcccccgggtttcgctggtacccggattcatctcttcggataaggtttcgggagacgtaacgaatctgggcaggggcggttccgactataccgcagctgttattgccgcagctctcgatgccgatagtctggagatttggacggatgtagacggcttcatgacagccgacccgcgtgtgatcagtacggcctatactatcagcgagctgacttatgtagaggctaccgaactttgtaatttcggtgcaaaagtggtgtatccgcctaccatctatccggtatgtcacaaaaacataccgatcctgattaagaatactttcaacccggatgcccagggaacggtgatcaaacaacacgtagaccacacgaagagcaaagccatcaaagggatttcgtccatcaacgacacgagcctgattactgtacaggggttaggtatggtgggcgtgatcggtgtcaactaccgcatctttaaggcgctggcaaagaatggaatcagtgtgttcctcgtttcgcaggcttcatcggagaacagtacctctatcggtgtgcgtaatgccgatgccgatctggcttgcgaagtgctgaacgaagagtttgccaaagagatcgaaatgggtgagatttcgcctatccaggcagagaagaacctggctacggtagctatcgtgggtgagaacatgaaacatacgccgggcattgccggaaagctgttcggtacgctgggacgaaatggcatcaatgtgatagcctgtgcacagggagcttccgagaccaacatctcgtttgttgtcgattcaaagtcgttgcgtaaatcgctgaatgtgattcacgactcgttcttcctctccgaatatcaggtgctcaacctctttatctgcggtgtgggcacggtgggaggaagtcttgtcgagcagatccgccagcagcagaagaagctgatggtggaaaatggcctgaaactccatgtggtaggtattatcgatgcgacaaaggcgatgttcagccgtgccggattcgatctggccaactatcgcgaatag

SEQ ID NO: 4817 - DNA, 639 bp, B.fragilis
atccatagacttatgatgaatcaccaaccagaaatagctatcgtagaggcgaacaccctcaccagcctgggactgaaaacaatcctggagagaatgatccccatggcagtcatccgcacgttccatagcttcggcgaactgacagatgacaccccggacatgtatgcccactacttcatctcggcacagatttatgtggagcacaacgctttcttcctcccccgaaagcggaaaaccatcgtgttggcgggagacagccaccagttccaactctccggcgtccccatactcaacatctaccaggcagaggaacagttggtgaaagacatcctgaagctccaccagcatgcacatcatgacggctatccggtaaaggacatgcctcctaccccgccgaccactggacacgaactctcggcacgcgaaatcgaggtgctggtcctgattaccaaaggactgatcaacaaagagatcgcggacaaactgaatatcggcctgaccaccgtaatcacgcatcggaagaacattaccgaaaagctgggcatcaaaatcggtttggggcctaaccatctatgcggtgatgaacgggtatgtggaggcagaccgcatatagcgaactatgtggtgaatccatggtga

SEQ ID NO: 4818 - DNA, 582 bp, B.fragilis
tcttttaagtggataataatgcattctgaaatcgcagaagaaaaattactggtctcccaattctcccaaggaagccatatagcgtttaaggcattgtttatgcgttattatccgaaggtgcgctcttttataatgggattggttaaatcggagagtgaagccgaagatttgacacaagaagtttttctcaaactgtggacgcaccgtgagaaattttgtgaagtagaagtgttcggaacctatctgtatgtcttgactaaaaatacaactttcaattatttgcgttcccggcagaatcgtcaggatagtcaggggacagaatgggtagaagagtctacagacacgactccttatgaagagttggttgctaaagacttgcagctattgattgatatggtggtggagaatatgcctcctcaacggcaaatgatttttcggttgaatcgggaggccggactgaccaatgcagaaatagcggagaagttgcagattagtaaaaaaactgttgagaaccatcttaacttagcgttgaaagaactgaaaaatgctttgttattctttatatttctctatttatgttaa

SEQ ID NO: 4819 - DNA, 1461 bp, B.fragilis
acaggcaagtgccaccttttcattttgataaaacaaactaaaatgaaaaggagacagataagaaaaaagaatcgtataactaaaaaaaatagagaaatgaaaatctacaaattcggtaagattcccacaggctcagtacagggaatgaaaggaatgctccgcctgattgacaacagtatcccccaaataatcgttctgtccgccactacagagactacggaacgtctggccggaatagctgcccatcttttcaacagagatacagaacaggcgcatgacgagataagcaggcttgaattcaggtttatcgatttcgccaacgaactattcaatgacgaatcgatcaagcaacaggcggtcgattccatcatcgatcgtttccggactctatggaactttacccgccaacgttttacatctgtcgacgagaaagacatactggcacagggagaatttatcagcagtatgctagtcagcctctatctgaaagagcagggaatcaacaaccgactactcaacagcctcgacttcatgcgactggctccggaagaagaaccggacatggaatacatcggtacaaagctacacttgctcttggcagagcataagtcgaccaatgtatttcttactcaaggacatctttgccggaatgcttacaacgaaacctgttacttgaaacaaggcggagatgatgtttcagccacactgatcggagctgctcttcaggcacaagaagtatgtctgtggacagacagcaaagagttgcacagttgtgacccgcgctttgtgaagcatccggcaatggtgaagcagctcagtttcgacgaagccgagcaactggcctattgcggctggacgggattcaaccctcactgcatcctgcccgcaagagaaaacaacataccgatacgtttgctatgttcgatggagcctgcagaaggaggaactttgatttcaaattcacaaagcggagaaaacataaaagccattaccgccagagacaatatttattacattaaattccaatcgaaccgaacgttacgcccctatctgttcatcagcaaaatattcgatacttttgccaaataccacacttccctgtgcctgttcgcctcgtccggttctgatgtatctgttgccatcaacgacaaagagcgtttatcgcatatactccacgaactctcacgatatgcagtcacggtggtaaaagaccacatgtgcatcctttcggccataggtaacatgcagtggcaatgcgccggatttgaagcccgaatcataaatgctttggccaccatcccgatccgaatgatctcttatggcagtaataacaacaatgtttcacttgtcatcagggcagaagataagagagaagcattgcaacgactgaacgacacgctgttcgctccctgccatgcaaatccttctcagatacatgttccgacattaaaacacagttag

SEQ ID NO: 4820 - DNA, 705 bp, B.fragilis
accgatcggtgcatcggctttgctccgtcggaaccttttaatctatgggttaggaggagtgattgttccctttgtcggaatcaagttaatcgatttggttgtcagtttattcttttaaatattcaagcaatgaaaacattattaaaatctatcaagataactctcgtcttttgtgtattcttctctgtattttatatcctcgtgctgtggctgtttgcacaggtagccggtcctaaccggggaaatgcagaagtagttaccttaaacggaaaagtggtaggggctgccaatgtaggacagacttttacggaagaaaaatatttttggggacgcccctcatgtgccggtgatggctatgatgcaaccagttcggcaggtagcaataaagggccgactaatcctgaatatctggcagaggtggaggcacgcatcgatactttcctcattcatcatccgtatctggcacgcaaggatgtacctgccgagatggtgacagccagtgcctcgggactggatccggacatcactccacagagtgcttatgtacaagtgaaaagagtggcgcaggcacgtggcatggatgtggaagaggtgagaagagtcgtagataaagctgtagagaagccgttgttggggatattcggaaccgagaaagtaaatgtattaaagttgaatatagctctggaagagttaaaaaacagatag

SEQ ID NO: 4821 - DNA, 2436 bp, B.fragilis
cattttttgctgcatctttgcaaacgaatcaatgaaaagatacagcacatgaagaaaaacagtattcttattgcccttgccctcttttctgccggtggcacatgggctgaagagcttccgaaagacacactgaaagtgatagatgtggaagagattgtagttatcgcagctccgaaagaaaaccgcaaactacgcgaacagccaaccgcggtaaccatgctctcacaacaggatatgcaggccaatcaggtgaactccatcaagagcctgacggcacttgttccgaatatcttcatccccgactatggctcgaaactgacttccgccatctacatccgtgggatcggttcacgcatcaatacaccgtcagtgggtttgtacgtagacaatgtcccttacatcgacaaatcagctttcgacttcaactatgccgacattgagcgcatcgacgtgttgcgcggtccgcagggaaccctctatggacgcaacaccatgggaggactgatcaaggtacacaccaaatcgcctttcagttatcaaggcaccgaccttcgactgagtgccgggacttacgataattacaatgcttccgtgactcactatcaccgcatgtcgaatcagtttgccttctccaccggagcattttatgaatacggaggaggctttttcaagaatacctaccttaacaaaaagatagacaaaagccaagctgccggaggacggttccgaggcatctacctgcccagcgagaacatgaagctagacttgaacgtcagctatgagtacagcgatcagggaggatatgcttacggagcttatgacaagcacacgggaacctacctgaaaccggcctacaatgatcccagcagttactatcgcaatctgctgaatgcagggttgaatctggaatatcagggagaccacttcacactgagttcggtaacgggactgcaacacttacgtgaccgtatgtttatcgatcaagacttctctcctgccaatatctatgtgctggaacagaagcagaagctgaccacgatctccgaagaaatcgtcctcaaatcgaaatccggacgacgctgggaatggaccacaggtgcctttgggttctatcagtggctcaccaccaacgggccggttacattcaaggaagacggggtgacagaaatgctggagaaaggcatcaacagtcacttccccgatctctcggcgatgggaatgaaaatgaacctggacatcacgaaccctacgttgttggtggacggacgcttccacacaccgatcctcagtggagcagtctatcatcagtccaccttccgtgacttgctgatagaagggctttcggctaccgtaggactgcgtctggactacgaaaagaactggatgaaatacaactcgggcagtaccattgactatcagttcaacatgacaagccctttcatgcctgtacgcctggaacagaccagttcaccacgcctgaacggcaagttcagcaacgactatctgcagctattacccaagttcgccctgcaatacgaatggaagaagggtaacaacgtatatgccaccgtatcacgcggataccgttcgggaggatacaatatacagatgttctcggatctgatacagggtaatatgcaaaacgacatgcagggacagatcaaggcaggcacgaaacagatcttcgaccgcctcgtgactcaaggcatgccacaggccatcgcggaccgcatcttgtcgaatattccggatgcaggtgagaatgcggatccgaaagcatcgaccatctacaagcccgaatattcctggaattacgaagtgggcagtcacctcactctgtgggaaggtaagctatggatggatcttgccgccttcctgatggatacgcgtgatcagcaaatcgcccagtttgccaaaagcggattggggcgtattacggtcaatgccggcaaaagccggagctatggggctgaagcggcactgcgtgctaacctgaccgatgctctcagcatgaacgcaagctacggatatacgtatgccacgttcaccgattataaaaccatcgaccggggacaaaatgaaatcagctatgacggcaattatgtacctttcgttccgaaacataccctcaacgtgggtgggcaatacatcttccgcattgctccccgccactggctggaccgtgtacaggtgaacgtgaattataatggtgccggacgcatctactggacagagcaaaacgatgtaagccagtcattctacggaacgctgaatagccgtgtcagcttggcaaaggggaacggacaaatcgacttctgggttcgcaatgcgctggataagaagtatgctactttctacttcgaatcgatgggcaacggatttatgcagaaaggacgtccggtacacttcggggtagacataagatgccgattctaa

SEQ ID NO: 4822 - DNA, 1158 bp, B.fragilis
tgcccattgctttttctccggataaagcggatcactttcttgacactttgctgccatttacaagatatatcattatctttgcaacaatacattcttcatttaaggactatgaacccatcagatacttccatattattaatatacacgggcggaaccatcggtatgatagaaaaccctgaaaccggagcactcgaaaacttcaatttcgagcaattgcagaagcatgtacccgaacttcagaagtttaccttcccgatagactcttaccaattcgatccgcctatggactcttcggacatggaaccggaagcctggaggaaactgctacacgtcatcagtgaacactaccaccagtacaccggctttgtcatcctgcatggtacggatacgatggccttcaccgcttcagccctcagcttcatgctcgaaggactcgacaaaccggttatcctgacaggttcacaactgcccataggagtgcttcgtaccgatggcaaggagaatctgatgaccagcatcgaaatagcatcggcacgcgacagaagtggtaatcccatggttcctgaagtatgtatatttttcgagaaccggttaatgcgtggcaatcgtacgaccaaaatgagtgcggagaatttcaacgccttccgttcgttcaattatccggtactggcagaggcagggatacatattaaatacaacaatgtgcagattcacattgaaggggagaaacgcgaactgcatcctcactatctgctggacaccaatatagctatcctcaaactctttccgggcatacaagagaacgtcgtagccgctacactcgccatcgaaggattgaaggcagtggtactcgaaacgtatggttcgggcaacgcttcccgcaaggagtggtttctgcggagacttcgtgatgccagcgaacggggtgttgtcattgtcaacgtaacccaatgtagcgccggtagcgtagagatgggacgttacgaaacgggatatcatctgctgaaggcgggcatcgtcagcggacacgacagtactaccgaatcggccgtaacaaaactgatgtttctgttaggacacggatattcgccggacgaagtacgccggaggatgaacgagtcgatggcaggagagattagtatcgatttgtcaaaatga

SEQ ID NO: 4823 - DNA, 2511 bp, B.fragilis
gaaactattttaaaacgaaaatatattcaaatgaagattattattattggaggcgtagcaggaggagctactactgcagcccgtatcagacgttcggacgaaacagcggaaatcatcttgttggaaaaaggaaagtacatatcttatgccaactgcggactgccctattatataggggacgttatcgaagagcgtgagaaactattcgtacagactcccgaagctttcggagtacgtttcagggtagacgtgcgtaccgagaatgaagttatttttatcgaccggaagaaaaagacagtaaccgtccgccttaagagtgaagacacttacgaggagagttatgacaaactgttaatatccaccggtgcatctcctgtacgcccaccattaccgggcattgactcaaccggcatctttactttgcggaatgtagcagacaccgaccgcattaaagcatatgtcaacaatcggcctccccgccgggctgtcgtgatcggggccggattcatcggactggaaatggcagaaaacctgcacgcactgggagcgcaagtatctattgtcgagatgggcaaccaggtgatggcacctattgacttttcaatggcagcactggttcatcaacatttgatggagaagggtgtcaacttatacctggagcaagctgtcgcatcgtttgagcaagcaggcaaagaagtgaaggtagtcttcaagaacggacaatccatcctggcggatatcgtgattctatctatcggcgtgcgtccggagacaacgctggcaagagctgccgaacttacgatcggtgaagcgggaggtatcgcagtaaatgattatttgcagacttccgacgaatcgatctatgccatcggtgatgccattgaattccgccatcccattacgggcaaaccttggctgaactatcttgccggacccgctaaccgacagggacgtattgttgccgacaacctgctgggtgcacagattccttatgaaggagccatcggtacctccatcgcaaaagtatttgacatgacagtagcctcaaccggacttccgggaaagcggttaaagcaggcgggcattgtatatgcatcttcaaccactcatccggcctcgcatgcaggatactatccggacgctatgccgatgagtatcaaaataaccttcgatccccaaacaggcaagttgtatggcggccaaattgtggggtatgatggcgtggacaaacgaattgacgaactttctcttgtcatcaaacacgagggaacgatctatgacctgatgaaagtggagcaggcgtatgcgcctcctttctcttcggcaaaggaccccgtagccatcgccggttatgtagccgaaaacatcatcctcggcagagtaaaacccgtatactggcgcgacctgagagatatcgaactgaaagatgtgttcctgctggatgtgcgtacaccggacgaatttgcattgggttcactgcccggagcagtaaatataccattggatgaaatacgtgaccgtattgctgaacttccttcgaacaagccaatctacaccttctgcgccgtagggctgagaggatatcttgcttaccgcatcctgatccagcacggtttcaaagaagtatataacctctccggcggattgaagacctatcgtgctgctaccgctcccatcatcttgcacgaaaatgaagaaacagacgacacgccttctgcgcaagacagcccggcgaaaccttctgtgacagctgaggcaccccaaactacaacggctgcaaatcctaagacaatccgggtggatgcctgcggattacaatgtccgggcccggtcctaaagatgaagaaaacaatggatacgcttgttccgggcgagagagttgaaattgtggctacagacccgggattctcgcgggatgctgccgcatggtgcaactctaccggaaataaatttatctccaaggatagtaccggagggaaatcggtagtagtcattgagaaaggcgaaccccaggcttgtaacctgactacgacatgtgacagcaaaggtaaaactctgattatgttcagtgacgacttggacaaggcacttgccactttcgtcctggccaacggcgcagctgccaccggacaaaaggtaactatcttctttactttctgggggctgaatgtgattaagaaattgcataagcccaaagtggagaaagacattttcggcaagatgtttggtacaatgctcccatccagttcgctgaaactgaaactttctaaaatgagcatgggaggtatgggtggaaagatgatgcgatacatcatgcaccggaaaggcatcgactcactggaatccctgcggcagcaggctctggagaacggggtggagtttattgcttgccaaatgtcgatggatgtgatgggagtaaaacgtgaagagttgcttgatgaagttacggtaggcggagtagccacttatatggaacgtgccgataatgctaacatcaatctgtttatttaa

SEQ ID NO: 4824 - DNA, 1023 bp, B.fragilis
attagtggtagaatgagttatttaaaaaatataattacttacttttttcatcatccggcatcggacggagtggtggaaagagtacatcaacgactggccgatacaaacagcggacaagagaaagaagaggtcttgtccggtatttgggaacagatcggttttccacaggcggatgaacatcaaacgctgagagcttttgaaaagctggaacaacagattggaggagattctttaaaatcggaatcttctttttcgcgttttcgtattccccgatggagttggattgctgcttctatcatcgtccccttattactattgttcggttccgcttacttatacaaagaaactcttatcattaagaacgaacttagcaatgtgactttcattcaatattatgttagtaatggaaaacgggagcaagtcactttacccgatcgatcgaaagtttggcttaattccggttctttgctgatctatccgtctgcgtttataggaaacgaacgtgaggtctatctggctggtgaaggctatttctcggtgacaaaagataaagaatgcccatttattgtaaaaacgaactctgtttctgtaagtgtacttggtacggaattcaatataaacgcttatccgaatatagataaggtagtgactactttggaagaaggatctatccgtatgtcgctgaatcgtttcgattcatcctatttgttggagccggatgatcagattgtttatattccgtccaccggacatatagagagaaaacgcgtgaaggcttctgattattctgattggagaggtggaggtttgtatttcagtaatagtccattcaaagaagtgatacagactatagaacgtacctattcggttcaggtacatttgcagacttctatttatcaatccaataatctgactattcatttctatcctaatgagtccatcgagaatattatgatgttgattaaagaaatgatccctggacttgaataccagatagaggggaaagatatttatatagattaa

SEQ ID NO: 4825 - DNA, 1536 bp, B.fragilis
tattggtctggatattactttctaagcaataaaaaaataaagaatgatatgaaaaagataatttatatattttccctgtttatcacagtaattggtttattaggctcttgcattaacctggaatccgaatcatatgactcaattaatacaactatatttcctactaatgcagatgatgctgatgcattggttattgcagcagcttacggtccgttccgtgcagatgggtatagcggattatttcaatgtgctaaaggtggtttggcctctaatacagatatgtctaccgacctattggattgtaaatggggagattcgtggtggccggctgtattacagttgaatttcactgctacctctgatattcctacttctttttacggaacatgggcgaatcatatcggaaagatgacattgacattagaccgtatctctggtattgatatgaaagaagaggaaaaaacacgtttaattgccgaaacacgttgtgggcgtggatggttggcatatattctttacgacttgtatggccctattcagattccttcattagaagttttacagaatcctacccaaaaggttattgtaccccgttcttcaaaagaggaaacagtgaagttgattgaagatgacttgaaagcggcagctgaggtacttcctgctaaatatagtaaatctgatgagaactttggacggttcaccaaaggactggcatatacggtgttgatgaaactttatatgcatgaaaaagaatggggcaaggctgtggaatgtggcagagaagtcatgaaatgtggatattcgttggttactaattataaggacatttttactttagacaatgaaggtaatgatgaaatgatcttttcatgcattgaaaccagaggagtaaacgaacagatgtggcatgcgcatgtgttgccaagcaactatcctacaactaatccgaacatacaaaaatggaatggttatcgtatgccatggcagttttaccacagtttcgatcctaaagacaagcgcctggaagttatctgtagtgaatatgtaggaacagatggagtgacatacaatgaaactaatcccggtgagtatttggataaaggggctttacccatcaaatatggagaagatctgacacaaaccagtgaaaatagtgaagtcgatgtggttgtttaccgttatgccgatgtattgactctgatggctgaggcattggcacgtagtaataatgcggttactcaggaagctgtggaccgtctgaatgatgtacatacacgtgcaggactggctgcttatcagttgagtgattttacctcactggacgattttcttagagctgttcttaaagaacgtgggcatgaattatggggtgagggttgtcgtcgcagtgatctgatccgctatggattgtatatcgactatgctatcaaatacaaaggatcgactaccgcaaaagagtatatgaacctgatgcctttgccacagagtgtcataacggaaagcagtggtcaggtcattcagaatgaaggatactaa

SEQ ID NO: 4826 - DNA, 1356 bp, B.fragilis
aactctgtgggactctgtggtgcaccgactccgaaaccatttataaaaatacccatgaaatattatagtactaacaaacaagctccgcttgcttcgcttgaagaagcggtagtcaaaggacttgcttctgataaggggctattcatgcccatgaccatcaagcccttgcctcaagagttttatgacgagatagagaatctttctttccgggaaatcgcttaccgggtggcagatgctttctttggagaagatgttccggcggaaacgctgaaagagatcgtttatgatacgttgaattttgatgtcccgttggtgccggtgaaggagaacatctattccctggagcttttccacggtcctacattggcttttaaagatgtaggtggacggtttatggcccgtttgttgggatacttcatccggaaagaggggcggaaacaggtgaatgtgctcgttgccacttccggagataccggtagtgcggtagccaatggctttttgggggtagagggtattcatgtgtatgtgctctatccgaagggaaaagtcagcgagatacaggaaaaacagttcactacgctggggcggaatattacagccctggaggtggacggaacgtttgatgactgccaggcgctggtgaaagcagcctttatggatcaggaactgaacgaacagttgttgctgacctcggctaactctatcaacgtggcacgtttcctgccgcaggcattctattatttttatgcctatgcgcaattgaagaaggccggccgggcagagaatgtcgtcatctgtgtgccgagcggaaactttggtaacattactgcaggcttgttcggcaaaaagatgggcttgcccgtccgccgttttatcgccgccaacaataagaatgatattttctatcaatatttgcagacaggacagtacaatccccgtccgtccgttgccaccattgccaatgcgatggatgtgggtgatccgagcaactttgcccgtgtgctcgacctgtatggcggttcgcatgcagccatcgctgccgagatatccggaacgacgtacaccgacgagcagattcgtgaaagcgtgaaagcgtgctggcagcagacgggttatctgctcgatcctcatggagcatgcggttaccgtgcattggaggaaggcttgcagccgggtgagacaggcgtattcctcgaaacggcccatccggccaaattcctgcaaacggtggagagcatcattggtaccgaggtcgaaatacctgctaagctccgggcttttatgaaaggcgaaaagaaaagtttgccgatgacgaaggagtttgctgatttcaagagctatctgctgggcaagtag

SEQ ID NO: 4827 - DNA, 1389 bp, B.fragilis
gacctatttatcaagagatcaatggcaaaagagaaaaccgtttatgtatgcagtaactgcggacaggaatcacccaaatgggtgggcaaatgtccttcgtgtggcgaatggaatacctatgtagaagagattgtccgcaaggaagttccgaataaacgtccggtatcaggcatcgaatcgcccaaagccaaacccgtcaccctaagcgagatcgaagcggatgaagaaccccgcatcgacatgcacgacgaggagctgaaccgggtgctgggaggcgggctggtacccggatcgctggtactgatcggtggcgaacccggcatcgggaagtccacactggtgctccaaaccgtgctccacatgcctgagcggaggatactctacatctcgggagaagagagcgcaaggcaactgaaacttcgtgccgaccggttaacccgaacttcgagcgactgcctgattgtctgcgaaacatcgttggaacagatctatgtacatatcaaaaatacacgtccggacctagtaatcatcgactccatacagacgatatcgaccgaaagcatcgaatcgtcaccgggaagcatcgcgcaagtccgggagtgctcggcatccatcctccgttttgccaaagagacgcataccccggtgttgctgatcgggcatatcaacaaagaaggcagcattgccggaccgaaggttctagagcacatcgtagacaccgtactccaattcgagggagaccagcattatatgtaccgtattctgcgcagcatcaagaaccgctttggaagtaccgctgaattgggcatctatgagatgcgtcaagacgggcttcgccaagtcagcaacccttcggaattgttactgtcgcaggaccacgaaggcatgagcggggtagccatcgcatctgccatcgaaggggtaagacccttcctgatagagacgcaagcacttgtcagctctgcggtttacggcaatccgcaacgttcggcaacgggattcgatattcgccgcatgaacatgctgctggccgtattagagaaacgtgtcggatttaagctggcacaaaaagatgtctttctaaatattgccggaggactgaaggttaacgaccctgccatcgacctggctgttatcagtgccatcctttcatccaatatggatgctgccatcgaacctgaggtttgcatggccggagaaatcggattatccggtgaaatccgtccggtaaaccggatcgaacaacgtatcggtgaagctgagaagctcgggttcaaacggttcatcctacctaaatacaacatgcagggcatcgatacaaagaagctgaggatagaactggtgccggtaagaaaggtggaagaagcattccggacgctcttcgggtga

SEQ ID NO: 4828 - DNA, 918 bp, B.fragilis
aattgtattattatgctactattccaaactacacaacaagtcgccgattccctgcaagtggcggctgagaagctggaccaggctatagcccaggcagacgggctcgataagttgggactgatcacccaacaactgatagactcgggcatacaggccggaggacatattctgaaagcggtcattgtatttttggtcggacgttttctgatccggatgctgaaccgtctggtcggccgggtgatggataagagaaacgtggatatcagtatcaagacttttgtaaagagtctcgttaatatccttcttaccgtactattaattgtttccgtggtaggcgcattgggcgtcgagacgacttcgtttgctgctttgctggcttctgccggtgtggctgttggtatggcgctttccggtaatttgcaaaattttgccggcggactggttattttactgttcaaaccctataaggtaggcgactggatcgaagcacaaagtgtttccggtacggtcaaggaaattcagatattccatacaatcctgacaactgccgacaacaagctcatctatgtgcccaacggggctttaagcagtggagtggtgactaactatagtaaccagaagacccgtcgcgttgaatggatctttggcgtcgattatggcgaagactataataaggtggaaaaagtggtacgtgaggtgctgactgccgataagcgtattctcaatgatcctgctccgtttatagctctgcatgcgctggatgccagcagtgtgaatgttgtagtccgtgtttgggtggagagtggcgattattggggcgtttatttcgacataaacaagacgatttatgctacgttcaatgagaaaggcatcaattttccctttccgcaacttacggttcatcaggctccgaattga

SEQ ID NO: 4829 - DNA, 1470 bp, B.fragilis
atgaacattatgaatcagaaattattacttggaagtgcactgctcgtgggaatggcttctacacagcaggcgttggcccggcagaagaaagcaaaggaacaaacccgtccgaatgtcgttttcatattggctgacgatttgggatacggagacttaagctgttatgggcaggaaaagtttgagactcctaatatcgaccggttggcacagaacggaatgcgttttacccaatgttattcgggaacaacggttagtgctccctcacgttcgtgtctgataaccggaacccatagcgggcatacggctatccgtggaaataaagagcttgctccggaaggacaattcccattgccggaaaactcacagactattttcaatgatttccgtaatgccggttatcgtacaggtgcctttggtaaatgggggcttggctatatcggttccgcgggggacccttacaaacagggaatcgatcagttttacggatataattgccagttgctggcacacagctattatcccgatcatttgtgggacaacgataaacgggtagatttgccggacaataatctcaatgtgcaatatgggaagggtacttattcgcaggacctgattcactctaaagcattggcttttctggatgaagccgctaaggagaaagatcaacctttctttatgtggtatcctaccattattccgcatgccgaactgatagtacctgaagatagtattattaagaagtttcgtgggaagtaccccgagaagccttatcgtggagtggagcctggaagtcctgctttccgtaaaggaggatattgtactcagttctatccgcacgctacatttgctgcaatggtctatcggttggatgtatatgtagggcagattgtacagaagttgaaagatatgggagtatacgataataccattatcatcttttcgagtgataatggtcctcatatggagggtggtgccgatccggactttttcaacagtaatggcatatggcgcgggtataaacgtgacgtgtacgaaggtggtatccgtgtacccatgatcatatcgtggcccggacacgtacaacccagtacggaaaccgatttcatgtgttcattctgggacttaatgcctactttcagggaagtgttgaatccgaaagcggatacccggaatatggatggtgtcagtatacttcctctgttacaaaaccgtaaaggacagaaagaacatgaatatctttatttcgaatttcttgagatgaatgggcgtcaggcagtccgcaaaggtgactggaagcttgttcacatgaatatacggggaaataagccctattacgaattatacaacctggcttctgatccgtcggagaagtacaatgtgctgaatcaatatcccgagaaagcggatgaattgaaagcgattatgaaagaagcccatatagaagattccaattggcctttatttagataa

SEQ ID NO: 4830 - DNA, 1485 bp, B.fragilis
tctcttcatatctttataatgtttaggttaattaaaaaaatcttgccctggtaccttaaggcgtttgcagaaaataacaagactcttgttaaaaggttcgcaaagaataatgttaaaatgcagtatgattacttggaggctttggtgaaagatctatctttgtacaaaattaaaaccgaaataaatatgaagaacctacgcatctggcagacactttcccttttcattcttttgctgtccataactcttcctttatcagcaaagtcagatttgctgacgaagttgaatacaattacccttatcatccgtacccaatcgttagagacctctctctttgcggaaaagtatttgttacgtttcaaacagccattagatcatagtcatcccgaaaaaggatctttcagccagcgggttatcgttgcgcatgtgggatatgaccggccgacactgatggtaactgaaggctacggagctgctcgttccctgaatcccggatattacgaggaactgtctaagctgttcaataccaatatcattgcagtagaacatcgctatttccttgaatcgacccctaaaccgaaagactggaagtatctgacagcctggaattctgccagggatctgcatgctattcgtgaggcttttcgttccatttatccgggaaaatggattgctaccggaatcagtaaaggaggacagacagcgatgctttatcgtacttactttccggatgatatagatattacggttccttatgtggctccactttgccgttcggtcgaagatgggcgtcatgagccttttctgcgaacagtagctatgcccgatgatcgtcaaaaggtggaagatttccagatggaggtattgaagcgtaaagctgctttactgcctcactttaaaaaatactgttcggtgaggaagttgcagttccgtgcgcctgtagaggacatttatgattatacggtgcttgagtattctttttcactttggcagtggggtattccggtcagccggattccgtcagtttctgcttcagacaaggagctgttcgatcatttggttgctatcagtgcaccgtcctattttgtgaaagagggatctaatacttcgttctttgtccaggcggcacgtgaattgggatattatggatatgatattcgtccgttccgggagtatctttcaattggaacaagtaaagattatcttcgccgtttgatgatccccgaagagcttgcagatatggaatttgacgagactctgagttacaagataacccgttttttgaaagagaatgatccgaaaatgatttttatttatgggcagtatgatccgtggacagcagccggagtcacctggctgaagggaaaaaagaatattcatgtgtttgtacagccgaagggtagccacatggctcgtattcacactttgcctcaaaaagagaaagaagaagccatcggattgataaagaagtggttggaagagtga

SEQ ID NO: 4831 - DNA, 1974 bp, B.fragilis
tacatgaatatgaaaaagatattattggttttaaccctctttacagggatgatactggcgggatgcaacgatagcttccttgagaaatatcctgtaaccagcctgacggaagaaaatgcattcaagtcgtatgacaattttaaggcctttatgtggccatgttatgaaatgttctctaatacgaatatcgccacttctacaacggcaatcgggcgtaactctcactatatgggtgatgtgtatgccggatacctgaatcagcgtggagccagcagtcagaataaatatgcgtttcagacagtgaccaatgctacgtcgggtaatggatggaacttctctacattcattcgccgtatcaacctgatgctttcgcatgtggatgattctgatatgacagaagctgaaaagaatcactggaaagctgttggatatttcttccactcattttggtatatggagttgatagaccgtttcggtgatgtgccttggatcgataaaccactggacgaaacctctgaagaagcttacggaacgcggatgcctcgtctggaagtggctgataaagtcctggagcgcttgcaatgggccgaacaaaatatcggtgatgcgtccgtttacgagaaaaaggacggttcgaatactatcaaccgtgattgtgtacgtgcggctctttcacgtttcacacttcgcgaagcaacttggcgcaaatatcatgaattgggtagttatgacaaatacttcgatgaatgtatccgtgtatcgaagctgttgatggcggattatcctacattatattatggtaccgacggacagccggcagccggatatggtgaaatgtggacaacagaggatctgagtaaggtacagggagtcattctgtatcagcagtggctggaaaccattaaacccggacattcgtgctattatgaacacacctcttcacatgatatagaaatgcatcagggaacggtagacttgtatttgtgtaaggatggcaagactatttcccattcagaccaatatcagggagataaggatatttatgctactttccgcaatcgtgacccgcgtatgtatcacaccatcatgccgccttataaggtaaaagatggtaagggggattattccacatggtcttataccagtgatcctgccgatcgcgaatatattgatatcatgggagctaacgagtcgtgcagtaatccgggtattggcatgaagcgcttgccgggacaaaactggagtgcttcattggtacgtcgtgttcctaacctgcaagggggcgcacaatacacaattgaaggaaagaaatatggaccgcatgcctatgtggcttcccgttcgggatattatgtatggaagaactgggataattgggaggaaaactataataatgcccaggtgaatactgccgacaaacctgtctttaaaattgaagaggtcttgttgaactatgcagaggctatgttcgaaacgaatcaatttacacaaaccattgccgacgagacgatcaacaagttgcgtaaacgtgccggtgtagctgatatggtagtagcccagattgatggtaactttgacccgaaacgtggaaaatattatccgaaaggaaatgataacggcatactcgttgatccggtattatgggaaatccgtcgtgaacgtattatcgaattgatgggcgaaggatttggtttttatgatgtacgtcgctggagaatggctccttggttcgtcaatatgcagcagaaaggtatgtggatttcaaagacggaactcagctcactgacgttgctcaacgaaatgaccggaacttcagacggggcgaacggatcgatgaccgaagggtatatctatctattcaacgatccgttgaaggaaggaaaaggctggttggagaaatattatctctatcaggttccgttagaagaaatagctcttaatcctaacttgacacaaaatccgggatgggaataa

SEQ ID NO: 4832 - DNA, 1404 bp, B.fragilis
cagaaaaccattatatttgcacgccctgttttttaccattcacattttaacttatcagatatgagtaaaattctgattattgatgacgaagtgcagattcgtggtctgctggcacgtatgatggaacttgaaggttacgaagtgtgtcaggccggcgattgtaagacagcactcagacaattggaacttcaaatgcccgacgtggctttgtgtgatgtatttctgccggatggaaacggggtggatctggtgacggagatgaagaaaaaatctccgggagtggagattattctgctgacggcacatggaaacatacctgatggtgtgcaggcaatcaagaacggagctttcgattacataacgaaaggggatgataacaataaaatcattcccctgatcagtcgcgctgtagaaaaggcacggatgaatatccgcctggacaaactggagaagaagatgggactgatgtattcgttcgattccatactcggtgaatcgaaagcattgaaagaagcggtttcgttagcccgtaaggtatcggtgactgatgtacctgtattgctgacgggtgagacgggaaccggaaaagaggtgtttgcccagtccatacattatagtagtaagcgtgcccggcaaaactttgtggcagttaactgctcttcgtttagtaaagagttgctggagagcgagatgttcgggcataaggcgggttcctttaccggtgcgttgaaagataagaagggactttttgaagaagccaataacggaacaatctttttggatgaaatcggtgagatggcttttgagttgcaagccaagctgttgcgtatcctcgaaaccggcgaatacatcaagataggtgacacgaagccgacccacattgatgtgcgtatcattgctgctacaaaccgtaatttacctgccgagatagctgcgggacgttttcgtgaagatctgttctatcggctctccgtgtttcaggtacatcttccgcctttgcgtgaacgtacgggagatattaagatactggctgaatcgtttgtccgttccttctccgaaaaactttcacatccggtcaataggattgctcccgcttatctggaggccctatgccaacaaccctggaaaggaaatatccgcgaattacgtaatgtaatcgaacgcagcctgatcgtttgtgagggcgaccgtctggatgtagacgatcttccgttggaaatacagaacagccactacgagaaatccgacgaaggaatgccgggcagttttgaactttcggctatggaacgcaggcatatagcgagggtattggagtatactaaaggcaataaaacagaagcagcacgtttactgaaaatcggattgactactttataccgaaaaatagaagaatataagctctga

SEQ ID NO: 4833 - DNA, 1248 bp, B.fragilis
aagatattaataacgaaaacaagatataaaagtatggaaccaatcagactgaataccattgaagaggcgatagctgacttcaaagaaggtaattttgtaattgtggtagatgatgaagatcgtgaaaatgaaggtgatttcattattgctgccgagaagattactccggaaaaagtaaatttcatgctgactcacggtcgtggagtactttgtgctccaatcacagaagaacgttgcgctgagttggaactggatatgcaggtgtcgtccaacacttcaatttacgaaactccgtttactgttactgtcgacttgcttgaggggtgtacaaccggagtttccatgcatgaccgtgcaatgactattcgcgctttggctgatccgaagacaaaacctgccgacctgggacgtccgggacatatcaatcctttgcgtgcccgctctcgcggggtacttcgtcgtgcaggtcataccgaggcaagtgtcgatctggctaagcttgccggattatatcctgccgctgcattgatcgaaattattaatgaagacggcaccatggcccgtctgcctcagttggtagaagtagcccgtcgcttcggattgaaaataatctccattaaagatctgattgcttatcgtctccagatggagtctattgtcgatagaggtgttgaagtggatatgcctacacagttcgggcatttccgtctgatacctttccgccagaaatcaaatggaatggaacacattgcattgataaagggaacctgggatacagacgaaccgattctggtgcgtgtgcactcttcttgtatgacgggtgatatctttggttcatgtcgttgtgagtgtggtgaacagcttcacaaagctatggaaatgattgaggctgccggtaaaggggtgatcgtttacatgaatcaggaaggtcgtggcatcggcctgatgaataagattgctgcttataaacttcaggaagaaggttatgacacggtagatgccaatctccatttgggttttgatgccgatgaacgtgattatggagtcggtgcacagattttgcgtgagatcggagtgaagaagatgaaactgatgactaacaatccggtgaaacgtatcggtctggaagcctatgggttagagattaccgagaatgtgggaattgagattaagccgaatccttataatgaacgctacctgaagactaagaaagatagaatgggtcatacgcttcattttaataagtaa

SEQ ID NO: 4834 - DNA, 2880 bp, B.fragilis
actataaaaataattaatttaatactgtatgaaatgaaaacaagaaccagaacgaaaatgctgttgctcttaggagttcttttatttggcttcactgtttcggcatggtcacaaaaagtttctttggattttaataatgagaaggtagaaaaaatactgtcttctataaaagcacaacaaggaatggggttggtattcagcgatcagttgatcgatgtgaatcgcaaaatttctattcaagtgaaagatgccagtctggatgaagcattgtctaaactgttggcaggaacgaaggtaacttttgaaataaaaatcaataagatttattttattgaaaaaaaagcggaccaacagtccggttgccgaaagaaaaaagtatccggagtggtgaaggatgctacaggcgaaccgattattggtgcgaatgtcgtggaaaaaggagtcggtaccaatggggtgataacaaatctggatggggaattcacactggaagttccggaaaatgcttctttgattatcagttatatcggttatctccaacaagatgtgtcgacaaaaggaaaagatgcgtttaacatcatcatgaaggaagatacgaagaccctggatgaggtggttgtagtaggatatggggttcaaaagaaagtaaacttaacgggagctgtcgctgctgtcgattccaagtcgttgcagaatcgtccggtaacaaacgtttcgaatgcgattcagggacttttgcccggagtaacggttatctccgggacggggcagccgggaaatgataatacaaccatacgggtacgcggtgtcgggactctgaataattctaatccgatgtatgtggtagacggtttgccggtatccagcataaatgaagtggatcccagcgatatcgagaacatctcggtactgaaagatgcttcttcagctgctatctatggttcgcgtgcggcaaatggagtaatcttgattactactaaaaaaggaggagataaagctcccacgcttcgttatgatggctatgtggggtggcagaaacctacggctcttcccgaatatctgcactcgtgggaatatgcgaagttgtataacaaagctatggttaacgaaggaaagaatccgatctatacagatgaagagatcgaaaagttcagaaatggttcggatcctgacaattatccggatacagactggcagggattattttataagaccggtttgcagcatagccaccgcgctgaaatttcaggtggtacggataaaatgacctatatgttttctgctggttacttgggacaggacggtattatagatattgctaaatatgaccgttattcggtgcgaggcaatatgaatgccaagatgggcaagttcacggcaggtatgaatctttcttttacttatggggaggcacaagaaccggtgagtggttttaccggtgaaatgtctaacatcttttcgcagatcaatcagatagctcctttcattccttataaatattcaaatggatattatggatatgccaatgatggtaatccacttgcatttattgaagaaggtaatttacgtactaccaaacagcatattaccagagccatcggaaatgtaagttatgaaccgattaaagggttgaaaattcaggaaatcgtgggttacgaatataaatcgatttctgatgaaaaattcattaaggatattcaatattataactggaaaacaggtgagcctacaaagtatcagggacctaacaatcaaactgatgaacgtaaaaatggtctgaaactgaacttacagactttggtcagctataacaatacgtttggaaaacatactgtaggtgcattggcaggatacgaacaggaatattaccgtgaagactggacaaaaggatatcggaaaaactttctgaacaatgatctttgggagttgaatgccggttcacctgatggtcagactgcagatggttcggctaatgaatatgctttgcgttcattcttcggacgcttgacttacgactatgataatcgttatttggttgaggcaaatatccgtcgtgacggaacttcacgtatctttaaggactcacgttggggagtattcccatctttctctggtgcatggcgaattattaatgagcctttcatggaaggaacccgtaatgtgttgtcggatcttaagctgagaggcggctggggagttttgggtaatcaggctatttcttactattcttaccaatctgtacttgatcaggctaattattcgtttggcggaactgttgtacagggggtagcaccggtcgatggagctaaccgcgatttgatctgggagactaccgagactttgaactttggacttgacatggggtttctgggcaatcaatatactttatctatcgaaggataccgcaaattgacgtatgatattctgatgaaattacccgtaagtaccttatatggtttaaatgcaccttatcaaaatgcaggtaaagtaaagaataccggtttggagataacggcaggttataaattgaatactcatggctggaatttccaggtatcggcaaatgccgcatataataagaatgaagtgatggacctgaagaatggtggtgcacgcatttggagtggtaaatatttcaaccaggaaggatatgccatcaactctatcggaggatacattgccgagggactttttaaaactgaagaagaggttgctaatagcgcaacgattcccggcactgatacagcaccgggcgacatcaagtaccgtgatattaataacgatggaaaaatcgatggagaagaccgtgtctacattggtaacaccatgcctaagtggacatttggcttgaatctgtttgccgaatgtcttcaccacggg

SEQ ID NO: 4835 - DNA, 1836 bp, B.fragilis
agatatccgatgataaaacaacgtaaaatagaattgctggctccggccaaaaatctggaatgtggcatagctgctattgatcatggagcggatgctgtgtatatcggtgcgccgaagtttggtgcccgcgcggcggcagtcaattcattggaggacatagctgctttggtagagtatgcccatctgtacaatgcccggatttatgtgacagtcaatactatcttgaaagatgaagaactgcaagagacggagaagatgatttgggctttgttccgtgccggtgtagatgcactgattgtgcaggatatgggaatcaccggtctgaatctgccgcctattccgctgcacgccagtacccagatggataaccgtacggtggagaaggtgcgatttctggctgatgccggtttccggcaagtggtgttggcgcgcgaactttcgctgcgtgagatcagcaagatacacgaagcctgtccggatgtacctttggaaatattcgtgcatggagctctttgtgtcagctatagcgggcagtgttatgtcagtcaggcttgtttcgggcgtagcgccaaccggggcgaatgtgcccagttttgccgtttgccgttcagtctggtcgatgctgagggacgggtgatcgtgaaggacaagcacctcctttcactcaaagacctcaatcagagtgacgaattggaagcactgctcgatgccggtgcctcttctttcaagatagagggacgactgaaggatgtctcttatgtaaagaatgtgacggctgcctatcgccggaagctggatgccatctttgcccgccgcaaagagtacgcgcgtgcctcgtccgggagttgccgttatgcctttaaccctcagctcgacaagagtttcagccggggctttacccattattacctgcatggacgtaccaaggacgttttttcgttcgacacccctaagtcgttgggcgaggagatgggtacgatgaaagaggcaagaggaaactatctgaccgtagcgggattgaaatcttttaataacggtgacgggatgtgctacatcgatgagcaaggcaggctgcaaggtttccgcatcaaccgggtggagggcaataagctttatccgcaggagatgccccgtatcaagccccgtacggtgttatatcgaaatttcgatcaggagttcgaaaagattctggctcgcaagtcgtccgagcgcaggatagctgtgtctgtccgattgacggatactcctttcggattcgccctgacactgacagatgaagatgataacagtgtaaccctgtctctggcgcgtgagaaagagccggcacgtacaccacaggaagagaatctgaaaacacagttggctaagtttggcaacacccctttcgaagcggtacgcatcgatatcgattttgccgggaactggtttctacctgcttcggtactcgccgattttagccggcaggccgttgagaaactgatttccgcccgccgtatcaattatcggagggaattatttgtactgaaacctaccgctcatgcctttccacaaagcacgcttacctatctgggaaatgtgatgaatgcacaagccgtttctttctataccgggcacggcgtggcaagcatcgctcctgcttttgagcgggcaccggcagaaaaggcggtattgatgttttgcaaacattgcctgcgctacagcatgggatggtgtcctgtccatcaacgggaacgctctccgtaccgtgagccttattacctggtgtcgacagatggtaaacgcttccgcctggagtttgactgtaagaactgccaaatgaaagtgaatgccgtatga

SEQ ID NO: 4836 - DNA, 2124 bp, B.fragilis
gaggtgcagatagtatccacacgtgccacttcaaaaaccccggtggcattcaccaacgtttcgaaagaagaactcaaaaagcagaacttcgggcaagacatcccttttctgctcagtatgactccttcggcactgaccaccagtgatgccggagcaggtatcggttacaccacactgcgcgtacggggaacagacgggacacgcatcaacatcacagccaacggaatcccgatgaatgatgccgaaagccatacactcttctgggtaaatatgcccgactttgcttcgtccgtaaaggatatacaggtgcagcgcggtgcgggtacatcgaccaacggcgcaggcgctttcggagccagtgtcaatatgcagacggaaggtatttcaatgcaaccttatgccgaaataaacgcctcgtacgacagcttcaacgctcacaaagagacagtaaaattcgggacgggactgctgaaagatcattgggcattcgatgcccgcctgtccaccatcggtacggacggatacatagaccgggcatcagtagacctgtactctttctacgcacagggtggatattttgccgacaatacttcggtgaagttcatcaccttcggcggtaaagaaaagacgtatcatgcctggaattatgcaactaaggaagagatgaagaaatatggcccacgcttcaactcatgcggcatgtacacagatgaccacggacacatccgcttttacaaagaccagacggacaactacctgcaaatgaactatcagctcttgctgaatcatactttctcggcagcatggaacctgaatgcggcactccattatacaaagggggacggctactatcaggagtataaagaggatcgcagcctgaaagagtatcgcctgcatccgtttatgtacgatggaaaggaagtggaaaaaagcgacctgatccggcagaagaagatggacaatcactttggcggcggcgtattctcggtgaactacccccatcagaacatggacgcttcgttggtcaacgcactgaactactacgacggatggcacttcggacgggtgatctgggtgaagaactatatcggcgagttgctgcccgaccacgaatattaccgtaacaaagccaagaagacggacgggaacctctatctgaaagccaactacaatctggtggcaggcctcaacgcgtatgccgacctgcaataccgctacatcaactataagatacacggtgacaatgacaagtacgattacaacactgacggactacaaaagctcgcagtcaacgatcacttcaactttttcaacccgaaagccggactgaactgggatatcgactccaacaaccgggtttacgcctctttctccgttgcccagaaagaacctacacgaaacaactataccgatggtaacgcagacgaatatccgaaggcggaaaaactgtacgactacgaactggggtatacctaccgaaacacatggttgagcgccggagtcaacttctactatatggactacaaggaccagttggtgctgaccggagaattgaacgaaataggcgaagccatggcacgcaacgtgccggacagttaccggacgggcgtagaactgatgctaggagttaagccatgccgatggttccaatgggacatcaacggtacgctgagcaagaaccgggtgaaaaacttcaccgaaaaactgtacgaagacgagtggaagaacccgatcgaagtggaacatggtaacaccccgatcgctttctctccggactttatactgaataatcgtttctcgttcagccacaaaggattcgaagccgccctccagtcacagtacgtcagcaagcagtatatgagcaatgccaagcaagcagagcagacactcgatgcttattttgtgagcaacctcaatctggcatatacattccaattgcgacacgtgaagtcggttacagtgggattcaccatctacaacctcttcaacgaaaagtatgaaaacaacgggtatgccggaagcggctatacgctgaaggacggcaagcccgaacgctataattatgccggctatgccgcccaggcaggtacaaatgtaatgggtaacatctcgatccgcttctaa

SEQ ID NO: 4837 - DNA, 363 bp, B.fragilis
aaagtaaagatgaaaaatgtcataaataaaaacacgattttagccttgatggtgattggaatgatgtgcttctggggaagtatgaacgcgaatgcccaacagtttaatgttcagggagatctcgtaagttcatatgtctggcgcggaatgtatcagacaggagcgagtatccagccgactttgggatttagtgtcggaaacttttcattgaccgcatggggctccaccgattttgacggaacttctgcttcggcaggagctgccgccaaagagatcgatctgacggctgcatacacaataagtcgttccggtctgaccggattggttgccgacttggggtggggcaggacagggagcacgtaa

SEQ ID NO: 4838 - DNA, 246 bp, B.fragilis
ttagtgaagattgtattgcttgcggaacttgtattgacgagtgtccggttggcgctatctctgaaggtgatatttactcaattgatcctgagcagtgtacagattgtggtacttgcgcagatgtatgtccttctgaagcaattcacccagctgaataatacaatccccaacaacaaagataaaggctgccttcctaatggaaagcagcctttatttatttcttttcagacgtttggcaaattataa

SEQ ID NO: 4839 - DNA, 375 bp, B.fragilis
aacatggagataaatgaattaacaggactgatactaaagaaagcttatgaagtacatactgttttaggacccggattactagaaagtgcttatgaagaatgcttatgctacgaattaatccaatgtggattaaacgtagaaaaacagaaagcactacccgtagtatataaaaacattaaagtagatgcaggttacagattggatattgtagtcaacaatgctgttataatagagataaaagctgtagaagaattacatcccgttcacaccgcacagctaataacctatttaaaactatcaggaatcaaatatggcctgcttatcaattttaatgtaagaagcctcaaagaaggcatcagaagatatattgtttaa

SEQ ID NO: 4840 - DNA, 336 bp, B.fragilis
ttatgccttgtaattagaaaaaagtatttatcttggcacacacaatcaataatgaatgaagctatgaaaaaagagaaaatacatttggaataccttctgaatgcgacctctaaaaatattctttggtcagcaattagcacacctaccggtttggaggactggttcgcagacaaagtagtatcagatgataaaacggtgaccttttgttggggcaaaaccgaacagcgtcaggctggtattgttgcgattcgggcatattcgttcattcgtttccactggcttgatgacgaaaatgaaagggactattttgaaattaagatgagttataatccttaa

SEQ ID NO: 4841 - DNA, 198 bp, B.fragilis
ctgacaaccgtagggaatatcaggacaaagaggagcaccgacagcggaaaccagtgtaacggcccggaaaataccggagcatggaaaccggtgacagccgaaacgacgatgcttgaaaaagccgctccggcaaaggtatacttcaatactgtaaacattccgaccgacttcagtattcggttacttgccaccagatag

SEQ ID NO: 4842 - DNA, 639 bp, B.fragilis
tcaagaaccgttatgaaaacaatgaaatatatttctcttagagtactggccatagcggcccttgctctggcctttgccatgccggccaaggcacagttatcagataatggatacgctaacgtggactggcagttcaacgcaccactgaagaatcactttgccgataaagccagcggatggggtatgaacttcgaaggcggttactttgtaactcctaatctcggactcggactctttatgaactacagcagtaaccacgaatacttcccacgcgcaactttccctgttggcgaaggaaccgtgaatactgaccagcaacataccatcttccagttaccttttggtgccgctgcacgttatcaaatgaatcgtggcggagcatggcaaccttatttcggtgtcaagctgggggccaattatgcgaaagtacgttctaactacaatatgttcgaaacccgcgataatacttggggattctacgtatcaccggaaatcggtcttaacgtatacccttgggcttacggtccgggtctgcatatcgccgtttactacagctatgctaccaacaaggccaatgtgctgacttacaatgtagacaagctgaacaacttcggcttcagggtaggtcttgccttctaa

SEQ ID NO: 4843 - DNA, 219 bp, B.fragilis
agaaagtacgtaggggttccggctataaataccgttgtggaaactgtggacacaagcttcgggataagggacaatgtcctcactgtggggctgttaacgaataaatcgggaatgtggtatgaatgttggggaggtactctccgttggtttaaaaccaagaggagtttacccagagaggtaaggggcattggttttaaaccaacaccccttaccttttaa

SEQ ID NO: 4844 - DNA, 183 bp, B.fragilis; identical to SEQ ID NO: 2683

SEQ ID NO: 4845 - DNA, 276 bp, B.fragilis
tcgcacgcagctttatctttgcaacaagcttttgtagaatcacaagcaacagaatcacttttacagcaagtagcagcagattccgctgcttctacagctactgaagtcgagtctgcggcagcatctgaattagctgttttgttgccaccacatgaaaccattgcaaaagaaaatgccaccattgcagcagctaaaaagaattttgtcttcatacttaaaatatttgctttaaacgtttataaatactcgattgcaaatataaataaaaataagtaa

SEQ ID NO: 4846 - DNA, 1014 bp, B.fragilis
atcatgaaagcattagtaacaggagccgcaggttttattggctcttatacggtaaaagcattggtagcacaaggttgtgaagttgtggggttggataacatcaactcttattatgatgtacagttgaaatatgatcgtttagctgataccggtataactaaagaatcgatcgagaaagacatattgttgccgagtgctaaatatccttcctatcgctttatcaagatggatttgacagatcgtgaaggattgaccaacttgtttaaagacgaacattttgatattgtggtgaatttggctgctcaggccggtgttcgctattcgattgaaaatccttatgcatatattgaatcgaatattgtaggtttcttaaatctgttggaatgttgtcggcattatccggtaaatcatttggtttatgcaagttcaagcagcatttatggactgaatgataaagtgccttatgctgaaacagataaggcagactctccggtgagtttgtatgcagcaacaaaaaagtcgaatgaactgatggcgcatgcttatagcaaactttatagtatacctactaccggtgtgcgtttctttacagtatatggtccttgggggcgtccggatatggctccttgtctgtttatgaaggcaatattaaatggcgaccccattaaagtattcaataacgggcaaatgcgtcgtgattttacatatatcgatgatatcattgcaggtctgatgaagatcattgctcatccttctgccgatcccattcctttctatatttataatattggtaattctgcaccggtagagctgatggatttcatttctgttattgaaaaaacagcaggtaagacagccattaaacagatgatgggtatgcaaccgggagatgtggtatgtacttatgccgatacgggccgattggaaaaggactttggctataaaccctctacttctatagaagaagggattcaaaaattctatgactggtatgtaggctatttcaataaataa

SEQ ID NO: 4847 - DNA, 1425 bp, B.fragilis
tttgtaaatcataaaataataaataaaaagatgaatacattatttgataagatatgggatgcacacgtagtgactacagtggaagatggccctacacagctctatatcgacagattatattgtcatgaagtaaccagtcctcaagcttttgccggattgcgtgcacgcgggattaaggtgtttcgtccggagaaagtatattgtatgccagaccataatacgccgactcacgatcaggataaaccgattgaagatcctgtttcaaagactcaggtggatacactgactaagaatgcagctgattttggtttgactcattatggaatgatggacaagcggaatggtattatccatgtggttggtccggagcgaggacttactttacctgggatgaccattgtttgcggcgattcacatacttccactcacggcgcgatgggagcggttgcttttggtatcggtacaagtgaagtcgaaatggtacttgcttctcagtgtattttgcagtcacgtcccaagaccatgcgcatcacggtggatggtaagttgggcaagggagtaacagccaaagacatcgctctctatatgatgtcgaaaatgacaacgagtggtgcgaccggatattttgtagaatatgcgggtgaagcgatccgtagccttacaatggaaggtcggttgacgctctgtaacctttctattgagatgggggcccgtggaggtatgattgcaccggatgaagtgactttcgaatatatcaaaggccgtgagaatgcacctcagggagaagaatgggatcaggcagtgcagtattggaaaactctgaagagtgaagatgatgcggtttttgataaagaagttcattttgatgctgcggatattgagccgatgattacttatggaactaatccgggtatgggtatgggcattacgcagcatattcctacaacggatggaatgaatgaaacaaccaaagcttcattcctgaaatctttggattatatgggatttcagccgggggaagcattgttggggaagaagattgattatgtgtttctgggtgcttgtacgaatgggcgtatcgaagatttccgtgcatttgcttctattgtgaaaggacatcagaaagctgaacatgtgatagcatggctagtgccgggctcttggatggttgatgcccagatccgcgaagaaggattggataagattctggaggatgccggttttgctattcgtcaaccgggatgttcgtcttgcttggctatgaatgatgataagattcctgccggaaagtattcggtttctaccagtaatcgtaactttgaaggacgtcagggacccggagcgcgtacactattagctagtccgcttgtggcagctgccgctgcgataacgggagtgatagctgacccgagggaactgatgtaa

SEQ ID NO: 4848 - DNA, 606 bp, B.fragilis
attgtaaataaaaagatgaaagcaaaattcaatatactcacaagtacttgtgtacctctcccattggagaatgtagatacggaccagattatacctgcacgttttttgaaagctacaacgaaggaaggctttggagaaaacttatttcgggactggcgttatgataagcaggggaataaaattgactcgttcgtattgaatgatcccacatatgggggacagattctcgtagccggaaaaaattttggctcaggatccagtcgtgaacatgctgcctgggctatcgctgattacggttttcgtgtcgtagtaagtagcttctttgcggatattcataaaaacaacgaattgaataatttcgttcttccggttgtggtaactgaagaatttttagccgaactgttcgattctatctttaaaaatcctaagatggaagtggaagtgaacttaccggaacagactatcacgaataaagccaccggaaaaagtgagcattttgaaatcaatgcctacaagaagcactgtctgatgaacggacttgacgatatagacttcttgttgactaataaagataaaatagaacaatgggaaaaggcgtcaaaatag

SEQ ID NO: 4849 - DNA, 1074 bp, B.fragilis
ttattgaataatatggattttaaaattgctgtattagccggtgacggtatcgggccggaaatctctgtacaaggtgtggaggtaatgagtgccgtctgtgagaagtttggacataaagtaaactatgaatatgccatttgcggtgcggatgccattgataaagtaggcgatccttttccggaagaaacttaccgggtttgtaagaatgccgatgcagttcttttttcggccgtaggtgatcctaagtttgacaatgacccgactgccaaggtgcgtccggagcaggggctactggctatgcgtaaaaaactcggcttatttgccaatatccgtcctgtccaaacatttaagtgtttggtgcacaagtctcctcttcgtgcagagttagtagaaggagccgattttctgtgtattcgtgaattgaccggaggtatgtattttggtgaaaaatatcaggataatgacaaagcatacgacacgaatatgtatacacgtcctgagatagaacgtatcttgaaagtcggtttcgaatatgctatgaagcgtcgtaagcacttgactgttgtagataaagctaatgtgcttgcttccagtcgtctatggaggcagattgcacaagaaatggcgccgcagtatccggaggtgaccactgattatatgtttgtggataatgctgcaatgaagatgattcaggagcctaaattttttgatgtgatggtgacggagaatacctttggtgatattcttaccgatgaagggtctgtcatcagtggctctatggggttgcttccgtctgcttctacaggtgagagtactccggtgttcgagccgattcacggttcgtggccgcaagcaaaaggcttgaatatcgctaatccgctagcgcaaattctttcggtggccatgctgttcgaatacttcgattgtaaagctgaaggtgcgttgatccgcaaagcagttgatgcttctttggatgctaatgtacgtacacccgagattcaagtggaaggtggtgaaaaatttggtacgaaagaagtaggggcatggattgttgattacatccggaaagcatga

SEQ ID NO: 4850 - DNA, 1587 bp, B.fragilis
ttggacgtaaaagctccaagcaatcagttgcctatgaaaagtaaatttcttccgtttttattattgctggctgtactgccggtgttgattttccgtgactacactccctctaacgagttacgttacttgagtattgttgacgaagcactgcgtaatggtgatatttttacgttcactaatcatggtattcagtatgctgacaagcctcctttgtatttctggattctgatgttgggcaagtggttgttaggcaatcatgccatgtggtttgcttcactcttctcttttattccggctttagtgatcatgttggtaatggaccggtgggtggaacgtgaagtttctgtagctaaccgtttatcggctcaattaatgttgatgagttgtggactctttttagggttggctgttgtattgcgcatggatatgttgatgtgtatgtttattgtgcttgctcttcgtactttttatcagatgctgaaagggcaaggcagtaagaactggaatcagtttctgtttcctttttatatttttatggcagttttctccaaagggcctgtggggatactggtaccattggggtctactttcatttttttgctgattaccggacgtgtgaagacctttggacgttattggggatggaaaacgttcgctgtattattgctcggatgtttcatttggttcggtggtgtttgttgggaagagggaggattaacttatctgcatgatttgttattccgtcaaacagtggggcgtgctgtcaatgcgttcgatcatagtgctccgttttattattattttatttctgtttggtattcgttagctccgtgggctctgtttctggtcggtataattattgccggggcttgtcgccgattgattcgttctgatatggagcgtttctttatggtcataattctcactacgttactgatgttatcttgtttcagtggtaaattggctgtctatttggcaccgacttttccattctttgtttatttggctgtacttttgttatctcatttccgctggaatcaatggttggcgttgacgttgcttcttcctgccgtcgtattcgtggcagggctgccggctcttattgtgctgggacgaatgccgggtactgaattcctgggacagaagcttttttatgtagccggtggaatattgactgtcagtggtggtacggctctgtattttctttatcggaagaaatcgttgaacaagactattaatgtgcttgccctcggattgttttgtgctgtctttgtgggaggttgggatgtaccggctattaatggtgagttgggttattccgagttatgccggaaagcagtggaactttctaaggagaaaaacgtatccggttattgtgtcctgaatgtacgtcgttctgaaaatatggatgtgtatctgcatgaaagagtgaaagaagtgacagaagaagaagtcttggataataaatatcagaataccattttgatgatttcgaacaaaaaaatacgttcgaacaagaaactggaagagtttgttaatggtaaagaacattacgttataggtcgtttttctgtaatggtactctaa

SEQ ID NO: 4851 - DNA, 192 bp, B.fragilis; identical to SEQ ID NO: 2482

SEQ ID NO: 4852 - DNA, 3096 bp, B.fragilis
tgtatgacaaaaagaactaacctgtttccgagtttaatcaagactcgtgaaatgaattgtctcaaaatagcaggtgctagtctactgctattatgtatttctcctcagtttgccgtggccgatgggctcaaacaggatgcggttaccattatgcaacaacaaaatctaaaagtcagcggcgtagttactgatgaagctggcgaacctcttatcggtgtatccgtattggtaaaaggaactactttaggaaacatcacagatctgaacggccggttctctttggatgttccggaagggagcattttggaaatttcctatattggctataaaacacagagtatcaaagcccagagagaaccaatgaacattgttcttaaagaagatgcccagaagttggatgaagttgttgtagtgggtttcggtactcaaaagaaagtcaatctgaccggatctgtgtctgctgtgacgggtgacgatatttcaaaacgtccggttgccaatgctgctatcctgctgcaagggcagattccgggacttcgtgtcaatcagggacttggacagccaggtggggaaggaacctcttttcgtatccgtggccaggggactttctcttccgccgggtcggatcctttgatcctgatcaatggtgtaccgggtagcatgacaaatcttgatcccagcgtgatcgagagtgtttctgtgttaaaggatgcagcttcggctgctatttatggagcgagagctgccaacggggttatcctggtaactaccaagcaaggtgcggtaggagataaggtgcacattagttatcatggaaatgtaggtttgcacacacccaccaagttatatgatcgtgtcaccaattctgtggaatatatggagctagcgaatctggcctggaagaactccggaaccggtaaacaatacactcaagaccagattaatctttatcggaataatgtcggggacccccaatatcctaactttgactggcaggactatatgttccgtacagctgtagtgcagacacataatctctcgatggccggtagcacggagaagactacctacaatgtagctttgaattttgtcgatcagccgggtactatgcgtggatttaaatatagaaaatacaatgcaacaatcgaccttactgcgcgtattactaattttataaaggtgggaacttatgccaacttgatgtatggtgagacagagcagcctcgccagggacagaatgatgctttcctctctacgctttcgcaggcaccgacctatatgccttggttaccggatgacggaacaggtattcgccgctggacaagttccgcttattccttcgaaagtcataacaaaaacatgcctgccattatcggagatgacgccatgaagcgtgataataattttgatataaatgctcagctgtggttagagatcaatctggctaaaggcttgacgtggtatactaaaggagctgcccgccttcagtctaacaaaagtaaagactggcgaggaagcacgacttatacttacgattaccataccggcgagagatcgtccgaactcgataaaggcggattgggattaagtgtaggcgatggccgccgtttctacaccaacctttatagttatctgaaatatgatttgtcgttagtggataatgcacataatttctctttgatggtaggttacaatcaagagtcggagaaatatgaaacgctcaatgcctatcgtaaagactttgcatttgacttgccggtactcaatgctggagggacagccgattggagtaacagtggaggtgaagaagagtgggctattcagtccttgttcggacgttttaactacgattttaaagagcgttatctgtttgaagccaatatgagatacgacggaacttcacgcatctccgatgaaaatcgttggggagtatttccatcattctcagtcgcttggcgtgccacagaagaagagtttattaaaaatttgaatcttaattggctgaacaatttcaagttgagaggttcatggggacagttgggtaaccagaatatcggactttatccctatcaagctatgatttcgggtgtggatgactatccgtttaccaaaacttcggatggtgttattatcggatatcagcagacagcttatgccaaccgtaacattaagtgggagaccactactattaccgatatcggtttcgacctgcaggtgttcgatggcttgagcgtaactttcgattggtataaaaagactactgatgacatattgcgttcttcacaggtgtcgagtttactcggactttctgctccgacggtgaataatggttcggtggagaataaaggtatagaggttgccttaaactatgccaatatggtgaagggaggtacattcaggggattccgctacaatgcaggggtttattttgaccgttcgcgcaacaagctgactgaatttggtgcagaagaaatcggaagttacagcatcaaacgtgagggattaccttatgatgagtattatatgttggagtgtatcggtgtatttgcagatcaggctgagatcaatgcatcaccaaagcaatttaatgataacacacagccgggtgatctgaagtacaaagatatcagtggacctgatggaaaaccggacggagtgattgataactatgaccgccgtactttctcaggacgttttccgggtttcgaatatggtatcaatgccagtgcgacatggaaaggttttgacctgtcgctgatcggtcaaggggtagctgataaaaaatattatactactgactggggagtacagccctttatgcaaggatcatctcccaacaaggactacattaaacacatgtggacagaagagaatccttatggtgctaagcatcctaaactctattggcaggatatgggtggaggcaagaatacacgtcccaacagctattacttgaaggatgcctctttcttccgcctgaagaatgtgactttgggctatacgctgcctcgggtatggaccgaaaaggcgaatatctctaaagtgcgtatctacttctccggtgataatctgttgactctggtcttcaccacgggg

SEQ ID NO: 4853 - DNA, 183 bp, B.fragilis; identical to SEQ ID NO: 2746

SEQ ID NO: 4854 - DNA, 267 bp, B.fragilis; identical to SEQ ID NO: 2762

SEQ ID NO: 4855 - DNA, 1503 bp, B.fragilis
aagaatatgagcgacagattatttattttcgataccacccttcgtgatggtgaacaagtaccgggatgccaattgaatacagtggaaaaaattcaggtggcaaaggctttggaagttttgggggtagatgtgattgaagcaggttttcctatttccagtccgggtgactttaattctgtgattgaaatttcaaaggctgtgacgtggcctacaatttgtgcgttgacacgtgcggtgcaaaaagatatagatgtagctgtggatgctttgaaatttgctaagcataagcgtattcatacgggaatcggaacttcagattcgcatatcaaatataagtttaactcaactcgagaggaaatcatagaacgtgctgtagcagcggtgaaatatgcccgtcgatttgtagatgatgtggaattctacgcggaggatgccggacgtacggataatgaatatctggcccgtgtgatcgaggcagttattaaagcaggagctactgtagtgaatattccggatacgacgggatattgtttgccttcagagtatggagcgaaaattaaatatttggtagatcatgtagcaggtatcgagaatgcgattatttctacccattgtcataatgacttgggaatggctactgccaacacgatggccggtatattgaacggtgcccgtcaggtagaagttaccatcaacggtatcggtgaacgtgccggaaatacagcccttgaagagatagcaatgattattaagagccatcacgagattgatattgagacgaatatcaatactcagaagatttatcctaccagccgcatggtatcgagtctgatgaatatgccggtacaggctaataaggccattgtgggacgcaatgcatttgcacattcttcgggtatccatcaggatggagtacttaagaatgtgcagacttatgaaataattgatccgcatgatgtaggtattgatgataattctattgtgttgactgcccgtagcggacgtgctgccttgaaaaatcgcctttccattctgggtgtgacactggatcaggaaaaactggataaagtatatgaagaattcctgaaacttgccgaccgcaagaaagatattcatgatgatgatattctggtattggcgggtgcagacagaagtggtaaccatcgcatcaaattggaatatcttcaggtgaccagcggagtaggagtccgttctgttgccagcctcggattgaatattgccggagagaaatttgaagcggctgccagtggtaatggtccggtagatgccgccatcaaggctctgaagcgtattattgaccgtcatatgactctgaaggaatttacaattcaggccattagtaaaggaagtgacgatgtgggcaaggtacacatgcaggttgaatatgataatcagatgtactatggatttggtgcgaatacggatattatcgctgcatcggtagaagcttatatcgactgtattaacaagtttactaaatga

SEQ ID NO: 4856 - DNA, 1539 bp, B.fragilis
aatagaacaatgggaaaaggcgtcaaaatagaaatcatggacacaaccctccgcgatggtgaacagaccagcggagtatcatttgtgccccatgaaaaactaatgattgcccgacttctgctggaagagttgaaagtagatcgtgtggaggtggcttcggcacgtgtgtccgacggagaatttgatgcagtaaagatgatatgtgactgggccgcccgcagaaatctgctacaaaaagtagaggtactgggatttgtcgacggacatacttcactggattggattcatgctacgggatgtcgtgttattaatttgctgtgtaaaggttcgctgaaacattgtacttgtcagttaaagaaaacaccggaaaagcatatcgaagacattcttgccgtggtagattatgctaacgaactcgatattgaagtcaacgtgtatttggaagactggagtaacggtatgaaggattctcccgaatatgtattccggattgtggacgcattgaaagagactaccattaaacgattcatgctacccgatacattaggaatactgaatccgcttcaagtgattgagtttatgcggaagatgaagaaacgttatcctgatacccattttgacttccatgcacacaatgattacgatctggctgtaagtaatgtacttgctgccgtgctaagtggtgtcaaaggactgcatacgacgatcaatggtttgggcgaacgagccggtaatgcacctttagcaagcgtacaagctattttgaaggatcatttcaacgctattaccaatatagacgagagtcggctgaatgatgtaagtcgcgtggtcgaatcgtattcgggtattgtgataccagccaacaagccgattgtcggtgagaatgtttttacgcaagtggccggagtacatgccgacggagataataaaagtaatctctattgcaatgatttgcttcccgagcggttcggacgtgtgcgcgaatacgctttggggaaaacttccggtaaggccaatatccgtaagaatcttgaaagcctgggactcgagttggacgaagagtccatgaaaaaagttacggagcggatcattgaactgggtgataagaaagagttggttactcaggaggatttaccttatatcatctctgacgtgctgaagcatgatggcatgagtaataaagtgaagttgaaaagctactttgtcactttagcacacggattgaaaccgatggcaacgctgagtatcgaaatcgacggtcaggtttacgaagaaagttcttccggcgatggacagtatgatgcttttgtacgtgctctgcgtaagatttataaagtgactttgggacgtaagttccctatgctgatcaactatgctgtaagtatccctcccggagggcgaacagatgcttttgtgcaaaccgttatcacctggagttttggtgaaaaggtgttccgtacccgcgggttggatgctgaccagacagaggctgctattaaagctaccataaaaatgctgaatataatagaagaatattaa

SEQ ID NO: 4857 - DNA, 288 bp, B.fragilis; identical to SEQ ID NO: 2800

SEQ ID NO: 4858 - DNA, 657 bp, B.fragilis
cgtaaatttgtgaaggggagcggctttatctatgtaattggttttttagcgcaggcttttttctcagctcgcatcatatttcaatggatattatcggaaagggcaaagaaggtagtgtctccttccatattctggatattgagtattgccggatcttatttgttgtgtatttatggatggttgcgtgatgatttttctattatcttcggacagttcatttcctattatatctatttgtggaatctgaacgagaaaggtatttggaataagcttcacggagcactgaaaaccttgttagtgattacaccggtaattgcggcagcttttatgttgcatgatgcgcaacattttatcgatagttttttccgcaatgaagaggtacctctttggctattgattttcggttcaatggggcaaattattttcactctccgctttgtatatcaatgggcttattcattccatcataaagagtctttactgcctgccggcttctggattatcagcctggtcggttcatcggttattgtggcatacggtgtattccgtcttgatcctgtgttgattttgggtcaatccgtcggattcgttgcctattttcgcaatctgatgattggacgtaaaagctccaagcaatcagttgcctatgaaaagtaa

SEQ ID NO: 4859 - DNA, 810 bp, B.fragilis
atttggattgttgtttcaataatcctattttatttcatattttttgtacttttgcgggatatttacaatgaggcaatgaataaaacgatcaattatcaactgactatcgttgttcctgtatacaacgaagaagacaatatctactctttggaacagaaattgggagagtttttacccaaatctatttgtacggcctgtgtgttgtttgtgaatgacggttcgcgtgacaacagtaagcagcgtattatggaggtatgcgcacgtaacaaggatttcttttatatggatttagcaaaaaattccggattaagtgctgctatgaaagcaggtatcgactatacagagtcggtatatgtagggtatatggatgccgaccttcagactactcccgaagatttcaatctgttgctgaaagatattgctgattatcagctggtgatgggaatccgcgccaatcgtaaagattcttttttcaagaatctgcaatcgaagattgccaatggtttcagaagaatgatgaccaatgacggtgtgcaggataccggttgtcctctgaaggttttgcatacagcctatgccaaacgtattccgttctttacgggtatgcatcgttttcttccggcattgatcttgttgcaagatgctaaaatcaagcaaattccagttcgccattttcctcgtgtagcaggtacatccaaatatcatttgtggaaccggttggtttctccttttcttgattgctttgcctatcgttggatgaaaaagagatatattaactatcgtatcggtgacaataacttaatagcgtaa

SEQ ID NO: 4860 - DNA, 261 bp, B.fragilis
ctaattagcttgaagacattgagatttattaaaaaaaagattcgtattttgcattttattaaatcttattcttatctttgccgcataacatctgccaaagacttaatagatgtgaattatttgttagccttaaaagctccgaaatgtactttctatgctgcggatatagttctgaaagaacttaatcaattaacaacacacaagaggcctccattctgtactacctattttatactaattgacgtccaatgccttatttaa

SEQ ID NO: 4861 - DNA, 465 bp, B.fragilis
ataagattctcttttgtctcatttgtctttaaaattttaattaaacattatggttgtccatcagccgggcgacacgcttacgtgcgccctcgaactcgtccagcatcgcctcccagatgtccgatcccatcacggacggcagcacctcacgggcttcccgctccgccttttcgtccgcattgtccgacaccagtacccggcgcacctttttcaggtcatcgaaggagtaccccgtggcgaagtcagggttgccgtccgggtaataagcccctaattcctcttcctcctccagttcccggatctcctccggcgtgggttcatagtccgtttcctcctcgtcctcctccggctcgatgtcggagtagtccgccccgtcgtcctccgctgcgagttcgtccacggctccggctaccgcttcctccccgtcctccgctccgaagggcaggtaggtgctttctcccatga

SEQ ID NO: 4862 - DNA, 429 bp, B.fragilis
caaccatcctcaaactggaaggctatgaagaagcagcggaatgagaagcccatcgacgaggagctgctgatgcggatgatggcgggcgaggcggcgggaacgggagaaccgggaaccggaaagggggaaactgccgtgccggtggaaaaggcgcaggaagggaaggcggcggacacaagacggcgcaagggaaggcaggcggactacgagacgaccttctttaaaggcatggacatccccgcccgttacggcaagccggtctatgtgcgccgtgagtaccacgagcgcatcgccaaaatttcggtgatgctgacgggcggcaaggtgtcgctctcggcatacatcgacaacgtgctggcacagcacttcgagcaataccgggaggagatcgaggcggcatacgccgggaaactggagaacctcttttaa

SEQ ID NO: 4863 - DNA, 510 bp, B.fragilis
atttctcgcccgtcatctgctccatcaggcggcacagcgagtacacgttgtaatagctgtccaccggttgcggcacgacatggggatgggcatggatcatcccgggatagttcaggtacgccgtcaggcacgcttccagcgaccgttccctccacggaatcatcacgaatgacatccagttatgttcggcgcatttccgccacagctccggcgtttgcaggtggacgagcagcagggacaggcacctgccgtcctccgccaccagaaaatccgccatcttcccgtcgaacacctccggtcggattgccgaagccacctcgtaaagatcggctctgccctcgccgtaccagtcccgtatggcttccatgcagacctctgcgaacgggatatggtgcagcaatgccagatgcccgtaaccgagttccgcactcgcttccagcgcacggcggcacatctccggggttttcatgtcctccagcacatgttccagcgaccatccgaactccctga

SEQ ID NO: 4864 - DNA, 387 bp, B.fragilis
gcacttttaccgttggctccgttagctccatcctttccgtcctttccatctttgccatccttaccgaaagcgggcttgcctgtatccgttccatttatataccagttgccgttatcgccaatggcaacctcgggagatttcccgtcctgcccaacggcctttttcccggtatccgttccgtccacaaaccagttgccgttatcgccgatggtgaccgtaggaggcacggcatcctttccgtcctttccatctttgccatccttaccgaaagcaggcttgcctgtatccgttccgttaatataccagttgccgttatcgccaatggtgactgtcggcggtatagcatcacgaccattcgttccgtctttaccgtctttaccatcctga

SEQ ID NO: 4865 - DNA, 2064 bp, B.fragilis
aactttgcttttctttgcgtcttatgccgatttttcggaaaaaaatattcggctcgtttgaactcggagtatgacttattgaatggtcgtttgaaagtaggtgaaaacctggagttgaactatatgaattatcgtgaagccaaccatacacagcttgctgcaaatgaaccccctatcattcctgtatataccgaaaccggtggttggggtggtgcttctctcgatgtgggtatggatgactatcgtaatccggtgaaagaccttattctggggaaagacaatgtcaataagttcctgaaggtaattggtaatacgtatgccgatttgatgattatcaaaggtttgaacctgagaacatcattcggtgtagattatcgtggttcatattatcgtgcagtcgataaaaaatggagtgaagcagacggttcgggccgtgatgaaaagttcaactatgtccgcaacgatcagactcatttcctggaataccagtggaccaaccagatcaactataacgggcaattcggaaaacactcgataggagctgtagtcggaatggaatttacgaaagctgaaagtgaagcattctatgcacgtaaagacggtttgaccctggaagacagagactatgcttttttaagttcggctacgggtgacaagattacagaggctaccggttcgggtgatgcttatgctctgttgtcatacttcggtaagttcaactattcgtatgcttccaaatatctggcatcggcaacattacgttatgatggttcttccaagttcggtgctgataaccgttgggcagtcttcccggcattttctttgggatggagaataaagaatgaaccgttccttgagaatgtagattttctttcggacctgaagctgagattcagttggggacgtaatggtaactcggccattcctagcggatacctgcaaagtagttatgtagccgattataacggaacttcttatgctatgaacggacaggaaagcggttctctacagtctggtttccgtaaatatctcaccggtaattcgacattgaaatgggaaactgtaacacagaccaactacggtatcgattttggtttcttcaaccagagcttggtcggaacaatcgattacttttataagaagacaaccgatatgctttatttgcccccttatatcggtgcattcggtgaaggtggagatacttatgtgaatggtccgagtatggaaaaccgtggagttgaaatcttgctgacataccggaacagtcttccatcaggatttaattatagcattacgggaaacatcgcgactttcaagaataagattactgaattgccggacaatgtgagaagtgtatatggtggaaacggtatgttggatgatatcatcggacgcccccgtaactctatatacggatacgtggcagacggaatcttcaagacacaggaagaggtggacaattcaccgcagcaggcaggaaaaggtttgggacgcattcgctataaagaccttgatggagacggacgtatcactcaggactacgaccgtacatggattggtgtcagtgacccggactttacttatggtttgaatcttcaggcttcgtataagaacgtagacttagctctcttcttccagggtgtgcatggcggagatgtttgggattcatggattgaatacagtgacttctggaacattcagaatgtgaataataccaaccacttgaaaggtgtatttaatgcttggtctcctcagaatccggactctaacattccggctctgtctactcgtaacaccaatgatgaaaagcgtacgtctacgtatttcctcaaagacggttcgtacttgaagttgagaacgatagaactgggatacactttcccggaaagtatggtgaagaaagccatgatcagccgcttgcgtgcctatgtttcggctaacaatgtattcactatcaagaaatggtgggatagcaatcgtttctcaggtcccgatcctgaaatccgtgactttggctatgtcattccatttaccgctacagtcggagttaatataaccttttaa

SEQ ID NO: 4866 - DNA, 999 bp, B.fragilis
tgctttacgccaaacaacaatagatcgacagattataaaaccattaaaaagaaaggacaaatgaaaaagatttttggatgggtcgccctgcttatgggcatggtgacgggtgcgaacgcacaagtgaatgatacgatacagcgggttacgggcaacgacctgtatcaggggattacacggaagctaccctaccggcagatggttacgccccacggggtgcaggtgacgttcgccaagacggtgcatatcatcttcccctcggcggtgcggtacgtggacttgggaagcaattggattatcgccgggaaagcggacggtgcggagaacgtgatccgggtgaaggcgaccaccgaggggtttccgggggaaacgaacttttccgttatctgcgaggacggaagtttctattcgttcaatgcccggtatgcgcatgagccggagatgctgaacatcgagatgaaggattttttggagaacgggaacacgacggacttttcgcatacccgcatgaacctccatttccgggaactggcaggcgaaagcccgctcttggtgaagctgatcatgcagagcatctacaaggaggacaggcgggagatccggcacttgggctgcaaacgcttcggggtgcagttcctcctgaaatccgtccactcgcacaacgggctgttctatttccacacggaaacgaggaacaggtcgaacgtggctttccggacggactttatccggttcaaggtcgtggacaagaaagtgccgaagcgcaccgccattcaggaacgggtgatcgacccggtgcgcagctacaacgaggtgctggtgacggaggggaaaagcgacgtgcgcacggtgtatgccgtcccgcagttcaccataccggacgacaagctgctggtcatcgaactgttcgagaaggacggcggtaggcaccagaccatccgggtggagaacgccgacctcgtggcggcaaaacagattaacgaactgaaaatcaagtaa

SEQ ID NO: 4867 - DNA, 366 bp, B.fragilis
catccacagccctgccatgagcaggcagatatacccgacggtaagggtggcgatatacagcacggtgtctgccggaagcgacagaggaagggcgagcagccaccagttgccgaaaaagagcagcaagccggacacgccgcaaaggatgatcctgcgccacgtgattttctgctccttcacgccctttgtgccgaggcagctaagggcgaggaacagcacggcgaagagcttcgtccagaggatattggagaacagcccggcggtacgctggaagccgagcaatatcctatcgaccacgccgatgtcgatgccccattcccggacggactggtaacagaaccaataaatattgatgactacaaataa

SEQ ID NO: 4868 - DNA, 1296 bp, B.fragilis
cacatcggtacattatttatacttcgtctccgccagtcgcttgatggcaagctccaaatccccgcccagctttttcggcagtgcgaacacctccgtcttctcgctctcttcggtggtataggtcaagtactcggcagccgatacctccgtggcatacaccgccgactgcaccccgttcagaccgatccacacctccttgtacttccgtccgggatggttggcgaggttgatggagagtatctgcgacttctccttgtccgtcagaccgagcatcgactggatgccgtcgaacttgttcatgtacttcttctggtcgagcaggattttgcagtccgagttggtgatgatagcctccttcacgatgggggacgagatgatgtcgtccacctcctgcgtgacgacaatcgcctcgccgaaatatttcctgacggtcttgtacatgtatttcaaatactcactcatactcggcgaggaaagggctttccaagcctcctcgcagatcagcatcttccgcacccctttcaggcggcgcagcttgttgatgaaggcttccatgatgatgatcgtaaccacggggaacagctcggcattatcttttatactgtcaatttcaaatacgataaaccgcttgtgcagcaggtcgatgttctcgttcgagttcagcaggaagtcatagcgtccgcccttgtaatactgcctgagtgtggtcaggaagttgtcgatgttgaagtccttccggctcaccttgatgtcccttgcagccagctccttccggtaatcgttcagcatgtactcgtagaaggtgtcgaacgaggggacgatgtcccggttctgctgtatccggcggatgtacgccgacaccgcactgcccagctcgccgctctccgtcttcgtgattttctcgtcctcgcccttccacagcgccagcagcaacgtcttgatgctgtccttcttctccacgctgaacttgtagtcgtccgtgaagaaggggttgaagctgatgggcttctcctccgtgtacgtgtagtaaatcccgtcctcgcccttggtcttgcggtgtatcagctcgcacagcccttggtacgagttgcccgtgtcgatcagcacgatgtggctgttctgctcgtaatactggcgcacgaggtggttcatgaagaacgacttgccgcttccgctcggaccgaggacaaacttgttgcggttcgagatcacccctttcttcatcggcaggtcgctgatgtccagatgcagcggtctgcccgtcatcctgtccgccatcttgatgccgaagggtga

SEQ ID NO: 4869 - DNA, 978 bp, B.fragilis
gttatggcaacaacgaacagcaccatcgaaaaaattgcaccgatgttcaccgagttgttgataaagaaaatcgagtgcctgaaaacggattggcaaaaaccgtggataacgagccttgaacaaggtttgccccgcaacatcagagggacgctctataatggcggcaatgtcttgatgttattgttctacaccgagttcatgaaattcactttgcccgtgttcctcacgttcaaccaagcgaaggaagaggacttgagcgtcagcaagggcgcacgatcgtttcccgtctattattggttcaagttcgtggtacacaaggagacgaaaaagacaatcaagtacgaggaataccgcaagctgcccgcaaccgagcaggaaaattacaaggtcatcccgcagatgaagtattacaacgtcttcaacatcgaccagaccgattttgcagggaaataccccgaacgctacgagcgcatgaaaaagggagagcagcccgaagactattcggacagaatgatttacgaggcgttggacgagcttgtctatctgcaaaattggtattgccctatcaaggtgcagtattcggacagtgcctactattcgccctcttccgaccatatcgtttgcccgcagcgtgagcagttcccgcagggagcggagttttacggcacgctcctgcacgagatggcgcacagcacgggaagcccccagcgactgaaccgcacgttcggctgcttcttcggggatgcgctctatgcccgtgaggaacttgtcgccgaacttaccgcagccctttgcggtgcgttcttcggctacgcaaccgcaccgcaggagaacaacgccgcctatctgaaacactggctcaccaagctaagggaggaacccgcctttttggtggagatattgggggacgtgaacaaggcggcgaagatgattgccgacaaggtaaccgaaccggtaaacgaacccgcagcagcctaa

SEQ ID NO: 4870 - DNA, 360 bp, B.fragilis
cccggaagaactctacggggtggcggtggctatccgcccggaggtgatgaatggcgaaatggcggacttcctgctgccgctggacggcaggtgtatcagcatcctgcccgtgcacctgcaaacaccggagcgggtgcgggtggcggtggaaacgtcggggatgtccgccgtcgggcgtggcggagtgccgaaaagcctgctcacgcccgatgtgtatgtcaggtgcgccgcccacagtcgggagtcgctgatgatgatcccgtgggcggaacgctcgccggaggtctgcctaatggcgaagacgctgtacccggacatagtgaagaatcacccggagttcgtgccggagagcgtgcataa

SEQ ID NO: 4871 - DNA, 663 bp, B.fragilis
agacataagacgatgaaaacattatcagaaaaggaatttaacggctttaacgttaatgcgatgtttaccgaaagagcggaacgggcgaaaaaagagctgtctccactcatgcaggagataaggaagtacataccccaagcggaatacggctaccacgtggagagcggtgaatatcccgcattttacggcgtgcgcatagagttcacgtataacggcatccgtttccatgtgtgcaagatatacaaagagaacaaatacaggatagccgccgacatggagcattttgaatatgtcaaccgctacgacatcgaaagggcgggcaaccaatacgaaaagccgtgcaatatcggcgtgttcaccgccaagaaaataaacgattggataaactactacacgcagatatacaggcaggtggagcaagaaaatgtggagaactcgaaaaaggtcgccgatttcttgaaaagtatcgagaatgaacccgtaagatgggaagggaacaaccattcaaaagggacgataatccgcaacggcttgcgcttcactttctacatagaggaaggacacctctattttgaactgtccctaagttatcggggaacggctgattacgacacgttccggctgatagccgataaccgctatatcccgaaaggaaactattaa

SEQ ID NO: 4872 - DNA, 1770 bp, B.fragilis
tataaccttttaaatagaaatagtatgaaaaccttttatagtttatttctgtcatcagcccttttgctttccttattggtgacgagctgtgccgaccaattgaatattaaccctaaaggggtgctggctgatgatttattattaggaaagcccgaacatattgatgattttgtgactccgtgctattcgctgattccttatctgccctggtcggaagctcatgcatggtggatgcatggttctatccgatcggatgatgcttacaaaggcggatcgggtgtaagtgaccagtcggcctggcacgatatggaagttttctcttctgtaactgccaatgtagggaacaatgacggaccttggttcaaaggatatgtagcgatatccagatataacctggcactctatgccttgtctaaagttactgatgaaaactatccgttgaaaggtgtacgtaccggtgaggtgaaattcttgcgcggagctacctatttctttatgaagactctgtggagatacattccttgggtggatgaagagaacggaagaacggtggaagatgtgactaatatctcgaaccgccccaatggtactgatgatacatatttgtgggaacacattgttgccgatttggaagaggctgtcagactgttgcctgaaaaacaagaggagataggtcgtatcaacaagaatgccgcacgtgcaatggctgccaaagctttattgttcatggcgtacaagcaggatgcaagacatcaggtagtcgaagtggataagaagattctggaacgtgccttggtttatatcaacgagatcactgatcaagaaggtggaaacgtaggcttgtgtgaagactttgccgaaaactttttgccggaatatgataatgctaccaaagaagcaatttgggaaatccagtattctatcaacgacggaacatcaagcggaggaaatacaaacaatggtgcagaattgaatgctccttcctgggaaccttatttcccatgttgtgacttccataagatgagctttaatatggcaaatgccttcagaaccggtacagacggattgcctttgttcgatacgtttaacgatgcggaaatgaaaggaagattcaaagagtatttcgatgaaaatagctttgaccctcgtttgagtcatacggcggctatcccgggatatccttataaatataatccggatttgctgtacgaggaaaaggcttccagaagccccggtgattatggttatttgaaatctgttaaagagttggttcctgccggttgcgattgtatcattgtaaaccgtaattcgatgaatgtgaagcaaattcgttatgctgaagtcttgttgtggaaagctgagatcctgattcagttggatcgtcacaaagaagctcgtcctatcattaataagctgcgcgaacgtgctaataacagtagaattcgcttgttgatggcagatggtactccttacatgaattataaggtcagcttgtataccgatgaggctgcttggaccaaagactatgcatggaaagcattgatgtttgagaatcgtcttgaaacagcatgtgagggaagacgcttcttcgatctgcaaagatggggaatcctggagcctacgatgaatgcttacttcaaaaaagagaaaacccgtttctcttggatgaataatgcggtctttgttgcgggaagagatgaatataaacctattcctcagcaacagatgaactgggcgaaaggaaattatatacagaatccgggttactaa

SEQ ID NO: 4873 - DNA, 810 bp, B.fragilis
cttataaaatatgcgcttatgtttttatacttttgcattcatattcagaaaagaaattatatgcgactcggacttttaaccgctttcatcctactcctgtcttttactacttcctgtcaatataaggaagcacagccccaccctgcatttaaagattccattgtcctcgtaactccagtggaaccgcaaccgattgcaagtaaaagccaaaccgccttttatctggattccatcggtctgatgaatatcgccgaacttgattctacattcattatccggctcatgtacgccactccggacaattttaccggtcaacttctttatactgatttgaaagaagcatatcttcacccggacgcagctaaagctcttttagaagcacatctgttacttaaagcccaatatcccagctaccgcctgataatttatgatgcggcacgcccgatgtccgtacagaaaaaaatgtgggatgtggtaaaagggacctccaagtatatgtatgtatctaacccctcacgaggtggaggtctgcataattatggattggcagtagatatcagcatagccgattcactaggacatccgttacccatggggacagaagtggactatatggatgcagcatcacacataacaaatgaagcaaaattagtaagagaaggaaaaataacccaacaagaacgggaaaaccgaattctactaagacaagttatgaaaagtgcaggatttcgtgcacttcccagtgaatggtggcactttaacctatgcagccgagacgaagccaaacagaagtacaaactcataaactaa

SEQ ID NO: 4874 - DNA, 183 bp, B.fragilis
cgggctggatattcagacgaaatacctgttcacggtggagacgatgcccgtcccgaaggagctgaaagtgaacgagacggcggagatacggtgcgagctgaaacgggaaggacgctgggaggacgcccggtacacgatccgctggttcctcttcgacggggaaggcacgctcaaactggatga

SEQ ID NO: 4875 - DNA, 1203 bp, B.fragilis
gatatgtatctttctccggaaaccatcttgtttatccgggagcatcgcaatgacgatgtacactccctggcattacaagcaaaaagatatcctcaagtggacatgcctctggctatcgttcagatagccggatggcaagctaccgtttctaaaataccaagttggcatgcaacagaaggacttttatatccgcgccatctatcattagagcaatgttcatcggaagttaccgcactctacaaagcttcactggtacatggagaagggttagtcgatctgaccggcggattcggcattgattgtgcctttctcgctactcagttcaaaacagtcacctacatagaacgccaggaggaactttgtgaacttgccatgcacaatttcccattactggggctgaaacacattcgggtacaaaatggcgacggagtggaatatctacaacagatgccggctgtagactgtattttcctggacccggcacgccgcaatgaacatggtggaaaaacagtagccatatccgactgtgaacccaacgtagccacattggaaaagttactactcgaaaagggtaagcaggtaatgattaaactttcacccatgctcgatctttccttggctatacgagatatgcagcacgtatccgaagcccatatcgtctcagtcaacaacgagtgcaaggagcttctgttactactccggcccggtgatgattctccggagattccatctgcaatgtctcagcccatcgtctgcatcaattttgcaaaccaggaaatacaacgttttgttttcacccgcgaatcagaacaagccaccgaatgttcatacacccacgaaataggaacttacctgtatgaacccaatgcctctattctcaaagccggtgctttccgcagcatcgcttcttcgtttcatctgagtaaacttcacgccaacagccatctctacacctcaaacgaacgaatagaaaagtttccgggacgcatcttccggataaccggttactcgggcctcaacaagaaagaattaaaaaatattttaaacggattagataaagcgaatatcaccacccgcaattttccacaatccgtagccgaattacggaaacgactgaaactaaccgacggaggtgatatctatctgtttgctactactttgaacgatgaaagaaaaatcatcatccggtgtgagaaagcataa

SEQ ID NO: 4876 - DNA, 2211 bp, B.fragilis
gaggcacttcaacgaacgcccgttcctctcgcacacctgctacctgttcctgacaaagaccacgaaggtgcggagccgtcaggaaagcacgttctccaccctctgcaagggcaggcttgtccccaaggagatagaggaccgggagacggttacgaggttcctcgaagccgtcgggcagttcgagaagatcatgaacgacagcggttttgttacgctgcgccgcctcacgacggacgagatcactgggacggaagcggcggcgggcatcgtggagaagtacctctcgctctcgcagcacgacacgacggtgctgaaggacatccagttgaacccggaggagatgcgcatcggcgacgacatcctctgcctgcacaccctctcggacacggaagacctgccgggcaaggtggcgacggacagccgttacgagcggctctcgaccgaccgctcggactgccggctgtcgttccgccggccccggtgggcttgctgctggactgcaaccactgctacaaccagtacatcttcatcgacgaccacggggagaacctgaaacgcttcgagcagaccgcccggaacatgcactcgctctcccgctactcccgctccaaccagatcaacaaggcttggatcgaggaatacctgaacgaggcgcactcgaaagggctgacctcggtgcgctgccactgcaacgtgatggcatggagcgacgacagggaggaactcaggcgcatcaagaacgaggtgggcagccagctcgccctgatggagtgcaagccgaggcacaacacggtggacgtgcccacgctcttttgggcggcgataccgggcaacgagggggacttccccttcgaggagagcttctacacgttcatcccgcaagccctgtgcttcttcaccgaagagacgaactacaaggactcgctctcacccttcggcatcaagatggcggacaggatgacgggcagaccgctgcatctggacatcagcgacctgccgatgaagaaaggggtgatctcgaaccgcaacaagtttgtcctcggtccgagcggaagcggcaagtcgttcttcatgaaccacctcgtgcgccagtattacgagcagaacagccacatcgtgctgatcgacacgggcaactcgtaccaagggctgtgcgagctgatacaccgcaagaccaagggcgaggacgggatttactacacgtacacggaggagaagcccatcagcttcaaccccttcttcacggacgactacaagttcagcgtggagaagaaggacagcatcaagacgttgctgctggcgctgtggaagggcgaggacgagaaaatcacgaagacggagagcggcgagctgggcagtgcggtgtcggcgtacatccgccggatacagcagaaccgggacatcgtcccctcgttcgacaccttctacgagtacatgctgaacgattaccggaaggagctggctgcaagggacatcaaggtgagccggaaggacttcaacatcgacaacttcctgaccacactcaggcagtattacaagggcggacgctatgacttcctgctgaactcgaacgagaacatcgacctgctgcacaagcggtttatcgtatttgaaattgacagtataaaagataatgccgagctgttccccgtggttacgatcatcatcatggaagccttcatcaacaagctgcgccgcctgaaaggggtgcggaagatgctgatctgcgaggaggcttggaaagccctttcctcgccgagtatgagtgagtatttgaaatacatgtacaagaccgtcaggaaatatttcggcgaggcgattgtcgtcacgcaggaggtggacgacatcatctcgtcccccatcgtgaaggaggctatcatcaccaactcggactgcaaaatcctgctcgaccagaagaagtacatgaacaagttcgacggcatccagtcgatgctcggtctgacggacaaggagaagtcgcagatactctccatcaacctcgccaaccatcccggacggaagtacaaggaggtgtggatcggtctgaacggggtgcagtcggcggtgtatgccacggaggtatcggctgccgagtacttgacctataccaccgaagagagcgagaagacggaggtgttcgcactgccgaaaaagctgggcggggatttggagcttgccatcaagcgactggcggagacgaagtataaataa

SEQ ID NO: 4877 - DNA, 2331 bp, B.fragilis
tttattcctcattttatatatttaaaattaaacaattacatgaatttattcaaatcatcagttctgtgcggcatggtcatagtgtcattcatgacatcctgtacagacgtggatatcaccatgcccaaggggcccaaaggtgatacggggctttcagcctacgagttttggaaggaaaaagttgcggatggaaccgtcaactggccgaaggatcagacagaagtcgctgacttcttcaagtttctcaagggaaaagatggcaaagacgggaaggatggtcagagtgctttcgagcagtggaaagacatgattgccagcggtagcgtggacgacccgcataatcccggcgagaaatggccctccgaaaacaacacggtacaggatttctggcgtttcctgaccggagccagcggagaggacggacagacaccgcatataggtgataacggcaactggttcattgggaaagaggataccggtatcggcgcacgtgggcgtgacggtcaggatggtaaagacggtaaagacggaacgaatggtcgtgatgctataccgccgacagtcaccattggcgataacggcaactggtatattaacggaacggatacaggcaagcctgctttcggtaaggatggcaaagatggaaaggacggaaaggatgccgtgcctcctacggtcaccatcggcgataacggcaactggtttgtggacggaacggataccgggaaaaaggccgttgggcaggacgggaaatctcccgaggttgccattggcgataacggcaactggtatataaatggaacggatacaggcaagcccgctttcggtaaggatggcaaagatggaaaggacggaaaggatggagctaacggagccaacggtaaaagtgcctacgagctttggaaagagtatatctcgtccggtgatgtggacaacccgcataatcctgaccaaaaatggccggcggaccggaacaagcagactgatttctgggatttcctgaccggaaaatcctctgttatcgagatagaagttggaaaatacaatgttattcctgaatactggaactcttccctgaaagagtatgttgtaccttcggacggttcggttctatttaccgtgtatgacaagaccggcaaaaaggtcacagccggagtaaaggtgagcgacttacccggtgtatcttctacggatgcatttatcacaaacgaggaagggcagttcaaggtcacatgggataaattgccagacaataagggtttatcagaaaggaaaggaagtgtgactgtaacggttgatggaacgcaggaaacgagtgcgggcaacacgttggtgccgaataggatcaatgttagagctatcattacaagcgcatatctgtctaattattctaatacgtcgatagatatttataggacactaaatgtatattacagcttcgagcgtcaagtggatggagaatgggataagtatccgacgtccattactactccttataatagtatgaaatcggccagggttaaagatataaaccggcctgtcaacgaaggaaatgtggacaaagatcagttagtccgctatagcaatggaaactcatatctctacatcattcgtccgttggttttgacagagacggagaaggcaaatgtggcgaagaatgatactgtcggcaagttggcgaaatatgaatgggaccaaacagacaattatgcggcactgtattttggtgatggtacgggaagttataatgactatggacagactgtatatttgcaggacaagatacatgtcccggaagtgtatccggccccatcttttaaagaaaacagtgtgtttattgaaatcaagcagggtattaccaccatgtggggagagattgacacggataatttacagaatttttataaaacatacgcttacccgacagggcaagataaatttacaaaagaggaaggaaccaatgtttggaaacatccggaaggcaagttgccggcatcagagctggaagaaaatcgggctgtatttatagaaatgcgtactttcatcaatggaacgggaggaactgtacataccggatccaagccgttgtcaacgggaggcaagcgctttaaactgacaagcacttatcccaataactggattggtctggatatcagacgacggacagaaagcactgataaaataacatataatatatctaacgagtaccgtgggcgttacgcttactatctgttaaaagaggaagataagtactatttagttgattttgcggactggtccaagcggatgcccttgccaatcaaggattgtcctgtcgactggatgaattga

SEQ ID NO: 4878 - DNA, 534 bp, B.fragilis
cgatatggacagacagacattgaacgtggctttcgccacacagaaaggcggcagcggcaagacggctatcacggtgttggtggcgggctacctgcactaccgcttggggtgtccgctggcggtgatcgactgcgacttcccgcagtacagcctgtacgagatgcgggaacgggacagccgggcggtactggagaacgaatacctgaaacgggcggcttacgaacagatgcggcagccggggcgtgccgcctatccggtgcgcaagtgccgggtggagcaagcccccgacacggcaagggagctggcggcggaaggctgctacgacctgctcttcttcgacctgccgggcacggtgaactcggcgggcatcctgcgcacgatcgcacagatggactacatcttcgccccggtgagtgcggacaaggcggtattggagagcacgctctccttcctcgacgtgctgcaacggatgatgctgggcaaagagacgagccgcctgaaggggctttaccttttctggaaccaagtcgataa

SEQ ID NO: 4879 - DNA, 2649 bp, B.fragilis
cctattcggcaactgacagggagggcaacaaggtcggcaagcccttcaagtcctccgtgttcggcaaggaggcgggcatcgctgccctcgaaaggcggatgcacaacgctgccgcatgggaaaagacccacaaggaggtcgccgccgccaccgccggaaaggttgcagccgccatgcagaccgcagggcatgaccgggcgcagttcgagcgggaactcatgcggcagggaatcggcgtggtattccgtcagaatgaagccgggcgcatctatggggcgaccttcatcgaccatgccgccaaagccgtcttcaacggctcccgtctgggcaaggagttttccgcaggcgtgttcaacgaccttttcgccgggcaggaaggcattcacctgccgcaaccctccgccggagtggaacatcccacccggcagcaggagcatacgggcgcatcccaatgggacggacataccggctatcgtcctgaccacaaggacggcactacccaaaacgtggcggcctccttcaacctctttgccctcgtacccggcggagcgtccggtgaccagcccgtaccgccgcagcgcaaaaagaaaaagaggcgcaagtacggcaggcaacaataatcaacttaaaattcaacgaattatgcaaaacgaagacgatttgcgtggactcgccaaagtcatggagttcatgcgtgcgataagcattttatttgtagtcatcaatatttattggttctgttaccagtccgtccgggaatggggcatcgacatcggcgtggtcgataggatattgctcggcttccagcgtaccgccgggctgttctccaatatcctctggacgaagctcttcgccgtgctgttcctcgcccttagctgcctcggcacaaagggcgtgaaggagcagaaaatcacgtggcgcaggatcatcctttgcggcgtgtccggcttgctgctctttttcggcaactggtggctgctcgcccttcctctgtcgcttccggcagacaccgtgctgtatatcgccacccttaccgtcgggtatatctgcctgctcatggcagggctgtggatgtcacgcctgctgaagaccgacctgctcgaagacgtgttcaacgtcgagaacgaatccttcatgcaggaaaccaaactgaaggagaacgagtattctgtcaatctccgcacccgcttccggttcaggggaagggcgtatgacggatggattaaccttgtcaatcccttccgtgcgacgatggtcttgggtacgcccggttcgggcaagtcctatgcgataatcaaccagtacatcaaacagatcatcgagaagggctattcgctcttcctgtatgatttcaagtaccccgacctcgccgagatagcctacaaccacctactcgcccacttggacggctacaaggtcaagcccaagttctacgtgataaacttcgacaatccgagggaaagccaccgctgcaaccccatccatcccgacttcatgaccgacatcagcgatgcctacgagagtgcctacacgataatgttaaatttgaaccgcacatggatttccaagcagggcgatttcttcgtggaatcgcctatcattctgttagccagtattatatggtatctcaaaatctacaagaacggcaagtattgcaccttcccccatgccatcgagttcctgaaccgcaagtatgccgacattttccccatcctgacctcgtacccggagcttgagaactacctttctcccttcatggacgcatgggaaagctcggcggtggagcagttgcaggggcagattgccagtgccaagataccgctttcccgcatgatctccccggctctctactgggtgatgacggcggacgatttcaccctcgacatcaacaatcccgaagagccgaaagtgctggtagtcggcaacaatcccgaccgtcagggcatctacggggcggctttgggattgtacaactcccgcattgtcaagctcatcaataagaagaaacgtctcaaatcctccgtgattatcgacgagctgcccaccatttacatacgtgggctggataacctcattgccaccgctcgaagcaacaaggtagccgtcatgctcggctttcaggatttctctcagttgaagcgtgactacggtgacaaggaaagcgccgtaatctgtaacacggtcggcaatgtatttgcaggtcaggtagttgcggaaaccgccaagacgctctccgaacgcttcggaaaggtcctgcagaaacggcagaacatgaccatcaaccggaacgagacttccgtctccatcaacacccagatggacagccttattccggcaagcaagatttccaacctcacgcagggcatgttcgtgggggcggtagccgacaacttcgacgagcgcatcgagcagaagattttccatgccgagattgtagtggataacgagaaggtcaggcgggagaccgcccgctacgtgaagataccgcagatcatcgacttcaccgacaaggatggcaacgacaccatgcagcagcagattgatgccaactactaccgcatcaagagcgaggttaagcagattgtcgctgacgagatcgagcgcatcaaggcggatccgaaactctcacacctgatcaaaaacggataa

SEQ ID NO: 4880 - DNA, 234 bp, B.fragilis
cagtgtgttaaatcaagtaataggaagagaggaaacaagaggaggaaaagggttgaagatgaagacgatagagaaacgagggagtattttctgggaaaagggataagtgccggtccgaaagggatagttgcgattaaggcaagtatgggggcagggaattttaaaaagcaaggctgggagtggaagcaggaggagtttactgttaaagaccaaaggacattgcttaaaaactaa

SEQ ID NO: 4881 - DNA, 303 bp, B.fragilis
ccaatattcctcactgctgcctcccgtaggagtttggaccgtgtctcagttccaatgtgggggaccttcctctcagaacccctatccatcgaaggcttggtgggccgttacctcaccaacaacctaatggaacgcatccccatcctttaccggaatcctttaataatgaaaccatgcggaatcattatgccatcgggtattaatctttctttcgaaaggctatccccgagtaaagggcaggttggatacgtgttactcacccgtgcgccggtcgccagcaaagaaagcaagctttcttcctga

SEQ ID NO: 4882 - DNA, 561 bp, B.fragilis
aaaaatatcaatatggaaacaaggacattggcagaaaacggaacacccgttacgaaagaaaagacggtagccttttcgggacaccgcaccaaccgtatagccaagttcacggcagaccgtgagaaactctttagagaggtggcgttcgatacatttgtagccatcgagagttattgtatcaaaaaaggctaccatacctttttgtcgggaatgtgcgagggcttcgaccttatcgcagcagaggaagtcttgaacctcaaaaaggaatacccgcatatccatttgaaatgcgttctccccttcaagggacaagccgagcggtacacccaggccgacaagcggcgttatgacaccattttggcgcaagccgatgaagtggtaaccttgcaggacggatataccgagggctgtttcctacgccgtaacgactaccttttggaaaactccgcttttctgatggtctattacgattcggtagccgtgggcggcacgttctacatcctcaaacgggcggtagagcagaaaaagaagttcgcgaacgtgtgctataaccgcaggtaa

SEQ ID NO: 4883 - DNA, 396 bp, B.fragilis
aattttgtaaaacttaaaaaaaacggaatcaagatgagacgattgaatttaatcctgctgctgtcggcggtgacggtggcgctggcgtttgtcatttcctgcaaggagacaaatgcggaacggttggaaaagatgtgcggcgagtgggtcagcacgggcggcaagccgcccttcaccctctgggaagaggacggcaagtaccgtgtaacggtcatgcacagaaaccacaagggcgacagtgaagcggagacctacctcgtccgggaaacggaaggggtgctgttcatcgagacgggcttcgccgtgatgatggactatgaccgggagaaagaccacatccggctgtcgccgggcggagagtacaggagaaagagtgacggaaccctaaaacagtaa

SEQ ID NO: 4884 - DNA, 465 bp, B.fragilis
actgggcgaaaggaaattatatacagaatccgggttactaataaaaaacagacgattatgaaaagaatattatactttttttctgtgatgctttgtatacttgccgtcacaggttgccaggatcgcgatatcattgattttaaagatggagtttccttacctccggtgaccgatttgaaatcgtcactgacacctgataatgatgcggtgttggagtggaaactaccttcagcgattccggaagagatacaacgtcctttatccgtttatgttcaggtttacaaaggggcagtgctggagcatcagatttctttggaaggtgaacctacttcgtgggaatatacactgaaagaacctgaatccaaatataggattgtggttaaggtccaggggatgttgaaagaaaagccctatggacaatcagatgaaatatattcgttgggacaaacagtttctataaattga

SEQ ID NO: 4885 - DNA, 861 bp, B.fragilis
aaaaacagaaacatggaacaagaagaaagaatgtatcaggtacctctggagatgatatgcaggcacgaccgcacggcggaggtgtgccgtgccgccgttgaagaggacggctggcagctggagaacgtgcccgaagagatgaagacaccggaactgtgccggaaggcgctggaaacggaagcgggattcgggaacgacttccaccgggggctggttcagcatatcccttttgcggaggtgtgcatggaggtgctgaaggagtgccgggagaataacccggaagaactctacggggtggcggtggctatccgcccggaggtgatgaatggcgaaatggcggacttcctgctgccgctggacggcaggtgtatcagcatcctgcccgtgcacctgcaaacaccggagcgggtgcgggtggcggtggaaacgtcggggatgtccgccgtcgggcgtggcggagtgccgaaaagcctgctcacgcccgatgtgtatgtcaggtgcgccgcccacagtcgggagtcgctgatgatgatcccgtgggcggaacgctcgccggaggtctgcctaatggcgaagacgctgtacccggacatagtgaagaatcacccggagttcgtgccggagagcgtgcataaccaagacagcatctacacgctgaacagcctgatggaaagcctgacgggggaaaagttcagctaccggcaaatgacggacttctacaacgggaagccgctgaatgtgaaacggatggaaacgccgggcggcgtgcagaaggacaagtcggtgaagttcgacaaggagacgggaggcttctccttctccgacatccggcaggagcgaaaacggggattgaagatgtag

SEQ ID NO: 4886 - DNA, 636 bp, B.fragilis
aaaaccggaaacatggaatttaagagtttgaaaaatatcgaaacgagcttcaggcagatacggctcttcacgctggtattcgcctgcctgtgcgccgtggtgacgggcttcgccctgtggaagtcgtacagcttcgccgaggcgcagcggcagaagatctacgtgctggacaacggcaagagcctgatgctggcgctctcgcaggacgtgcggcagaaccgcccggtggaggcacgggagcacgtgcgccgcttccacgagctgttcttcacgctctcgcccgacaagtcggctatcgagggcaatatcaaacgctcgctgctgctggcggacaagagcgccttcaactactacaaggacctctcggaaaaggggtattacaaccggataatctcggggaacatcaaccagatgatagagatagacagcctgcggtgcgacttcgacaagtacccgtacagcgtgcggacgttcgcccggcagatcatcctgcgggaaagctctgttacggagcgcagccttgtgacccgctgccgcctgctggatgcggtcaggagcgacaacaacccgcagggcttcatcatcgaggggttcgagatcacggagaacaaggatttgcagaccctcaaacgctga

SEQ ID NO: 4887 - DNA, 576 bp, B.fragilis
ttgaatatgaagaaaaaaataacgatatgctttgtgtgtctctccttgctgttggtctctctggcggtgagaggacaggacacgaaaacgacccgtcgtgtgcctctccaggcagaggtgacgcatgacggactgtcagaaaaggaatcaaaagcctgggagatcggtctcggcggttcgctgataaactggagtcgggtgtcagtcactggtttccggagtacgccggacaactacttttataacctgaaagcgaatcatctgatgggaggggcaaacttgtacatcgcacgggaattgaaccggtggttttacctggatttgcagggaagcgtcggtttgacgaaaaacaacaaccgtaccgcaggtgatgacaggaaacgtgatttactgtacatggggggactggggctacaattccgctttactcccctgctcagatcccaatgggttgaaccttatctcagggtaggtgtgaactatctgcataaagactttgcttccgtatatggcggcaactttgaggatgatccaaccgggtcttcaccacggggctggaaggatcgacggggttcg

SEQ ID NO: 4888 - DNA, 576 bp, B.fragilis
cagttatcgaatcatgaagcggattcccacgccgacctgcgtgtggaatttcccgcagtcgccgccgaacagcacccgttggcgaccgtttaccagcaagacaatcttgtccgtcacgtaggcggacagctccagcgtgagcgcacccccgtagatgaaattgtcctcatccgtgagccgggagccgtccggcagcaggctctcgccccagttcaccgtctcgtacccggcaagggcggacagtcccagtgcggcgaagaacgtcttcttccggtcggaaaggaagttcaggtaatagccgccctcgcccgtgaattggctcgccggatagaggcagtcccggtagccgtaccgcttctccaagtattccacaccgaccacccaatggtgggcgttcttcgtgtaggtgctcaccgctatcccggcgtggtagccgaagccgtcgccgtttttccagcgcatgttgtccgacagcccgcccgtgagctgtatgcccctcattccgggcaggcaccgttgggcgtgtgcccggttcacatgcaggcacaccccgaaaagcaggataatgaacagtaa

SEQ ID NO: 4889 - DNA, 702 bp, B.fragilis
agtaagaatgaaaaagagcggcaaccgcccgagggagtgccccggcactccgcagcaggcaagggcatcctcaatctgtccggcaggacggattttattttcaaacgaaaatggcaagttgtgtgctgcggcactcgaaatgaatttcgtgcctcaccaccaccttgccccctcgatgtggcattcccctccggagtcgggggatgctcacgggggagagccgtaggcatacggcgttttcagaccatgtttcacttaaaattttacaggatgatggacaatcagaagaagtatgcgggcaaccacgggcgaaaacccaagcccgacaagatgcgccaccgctacgtattccgtctggatgacggggacaacgcccgtttcctcgcgcttttcgacgagtcgggcaaggcgaccaaggcggagtttatcgtttccgcacttttcggcaaggagattaaggttattaaactggataaggggacgcaggatttctacatgcgcctgaccactttccactcgcagttccgtgccataggcacgaactacaaccaatgcgtgcgtgcgctcaaatccaatttctcggagaagaaagccctcgctttcctctacaagctggagcggcacaccctcgaactggtcgagttaagcaagcggatttccgcactggtggaggagttccagagcaaataccccgtccgatga

SEQ ID NO: 4890 - DNA, 222 bp, B.fragilis
  unsure (201): Identity of nucleotide sequences at the above locations are unknown.
gtcagttgtgaaagtttgcggctcaaccgtaaaattgcagttgatactgtcagtcttgagtacagtagaggtgggcggaattcgtggtgtagcggtgaaatgcttagatatcacgaagaactccgattgcgaaggcagctcactggactgcaactgacactgatgctcgaaagtgtggggtcttcaccgcggggtggaagngtccgtgctataggttttcta

SEQ ID NO: 4891 - DNA, 330 bp, B.fragilis
aaatcccccgattatttatttttaaacactggcaagaatgaaaaacgtaatgaaagcggcgacgctcgaaagcaagttcccgctgctggcggtggagaacggctgcgtcgtgagcaaggaggcggacgtgacggtcgccttcagggtggaacttccggaactgttctccgttacagggagcgagtacgaggcgatccactcggcttggcacaaggcggtgaaggtgctgccggagtattccatcgtacacaagcaggacttcttcatcgaggagaagtaccggccggaaacggacagggacgacctgagcttcctgagccggagctttga

SEQ ID NO: 4892 - DNA, 837 bp, B.fragilis
gtgaacagagaagcggctgcacgggcggcccggatgaataaccaacagaatgacgatatggacagacagacattgaacgtggctttcgccacacagaaaggcggcagcggcaagacggctatcacggtgttggtggcgggctacctgcactaccgcttggggtgtccgctggcggtgatcgactgcgacttcccgcagtacagcctgtacgagatgcgggaacgggacagccgggcggtactggagaacgaatacctgaaacgggcggcttacgaacagatgcggcagccggggcgtgccgcctatccggtgcgcaagtgccgggtggagcaagcccccgacacggcaagggagctggcggcggaaggctgctacgacctgctcttcttcgacctgccgggcacggtgaactcggcgggcatcctgcgcacgatcgcacagatggactacatcttcgccccggtgagtgcggacaaggcggtattggagagcacgctctccttcctcgacgtgctgcaacggatgatgctgggcaaagagacgagccgcctgaaggggctttaccttttctggaaccaagtcgataagcgggaaacgagcgggctgtacgagaagtacgggcaggtagtcgccgacatgaggctgccgatgctgcaaacccgcatccccgacacgaaacgcttccgcaaggaggcggacagtacgggacggacggtgttccgctccacgctgctggctcccgacaggcggatgctggcaggcagcggcatccccgaactgacccgtgagatagcaaccatcctcaaactggaaggctatgaagaagcagcggaatga

SEQ ID NO: 4893 - DNA, 642 bp, B.fragilis
aacagtaaggacatgagaacaataaaggcaatcattctgggcgtggcgtgcctgacggcaggtgcggccaacgcccaatgggtcgtacacgaccccggcaatctggcgcagggcatcatcaacacagctaaggagatcgtggagacctccgccaccgcacagcacacgctggacggcttcagggaaacggcgaagatattcgagcaggggcggaagtattacaatgcgctaaaggcggtgcatgacgtggtgaaaggcggagtgaaggtgaagaagtccatcgggctggtggcggacatctcggaaatctacgtgcgcaactaccagaagatgctgggcgacccgaactacacgccggacgagctggaaaccatctcgttcgggtacgccaagctgttgagcgagagtgcggacatcctgcaagatctgaagaacgtggtgaacgtgacggggatgtcgctctcggatgccgaacggctggctatcatcgaccagagctacaagcggctgctggagtaccgcaacctcgtgcagtattatacggacaagaacatctcggtgagctacctgcgggcgaagaagaaaaaggacgccgaccgggtggtggctctctacggggatgcggaagaccgttactggtga

SEQ ID NO: 4894 - DNA, 1080 bp, B.fragilis
aacgggaaggacgctgggaggacgcccggtacacgatccgctggttcctcttcgacggggaaggcacgctcaaactggatgacggcacggtgctgctgcccaatgaccgctacccgctggagaaagagacgttccggctctattacacccggctgtcggacgagcagagcagcttcaccgtctgggtggaggactcggacggtcaggcggtcgagctggaatacgacttcaatgcggacaacgacaaggaggacggggatggaagtggaactgggaaagagtgaggtgccggctttggcggaattgaaagacctgtgccggcacgagtgcaccgcagagcggtacgccgataccgtcagggagttcggatggtcgctggaacatgtgctggaggacatgaaaaccccggagatgtgccgccgtgcgctggaagcgagtgcggaactcggttacgggcatctggcattgctgcaccatatcccgttcgcagaggtctgcatggaagccatacgggactggtacggcgagggcagagccgatctttacgaggtggcttcggcaatccgaccggaggtgttcgacgggaagatggcggattttctggtggcggaggacggcaggtgcctgtccctgctgctcgtccacctgcaaacgccggagctgtggcggaaatgcgccgaacataactggatgtcattcgtgatgattccgtggagggaacggtcgctggaagcgtgcctgacggcgtacctgaactatcccgggatgatccatgcccatccccatgtcgtgccgcaaccggtggacagctattacaacgtgtactcgctgtgccgcctgatggagcagatgacgggcgagaaattcacctgcgggcagatggcggacttctacgggggaaagcggatggcggtcaagtgcatcgaggtgcccgatggtttcctgaaagaccgtgaggtactttcgaccggcagaaagagacgttccgcatcgcccctctcagccagcggcaggagcagaggcagcaggaacagcaagagccggaacggaacgacgcacccaagaggcgcaacggaatga

SEQ ID NO: 4895 - DNA, 1050 bp, B.fragilis
agagcggtttgtcagcttggcggaggagtatatgcggcgcatgggcttcggcgaccagccctatatcgtctatcgccacaacgacatcgggcgggagcacctgcacatcgtttccgtccgggtggacgaaaccgggcgggcgatttccgacagctacgaacacgggagttcgatgaaggtctgccgggagctggaacggcagttcggtcttgtcccggctacgcccaagcagtggaaggagggactacccttgtcgcccgtcggttacggggacgacaatctcaagggacagttggcaggagtcatccgcccgctcgcccgggagtggcgtttccgtacattgggcgaataccgtgccgtgctttcccttaccgcatcacggtggacgaggtaaagggggaatacggcgggcgggagtatcacggcttgacctattcggcaactgacagggagggcaacaaggtcggcaagcccttcaagtcctccgtgttcggcaaggaggcgggcatcgctgccctcgaaaggcggatgcacaacgctgccgcatgggaaaagacccacaaggaggtcgccgccgccaccgccggaaaggttgcagccgccatgcagaccgcagggcatgaccgggcgcagttcgagcgggaactcatgcggcagggaatcggcgtggtattccgtcagaatgaagccgggcgcatctatggggcgaccttcatcgaccatgccgccaaagccgtcttcaacggctcccgtctgggcaaggagttttccgcaggcgtgttcaacgaccttttcgccgggcaggaaggcattcacctgccgcaaccctccgccggagtggaacatcccacccggcagcaggagcatacgggcgcatcccaatgggacggacataccggctatcgtcctgaccacaaggacggcactacccaaaacgtggcggcctccttcaacctctttgccctcgtacccggcggagcgtccggtgaccagcccgtaccgccgcagcgcaaaaagaaaaagaggcgcaagtacggcaggcaacaataa

SEQ ID NO: 4896 - DNA, 681 bp, B.fragilis
ggatggttgctatctcacgggtcagttcggggatgccgctgcctgccagcatccgcctgtcgggagccagcagcgtggagcggaacaccgtccgtcccgtactgtccgcctccttgcggaagcgtttcgtgtcggggatgcgggtttgcagcatcggcagcctcatgtcggcgactacctgcccgtacttctcgtacagcccgctcgtttcccgcttatcgacttggttccagaaaaggtaaagccccttcaggcggctcgtctctttgcccagcatcatccgttgcagcacgtcgaggaaggagagcgtgctctccaataccgccttgtccgcactcaccggggcgaagatgtagtccatctgtgcgatcgtgcgcaggatgcccgccgagttcaccgtgcccggcaggtcgaagaagagcaggtcgtagcagccttccgccgccagctcccttgccgtgtcgggggcttgctccacccggcacttgcgcaccggataggcggcacgccccggctgccgcatctgttcgtaagccgcccgtttcaggtattcgttctccagtaccgcccggctgtcccgttcccgcatctcgtacaggctgtactgcgggaagtcgcagtcgatcaccgccagcggacaccccaagcggtagtgcaggtagcccgccaccaacaccgtga

SEQ ID NO: 4897 - DNA, 351 bp, B.fragilis
cgggatcatcggcgacaagcggaaagcctacgagcaggcgcaggcggagaaacagcaggcggagaaggtgcgctcgctggaggacttcgccttctccgaagagagcgatatggacggggtggaaatggaactgccggacagcgagccggaacgggaaccgttcagggactattcggacaatggcggcggcagccgttcttccgttaccgcctaccgggacatcaaccgtcagctcggctcgttctacgaggaaccgaaggtggacggggaaaaggaggagctgaaaaggcaggtggaggagttgaccgccaagctggaagaaagggaacggcaggcgggcggaatcgatga

SEQ ID NO: 4898 - DNA, 306 bp, B.fragilis
actccgcatcgctcaggggctgttgcagccccgataccgtccgctcccgtgccacctgcaccgccacggcgggctgtcttggactgttgtcgttctgcacggctgcgccgtccttcccgttctgtcccatgtacttggcggcaagctcgtagctcttctccatcagcgccacctgatcatcgattccgcccgcctgccgttccctttcttccagcttggcggtcaactcctccacctgccttttcagctcctccttttccccgtccaccttcggttcctcgtagaacgagccgagctgacggttga

SEQ ID NO: 4899 - DNA, 1791 bp, B.fragilis
caaagaaaccgatttcccgaccggaagaaattatcaaaaagaacaagaataaacaatcaacttaaaaacaaacggattatgaagacaaaagcaaatcaatcagcagcagagagaaacatcacgatggtagcattggcaaacattcagccgagcggtttcaacccacgcaagcgtttcgatgaaacgagcctttacgagcttgccgagagcatcaagcggcagggtgtgttgcagcccatcaccgtgcgccccgttgacgggacagaccgttacgggattgttttcggggaacgccgttaccgtgcgtccgtcattgcgggcagggacgaaattcccgcaatcgtttccgagttgtcggacgaggaagccgaggaaatggcgattactgagaacttgcagcgcaaggacgtgacacccgtggaggaagccgcagcctatcagcggcttatcgagagcggacgccacaccgtgcagaccttggcggtactcttcggaaagaacgagaactacatccgcacacggctgaaattcaccgcccttatccccgaaatcgccgccctcttggatgcggatgaaatcaccatcagcgtggcggctgaaatctgccgatacggggaggacattcagcgtgaggtgtacgagaaacatttgcaggacgagggaacgtataacagttggcggggactgaaagccgccgatgttgcaaggcgcattgaacagaacttcaccaccgacctgcaatactaccacttcgacaaggccgagtgcgccacgtgcgcacacaacaccaataacttgctgttgttccatgacggcgggtgcgggcattgcgccaaccgcacgtgtcttgccgagatgaacgcctctttccttatggagcgagctgtgcaaatcatgcggaaccagccggaggtgtcgctctgccgtgactgctacaccgccaacgagacggtagtagaacggctaaccgcttcgggctacgaggtggagacccttgacaggtacaccgcctttccaagctgccccaaagaacccaaagccgaaaatttcaacgaccccgaacgctacggggaagcccgcacccgctacgagcagcaatgggcggactacatggagcaggaggaggaaatcacccgcaggagcggagcgggggaaatcaccgtctatgccaaaatcgggcagaaggagattacattctgttacgtggagaacgtgacagagaccgagacagcggacggaacgcccgcacccgcaccgctctctcccgtggagaaattggagaagcaggacaagcgcaataaggaaatcgcactcgaacgcacggtggaggacaccaagaaacagattctcgaagccgacatcacgggcggcaagttcagtgccgatgaagacacgatgctgtacttcttccttctgtcctcgctccggaaggaacacttcgcagccgtggggattgcggaagacaagccgtatatcacggacgaggacaagatggggattatcggaaacctcacggtaaagatgaagaccatcatccgcagggacttccttgtagccaacttcaagggagcgtacgggaacaacaccgtggcgaccctcttgcttgacttcgcacgcaggcacatgccggaggaactcgccaacatcgaaagggagtacaacggggtgtacgagaaacgtcaccagcgcatcgaggaaaagaaagccgtcctattagtgcaggaacgggcaagggagcgcaaggtaacgcaacccgaggaacaaccgcaacccgaagagattgcagcctaa

SEQ ID NO: 4900 - DNA, 237 bp, B.fragilis
ggagaaaatagggaatttaacgggaacttgacggaaattaaacggggtttaagcaaaaaactcggtgggaccttggcgggaattgaacgggaatcagacaggaatcaaacaaaaattgaacggaagaccgcgttaacattgttaatgcagttggggagagatttatttcaggggcggaaagaacaaagctttggcttcgaaaagacttgttatttggaaataaaaggcttgatttaa

SEQ ID NO: 4901 - DNA, 1374 bp, B.fragilis
tggaagaacagacccaagaaaaagcaacggccaacgcagcacgtgacggtggcggatgccccaaccccggagacggggaacggaaagaaggaggacaagggcggcgggaaaaaggagaagaagacagccaagccgctcacgccgaaacagttgcagcaacggaagaagctgatggtatatccgctgatgggcttgctgttcctcggctcgatgtggctgatattcgcaccttcggaggagcgggacgtgaaccgggacaccgtgggggcgttcaacgccgacatccccctgccggagaatgacgggatcatcggcgacaagcggaaagcctacgagcaggcgcaggcggagaaacagcaggcggagaaggtgcgctcgctggaggacttcgccttctccgaagagagcgatatggacggggtggaaatggaactgccggacagcgagccggaacgggaaccgttcagggactattcggacaatggcggcggcagccgttcttccgttaccgcctaccgggacatcaaccgtcagctcggctcgttctacgaggaaccgaaggtggacggggaaaaggaggagctgaaaaggcaggtggaggagttgaccgccaagctggaagaaagggaacggcaggcgggcggaatcgatgatcaggtggcgctgatggagaagagctacgagcttgccgccaagtacatgggacagaacgggaaggacggcgcagccgtgcagaacgacaacagtccaagacagcccgccgtggcggtgcaggtggcacgggagcggacggtatcggggctgcaacagcccctgagcgatgcggagttcatgcggcggtacagccagccgaggaactacggcttcaacacggcggtaggcagcgggtacactatggggaagaacacgatacgggcgtgcatccacggagatcagacgattatggacggacagacggtgaagctcaggctgctcgaaccgctgcaagcgggaaaccttgtgattccgcagaacacgctcgttgcgggtacgggaaaggtacagggagaacggctggatattgtggtgtcgtccatcgaataccgggggaacttgctgcccgtggagctggcggtgtatgacagtgacgggcagaaaggcttgtctgtcccttcatcactggaacaggaagcggcaaaggaggcgatggcgaacatcggcggcgggttgggaacgagcatctcgttcgcacggagcgccggacagcaggtggcgatggacatcacccgtgggctgatgcagggcggcagccagtaccttgccaagaagttccgcacggtaaaggtgcacctgaaagcggggtatgagctgatgctttacgccaaacaacaatag

SEQ ID NO: 4902 - DNA, 723 bp, B.fragilis
cgggcggcaaggtgtcgctctcggcatacatcgacaacgtgctggcacagcacttcgagcaataccgggaggagatcgaggcggcatacgccgggaaactggagaacctcttttaaaaaggaaggaggaaacggcatgatactgaaattatcgctcaccgtcctgctgctctattacctcgccgtgctgtggaaatactaccggcaggacatcgccgggatattcgggacagcggagacggacgaagacacggacggaacgggaaaggaaccggggcaaccgggtgagccgtacacggtcatgggagaaagcacctacctgcccttcggagcggaggacggggaggaagcggtagccggagccgtggacgaactcgcagcggaggacgacggggcggactactccgacatcgagccggaggaggacgaggaggaaacggactatgaacccacgccggaggagatccgggaactggaggaggaagaggaattaggggcttattacccggacggcaaccctgacttcgccacggggtactccttcgatgacctgaaaaaggtgcgccgggtactggtgtcggacaatgcggacgaaaaggcggagcgggaagcccgtgaggtgctgccgtccgtgatgggatcggacatctgggaggcgatgctggacgagttcgagggcgcacgtaagcgtgtcgcccggctgatggacaaccataatgtttaa

SEQ ID NO: 4903 - DNA, 585 bp, B.fragilis
gcgatgaaaaggttactgttcattatcctgcttttcggggtgtgcctgcatgtgaaccgggcacacgcccaacggtgcctgcccggaatgaggggcatacagctcacgggcgggctgtcggacaacatgcgctggaaaaacggcgacggcttcggctaccacgccgggatagcggtgagcacctacacgaagaacgcccaccattgggtggtcggtgtggaatacttggagaagcggtacggctaccgggactgcctctatccggcgagccaattcacgggcgagggcggctattacctgaacttcctttccgaccggaagaagacgttcttcgccgcactgggactgtccgcccttgccgggtacgagacggtgaactggggcgagagcctgctgccggacggctcccggctcacggatgaggacaatttcatctacgggggtgcgctcacgctggagctgtccgcctacgtgacggacaagattgtcttgctggtaaacggtcgccaacgggtgctgttcggcggcgactgcgggaaattccacacgcaggtcggcgtgggaatccgcttcatgattcgataa

SEQ ID NO: 4904 - DNA, 468 bp, B.fragilis
ttgtatatgaggacaatgatttatagaatattcacgggctgctacatcgtggccgccctcgtgctggtcgcagcctgtaatgacgggctggatattcagacgaaatacctgttcacggtggagacgatgcccgtcccgaaggagctgaaagtgaacgagacggcggagatacggtgcgagctgaaacgggaaggacgctgggaggacgcccggtacacgatccgctggttcctcttcgacggggaaggcacgctcaaactggatgacggcacggtgctgctgcccaatgaccgctacccgctggagaaagagacgttccggctctattacacccggctgtcggacgagcagagcagcttcaccgtctgggtggaggactcggacggtcaggcggtcgagctggaatacgacttcaatgcggacaacgacaaggaggacggggatggaagtggaactgggaaagagtga

SEQ ID NO: 4905 - DNA, 306 bp, B.fragilis
agacaaatgagacaaaagagaatcttattcacggcggcctgcatactcgctgccgtgggcgcaatggcgcagggaaacgggcaggcgggtatcaccgaagccacgcagatggtcacctcgtattttgaaccggggacgaaactgatttacgccatcggtgcggtggtcggcttgatcggaggggtgaaagtatatgggaagttcagctccggcgaccccgacacgtcgaagacggcggcgagctggttcggagcctgcatcttcttgatagtagctgccactatcctgcgttcgttcttcctgtaa

SEQ ID NO: 4906 - DNA, 756 bp, B.fragilis
cgcaacccgaggaacaaccgcaacccgaagagattgcagcctaaagacaaagggcagggcggagaaatccgcccgctactttctttcgtgagccgtagcggaaaagaaagatcgcaaagaaaccgatttttaaactttcaaattttcaaacttatgcgaaccgtacagagaacctatacactattcggcattgcggaactggaggacgaagcccgtcaaaaagcctataccgactggcttgccaagggaaacgattacccgtatgcttccgagaactgcgacacgctcgaagccttctgcaaccttttccgcattgcctgcaccaactactgttacgacagttgcacatacgcttaccgtttccataccggacacgaggaggagaccgaaaggctttcgagcgtccgcttgctggcttacctctataacaacttccatgcggagctgtacaagcccaaggtctattggacgaaagaccgcaagaaaagacgcaggagccgtatctccgtcacttgcgaatgccccttcacgggggttgtgtcggacgaaatcatcttgcagcccctcatggacttcatgcgctcgcccgacacacggaatttcaaggaactcatgcgtgactgtctggaaaacttcttccgctcgtgccgtgacgattgcgagtattgcgagagcgaggaatatttcacggacgagagccacaagaataattgggagtaccttatcgacgggacacttttcatagaaacggcatga

SEQ ID NO: 4907 - DNA, 333 bp, B.fragilis
tggaggacgagtgacatggaagtgataacaaaagacacggaagaggtacgtgcgtacttcgaggctctggaagagggcatgaggtatattgatacggtgacggcgcatttccgtccggcgatgaacggcgaggtctatttcacgggtgaggatgtgtgcagaatgttacatatcacgtcaaggacgttgcagggctaccgcacacaacggttgatcccgtacatatcgctgccaggcaagacgctttaccgccagtcggatctgctgcgtatgctggaagaaaattacgtggacatgagacaaaagcgcaaacgggggaaaagtccaacataa

SEQ ID NO: 4908 - DNA, 1224 bp, B.fragilis
acccggaggagatgcgcatcggcgacgacatcctctgcctgcacaccctctcggacacggaagacctgccgggcaaggtggcgacggacagccgttacgagcggctctcgaccgaccgctcggactgccggctgtcgttccgccggccccggtgggcttgctgctggactgcaaccactgctacaaccagtacatcttcatcgacgaccacggggagaacctgaaacgcttcgagcagaccgcccggaacatgcactcgctctcccgctactcccgctccaaccagatcaacaaggcttggatcgaggaatacctgaacgaggcgcactcgaaagggctgacctcggtgcgctgccactgcaacgtgatggcatggagcgacgacagggaggaactcaggcgcatcaagaacgaggtgggcagccagctcgccctgatggagtgcaagccgaggcacaacacggtggacgtgcccacgctcttttgggcggcgataccgggcaacgagggggacttccccttcgaggagagcttctacacgttcatcccgcaagccctgtgcttcttcaccgaagagacgaactacaaggactcgctctcacccttcggcatcaagatggcggacaggatgacgggcagaccgctgcatctggacatcagcgacctgccgatgaagaaaggggtgatctcgaaccgcaacaagtttgtcctcggtccgagcggaagcggcaagtcgttcttcatgaaccacctcgtgcgccagtattacgagcagaacagccacatcgtgctgatcgacacgggcaactcgtaccaagggctgtgcgagctgatacaccgcaagaccaagggcgaggacgggatttactacacgtacacggaggagaagcccatcagcttcaaccccttcttcacggacgactacaagttcagcgtggagaagaaggacagcatcaagacgttgctgctggcgctgtggaagggcgaggacgagaaaatcacgaagacggagagcggcgagctgggcagtgcggtgtcggcgtacatccgccggatacagcagaaccgggacatcgtcccctcgttcgacaccttctacgagtacatgctgaacgattaccggaaggagctggctgcaagggacatcaaggtgagccggaaggacttcaacatcgacaacttcctgaccacactcaggcagtattacaagggcggacgctatga

SEQ ID NO: 4909 - DNA, 405 bp, B.fragilis
gcgtgctctggaacccgtcatagaccgagagggcgaacgctatcggaccaaggatggaaagggcgatcaggaagaacgtccgtatcgtgtcgatcaccagcgcagccgactggaacagcagttcgagcagttcttggaaccacagccggatgttccgcttcatgttgtattccgtccggtcgatgtacatcaccgccatcgtcttcaagtccttgggcgaccagcccagctcgtcgagcttcttgtcgaagtcctccttgctcgccagatatgccttctccgggtcacggcggaacgcctccctctccagcgtctccttctgctcccggtatcggttcatgtcgaaggtctgtgattcgagcatcccgtggcagcccttcaccacgggcgagagcaccgtgttga

SEQ ID NO: 4910 - DNA, 1431 bp, B.fragilis
agatgtactggttgtagcagtggttgcagtccagcagcaagcccaccggggccggcggaacgacagccggcagtccgagcggtcggtcgagagccgctcgtaacggctgtccgtcgccaccttgcccggcaggtcttccgtgtccgagagggtgtgcaggcagaggatgtcgtcgccgatgcgcatctcctccgggttcaactggatgtccttcagcaccgtcgtgtcgtgctgcgagagcgagaggtacttctccacgatgcccgccgccgcttccgtcccagtgatctcgtccgtcgtgaggcggcgcagcgtaacaaaaccgctgtcgttcatgatcttctcgaactgcccgacggcttcgaggaacctcgtaaccgtctcccggtcctctatctccttggggacaagcctgcccttgcagagggtggagaacgtgctttcctgacggctccgcaccttcgtggtctttgtcaggaacaggtagcaggtgtgcgagaggaacgggcgttcgttgaagtgcctctcaaagctccggctcaggaagctcaggtcgtccctgtccgtttccggccggtacttctcctcgatgaagaagtcctgcttgtgtacgatggaatactccggcagcaccttcaccgccttgtgccaagccgagtggatcgcctcgtactcgctccctgtaacggagaacagttccggaagttccaccctgaaggcgaccgtcacgtccgcctccttgctcacgacgcagccgttctccaccgccagcagcgggaacttgctttcgagcgtcgccgctttcattacgtttttcattcttgccagtgtttaaaaataaataatcgggggattttcagccggttcaccacgtatctcggatgcctcctgcgggcggctgccttcatcagcccgtgcgtgccgtaccgggcgttcagccggaaggtcagccataccagcagcgtagccgcagccacgccgaagccgatgcatacccactggttcacgcccgccatgtacaggatgacgaacaccacgaaaacggcgagcagaccgccgcagaagatgaagaggtactggctttccagccccttgaactccacgttcctgccgatccccttgttgatttccatgtccatagtcgctgttttacaggaagaacgaacgcaggatagtggcagctactatcaagaagatgcaggctccgaaccagctcgccgccgtcttcgacgtgtcggggtcgccggagctgaacttcccatatactttcacccctccgatcaagccgaccaccgcaccgatggcgtaaatcagtttcgtccccggttcaaaatacgaggtgaccatctgcgtggcttcggtgatacccgcctgcccgtttccctgcgccattgcgcccacggcagcgagtatgcaggccgccgtgaataa

SEQ ID NO: 4911 - DNA, 861 bp, B.fragilis
ggggacgcaggatttctacatgcgcctgaccactttccactcgcagttccgtgccataggcacgaactacaaccaatgcgtgcgtgcgctcaaatccaatttctcggagaagaaagccctcgctttcctctacaagctggagcggcacaccctcgaactggtcgagttaagcaagcggatttccgcactggtggaggagttccagagcaaataccccgtccgatgatagccaagatctcgcacggcagcagcctgtacggggtgcttgcctacaaccagttgaaggtggacgaacggcacgccgacgtgcttttcaccagccggattatcgagccgcagggcgataacccctacacgatagggcatctttcccgctcgttcggtgactacctcacagccaaccgcaagaccgagaagcccgtcctgcacatctccctcaatcccgacccgaaggattgcttgagtgaagagcggtttgtcagcttggcggaggagtatatgcggcgcatgggcttcggcgaccagccctatatcgtctatcgccacaacgacatcgggcgggagcacctgcacatcgtttccgtccgggtggacgaaaccgggcgggcgatttccgacagctacgaacacgggagttcgatgaaggtctgccgggagctggaacggcagttcggtcttgtcccggctacgcccaagcagtggaaggagggactacccttgtcgcccgtcggttacggggacgacaatctcaagggacagttggcaggagtcatccgcccgctcgcccgggagtggcgtttccgtacattgggcgaataccgtgccgtgctttcccttaccgcatcacggtggacgaggtaa

SEQ ID NO: 4912 - DNA, 198 bp, B.fragilis
atcatggaaggaaagaagtttaaacacaagtatctgccgtacctcacttgcgtggtcgtggcagccacccgaaaagggtacaaggttttggaaacccaagttttgggcgggcgcaggaagcccaaaacaaagacagcctactactacgacattgattttgataaagagcgtggtttgtggcaggaagaaggcaagtaa

SEQ ID NO: 4913 - DNA, 210 bp, B.fragilis
tggggcacggggcaaatttcgtcaccggcttgccccttgtcaaagccatctctttcgaaaacggactggaatagttattttacttttgcggtaatttcatctatcaggttcgtgatcttctcaatggaatacttttctatcaatctcctgtttgccgcttctgcctttagtctttcattgattaattttagttgtggcaaatctgattga

SEQ ID NO: 4914 - DNA, 2055 bp, B.fragilis
ggattgcaggggaaagcccacagcatagcgaggacttgcagcggaaagcccgacccgaaggggaacgctccgacaatcatctggaaacacgaattgaccgtaataacttatttcttaaaagttatcagaattatgcctcttttccgtaattttgaaacctctaatgaacatggctatgatagaaacatactcacctttttaaatgaatatgcggaaatatccgatccgcaatatgccatcatgctgcgaggtgcctggggatgcggcaaaacgttttttatccgccaatggataaagcaactgaaaaacgataaagatgcggacaagttaaaatggcggcccatatatgtgtctttatatggtttgaccactacccagcaaatcacagaacaagtcaacaaggaaatatccccgtggctgtacagcaagggaatgaaacttgccaagaatatattaaaagccgcctcgaaaatcgctttgaaatatgacatcgacggtgacggaaaggatgaagggagtgtaacctgtgacttggactccattttgttgttgaaagaagaaaattccgaaataaaaggaaacaagattctgatttttgacgaccttgaaagatgtgatgtaaaactggaaaccttgttgggatacatcaattacttttcggaacattgtaaatgcaaggtcatcatcattggcgatgagaacaagatttccgaaaaagaggacgataagtgcaagttgaaattcaaggatttcaaggaaaagactatcgggcgcacttttgagatcaaattaaatataggggagacactcgatttcttcattggcgagatatccaccaacaacaggaacctcttgtctgagaacaaagagcttatcatcaagatattccatgcctctaaattcgataatttaagagtcctgcggcaatgtctaaacgattatcacaggatagccatggctttgccggagcattatcataaatctcccaagtacaaacttgtcataacatcgttgttggcaaattttgtcgccgtttactgcgagtataagggtgggaatactcggatcggaagcctattcaacagcctgtatgacatgttcccggataaagagaaagatgaggagcgtgaaaaaatcctctccaaataccgttttatagagataggtaaacagttggatatttttgatagattcatcgttaatgaaattgtctgctatctggaaagcgggtattttgacacgacctacctgcaacaatattttgcagccgaagacgcaagtttgaacagttgggattacctgtacgactattggagactggataacggggaatacgagaaacactacggggaaacggtacgatattactttgcggatgaaagcgttgatctaaaagaattgtttgtcattatatctgtactatcggttttatatagcgacaaccttgttcacgtatccgaggaagacatcatagcccaaggcaagcactccatagacaggctgatggaaggtatcagcgacatggagggtttgttgaattgtaactcaaaggtacatgcgggtacaagaaggaatcattctaatattggttcagatcgaattttgaatggactggttgcgtattttcaaaaactattcgggcaaagattgaagaaatgccctaataaagtgtctgtcatgctggaaaatctgacggatgaaacttgcgaacgcctgaatccggcattgaatgatgtagtcccggtcaaacagcgtctttatagggatacttcaatattccaagaggctgatgcggataaggtttcaaaaagtattttgggattgtccaacgaatcacgtaacacctttctgcattttttacagttccgttataaatatacctcttggggcagtgaaatagaacacttgagcaaatattgtcaatcagatttgccacaactaaaattaatcaatgaaagactaaaggcagaagcggcaaacaggagattgatagaaaagtattccattgagaagatcacgaacctgatagatgaaattaccgcaaaagtaaaataa

SEQ ID NO: 4915 - DNA, 399 bp, B.fragilis
aagaacaagggtgcagcaacggacgagtacctgcaacagttgagccgacagatagaccggttggaagggttgaaagtaaaccacagccatagtttcaacgtgacatattccaggtcgtatcttgttcaagtcaccatcgtggaattgtttcttttttcgctggtgcataacgcatggcagcttaaaaggggctggcggctcaaataccgctacgttctgatgtcgggaaatgcggacgccaagacacttgacaggctggagaactgcttcgagtggaacagggacaggaagctaatatggaagatcaggaaagaggtggaggacttcgagcgttggacggaaaagaaagtggcagaaatgctgcgtgctaaaagacaacagccgggagtggggaaataa

SEQ ID NO: 4916 - DNA, 507 bp, B.fragilis
agtccgttctttccccgtgccccaaagcaaaaaataaatgtttcacttttaattttttgcattatgaatacactgtctttccctcaaatcaccgtaagttacaaggacgctgacgcatccaagagagttagaatccactcttccaaggagtcttacgacatcctcaagactttctacgaggactgtatgcagcaccacgaggagtgctgggcgatgtacctgaacggcgcaggcagactgctgggcgtttcgtgcgtctcacgcagcggcatgaacagtacggtggtggacatacgcatcgtcctccagacggctctcgtctctcatgcctcgggaatcatcctctcgcacaaccacccttccggctcgaccgtggcgagcacgccggacaacaacctgaccagccagttgaagaaaggctgcgaggcaatcggcatacagcttttagaccacatcatactgaccgaggacgcctaccttagctacatggacgaggggatgctttaa

SEQ ID NO: 4917 - DNA, 1014 bp, B.fragilis
tataggactatgttgttagcgatagacttcacgaacctgcatgagatattgcaggtattgtatcaggacatgatgccgctctgcgagaagctgacgggggtagccaagggaattgccgggctgggtgcgctgttctacgtagccgccaaggtgtggcaggcgctcgcccgtgccgaacccatcgacgtgtacccgctgctccgcccgttcgccatcgggctgtgcatcctcttcttccccaccttcgtcatcggcacgatcaacacggtgctctcgcccgtggtgaagggctgccacgggatgctcgaatcacagaccttcgacatgaaccgataccgggagcagaaggagacgctggagagggaggcgttccgccgtgacccggagaaggcatatctggcgagcaaggaggacttcgacaagaagctcgacgagctgggctggtcgcccaaggacttgaagacgatggcggtgatgtacatcgaccggacggaatacaacatgaagcggaacatccggctgtggttccaagaactgctcgaactgctgttccagtcggctgcgctggtgatcgacacgatacggacgttcttcctgatcgccctttccatccttggtccgatagcgttcgccctctcggtctatgacgggttccagagcacgctcacgcagtggataacgaggtacatctccatctacatgtggctgcccgtgagcgacctgttcagctcggtgctggcacgcatccaagtgctgatgctcacccgtgacatcgaggcgatgagcgacccgaccttcatcccggacagctcgaacacggtgtacatcatctttttaatcatcgggatattcgggtacttcaccatcccgacggtcgccaactggatcatcatggcgggcggggtgagccaagccaaccgtgcgatgaaccaaaccgcaaacaaggtcggcaacgtcgccgcagcgggtgcgggtgccgccgtggggaacatcgccggaaaaatcatcaagtag

SEQ ID NO: 4918 - DNA, 1329 bp, B.fragilis
ttaactacctttagaaacgaaaattttagagttatgaaaacaaagagaagtacgtttgcaacctcgttctacatcaagagatcggcagtgagaaaccgggacggaaaagcccccatcatggtgaagatctccattgatggggatgacaaagtattgggaaccaaactattcgttacgccggatttatgggagaatggtaaggcaaaaggcaagtctgccgaggcgacagagataaacgggcagctcaaagaagtcagtgcccggcttaccaaccactatcaccgcatcctccgggaagaggattttgtcaccgccgaaaagctgcgtaacgcctttctgggtatcggtgtgatggaaaactgtatcctgaaagatttcgagaacatgaaccgggaatttgaggcgatggtggagaaaggacagcgtgccaaatccacttacaacaagtacttggccgtgtacaaccattttgccaccttcctttgggagaagaagaaacgaaccgatatggcttacaaggaactgacaaaggagattatcaccgatttcgacaagtacctgcgcgtggaaaagggattgagtgacaacactctttggatatacaccatgccactgctcagcctgacagacaaggcatggcggcgtggtatcgtccgttccgaccctttcggcgagtacagccttgaaatgcaggagacagaccggggctacctcacggaagaggaactgcgcaccctggctaacgccgtgttcgtgaaaaaacagaccaacctcgtacgtgacatgttcctcttcgggtgcttcaccggacttagctacattgatataaagacactcacccatgacaagatccagcgcatggacttcgacggcgaggattggatcataacccgacgcaccaagacccgtgtgtcgagcaacgttccccttatggaaatagccaaggaactgatagaaaggtacaagggacttgccggaggcgatttcgtatttcccatgccctctaacggtacatgcaacaagcacctcaaacagattgccaaagcctgcggcatcagcaaggagatcggattccacctgagcaggcacaccttcgccacgaccgtctatctctgcaacggcggcacgatagaggcgctctccaagatactcggtcacaagcacatcagcaccacgcagatctacgctgaagtaaccaacaagatggtaagttcagatttccgtgcaatctccggcaacctcgccgccatgcagcggagcgtactggagaaaagggacaggaagcaaggtaggaaaaaggtgcaccggtccctccgggaaacggcttga

SEQ ID NO: 4919 - DNA, 315 bp, B.fragilis
atttttgacttgatggaagaacagacccaagaaaaagcaacggccaacgcagcacgtgacggtggcggatgccccaaccccggagacggggaacggaaagaaggaggacaagggcggcgggaaaaaggagaagaagacagccaagccgctcacgccgaaacagttgcagcaacggaagaagctgatggtatatccgctgatgggcttgctgttcctcggctcgatgtggctgatattcgcaccttcggaggagcgggacgtgaaccgggacaccgtgggggcgttcaacgccgacatccccctgccggagaatga

SEQ ID NO: 4920 - DNA, 339 bp, B.fragilis
atccatatatttgcagggaagtataatgaaaaatgtatcagaacgatggaaatagtaagtattgaaaagaagacctttgaggagatgaaggagcggttcggctgcttctcacggcacgtgaaggaactttgcgcccgttaccgcccgcccgggaagatgaactggatggacggggcggacgtgtgcgagaaactggggatcagtaaacggacgttgcagacctaccgtgaccggggactgctgccgtacagccagatcaaccataagatttactaccggacggaggacgtggaggtattcgtggaatccatgagccgggaaataatggaggacgagtga

SEQ ID NO: 4921 - DNA, 1005 bp, B.fragilis
  unsure (840): Identity of nucleotide sequences at the above locations are unknown.
agaatagtgcctatgaaacttaagtattgtattttatctctactctttttttatctgaatatttcttctatccaggccgtaataccacagatggaagtcagtccggatgagagaggtgtgagttcgctcgtttttcaaggtgcgggcaatgttcggaattatgtagaccacgggaaatatctgggcgatttgagtctgatttatgaagtaagagggaagagttatgccgtttctttggctgatattactcctctggtcttgtcgaatactccggataagatacagatattctggcagcttcctttcgatgtgcgtctttaccaaacttttactattaaaggagaagaagtagactgggagattgatttttttaatcgcagtcatcatccggtgaaggtgacggatatgtggttcgctctgcctgtgggcgctttggatgagtctattcaggcacatcagaacctgaaccgtcatttctctctgaatggaaatgcctccttcttttattggactccgctgacagggcaaggtgatattctgctgatgactatgcataagggaactgcgatagaatatgctacacaagatggcaagtactatctgcattcaatgaatgctgtagatcgtaccaatgatagctggagattaccgtctacctcaaaaaacgtacagccttacgagcattacatgacaggtttcaacttcacactcactggaaatcatgaagaggtaaaaacgaagatttatgataaacacggagtggttgtgaaagttgctcccggtatggtagtaactcctgagtttgaggtctattgtgccttgcaatcgaaactgcctgtngctgaattagtggcagaatatccagaggagatacagataaccagtcttggacaaaaggaaggagataaatatatctataagttccgtttctcccgtttgggagaaaacctgattacggttcattatggagatgatttgatatggctttctcgatttcttttgtga

SEQ ID NO: 4922 - DNA, 930 bp, B.fragilis
agacataatatccagttagtgccctacaaaaaaggagactttccggaggcactgatggaaatgagctatatagggacgaatcaattgaagtttacggtgacagatcggcggattccttcgggcatccggatgaagccgaatattcatatctttggaggacttgccaatcaaccgggtaatacaattatcgagagtcgctttgtagcgtgtgatgctgatcgtgcaatacgtaaatactctaatgatgcatgggtagctgcttattttggtttacataccgaacagttggaagactttcagggatatagtgcaggatacaaatattatacgttccaagatgaacgttcgtatggagcgtttcagactaacgatccattatcccgccgtcctacggaaggattttataaacttggtgatatgtacaaccgggatacttacttgcagccttttttggatcatggagaaaaaatcattcttcgccaagtggatatgtacgtgaatggtcgttcgacttttgtggcagctgatgattcgccttataaatatgatttggacggagacggagtattggaatcgtatgaatgtgaactcgatcctgctaccggtcttccggtacatgaagccgactatacaaagtacaaaggttttcagggagatgtttatctctcttttatagagatgggaactgatgaatatgaaccgtggaataccggtgtttcattaggttctgtatatactaccggaggaattcagaaaacttataagtatatttacaccggagccggtgactttacaattaccgctgttgctaccaatgtaggtgataaagattataaaggaatagattatagcgaggaaagaagtaactctttggatgactatagtcataagagagcacttagcagtgtgaaggtttcggtaaaaccgtag

SEQ ID NO: 4923 - DNA, 522 bp, B.fragilis
gaagcagtgttttctataccggtggatacgacatttatgaggcttcgtcaatgggagtggtattgtcagaaacgggctgacagttgtctgacagagaataattatcagggagctttatcttggctggattccgctcgtatccaagtggaacattacggacgtccttattatatattggcacgcggggacgtatattattccatccatcaatatgattctgcccgtcgttattttagtatggcagtccattccattcatccacatattgctatcgaagcttggaggaaacttgcagaactggaacttatggaaggaaatgagaagcaagggttctattctacgcagaaggcagatgcacttttccgggtggagataggccatgtgcagagtgataacagtgaagctctatatcaggaagagaggttgaaaaacgagttaaaccaattgaagattgccaaacagaatagggaaattgccatgtcttcaccacggggctggaaggatccgcgatggcgttcaccc

SEQ ID NO: 4924 - DNA, 1278 bp, B.fragilis
  unsure (17): Identity of nucleotide sequences at the above locations are unknown.
gcacttttttttcattnttataccaaatatatgttgtttattccaagaaaaattgtgtcctttgcaaaagaaactaaaacgccaaacactatgtacggtaaaatgaaagaacacctcagcaatacgattgctgaaatcaaagaagcaggcctctacaaagaggaacgcttaatcgaaagtgcacaacaagctgctatcaccgttaaaggcaaagaagtgctgaatttctgtgccaacaactaccttggattgtctaaccatccccgcctgatcgaaggtgcaaagaagatgatggaccgtcgtggatacggtatgtcttctgtacgtttcatctgcggaactcaagatatacataaggagctggaagccgcaatttcagactatttcaagaccgaagacacaattttgtacgcagcctgctttgacgctaacggcggtgtattcgaaccgttgttcaccgacgaagatgccatcatctccgactcgctgaaccacgcttccatcatcgacggagtacgtctttgcaaggcaaagcgctaccgttatgccaatgcagacatggccgacctggaacgttgcctgcaggaagcacaggctcaacgtttccgcatcatcgtcaccgacggtgtattctcaatggacggaaacgttgctccgatggacaaaatctgtgacctggccgaaaaatacgatgccctggtgatggtagacgaatctcactcagccggtgtggttggtgcaaccggtcatggagtaagcgaacagtacaacacttacggacgtgtagacatctacaccggtactctgggcaaagcttttggcggtgctttgggcggattcacaaccggccgcaaagagatcatcgacctgcttcgccagcgcagccgtccgtacctgttctccaactcactcgctccgggcattatcggtgccagcctcgaagtattcaagatgctgaaagaaagcaacgaaatccatgacaaactggtagacaacgtaaactacttccgcgacaagatgactgcagccggattcgatatcaagccgactcagagtgctatctgtgccgtgatgctttacgatgccaaactgtcacagatctatgcagcccgcatgcaggaagaaggtatctacgtaacaggcttctactatccggtagttccgaaagaccaggcacgtatccgtgtacagatttcagccggtcacgaaaaagaacacctcgataaatgtatcgctgcattcatcaaagtaggtaaagaattaggtgtactgaagtaa

SEQ ID NO: 4925 - DNA, 735 bp, B.fragilis
aagagtttcgaaaaccggttggcatgtggggatatcgacacattgctaattattaaaatgaaaacaataatggcgggagtcaccgtcctggtgttgttcgcttcatgcggcaacagtaataagactgacgctgacccctttgcatctattacacatctggtagattcggcaatggtgaacaaaaccgattctattgacagagaaaagacttcggacgaacctaaaccgattgaggctgacgaatcgtttgacgactttatctacaactttgcttctgatgacgctctgcaaaggcagcgcgtggtgtttccgttgccctactacaacggagaacgggctttgaaaatcgacaggaagtactggaagcatgatgacttgtttgccaaacaaagttattataccttactcttcgaccgggaagaggatatggatctggtaggagacacttcactcacatccgttcaggtggaatggattttcgtgaaaaaacgaatggtgaagaaatattattttgaaagaattaaaggggcgtggatgctcgaagcaatcaatctgcgtccgattgaggaaaacgagaacgaagactttgttgaattcttcggtcattttgcgacggatagtattctccagagccggcgaatccgccaaccgcttgtctttgtgacaaccgatccggatgatgacttctcgttactcgaaactacacttgacttgaaccaatggttttgcctttaa

SEQ ID NO: 4926 - DNA, 1050 bp, B.fragilis
tgtatgaaaagaatgatcgtttataaaagttgctcgtatgtaatcatggctctgctttgtacggcatgtgccgctggctctcccgaagaagatatggaggatcgggtacggattgatcccgttgccggtggatattatccttcaatttctccttcggcccagacccgtggggcgacaccggatggcgaaacgttgaaagatagaccgatttttctgctggaagacgggagtacgatacgcctggtggtatatgatgatgccaagaatctattggaggagtattccaaagcttatctggtacgtaacgccggtacgtcaggcagcagtctgctctatccctgtgaggtagacgacaacggagcggtaatatcttcaagcagcactcctctttatatgaaggcgggtacttattacttcagaatcctgtcacctgccaaggctttaaactcaaagggatttgtcaatatcggtaacggagaatacctgcttgcgaccgacgaccggtatacgcaaacagccatgacggcagtgaccattacgaaaattgatgaagggggtacattgaacaatgtccagacactgtatctgccccccatcatcaaccagacagcgcggatgcagtttactgtcagggcgggtgaaggggtgcacaccttggagatgcttgccgaaggaatcgaaatcagcggtattcagcagccactggacaatacgaccagcttcgactgggtaaatggagatgtgctgcctgtgaaagtgggggatcagagtgcatcggtacgtatcacacaggccacccgaaatgccgataacagcctggtggcgcataccggcgtattgcccacagacgcacgttctcactctatcagtgtgttgctgaacctgaaggtgaacggtaaccctactcagtatcagatgttgctcaccggtttgtatctgacagcagggcgttcgtacaactatacggctacggtgaagatcagtaatggcgtcactgtgctgacctggcaaaaccgttcgtggacggagaatgtagtaatggataaataa

SEQ ID NO: 4927 - DNA, 420 bp, B.fragilis
aaaaatacgataacaatggaagaacttacactcacgacacccgcgctgctattttcagccgtttcacttattcttttggcatacaccaaccgctttctctcgtatgcccaattggtccgaattcttcgtgaccgctatatggaagatccttccgacatcaatgttgcccaaattgagaatctgcgcaaacgcctcaacctgacccgtatgatgcaggtattcggcattgccagtctattcttctgcgtagtcaccatgtttcttatctacatcggattgctcctgctctcaatctatatcttcgggttggcattgctactgctgatcgcttctttgggggtttccctccgcgagatacagatatccacccgtgccctggacatctacctgagtacgatggaaggcaagctgaagcattaa

SEQ ID NO: 4928 - DNA, 930 bp, B.fragilis
aataaacagattagagtaatgaataataatgatcccatgaaaagattcggatatatcgtttttagtatttgcctgtttgcgctgagtgcctgcacatcccatgaacagatggatcaggaggagggaatagtgaaagtgtcgatgggacttactgccgcttctttcaccgatgatgatgcgacaacccgtgcggagcagccgatggcacctgattatgaaaacctgattagtaatttgtggattctgcagtttgaccgtgaaggtatcctgacaggcagcgaacataaagtgctgcccacaccggtgctcaacaccacgcttgaaggaattgcgttgaggaccgggcgcggtacggtttgtgtggtgggcaatctggcggatggagagattgccgcgtggcctgataacttgagtggcttcaagagtctggtggtggatatgggatggctgaaagaacggaatacggaccggaatgtgtgtctcttcggttattacgaaggcgagattgctgccggcaccacagctgtgaatgtagtattgggacgtctggtatgcaggctcaatatagctgtttcggccaagacggcagggatattcagcaacgtgaggatccagttgcagaatgcgcagaccaaaggctatttgttcccttcggatgtatatctgtcaccggaaggaggcgggaattatacggaagaggttgtcatcggtgccgacaaagtattggggacagcccccctttaccgctactattatatggctgagaatgtgactgagggaaccgactccggtgaacgcacccggctccaaatcaaagcaaagaaaggaggggccgaatatacaaaagccattgacttgggcagaagtgacatccatgattattccctccgccgaaacaataactatacattcaacatcgttttagagtaa

SEQ ID NO: 4929 - DNA, 207 bp, B.fragilis
aattgcggcttccagctccttatgtatatcttgagttccgcagatgaaacgtacagaagacataccgtatccacgacggtccatcatcttctttgcaccttcgatcaggcggggatggttagacaatccaaggtagttgttggcacagaaattcagcacttctttgcctttaacggtgatagcagcttgttgtgcactttcgattaa

SEQ ID NO: 4930 - DNA, 975 bp, B.fragilis
tacaccttattagtaaagataatgaaaaatattttggtaattggagcgaccggacagattggttcggagctcacgatggaactacgtaaacgctacggaaacacacatgtagtagcaggttatattcacggggcagagcccaaaggggaattgaaagaatcaggtccgtcggctgtagtcgatgtaacagatcaggatatgattgcctctgtagtgagagagtataatatcgacacaatctacaacctcgccgccctgctgtctgttgtagccgagtcgaagccgaagctggcttggaaaatcggtatcgacggtttgtggaatgtacttgaagtggctcgcgaaaacaaatgtgccgtattcactccgagttcgatcggttcgtttggtgaaagcactccgcatgtgcagacaccgcaggacactattcagcgtccgcgtaccatgtatggtatcagcaaggtgactactgagttgctgagcgactactattttaataagtatggcgtagatacccgtgccgtgcgtttcccgggaatcatttcgaatgtaactcctccgggaggtggtacgactgactatgcggtagatatctactactctgccgttaaaggagagaagtttatctgtccgattccggaaggaacactgatggatatgatgtatatgccggacgcgctgaatgcagctatctcgctgatggaggccgatccgacgaaactggtgcaccgtaatgctttcaacatcgcttctatgagctttgcgccggagaccatttatgctgctatcaagaaacatgttcctgactttgagatggaatataaggtagacccgctgaaacaacgtatcgccaacagctggcccgacagtatggatgattcttgcgcccgtgaggagtggggctggaaaccggcttacgatttggaaagtatgacagtggatatgcttgaaaaactaagagctaaattaaaataa

SEQ ID NO: 4931 - DNA, 1770 bp, B.fragilis
gcagaagaatcgtgctcggccttaatgtttcattctaaaaaatcacgtcatattatgaaaatcaaacatatcgtatcttgctttttcgtttctctgatcggactttcggcttgctccatagaggaactcccctacaaccaactgacagaggacgagctggatggcagttatgaatctctgctgtctgccacccgtggtaactatgccgtatttaaacagacagccttccaccaggggtggcactatgcaggcgagttggccagtgataacgtttcgttgagcggagtgtcgtcggatgcattaatgtatatctacaactaccagcgcatcacggacaactaccatatgtcgaacatgtggggatgggcctaccgctccatcatcaactccaacaagatacttgagaaagcacaggaaggagagagcaaagagatggaccagctgattggcgaaaactacttcctcaggggatggctggaatttgtactggtcaatgtcttcgggcgcccttacaatcagtcaccggaaaccaacctcgggattcccctgaaactgacggcagacataaacgactatccaatgcgctctaccgtaaaggaatcttacgagcaaatcctgaaagacctgaagaaagcagaaacactgctgaattcggagtcgaacatctacgccggtcccagtgcagccaaggctctgttgtcacgcgtctatctgtacatgggtaacaataagctggctgccgaatacgctaccgaagtaatcgaaagttcaggacgtactttactggaaggagaagcttatgctacagccaatgttttggtaccggaagataatccggaaatcatctttgccatccgttgtactaaagataaagacgactacggttggaactctatcggaggcttttatgccaatatcgatggggtaggctggggagagttgtatgcttccgaaccactccgggatgcgtatgcggaatatccggaggacttgcgctcacgatatatcgttccgcaatacctgaaagatgacgagacaggtgaatatcgtaaagaatttatctatatcgaatcctccgaagaagatggagtccccagaaagtattaccgctggaacgaaatcatagaagaaaacggaaactaccggatcaaagatgcctatttgtcgaagtatgaatacaaagacacactgaccatgaagcaggatgccggaggctattacgtagaatcgagactgaaatcgggtaaagacaatcccaccccgggcacatacgaaaaacattacgtgaccatccaaaatctgatggcaaaacgcaatgactatccgaagtactacgtatacaaatgctccaaacaagaaaaccaaccccagctgtggtcaccaactgttctccgtctgggcgaaatgtacctgaaccgtgcggaagcctatgccaaagaaccggcattgggtgatgctttggcagacctcaacgtaatccgtacccgggcacacatacccgcactttcggccggtgacatgaaacccggtaaaaccatgttggaatatgtattggaggaacgccgcaaggagttggctttcgaaggacatcgccgcttcgacatcttccgcaacggactgaccatgaaccgtacctatccgggcactcacgaccgtggagccgcaacttcggtccgcctgaccatttcagctgacgatccggcagcaatcgaattcatccctcaacgtgagatcgattcatatccgggagtcttggaacagaatccataa

SEQ ID NO: 4932 - DNA, 3183 bp, B.fragilis
tcgtctttgtcccgatgcctggaatggaaagctgaacagcatgaagatacgacaagcagtccaggaagtgatttatcagtcgttatatacaccggaatagtggaagtgaatggctttttacaatataaaatgaaaagaagatatttattggctggtttagttgtatcagcgcttttgggagtaggagcgaaagttcctgcttctatggatgcccctgtccgtgaggtttttcatactcctcccggtatgtctgctcctatagaacctttgttgctttatcaggcttcccaggatgaaaagtgccgtcactgggtagattctgtctacaatcggatgaatctgagagagaaggtggggcaattgtttatttacaccattgcgcccgtgcagaccaagcgtaatatgcagttgttgcgtgatgcggttcatacttataaagtcggtggattacttttttccggcggaaagatacagaatcaggctacattgaccaacgaagcgcaacggatggcccgctgtccgctgctgattacctttgatggtgaatgggggctttccatgcgtttgcgtggtactcctgtctttccgagaaacatggtattaggatgtatccaggacaaccgtttgatttatgaatatgggcgggagatggcccgacagtgtcgtgagatgggagtgcaagtcaattttgctccggtggcagatgtgaatatcaatccggacaatccggtcatcaatacccgttcgtttggtgaagatccggtgaaagtggccgataaggtgattgcttacgcttcggggctggagagtggtaaagtcctttctgtctgcaagcatttcccgggacatggtgatacggacgtggattctcataaggcactgcctgtgttaccatttacgcgcgagcgcctggacagtgttgaactgtatccttttaaagaagctattcgtgccggggtcagtggtatgatggtaggacacttgcaggtacctgtcatcgagcctataggtgatttgccttcatccttatcccgtaatgtggtttatggacttctgaccgaggaattggcatttaagggacttatctttaccgatgcccttgctatgaagggagttgccggcaataagagcgtatgtttgcaagctttgcaagccgggaatgatatggtgctggctccccgcaggctgaaagaagaaatggacgctgtattggaagcggtggaaaaaggagaacttccggaagaagaaattaatgcaaaatgtcggaaagtactcacttacaaatatattttggggctggaacgtaaaccgtttgtgaaactatcgggattgggaacccgtattaatacacctcagacacgtgatttgattagcaggctgaatctggctgcaattactgtgctgaataataaaaatgatgtattgcctttgcatcccgatctgaaagaggcggccatactgaatgtaggcaaaccggaagagattgagccttttgaccacaaaatgaaaaagtatacttcatttgcccgttttcaattgcgtaaagatctgccggaagccgagcaacaaaagttgcgtgactctcttgctgcctaccggcgtgttatcgttactgtgacagagcagcgccttgcttcctatcagtcgtttttcgccaagtttgctccggaatctcctgtgatatatgtattctatacgccggctaagtcgatgttacagatacagcgggctgtatcggctgctgaggctgtggtattggctcatgcctctcgtgacgacgttcaggaacgtgtggctgatttacttttcggtaaagcaacggcagatggaagactgtcggccagtattggcggattgtttcctaccggttcgggtgttacgattactccgcatacgcctttccactttgtacccgaagaatatggaatgaaatcggaagtgcttcgccgtatcgacacgattgctttggagggaatcaaggagggagcttatcccggttgtcaggttctggtgatgaaggatggcaaagctttgtatgaccggtgcttcggataccatacagatgcaaatagcgagaaagtgaagccgacggatatttatgatttggcttctctgtctaaaacaacaggaacgttgttggccataatgaagctttatgataaaggtcgtttcaatctgaccgataaagtttcagattatctgcctttcctgcgcaagacgaataaagagaacctgaccattcgtgaattgctcatgcatcagtctggcttaccttccggtctgcttttctatcaggaggccattgacgggaaaagctataaaggttcgctgttcaagcagtcgaaagatgccttacatacggtacggttgggtgtccgtacctggggaaatccaagattccggtttaataaggggatggcgtctaaagagaagaacggtgattatactcttcaggtttgtgacagtttatggttgaaccggtcgttccgtgaagagatacggaagaaaatagccgaagcaccgttaaaagacaagagttatcgttatagtgatgtcgggtttatcttgttgcagatgcttgcagaagagcttagcggaaaaccgatggatgaatatttatggcaagagttctatcagccgatgggattggaacatactgcctatctgccgttgcgttacttcgataaaaaagaggtagtaccttctgcagtagaccgtttcctgcgtaagactactttgcagggatttgtccatgatgagtcggctgctttccaggggggaatttcgggtaatgcggggcttttctctaatgctcgtgaagtcggacgtatttatcagatgttgctcaatggcggtgagttggatggaagacgttatctcagcaaggaaacttgtgctctattcactaccgaaaagtctaaaatcagccgtcgcggtttaggttttgataagccggatgtggtgaatgaaagtaaaagtccgtgcgctgcttctgttccggttactgtttttgggcataccggatttacaggaacttgtgcctgggtagatcccgacaatggcttgatttatgtatttcttagtaatcgtacctatcccgatgcttgggtgaacaaattatctaaacttgagattagggaaaaaattcaagaaacgatttacgaagcgatgaaagaaaagtaa

SEQ ID NO: 4933 - DNA, 729 bp, B.fragilis
atagatgaaactgtgatacacttaaaagacattaacaaaacctacaacaacggagccccactccatgtactcaaaggcatcaatctcgacatcgagcggggtgaattcgtttccatcatgggagcatcaggttccggcaagtctactttactcaatatactaggtatattggataattacgataacggagagtattacctcaacaacgtgctgattaaggacctgagcgaaactaaatccgcggaataccgcaaccggatgatcggtttcatcttccagtcattcaacctgatttcatttaaaaatgcagtggaaaacgtcgcactgcctctgttttaccagggagtaagccggaaaaaacgtaatgccctggccatggagtacctcgacaagctgggactcaaggattgggcacatcacatgcccaatgaaatgagtggaggtcagaaacaacgtgtagccattgcccgtgccttgattacacagcctcagattattctggccgacgaacctaccggtgcattggacagtaagacgtccgtagaggtgatgcaaatactgaaagacctgcacaagaccggaatgaccattgtcgtagtcacccacgaaagtggagttgccaatcagacagataaaattatccacatcaaggatggtataatcgaacggattgaagagaacctgaatcatgatgcctcaccattcggcaaggatggatacatgaaataa

SEQ ID NO: 4934 - DNA, 447 bp, B.fragilis
atgccggaggccatgttctcaatgatggataatctgtttaccggtatccatgtattgatctggatggtaggcttgggcactctgctggcaggggctatcggtgtatcgaacatcatgatggtgaccgtgaaggaacggacccccgaaataggtaatccgcgtgccatcggtgcccgtccgaaagacattttacaacagattttatcagaaagtatggtattgactaccattgcaggcatggccggcatctcttttggtgtactgatcctgcaattaatggaaataggcgtcaactccggtaaggaccattattcccacttccaggtgtcttttggtatggctatcggaacctgcctgttactggtgacgctgggactactcgccggactggcacccgcttacagggcaatggctatccgaccgatagaagctatcagggatgaataa

SEQ ID NO: 4935 - DNA, 786 bp, B.fragilis
tcaaagattctaagaaggaaaaagatgttcgacaacgaacacctcacctacatttgcggacactataaaaaaggagcaagtgaaacatacgatagcagacaatatccccgggaaagaagcaaaacagaaatactcacaactattaatcctcttttgctttttttttcataccttgcggcacttttagatcatacagaaaaatatcccggaacacagtatacaagaatggacgacttaaatatcaacagttttaacgctctctatactctttattacaggaagtctttcttgtttgccaaatcgtatgtacacgacgaacaggtagcagaagacattgcggccgaagcactgatcaaattgtgggaaaaactgaaaactgatatcataaattcccctcaggccatgttactcaccattctgaaaaataaatcactggattacttacgtctggaacaaaacaaactgaatgccatgtccgagttgagtgaactttatgttcgcgaactggacattcgtgtatccagcttggaagcttgtgacccgtcagagattttttccgaagaagttaaccaaattatccaagccaccctacgcacactcccggaacaaacccgaaaagtctttaaaatgagtcgtttcgagaataaaatgaataaggaaatagctgaaaatctgggcatcacagtcaaaggagtggaatatcacatatcaagggcgcttaaagaattccggatttcactcaaagattatcttcccttgttttacttctttttctatttccactaa

SEQ ID NO: 4936 - DNA, 3024 bp, B.fragilis
aataccgtctatgaaatacctcccagacaaactatgctaaaacaactactaacagttgtgtttctgctgagtgcaggcactttgtgggcacaacaagctgcaggacttctgcctgtacaggaagatacacattgcaaagaatgggtagagcagacgctctcccgtatgaaactgaaagataaagtcgggcaattatttgtttataccctggctccacgagcagataaagatactgaaaagctagtgggcaaactgacccgcaagttcaaagtaggggcctttctgtactctgaaggaacagtagaagatcaggcaaacctgaccaactatgcgcaacgccagtcgaaaattccattaatgattacctttgatggtgagtggggactcgccatgcgattggaaaatacaccggtgtttccacgtaatgcggcattgggctgtatcagcgacaataccttgattgaggcttatgggcaggaagtggcgcgtgagcttcgtgagatcggtgcgcacgttaattttgctccggatgcggatgttaataccaatcctgaaaatccggtcatccatgtccgttcgtttggtgaaaatccgaaaactgtggctgagaaagtaatagcttatgggcgtggattggagaccggtggcattttgtctgtctccaagcatttcccgggacatggtgacacggatgtcgactcacaccaggcattgcctgccgtttattataatcgtgcacggctggacagtgtggaactgtatccttttaaagaagccattcaggcaggattgggaggtgtgatggtgggacacttacaagtgccggccttagaacctgaccggattaccccttcttcattgtcacatagcattgtgacggatctattgagaggagagttgggattcaatggattggtatttaccgatgcgctcgccatgaaaggagtagctgccgaatcggatgtaacagtgaaggctctgaaggccggtaatgatatggtgctggtacagcaaaatgtagaaaaagcacaagagagtgtggtgcaagccataaaagacggacgtctcacgatggaagaaatagatgcgaaatgccgtagaattctggcgtataaatatcgtttgggattaagcaggcgaccgatgattccggtagacggattgagtgaccgtattcatactcctgaagcgcaggctttggtaaccaagctgcgtacgtcggcagtgaccgtacttgggaattattttcagatccttcctcttactgcaacaaagggtgagatagccgtattaacagtgggagatgaaggcagcgatgcttctttcatcgaggggttacgtagtgaattaccattaaaaacattccggatggataaaaataccggggaagaagagcggcggaagatagtgaaagaactgggaaactatcggagggtggttgtctgtataacggtgcaggataaagaagcgggtgagtatcgttcgttttttgccgggttcaggccccaagctcctgtggtctacgctttctttacttcctatcgggcactggcgtcgcttgaagaggctgccgcccgttcggctgctgttgtcctggcacattccggtgaggaggatttgcaacgctatgtagccgatgtggtgttgggcaaagcttcggcaacgggacgtttatccatgcgtatcggcaatacatttgcagccggttccggtgtagatgtgatatccggtagcccagcgggcatagcacccgaagattatggtttgaaatcatacagactccaccggatagactcggtggtagctgccgggctggcggcgaaagcctttcccggatgccaggtgttggtattgcggcatggacaaccggtatatgataaatgtttcggcactcactctgtaacagacactactccggtacgggcgaccgaccttttcgatctcgcttcattgactaaaaccagtgccacactgctggccgtgatgaaactctatgatcagggacggatcgagttgacagatgctgtctctaaatacgtgcctgctttgcgggctacgaacaaaaagaatatcacaatcagggaactgttgttacatgaatccggactggtgccttatattcgtttttatcgtgatgcaatcgatgaatactcggtgaccggcccttttacacaaggatttgtagacgagtggcaccatacccgtatgggagaatatacttatgcctgttccgatttcaagtttaagaaaggattggtttctgcaacaaaaacctccgggcatacgttgcagatagccgatggattgtggctggacaagaaatttaaagctgcgatgatgaagagtattgcgcagtcggaactcgaccgtaaacgttttgtatatagtgatatcggatttatcctgttgcaacaggtggtggaagccgttaccggcaagacactcgatgcttatttagtttcagagttttatcggcctatgggattggaacatacattgttccaccctttaaaccgttataagaaagcggatattatgccgactgctgccaatgattacttacgtcggcaggatctttgcggatatgtgcatgatgaagctgccgcctttatgggaggcgtaagtggcaatgccggattgttttcaacggcccaagagttgggaaaaatctatcagatgattctgaatgagggtgaactggatggaaaacgctatcttcggccggaaacctgccgtatatttactacggagaaatcagctgtcagtcatcgtggactggggtatgacaaacctaatctgaaggatccgaaggcaaatgcctgtgcttcttcggctccggcttctgtttacgggcataccggctttacgggtacttgtgcttgggttgatccggagaacgacctggtctatatcttcctgagtaatcgtctttgtcccgatgcctggaatggaaagctgaacagcatgaagatacgacaagcagtccaggaagtgatttatcagtcgttatatacaccggaatag

SEQ ID NO: 4937 - DNA, 1401 bp, B.fragilis
actatggatttatcggctgcaaagttatacaattcccaaaggatgaatagggctatttcccggaaaaaattctatttttggaaaatcattttagaaggacccgggaaaaagtgggaaccaaatcgccgaaccctcaaggacttaggaatggtggaagagccgtatggcaagaaaactcttttttcgctctttgacatgacggaaagtgatggaggaaagaggggtctggaaaagtggctggttcaccctttgtctgattggaaagcattgcacgaaaggcaggaagcgatccgctatccggactttccggagatacgtatttgtagggaagaactggatttcattgagttttatctcagccagggagatcgtccgacgagagtgagctatttggaatctgccttttcatatatcttccggcatttcagggctactcccgagcgttatgtcatccgtaggggaacgaagttgcttgaaaacgttttgttggagctgaaaacttttgcagatcatgtgacggcactctctccccggttgatccgtaacattgccgccactatctcagagatctatcaggctacagaattgggaaaaatggttgattcctgcgggcaggaagatagcttttaccggaccgaccgtttggattacattttccgttatcgacgaaatcataccattgcagctcttctttctattgtatatcaactggatgccattcgtaccgtgcatcggacagcagtgacgaaaggttggtgctttccttcttttactaatgatagcaagtttatgctgtgcaatttctatcatccgcaagtgaaagatgctgtagcgaacgattgggagatggagaatgggaatatctgcatctttaccgggtcgaatatggcgggtaaatccacgactttgaaggcaatagcatctgctgtatggttggctcatgccggatttccggtaccggcttcctcgatggtttgtcctatgttcgatggtatttttacttctatcaatctgccggattctctgagagatggtcgcagctatttctatgcggaagtattgagagtaaaagaggtgctggaacagattaacaaggggcatcactgttttgtacttttcgatgaattgtttaggggaaccaatgcgcgggatgcttttgaagcatcggttgccgtagcagaggtgttgaaagcaaaggcatatagccgttttttgatatctacacatatcatagaattggcccgtaaattggatggagatgacgcctgttgtttttattatttagaatctgcgatagtggatgacgagttgatatgtaaccataaagtgaagccgggtatttcagagtcaagagttggatattggattgtgaagaaagaacttgccggatttgagaaataa

SEQ ID NO: 4938 - DNA, 933 bp, B.fragilis
attatgaatcaagagatactaaacagatatcttacaggagatgccagtgcggaagagaagcaaatggtagtccgatggctggatgccgatccacaacacatgcgtgagtatcttgccctgagaaagttgcacgacatcaccctttggcaagagaaaccggcagcaacggttgataaaaagaaacggctgacacttccttacatcagggagttcattaaaatagccgctattttcctcatagcagttacctctgtttatttcctggctccggagagaggaaaagatacacctgatttgaaagcaatacatgtcccatcaggacaacgggcagaattaacattaggtgacggaacccgagtatgcctgaattcaaatacgacacttacgtttcccgaccacttcgaccggaaagagcgtagagtgacactggacggtgaaggttatttccaggtggcaaaaaatgataagaaacccttcatcgtacaagccaaagaatatgaagtaagagtattgggtaccgaatttaatgtgatgatgtataaagatcaggactttttcgaaacagtcttgctgaaaggctcggtagaagtaaacgaaaccactactggtaggaaagtaaaactgcaacctaacgaacggttattcggcaaagccggtcaactccggaaagagagtatcagcgagtggaaccgggcattatggatgcaaggaatcctttatttcgacaatacgcgcatggacgaaattatccgccagttaggtctatactatgatgtaaaattcattttggaaaaagagtccctggcaaatgtacggttcaccggaaaatttcgtatcagagacggtgtagaacacgtattaaaggtgcttcaactgaaatgtaaattcacctatcaacgggatgaagacagtaataccattactataaattaa

SEQ ID NO: 4939 - DNA, 3258 bp, B.fragilis
gtattaattaacacagtgtacaaatgtatgaaaaacactctgataaaaacaagtaaaatcgtaaataaatcaatttcacatactatgaaaatgatagttttattccttttcgttttcatctcgggagtattcgccggcaatgcgaactctcaggaaacaaaggtatctatctcgaaaaacaataaaccgatacgggaaatcctgggcgaaatcgaacgccagacagattacctgttcgtatattccgagaaggaggtagatgtaaatcaacgcaaaaccgtcaatgtaagtcagcaacgggtagctgatgtactttcttctctattccgtagcaccaatgtaggttatgccatggaaggacacaacatcatgctgatggcaaaaacaactcaaacagacgctgcacagcaaaaacgtcatattacaggagtggtgaaagacatcaaaggagaaactatcatcggagccaacatcatgataaagggcacaggtacaggtgtgagtactaatatcgacggagaattttccatcgaagcagctgccggtgacgaactgattgtttctttcatcggatacctgacacaaactatcaaaatcgattcacaaaaaacgctcaatatcaaattactggaagacactaaaacactggaagaagttgtcgtagtaggttacaccgtacagacgaagtcggccgtaaccggatcggtagccgtagtgaaagccgataaattgaaagacgtaaacacactggaagtaggaagtatgctccagggaaaagtatccggcgtatatgtctcaggttcatccggcgaaccggggcatgccagcaaaatccgtattcgtggtaaaggcacactgaactcgtctgtctctccactttgggtagtcgacggtgtgattgtaggtgaggatccgggactgaacccgaacgagatagacaatatcagtgtgctgaaagatggttcggctaccgcattgtacggttcgcgtgccgccaacggtgttattgtagtaaccaccaaaagaggcgaatatgatgccaacaaatatagtgtatcgatcaatgccggtgtatccttactatcgaccgggcgccttgagatgatgaattcacaagaactttatgactatcagaaatcctggaacaatcagtcgtggttcacagaagaacttctgaaacacaacacagactggtttaaagaagcttccaaaccgggattatataccaacgcaaacattacctataccggaagcagcggtcgtatgcgttcctttgttatggcagactactaccgcgaagagggagccattaaggactttacattggaccgcttcactttccgttccaacaatgatgtgaagtttacagaccgcttcaccatgtcaaccaagatttcaggttcgctctcacgtacagacagtcagcaacgcagcgtgtacaacacttatctctacctcccttgggatttcccttacaatgaagacggttctatccgctcgggacaagaacaagactggagaggacgtgacggaatcaacgacatgtatgacctgcaatggaactggagccgttcgaaaaaactgacggttgacggaaccattaatttcaattatcagattacggattggttgcgtttcgagtcaaacaactatattcgctatatcagtaaccgctccgagagctacacggacaagcgttcgcgttcggggcaatcggacaaagggtcgttatccaactctaattcactactgaccaagcaattcaccaaccaaatgatacgttttgagaaatcattcggcaaacacaaagtcaacgcactgggagcttacgaatatacccgccacttttacgaatcgacttccgccgaaggacgaggcatacagcccggcagagagattctggacgtaacaaccggtattaaatccatcggtggatacaaagacgccattgccacccaatcggcactgttcaatgccaactacgactatgataaccgctacatgggacaagtatcgtatcgcatggacgaatcatcttgtttcggtaaaaacaatcgtatgggacacttcttcacagtcagtggcggctggaatatccagaacgaaacttttttcgaatctcttcgtgagtctgtcaaccaactaaaagtgagagtcagttatggttctctgggtaacactcccggagcatactacggacactacccgctctattcttcaatgatgtataatgacgaagtagcttacttcccttcacagatggggaatgccgacctgtcgtgggagaaatgttacaccaccaatatcggtatcgacgcacggttcttcgatcgcttcggagtcaccatcgacctgtacaataaaaacacctcggacttactgtactatgccccgctacccaatatatcaggctacaccggacaatataaaaatgtaggtgccatcaataataaaggcctcgaaatcagtcttaatgcagatgtcatccgtacctcaaaattccagtggaccagtgacttcaacattggattcaaccgaaaccgggttaccgaactttatggaaggaaaccggaactgaagggattgaaacgcctggaagaaagacgggatatggatgaatggtatctgaaagaatgggccggtgtagatcctgctaaccgttctccattgtggtataccccccgatgggaatggccaaaggcacaactacccgactcttacaataaagccgaccgtgtatattgtggttctgccgcccgaaagtttaccggtggatggatgaattcatttagctataaaggttttacactgactgccaacttcgactttgtatacgggaacctgctttataaccaatcccgcgaattgctcgattccgacggtgcttatgccgactacaattcaatgaaactgaaaagcggctggaaacgctgggaaaaagaaggagacatcgccacgcatccgaaagccattaacggaggtaacaaaaactctaacaaatcgtcttcacgctatttggagaaaggcaattacttcagcttgcgcaacttatcactggggtattccataccggagaagttatgcgggaaactgggcttgcaacgggtcaacgtctcttgcagtgctgataatctattcacgcttaccccattctcgggggtatctccccaattgtcggacagcagtaccgacggttatgcaggtactatctatccgttgagcagaagaatcgtgctcggccttaatgtttcattctaa

SEQ ID NO: 4940 - DNA, 1032 bp, B.fragilis
tttgtgtgcaataaacatttaatattaactaaccctttaaataagagtatcatgaattcaagcatggagaagccctatgtggtgggtattgacattggcggaacaaacactgtctttggaattgttgacgcgcgcggaactattatagcaagcggtgcagtgaaaactcaagtatatcctacagtagaagaatatgcagatgaagtatgcaaaaatcttctgccgttgattatcgcaaatggcggggtggataaaataaagggtatcggcattggcgctcctaatgggaactattataccggaaccattgaatttgctcctaacttgccttggaaaggtgtattgccgttggcttctatgttcgaagaacgcttgggtataccgactgccttgacaaacgatgctaatgctgccgcagtgggcgaaatgacttacggagctgcccgcggtatgaaagattttatcatgattactctgggaacaggtgtcggtagtggtatcgttatcaacggacaggtggtttacggtcatgacggttttgcaggcgaactcggtcacgtgattgttcgtcgtgacggacgtatctgtggttgcggacgcaagggctgtctggaaacttactgctcggctacaggtgtggcacgcactgcacgcgaattcctcgctgcacgtaccgatgccagcttgttgcgtaatatcccggctgagagtattgtatcgaaagacgtatacgatgcagccgtacagggagataaactggctcaggagattttcgaatttacaggtaatattctgggtgaagcattggcagacgctattgctttctcgagtccggaagctattatcctgttcggtggtttggcaaaatcgggtgattacattatgaagccgattatgaaagccatggagaataaccttctgaacatttacaaaggtaaagcaaaattgctcgtttctgagttgaaggactctgacgctgctgtgctgggtgccagtgcattggcttgggaactgaaagacttgagagactaa

SEQ ID NO: 4941 - DNA, 1107 bp, B.fragilis
aacaagatgaaaaagtatctgaaaattacattactggtagtggtagccgccatcttcattgggacattcattttcctgtaccagaaatcaaagcctaaaacaaccgtatatgaaaccgttaccccggagattgcggatctggaaaagactacggttgccaccggcaaagtagagccgcgagacgaagtactcattaaaccgcaaatatcgggtatcatatccgaagtatacaaagaggccgggcagaccattaagcaaggtgaagtaatcgctaaagtaaaagtcatcccggaactgggacaattgaactcagccgagagccgtgtacgtgtggcagagatcagtaccgcgcaagccgaaacagatcatgaacgtatcaagaagctttataacgacaagttaatcagcagagaagattacgaaaaaagcgaagtagaaataaagaaagcacgtgaagaattgcaaactgcaaaagatgcactggagattatcaaagaaggtatcaccaaaaacagcgcttccttcagcagtacgctgattcgttcgaccatcgacggattgattctggacgtaccgatcaaagtaggtaactcggtaatcatgagtaatacgtttaatgacggtacgactattgccacagtagccaatatgaacgatctgatcttcaaaggcaagattgacgaaacagaagtgggacgtatccatgaaggtatgccagtgaaactgactatcggagctttgcaaaatcttacattcgatgccgaactggaatatatttctccgaaaggtgtagaagagaacggagccaatcagttcgaaattaaagcggccgttcatgcaccggactctgtacaaatccgttccggatattccgccaatgcagaaatcgtgcttcaacgtgcgcaaaaagttctggcagttcccgaaggcattatcgaattcagtggcgacagtacgtttgtatgggtaatgaccgatagtatacccgaacagaagtttgaacgccgccagatcaaaaccggcatgagtgacggtatcaaactggaaatcaaggaaggtctgaccggaaaggaaaaagtaagagcttcggaaaagaaagacaaataa

SEQ ID NO: 4942 - DNA, 1353 bp, B.fragilis
  unsure (249): Identity of nucleotide sequences at the above locations are unknown.
ggaaagtatgaatcaccaacaatgcataatatgagaaataaaatattgatcaacttattgatactgaccggactgtcagcttacactgcacaggcacaggaaggatggactttacgccggtgtatcgattatgccattgagcataatatcaatgtgcaacaaacggcaaactcggccgaacagagtaaagtggaggtgaataccgccaaatgggcacgcttacccaaccttagcggcagtgcttcgcanaattggagttggggacgtacagcatcgccggtagataacacctataacgatatcaacagcggtagcagtagcttcagcctgggtacaaatattccgttattcaccggtctggaattaccgaaccagtatgcacttaccaaactaaacctgaaagcagcaatcgaagacctgaataaagcaaaagaagatttggcaatcaatgtcacttccgcttacctgcaagtgctttttaatcaagagttaagcaaagtggcacaaagtcaggtaggactcagcaaagaacaactgagccgcatcacacgattgcatgaagtaggaaaagcttctcccgccgaagttgccgaagccaaagctcgcgttgcacaagatgagatgagtgcggtacaggctgacaacaattaccggttagctctactcgatttaagtcaattgcttgaacttccgactccggagaacttctcacttgccacaccggatacggagttggaattctctccccttacttcacccgacgaaatctataaccaggccatgctctacaaaccgggcatcaaagcagccgaatatcgtcttgaaggtagcgaaaagaatgtccgcatagcaaaaagcagttactatccgcaattgtccttctctgcaggattaggtacaaacttctatacggtaaatggtaacgccggttcaaattttggcaaccaaatgaagaacaacctgaataaatatgccggattcagtctgaacatacctttattcaatcgcctggccactcgcaaccgtgtacgcactgcgcgcctgcaacaaaccaatctggcattgcaactggacaataccaagaaggtattatataaagaaatccaacaagcatggtacaatgccatagctgccgagagcaagtttaagtcaagtgagtcggcagtagaagccagccaagagtccttccgcctgatgagtgaaaagttcgacaatggaaaagcgacctcggtcgagtacaatgaatccaaactaaatctgactaaagcattgtccgaccggattcaggccaaatatgactatctgttccgtacaaagattctggacttttacaaaggacagcccattgagtaa

SEQ ID NO: 4943 - DNA, 360 bp, B.fragilis
acaacaatggatttaattaaaattgcagaagaagcattcgctaccggaaaacagcacccgagcttcaaagcaggagacactgtaacagtagcatatcgtattatcgaaggtaacaaagagcgtgtacagttgtaccgcggtgttgttatcaaaattgcaggtcacggagaaaagaaacgttttactgtacgtaaaatgtcaggaaccgtaggcgtagaaagaattttcccgatcgaatcaccggctatcgacagcattgaagtgaacaaggttggtaaagtacgtcgcgctaaactgtactacctgcgtgctcttaccggcaaaaaagctagaatcaaagaaaaaagagttaacggctaa

SEQ ID NO: 4944 - DNA, 349 bp, B.fragilis
  unsure (329),(331),(333),(336): Identity of nucleotide sequences at the above locations are unknown.
atccatagtttacatattgaaatgggaaaatatcgcacgaaagggagcattgctctcatcattacaggaagtgtcctgatcctcgtactcgcaggtttatatctgggacgtaacggaattctctgccggacggccgacaaacgaatactatatgccgaacaaaaatacggattatctatctgctatgaggacctgcgaatgaaaggattaaacgaaatcgaactgaaaaatctctctatagttccccgcaaccgggatacccttctcaccctgcatactttgaacatgcacctcaacttttggaaattgattcggggaagtcttcaccngnantgncaacagcgctcat

SEQ ID NO: 4945 - DNA, 801 bp, B.fragilis
gtacttaaggatatgaaacaaaattacgcaaagattatttcaggattcattctggcggggttgctgacatttagttcttgtcagtcgacgcatgagatggcaaaaaccgattaccagattgccaaagtagagggaaggatgattgacattgacgccaaatgggacacccatcccgatgcagatgccgtggcaatattaaagccttataaagaaaaaatagacaatatgatgtatgaggtgattggcagcagcgagcagaagatggacaaaggacatcccgagagcttgctttctaatcttgtagcggaagtattgcgtcaggctgcaaccaaggtgcaggacaagccggcagacatgggactggtgaatatgggaggattgcgtaatattttgcctgccggagatattacggtgggaacggtatatgagatattgccattcgaaaattcgctttgtgtaatgaagatgaaaggaacacacctgaaagcattgctcacaagcattgcatcgttgaaaggagaaggggtgagcggtatccggatggaaattaccaaggatggaaaattactgaatgctacggtgggcggccagccgatcgatgacaataagctgtataccgtggcgacaatcgattatctggctgacggtaatggaagtatggaggctttcttgcaggctgatgatcgtgtgtgtcccgagggagccacgttacgcgggctttttcttgattacgtgagacagcagactgctgccggaaagaagatcacttcggcactggatggcagaatcactgtgaaataa

SEQ ID NO: 4946 - DNA, 2175 bp, B.fragilis
agtacaatgctaaaaagaacatttatattaatcggccttgtcctgagtttttgttcactgccagcgcaagaactgattcagattacgacacgcaacacagcacttgttttcagggttgccaatcaatcactaagacaagtttattatggcccacgcctggcagacaccgatgtattacagaaacagggcaataactttccggcatattcgacttatggaatgggagaacaaaacgaagtggcccttcatgcagtacatgcagacggtaatacctctacactactgaactttgaaaacgtgaaacaagagtctccggaacccggcataacactgactacgatttcactgaaagacccgctatatccttttcaagtgaaacttttctataaggcatacgaagagagcgaccttatagaacaatggactatatatcagcatactgaaaagaaaccggtaacactttaccagtttgcttccgcacagctctcctttaaatcttcctcctaccgactcactcactttgccggtgactgggccggagaatgcaacatgagtgaagtagaactgacagaaggcatcaaagtgatagattccaaattaggaacccgtgccacattctttgctcatcccatgtgtctgctatccctgaacggacggatgactgaagacaatggagaagtgatagggatggctctggcatggcctgccaactttaagttggaatttgaaaaaaacaacaatcaggaactccgtgtacttgccggaatgaatccgtacgcatcacactacaaacttaaaaaaggcgatgtattccaaactccttcgttcctctacacatacagtacaaaaggaaacggacaggtcagtcgtaatttccaccgttgggcacgtaaatatggtttacgccacggagaaaattcacgttataccctgatgaacaactgggaagccacttacttcaactttaacgaacccaaactgaaatcaattatagaagatgctgcagggatgggcttcgaactcttcctgctggacgacggatggtttggacagaaacatccccgcaacaatgatgacgcaggacttggcgactgggtggtaaacaaagaaaaacttcccaacggactgggatggctggtaaaacaatgtacggataatgatatcaagttcggtatctgggtggaacctgaaatggtaaacccccaaagtgaactattcgaaaaacatcctgactgggtaatccagcaaccgggacgtgaacatattctctttcgccggcaactggtactcgacctgtcgaatcccgaagtacaagagtttgtatataagagtgtacacgacattctgaaagataaccctcagatagcttttgtgaaatgggactgtaaccgtgctgtaaccaacccgggatccacttatttacctgccgacgaacagtcacacatatggatcgaatacggacggggattactgaatgtttttaagaaagtacgcgattcacatcccgacgtacactttatgctttgctctggtggaggaggccgtctggattacggttcactgcgctacttcgaggaatactggcccagcgataataccgatgccttgcaacgtatccttattcaatggggcaattcacagttctttccctcgatagcaatgtgttgccatgtttctgccagtccgaatcatcagaccgggcgcactactccactgaaattccgctttgacgtagctatgcagggagctttgggaatggatttacaaccgtccaccatgaatgaaaaagaagtaatctttgccaaagaggctatcaagacttacgaaagtatccgtaacatagtgtttacaggcgacctgtaccgtattttatctccttacgaaggtaaccgcacctccatgatgtatgtattgccggacaagagtcgtgccgtattctatgcttaccaattaaaatcacatatcggtgaagttagtgctccgatgcgtttcaaaggtctgagtcccgacaagaaatacaacgtgaaagaattgaacatctatccgggaagccgtgctgcaacagggtcagccaacggacaatctttcagtggcgatttcctgatgaatcaaggcttgcctattggtttatccggtgattacagtagcgctgtcattgagttggaacagcagtag

SEQ ID NO: 4947 - DNA, 3087 bp, B.fragilis
gttctgataggacttggcatttctgccggcctgctctctccgaactatgtgttcgctacgtctttagagacttatgagaaccagtctgtagctgctgttcagcaagcaaggaagattaccggtacactgaccgatgctgtcggtgaacctattattggtgctactgttttagaaaaaggaaacccttccaatggtacgattaccgatatcaatggtaaattctctctttcggtccatcctaatgctgtgatcagtatttcgtatataggatacataacacaaaatattaagataactaatcaaacctcactgaaagtggttatgatggatgatacccaggcgctggaagaagtagtggtagtaggttatggttcgcagaagaaagcgaatctgaccggagccgtatcttctgtgaaaatggatgaggtactgggtgaccgtcctatcttgaatgcatctgatgctcttcagggagccgtgccgggactgtttgtatctaatggaggtaatgctcccggaaccagtaagtcgttccagattcgtggagcctattcggtgggtgtcaagaactcggacggttcatacggaaacaccattaagccactcgtattgattgataatgtggaaggtgacctcgatatggtaaaccccgaagatatcgagtcaatcagtgtactgaaggatgcagcttcagcagctatctatggtgcacgtgcagccggtggtgtaattgtcgttacgactaaacgccctaaaggtgctgctaagttctcattgaattacaacaataactttgctttcggaacagctgtcaatctgcctaaacaggctccgctgatggactatctgcaagcttatctggattgtggatattcagatgcctattggtcgctcggttcgccaagtgtcagcaaatggatggaatatctgagtgaataccagaagaacccttctgctttcaatacggtgggagacggtatttatatggatgaatccggtgtaccatactatttgaatgaaaaagatctctataagaactttatggagaccagtttccagatgactcataatatttccgcttcaggaggtacggacaaactgcgttatcgtatttcgggtggatatacttcgaatgacggtgtattggtgtccgatcgtgataagtttgaacgtatgaatatcaatacctttatttcggcagatgtaactaactggttcactcaggaagtgactatgagctatgcacatagtctacagacttcacccggtggaatgggaggtgtgtataatacccgtttggtttcatattatccggaaggagatctgccggcatcagtcaatacgttggcaaacgaggatcttcctttgttcactccacgcaaccagatcttgttgtcgaatccggtaaacaataataatgacaatccgcgtatcttcctgaaatccatattgaaaccactaaagggactggaagctgtatttgaatatacatttgataaaaacatctatgattaccactggtatacaggacagtatgactatactaccattcagggaggaagttcaaaatcatttgtagacgattatctgagaaagtacaaacagcatacgaattataacgctatcaacgtttacgctacatatagtaagaaattcggtgaccataatttcaaagtaatggcaggattcaaccaggagtcgagctatcaggaaacattggatgcttattcttacaatcaggcggtgatagacgtaccggccatgggatcgggaaccggtaccatcaaggctaccgactcatacagtgaatatgccgtacgtggtggattctttagagtcaactataattatcaggacaaatatttgctggaagtgaacggacgttatgacggttcttctaaattcccgaagagctctcgtttcggtttcttcccttctgtatcagccggttggcagatcgctcaggagaagtttatggagtctacccgtaactggttggacggattgaagattcgcgcatcatatggtgtgatcggtaaccagaatgtgaatccgtatactttcactccgacaatgagtgtcagcaataaatctacttcctggattatcgacaatacgtatgtcacctctatcagctcgttgccggctttggtaagccagaactttacatgggagaaagtaggtacggtcaatgtcggacttgatattaacttattcaacaatcgcctgaatggtgtatttgaatggtatcagcgtaacactaacggcatgcttgctccgggtgtgcagctaccggctgtcgtaggtgcaagtgctccttatcagaatactgccgatatgcgtacacgaggctgggagttgagcttgaactggcgtgaccagatcggtaaggtgggatatcgtttgggattcaacttgtcggattataaatcgaaaattaccaaatacgatgataatgcaaccaccaagttgctgagcagtttctatcccggacaggtgatgggagagatatggggctatatagccgatggttattattctgtggacgatttcgaagatacatcatcctggaaactgaaagagggaataacctcgatcaatggttataacgtacgtccgggtgatgtgaagttcaaaaacctccgtgatgatgaaagttctactaatgtaattaccagtggtgacaatacattcgacaatccgggtgaccgtaaagtgatcggtaatacgactccgcgttatcagtatggtatcaatctgggagctaactatgccggtttcgacctcaatgttatccttcagggaacaggaaagcgtgattactggatttcgaatgtcttgactttcccgatgaatggtgataacttcattccgttgtttgacggtttgagtgattactggatgcctaaagatcctgacaacggtgactggacggcagtcaatccgaatgcgaagtatccccgtctgtatggtaaccgaggtaattccggttcaaacctccgtcagagcgacaaatacttgtctgatgcttcttatctccgtattaagaacatcactttgtcttacaatgtcttcaccacggggctg

SEQ ID NO: 4948 - DNA, 609 bp, B.fragilis
ataatagatatatttgtagattattttaatttaaaaacaacgacaagtatgagaattaaattattatttttgataagcattctgttctgtacaggtagttatgcacaagagacggttaccgaacctgattttataggtgaggtgttagtgttaaatccggataacagcacgactccgctggaaaaagctactgttaaaatcaaaacaaaagccaatgcttcgatatatttggtaggtatgggtaaagtgaaaacaaagataaatgtagatggtcctagcgctcaggtacgattacatcagggagatgattttaagttgattgtgagagctgtggacaacaataccgatccaatgtctattattaatatctttcagtttgaaacgggtaagaaagtacgtaaggccgagttatcttctttgagtacatttggaggagcctctagtaataatctggaactacttccgtatacagctaaaaaatatggagaaagttcttatctgatcacattgaaagaaaagccggtgggcgaatatgggataacggttcgtaatcctaattctttggatgaaaaaaatatcattgtggcttcgtttggaatcgatcaataa

SEQ ID NO: 4949 - DNA, 1617 bp, B.fragilis
gatcgattcatatccgggagtcttggaacagaatccataaagggagaaacatccggtggacccttgtccgagtatacgagggtctaccggataaaaagaagatatagagataacctgaacagttcatttaacaaaaataaaaacgacatgagaaacatccaacgaaccatcctttggatagccgggctactcttttgcctgccatcctccagttcaaacccagtagtcataggcaatagccgttttacctttatcaccgaccatctggtacgtatggaatacgcacagcagggaaagttcctgaacgactctaccctcttcgctgtagaccgtacccccagatgtaccgaagtaaaagtagagcgtaaagaaggcaaccgttacatcatgaccactcccgccatgcgtatcgagtattacaatgacggatttcccttcggacaaaccaacttgtttgtctatttccgaaacggagactcccctaaagaaaaacgttggtacatagccagccgccaaagccggaatctattaggagcagtgacaacgcttgatgacgtagaaggtcccatcgaccgccaggaagggttattgagccgggacggctggtatcttattaacgataccggtaaggaagtcctaaaaaacggatgggtggcgacacgtgaccgtaaccatgttcaggatctgtatttgtttgtttacggtaatgactacaaggcagccttgaaatcacttcaggcagtcagcggaccatcaccgatgacccgcaaatatgtacacggatcttggtattgccgctggtggaactacacagacgaagattatcgccagttggtacgggaatatcgtgaacacgactttcccctcgatatcatggtgttcgatatgggatggcatacacaaaatgccaaagtcggaaccggacatgccggcacacggggttggacaggctatagctggaaccgtaaactgattcccgaaccggagaaactgataaaagacttcaaagacgatcatatctacgtagtactgaacgaacatccacatgacggcatccgtccgcacgaagatagttatcaagcttttgtacgagatttgggagtcgatacccagcaaacaggtgtacccctgtttgacgcaggtaaccgtgactatatgaatgctttcatgaaacatgctcatcaggaaagtgattccatgggagtagccttctggtggctcgactggcaacaagattatctatatcctctggtacggggaacaaatatgaaacatcttccctggatgaatcgcatctattataattattcgtccggcaaccaccttcgcggtgcaggtttcagccgttgggccggatggggcgaccatcgtcacccgattcaattctccggtgatgctgtgggcaactgggacttactccgctttgaggtcgacctgactaccaccagcggcaatgcaggttgtttcttctgggcacatgaccttggcggattctacgacggaaccgacccggaactttacactcgctggacacagttcggattgctgaattcttcactccgcatccactcggtgtacgacgaaaactcgaccgccgtccctggctctggggcgtag

SEQ ID NO: 4950 - DNA, 1311 bp, B.fragilis
tgcctcaccattcggcaaggatggatacatgaaataaaaacagatataaatatgattgacatttggcaagaaatatacggtaccatcaagcggaacaaactccgtacgttactgaccggattcgccgtagcatggggcatcttcatgctgatagtgctgttgggagccggaaacggactgatccatgcttttgaaaagtcatcatcggcacgggcgctgaactccataaaaatatatccgggatggacagggaaaccttacgacggattaaaagaaggacgacgcatccagttggacaataaggacctggatgccaccatggagcacttcagcgacaacatcatcagtgtaggtgccagccaatggcaaagtaatgtaaacctgagttacggacaggagtacgttaacctttcactggaaggtgtgtatccgaactttaccgaagtggaatccgtaaaatcgacagacggacggttcatcaatgacatcgatctcaaagaacgacggaaagtaattgtactgcataccaaaacggctgaaatccttttcggaaaaagcaaaacagaacctatcggaaagtttgtaaatgccggtggagtctcttatcaagtcgtaggcctttacaccgatccgggcgatcagggaagcagcgaggcttatattcctttctccaccttacaggtaatctacaacaaaggtgataaactgaataacctgaccttcaccaccaaagggctcaccaccattgagacaaacgaagcattcgaggcagcctatcgcaaagtaatgggcgccaaacaccgttttgacccatcggacaacagcgcactgtggatatggaaccgttttaccaattatctacagtcacaaaacgctatgggcatcttgcgtacagccatctgggtgatcggtatcttcacattgctgagtggtatcgtaggcgtatcgaacattatgctgatcacagtaaaagagaggacacgtgagttcggtatccgcaaagcattgggtgccaaaccattctctatcctgtggttgataatcgtggaaagcgtgaccatcacaacactattcggatacatcgggatggtagccggaatcgccgctaccgaatggatgaataaagtggccggagaacaaaccgtagatgtaggaatgttttcggaaaccgtattcctgaatccgacggtggatatcagcattgccatacaagccacgctgaccttggtcgttgcaggaacactggcaggattcttcccggcaaagaaagcagtgagtatcagacctattgaagcacttagagcagattga

SEQ ID NO: 4951 - DNA, 843 bp, B.fragilis
agcagattgattatgagagtagatatggatacgtgcgaggaaatcctcgtcacgataacaagaaacaaaacacgaagcctgctgacggcattcggagtattctggggcatcttcatgctggtggccctgatgggaggcggacaaggaatgcaggagatgatgcaagccgaatttgaaggcttcgcaaccaactcgggtttcatggcctcacaaaagacaggagaggcttacaagggattccgcaaaggacgctattgggatattgaaaacgcagatattgaacgaatccgcaaaaaagtaaaagacatcgatgtaatcactccatcgatagcccgctggggatcgacagccatttatggagagaaaaagtacgattgcagcgtgaaagggctttatccggactatgcaaagattgaaaaccaggatatggcttacggaagatttatcaacgacgtagacgtacgcgagggacgcaaagtgtgcgttatcggcaaacgtgtttacgagagccttttcaacccgggcgaagatccttgtggtaaatatgtacgggtagacggcatttattatcaggtgataggcatgtgtgtgtccgaaggaaacatgaacatccagggccgggcttcggaagccgttgtgctacctttcagtacgatgcagcaagcctacaacatgggaaaacgtatcgacgtgatatgctataccgtgaaaccggggaaaaaggtaagcgaccttgaaccggagatagaagccatccttaaagaggcccattatatatcgccggatgacaaacaggcagttatgaaactgaatgccggaggccatgttctcaatgatggataa

SEQ ID NO: 4952 - DNA, 552 bp, B.fragilis
gaaaaaaagatagccacacaagaggtctggctgcccggtggaaccgactggtataatttcttcaccggagaaagacaagaaggcggacaagtgatcaaaacgaaaagcccgctggaacaatttccattgttcatcaagggaggttgtcctctaccgatgcagccttatacggaacgaatgtgttccaccccgctcactgaattgatcgtacgttgttatccgggcaaagaaggagcaaacaatacttatatcctgtacgaagacgacggactgacccaagactacctacaagggaagtatgccaccacacgcctcaactatcagaaatcagggggacagacgatcatcactgtatctccggtagaagggacttatgaaggacagccccgaaaacgtgcctaccggatcgaactgccggggattccggtacaggcccgtgtgtcggtaaacggcaaaaaggctcgaacaactcccaatcaagaattaaacggagttatcgtacctattaaggtaatggatatccataaaccgattgtaatcaaaatacaataa

SEQ ID NO: 4953 - DNA, 351 bp, B.fragilis
  unsure (274): Identity of nucleotide sequences at the above locations are unknown.
ccttggcggattctacgacggaaccgacccggaactttacactcgctggacacagttcggattgctgaattcttcactccgcatccactcggtgtacgacgaaaactcgaccgccgtccctggctctggggcgtagaagcagaaaaggcaatgcaccggatttaccacctacgctctcaactgatgccctacatctactcttccgtccgccaatgccatacagatatgttgccacttaaccggggaatgtacattgaatatccggacgaagaanaagcctatcaatatccgggacaatttctcttcggtgacctcttgttgggtgctcccatcaccgccaagggagaatga

SEQ ID NO: 4954 - DNA, 876 bp, B.fragilis
attatgatattcccaatcaataaaaaacatacgttcttttccaaggaaaagacacttctaactttcttttttattctctttatttctttttctgcatttgggcagcaggataaaaagctgattcttctgcagaccagtgatgtgcatagccgcctggaacctatcaatcaggaaggtgaccggaattatgataaaggcggattcgtacgtcgtgccacatttgtgaaggagttccgcaaagagcatcctgatatgttattgttcgattgcggagacatttcgcaggggacaccttattataatatgttccagggtgaagtcgaagtgaagatgatgaacgaaatgaagtatgatgccatgactatcggtaatcacgaatttgattttgatctggataatatggcccgtttattccggatggctgattttccggtggtttgcgctaattatgatgtaagtgctacggtgcttaaagacttggtgaaaccgtatgtcgtctttgaaagagacggtgtcaagatcggagttttgggattgggttgccagcttgaaggcatggtacaagccaataagtgtgtaggagtggtttacaatgatccggtaactgtagcgaacgaagtggctgctctcctgaaagaaaaagagggatgtgacgtagtggtttgtctttctcatctgggtgtgcagtatgacgagaatcagttgatccctaaaacacgtaatatcgatgttgttctcggaggccattcgcatacattcatgaaaggtcccaagactctcctcaatatggatggcaagaatgtgtcgctgatgcataccggtaagagtggtatctatgtagggcagatggacttaacacttgaaaaaaagaaataa

SEQ ID NO: 4955 - DNA, 345 bp, B.fragilis
atgaataactcgaaaattatcaatgtgagattgatgaaaaaggtgttagtgcttgttctatcttttttgtctgttactgcttttgcgcagaatataacagtgaaaggaattgtaaaagatggaaccggtgaaccgattatcggagggagtgtacttgttaaaggttcatcgatcggtacagtgacagatgttgatggcaattacactttatctaatgttcctgcagacggagttctggagttttcttacatcggcatgaagaaacaggatgtaaaagtaagcggtaaaactgttattaatgttgtgcttcaagaagatacccagatactggacgaagtaggctag

SEQ ID NO: 4956 - DNA, 357 bp, B.fragilis
gccggcgagccggcgttttgtgatgaaaatccaatagattgccattttgatgtgaaaagctatcctgccggaacaacggtgcataacaacgatacgaatatcatttacctgatattctgcatgaaagggcatgcacggattaccagcacattcttccacgatgaaattttgtgtgcgggagaggtgatgttcgttcctcgcgggagtgaatacagcggcgtggcgttaagtgatgttacgctgctggttcataaattcaataacacagtctgccagacagaaaactgtatcctttcctatctttattcgcacaagaatattgattccaaaatttattgttgccaaagaagaacgtaa

SEQ ID NO: 4957 - DNA, 906 bp, B.fragilis
aggaggcaagccatgatgaataaattcctgaatacgaaggttctctatatctttatctccgttatcatatttattatggtttttctgttggtaatgagagcttgctcgcagaagcagccgattcaggctgttgtaactccgtctgaccctgtcgtgggggaagaaatatttttttccgattccacgtcgggagcgagaatctggtactgggagttcggaaacaacgagacatccacacaacgtagcggacaccatcggttcaagcaaaaaggggtgtacaaaatacgactgaccgtcaacggaaatctggaacgctactttgatgtgagggtaaaagagaagaccaatacggaagacctgcatctggttcatatcatagctcccaaggaagctattcagggagaaaatatcatcttccgtggcgaaggacacgacgaacaatggcgctgggagttcggagagacggggatgattgattcccgtgaaaaaacggctctttatgcttataccgaacccggagagtacgaagtattgcttaatacggagaatacccggtatcccatcagacaccggataaacattctgccctactattcggagaatgattctaccgatgtaatggtgctcatcggtttagacatcaaagagaagttgcagaacattgcagacggtaaaccctttaatgtaaactacaactatgtcgtggacaagtattttaataataacccgaacacgctggttgttatcaacaacaataaatataacgacttttattcttattgccaaggactgcaccatatcggcagaaaagaaacgattatccagaatgtcatcgtagagacggaggatgaagagagcggatacatcacccaactaacggttatgcaaatcgaaaaaaagaaatga

SEQ ID NO: 4958 - DNA, 936 bp, B.fragilis
acaggaaacaagccaatgataaagactgtaataacccaattgtatattgctttttgtcttatttgcttttttgcatgtgaaaaacaaaaagaagaatttcccgatatccgtataggaaaagaaggagttgttgatgagttgtcgttgaataaacagacagagaaaagacttcttttgtcaggtggaaacgggaaatatatagttaatgtggagaacgcacaaatagccactgctgatataagtatggatacccttaaagtaaaaggttggttggaaggtgaaacgtttgctaccatcatttctcatgataagcgcataaggttgaagatcaacgtagtctttccggagctcggaataagtcattccgtagtgcagcttcttccccgatttagaagtaaattcataagtatttccggaggaggagaattgactaagctggaagaggacgatcccgcagatattatggatatgaaatgggacggttctacggggatgctggagatatatcccaaatatgagggagaagcccgggttatcgctatttcagaagacgcaaaagagaagaaggttattcatattaaagtgagaccggaaggaaaactggaaattccggggtggtatagcaccaactcaagttcatactatctgatccaaaataataacatggtagtcaaaagaaaaggagtaggtacatggattgtaaacagtgcccgcccttatggtgggggagtgatgtataatagttcttatataaaaatagctcctatcatgaatcccgtacagggtgactctatcgatttaaatatacttcgccatggatccttgaaaccgcagataacagaaggtatacataggctgtatgtagaagaagtgcgtgagtcggaagtcatgttacggggaagaggtttcaaatttttgctcccttatgaaaagtga

SEQ ID NO: 4959 - DNA, 846 bp, B.fragilis
cggttatgcaaatcgaaaaaaagaaatgaaatgagaaagttatttgtcctattgatttctatcgtcgttttatcggcttgtgctcccgtacaccgcttcactcaactgcggaagcttcctcgtgaatattctgacaattattccatagaggggataaaggcacccagaagcgctgcccaccgcaaaccgtggattgtctattcggacagggtggagaatgccgcctatgtcaatccgggaggcagggtaaagtctgccgaggtaggattactggatacgttcttagttatcaagaccaaaggagattatttgcggttgattaaatataaccccacaaatatcaagcacaaccgtatgacccaacgcaaaaaggcggaatatgtgggctggatgcaccgctcccgactgatactttcaccttcttccattaccgatgtacagtcgggactgcatgacaaattgttgactgcgattaccgacaccacggcaatcatgcaatccgcaacttattttacaaccgccgattcattgaaagtgttcggcgatccggaactacagaatcaaaccggcgtggtgggtatccacgctattatatatgcgctcaagcattctgttgacaaacgcagtgtattggtatcgaaaactccctctctctctgccgataaaatcggtgagcaggtgatcggatgggttcccgctgtcatgctccaagaaatcggacatcaggtgttcacaggaacggcgttttccagagtgccgactttgcaaaagacgctgaaatatgctcctatgatatatccttatcataccgattccacctgctcgttcgtcagcggaacattataa

SEQ ID NO: 4960 - DNA, 1557 bp, B.fragilis
ccggttattgacaagaaggacaaccacgtgttcaacatcaacggaaagagaatctcttatacccgtggaaatcaaatcaagcaagaattgaagcgaataaatatcctgttcgcaatggaacagtcttcccggctaccggaacaatacccgatgctgttgaatgccatacagaatctgggaccgttttttgccggttccggtgaatcgttctcctatcaattcggagcggcggtagctaccccccggggcatggagacaattcccctgactgctgactacgagatacttatagaccgattggtaaaaatggcgtcatatgtagctgacactgaaaatactcctttgcctgcatggaaggcaatgagaagtgcattggaacttatcggcaatacacctgaagcggttaatctgattatatcagtcggtgaaacgggagaacagcaagagaatgctccctcttccattgtgaaaaccctgaatgaaaagaactgtcgcctgctcggttggcaactgtacgcctcgaacgacgataagtacaataactatgtgcttcaactttcaaacatgattgaacattacgccgagtaccgcactaaaaacaagcggaatatgattctgtatgccgaccagttttgccgcagcaacctgctgcgggaagcaggcccgaattttctcatgctcgactatccctatgccagcatgacacaaggcggtttcctgtttccggagaaaggtgaaaccctgccaatggaattgtttgccggagcggtggattccatcgtaacgcagataaaagcggatcaccaactgctctctgaaagcatagaccgtgcatttgccacggttggcaatggtaaagaccgtttagacagtcttctgattgcaacctatcatctgcctcaaggggtaaaaccgaataaggagtttaaaaaaatatttggtgatgttgctccgatatggtataggaaaacagaaagaattaccgttccggacagtttgatgcgctattacctgctactctccgacccggaactgaaacagacaatagaacgcttggaaacactctgtgccatagaagtggatgtgaaggacatgaataagccaaagaaaggtaaagttaaacagttgtgccgctatttaagggaaagggtacgccccgataaggtagaaactctcggcgcatcacccgcaaatcccgaaagcaaagcagatacggtgtatgtatctaccggaaaaatacgccgccacctttatcgcttttatatgtcagaactgcgcaactgccggatctgcaaaaataagcgaaaggaaatcaggcgatattctctttcttatgcacacagtcagatatttggagttccggccaacagccctgtgcttgatgacataacggtgaaggagctcaaaaagaaaaaacagttaaccgacaaagagttggacggacttattcaatattttaaagagaggaaagaaaatatggctaagaaatacggagaagaaaaaataacgatggaaggacaaagctattactacatagcttcagaactgttaccgtag

SEQ ID NO: 4961 - DNA, 540 bp, B.fragilis
aataggaaagatatgagcataacccctaaaaataaaagcagcaaaaccgttagcgagcgtgaacgctttatcggatttgtatatgtgcttaccctgcttattgttatcacaggagcctgtggatttattcttttcaagtatgcagggacacgccacatcttctccaataaaataatggtcattaaaaagatggagcggcaaaaggaatttcaaaatatacaatcagtacagattgtgagcgcagataccctattttcacgtattgaacagtttgagccgggcgtcaatgcctcttatgaggaaaatgatatcaagttcctgataaacgaccttgccaaacaatgggagaaaaacagctttgacaagcgcaataagatgttctggcatctcgcttcggtatatgaaatgtggtttgccgacaagaaagaactatggagcaaacaggataacataataaagttcaagaaaaatctggaggagtgcgaagtcggactccagaagaaggaaggcgaacttaaaaataaaggaggcaagccatga

SEQ ID NO: 4962 - DNA, 321 bp, B.fragilis
tatggggattgcgcggacccttccagccccgtggtggaagacatgggcagtaacgaccggctgaatcaggtggtgctccaaaaagttatcagtacacgcaagatggaacttatcgaggaactgcaaataatggatagtaaggatgtacttctgtacaaaaaactggcttcgcaaatcaacgtgtttctggacaccaaagaagccatacgtaaagcggttattgaagaaagccttgtgagaaaagacctgatgcggtgcattcaggacaataaacaggctacccgaaagctgacattgggaaacattattgtagaaaagtaa

SEQ ID NO: 4963 - DNA, 957 bp, B.fragilis
cgaaatagactggcacttccgccccgcgtgaagacggaaagacgtccggagagtacaggtgtgtatgcacttaaaatatggcttaacggaggatctgttttcttggctcaacccgtatcggtaaaagcaggaaaacaatatacactctctttttggaacaaaggaagtgtgggaaatcgtgaaatagtagtaactctgttttggtatgataacgggagtataaaaagcagagaaaaaatactttctataagaacgggtaaagatgagtggagaagagtggaaagtactgtaacaataccggagaatatccatagtatggggatggggataaggacacagagctatcagggctatatgctgatcgatgatatgtcactggtactcaaagagagcgggccggacatatctgccgttccggaagctcccgataatttaagaatgaaagcatatcagaatgaaatggagatttgctggaacaaggtatcagacgaaaccattaaatgggaagtcgtgtttgatgaccacgtcgagacaatcacgttcggaaactcatatgtaaagacaaagctcataccgggaagtacccatcatattaaagtgagagcgggtaagggtaaggagttctcgccatatgccgaacgaagaggtgcgacagaaagaatgcgtgaagcggaaaattccgaagatcgtattccttatttgcgtaccatccttcctgacgggagttgcgagggacgttttttgaaactttattataatgaactggccaatccgaacgccaaggtatcttataaattggacggagtaactattgaacccaaagataatactttagagtttccggagttcgaaggattttataaacgatttcgcctggaagtttatattgatgagggagaaggtcgtgaatgggagattctgtatcctcatttgggcgtaaaaagaaatgaaaaatag

SEQ ID NO: 4964 - DNA, 195 bp, B.fragilis
gtgatgttacgctgctggttcataaattcaataacacagtctgccagacagaaaactgtatcctttcctatctttattcgcacaagaatattgattccaaaatttattgttgccaaagaagaacgtaagaaacatgtatatagtttagttcttgtcacaatactgattaagttttattgcaaatacaaaacttaa

SEQ ID NO: 4965 - DNA, 1875 bp, B.fragilis
ggtcccattttcctgagtggaatgaatatacaggatgccgaacgaagtttgagacgtgagtttagtaagatttatgctgctattcctcaaaaaacggtccatatagagttatcgttggggagaatccgtaccatcatgatcaatgtcatgggtgaagtaaaagtacccggtatttatcggttgtcggcatttgcatcggtatttcatgctttgtatcgtgccggtggaatcagtgatatcggaagcctgcgtgatattcgtgttgtgagagatggaaaggagatcgtccgtgtcgatgtatatgattatattatgaaaggtaaattgacggataatatccgtttatcggaaggcgatgtcattttagttcctccttatcagaatctggtaagtatttccggaaaggtaaaacgtccgatgaagtatgaaatgaaaagtggggaaaccgtagctactttgttgagttatgcgggaggttttacgggagatgcttatcggagtgccatacgtttgtttcgtatgggcggaaaagcaaaacaggtatacaatgtggcgcaggacgattatcagtcttatcttctggccgatggtgataaattatccgttgaagcggtattggaacgtttctcaaacaaggtcgaaattcgtggcgctgtatatcgtgcgggcatatatcaattggatgacagtgtaacaggaactgtcaggcagttgattagcaaagcggaaggacttcggggagatgcttttcttaacagggctttgttgagacgccaacaggaagatctgacacatgaaatgattcctgtcgatttgaaaaaaatgatggatgacacatccgccgacctatgtttgcagaagaatgatgtcctctacattcccagtgtgaaagatattgagaaagaaggaactttgtccatttatggtgatgtaagggtaccgggtgagtttccttatgttaaaaatacgactatacaggatttgattgtaaaagcgggaggattgccggaatctgcttctatggtccggatcgatgtgtcgcgtcgaatcaaagatcctggaagtatactatcctccaatgttattggaaagagttttacggttgagcttgcaaacggattgttgataggggaggataaaggatttgaactggaaccttatgatatcgttttcgttcgtcgaagtccggggtatcgcaaacaggccaatgtaacagttgaaggagaagtggttttcactggtaattacgcattaaccaaaagcaatgaaaggctgagtagtctgatagcaagagccggaggattatcgaaagaagcttatgtgagaggagcacgtctgatacgtagaatgacagcggatgagataaggcggaaacaggatgtagtacgtttgttggtcaaggggagtgaagaaaattctatatctccggtcgctttggaaaccggttctacttatccggtaggcatagaactcgagaaagcgttaataaatccgggttctgacgaagatatggtcttgcgtgaaggagatgtactatttattcccaaatatgtcagtacggtaacaatcagtggggccgtgatgtatcctaatacaatactttatcaaaaggggagtaatcttgactattacattgaacaggccggcggcttcggaaaccgggcactgaagcgacatatttatgtagtatatatgaatggaatggtgtctcgtctgagaaagagtgcggtttgtgcaattgaaccaggatgtgaaataatagtaccaagcaaagaaaataggaaaaagactgtgccgagggacgttgcaggaatgaatacttctattgcctctatcgctgcaatggtggctgccatggtcggtatgataaagtaa

SEQ ID NO: 4966 - DNA, 399 bp, B.fragilis
aagaagtgcgtgagtcggaagtcatgttacggggaagaggtttcaaatttttgctcccttatgaaaagtgaaatatttgtgcgatttgtgtcttgtatcgcaaaaaaagtaagctgtctgaaggatatgatattaaaaaaaacaaacgataagggagcattgttatttgctctgtttattttattggcaggaggcagcagagcaagacaacatatgaaagatgatcatgtcattcgtggtaagcaggttgctgtttttgggcgtaatatatttactgccagaaatttatcttttgagcctagcctggatattcctactcctgaaaaatatgtaatacgttctggagatgaattgataatagacgtatggggtgcttctgaaatacagtcagggaaataa

SEQ ID NO: 4967 - DNA, 951 bp, B.fragilis
tatacagagccccgatgtgaagacgcggtgtcggcctttctctattatagaaaggggtatgatatgggggctgatttttatcaggtcgttatttggagttttattgttttggctgcttctgaggctatttatggcttgaggcagctttatggttttacttcttcccatcattctctgtattccctgaccggatctttttttaatcccggaccatattccggttatctggctatgatatttcctctttgtctggatcaatggttacgattacggaaaagggagaataagaattggatggaatggacgggatattatggggccgtggcagtattgtttcttatactctgtgtgcttcctgcgggaatgagtcgttcggcatgggtggctgctcttatttcaggtatttgggtatatggagcgcataaatcctggccggtacgcttgaaaagagtgtggatgcgcaaaaagacaaaggtactggccgtcacctctgtgttatgtatagttgtgttggtcggaggagtctgtttgtttaacctgaaaaaagattcggccagcgggcgactgttcatgtggaaaatcagtagccgggccattgcagagaaaccatttacaggttatggccaaggaaattttgcactggcatatgggacaagtcaggaagcttattttgccgaacggagttattcgcctcaggaagaattggtggcaggaagtccggaatatgcttttaatgaatatttgcagatagcactcgagtgggggatacccgtattgctttgttgcctggcttttgcaggattttgtctacagagaggtgtggaactgaaacgttgggggccttgtggcagggggatctctttgttggtattcgctttttcttcttatccgatgcaattgcctgcttttggtattgcattcctgattttactgatggcttgttttgcatga

SEQ ID NO: 4968 - DNA, 1527 bp, B.fragilis
gaccctgtgttactctgtggtgaacccaaaaccattacaatgaaaaagatatattcaatattactggcttcggcactgaccctttcttcctgtgccgatttcctcgatgtagattcgcagggaaagctgaccgaagatgtcttcttcagcgaagaagaaggcgcgttgatgagtattaacgccatctatacccaactccgggcgtgggacatcatcggattctcatggtttgccatcaccgagctacccggtgataactccgatacaggcagcgaactggcggacggcagtgtggcacgtctgaaccagttcaacgactttacttacgacgcctctacctccgagatcaacggctggtgggaaggcaattataaagctatcgcttcatgcaatgtggctctggacaatctgggtgcggtgaagaacgaagaactccgggtgaagtgtgtcgcccaggcccgttttttccggggattcttctacttcaatctcgtacgcgccttcggtggggtgcctttggtgaccaaggtgttgcagcccggcgaatacaatcagccccgtgcaaccgaagaggctgtctatcaacagatcattgaagacctgacctatgcagccgagcatctgcctacccgtcaggagtggggtgcgaaagagtcgggacgcgccaccaagggaacagccgaaggattgctggccaaggtatatctcttccgccaggactatgccaacgtgaagaaatacaccggtcaggtgattgcccgcggcgagtatagcctgcaccgggattatcgcgacctgttcaatccgaactcttactattcggacgaagtgatgcttgccgaccaatacctttggggcgaatcgaccgaacgcaacctcgagtcggaatatgtgaaatggcagggtattcgcggtgagatgggctgggggatgttctctccttccgaagctctcgaccaagcctatgaagcgggagatccccgacgcacggcaaccattttctacgatggagagacattggagggaaagggcgagattcatttcaagaaagaagtgccgccccgtgccaacaaaaagaccatctggcctaccggttactggaacgagaactcgtttgccaaacagaattgtcacctgatcttcctgcgttatgccgatgtactgctgatgtatgccgaggcctgcaatgaactgggcgaaagccgggaagcactcgacaagctggaaatggtgcgcgcccgtgcccgcagaacggtgcatccggcggatatgacagtgggattgcccgagattacggaaaccggtaaagagaagcttcgcgagatcatctggaacgaacgccgcatcgaactggctttggagggacaccgcttcttcgacctgatccgtgcggacaaggtggtgccgggctatgcggagaagatgatgaaggcacacgggaagacaaacttctcgatagcaaaacatgcaacgttcttcatcccgcagaagcaggtggatatctcgcagggagtcctcaaaaactga

SEQ ID NO: 4969 - DNA, 1719 bp, B.fragilis
gttacttttacgtctcattttaacgaaaagtgtatgaaaaagtttctgaatagacgaaatggtgtcctgttggcagcagtgttggttgctgtagcattctttagtttcaagagcggtgacgaccgtaacttccagattgctaaaaatctggatacctttaattctatcgtcaaagaactcgatatgttttacgtagatacgcttgatccgaataagacggtccgtgaagggatcgactatatgttgtcttcgctcgatccctatacggaatactatccggaggacgatcaggccgaactgcagcaaatgttgaatgcctcgttcggaggtatcggatctttgatcacgtacaatcaaaagctgaaacgttcgatgatagccgaaccgtttgagggaactcctgcagctaaggtcggattgaaggccggtgatatactgatggagattgacggaaaagatttggcggggaaaaataaccaggaagtcagccagatgctccggggagcagtaggtaccagtttcaagctgaaagtggagcgtccggacgaaaaaggaggaacacggccattggaatttgatattgtgcgtcaaaccatccagactccgatgattccttatgataccatttttaataagaatgtaggttacatcaatctgagtactttttccggcactccttcgaaagattttaagaagacctttctgaaactgaagaaagaaggtatcacttcattggtgattgacctgcgtggtaacggtggcggacgcttggaagaagcggtagagattgctaattttttcttgcctcgtggtaaagtgattgtaacgacgaagggaaagaccaaacaggccagcaatacttataagacattacgtgaaccgctggatctcgatatcccgattactgtactggtgaacggtgctacggcttccgcttccgaaatcctttccggagctttccaggatttcgaccgtgctgtgattgtaggtagccgtacgtttggaaaaggactggtgcagaccacccgcccattgccttatggaggagtaatgaagcttactacttctaagtattacattcccagcggacgctgtgtgcaggccatcgactataaacaccgcaatgaagatggcagtgtaggtactatccccgatagtctgactaccgtgttccatacggcagccggtcgtgaagttcgtgatgggggaggagtgatgccggacatcgaagtcaagcaggagaaattgcctaatattcttttctatctggtacgtgataacctgattttcgactatgcgacgcagtattgcctgaagcatccgagtattccttctccacaggagttcaaggtgaccgatgccgattataacgactttaaagcgatggtgaagaaagctgatttcaagtacgatcagcaaagtgagaagattatgaagacgctaaaagaggctgccaagttcgaaggttatctggatgaggcttcggaagagataaaggcattggagaagaagctgactcataacttggaccgtgacctcgactatttctctaaagatatcaggtcgatgatcgccgatgaaatcattaagcgttactactacacacgtggcggcatcatccagcaattaaaagatgacgacgggctgcaagctgctcttaagatattggccgatccggtgaaatataaagagaccttgagtgctccggtaaagaaataa

SEQ ID NO: 4970 - DNA, 213 bp, B.fragilis
taccgaataaccatgaaacagtttgtccttttctttatcagtctctttcttttgggcgtgggtgcccgttcgcaagagatgtatcaaaagaaagtttttatctcttcccggggtgattctctcaattaccgtctacttcgtccggaggtggaaaagacgggactgcgtcttcaccacggggctggaaggatccagcggtggatgcgatttcaa

SEQ ID NO: 4971 - DNA, 450 bp, B.fragilis
cttgtacaaaccggtgctgtcggcagcaatgcgggcaaaagagttgttcaggcagaggtaggagcagtcgttccgcctgtcgtatactatccgtgccagtccttcgatgggaaggttgccgaacatggagaaaggtattctcctctcaactttaaagtcgcttacggtacatctcaccagataggcttcgcggtcactgagaaaccagtagagatctcccttcatgacgtcgacggtatgaatgcccctgagcgttgccaactgttcgttcatcgctttgtaggggatgatggaatccgccatgtcatcgtaagtgtagaagttccgcccatccgagaaagcgacacgcccgttcaccttgaacaaatagcagtttccaccctgattgccggacaaggaatcatactgtttcaggtccgtcacctgcttcagctcttcatcgagacgtag

SEQ ID NO: 4972 - DNA, 2319 bp, B.fragilis
atagatactaaaactgtaaagaccatgaaacattttgtacgaagaatgcaggcgcttgccgcttctttggtcgtagtggccgccgggttacaggcacagaaggctccccgggatatggaccgttttatcgaccagttaatgaaaaagatgacgctggaggagaagatcggccagctcaacctgcccgtgaccggagagatcactaccggacaggcgaaaagcagcgatgtagccaaacgaatccgtaacggagaggtgggaggactgttcaacctgaaaggagtggaacgcatccgtgaagtacagcggcaggcggtggaggagagccgcctcggcattcccttgttgttcggtatggacgtaatccacggatacgaaaccattttccctattcctctcggcctgtcgtgtacctgggatatgaaagccatcgaagagtccgcccgtatagctgccgtcgaagccagtgccgacggtatctcgtggacattcagcccgatggtggacgtcagccgtgatccccgttgggggcgcgtgtcggagggaaacggtgaagacccgttcctcggcgcagccatcgcccgtgccatgatacgcggataccagggaaaggatatgagccggaatgacgagataatggcttgtgtgaagcatttcgccctttatggagcatcagaggcggggcgcgattataatacggtggatatgagccgccagcgtatgtttaatgaatacatgctgccctaccaggccgcagtcgaggcaggtgtcggcagcgtaatggcttcgttcaatgaagtggacggtgtgcctgccaccggaagcaagtggctgatgaccgatgtgctgcgcaagcagtggggcttcgacgggtttgtggtaacggactataccggtatcaacgagatgatagaccacggcatgggtgaccagcagactgttgccgccctcgccctgaatgccggggtggatatggacatggtgagcgatgccttcagcggcactctgaagaagtcggtggaggaaggcaaagtatccgcagctgccatcgacgccgcctgccgccgtattctggaagcgaagtataagctgggactgtttgacaatccttataagtattgcgacgtgaatcgtcccaagaagcagattttcaccaaggaacaccgtgccattgcccgtaagactgcttcggagagctttgtgctgctgaagaatgaaggtgtgttgccactcagcaagaaaggaaccattgccgtagtcggtccgttggcgaacacccgttccaacatgccgggcacctggagcgtagctgctgtgctggataacgctccctcgctggtcgaaggactcagggaagtagtcggtgaccgggcaaaagtggtaaccgccaagggaagcaatctgattggcgatgccgactatgagaagcgcgccaccatgttcggacgtgaactgcatcgggataaccgtacggatcgcgaacttctggacgaagctctgaaagtggctgccggggccgatgtcattgtcgccgcactgggcgagtcgtccgaaatgagtggagaaagcagttcgcgtaccaacctggagatgccggatgtacagagagcgctgttgcaggaattactcaaaaccggaaagcccgttgtgcttgtgctttttaccggtcgcccgctggtgctcacctgggaagaagaacacgtgcctgccatcctcaacgtatggttcggagggagtgaagccgcttatgccatcagcgatgtgcttttcggcgatgtcaatcccagtggaaagctgaccgctacttttccgcaaaatgtaggccagattccattgttctacaatcataaaaacaccgggcgtccgttgcaagagggacgttggtttgaaaagttccgcagcaattacctcgacgtgagcaacgagccgctctacccgttcggctacggattgtcttatacgacttttgcctacagtgatattcacctgagcagcacggagatgagtgctgatggcaaactgacggcgactgttaccgtcaccaataccggcagccgtgacggagcggaggtggttcagctttacatccgcgacctggtgggcagcgtcacccgtccggtgaaagaactgaaaggttttgagaagattttcctcaaggccggagagtctcgtaaagtaagcttcagcatcacgccggaattgttgaagttctataattacgatttgcagtttgtctgcgaaccgggtgatttcgatgtaatgattggcggaaacagccgggatgtaaaaaaggcacgatttcttctgaagggagaataa

SEQ ID NO: 4973 - DNA, 2847 bp, B.fragilis
ctgatgaagaatctgttattgttcctagtttttgcctgtaccttttctttttcttgcctggggagtcctgtccctttctcacccattgtccgcaactattctgttcttgactataatgccggaaatgaaaactgggcggttgcccaagatgaacgcggggtgatgtactttggcaacaacagtggactgctccggtatgacggaagccgatggaagctgtttccactgccgacttcgggtattgtgcgtgcggtctatgtggcttccgacaggcggatctatgtcggatcgttcgaagagttcggttattttgaacagaacgacctgaacttgctggagtatcattctctgaaagagcaggtaaaaggattcgatttccataatgacgagatatggaccattgtagagcagggaggaaatataatcttccagtcattcggatcctattttatatacgacggtaaggggacgaagggagtccgttgccctgaacttcccctgaaccttttccggatcggggacacgctgtattcccaactgatcaatggaggcgtctgtacttttgcaggcgataagtttattcccctgatttctcgtcaggagttgggtgatagcgatgttctggcagggttgccttatcccggcggaatgttgttgctgacccgcaatagcggaggatatatccatacttcttccggcatccgctcctggcacacggatagtgatgaagaactgaagcgccatactgttaatcgcgcggtaatgacaaaagactcttgttacgtgataggcactatctccaacgggctgtatgctttcagcaaagagggacacttgctttggaaggagaatgctgataaccagttggagaataataccgttctgggcctgtattgtgatatggacaataatatctggacagcccttgacaatggtattgcctatgtccgcaataattcgctgatttaccatttcgagccggttcgccgcaaagtcgggatggtttatgatgtgctggtacgcgataaggatgcttacatcgcatccaatcaaggactgtaccggcttgaagatacccgtctggagttagttccgggccttgaagagcaggcatggaccattggagagtggggcggccaggtgctttgcggtcataataaaggtactttccagattaaaggcatgcaagcccggcttctttccgatgtgcggggggctatgtgtatgcggcaggcgcagatcaacggcgagcaactcctgatacagggcacctatacctttttgaatatttacaagaagagtgctgccggcgaatggtacttcgctaactcggtgggcaacttcagtcacatggcgaagaatatcgaagtggacgctcatgggaatatctgggtgcaacacatgcgaaaggggctctaccggctacgtctcgatgaagagctgaagcaggtgacggacctgaaacagtatgattccttgtccggcaatcagggtggaaactgctatttgttcaaggtgaacgggcgtgtcgctttctcggatgggcggaacttctacacttacgatgacatggcggattccatcatcccctacaaagcgatgaacgaacagttggcaacgctcaggggcattcataccgtcgacgtcatgaagggagatctctactggtttctcagtgaccgcgaagcctatctggtgagatgtaccgtaagcgactttaaagttgagaggagaatacctttctccatgttcggcaaccttcccatcgaaggactggcacggatagtatacgacaggcggaacgactgctcctacctctgcctgaacaactcttttgcccgcattgctgccgacagcaccggtttgtacaagtcacgtcagaagccgtctttgtgggtttcgggtttttcggcatccgacgagcagacgggagagcggatacaactgcccgtttccggtaccgacgagatagcttcagctttcaataatatcagcatttccctggcctatcctgtctacaacgattttgcgctgaacgtgcgctaccggcttgaagggctgtccgcctccggtaagtggaccgaaggccttccggacttgcagaaagaatttacccgtcttccgttcggctcttattgtttccgtgccgaggtatacgacgagaacggagtgatttcctctgtcgaccttccattccgcattttgaggccctggtatctttcgtatccggctgtcgctgtctatgcgctttccgggatagccttgctgctggggctgctctatggagtctacgtatacaccaagaagaaaaaagatgtcgtcattgagcggcaacgtgcccgtcacgaagcggagatagagcagcaggagaagaagatcatggaactggagaaagagcaactcgaggccgacctccgtttcaaaagcaaagagctttcgggtgtagtgatgaccaatattgcgcatcaggaatttctgaattcactcaaagaggagttgcaacagcagaaactctcggggcaatatacgcgcaagaacctggataagctgctttcaatgatcaaccagaatatggtttcggatgaagagaactggaacatgttccagtccaattttgaccgcatccacgagaacttcttccgaaacctgaaagagaagttccctgacctgacttccggcgatttgcgtttgtgcgcattgctccggctcaatctgccgacaaaggagattgcgaagctgatgaacatctccgtgagaggtgtcgatgctgcccgctatcgtctgcgcaagaagctgggccttcctccggagagcagcctgacggattttatgattgcgttcaaatag

SEQ ID NO: 4974 - DNA, 1083 bp, B.fragilis
gctaaggaagaatgttttgtttttctcaattgcgatgcaaaagtaataggatattttgaaatatgcaatatctttgcaaaaaaaattagtgaaatggataaaataattggattgggcaacgccctggtagacgtacttgcaaccctgaaagatgatacactccttgatgaaatgggattacccaagggaagcatgcaacttattgatgatgctaagttacagcagattaacgaacgatttagccaaatgaaaacccacttggcaaccggtggagcagctgcaaatacgatcctcggactcgcttgtttgggtgccgggaccggttttatcggaaaaatcggaaatgacgcttacggaaacttttttcgggcaaatctgcaaagaaatggcatcgaagataaattattagtgtctgatctgccatcgggagttgcttctacttttatttctccggacggagaacgtactttcggtacttatctcggtgctgcctctacgctgaaagccgaagatttaacgctggatatgttcaaagggtatgcatatctgcttatcgaggggtatctggtacaggatcatgatatgattcttcatgccatcgagttggcaaaagaggccggattgcaggtttgtctggatatggccagttataatatcgtagcgggtgatcttgaattcttcaccttattaataaataaatatgtagatattgtttttgccaatgaagaagaagcgaaagcgtttacgggcaaagaagatccgaaagaagctcttgagttgatcagtaagaaatgcagtattgccattgtaaaggtaggcggcaatggttcttatattcgtaagggtactgaagaaattaaggtagaagctattccggtgaaaaaagtgattgatacaacaggagcaggcgactatttcgcatccggatttctgtacggactgacttgcggatattctttggagaagtgtgctaagattggttcaattctctccggaaatgttatacagatagttggaaccacgattcccggtgagcgttgggatgaaataaagttaaatattaacgaagttctgtcagagtaa

SEQ ID NO: 4975 - DNA, 2475 bp, B.fragilis
aaacaaattagaatgaaaaatgtactaacagggctatttctgcttatccttgcgacagcttgctcggaggaggagccgcagacaataacacccgttccttttaatcaggtaactttgaccgatgggttttggaagaataggatgcagacggaaatcaatgtaacagtaccgttctctgtcgaacaaagtgccccggcagtagagcgtttccggcgttgtgccgctttcttggcaggagactctaccgctcttcctgaaactcatcgttttataagctctgatctttataaggtgatggaaggggtgtcttattcattgatgattcaaccaaataaggagttggaagagttcatggatcgagtggcagacctgatcactgcttcgcagaaagacgacggatatttatatatttcacatatttgtggtaatcccgatcctcgtgagatgggtgagaagccttactcatgggtggttcatagtcacgagctttataatgtggggcatctgtacgaagccgcagtagcttactatcaagctacaggtaaagataaactactgaacgttgctatcaaaagtgccaagcatgtgaataaagtgttctttgaaggaggtgatccgaattataatgggggtaaacctattaaccaggctccgggacatgaagagattgaactggcactttgtaaactataccgggtgactaatgatccgctatacctcgatatggcgaagaagtttctggagatcaggggagtgacctatcgtcctgagggtgaaggagtgatggcacccacttatgcacagcaacacgcaccggtgaaggagcagacggaagctgtgggacatgcggtccgtgcggcttatttgtacacggctatggcgcaggtggatgccttgaccggattgaacgattataccaaggctctcaattccatttggacaaatctggtgacgacccgcatgcatattacaggtggactcggggctgtagaaggaatggaaggttttggagctccctacgaacttcctaacttaacagcctataatgaaacttgtgcggcagtagcaaatgtcttctttaattatggcatgtatctggatagtggcgatgctaagtttctcgatatagcggaactttcacttttcaacaattcgttggcaggtatcaatctgcatggtgatcgtttcttctatgtcaatcctcttgaagcagatggagtgagacgttttaatcatgggaatggcggacgtgccaaatggttcgggtgtgcctgctgtcctcctaatatttctcgtttgattctgcaagtgccgggttatatgtatgcttacagtaaagacagagtttacctgaccctttatggtggcagtcagacaactattcctctggaaggaacccgtgtgaaactggagcaaacttctgcttatccgtttgatgggaaagtacgcttgacggtacaacctgaaaagggaagcaaattctcggtttgtatgcgtattcctacgtgggcacgatccgacgaatttgtgccgggaggactttatccctacaagcagcccaagcaggcggaagtagaattgagtgtcaacgggcagaaaaccgacttcaagatggagaaaggatttgccgttatcaaacgtgactggaagcccggtgacgtagttgaacttaacataccgatgcccgtacgttttgttgattgtattcccgaagtcagtgaaaatataggtaaaactgctgtaactcgcggaccattggtctattgtgcggaagaggtagataatgcgggacctgttcagcggctctatctgggggatacgaacgaagcacaggctaaggtagcaaacatctcttccggcgtgctgcaaggattggagaggatcactttgcccggaatggaaaagaaggtcggaggaatcacttcacgagagattacgatgattccttattatgcttggtgtaatcggggagataaccgtacaatgctggtttggctaaacgaagaggcttctacagccagtatcggtcagcagaccatggcttatctgcgtaatgtaaagggagtgaatgcttcatctgttgccggagggaagaatatctccgtgcgtgcactttgtgatggaaaagtgtctgaatcttctgcagacaagcttacagaacagtgggtgtctgagggatcgggtaaacaatgggtgcaggtagactttagagagccattcctactaaattcactttccgtgtattggctggatgatcaagacaaaataactgttccgtccggttggtcggtggaatataagtcggatgccggttggactccccttgaactctatgtgacggactcttatcagatgggtaccgatcggttcaacgtagtacatccatccggtagtcttgaagtggaatccgttcgtattcttatagaacctcagaaaggaaaatcaataggtgtttcagagataaggtttgagtag

SEQ ID NO: 4976 - DNA, 3030 bp, B.fragilis
gtttgcagcagaattttaaatcagtaccaaacgatgaaaaaaaatctgtttaccctatgtatgatgttgctgctctccatgctttcttttgcgcagggcagtctgaccatctcgggtgttgttaccgagaaaaagacaggggagcctatcattggcgccagtatcctgctgaaaggtcaatcgtccggaaccattacggactttaacggcaactattctattccgaatgttccttcgggcgccactcttgttttcagttatatcggcatgaaaacgcaggaggtcaaggtgactgcctcctcgaagctggatatctctcttgaagaagataaccaattgatagacgaagttgtcgtgatcggttatggtatacaacgtaagtccgacctgaccggttcggtaggtgcggtgaagagcaaggatctcacgaaagttgccactcccaacgtggcgaatgcccttcagggacgtgtctccggtgtgtatatctcggctaacggtgctcccggaagctcacccgaagtacgtatccgtggtatcggcacaacgaataacagcaatcccctttatgtggtggatggaatgtttatggacgacatctctttcctgagcacacacgacatcgagtcgatggaggtgctgaaagatgcatcagcgaccgccatgtacggttcgcgcggtgccaacggtgtgattatcgtcactaccaagcagggaacggaaggaaaagcggtggtgaacttcaccgccagcgaaggattccagttcaacaacagcagcttcgagatggccaatgctaccgaatacgcgacactgctgaacgaagcactggtcaacacaggcggaaaacccaagtttgacgatcctgcttcactgggcaaaggaaccaactggttcgacgaaatcttccgtgtggcttccgtacgcgactatcagctcagcgtcagcggcggatcggagaaggtgcgctacaacctcagcgctggatattaccagcaggacggcatcatcaccggaaacacctacaaccgcttcaccctgcgtgccaacaatagttacaagatcagcaaacggctgactctcgggcacaatctgtcggcctctttcagccataagaagaacgaaaacagcgcggtggtgaaagctgcctataccatcagtcccgtgaagcgtccctacaatgaagacgggagttttatggattccgaaagcgcctcttctgccaatcccgtcgccacactccattatacaaacaatgacgactggaaagaacgtatcgtgggcagcgccttcctgaactggaatatcctgaacgggcttgactttaaaaccagcctcggcatcgactacatcaacggacgccgccgcaacttcgtgccgaaatactacgtttcggaaacacagaagaacgaaaccaacagcctctccaaaacctgggaccgcgacttcacctggttgtgggagaacctgctgacttatgactggaagatcaatgataagaaccggctcaacctcttgggaggtatcacggcgcagaagcgtgtttacgaattgctggaaggcaccggacgcgacttcttctccgataacgaaaactactggtatctcgaccaggcttcggccggctccaagtcggtggccaacaacggataccacgaaacaatgatgtcttatctcttccgtgccaactatgcgttaatggaccgctatctgctgactgtctcggtccgtgccgacggttcatccaagttcggtcctgacaaccgttggggctacttcccctcagtagctgccggatggagagtctccgaagaagcgttcctgaaagaccgcgtgcagtggctgagcaacctgaagctcagaggaagctggggacagatcggtaatgataaaataggtaacgacaaataccgggcgctcgccaatatctctccgtcctatgatgccgtgtttggcggcgtgttctatcccggcggaaccatcacgtcactctccaaccggagcgtccattgggaacgttcggagcagatggacctcggcttcgacctcggactgctgaacaaccgcttttcacttgaactggactactatcgcagagacacgaaagacatgctggtgacggtggatgtaccggcttccgtaggcctcaccccggtagaaacaaacgtaggggcggtgcgcaacagcggtgtggactttaccgtgaaatgggaagattcgctgaaagacttccggtacggcatacgcctgaccggaacgacgatcaaaaacgaagtcatcagcctgggcggcaaacgcatcgccagcggtgatatcggcgccgggaaatccgtacagatgaccgaagaaggaaagccgattaaatatttctatggttacaacgtgatcggcatcttccagaacgaagcgcagatcaaggagtacaacgagcgtgccgccgctgccaccggaaattccggacaacagtatcagaacaacgtaggtcccggcgacctgatatacgaagacgtggacggtgacggatatatcaccgccaacgaccgtaaggatctgggcagccccactcccaagttcatcggcggtctgggcatcagtgcttcctggaaaggattcgacctctctatcgacttccaaggtaacttcggaaacaagatattcaatgccaagcaggtggaacgtttctccggttcggacaactgggaccgctccttcctcgaccgctggacacccgaaaatccgaataccatgacaccgcgaatgactctggaaggcaataactatcaggtgtcgagccgctacgtagagagcggttcgtacgtgaaactgcaaacggtggaattgggatatactttcccgaaatcatggatgcagaaggtatccgtgcagaatctgagagtctacttctccggcaacaacctggcctatttcaccggctataacggtttcacacccgaagtgctgggcggcatcgaccgtcagatctatccggtgacagctacctgccgcttcggcctgaacgtaactttctaa

SEQ ID NO: 4977 - DNA, 1731 bp, B.fragilis
attacaaccatgaaacaactattccttcttttactcgctttgggggctcccgcccttgcccttgcgcaagacatgcggcaagatacttattgcaacccgctgaacatagattatacctatatgatctataactccgacaaggacatttcctaccgttcgggtgccgatccggcagtggtcaggttccgtggagagtattatatgttcgtcacccgttccaatggatactggcactctaaagatctgctggactgggattttatcgctcccaaagactggtatccgcaggggagcaacgctccggccgctcataactataaagactcagtgctttatgtcaccggtgatccttcgggttctatgagtattctctattccgacaatcccaagagcggcgaatggaaagctacacccgccatccttcataacctgcaggaccccgatctttttatcgacgacgatggcaaagcctatatgttctggggttcgtccaatgtttatcccatccggggtatggaactggataagaatcaccggttccttccgaaaggagaagtgaaggagcttttcaatctcgacatgccgcgccacggctgggaacgtttcggtgagaatcatagcgataccgttttaggaggatatatcgaaggcccgtggctgaccaagtacaacgggaagtattatatgcagtatggtgctcccggtaccgaattcaatgtctatgccgacggtgtttatgtagccgatcatccgatggggccttacacctatcagaagcacaatcccgtgtcatacaaaccggggggatatatgaacggagccggacacggcagtacggttcaggggcccggcggagagtattggcattttgcttcgatggctctttccatcaatgtcaactgggaacgtcggctctgcatgtttcctgccggattcgataaagacggtattatgtacgtggacacccgcttcggtgattatccccgctatgctccggccgtacccggcaagaaggggcagtttcgtggatggatgctcctttcttatcgcaaaccggtgacggcatctactgcgaaaggtgagttcggaccggatgcattgacggatgaaagaaccaagtctttctggctggcggaagcaaatgatgaacgtcagtgggtactgatcgacctggagaaacctgcccgtgtctgtgccgtacaggtgaattatcacgactatcggagtaatctatacggtcggattcccggattgcgtcaccgctatgtgattgagggctcttccgacggggagacctggaatatactggtcgatcgccggagcagctataaggatacgccgaatgactatgtagaacttgaagtcccgactaccgcacgctatatccgctataagaatatagacgtacctactccgaatctggctatttctgaactgcgtgtattcggactcgggttcggcaaggctccccggtcacctcaaaagctggctctggatcggcacaccgaccgttgtgatgttaccgttcgctgggagccggtgaaaggagctcagggatacaacgtcctgtgggggatcgcccctgataagttatacagttcgtggatggtgtacggtggcaatgagttggagatgaaatcgctgactatcgatcaggattattattttgctgtggaagcctttaacgaaaatggtgtatctttaccttccgaaactaaatatgtagaataa

SEQ ID NO: 4978 - DNA, 1545 bp, B.fragilis
  unsure (63),(68): Identity of nucleotide sequences at the above locations are unknown.
gtgagaagaatgtcatttatccctaataaagaagaaattgcttctttggagtattatgaaganaattntgtgtggggccagctgcaacgcacggatgaggaatatccctatccatatggtatttacggcagtgaaaactggtatcagaaccgcagcgggaaatatggcggatatgaagacgggggttccggtaaggggcgtatgtggcgaacttttgattataccactcattttgccatctattataatctctaccggatagcagaggataatcctgaaatggtatcttatctggatgctgatggctatctggaacgtgcttatcggacagcgattgcttattttgaagtaccctataatattttgatgggtaaacaatgggcttttcatggttggacggactgggcctataaacaaggtaattttcatgagcgatatctgctggatattatcaatgccctgcaacagaaaggtagattaaaagatgcagccaagttgcgtcgtgaatgggagaaaaaggtaacttatatggtttacgaagatccctggccttttggatccgagatgtttgttgaccgtacagcttttgagtcctcctattatgtggcagagtatgcaaagctaaatcccattaaacccgaagaacaattctggtatgataagaatcggaaaaaatggtactcgtatacttcgtttgacacttcgatgattgatcgtttcatgcagaatcagttggatggaaacctggcgttgagagggttgtttgaaccaggttatgctaatctgggtacagcatggagcggacaatatgtaaatctggattatatgacccaaatgggtggagtggcattactcgattatgcttaccggttttcggaccgaccggataggtatattaattatggatataattctttgttggcttcgtgggcactgatgaataccgggactaaaaagacagattttggctattggtatcggggagaacagaatgacggtgctgtaggctgggctttttcaccctatcagaactcacgtacctatatgaattatatcaaagtggggcgtgctccctggcggtttgatggtgagatagaccatgggcttaccggaggtattcacggttcaggagtttatctgctcgatgatcctgatttcggattaatcggttatggaggaaatgtccgaatggataaagatggaacagtgagtatcattccttttgacggagtacgtcgtcaggtccgtatcatgactcctgtccgtttttcggtcgagttgatgcaagacggattccggaaagattacccgatcactctgagagggacggaagaactgagtttctgcatagaaaaccgttctgataaacctcataacacaactatccgggctgagggaatgcctgaaggtaaatatactgtcatgaccgatcacaaaatgataacgacattcaatattgaggcgggtaatgcacatcatccttattatatagaggtacccgttacggacaaacatacccaagtgaaacttttaaaaacaaattag

SEQ ID NO: 4979 - DNA, 1314 bp, B.fragilis
aatcttgaattaacaacaacaatgaaacatacccttttatttcttcttatgatctgtgcttgtacgttgcaagccaccgctacaggcaaacagccgagactgaccgatgatgagttgatgactcttgtccagaaacaaactttccgttacttttgggattttgcccatcccgagtccggtctggcccgtgagcgcagcaatgaccgcctcgagatagcaaccatcggtggttcgggctttggggtaatggcaattatagtcggtgtggaacgtgggttcatcacccgtgagcaaggcgctgagcggctgctcaaaatagtggagttcctcaataaagccgatagctatcatggtatctgggcacattggatggacgggactaccggaaagaccattcctttcagcaggaaagacgatggagccgatttggtagaatctgcctttatgttcgaaggactgctggcggcacaccagtatttcactcacgataatccgacagagaatcggatacgagggctgatcaataccctgtggcatcaggcagagtgggactggttcacccgtggaggtgaagatgtgctttattggcattggtcacccaataacggatgggcgatgaaccatcagctgaaagggcagaacgagtgccatatcacttatattctggcggcttcttcgcctacttatccgattcgtgaatcggtgtatcataaggggtgggccaactctattacattcaagaacggaaaagaatattacggcatccgcttgcccctgggcaccgactttggcggccctctcttctttacacattattcctatctcggactcgatccgcgcggactcaaagacagttatgccgactacggtgagcagatgaaagcacataccctgatcaaccgtgcttattgcatcgataatccgaagaagtataaaggatacggccgcaaatgctggggactgacagcgagcgacaatcatcagggttactcggcacattgcccgcagaacgacttgggagtgattaccccgaccgcagccatctcttccattccttatactccggaacattctctggaggctatgcgttatttctacgaagaattgggcgaccgcctgtggggagaatatggctttaaggatgccttcaacctgacagaaaactggtttgcttcctcttatctcgccatcgatcagggaccgattattgtgatgattgaaaactatcgctcaggcttgatatggaaactcttcatgagtcatcccgatgtacagagaggattgaagagactggggttcggctcagaagaataa

SEQ ID NO: 4980 - DNA, 342 bp, B.fragilis
tcgcttcatgctccacaactgccgtttcattatggatatccatgtagggaaaagtatgtgcaccacacttatcacccaacagcaatgagtcacactggctataattacgggcattatcagccttttcggctacacggaccaacacacagtgacaggctgagttcttcatccgtcaataactataaatacataggttataattacagtgaatatacagatccacgctcaagtagtggagagggggtagatgggcgtatgcgtgaatatcaaactaccactgtacgtcgttattctaatcatatgatacgttttaacaagatgtttggtaaacattcaatataa

SEQ ID NO: 4981 - DNA, 267 bp, B.fragilis
cggatgaagaactcagcctgtcactgtgtgttggtccgtgtagccgaaaaggctgataatgcccgtaattatagccagtgtgactcattgctgttgggtgataagtgtggtgcacatacttttccctacatggatatccataatgaaacggcagttgtggagcatgaagcgactaccagtaagattagtgaggatcagatattttattgtaatcagggtggtactaatggctttccaagggggctgcaaagggccgctctatttatc

SEQ ID NO: 4982 - DNA, 234 bp, B.fragilis
cggctcatcgacaccgcttcggtctatggaaatgaacgggcggtcggtatggctattcggaaaagtggtattccgcgtgaggaactgttcatcacgaccaaagcatggatttcagaaatgggttatgaacggacattgcgagcattagacacttcgctcgcccgtttgggattggattacctcgacgtttatattgaatgtttaccaaacatcttgttaaaacgtatcatatga

SEQ ID NO: 4983 - DNA, 564 bp, B.fragilis
ggcgcggctccttccagccccgtggtgaagactttcgcagatggatttgaagaaattgaagcgcttactacaattgatacattgagacgcgcaggtttagatgtcgaaatagtatctgttactccggacgagattgtagtcggagcgcatgacgtatctgtgctttgcgataagaattttgaaaattgtgacttctttgatgctgagctgctgtttttacccggaggtatgccgggagctgccactttggacaaacatgaagggttgcgtaaattaattcttagttttgcagagaaaaacaagcctattgcagccatttgtgctgctccgatggtacttgggaaactgggactcctgaaaggacgcagagttacttgttaccccagtttcgaacaatatctggatggggcggactgcactaacgaaccggttgtaagagatggtaatattattaccgggatgggaccgggagctgccatggagtttgcattgactattgtggatacattgttgggcaaagaaaaagtgaacgaactggtagaggctatgtgcgtaagacgttaa

SEQ ID NO: 4984 - DNA, 402 bp, B.fragilis
  unsure (393): Identity of nucleotide sequences at the above locations are unknown.
gactgtactcattttcaggtatttatatttatggagtttagaagagataattttccttttttattaactaaaaatcaatttatgaaaaaagtcctttttattttgttgggctgtttgctatcgtttaatgtgatggcacaggtaaaggcgatttcgggactggtaacagatgttactggggagcccgttattggggcaagtgttgtagaagtgggaaccactaatggagtaattactgatttaaacggtaagttctcgttaaaggtggcacctaattcacaattcttggtgagctatattggctacaagcaacaaacaattaaagttggctctgaaagcacttataatattgtcttcaccacggggctggaaggatcagcgctggccatacgntcagaaaac

SEQ ID NO: 4985 - DNA, 213 bp, B.fragilis
tctccattgtccgtaagcgtacgctttccgtcggctttatccgcagggaacggagacgtgcgtgggttgtggctgggtgcaggtctggtatcgttgggagcggccttcctgttggataagaagtacgagatgacttccgatttatatccggtcaatgtgtgctataacgtaatgcttgccgtggagccggaatgcccggactctcgattatga

SEQ ID NO: 4986 - DNA, 1125 bp, B.fragilis
gaagacattacgcatattcctgtgatagaggactctgcttctgtatccgtcactgctgattctgtcgcggtgaaacgtagtttcttcaagaaattcctggactacttcaatgatgccaacaaggagaagaagaacaaaaagtttgacttcagtgtgatcggtggcccgcattattccagtgacaccaaactcggactgggcttggtagccgccggactataccgtaccgaccgtgccgatacactgcttcctctctctactgtttcgctgtatggcgatgtgtccactgtcgggttctatctgctcggtgtacgcggaagtcatatatttccgaaagacaagtaccggctcaattataacctttatttctattctttccccagtctgtattggggcgtcggctaccggaatgcggtgaatgacgagaatgaaagcagttacaagcgctttcaggcacaggtaaaggttgactttatgttccggatggcaaaaaacttctatctggggcctatggcaagtttcgactatatcgatgggaggaattttgagaaacccgagctttggcaagggatggatgcccgcacctccaatgtcagtgcgggactttctctggtgtacgactcgagagatttcctgacgaatgcctataaaggatattatctgcgcatagaccagcgtttcagtccggcatttctggggaatgactacgctttcagtagtacggaactgaccaccagttactatcgccgggtgtggaaaggcggaatacttgccggacaattccataccctgctgacctacggcaatccgccttgggggctgatggctaccttgggaagttcgtactccatgcgtggctattatgatggccggtaccgcgataagaatgtggtggacatgcaggtggaactccgccagcacgtatggaaacggaacggagtagccgtctgggtgggagccggaaatgttttccccgacttttcctcattcaaagtgaaacatatacttcccaactatggctttggctatcggtgggagtttaagaagagagtaaatgtacgattggatttagggtttggaaaaggccagaccggatttatatttaatatcaatgaagctttttaa

SEQ ID NO: 4987 - DNA, 210 bp, B.fragilis
ttaaaaagggcgccggggaacccgcctaacgggggaaaacaattgccacaattgtttctccaaaaaaaatttttttccccagtctcccaaagaaaaaagggaaaataccgagcccggaatactctttttaatgaaaaaaggccctatatcactctagaaaaaaaatttgtcgggtataaggagatggaatggtctaaagccattaattag

SEQ ID NO: 4988 - DNA, 564 bp, B.fragilis
ggtttggaaaaggccagaccggatttatatttaatatcaatgaagctttttaatagtataaaaaaatggttcggtaatcaggagaatttgttctacctgttcctgtttgtgctgatagtgcccaacgttgtattgtgtttcaccgaacctttgccgcttgtagccaagattgccaatgtcctgttgccattggggtgttattatctgattatgaccctttccaggaattgcggaaagatgctctggattttattccttttcgtattcttcggggcctttcagatcgtgttgctctatctgtttgggcagtccatcattgcggtggatatgttcctgaacctggcgactaccaattcttccgaagccatggagttgctcgacaacctgttgccggctttgattacgattgtgatcctgtacatcccggccctgatactggggatgatctccattgtccgtaagcgtacgctttccgtcggctttatccgcagggaacggagacgtgcgtgggttgtggctgggtgcaggtctggtatcgttgggagcggccttcctgttggataa

SEQ ID NO: 4989 - DNA, 207 bp, B.fragilis
agagacttcgaaggatttcactttcattgccgccgcacgcatccggcagaagaccgggagatttacgtactggtagtgggagagacttcccgtgcgctcaattggtcgttgtacggttatgatcgtgagacaaatcccaaactgtcggaggtatccggcctgacggcttttacgaatgtgcctgacccaatcgaatacaactcataa

SEQ ID NO: 4990 - DNA, 402 bp, B.fragilis
cggcttttacgaatgtgcctgacccaatcgaatacaactcataagatggtcccaatgctcatgtctgccgtttcggcggagaatttcgattccatctatcatcagaaaggaattattaccgctttcaaagatgcaggtttcaggacagctttcttttccaatcagggttacaacacctcttttatcgactgctttggacacgaagccgatcactgtgacttcatcaaggaggatccgttgactgccggtcagaatctttcggatgattatctggatgacctggtgcaagaggtacttgctacgggaacccgtaaacggttttcccggttgtacccgtccggtatacatttgaataatcggaatcgtatgctcgtccagacatctcttattctagccgaatag

SEQ ID NO: 4991 - DNA, 324 bp, B.fragilis
  unsure (132),(159),(161),(209),(249): Identity of nucleotide sequences at the above locations are unknown.
ccttcgtcatcccaaaaacgtactttttcttgcactctgtctgggctatattccaagcgacttttaccaggaattcttttggtttctttaagaggaggtaaacttaagtccgaatttttctccccagctaanagaatcatagaaacctcatctcctcgntntatcatagaaactccacctattgcatattttaatttatttatccatantgaaaaatctatgtctggtggggtattagttactgtgaanattgaaattctatcttcatcaaataattttaatgattcttcgaatttatttgggcaatctttggaagtaacataa

SEQ ID NO: 4992 - DNA, 864 bp, B.fragilis
  unsure (147),(187),(235),(237),(264): Identity of nucleotide sequences at the above locations are unknown.
tccccaattaaattccttttttcttataagccgaaaaggatttttctaattgatttaatggccttatcggattatgttacttccaaagattgcccaaataaattcgaagaatcattaaaattatttgatgaagatagaatttcaatnttcacagtaactaataccccaccagacatagatttttcantatggataaataaattaaaatatgcaataggtggagtttctatgatanancgaggagatgaggtttctatgattctnttagctggggagaaaaattcggacttaagtttacctcctcttaaagaaaccaaaagaattcctggtaaaagtcgcttggaatatagcccagacagagtgcaagaaaaagtacgtttttgggatgacgaaggttattggaagacaataatccttttaagatttgatgttttaaccatggagctagacgcaaaattcataaataaagatatgggtaactctttttctgtattgacagattatattgagtcgtttttatcagaaaaaggggagttcctgtttccagaagctgaaaattatctaaatgaacaaaaggtaaaaatacaaaattattatcctttgtttgagattgctagaacgtgtttacatctattgtcttatgtggaaaagtacacagactcattatcgtcggaggagcatataacagtattaggacatgaaccgataaaacctagatttttcaaaaaagataaaatggttccaccaaaatatgagttgcgaaaaagagatgtatggaatttaaagaggcaaagggataattattcctctagcataataacatttaagtcttcaccacggggctggaagtatcaacgctgttcc

SEQ ID NO: 4993 - DNA, 633 bp, B.fragilis
aacgcatacaatatgaaagaacattcaataaaggcggtcaggctaacccccacagtgaaagcccgtctggacacctttaaaggaagcgacacggtcagtgtctgtatcgatagaatgattactttttttgaaatcacagggttcaatccccgctacgcatcccggaatccgacggcactggtggaaaagagaattgaggacgttgtcagaatcatcaagtcccaggaacgggatatactcaagcccgtacttgagaaactctccgccataaacaacaccccgcaggagtcacccgattatgcccggttgatgaacgagttccgggatctgaaagatgaaaaccggaaattgaaagaaaggctgcaggcggatgatctccatacccaagacgccgccgtataccatgacaagctcaaacgcctgggcgacctgctgaaataccagcttgatccggagaagttttcaacgataaaatacagcgatgatgtaagagtccccgtcaacaccctgcagttgcttatcaagaagatcaacgaggaatatgttcttgtcaaccgcataggccgctatacactccgcacgtaccggataacaaagataaatgctcccgggctggtagactactctgaataa

SEQ ID NO: 4994 - DNA, 312 bp, B.fragilis
tatccgataccgacctgcatgatgtcggctttgtcctttatcctgtaccctgaaaggagcaaatttgctttaaaaaacaaaaggatgaaaggattgacagaactgattgtggcgggctgtattttattcggcctgcttcttacgccgctggttttctccatactggattttataagcggagtgcgcaaggcccggcagcgcggtgaaaggatcacctcggaccggtatcgcagaagcgtaaagaaagggccggttattaaacctgctgctgtttcacccggggtggaagacagcggggtcagaaaggtttca

SEQ ID NO: 4995 - DNA, 831 bp, B.fragilis
aaatcgagatatatgaataattacgttaagacttccgttcccagaccggtgggcaatcccggaaacggtatcaaccccaaagacgtgctcaccctgatcgacatcgacgatctggtctatttccctccccgtgacggtgccggagtggtgctggagggtgacatcgtggtaaagccgtcggcttactccacggacttgtatttaactcccggtactgtggagctgagctccaacggtgaaggggaaaccgacgccaagggcttcaccccttcggttaagggaaaacatccgggtaacaaacaggaggttcgtgagttcaagaccaactggctgggacgccactgcatagctatcctgcaatactgcaacgggcaggatccggatatcctgggttccccttgcaaccctttggaaatgtcggtcaattataccggaaataaagacggcaacgcctcggagttcaccttcacgcagataagcaaaggagacgatatcggtatctataaaggcaccatcccacacgaagagccggtggcgactgttcccgcatcggcaacggaaattccctttaaaggccgcgggcagtaccagctaagcgccggagcggccaagatcgctaccattaagggggccaaacacggcgacctgttcaccctgctcggggtggtgtccggcgtagctcctacaatcgaaaaggcaggacagacagccttcatgctgaaaaacggaaagacgttcaccgcttcaccgggcagccagattactttcaaggccttcgataccggcgggggagccatccagtgtgtggaacagtcgagattcgaggtttaa

SEQ ID NO: 4996 - DNA, 186 bp, B.fragilis
aatggaatccagaaaaaaaaactgatttttcatcgccggaggctggaaatcaaaagggcctcctggctgaaaatggggacccgttaccttcatccctgcgaccgcagtgaagcgggcatgcaggcacggaagctggataacgagatcctctcttgtaataaccgtttaatgaatttatatgaataa

SEQ ID NO: 4997 - DNA, 1488 bp, B.fragilis
ctgtttttacacgtgcaaacacttgtaaagaactccttccgaagaccgcgccgctcagaagccgaaaggcaattgcctgaggggcaaatggtgaaatatgattacattaagggcaggcaggcagaagggttgggaacgaaaaaccgcttccggtatttccggaagcggtcaggcaaaacaaggcaattgcctttcttatccccccgtcaggtcatcgagtccgggcatgtagggaccggacctgctgcggccggacttgcccctgacggcacgcctccaggccccccgcatcatcaggtacttgaaggcgtcggagaagttcgtggagagcatgggcagtttcttgggctccagcttctcggacttcttgaccttgtagatgatcttctgctgtcccttgtaacggatacccgcaggcgccttctcgatactggagatggtctcgcgacagttcaccgcgtcaacaagcaaagtggggagggcgtcgttgtcgcctgtcatcagctcctgcatgaaatcgtactcttcatcctggcggatattggactgtttgcggctcatcaggttgacaatccatcccgtgcggttaccgtcaccgtctatctcgatggcctgcttgagcttgcgggcgtaatcctctttctgcttctcgaagttattgcccgcccggtcgtaatacaggttcagttccttctcctcatggttaaggaagaatgccaggaactggtcggccagctgcctgaaccatccgggaggaagctcgtaaaagttcttgtgaaggcggtacagcggtccgtcctgctgtcctactatcagggacagctggttaccgaagtccacgccgccgtcgatgggctcgccgcgcctgaggaaacgcaggtccaggcagctttgtgcaggttctccgtaccgtgtcccgtcggtatacttgtgcctttccccgaaagcgatatagaagcgcgtgtcacggcgaagccccggacgcatccccactacagacttaaggaagtcgtggagttcgagcgccccgtcgagaaggcgacggacgtactcaggcgtaaggatgtcgatgttggtaaaactcgaggcgttgatgaagtaggtctgccccttgcgcatcttcagcagccccgcctcgtaccaggcgattttcttcttaagagccccgcagtccgtccgtgtccttcccgcttttaccaggcggacgcgcaggctgttcagctccgcagccgcctgggcgatacgcaggatgcgctgaggatcgaccagacagacgtaacggaagtaccagtcatactcaccctccagcacgtcgggcatgtcggtggtaatggtcacccccagaaaatagtggctgcatccgtaacgtatggcatccccgcgcaatacgggcatggcccggttgactttattgtcgggggcgtatttggattcgtcgaagaacaaatgaacgaccgatttgcccgccagaagggaggggtggtctag

SEQ ID NO: 4998 - DNA, 348 bp, B.fragilis
atttatatgaataatatggagcgtttgccggcggacacctttttcctggaccttgaactccgccaggaggtggagcgcatggcctccctgggatatgctccggacgatatcgcctcttatctggggctggatgcggagagttttgtctttgacgccggaagggaagggaccaccgtgtattcccttatgcgccggggagcattgaaggccggggccggagtggagctaaaactgcaagaacaggcactttcaggggatttggatgccatggaactgctggagaaagtgcgtggtcgcaggagttttgaaataatagtgaagcaaatcgatgaagacgaatttggttaa

SEQ ID NO: 4999 - DNA, 1668 bp, B.fragilis
cccaccgatgatgtggaggttcgttactcccatatcatcaaggttcatcaccgactggatagacaccaccaacctggttgtcgtcgcgggccggctgccaagagtaccgtcatacaagcgcgccggtcggccgattgcgtgtatgacatgcccggtgcgccgttggctttcgtggggaatacatataccaacttaagggataatatcatgccggccgtcaagaccggctgggaactgatgggactctatgaaggcgtgcactatgtatcgtcctgccggccaccggaatcctggcgcaggcgttgcagcgtgatcgtcgacgattacaagaacacggtctctttcttcaacggatgcattatctttctgggatccctagaccacccctcccttctggcgggcaaatcggtcgttcatttgttcttcgacgaatccaaatacgcccccgacaataaagtcaaccgggccatgcccgtattgcgcggggatgccatacgttacggatgcagccactattttctgggggtgaccattaccaccgacatgcccgacgtgctggagggtgagtatgactggtacttccgttacgtctgtctggtcgatcctcagcgcatcctgcgtatcgcccaggcggctgcggagctgaacagcctgcgcgtccgcctggtaaaagcgggaaggacacggacggactgcggggctcttaagaagaaaatcgcctggtacgaggcggggctgctgaagatgcgcaaggggcagacctacttcatcaacgcctcgagttttaccaacatcgacatccttacgcctgagtacgtccgtcgccttctcgacggggcgctcgaactccacgacttccttaagtctgtagtggggatgcgtccggggcttcgccgtgacacgcgcttctatatcgctttcggggaaaggcacaagtataccgacgggacacggtacggagaacctgcacaaagctgcctggacctgcgtttcctcaggcgcggcgagcccatcgacggcggcgtggacttcggtaaccagctgtccctgatagtaggacagcaggacggaccgctgtaccgccttcacaagaacttttacgagcttcctcccggatggttcaggcagctggccgaccagttcctggcattcttccttaaccatgaggagaaggaactgaacctgtattacgaccgggcgggcaataacttcgagaagcagaaagaggattacgcccgcaagctcaagcaggccatcgagatagacggtgacggtaaccgcacgggatggattgtcaacctgatgagccgcaaacagtccaatatccgccaggatgaagagtacgatttcatgcaggagctgatgacaggcgacaacgacgccctccccactttgcttgttgacgcggtgaactgtcgcgagaccatctccagtatcgagaaggcgcctgcgggtatccgttacaagggacagcagaagatcatctacaaggtcaagaagtccgagaagctggagcccaagaaactgcccatgctctccacgaacttctccgacgccttcaagtacctgatgatgcggggggcctggaggcgtgccgtcaggggcaagtccggccgcagcaggtccggtccctacatgcccggactcgatgacctgacggggggataa

SEQ ID NO: 5000 - DNA, 1077 bp, B.fragilis
tggtctgatatcaagaccattccactttcaggcaattgccttgttttccctttacggggcaaggcaattgccttttttcagtcctttgtaccgcagccggtatcgggtatctttacggcgtatcatttaaaattcaattcaatgaaagagcaaatcatttcctatttagaaggaccgcgtgattactcccaaggggtagccctgtatgagcagttcggtcccaaccgcatgctgaaggccaagttccggcagatcggggagtgtgagatgacaaggggaacccttatcgaggagctgcgcaagctttccggcatgagcgaggcggaatttgccggcatgcacaggaaggcgcaccatattccgtcgaaggcggaacagcctgtcagccccgtccctgtcaggatgtatgcggacgacctgcttatcgcccttgcctcacgcctgggggtaacggtggaaaaactggtaagcgacgattttgtaaaagagcggctctcccaaagtccggatatggaacaggtgcggggtctgaaggaagaactcgaaaacgcacaaagcacgtactcggaggcaccggaaaccgtccgtaaggccatccgcttccgggaggagtttccattcctgagacaacctgactgtccggacgaactcaaggtgctcgtagcggacatgttctccgcttatgatctctatcgggaaagccaccgcatgctggtcgagacaccggatgacgtggccaccggggagacttacctttgggctaaaacggccgtggagaacttcctggagaaccgccaaatgtgggaagagttggagtattataagaataacggagaaatcctcggaaaggcgcaggccatgcggcaggccagggagaaacaggaaatctcctccctgacggatctggaactgtccaagcagctgggtaatgccaagtctaacatatccaagggaaaaaacgaactcgaaaaagcaccggatgaagaaaagagggtcaaggccatggagaagacccgcaaatggacggaacgcaaaaatctgctggaggctgaaatggaatccagaaaaaaaaactga

SEQ ID NO: 5001 - DNA, 630 bp, B.fragilis
agcaaatcgatgaagacgaatttggttaagccctcgagggtgaattttgaaaaagcggatatcgggcagatagggcgtatcctcgccaccggtgatctggactcgcttcccgaggagcagcgggcgtattacgacctgatggagatggtgcgcggactgcgtgcccgtatgaggtataacgggaaggtgattacaaaagccgggatcatccggctgctcaagtctgaggtatacgggctttccgactggatggcacggcaggtatacgccgactccgtcaatttcttctacagccaggaaaacatacgtccgcaggcttttgccaacctctatgccgaaaagctggagaagtgggccgattccatgttcctgacgggcaagggggaggaagcctcccggatactcgagcgggcggccaggctccgggtgcgcttcgcatgtgacgaacaggagataccccaggaacttttagacaggaaacccgtggtgatctatacatgtgacgggtccgatatgggcgttccggatacggaccgcaaggagctggaggcgttcatcgactccattcccgaggtgccttccgtggtacgtgagagggtaaaggaggatgcacgcataaagaagttttga

SEQ ID NO: 5002 - DNA, 1014 bp, B.fragilis
  unsure (110): Identity of nucleotide sequences at the above locations are unknown.
ttctgcggtgcagaaataaacataagcaaaatgaatgcgaagaagaatttaatggcatttatattgacggtatcctcaatagcgttgatggtgatttgtctgggcctggngatggtgaaagcttgtgcgggaggagacgggagcgaatggaaaaagaaggtggcggcagacacgctgcatgtggtgcattatacacggccggatttaccacagataatgaccgatcctgcggaacgtgcggtctactacgtgaaacattactgggatggttatctgacaggtgatacggcatgggtgaatagtggagacacggagcagttgtatgttgactttatcgatgcgctgaagtatgtcgaacctgagaccgggcgaaaggcattgcataccatgatggtacggatggaggcagacagtacggcataccggcgctttggcctgctgggggaaaagtatctcaacgagccgaattcaccgatgcgcaacgaagacttttacatcgcggtactggaacagatgctgcaatcggaccgattgcaggaatgggagaagatccgtccggcagaccgattgaagcaggcacacaagaatcgcccgggaatgaaagcggcggattttacatatgtcacggtacatggtgacaatagccggatgagcaggctgaaagcccaatatacgatgttgttcttttacgatccggactgttcgaattgccggaagtttgagaagttatttgctgaaatacctgctttcgttgagatggtggaaaacgggacactgcgggtgctggctatctatcctgacgaaaacagggaagagtgggcggcaaaggcagtgtatatgccgcagggatggatcgtgggctggaacaaagcaggcgatatccgaacccggcaactttacgatatccgcgctacgccgactatctatctgcttgacgggcggaaacgggtgatactcaaagatacttcgatggaacagttgatagactatctggcgacacaggccggaaagtga

SEQ ID NO: 5003 - DNA, 381 bp, B.fragilis
actttgaaagatatggtagagataagaaagatcgaggaggtgtggggaggtgtcgacattccggagataaccggagtatacgatccgctgagcgggctgagagacgggactattacatcgcaggcaccgattgttgtttcgggttacaatctgaaccgttatgcgttggagaatatcagattgtgcctggtgacacatgccaaaccggaacaggtgatcgatatcaggcttgtgtatacgtactctgaggggaaggtggttgtggctttaccggagttgaagccgggtgagtatcgtcctgcggtgatactgaaaggagatgaaaaaaaggtgtatgtactgcctatgcggtgggtggtacgaggaaggtggagaagataa

SEQ ID NO: 5004 - DNA, 216 bp, B.fragilis
accggtttactcctccttcatcgtcaactgtatccgtttccgttcgaggtctatgctcaatactttcaccgtgacgtgttggtgaatggagaccacttcggtgggatcggtgatgaatcggttggcaagctgggagagatggacaagcccgttctccttgatgcctatatcgacaaaagctccgaagttggtgatgttgctgacaataccgggtag

SEQ ID NO: 5005 - DNA, 2127 bp, B.fragilis
tttatggaaatttttcacaaaatgatttcggcagcactcaacctgccggaaaagcagatcagtaatactctcgggctgttagccgagggagccactatccctttcatcagccgctaccgtaaagaaatcaccggcggactcgacgaagtgcagatagaatctatcaaaacgcagtacgataaactctcagaactcgccaaacgcaaagagaccattctcggcaccatcggcgagcaaggcaaactgacgcctgagttgcggcaacgcatcgatgccacctgggatgccaccgctcttgaagatatctacctgccctacaagcctaaacgcaagacccgcgccgaagctgcccgccagaaaggactcgaacctctggctctgctactgatgatgcagcgcgagaacaacctgggctcccgtattcctgcgttcgtcaaaggcgatgtcaaagacgcagaggatgctctgaaaggtgcccgcgacattatcgccgagcaggtgagcgaagacgaacgtgcccgtaatgcagtgcgtaatctctttgcccgccaggctgtcatcagcgctaaagtagtgaagggtaaagacgaagaggccgccaaataccgggactatttcgacttctcttctcccttgaaacgctgcacctcccatcgcctgctggccatccgccgtgccgaggccgaaggtttgctgaaagtcagcattacccccgatgatgacgaatgcctcgaacggctcgaccgccagtttgtccgtagcaataacgaatgtggccgccaggtggcagaggccgtacaggatgcctaccgccgtctgctgaaaccttccatcgaaaccgaatttgcctccctcagtaaagaacaggccgatgacgaagcgatccgggtctttgccgaaaacctacgccaactgcttcttgccccacccttgggacaaaaacgggtaatgggtatcgatcccggctttcgtaccggttgtaaggtggtctgcctcgatgcacaaggcaatctggtacacaatgaaaacatctatcctcacccgccggtagacaagaaaaccgaagcggcttcgaaactccgcaaaatgattgaagcttacaagatagaggccatcgccatcggtaacggaactgccagccgcgaaacggaaaacttcgtcacgcaccaacagttcgaccgtcccgtacaggtctttgttgtcagtgaacagggtgcttccatctactcggcctccaaaacggcccgtgacgagtttcccgattatgatgtcaccgtccgtggggccgtctccatcgctcgccggctgatggatccgctggcggaactggtcaagatcgatcctaagtccatcggtgtcggccaataccagcatgatgtagaccagaccaaattgaaaaaatcactcgaccagacagtggagaactgtgtcaaccaggtaggtgtcaatctcaacacagccagcagtcatctgctcacctacatttccggtctgggtccgcaactggcacagaacattgtagcctaccgcgctgccaacggcgcctttgcctcacgtaaagagttgatgaaagtgccccgcatgggagctaaagcttttgaacaatgcgccggattcctccgtatcgccggaggagagaatccgttggacaacaccgctgtgcatcccgaaagttatgggatcgtgcaacagatggccaaagatctgtcatgtactgttcctcaactgattgccgacaaatcgttgcgtacccgtatcgaaatggaaaagtatatcacccccaccgtaggactccctaccttgaaggatattctgcaagaactcgacaaaccgggacgcgacccacgcgataccattcaggtatttgagttcgaccgtaacgtgcgcaccatcaacgacctccgcgaagggatgactctacccggtattgtcagcaacatcaccaacttcggagcttttgtcgatataggcatcaaggagaacgggcttgtccatctctcccagcttgccaaccgattcatcaccgatcccaccgaagtggtctccattcaccaacacgtcacggtgaaagtattgagcatagacctcgaacggaaacggatacagttgacgatgaaggaggagtaa

SEQ ID NO: 5006 - DNA, 324 bp, B.fragilis
gcgacaaatgtacgcaataaatctgctataaccatcaacttttactatctttgcgggcataaaaaaacggatacacacactctaaaacagatgaatatgccggtatcgttcaaatatattctttatttacttctgttagttattggttgctgtcctcccatggcaggacatgctgctaccggtgagaaacccatactgatgatctgttcgtacaatccgggagcgtatccgacttctgccaatgtatccgactttatggacgaatatcagaggttggggggcaaacggggagtggtcattgaagacagtcatcaccgggggtgc

SEQ ID NO: 5007 - DNA, 834 bp, B.fragilis
agacacatcgtgtgtgtggacagtaatcagtcatggcgcatcgtgagtgacaaggcggcggactgggtggaggtgagtgaacccgaactgttgcaaggacattatgacggacggttcacggtgaaggtgcattctaatgccggataccgggtgcgtggtggatttccggcagcgcgtcacacggtgctctcgttggtgaatgatacgggcgtagtacgcgatatccttatttatcaaggtggttacgtacgtatccggggtaaatattggctggaccgtaatctggcggcaggcgggaaattagcacaggtagccatcccgttggggttggaagtggataccacgcttaatcggggtacgtattttcagtttggctgtcctactgatcgatgggaggagaactttatgccctgtcgcggcagttggtacgatggcacggcagagagtcctgcacggattaatgagttggacccttcaccggaggggtggcggctaccatcgcgtatcgaaatggaggcactgatgaacagtcctgctgctccgatggagcttcaacgggaggaggaccggacgaatatctgccttctgagtgacgacggagtaccggtgtatctgccgctgtgcggacaccggagtcacatcaacggctgccggattgtgattccgcatgggcatcgctactggacggggagcagccaaagcccggtatatggttattcgctctgcgtggaacccagccggcagatgtatctgatgcacgatatgaaaaaatatgggtttccggtgagaagcattttcaacgatgaacgacaaatggttaacgataaactttga

SEQ ID NO: 5008 - DNA, 911 bp, B.fragilis
ggtaaaatgacacacagaattcaacaggaaagcataaagagacgtctggcaaaactggctgctcctatttttattgagacattactgattatgatgctgggagcggtggacaccattatgttgagccgtcactctgacaatagtgtagccgctgtcggagttgtcaaccagattattatgctgacctttttggtgtttgaggtgatcaacctgggaacatccgtactttgctcgcagtacctcggcgcaaggcttgaaaagaaggtggttcaggtagtgggggtgtcgttgcttgtcaatttgttggttggtggaataatcagccttattctgtttacaatggctcgcaccattctgcaatggatgggcttgggtccggaactgatggccgacggtatggattacatgcgtatcgtgggtgcattcgcttttttccaggctatttctctcactctttccgcttcattgcgcagtgccaataaagccatatatccgatgttggtgacggtagtagtcaatattcttaatattatcggtaattattcgctgattttcggtaagttcggctgtcccgaactcggggtggaaggggcggctatttctacagccttcagccgtggagtatctatggtgattctgtttgtcattctgttccgcaaacacattcatcgtttcccgttggcctacttccgtccgtttccttttatagaattgaagaatttgatgcgggtcggtctgccttctgccggagagcagctctcgtacagttcatcgcaagtggtcattactttttttatcaatatgcttggagtcgaggcgctggctacccgtacttattgtgtcaacattatcatgttcggctatatattcagcatctccatggcccagggaggagctatctggatcggaca

SEQ ID NO: 5009 - DNA, 774 bp, B.fragilis
aaacagaagaccatgaataaagaagtagatctttcagtatcctgccttggtaaggtgaaagagctgaaatatgatgttattattttgccgtggggagctacggaaccccataatttacatttgccgtatctcaccgattgcattctcccccatgatattgctgtggaggcagccgaactggcacttagccgttcgggtgtccgttgcatggtgatgccgcccgtacctttcggagcgcataatcccgggcagcgtgaattgccgttctgtatccatacccgatatgccacccagcaggctattctggaagatatcgtatcgtcccttcatgtacaaggatttcgtaagctgttgattttgagtggacacggagggaataattttaaagggatgattcgtgaccttgcttttgaatatcccgactttctgattgctgccgcaaactggtttgaggtggtgtcgcccaaaggctattttgaagcggagattgacgaccatgccggagaatcggaaacttccgtgatgatgcactatcatccggaactggtgaatctggctgaggccggtgatggcgaatcgaaaccgtttgccattgcttcgctgaacgaaaaagtagcttgggtacctcgtcattgggacaaagcaacagtagacagtggtgtaggaaacccgaaaaaagcaacagcggaaaaaggagagcgttatgtgaaaccgatcgtagagaaactcgccggactttttgaagaaatggcacagcatgatctatatgaatga

SEQ ID NO: 5010 - DNA, 357 bp, B.fragilis
aataatatggctgaagaactgacatttatatcgggtagcaaagaggagcattatctctctttgctacctcaagtgagatccctgatagagggcgaggtggatttagtggccaatttggccaatgtggctgctgccctgaaggaggcttttgactttttctgggtgggtttttatttggtgaaacacgatcagttggtactgggcccgttccaaggttcgggggcttgcacacgtatcccgaaaggcaaaggagtttgggggactgcctggcacgagggtgccacactgttggtgccggatgtggaaatttttcccggacaaattgccttggagatttgtttccccgatcggaaatag

SEQ ID NO: 5011 - DNA, 201 bp, B.fragilis
gaattcaagaacatcttcctgctaaaaggtgcttgtagaaagaaatccccatttatacttctccgaatgacgacaacgggtatggatggaaaagcgactgtcatcttacataattatgaagataaaaagtatccggccgtattgcatggtaacaggctgtggttacggccttatgaagccattgcctggaagcttacttag

SEQ ID NO: 5012 - DNA, 459 bp, B.fragilis
aaactatacgatatgaagactttaacttttaaatacttaaaattgtttctgctggcagtggcaatgataaatcttacttcttgtgagattgagatagatgacttttatgatgatgacaatatcggtggttcgtattataataaatcccttgatctttgcagtcgtccttgggcagatacgttttatgatgccgacgggaactattgctatcaggaactgaatttttatctcgatcgccatggagaagattatatccgggtggaatatcccaacggacgttattccgaatcggtgtactcctttacctggaattgggaggaccgttcgcaatactcccttcggatggtatatggtcccggtgatgtctcttatctcgatgatgtctggattcgagggaatgtgctgagcggatacctggatggacacgataattatgttgactttaccggagtgagataa

SEQ ID NO: 5013 - DNA, 483 bp, B.fragilis
atcgaccattggcgctctccttccagccccgtggtgaagacgactgcgatgtggttcaactgtgcaggcaggcattatcgtcggtggagatgtcccgcagggaatcgggtaaccggtttgtttttgagacaagagaccgactcctttgttcttcagacagatattcaacgcttacagcaagtgcttatcaatctgctgaccaatgcggcgaagttcaccaagaatggtacgatcacattgcagtttgaggttgagaaggagaagaatcgggtgttgtttgcggtggcggataccggatgcggcattccgaaggagaaacagaaacaggtgttcgaacggttcgagaagctgaacgagtatgcgcagggaaccggattgggactctcaatctgtaaactcacggtagataaatggggtggcgatatctggatcgacccggattatgaaggtggggcgagatttgtggtttcgcacccgttataa

SEQ ID NO: 5014 - DNA, 1392 bp, B.fragilis
cgtaaaaggcttttttattgcatcttggttatgaatgataaatatgaagagaggcttggtacggaccgtatgttgccacttgtgttcaggatggcacttcctgcggtaattgcacaaatcgtaaatttgctctataatattgtggaccgcatctatatcgggcatatcccgggaatcggtactcaagcacttgcaggtatcggggtggcaggttctctgattattttgatttcagctttttcggctattgtggccgggggaggtgcgcctcttgcagccatagcgttagggcagggcaaccgtacccatgccgaaaaaatattgggtaatggcttcgtgttattgctgttttttacacttctgacgtccggcttatcttatttgtttatggaaccgattcttttgtttaccggtgcttcggaacagacgctcgggtacgcaacggcttatctttcgatttatcttatcggtaccctttttgtcgaagtctctgtcgggttgaatacttttattaatacacagggacgtcccggcatcgctatgctgtcgattgttattggagcgttgcttaatatcttgctcgatcctctgtttatttttgtctttgattggggagtgaaaggagctgcgcttgccactattatttcacaggcttgcagtgctggctgggtattgttctttctgacatcccggcgtgcttctttgcggctcgagcctcgttatatgaggttggaccggaaggttgttggagctatattggcgttgggagcctcaccgtttattatggcaagtaccgaaagcttggtaggatttgtgctgaacggttcattgaagacattcggtgatatctatgtgagtgcattgacaatcatgcagagtgccatgctttttgtcagtgttccccttgccggcttcgcattgggattcgtacccatcgtaagttataattatggtcatggaaaccgagaaagagtgaaggaatgcttcaaaatagtgatgacctttatgtttctgttcaatctcgttttgatcctgctgatgattttgtttccctctgtgattgcttcggcctttacttctgacgaaaagttgatagaaaccgtagtgcaggtgatgcctgtctttttggcggggatgactattttcgggttgcagcgtgcgtgccagaatatgtttgtcgcattggggcaggccaaggtttctatctttattgcattacttcgtaaggtgatcctgttgattcccctggcccttatgcttccatacctgatgggagtgatgggggtatatgctgccgaagcaatatcggatgctgcggcagccatttgttgtacggtcatctttgcggttcagttcccaaggatcatgaataaattgacggtccgttcctga

SEQ ID NO: 5015 - DNA, 1752 bp, B.fragilis
aacatgattatgatgaaaagattgatttgtatgtatgctttcttgctctgcctggtatgtgtgttgccggcacaagagagagaggtgaaactgaaaattgtgcagaccagtgatgtacatggtaattactttccatataacttcattacacaaaaggagtggggcggaagtcttgcacgtgtatatgcgttggtgcaaaagaaccgggaggtgtataaaggaaaccttatattgctggataacggagatattctgcaaggacagccttcggcgtactattataattatatagatacagtggcgcctcacgtatgtgccgagatgatgaattttatgggatacgacgccgggaacatgggaaatcatgatgtggaaacaggacgcgctgtattcgaccgctggattggtgagtgcaatttcccggtgctgggggcaaacatcgttgaaacggctacgggagagactcatcttcctccttatcgggtgttggagcgcgacggagtgaagattgtggtgctgggaatgattacgccggctattcccgcgtggttgtcagagaatctgtggcagggactgcggtttgacgatatggaagagacagcacggaagtggatgaaagttattcgtgagaaagaaaatccggatctggtgatcgggttgtttcatgccggacaagatgcttttgtgatgtcaggcaggtataacgagaatgcttcgctgaatgtggcgaagaatgtaccgggatttgatatggtgctgatggggcacgaccatgcgcgggagtgcaagaaggtggtgaatgtggcaggcgattccgtactggtaatcgatccggcaagcaacggaatagtagtgtcggacattgacgtgactttaaagttgaaagacggtaaagtggtgagcaaacagatagacggtgtgctgacggatacaaaagaatacggagtcagcgagtcctttatgagacatttcgcattgcaatacggggcggttgagaagtttgtatctaagaagatcggggtatttacagaagatctgtctacccgtcccgcctatttcggttcgtcggcatttattgattttatccattcgttgcaactcgatatttcgggagcggatatttcgtttgccgctccgttatctttcgatgcagagataaagaaaggagatattcgtgtgagcgacatgttcaatctgtataagtacgaaaatatgctttatgtgatgaagttgtcgggcaaagagattaaagacttcctggaagagtcctattatatgtggacgaaccggatgaaatctcccgaagaccacttgttgtggctgaaagaaaagcgtagggcaggtgccgaagaccgggcttcgttccagaattttagttttaatttcgattcggctgcgggaattatctacacagtggatgtgacccgaccgaagggagaaaaagtgactattgtcagtatggcggacggttctccgttccggatggatcatatctacaaagtggcgctgaactcttatcgtggcaacggcgggggagaactgctgacaaaaggatcgggaatcccgcaggagaaactgaaagagcgtattatcttttctacggacaaggacctccgtttctatctgatgcagtatatcgagaagaaaggtacgcttgatccgcgtgcgctgaaccaatggaaatttgtaccggaagagtgggtgaaacctgccgcacagagagattatgaatatctgtttggtggaaaataa

SEQ ID NO: 5016 - DNA, 339 bp, B.fragilis
  unsure (14): Identity of nucleotide sequences at the above locations are unknown.
gtgggacacatcanaaagattctattatcgtttctgttattgacgctgttcgtaacgtaccaggtaagcattacaatgtttactcatgtgcattacgtgaacggtgtgatgatagctcactctcatccctacaaaggtacccactcgcatactgcttccaacattattgttattgcacattttgccgcattccattctttggaagtcgatgtgcattatgattttacacccgaacgcccgattctgttcaccgtagagataccggagagtataccggtgacggccggaacacatctgcaggtgatttctttgcgggcccctccggcagagttagcttaa

SEQ ID NO: 5017 - DNA, 2301 bp, B.fragilis
caaaaaagaatgaaacattatatagttatgcttgtgcttgcttgtgtaagcatgagttcgtatgcggtcaatccgattaaagaaggtaatatgattgccggacacgttattgtgaaaggcactgaagagggtatcccattcgcaacagtgatgattctgggaaccaaccgcggtgcggtgtccaatgaggaaggacaatttgaattccgtaaactggctgccggtaaatatacgctccgtgtacaggtgatggggtataaaacacaggaaaaaacaattacggtcagtgcagaggctacgtccgtggttcatttccaaatggaagaagtaagttttacgacagatgaagtggtggtttcggccaaccggaacgaggtgagccgaaaggcggcaccggtggtcgtaaacgtgatgagcgctaaactgtttgagacggtgaactctaccgatctggctaaatcgttgaacttccagtcgggtcttcgggtggagaacaattgccagaattgcggtttcccacaggtacgtatcaatggcttggaaggtccttattcgcaaatcctgattaacagccgtcctatcatcagcgctctctcgggagtgtacggactggaacagattccggtaaacatgattgaacgtgtggaagtggtacgcggtggtggttcggcgctgttcggtgccaatgccgtaggaggaacgatcaatattatcacgaaagacccgattaataattctttccaagtggcaagcacgatgtctaatatgaatggcaagtcgtgggagcaatatatgggaggaaacgtttctttggtggcaaaagacaattcgtacggtatcgccttgtacgagacctatcgtaaccggaatccttatgatgccgacggagacggtttttcggaactcggtaagctaaatatgaatacattcgggatgcgtgcttattatcgtcctaactattttagccgtatcaatgtggagtatcacacgacaaacgaattccggcggggaggaaataagttcaatttgcaaccccacgaggcggatattactgaacaaacgaaacatatcatcaatagtggaggagtgagttacgatcgttactggggcgagaagcataaaatgtccgtatacggttctatccagcatacggatcgcaacagctattacggtgcacagaaagacatgaatgcctatggtaagacaaacgatctgacttgggtagtgggaggtatgtatgtgggcaacatggaccgctgtctttttgctccggctacgtttaccggcggtgtagagtatcagagcaactcactacacgatgtgatgacgggatatcaccgcgacatgcagcaggatgtgcgtattgccggaggttttgtacagaacgaatggcggttgaatcgctggacgatgcttgtaggggcacgtctggacaagcataacctgatcgatcatccgatttttagcccgcgtgtgaatttcttatataaaccgagcgataatttgcaggcacgtctgacatactctaccggattccgggcaccacaagcatacgatgaagacttgcatgtaacggctgtggggggtgaaggagtacagatccggttggccgacggacttcgtgaagagcgctccaacagtttcagcggttcggtggattggtcgttcccgatggggcactggcagtcaaacattcttctcgaagggttttatacggatttacatcatgtatttgtgctcgaagatatcggtgaggaccaaaacggagataagataaaagagcgccggaacggcagcggggccaaagtatatggtgtcaatctggatgcaaaggtagcccatggacgcgaagcgcagttgcagttgggatttacggtgcagcgcagcagatataaccgggcggaagtatggaccagtgaaggagaagaagagcagactacgaaacgcatgccccgtacgccggactactacggttatttcacttttacgtcggcaccattaaagaatttcgatttctcgctttcgggtacttataccggtaagatgattgtgccgcacatggccggatacatcgagaagtcacgcatggagcacactccgcaattcatggatctcaacctgaaactgaattatacttttgtgctgaaagatcatatcaaaatgcaggtaaacggaggagtacagaatatatttaatagcttccagaaggatctggacaagggagaattccgggatgcaggttacttctacggaccgactcagccgaggacttattttgtggggataaagattatgaactaa

SEQ ID NO: 5018 - DNA, 675 bp, B.fragilis
aacgaatctttttactttgaaaaattgatttatatcaaccgattttcgtacttttgccccgcaatctataataacttatcaatatataacataatggaaaacctgaaagagacagtggatattgttgtaaactccagatatccggagatgaacagagaaggacgagaactactggcacaggtcttgatacgcaaagagctggaaaagggtgaaatgttgttgaacgaaggacaaataagccgccacatggtttttgtcggtaaagggatgttgcggcaattttattataaaaacggaaaagatgtcaccgagcacttctcatacgaaggatgtatcctgatgtgcatcgaaagcctgttaaaacaagaacctacccacctgatggctgaagcattggaaccggcggtagtatatatgctcccttatgacgtcctgcaaaagttgctggaacaatccaaagaaatcaatgctttctatcgtaaggtactggaatactcactcatcgtatcgcaaataaaggccgattcatggcgtttcgaaacagcacgcgaacgctacaacctactcttgcaccatcatccggagatcatcaaacgagctccgttatcacacattgcatcctacctgctgatgaccccggaaacactcagtcgtgttcgttcgggagtactgtaa

SEQ ID NO: 5019 - DNA, 1962 bp, B.fragilis
agacgggagccgctggatcaggtaacaccggaatcgtatttccagaatgcagatcacttggcagcttatagtatttcaaaatatcagaatctgttctctactcatagcggatttagtgcgggtactgtaaacaatgacggtgctaccgacaatatggtttcaggcggcagcagcggtagcggactccagaattactacaccaaggatgtttggaagacagaagcagccaatgacaactgggatttctccttttttcgttattgcaattacttctttgaaaaagtactccccaaatatgaggcaggagagatatcaggtaacgctgacgatgtgaagcattatatcggtgaaatgtactttatccgtgcctggaaatatttccagaagctgaggatgtatggagactatccgattatcacagaagtattaccggataatgcggaaatattgatagaaaaaggtgtacgacaaccacgtaacaaggtggcgcgtttcattcttgaagatcttgacaaggccgccgagtacatgcacgaccatggttttgccggcaacaaccgcttgaacaagcaatgtgctttgttaatcaaatcacgtgtagcactctacgaagctactttcgagaaatatcatcagggtacgggacgtgtaccgggtgatgccaactggccgggtaagcgagtgcatcctgattataaatatgatgccaataccgaaataaacttctttctggaccaggcgatgtccgcagcagaacaagtagccgatgtcattaagctgacacctaacagcggtgtgttcaatccggcaaatgacaacgacatttcgggatggaatgattatttcgatatgttttcagccgaagacatgagtggatttgaagaagtgctcttctggcgtgattattactccggcgactttaccatcgcacacggcgctacagcttatgtagcttcgggaggcaacaacggtatgttgcacaactatgtacaatctttcctgatgaaagacggtatgccttggtatgcagccacagccgcatatccttttaaaggtgacgaacgggtaatggatgaaaaagccaaccgcgacgaacgtctgcaactcttcttatttggtgaggaagatatgataccggccgtatccaacgctgcaaccaatgccatgaaaacatatcaggacgcaaactaccccaatataattgtagccgaatcggaaatcaaagacttaacaggatatcgtattcgtaaatgtctctcttacgaccagaaacaatatgtttcgggacaggctcagtctacaaccggttgtgtgattttccgtgcagtagaagcttatctaaactatatggaagctgcctgcatgaagaataacgggaatgttacgggaaaagctgccgaatattggagagctgtacgcatacgtgcaggagttgatccggacttcactaaaaccattgccgcaacagacttgagcaaagaaaacgatttggctaaatacaaaggcgagaatgaaatgatcgatgtgacacttttcaatatccgccgcgaacgtcgttgcgaattcattggcgaaggcatgcgtatggatgacctgattcgttggagatcattatacagactgttggtcgaacgatttattcccgaaggatttaacttctggggaagtgacgcttacaaacgttatgaaggagaagatgccaagttcgaatatatcgaaggcccggacaacgctatggcaaatgtttcatccagaaaattatccaactatttacgtccttattctgttgtacaaaagaataatgaaatctatgacggttatacttgggctaaagcgcattatctctatcccgtacctatccgacagatcgaattattatcaccgtcaggcgaaatagcttcatcggttatctatcagaacccatactggcctgaagaaagaaacacagcagctatagaataa

SEQ ID NO: 5020 - DNA, 2520 bp, B.fragilis
tgtatgaaagaaaaaaccaacctgtttccaagcctgatacgacttcgggaaacaagtcgcctaaaaatggcaattgccgcttctatcatgctttggtgtgcaacacctcagcaagccacggctgatactaacgaagaacacgcgattgaagctgtacaacaagctaaagtaaaagtaaaaggtactgtagtagatgaaaccggagaaccgatgatcggtgtagccgtaaaagttctcgcaaacaacacaggtaccattaccgacctggaaggaaaattctcggtcgaagcccctctaggaggcgccatccaaatttcatttatcggatacaaaaccgttacggtgaaagcaagtagcgagcctatcagtgtgacgttgaaagaggattctcaacagttggacgaagtcgtagtagtaggttacggctcacagaaaaaggtgaatgtaaccggttctgtcagcatggtggactcaaaagtaatcgaatctcgtccggtacaaaacgtatcacaagcccttcaaggtgtggttccgggattgaatatgtcagtaggtaatagcggtggcgcactggacagtagtctcagtatcaatatccgcggtgccggtaccatcggcgaaggttcgagcggaagcccgttagtattgatcgacggcatcgaaggtgacatgaacacagtgaacccgaatgacatcgaaaacatttcagtattaaaagatgccgcctcttcttctatctacggtgcacgtgcttctttcggtgtaatcatgattacaaccaagagcggtaagtccggtaagactcgtgtgaattactcgggtaacgtacgtttctccgatgcaattcagattccggaaatggtggattcttataccttcgcacaatacttcaaccgtgccaacacaaacgatggaggaggtttggtatttgacgaagcggccttggagcgtattaaaaactatcagacagggaaatacaccgacccgaacactcctgaatactatggagcgaaggccggtaatgacggaaaatggcaaaactatacaggttccttcgccaacacagactggtttaaagagttctataaaaattgggtaccctcaacagagcacaatctgaatatcagcggcggtacagacaaactcacttatatgatcagtggcagttttcttgaccagaaaggtctgctaagacacggtgaagatcagttcaaccgttacaccatgaacgccaaaatttctgcaaagttaaccgactgggttactttgaactacaccagcaagtggacacgcgaagattacgaccgtccgacttacatgaccggtctgttcttccataatatcgcccgccgttggccgacttgtccggtaagagatccgaacggacattatcagcagaaaatggaaataatcgaaatggaagacggtggtaaacaaaccagccagaaaaactggtatacccaacaattgcaggccatcttcgaacccataaaagactggcgtatcgtagcagaaggcagtatgcgtacctatacacgcaaacaatcatgggctgtacttcctatttacgcttatgatgccgacaatcaaccctatttattaggatggggcgataatgcagccggttattccgaagtacaagactcacgtgaaagtgaagactacttttctaccaatatttatacggacttcgccaagaccttcggtgatcacaactttaagataatggtcggtttcaatggtgagctttaccgcccaagcgggctgactgggttcggtacagacctgatcagtcctgaagtaccgtctttgggattgacacaagacaataaaaaagccagttcatgggccagtgaaaaagcaatcgccggtttcttcggacgtttaaattataactataaagaacgctacatgcttgaggccaaccttcgctacgacggttcttcccgatttatcggtgacaaacgctgggggcttttcccatcattctccgcaggatggaacatctcacgcgaagcattctttgaaccactgactcaagtggtaggaactttaaaactgagaggttcgtggggacagctcggtaataacaataccagtgaaacgaacgcttggtatccattctaccaaaacatgcctacaggcagtgcttcctcgggatggttgatcaacggcaaaaaacagaatgtagccggtctgcccggtatcgtcagcagtttgatgacctgggaaaccatcgaatcatggaacgtgggtatcgactggggattgtttgacaaccgtctgacaggttcattcgattactacaaccgctatacatacgacatgatcggtccggctcctacactgccctccgtattgggtgccagcgctccacaaatcaacaactgcgatatgaaatcgtatggttgggaattagagctttcatggagagaccgcattcagcagttcaattacggtgtccgcctcgtcatgtctgacaatatgcagaaaatattggaatacccgaataaaacgtct

SEQ ID NO: 5021 - DNA, 189 bp, B.fragilis
ttccgtaccatcagcacatctcagacaagacaaaaacgatattataagataaccctaatcagacaagcttatggagtagaaacaaaaaagacacttaaacatcacttccggcaagataaatctttaccggaaaaatctcaaaaaacaaactattcaaatttatgtttaaccgaacaatttagtgtatga

SEQ ID NO: 5022 - DNA, 576 bp, B.fragilis
gccaccgtcgatacttccagccccgtggtgaagacatgtttattgtctccacatcgtaattcgccgatgaatcgtgttgatatagaagaatatctttgcagagtattccatttacaacgggttttatggctcgatcatggatacttatcgggagatgatacggatagccatatagatacattggctcgcttttgttctccggatactattgcgtatgtaaagtgtaccgactctgaagatgaacattacgaggcgctatgcaaaatggaagagcaattgaaaacgttccgcactacatcaggtgctccttatcgtttattggcattgcctatggcagacaaaatagaagtagagggagagagattgcctgcaacgtatgccaattttttgataatgaatgatgttgtactttatccgacttataatcaaccggaaaatgataaattggcgaaagaagtgctgtgtgaggcttttccgacatacgaagtggtaggcattgattgccgtgcacttattaagcagcatggatctttgcattgtgtgacgatgcaatatccgacaggagtgattaaataa

SEQ ID NO: 5023 - DNA, 609 bp, B.fragilis
aaagcacggctcctaatagaccccggtgaagactcatatagacttgtagatcttcctaacggtgaagagttacgtgctcaggcccagaaagaattcaatctgacagactctgaaacaaaggcattagccaattacaaactttatggcaacctcgacaaaggtgttgtcagaggttttgaagtaaacgcagccaccaacctcggcgcaggcttcagcctgaacggaaactatgcttacgcttatgcacgtggcaagagtgtggacggtgtatggggtaacatagaccgctcggtacgccacaccggaaccgtagcaggaaactacacacatgcatggaacgactatatgctgaacgtaaatatcaacggtcgtttccaaagcaaacgtttccacccgggacatagctacggtgacgctccgggctatggcgtatggaacttgaatgtaaaacactcactgacaggtttccaacacttgggactggacttcggtatgggtctcgacaatattttcaacaaacgtgatactcgtcctaacggtgtgaactacgcactcctctctccgggacgtatggcatatgtaagtttaacccttcgttttaagaaataa

SEQ ID NO: 5024 - DNA, 3288 bp, B.fragilis
tgttcacgattttgtcattataaatttttattatatatgaaagcatataggctgaaaataacttgtttcattcttttgttactgcccgttcttacctgctgtacggacgaggagctgcttcggggcagcggtgtcccggaaggcgtgcccacgacggtagatatcagcgtgggtacggcagccaacagggccaagacacgttcgggcctgccggaaggcgaggagagaaagatatacgacctttacctgtgggttttcgattcccgcggcggcgtggagttctcccgggagtatccccgtgcggagctttatcaggccgctgctgccttggaaacggcaaccggcgagaaggacacggatgcacccacgagcatgggattgctgaaaaacatccccattacctcgggagagaagacgctggtcctgctggcgaactataaatcggatggtgacgggctgtttcaggtagagcccgggatcctggctggcgtgtcgtccctttcggacattcagagggtcaaggcggagatgaccgcccgtaccctgttccgaccgaatgggaacctgctgatgtcagttaccaagacggaggagatcagtcccgacaccaggcgcctcgaggtctccctgaaacgtgcggaggcgaaaatcacgatcaacctgaaaaccggagaggggctcacgttcgtgcccgggacatggagagtcggtaacgtgccggcttcgacctttgtcaccgagcatgtcaagggcagtgacgccggggctccctgggatgccggcgggatggagatggattcgtactggttgtccgaattattccagttcgagggcgacgctactactactactactacgttttaccttccggagaaccggaaattggcaaaaaaaatgataactcccgcctctcccggttacaatgcggagaggaaggggtatgacctgcggcagaaacaagtgaagtctcccgttcccgatgctacggagaagccgaacgtgcagaacggagctacagaatacgctccggatctggctccctacatcgagttcacgggtgagttacgccaggatatgacaaccggtgaagtctcaacggagcgtttcgggagggtgacctaccgcgtttatctgggatacacggcggagaatgatccggtcaacgattatgatatagaacgtaacgtgcactatacctataacgtgacgatcaaggggatgaacgacctggtagtggaggcgatgtccgacaaggaccgggaagaggagcccgctcccggggtggaaggccttgtatatgacgctcaccgctccttcagttttgactgccattatgaacagggcctgatgcgtttcaacaaggacgagcttgccatcttcaatccggatggcagtttgaaggacgacgcgatgatctcctttgccatacgcaccccgttctgtgacaagatagtctcttacacgaaggcggagctggaacagctggaggataacggatacgttccttcaggggagaagaaggcagacactggttggctcgcgttcttcatccacccgagcaccctgtctgacaatggaaacgaaaccatggaatattactccaacacgggggcgcatctgctttcgctggaacagtttctttaccgacttgtcaaagagcccgattatgtatttaatgcctccacggggctttgcaaggtgacggtttacgccaacgagtatttctacgagcggaaccccatgcgggatggcgcccccgaggacaagaacttgtggaaaacctttgccaacgccccggatcggactttcgacctgctggtgaacacgtcgcatgaaatctcccccgacgggcagtcacgttatcaccaggctgtcgtttccatccgtcagatgtccatcaagacggtgtttacggagggacccgaaggcatgcgtgtctggggggtggaaaacgtgaacgagacaccggacctggactttatggtgaaggctccgggagaaccggatgctttttataataaatatacatccaacggctggtcgaatacctggaaggtgatggcaaggtcgggcgacttcagtcaagaggtcatgattgacccgatgagaagaagtaaacaagaccagttatggcaggtcatgacgaaggtggacaacgcgaagctgactctcagcagagaccattataatttggcagccaagaattaccacgccgaatatgcctgtttcaccccgtttttacggaaccgggatgataaccgtgatggccggatgcaggccgccgagatgaagtggtatattccttcggtgagcgagagcggtatgcttctcgtgggggaacgggcgttgccgttacattccaggctgcacgggcacgccccctcggacaacgccacagcattttatatgtcaagagcctttatggcaagtacaaacctttctttatactcttccaacccctatatttgtatcttggagtcccgcagcgtgactcccatcgcaaactttgattattacaagggagggaactcacccggggaccgcaccccctactcggaagtgaggttgatcagggatctggggatgctggagtctggggaagaaagctatcacatcgaggagttgggcaaggaactgaacaagtctcttgtcaataacaggacgaaagaggaatatctggtctttagggcagataacctgccatacagcatgacgcgtggagtaagagccatttacgagttgcccgcgcatgatgaggactcccagagcaacaccatttacaagaacgggtttgaggtggccaagtatatcgccaataagatagataagcccaaggatttgaataatcctgacaggaagagcgagtattacttacaggattggagcacgctgatggcggacatcgaacagggaaacagcccgtgcgcctattattaccaggaggcggacaagagcgacctgggaacctggcgggtgcccaacgaggtggaattgatcatcatgtgcgggagcctgttcgactggcataaccctgagaaaaaggaggtttacgaattcggtaatgaccttccttctctgggagtagtagaatctgaagttctccattctcggacgggattttccaagcgtagcatgaacggggcaagatcgttcagtgccggctaccagatgtatctccatggttatctccgatgggtcacgaccgtggatacccagtgggcgggtgacaatgacaggcttgtgaataacaggaagggatacgtgcgttgcgtgagggaccttgaatag

SEQ ID NO: 5025 - DNA, 270 bp, B.fragilis
ataaaaatatcactgcaaaattatatatggtacatacgtgtagaattattttcgatgctgtccgaacttatcggaaattttatgaagaaaggggaatatttgcgtcatatgcgggtattttcatctgtccgttttccacggggttattcgtgtgtggccttgtaccaagaggtcgtacctttcagtaaggccatgggattggtgctcgggtccgagatcgttatacccgagaaagtatgtatgggaaggggccctttggtcctggaataa

SEQ ID NO: 5026 - DNA, 411 bp, B.fragilis
aaaaagatgtcaaaaagtagttttttactggattttaaggcgtttgtcatgcgtggaaacgtagtagacatggccgtgggtgtgattattggcggtgccttcgggaaaataatatcttcagtggtggcagacatcatcatgccaccgatagggttgctggtaggcggaaccaacttctcggaactgagatgggaattggaacccgccagggtagttgatggagtcgaacaggcggccgtcacgataaactatggaaacttcatacagaccatgctggattttgtgatcatcgcttttgccattttcttgttcatccgcctgctctccaatctcaggcgcaaaaaagaagagacaccctttgcccccacctgtcccgagcaacgaggaaaagttactttcagaaatacgtga

SEQ ID NO: 5027 - DNA, 282 bp, B.fragilis
agacatattccggaagccaattcctggcaggaaggacaccctcacccgaagatacagctgacagtggagtattatacaggaggaaacatctcacagaccaggacaaggacctttttgcttgacattggcgaggaaagttctcccggggtgtattccggccccatttacccgaaccgggattataaggtattcatggtcttgccggaagccgcggacagagagattatctaccgggtcgaatcctgggagcggaaggatgtggagttccctccttttcagtga

SEQ ID NO: 5028 - DNA, 531 bp, B.fragilis
  unsure (45),(83): Identity of nucleotide sequences at the above locations are unknown.
ctacgtgcgcccggagaagaaagagctcgtgccgacggacaaggngcttgcgtgtatcaaatagtgaaggacaagcgcatcgncgatgtcgagatgaccgggcagtgggagaccgccctcgccaagatcgagagcggggagatgaatcccgacagcttgcgcaaggccatcgagggctatgccgcccagattaccgaagaactcctgcaagtgcaggtatcggtggcggacggcggacatatcccgtgccccaagtgccgttccggtcgcatcctcctttacccgaaggtcgccaagtgcagcaacgtcgattgttcccttaccgtcttccgcaacaagggggagaagcagctcaccgacagccagattaccgacctcgtgaccaaaggcaggactgccctgatcaaaggattcaggagtagggaggataagcccttcgatgcatacctcactttcgacaaggacttccgcatcgtatacgggttcccgcctcacacggacaagtccaaaggaaaggagcacaggcgatga

SEQ ID NO: 5029 - DNA, 204 bp, B.fragilis
ttttttactacgatgaaggaatattgcgtttattggtttgaaaacggagaaccgaggcacgaggtattttcctgtctggacggggcggagatgttttcctgcatgataagaggacaggacggcgtggaacacgtggaaatatccgaggaagatatttccgctccggaggaattccgggaaatatgccccggagatttctcttga

SEQ ID NO: 5030 - DNA, 2166 bp, B.fragilis
ttgaagcgtaccctttacaccaatgcaaaagcagatcatatggtaagaaaagaggaaatactggcaaaaacaggtaacgggctggaggtgttccgtcattatctgcccgtaaaatggcgggtgggtcgaaatttcctgaatccgctgtacgctgatggcagggcctcgtgtaacgtttattatgatcgccacagcgggatgtacaggatgaaggactttggtaacggtgagtattcgggagactgtttcttccttgtggcgaaactgaaaggactggactgccggagtgccgctgatttcgtggaagtgctgcacaccattgaccgggagttgtgcctggggttggatggggccatcccttccggtaccaacaatcgggagggaagctgccggacgacacggcccgtaacgggtgcacgagagaaaagtgagggggaaaataccggggagagcattcccggggatactgtcacgggcacggaagggaaagatttatcccgcgagcgtcctggaccaagcccctaccaagtagctgaaaagtctttcacagagagagagctcgcctactggggcatatcgggcatcacggtagaggtgctgcaccgttacggggtggtgtcgctcgccgagtaccggagcgagacaagggaaggcaagacgttcggctttacttcaaccccggcggaaccgatgttcggctacagggggaaatggggcgtgaaggtgtaccgcccgttatcggaagtgcgtttcgtctatggcggtcatacgggcgacaactactgtttcggtctggaacaactgccctcgaagggcgacctgctcttcctcacgggtggcgagaaggacgtgatgacgcttgcggctcacggtttccaagccatctgcttcaactcggaaacctcggtaatcccggcgaagaccgtccggaagctcgtctatcgcttcaagcacatcgtactgctgtacgacacggacaagacggggctggaatgctcggagaagcaccgggtacaactgtcggagtacggtgttaaacggctggtactaccgctgccggggacgaaatcagagaaagacgtgacggactattttaaagccggacacacacgggaggatttgatggggctgttcctgaaactgctcgacacgctgtacggggacacgatggcggtactgaaatcgtgtgagatcgattacgactgcccgccggagcaggcagtcgctatcgtgaccgccggggacgtgccgttaggctcggaagagaacatactctgcatcacgggcggagaagggacgggcaagagtaactataccgccgcgttggtcgccggggcaattatggaacgggaggaggacgcggaccttcttggggtgaaggtggaaccgaaccgaaaggggcgtgcggtgctgctgtacgacacggaacagagcgagcaacagctctacaagaacacggggcggctgctgcggcgtgccggtcgggagaaaatgccgccttacctgcacgtgtactgcctgacggggatgtcgaggaacgagcggctgaccgccatcatccaaagcatggacaagtaccactacctgcacgggggcatccatctggtcgtcatcgacggagttgccgacctgatccgttgctccaacgacgaggcggagagcgtggcgctggttgacgaaatttaccgcctagcgggaatttaccgcacgtgcatcaccgccgtggtacatttcgtgccgaacgggttgaagttgcggggacacttgggcagcgagttgcagcggaagtcggcggctatcctctccatcgagaaggacgagaacccggaggtgtcggtggtgaaggcattgaaggtcagggatggaagcccgctggatatcccgctgatgcagttccgctgggacaaacaggccgggatgcctgtctatatgggagagaaaccgagggtggagaaagaaaggcgcaaggagaaggaactgtctgaaatggcacgggcagcgttcgtcacgcaaaaaaagtatggctatatcgagctatgcgaactgatacaggaaaccctggacgtgaaggaacggacggcgaaggggtacatccgttacatgcgggaaaaggaaattattgaaaaggagggcgactgctatgtatatggacagcgaaaaatttga

SEQ ID NO: 5031 - DNA, 423 bp, B.fragilis
gcaatccgcacaaaggatgtgggcgataattggcgtaagccgggacaggattttctggtttccaaatcatttgatgtcacgttacgtgacttcacactgattgatgaaattttaaaacgggtggacacaaaaggaattcatacgatgtatatagataaactggaacataggcatatcctgtcctatcacaggaagggcaagatagaagcgctgaaagcggcacgggaaaaggcggtttacctgctggaggcaataggtaagaggccgggtgagatcatccgcatcgtggaaggaggggatgctggaaaagagatgtttgcacaaggtcatatcttatcggttgccccgcccccatttgagagaagccgcacgataaaaaagagatattcgatgctggtccggttcgggatcgtggatcgatga

SEQ ID NO: 5032 - DNA, 879 bp, B.fragilis
ccgtttgcagcctcggcatcctcgacccggagaagatgcagaagcagttcttcggttacgacatcaccgactccgacaagcaggtgctccggcagacgggctacatggggcacccggcgactcgtcaccaaccgggcgggcgagcaggtcgaagcccttgtcagccgcaacttcaagaccaacgagctggtcgctttcccgctctccaaggtcaatatcccggcggagaagaacgggcataccttcaccccggacgaaatagcccggctcaaacagggcgaggcggtggtctgccagttcctttccagagccaaggagggggagcaacccaagatctacccggctcccgtacagttcagcgcagccaagatgcagctcgaatttctcttcggcgaccggggcaagctggcgatggatgcgtacaagacgaacctgaaacagaccgccaatcaggaggtgccgaagactttccgcaagcaggagcttaccgagaagtctcgcctcgaactcgaagccgggggaacggtcaaggtctccggtctggtggacaagaaaggaaaagcctaccaaggctacatcacatggaagcccggcgagaagcccgccttcatgtttcccaaggactacaaggcggcactcgaagaggggcgtgtcaagcccgccgtggagaacgaggtgcaggtggcggtcaattccgagggcaagaccgtagaggcgacccgcaacctgaaagaagccctgcaatccgcacagcagcgccccaccggggagcagaaacagcagcaggagcgcaagcaggagcagaaagaggaacggaaacagtcacagaagcaggaacagcccgacaagcccaagcgcagccggggtgtccgccgctga

SEQ ID NO: 5033 - DNA, 846 bp, B.fragilis
ttaaggaataacatgatagaaacgtactttaacaacttgatgcaggaggtcgaacgtaagatgggcattgaatcttcccgtatggagggagagcaagtgatacggacttgtcaggagatggtttcttttttgagggagcgatcccgtgagttgaaggactatgtcctaaaccacccattctccaacgtggaagaggaaatctgctttttcaagtattacaagcctgccctgacgggacgcctgctgtattattaccgggtataccagatcgagagcggttgttcatgttgcccggagattgcccggatgcattaccgcaaggctatgaaagaataccagcggaaactggaacgataccttcccttttaccagtattaccggagcggggcgacttaccgggaccattactatttccgccgtgccaaaaaggagctgagcccggaaagcggaagttttatgctggaggaggattcggtgatgtcaaccggttatgacttgttggccgcaagactgatagcggcggaaatgttacttggttatctgaaccggaaagtgctgctggcaatggagggggcgtatgccgtgcaggaaaaggagcaccattggacggaccggaaggcggctgccgtggaactgatatatggcatttgggcgatgggtagcgtggataacgggagggtgagcattgtcgagctcgtgatgctgttcgaacaaatgttccatattgacctgggagacgtgtaccacacgtttatctccatgcgtaaccggaagaacagccggacagcttaccttgatcaaatgaaggaacgtttgttgaaacgaatggacgaaacggacggataa

SEQ ID NO: 5034 - DNA, 1248 bp, B.fragilis
tctggttgtaaaatcgggccagtgtcaaccattttttcaccgattaatcgcatacgcaagatgaaagctccacggaaaatttatacatggaccagtatcctgcttttcgtgtgctgttcccttatttttctttcatgtgaaaaggaagagctcggggaagccatggaaaatcggaaaacgttattcatgtttctgccgtggtccactgacctgacaggctatttttacaccaatatcgcggatatggaggcgtgtgtaagcagaagggggctggagcatgaaagaattctcgtgtttatgtccacgagctctacggaagccacgatgtttgagatcatacattccaaaggaaagtgcgatcgtaaaacgctgaaaaggtatggcacttcggggtttactacggtggagggcataacggggatattgaacgacgtgcaggaatttgctcctgctccggtttacgctatgatcataggttcccatggcatgggatggcttcccgtggacggtacacaggcggattcccttttccggatgaaaaagcattgggagtatcaggagcagccgctgacacgctatttcgggggactgacccgggagttccaaacggacgtgggtaccctggcccgggggattgtaggcgcgggcgtcaaaatggagtatatcctgtttgacgattgctatatgtcatccgtagaggttgcctatgaactgaaagaagccacaagatttcttatagcctctaccagtgaaatgatggcatacggaatgccttacgccactgtgggggagttcctgctgggaaatcctgattacggatccctttgcgaaggattccacgacttttattcaacctatgaaatgatgccctgcgggacactggctgtgacagattgctctgaattagataatatggctgctatcatgaaaagtatcaatgacaggtatgttttcgatgattccctacaaggagaactccagggactggacggatacacccccgtcatcttttatgactttgccgattatgtcctcaccctctgctctgaccctgtcctgacagcccgcttcagggaacagctggagcggcttgttccctataaaacccatacgggtaaattttattccaggaccaaagggccccttcccatacatactttctcgggtataacgatctcggacccgagcaccaatcccatggccttactgaaaggtacgacctcttggtacaaggccacacacgaataa

SEQ ID NO: 5035 - DNA, 258 bp, B.fragilis
catgctgccaaagttttttttctggtacaaaaaaaccgccgcggagccttattcgggctctctacggtggctatatactgtattttcaccaaatggcgtatcgggaaaggtgatttggcaacttgctatgaacctgccagtctcttccttgttttacaaaaggttatccgtccgtttcgtccattcgtttcaacaaacgttccttcatttgatcaaggtaagctgtccggctgttcttccggttacgcatggagataa

SEQ ID NO: 5036 - DNA, 699 bp, B.fragilis
aatgctatgaacaggtatgtatctgaaatgatcgggacaatggtccttgttttgatgggatgcggaagtgctgtttttgccggggatatgcccggtgcggtcaccaccggggtgggtaccctgggagttgccatagccttcgggctgtcggtggtcgccatggcatacgctattggcggaatatccggatgccatataaatccggcgatcacactgggcatgtactgctcgggaggaatggggggcaaggatgccctgttatacattattttccagataatcggggggattctcggatcagccgtacttttcatactggtatctacggggccacatgccggccctaccatgacagggagcaacggctttgttgagggggaaatgttgcaggcctttatcgctgaggccgtctttacgtttattttcgttcttgtggcgctgggagccacggataaaaagaaaggggccggtaaactggcgggcctggtcatcgggctgacgcttgtcctggtgcatatcgtatgtattcccatcaccggaacatcagtaaatcccgcgcgcagcataggacccgcacttttcgagggaggaggcgcgatctcacagctttggctatttatcgtcgctccactgacaggaggtctggccagtgccatagtgtggaaagccatttctcagcatagcgacagacaacgatga

SEQ ID NO: 5037 - DNA, 1137 bp, B.fragilis
cataacatgaattttgaacaattagcaaccatcatagccgacacgcaccaacgattacaacagagtgcggtcaaagccgtaaaccagtgccagaccatgcgtaactggcttatcggtttttatatcgtggagttcgagcagaacggagaagaccgtgccaaatatggggaattcttattgaaaaacttggaacaaaaagttaatttaaaaggattgaatattacattattcaagcgttcacgagtcttctatatggtatatccccagttggcaactgtaataaaaacgatattgcctccaacaggtgcatcaacgatgcacttattggaaatgcagggtcttggaaaaagtgcatcactgatgcacttattacaaaatgctgaaaacaaacaagatatagttaatacgatagagcctcagaaactactcagctctatttcttttacccactttatcgaactggtaaaaatcgacaatcctatcaagcggatgtattacgaaatgctcaccatccaaaccgggctttctgtccgtgaactcaaacggcagataggagcgttgagttatgaacgtgtcggcttatccggcaacatggaaaatgcacttgctgccattcagcagaagattcacccacaaactgtaaccgatgccgtcaaggatgactatttcttcgagttcctgaacattccgcagcaacgggcttctttgctaaaggagaaggaactcgaaacacttctgctcgaccatttgcgagacttcattatcgaactcggaaacggcttctgtttcgaagccagacaaaaaagaatccttatcggtgacgaattttatttcattgatatggtcttctaccaccggattttgaaatgtcatattttgtgcgaattgaaagttgatactttcaaccacgctcatgtgtcacaactttattcatacctgaattattataaagccgaagtgatggagccgggcgataacccgcctatcggcattttgctggtaacggacaagaacgatgcgttggtgcggtacaccacaaccggattggatgaacagatattcgtttccaaataccagttgcaacttccgactgaacaacaattaaaagagttgattttaaagacaatccggcaataa

SEQ ID NO: 5038 - DNA, 363 bp, B.fragilis
  unsure (191): Identity of nucleotide sequences at the above locations are unknown.
aaattaaaccttatgatgaagaaaatttttatcagtttgtttttgtctggtgtttttatgtatcacacaaatgcccagactgcagtagagggtaacaagtttctggacaactggtccatcgggatcagtgcgggaggaacaaccccgttaacacatcattctttctttggaaacatgcgcccgatcacggngatagaactgaataaacaattgacaccggttttcggtttcggtctggaggcggtcggaagctttaacacctcacaaagcaggaccattttcgaccgctccaatgtcagtctgttggggttggagaacctgaacaatctccttgggacctataccggggttcccagaccttaa

SEQ ID NO: 5039 - DNA, 417 bp, B.fragilis
aagattatggaaataatagcaatcgaaagcatagcgtttgctaccctcgtggagaagatagaggggatagcggcatacgtgcaggcgtccggaacaaaggagcgggagcaatggccggtagcggataagaagggtacgaggaaggcagggctatggatgacgggaaaggaagtgtgtgaacaacttgaaatcagtccccgtactttgcagcgttaccgcacgaaccgtatcatcgcttactctatctgcgggaggaagatacgttaccgccgtacggacgtggaacagttccatgagcgttggatacgggaaacgcctgacaagctggtggaccgaatgattgaagcgtaccctttacaccaatgcaaaagcagatcatatggtaagaaaagaggaaatactggcaaaaacaggtaa

SEQ ID NO: 5040 - DNA, 432 bp, B.fragilis
aggaacggacggcgaaggggtacatccgttacatgcgggaaaaggaaattattgaaaaggagggcgactgctatgtatatggacagcgaaaaatttgagaattggatggagcgtatcatggaacgtttcgaccggacggagaagttgttggaaagagtactgaagaagagcaacgcgctggatggagaggaggtactggataaccaggacctgtgcctgctgctgaaggtcggtattcgcacattgcaacgttaccgtgccattgggatactgccgtatttcactatcagtggcaaggtcttctatcgggtgaaagatgtgcacgagttcctccgcaaccagtttgccgctgtggaggaacgggctgcaaaacggaaggagaaggaagtccggaaagaggaaaggcgcaggaaaaaaggcttgtttccgtaa

SEQ ID NO: 5041 - DNA, 708 bp, B.fragilis
tttaacctgcgagagagcaaggcatggacattggcactgaaacctgccctggtctatgacatgaatgctatgggttccgaagccgtacgtttccattccggacgggccgtatgggaaatatccgttggtctgaagtatcatttcggatgcagtaacgggaaacaccactttacaaaagtgagagcttacgaccagcaggaggtggatgtcttgaacgcaaaaattaatgaacttcatacacaggccggtaaagatgccaaggcattgcaggaggcagtgcgaaaggtaacggaactggaggccgcactggacaaatgccgcaaccaggaaccaaaaattgtgaaagacaccattgacaacactaaaaagacgctggaatccgtcataactttccgccagggcaggacgacagttgacaactcccaactcccgaatgtcgaacgtatcgctacttatttaaagaaccataagggagcaagtgtactcatcaagggttatgcctctcctgagggaagcgtggaagttaacgagcggatcgcccgacaaagagcggaggccgtgaaaaaaatgctggtgggcaagtatggaattgcagaagaacggattgtagccgagggccagggagtagggaacatgttcgaggagcccgactggaaccgggtaagcatctgtacgatcaacgcgggaacggaatccagtagccgttaa

SEQ ID NO: 5042 - DNA, 276 bp, B.fragilis
actgttatgcgtgttttcaatcttttattgttgatctccatgttcagtcccattccgctgcccgctcaggtgggcgaacgttatatagaggtagccggtacttccgagatagaggtagttcctgacaggattcattatgttatcgaaataaggcagtacttcgaagtagagtttgatggcgtatccgaaccggaagaatatcgcactaaggttcctcttaccaggatagaggagcaattgaagcaggttttgacaatagtcggagtgccacggtag

SEQ ID NO: 5043 - DNA, 264 bp, B.fragilis
ccggtaaatagattaatagattcaactcacgataagatgaaagattattactttattatgaatgccggggtaaaagccggaggggagatcacccatgcggtattagaagggaaaattgtatccgcaccgaaaggatacgatgccttcacggggattgaagcggccagggagaaactggcttgcgggaatatccgtcagcagatggaagaattcggtatcgaacttgagatcgtgccggtaaatactgattttttactacgatga

SEQ ID NO: 5044 - DNA, 432 bp, B.fragilis
gaaggggctggagtgcggaccgaacgacggcaggatatgggctgtacggtcgagcgaagtgctggaggacgggaaaatccgaacggtgtacgggaggatgtaataaaaaagcaacccgccgatttgggcattattaaagaggcttggcaggttctattgattgcaaagataacggaaatagttggaacgacaaatattagaatactacaaatgcgcaactatgtgttgcgcatttgttattattgccggattgtctttaaaatcaactcttttaattgttgttcagtcggaagttgcaactggtatttggaaacgaatatctgttcatccaatccggttgtggtgtaccgcaccaacgcatcgttcttgtccgttaccagcaaaatgccgataggcgggttatcgcccggctccatcacttcggctttataa

SEQ ID NO: 5045 - DNA, 297 bp, B.fragilis
aattcagatatgactaaagcagatattataaaccgggtctctgaggagcttggaatcgatcgcaggaccgttggcctggtaatcgagagtttcatgaaatgcgtgaaggatgcactcggcagagagagaattgtattcctgcgcggattcgggaccttttctttgaagaaaagggcggcaaagaaggcacagaatatccaacagcacacaaccatatgcatcccggctcgcaaggtccctcattttaaaccctcggagtctttcttggttctccggaaagaagataatcgaaaatag

SEQ ID NO: 5046 - DNA, 246 bp, B.fragilis
caagtccgtatcacttgctctccctccatacgggaagattcaatgcccatcttacgttcgacctcctgcatcaagttgttaaagtacgtttctatcatgttattccttaattatggggcacgtgagtaccttcacgctacccgatttatttttatgcctcgcttgattcgatcgcaggttttcctttcggccctttacgatgaaaaaacttttcctcatatcgaaaagaccggagaaaagccatga

SEQ ID NO: 5047 - DNA, 1641 bp, B.fragilis
  unsure (1363),(1550),(1568),(1622): Identity of nucleotide sequences at the above locations are unknown.
agaaatatgattacagcagttatcgctgaaaagccttccgtagcgaaggatatagcaaacgtgttgaatgtccgagagcggcacgatggctacctctcaggtaacggctacctcgttacctgggcgttcggccatctcgtccagcttgccatgcccgaagcatacggctatgcgggcttccggcgtgagaacctgcccattctgccgcaggagttcaagtacatcccccgccagatacgggagggcaaggagtacaagcccgaccccggcgtactcaaacagttgaaggtcatcagggaggttttcgaccgttccgatcgtatcgtcgtggcgaccgatgccgggcgtgagggtgaagccattcatcggtacatctacaattaccttggctgccgcaaaccctgcctgcgcctctggatctcctcgctgaccgaccgtgccatccgggaagggctggacaacctcaaaatcggaagcgactacgacaacctctaccgtgccgccgaagcccgtgctatcgccgactgggagattggattaaacgccacccaagctctcagtatcgccgccgggcagggcatctactccctcggacgggtacagacacccaccttgatgatgatctgctcccgttatctggagaacagggatttcaccccgcagacctattaccggctgaaggtcacggctgaaaaggacggcacgcccttcgccgccatctctgaattgcgttacgaaacccttccggcggcaaatgccgctctcggcgctgtaaccgcaacggggacggtggaggttgccgacttgcagcgcagggaggtgagccaagaacctcccttgctctatgacctgaccgccttgcagaaagaggcgaacggcaggtacggcttctcggcagacaagaccctctccatcgcccagtcgctttacgagaagaaggtgttgagctacccccgtaccggctcccgctacctatcggacgatgtgttcgacgagatacccgatcgtatcgccctgctggagcggtacccggctttcgccgcccatgccgccgccctgaaaggagcttcgctcaaccgccgcagcgtggacgcagggaaagtcaccgaccaccatgcgctcatcatcaccgagtgtctgcccggcgagctgtccgccgacgaacgcacggtatatgacatggtagccgcccgcctgctcgaagccttctccgcccgttgcctcaaggacgctaccaccgtctctttcacggcagggaacagcgtgttcaccgccaaggggacggtcgtcagatccgccggatggcgtgccgtgcggaacgagcgggaggaggacgacgagggaacagccgctttgccgactntgcagaccgacgaggctttccccctgcaatcggcggagtgtgtggagaaacagaccaagccccgtcccctgcacaccgagagcagcctcctttcggcgatggagcattgcggcagggagttgcaggacgacgagcttcgagacagtttgaaagggaacggtatcggcacgcccgccacccgtgcctncatcatcgagaccctctntgcccgtgactacgtgcgcccggagaagaaagagctcgtgccgacggacaaggngcttgcgtgtatcaaatag

SEQ ID NO: 5048 - DNA, 1554 bp, B.fragilis
ttttttcagattatggacgaacaaccggacagcagccagcagttaatggacatcctgctcgtcatggacgagaaaggcacgcttcaagccgtcagcggagtaaaggacggcgagttacagaccaagaacccactggaggacaacaacgacctcctgcgggtggatcgccacggcgatatgttttcaaatttcttttccaacctctggagccagttgaaagatccgacccgcttccatttcttccgtgtgccggaagagcaggtgcagcgggtacccgccgatttccggcagcgggagagccggtcggtcaagacaggtgagccgctcctcgcacagtacgaggtgcagccgcccgtgcaggcacagcagcagacccaagccgggcagcagcaacagccggaggatgcgccgcagcagtccgccgggcagaccgaacagaacccgcagtacaagtaccgcccggaggacatcgactggaacagcctcgctgccctcggcgtgcagcgggaacagattgagggcaacgggatgctcgaccagatgctccggggcttccagaccgacaagaccgtccgggtgcatttccacttcgagggcatctcgcacagcaacgatagccagctctcgctcaaacccggcacggacggcaggctgaccgtttgcagcctcggcatcctcgacccggagaagatgcagaagcagttcttcggttacgacatcaccgactccgacaagcaggtgctccggcagacgggctacatggggcacccggcgactcgtcaccaaccgggcgggcgagcaggtcgaagcccttgtcagccgcaacttcaagaccaacgagctggtcgctttcccgctctccaaggtcaatatcccggcggagaagaacgggcataccttcaccccggacgaaatagcccggctcaaacagggcgaggcggtggtctgccagttcctttccagagccaaggagggggagcaacccaagatctacccggctcccgtacagttcagcgcagccaagatgcagctcgaatttctcttcggcgaccggggcaagctggcgatggatgcgtacaagacgaacctgaaacagaccgccaatcaggaggtgccgaagactttccgcaagcaggagcttaccgagaagtctcgcctcgaactcgaagccgggggaacggtcaaggtctccggtctggtggacaagaaaggaaaagcctaccaaggctacatcacatggaagcccggcgagaagcccgccttcatgtttcccaaggactacaaggcggcactcgaagaggggcgtgtcaagcccgccgtggagaacgaggtgcaggtggcggtcaattccgagggcaagaccgtagaggcgacccgcaacctgaaagaagccctgcaatccgcacagcagcgccccaccggggagcagaaacagcagcaggagcgcaagcaggagcagaaagaggaacggaaacagtcacagaagcaggaacagcccgacaagcccaagcgcagccggggtgtccgccgctgatttcccccgccactctgtaa

SEQ ID NO: 5049 - DNA, 498 bp, B.fragilis
aaacacattgttatgaaacagattaccttgcacgtgtaccaatccatcgacggctgtccggtcatagcggacaagtgtttcaatgcggtagtggacgcctgtgcctacgtgctgattgacgaggaaacttacctgcgtatttacctgaatgatcttgactggccgcttgaggcaaaggagaccttggtcgtgacgaacggctgtatagacttgacagagacagaacgggtacgttttgtcagggggaatgtggtaacggaactgcaacggataaaggagaatggcgacggtatggtggtggcttacggaggagaaaccggagttttactcttggacaacgggctggcagatgaaatcgtgatgacaaccgtgccggtgctggtcggtaacagtgagaaggggctggagtgcggaccgaacgacggcaggatatgggctgtacggtcgagcgaagtgctggaggacgggaaaatccgaacggtgtacgggaggatgtaa

SEQ ID NO: 5050 - DNA, 210 bp, B.fragilis
cacatgagcgtggttgaaagtatcaactttcaattcgcacaaaatatgacatttcaaaatccggtggtagaagaccatatcaatgaaataaaattcgtcaccgataaggattcttttttgtctggcttcgaaacagaagccgtttccgagttcgataatgaagtctcgcaaatggtcgagcagaagtgtttcgagttccttctcctttag

SEQ ID NO: 5051 - DNA, 492 bp, B.fragilis
gttatgaatacactcacttctcaaattgaacaattacagagtctcgcgcacgagttactctatttaggtgtggatggtgctcctatttataccgatcatttccgtcagttgaacaaagaagttttagaacaatccgatgcgttgtatcctcagcgcggtgctacttccgaagaggaggcaaacatttgtctggcactattgatgggttacaatgcaaccatctataatcagggtgacaaggaggagaaaaagcaagttgttctcaatcgttggtgggacgtgcttgaccaaacttctggtactttattgaaatgccagttggtgacttattgttatggtggaggtgttgaagaggaattgggcaaagaggggccttcctttattaaaaaggtggaaagaataagaaactttctgaagattaaaaagaggcaattaattattttgagaaaattgggaaaaaaaatcctattctctatggggaaagggaaataa

SEQ ID NO: 5052 - DNA, 525 bp, B.fragilis; identical to SEQ ID NO: 4192

SEQ ID NO: 5053 - DNA, 369 bp, B.fragilis; identical to SEQ ID NO: 4207

SEQ ID NO: 5054 - DNA, 927 bp, B.fragilis
acatctttattattaactcaaaaagcaatacttatgaagaaaaccatcttcttgattttgtgcattttatgttctcttggagccatggcacaaaagaaatcaatcacaggtgtggttacggatgctagcggtgaatcagtcatcggagcgagtgttgtcgaagtcggtaccaccaatggtgtaattaccgatattagcggcaagtttacattaatggtcgatcctaacggaaagatcaaagtttcttatgttgggtatcagcctcaggtactcgatgtaaagggcaaaaattctttcaatattaaattgaaagaagactctgaaatgttggatgaagtagtagtcacaggatatggtggcaaacagttgcgtaccaaagtgaccaattcaattggcaaagtaaaggaagatgttctacaaaaaggactcttttccaatccggcacaagctttgtctggggcggtatcgggtgtacgtgttcttcagacctcaggtgatccaggagctactcctactataatcctacgtggtggtaccgattataacggaacgggatctccattagtgttagtagacggacaagtccgtggaagtctgagtgatatcaatcctgaggatattgagtcaatggaagtcctaaaagacgccggtgccactgctatttatggtgctcgcgctaataatggtgtaatcttagttactactaaacgtggtaaagaaggtaaaggtgaggtcagtgtaaaggctaaagtcggtatcaactattacaataatccttatgaatttatgaatgcccgcgattatatctattggatgcgtacggcatatcaacgttctggccaaatctataaagattccaaaggtaattgggttggtacagcagatatgaatagtctaaataatgcaacctccctatggtacgggtaa

SEQ ID NO: 5055 - DNA, 807 bp, B.fragilis
  unsure (55),(111),(202): Identity of nucleotide sequences at the above locations are unknown.
aattcaaataagctggttcacccggatgttcatttcgtttttccggtagtaaaanacgggagaagcgatgactacattgtagaatggagaaaattggtgttaaacaatccntattttaccatcaatcattggctgaacgaaataaatgcagaaaatgcacaggcggtaatctacaccaaagagagtgatgagatcatgaaanagctcagccttaaatccagcgagggcggatttaagattacactcctctggctgccggaaaagatgcaacaggcttgtgccaacaagttattgaaactgctggaagaaccacccgaaaagacaatcttccttttggtttcggaggctcccgatttaattctccaaacgatattgagccgcacgcaacgcttcaatctacgtaaaattgaggaagagtgtatggccgaggctttacaaagcaaatacggggtccagcaggcaaccagtatttcgatcgcccacctagccaacggaaactttatcaaagccctcgagacaattcacctgaatgaagagaatcagttgtttttcgaactgtttgtcagtttgatgcgactctcttaccaacggaaaatccgggaaatgaaattatggagtgaacaagtggcaggcatgggacgcgaacgccagaaaaattttctggaatactgccacaaagaacgtttcaaatccttgcccggacgtccggtcaatgacttccggaactatatgacattagaagaacagaacttcgctacacggtttgccgtcttcaccacggggctgggaggatcgacgctggtgtaa

SEQ ID NO: 5056 - DNA, 222 bp, B.fragilis
ctgaaaatagccataaaaagcataaaagtatgttcattcgtatattcattccgaagaaaactaaacagacgcaaaattagacagttttcattggctgctcaataccttaaaataggtaatatgccgataatgctttactatccttttcaaaaaggactaataattcacgctaggaatggaaattcttatcatggcactaaatctgtagcttatttcatttaa

SEQ ID NO: 5057 - DNA, 1680 bp, B.fragilis
attatgaaagctaaaaaatataattggacattacgtcattcctttcttttatttcttgtgatctttatctccagcagctgcgttgaagatgttacagaatcaaccaaagaaccaacacggtatacagcaaacgatataaaatcatattctgacctgtttgatgtgttttggaatacaatgaatcaaaaatataattatttttacgagcagagcagttttaattgggaaacggtatataatgaatatgctccgaaattcaaaaaattgaaaacgttcaacagagataagcagtatagcaaagcggaaatctcagaagattgtaataaagcgatagaatattttacagaaatcatagatcccatcatagacaggcacttctatgtaaagatttcacttcctgtatcgcatagttttatcagaaatgtctactttcatggtggtatgaagagtaaagaaaagatatatacctacccttttgaactcaagtatgaatacatgagatctaaaatacaatctgaaacaggagtattcggacaggccaacgatatgttaggtggtttcttatcagacaatcctgacatatattacttcagctttaaatcatttacaataagtaatcattatatattgtcatttggcagcgaatacttggttatagacgataaaagtccgtactatttaacagaaaaagagatcagagatactgtcgaagcgaataaaattaaagaccccgcagtaaaaagtgctctaattgagaaatcgatagaatacatgaataagtttaactccttcatgaggtctgaaatcgcacaagatgcaataaaaaaaatagcggattttaatcaatcagaaaatccagacaatagttttattgaggcattatccaaagcaaaagaaaatgcgcctgatataaatattgaattatcacagttaagtggtttgaaagaatttagattaaatcctaattatactacatggtttaaacagcgctcaaccgaacatttacaattagcatgtgaatataccgtctttctatcaaacatagataatgtcatcaacaatcaatataaaatagatttctatagaaactttttggtacccctcaaagttggaaaaataaaaaagataatactggatcttagaggaaatggtggcggtatggtacttgatgcaagaacatttacagatcgttttatcactaaagatgctatatttggctaccaaagatttaaggaagataacaatccattcagttataccccatggacaccttgcatgacaaaaacaacaggcattgggataaaaaaggaaataccgatagttattcttttagataacaatagtgctagtatgtccgaaatcagcactttaatgttaaaaagccaaggaaaacatgtcacagtcgtaggaggctatagcgctggtgcaactgctggattgggagattcggatcaattcaacggaggaataagaggaaaggttagtgactatttagagttttatatgcctttacttgcaatgcaggatgcaacccatactgtaatagaaggaataggtatcaaaccggacctactagtagacccactaacagaagatgaagttcgtgaaatggctctttcaccttttactcatattgatcgtacattaaaacaggcaatagaagtcttgagcaataattaa

SEQ ID NO: 5058 - DNA, 516 bp, B.fragilis
tgctttaattttatgaaaaaaggtattttgtttattgctctttttgcagcaagtttcggatttatgcagtcttctttcgctgcaccgtcgatgagtgctaactctataaccaacgtgttggctataagtgactatgaaggcacttatagcggtacgatggataatatcataatgagaggtaagccttatgaatcacgggctgcaacttataaaatagagggtggccgtttgaaatgtgattttccgcagataggtagtatgccgggtacaattactatttctttggctgtggaagtagatgaggaaaccggcgagattacagcttacaacggggacgaagcaggcactttgtcgcttccgttgggaataaaggtcaaattgtatttggacgacttgagagatgcaaagattacggataatggtagctctaaacaaatagaatttacactggacgtttccggtacattcttgggagctaatttccctgcatctgtgcattttgtaggtacaaaatag

SEQ ID NO: 5059 - DNA, 255 bp, B.fragilis
actctaaaaaaacgacctatgagaaaactaaaaaagccatattctcaaaattggagaggtctgtctgccaaatggctgtttattttgtctactgttttagggattatagcagggacttgtttttggatttttatttctcgctgtggaaatgaggagtgttttttaaattatgatccattgccggaaatgtttattggtggcgtaataggagcgtttttatatgttattatatggggtatgacgtctgatatgtga

SEQ ID NO: 5060 - DNA, 1494 bp, B.fragilis
cgacgaatgaaaagagtaactacaattctattcttaatgttgctgatatgtgttcatacggcagcacaacaaaaagtcaagttagaggtgttggagaagggcacggaacaacccattatcgcagccaatgtgatctatgccgataatgaagctttgcgaaatccccaatatgccattacgaatacatccggacaggctgaattaaagcttccttctaagggaatctgctattataaggtgacttatatcggctatgtacctgtgacggggaagattggagggacacaagatgaaaaagtcatttatatgaaagaagatgacctgggaataaatgaagttgtcgtgacaggttcacgtacagcccgtcccatcaagatgtctccggttacgacacaggtacttggcggcaaagcactggtagatgccggatatagtaatcttcaacaggcactgcagcaggaaacgcctggacttaacatacagaaggtggggttcggtaatgaaatctccatgcaagggttggacgcacgccacgtgttgtttttgatggacggagagcgcatgacaggcgacatggcgggtaatttggattacgaacgttttaacctgcatgccatagatcgcgtcgagatagtgaaaggtgcgagcagtaccctctacggatcacgtgcggccggtgcagtcattaatttgattaccaagaaaacagacaaacctctctcgatagatgccggaatacgttatgggcagatgaatgaacgcaattacaagcatccgcaaccgaaggacttcctttacatgtttgagcaaaatgccgatcgccctaacttacaaagctgggtatctgccggattcaaggccggaaaattcacgtcgcagaccgatgtatggtatagcgagagtgatgccttttatatgtatcaggcggaaaatgacaagaaagtttacacaaaggaagcgaatcccttcttgccacatgacataaccgtggtcagcaatgctgtccgtccacccatgggtatcgaaggcaaagagcacattacggtatcgcagaaactgtactataatccgaatccgaatctgtcggtgctggtttatggcagttcttttttcatgaacacgtatgacttgatacaggatatgatgttcagccaggcacgagatttgacagccgggactaaagtgacttatcatgtgaaggactggtttagtgtgacaggaagtctgcacgctgatttttacgatcgcttcaaacgccatgaacgtatcgacaagcggcagaaggattatgaaagtagcatttatcagccacgtttgaccgttacgagcaattacttcaacggacacagcttaatattgggtatggagcatacgtcggatgaattgacttccgatcgtttctccggcaatgctaaccatgacctgaaaacgcgtgcattgaaggaaacagaatactttctatcgtcactcatggctgaaaggccctcatttccc

SEQ ID NO: 5061 - DNA, 183 bp, B.fragilis
  unsure (13),(15): Identity of nucleotide sequences at the above locations are unknown.
cgacccttcgatnanctggagcggctctcttccagccccgtggtgaagactgtcgaccaagaaaacatagacagcatacttttctgcattgaggagaataattcaaccctgaaagcattgagagaagaaacaaacgctcagaaattggggaataagacaggtatatactctgttcgaccctga

SEQ ID NO: 5062 - DNA, 198 bp, B.fragilis
tttatttattgtaatccaatcggagaggtatgggggacttgctttaatcctgctgccctgcttttgctaacttcctttagttcgatagtggtttgcagtatgttttatttctttctacaggtatctgtagaagaaaccaataaaagaaaatcatttataaactatataaaaagaaaactgaaatgtataataaaataa

SEQ ID NO: 5063 - DNA, 2796 bp, B.fragilis
ttttgcgtctgtttagttttcttcggaatgaatatacgaatgaacatacttttatgctttttatggctattttcagctaccctgtccgctcagcaggtgaaaatagtcaaaggacatgtttgcgttctttccgaagattcgatagagagaagtttgccttatgcaagcgtggtcgttttggaaggaaaggattccgcttttgtaaaggggatggcgagtgatgcaaatgggagcttcaagttggagtttataccacaaaagcgaatggaatacttgttgcggatatcttatatcggtatgtcaactatctttcggaagttagatccgcatatgatggatattgattgtggacatattctgatggaaagtggtatcaaactggccgaagtgctggtgactgctcccgtcaaagagatagatatggcaggggatacgaccgtaattaatgctgatgcctaccggactccagaaggctcaaatctggaggagttagtgagaaagattccgggactggaatacgacgaccgaagtaaatccttatcatacaacggtcttgtcattagcgaaatcaatgtgaatggtgaggcttttttttcagggaatcatgtattggcattagaaaacttgccggccgatttaataagtaggataaaggtctatgataagcgtagtgagatggaaaagtttaccggagtcaggactgttgatgaaaactatgtgctcgatttgcaaaccaaaaaagagcttaatggtacgctgataacttcggttgctgtgggaaagggaaataagaaaaagaaagaggcagagttaataagcaactttttcaaagctgatggagaaaacctgtccgttattgccaagagtggtaatcgtgatataaccactgagaataaaaagaatcgtcaagacaacatagcggtcaatttcttgaagaagtttggagaaacagtacatatcaatgggaatatcatgtacaacaatgcgattaatggtattaacgggacttcctattatgagcaatacctgatgacaggaaaccgttatcggtatgcgaccgataatggttatcatacgaatcgtatgataagtgccatgttaagtgcgagatggaacattgacaaaaagaccttgcttaatatttcgggaagttttaatgctctaaaaggtattaatgatgatagtaacaggcaagctacttataatgcagatccaaagttagatgtaacaagtccctttaatagagacgcgagtgagcaaattgaggatagtatacgggtgaatgacatctgtatgacttcgaggtcatcaagcattaaccgactatattctatcggtgctgacattacccgacgactgaatgcaaaaggtacaagtttgggactgaccgttcaatattcggaggaacgaggcaacaataaagctttctctttatcatccactacctattatcagttacagaatgtaaagggcaatgactccatactctaccgtaaccaatatcaagaaagtccgaacagaaaccgtactattaagttgggactaatactgacgcaaatacttcgcaagaacttgagggcgcagttgtcatacatatttaaattggataaccaaagtcgtgaccgtaacacttacgttctttctcctgtggtagacggtgaagaacatacacctaccggtaattttccgaaaggttacgaagtggaatataccgatagtttgagtaacaaaagtcgtagtcatacgatggcacatggagtttcccttaatcttaattatactgataaaacgtgggagattactaccggtttgtccgttacacccaaacgacaaactcttggccaaaagacagggtggacacaggctgatacattgagatattctgtaaactatcatcccactcttaccatcttatggcgcaaaagaaagacatgggtgcaactaagttatgaagggaatactcaacaaccaggactggcagaattgcttacgctaacagacaacagtgaccctttgaatatcattcgtgggaatcccgatctaaaatcttcatacacccaaaaggtaaggcttgaagttcgggatacgaaaaccgggctaagcggtgacgtgaattggacgagcatgttgaacaatgtgacgagggctgtgatatatgacagtcagacaggaggtattgagagccgtcctgtgaatgtcaacgggaattggaatataaaagctgccatgcgttatcaaaagcgtattaatcattacttcaatttgtctgcacgtaccggtacttcatttatccaaagcgtgagtcttgtaaacgatggacaacgagaacagcccgaacgtagcgttacccataatcgactgtataatgccggtctacgtgtaggctaccaacctaaatggggaggttttgatttgagcggtgactggcgattccgccattctacgaatcttttaagggaaacaaacaattatattcgtgattattctttcggattgaccgcttacgccgtttttccgggtaatatacgtttgaaaagtgagacaacccatacgtttcgcaacggtaccaatatcaatagaagtgaggataacgaagtagtttggaacctccacttgtcatggagttttctcaaatataagaaagctgaattttctgtgtattgggcggatattctcagtcagaaaaagagctatagccgtaacgttacatcccatggattgtccgaacgatatactcagcagatcggcagttatttcattgtatcttttaagtatcgttttaatagacagttatag

SEQ ID NO: 5064 - DNA, 837 bp, B.fragilis
attaacctgcttttggaggcgaagcaatattgcattgatctggtttattataacggtttgaaaaaagaacttaaagtccggttacgacatgcacaagccatagccgatgcttatcgacaacgactggatcgtggagacgccagtattctggagtacaataaggttcagttgaatctttccaccgtgcaaggggagatgtcaagaatagaagtggagaggaacgctcttctttccgaactcaaacgattgaatggtggtatggatgtgatttttgaggcgagcaactattctccggcttcgctgcctgtcaattttgaagactggtatctgtcggctcaacaaaagaatccgctactgcaatacgtaaagcaacagatagaggtcagtaaggagcaggttaagctcggtaaggccatgacacttccgaaattttcagccggttattcgctggaaaggacccttggacaaaaatatcagggaataagtgtggggatttccatccctttatgggagaataagaatcgggtgaagcaggctaaagctggtgttgtggcggcacaggccagagagcaggatagcaaacagcagttctatgacaggctccggaatttatatatgcgtgccagtggtctccagcagacagccattgcctatcgtgagtccctcaaggcactcaataataccgcgttactgatgaaagcactggatgtgggtgagatatccttgttaaactatatcgttgagataggcctgtattatgacacagttaatcagacgttggccgccgagcgtgattttgaaaaggctttggcagatttgtctgctgttgaactctaa

SEQ ID NO: 5065 - DNA, 750 bp, B.fragilis
caaacaattggttctatgtttaatttaaacattaattttatgaaaaaacaattagtaattttcattctgctaggaattattgcaattccttcgtcagtaaaagcacagaaactaaaagttagtttaagtgccggtctatccaaaagcattttgaatagcgatgtttctaatttggtcaatacacgttatgataccaaaacaggtgttgcaacaagggtaaatcttgaatataatttttttaaagattttatagtaggaacagggctgggattcatacaaaagaattatgaatacaaaaagacggataatattacaggaacacatacactgtataaaaacaactttatggatataccgttaaatgtaggcttgtatctttttaataaccctcataaagaaaatggtatatggctaaaagttcaaggtggcgtcttctatgagtacttcacaagaatgcatcggaaaggcgaatatccaatctttgcacaattacaagaagatggttcctacatcaaagctcaggtaaatgaaacatacgattttaagagaaatgaaaacaacttgaaaagaaacctattcgggatagaggggacaggagaagttggctattctttcaataggatcgacgtttttgcttcatatacctatcagtatggtcttaccgatatatacaaagcaaaaacttcttctaatcgtaaatcaaaaagaatctcaaacatcatatcgttaggcgttgcctataaattttaa

SEQ ID NO: 5066 - DNA, 687 bp, B.fragilis
aagaaaatcatttataaactatataaaaagaaaactgaaatgtataataaaataagatttgatacttttatgttgatgtgcttctttatgataacaattctcggattaagtgcgtgtgatagcgatgaaaagataacacaggagccaccttcccagacatatgttaaaaaggcgaaagagattcttgcaggagatattgtactctctaccagagcaacaatgaatggtgtggacaagacattgttgaagagtggttgcccaaccaaatttaacttttcctggcgtgaggacggtatgatgatactgaacctgagtgatttcagcgtaggtgctatgccatttgccattagcttcaaatgtgctacgaaaatcatgcagctcaacagttgggaacaggatgaatatcccggagatggatggattaagtttgttggtacagatggtaatgttacgacttccggtgatgatgccgaagataatcaagaagggagcggagcgagagtagatggttatttgaacgtgaataccaaccaaatagagtttattgtagattacaatatgatgaatgtccgcactgaaacatttttgcaaacaatcgataaaacccgtatcgatcgctttaaggaagagtttgcacaatacgagaaagatttggaagaggctaagaaagaccaaggaaaggcctaa

SEQ ID NO: 5067 - DNA, 1428 bp, B.fragilis
tgtaatgaaatgaacaatttgagaaactatctcggtttgagtgctcttacaatgggcctgtgtttaatgtcgtgcaatgacgacaatacaccgtcatatagccaaacgactatgaagaatagtgagttgaagacaattttgcaacagaaaggataccaatttaatgaacagggtaatttactgttggatgatttagctaataatactactactttagatttatcgggaacaaaactttctaacttgtcggaacttgatattcttcccaatctgacagaagtaaaattgtcagataacgattatggtcctgtattcgacttttcaaaactgcccaaacagattacaggaattgatctgactggtaatgatatttatgattatgataatcttgttaacgttgtagtagaagaaaatggtaatgaaacagtaacaaatttgcatgatattaccaaactttaccttccccggacagctaaagacaatattaaggatctggtacgtttctatattaaaaataaggacgctataacaaatgggaaaatagatatgaagataaaagatgagagcggaaccttacaaacgtataccacattgagggaggtgccagatgaaaatttgcgtacttatttacaggccaatttttctgatttattcaatggtgaccaaatagatcttagcaagcatttgggatatgctcaaaagactacgattctgcttattcaagctaatgccggagtgactaactttgagggaatacaatacattatacagaatccttattgggaaggtgcagcagtcgctctttattctgctgcgcaaagtggtgctaacatgccttctgtcaaattgggtaaatatgtcaccaatcttgtattgaataatctgaatgtgagaagtttggacttgtcgaatgccggaagtctttttgtacttaatatcggaactgttgccggtttgagcacattagatttaacccacactatttgggggcagcgtgaaaaggagatagaagcagaggaatccaaaggcagttatttgatcgtttatgattgtccttcgctgaaagaaattaaactgccaaagaaagatgagctgaaaacgtgcttcttagatcttgaatgtttggatgcattggaaacatttgatatatctaatctgaagatggtaaagaatcttatttttggaaatttaccggaaaatttcaatctcgtttatccagagctgactgttttttattctccggaagggaggtctgcaacttctttttgttgttcagaaagtacattcaatagagaatcgacaaagacgtttcttgatagatattatactaaaggtacgggagttgaaaagttaggatttagtatctctatgagttgtaataagaatgatgggtacaattggagaaaagctcttaagaagaagtcttag

SEQ ID NO: 5068 - DNA, 234 bp, B.fragilis
agacaaagctctcacggttataatgctttctatcgcacccgccatctggatggtattcctttcaataagagctttaagttcgatattgaaatgctgggatggaaacgaggtgaggccgattatgccactactatttattggtatggcgatccggaggcacaggtatttggaacttcaggtattgaagaagcccgccggcagttgctgcctgctgttgaggcttcggcagactga

SEQ ID NO: 5069 - DNA, 1185 bp, B.fragilis
ttggtgaatatgaaacatgaaagaccttgccttgtggcctccggaagtgactggctgcaagaagtgttgagaaggcttttggtctgggtggttgtcttgtcctcggggacattgatggcatacgcgggcaatctggatatcagccagacgaaagtcattacgggtacggtgaccgaaaaggaaacaggtgatccgttaattggagtaaacgtttcggtaaaaggtacttcgaagggtacaattacaaatttgaatggccagtattcggtcgatgtgaattccgataaagatattctggtattctcgtttatcggaaaggctacacaggagaaagcagtgaaaggattgagtcatattgatgtggtgatggccgatgatgccacgatgttgggcgaagtagtgatccagaccggttatatgacacagcgtaaagctgatcttaccggttcggttgctatggccaacacttcggatttggctcagaacccttcgactaatgcattgaagtctttacagggaaaattgccgggtgtatttattactacagatggtagtcctgggggaaatgcttcgatacagattcgcggacttacgtcactgaatgcgcagcctaacccgctgatcgtacttgacggattggcaggagactataacctgcgtgatatcaacccggcgaatattgaatcgattcaggtgctgaaagatgcggcttcggccagtatttatggttcgagagctgccggtggtgtgattatcatcgaaacaaagaagggtaaaaagggtgaatcgaagattagctacgaaggtcgtgtacagttctctaaatgggttaataaacccgacctgttgaataccgatgagtatggacgtgccatctggcaagcgtatgcaaacgacgataaacttggtgaaatcaagcaaagcgtccgtttcttcgattatgactggagttatgacagcaacggttatccggtacttaattccgtgaaaccggtggaatggctgaatacagctcagactatgcgctcggccgatactaactggatcgatgaaatatctcgtaccggagtatcgcagaaccatcagatttcagtatcgagtggtactgataaatcacgtactttcttcaacctgggttatgaaaacacagaaggtattcagattgaaactttctggaaaaactaa

SEQ ID NO: 5070 - DNA, 192 bp, B.fragilis
cgccaggtgtcgtcactgcattgtgacacaccgatggtatatcggggagcatccggactgcacgagacaagcagtcccgacagcatcagtccgagtaagaaaagtatacggttcatggtcggttattacataaaaggttccggaggcaaatataacaatttccctccggaatctcccacctgcttggtttaa

SEQ ID NO: 5071 - DNA, 1182 bp, B.fragilis
gagatggaaacattctaccgcacacatgcctaccttgttgagcacaccaatgccccggtccgccgcgacctgatggacgaaataaactggagtgaccgcttgattggtatcaaaggaacacgtggcgtgggaaaaaccactttcctgcttcaatacgccaaggagaagttcggaaccgaccgttcgtgcctctttatcaacatgaacaacttctacttctccggacacagcattgtcgatttcgccaatgaatttcagaaacgcggtgggaaggtactgctgatcgaccaagtattcaagcaccccgattggagccgcgagctacgtatgtgctacgaccgtttccccaacctgaagattgtattcaccggttcgtccgtcatgcggctcaaagaagaaaacctggaattgcgtgacatcgtgaagagctacaacctccgcggtttttcgttccgcgaatttctgaacctgcaaacagggatgaaattccgtcactacacactcgaagagatattgagcagccacgaacagatagccaaaggggtgctttccaaagtccgccctttggattattttcaagactacctccatcacggcttctaccccttcttcctcgagaaacgcaatttctctgagaatctgctcaagaccatgaacatgatggtagaagtagatatcctgcttatcaaacaaattgagctaaaatatctctcgaagataaaaaaattattatatttgttggctgtagacgggccaaaggctccgaacgtaagccaactggcaagcgacatacagacatcacgcgccacggtgatgaactacatcaagtatctggccgacgcacggctgatcaacctggtctatcccaaaggggaagagtttcctaaaaagccctcgaagattatgctgcacaaccctaacctgatgtactccatctaccccgtaaaggtggaagaacaggatgtgctggacactttctttgtaaacacgatgtggaaagaccacaaagtgcacaagggtgacaagaacacctcgttcatggttgacgaagtgatgccgttcaaaatatgctgcgaaggagcaaaaattaagaataaccccggagtgacgtatgctttgcacaaggcagaaataggtcgtggcaatcagataccactctggatgttcggctttttatattaa

SEQ ID NO: 5072 - DNA, 1479 bp, B.fragilis
gaagacagagccggaagaggaacatccctcctctttctttttctcctctccttacttccgctccatgcgcagacctccccgaaacacgaggtacgggctgcctggataactgcggtctacggactggactggccacgcaccaaagcaaccactcctgcaggtatccggcgacagaaagaagaactgatcgatatcctcgaccgcttgaaagaggccaacttcaatacggtacttttccagacacgtacccgtggtgatgtgctttatcgttcggacatcgaacccttcaactccatactgacaggaaaaaccggaggcgatcccggatacgatccgttggccttcgccgttgaagagtgccacaaacgaggcatggaatgccatgcctggatggtgaccatccccttgggaggcaaaaaacatgtggcctcacttggcaagcaatcggtgaccaggcgtgagcgtgacatctgcgtgccttacaaaaatgaatatttccttaaccccggacatcccgccaccaaggaatatctaatgaaactggtacgtgaggtagtcagccgttacgatgtggacggagtgcacttcgactatctccgctatccggaaaacgccccgcgctttccggacagttacgacttccgccgctacggcaaaggacgcacgctggcacaatggcgccgggacaacctgaccgacattgtacgctacatctacaacggtgtaaaagccatgaagccttgggtgaaggtgagtacctgcccggtaggaaaataccgtgacacctcacgctactcctctaaaggctggaatgccttcttcactgtctatcaggatccgcaaggctggctgggcgaaggcatccaggaccagatctacccgatgatgtatttccggggcaacggtttttatccgtttgccctcgactggcaggaacaaagcaacggacgccacatcgtccccggactcggtatctacttcctccaccccgacgaaggtaactggaccaccgaagaggtggaacgccaaatgcacttcatccgctccaaccggttggcaggcgaagcgcactaccgggtaaagtatctgatggacaacacccaaggggtatacgacctcctgctggatcatttctatcagtatccggcactacaaccgccgatgccgtggattgacaacgtctcccccaccgccccttcggcattgaaggctgtctccgccggcgacggatatacccgcctcaactggaaagccgctacggacaatgacaagcagaatgcccccatgtacgtggtctacgcatcggacacgtatccggtagatatcacgaatccggaaaatatcctcgtgcagaatctgcgggatacgcactacatatatgctcccatccgcccatggacagccagaaagtattttgccgtcacggctgtggaccgctgtggaaatgaaagtaaggcagctcaacaagaagaaaaataa

SEQ ID NO: 5073 - DNA, 906 bp, B.fragilis
aaattaattcataccatgaacagtataatcgtaggaatgggcgaagcgctatgggatgtgctgcccgaaggaaagaaaatcgggggagccccggctaattttgcttatcatgtgtctcagtttggtttcgacagccgcgttgtcagtgcggtaggaaatgacgaactgggtgacgagattctggaaatattccgggagaaacagttgaagcaccagctcgaaagggtgaactacccgaccggaacggtgcaggtgactctcgataacggcggagtgccgtgttatgacatcaaagagggagtggcatgggataatattcctttcacagacgacttgaaacggctggctttgagtacacgtgctgtctgtttcggttcgttggcacagcgcgacgaggtgagccgtgccactatcaaccgcttcctcgacaccatgcccgacatggaaggacagttgaaaatattcgatatcaaccttcgtcagaacttctacaccaaggaggtcttgcgtgaatctttccggaagtgcaatgtgctgaagattaatgatgaggaattgatccttatcagccgcatgttcggttatcccggcatcgacctgcaggataaatgttggattctgctggccaagtacaacctgaagatgctgatcctgacttgcggaacgaacggaagttatgtattcactcccggtacggtctctttccaggagacaccgaaagttccggttgccgatactgtgggggcgggtgattcgtttacagcggctttttgttcatctgttttaaaagggaagagtatccctgaggcacatcggctggcggtagaggtatctgcttacgtatgtacccaaagtggagcgatgcccgtacttccggaggctttgaggaatcgtttgaatgactaa

SEQ ID NO: 5074 - DNA, 2307 bp, B.fragilis
acgaaaaacaaaccgaacaaacgaacaacacaccgaatgaaaagtatgcggtccattcattcactcatacgttgctgtatgatcttactgctattgacctcctgttattcaaaagaagagcggcgggtattggtgatccactcttatgaaaaggattaccaaggatatgcagaattcaataaactgataaaaaaggaattcgccaaagctcacattcccgtagaacttactttcttctatctgaattgtgaaattaacaacgaacagcaagagatagataagatcaataactttctcgattctatttcgaaatggaaacctgaagttcttcttgttaacgatgaccaggccacttactcgttattggaaacccatcatccgttattgaagggaataccaatcgtattctccggagtcaattatcccaattgggaactgatcggacaatacaacaacgtcaccgggtttcacgacaagatagatttcagaaagaatctggaaatggtgcacaagctaaccggcaaaaaccatatttacaccatacttgactttacgttcttagaccggaaagtccgaaacgatattgacaaccaattgaaatcgacggacatcatatccaatctggactggcatctggacaaaaacgacacacggaaagaagcagaaaaaggacatataataattaatgcgctatctgcccgtaacctctccaagaaccagaataaggatcagacaaaaggtggagactttatctggtctatcagtaaatacagtaccctcccttatctacagacaaagtttgactacacaacggtcactatggcatctttgtccacccggcaacgctttacaacgatcaatgaacttttcgactgcgggcgcgactttctgggcggatacatcaccccgatgcatatccaggtagaagagtccgttcatgcggcggcccgtatcctcaatggagaaaacgttgccgacatacccattcaggaaagcgccaaaggatacttcatcgactggaatgccatgcaaaaagaacatctgaccatcgcggacattccccatgaatacaccattatcaacattccattcaagacccggcaccccatcgtctggtggttcgcactattaggcagcatcaccgccattgtcagcctgctgtcgggcatcacttacctgtattggcgtgaaacgaaaaggaaacgctccatcctgtacgaactggaagatgagaaagaatcgttggcgctggcagtcgagggaagcgatacatacgcatggcggttaaaggacgatacgatggtgttcgaatacgccttttggaaaaacttgggcatggctccccatccattgacgattgacgggttcctgtcctttgtggatgccgactatctggatacgacacaagccttattgacaaagaacgccaccaacggcaaacacttcataaagctgaaatgcgactttaacggtacaggataccaatggtgggaacttcggtgcagcaccatgaagagtgctctgggcggacagaaaaccaccggccttttattgaacattgaggactacaagaaacgggaacaggaattgatcgaggcccgtaaaatggcggaaaaggcggaacttaaagaatccttcctggccaacataagccacgaaatacgtacaccgctaaatgccattgtcggattctccaccctgcttgcctctccggatgatacggacatcacccccgaagagaaggaacagtatatagataccatcaaccgcaacagcgagttgttgctgaaactgattaatgatatattggaactttcgcgcatcgagtccggatatatgtcattcgactgtgatgactatccgctggatgcccttatcagggatacttatcagacacataagattctgattcccggacagctccacttcctgttggaagaaggcgaaaagggcctgatcgtacacgtcgacaaaaaccggttggttcaggtgatcaccaacttcctgaacaatgcctccaaatttacccgggaaggctccatcaaactgggatggagctacatgccgcaaaccgaagaagtggagatctatgtagaggacaccggaatcggtatcccgcagtccgaacaaaagatgatattcggccgattctacaaacagaacgagtttgcacaaggaaccggcctgggactctctatctgcaaactgatcatagaaaaacttcagggaaggctatcattacggtccgaagcaggcacgggaagccgcttctccattttcttttcttgcaaaaagcaatctatataa

SEQ ID NO: 5075 - DNA, 849 bp, B.fragilis
aatcattcaaaatgcaatagaattatgatcaacataggacaatatattgagacgctcatcaactggatgatgatacacttctccacttttttcgatgcactcaacttaggcatcggtagttttattaatggattccagcacatactgttcggcattcctttctatctgaccattgcggcaatggtgctgctggcatgggcgaaagccggacgcggggttgcagttttcacccttttaggcttgttgcttatttatggtatgggattctgggaagccactatgcagacattggcactggttctgtcatccacctgcctggcccttatcgtaggggttcccatcggagtatggacggcaaacagcaatcgtgccgagaaggtgatacatcccattctcgacctgatgcagaccatgccagccttcgtctatctgattcctgctgttttgtttttcggcctgggagtggttccgggagtatttgctacaatcatctttgcgatgcctccggtgattcgccttacagggcttggcatccgtcaggtgccaaagaatgtggtagaggcttcacgctcgttcggagctacccgatggcagttgctttataaagtacagttgccccttgctttgcccaccatcctgaccggagtgaaccagacgattatgatgtctctttccatggttgtcattgcggctatgattgctgccggcggtttaggagaaatcgttttgaaaggtatcacccagatgaaaatcgggctgggctttgaaggaggtatagccgttgtcatattggcaattattttagaccggattactcagggaatggtccgtcggaaggacaaaaaatag

SEQ ID NO: 5076 - DNA, 858 bp, B.fragilis
gatatgcgaaaatatagaataataggaagtttgttgctactggctgtgatgtgcgtagcctgtaacccggatagcgggaaaaagaagataagcattgcctatgccaactggttggaaggaattgccatgagtcatctggctaaagtggtgctggaagagaaggggtacgaagtggagttgctgaatgcagatgtagctcccgtctttgcatcggtttcccgtaagaaggcagatgtgtttatggatgcctggttacctgtgacaatgaaggattatatagatcaatacggtgatcagatagagtttatcggagaggtatatgatagcgcgagggtagggctggtggtacctcaatatgtcactatcgattcgattggggaacttgccgcctacaaagggcagttctcttccgagattgtcgggatcgatgccggagccggtattatgaaaactaccgataaggctatcggggattatggtctcgatggttataaattactcacctcgagcagctctactatgttggcttctttacagaaggctatggagaaggaggcgtggatcgtcatcaccggatggactccgcattggatgttcgaccgctatccattgaagttcctgcatgatccgaaaggtacttatgggaatgtggaatctatctatgtcgtcggatggaaaggatttacggagaaagatccttttgcggcaaagtttttcagcaatattaaattcactacagaagagattagttcgttgatgaaagcacttaaagatgcacgcatggacgaagaagatcttgtccgaaaatggcgcgacgaacatcgggaactggtagaaagctggatccctgaatcataa

SEQ ID NO: 5077 - DNA, 2730 bp, B.fragilis
ccgaccatgaaccgtatacttttcttactcggactgatgctgtcgggactgcttgtctcgtgcagtccggatgctccccgatataccatcggtgtgtcacaatgcagtgacgacacctggcgtcacaagatgaatgacgagatacagcgggaagccttgttctacggaggagtcaaagtagagacacgtacggcgcatgacgatagccggcgtcagatagaagacatacgatacttcatccggcagaaggttgacctgctgattgtagcagccaatgaaggaatggctctcactccggttgtcgaggaggctttcgataaaggaataccggtgattatggtagaccgcagaatactttccgataaatataccgcatacatcggagccgacaattatgagttgggcaaagccgtcggcaattacatagcccatcgcctgaaagggcgcggaaaagtagtcgaactgagcgggcttgtcggttctactcccgctatcgagcgccatcaggggtttatgagtgccatcagccaatatccggacatgaccttgcttgccagcgaagatgcaggatggctgcaacaacctgccgaggcaaagatggactcccttttgcaacgttttccggagatcgatgccgtatatggaatgaatgaccgtatggctgcaggggcttttcgggctgccggtcgtcgaggacgggagaaggagatgatttttgtgggcatcgatgccctgccgggtaaggggaatggagtggaactggtgctcgacagcgtactggatgccacctttatctatcccaccgaaggggataaagtggtgcaactggcaatggatattctcgaaaagaaaccttttgaacgggaaacgaagttgaagacggctgtagtcgatgcggtaaacgcgcatgtgatggagttgcagacaaaccatatcggtgagctggatggaaagatcgagacactgaacgaccgtgtggggatatatctctcgagggtggctacgcaacggatagtgttgtacggaggcctgatcatcctgctgctgatcgtcgggttgttgattgtagtatataaatcgctgcgttccaagaatagcctgaaccgggagctgtcacggcaaaaggagcagttggaagagcaaagagatcagctgatcgaactttcccatcagttggaagaggctacccatgccaaactggttttcttcaccaacatttcacatgatttccgtactcctctcactttggttgccgatcctgtggaacagctactggcagatccgtcgctggaaggtgaccggcgtagaatgttgttgctggtgcaacgcaatgtgcagatcctattgcgtttggtcaatcaaatacttgattttcgcagatacgagaccggaaaaatggagtttacaccggttccgctcgacctgttgcaatgctttgtagggtggaatgattcgtttcaggcggctgcccggcggaaacatatccacttctctttcgacagtgttcccgatacggattatcacacacaggcagatgcggagaagctggaacgcatttacttcaatttgttggcaaatgcctttaaattcactccggagaatggaaaggtcactgtccgtcttgcggctctgcagaaggacggcgcgcctttcttccgtttcacggtggccaataccggcagcctgatttcggctgaacacattcgcagcattttcgatcggttctataaaatcgataggcatcataccggttccggcatcgggttggcattggtgaaagcattcgtcgagatacatggcggaagtattagtgtggagagtgacgaacggttgggaactgtctttactgtcgatctgccggtgcggacttgtgaagagggggcttgtgtggtgactgctccgatggaggagtctgctccggaccgggtggacagcctgctccgtgaggatgaagcggaaaacctgaatgatccgtccaaaccttctgtccttgtgatcgacgataatgccgacatccgtgcttatgtgcatacgttgctcaattcggagtattcgattattgaagctgcggatggtaccgaaggaatccgtaaagcgatgaagtacgtccccgatgtgattatttcggatgtgatgatgccggggatcgatggcatagagtgttgtcggaggctgaagggagaactgcaaacctgccacattcccgttatcctgcttacggcctgttcgctcgatgagcaacgcatccagggatatgcgggaggagccgattcatacatctcaaagccgttcagttcgcaactcttgttgacccgtatccgaaatctgattgaatcgcggcagcgtatgaagcagttctttggcgatcggcagacgctggcgaaagaagacatttgcgatatggataaagattttgtggagaggttcaagtcgctgatcgaggtgaagatgggtgattcggaacttaatgtggaagatctgggcaaggagatggggttgagccgggttcagctttatcggaagatcaagtcgctcacgaactacgctcccaatgagttgctccgcatggcacgtcttaaaaaggcggcatctctgttggcttcttcggatatgacgatagcggaggtcggatatgaagtgggattcacatctccttcgtactttgcgaagtgttacaaggagcagttcggtgaaagtccgacggagttcctgaagagaagcggattataa

SEQ ID NO: 5078 - DNA, 645 bp, B.fragilis
acaaaaatgaataggtttcaccacagagtaacacagagtctcacagaatttaaatttcttgttcataggatgtttaagagaaaaatcttctctgtgagactctgtgttactctgtggtgcccccccaaaaacggaataatcatgaatataaccatacgccccacccggcttgaagaactcggccaagtgatgccattctacgaacgtgcccgccgcttcatggctaccaatggcaatgccaaccagtggatcaacggatacccctcccctgatgatatccggcaagatatcgaaaacgggagcagctatgtgtttgtaaacgaaaatcaagagttagaaggctgttttgctttcatccggggagaagatcccaactacaaagtcatcaaagacggcgcctggctcaacgatgccccttacggggtgatccatcgcatcgcatccggcggacgggtaaagggattgatggacttatgcctagaatggtgttcgtcccactgtccgaacctgcgtgtagacactcaccgtgacaataaagtactccaaaacattctcctaaagaacggtttcacctattgtggcattatttatgtgaaaaacggtacggaacgacttgcctaccaacgcactgccgttacccgatag

SEQ ID NO: 5079 - DNA, 846 bp, B.fragilis
agacacgtgaatccgggatgttactttgggggaagtgccacccaatactttatcggtgactttgacggagagaagtttgtttgcgacaataagcccgaaacggtgaaatggctcgactggggaaaagatcactatgcgacggtctgcttctcgaatacgggtgaccgtacgattgcggttccctggatgagcaactggcaatatgccaatatcgtgcctacccgtcagttccgcagtgccaatgcattgcctcgcgaactgagcctttatacacaagatggggatatctatatggctgccgccccggtggaagagaccaagtcattgcgtaaagaatcccgggagattccggcttttgaggtgggggatgcttatcatgtcgattcgttgttgtccgataataaaggggcttacgaaatagagttggaactggcagccggctctgccgagattatgggactgaagctgttcaatgaaaagggggagaatgtggatatctacatcagccttccggagaaaaagttggtgatggaccgtacgaagagcggcatcgtagacttcggcaaagacagtgccccgcatgccatcgaggcacacgatcgccggaaacagaactctattaattatgtagacgattttgctttgggtacctgggctccggtgcagaaagccggtaactataaattggatatctttgtagataaatgctcggtagaaatcttcctgaacggaggtaagattgctatgacgaacctgatattccctacaactccttacaatcagatgagtttctacagtcgtgggggagccttcaaggtggatcggtgcaagatatacaggttgtag

SEQ ID NO: 5080 - DNA, 1173 bp, B.fragilis
catatcatggaaaataccaaaaacaactcttacatgaaactcatcccggtgatgctctgcttctttgccatgggattcgtagatctggtgggcattgcctccaactacgtcaaagcagatttgggactgacggactcacaggcaaacatctttccgtcgctcgttttcttctggttcctgatcttctctgtacctacggggatgctgatgaaccgcatcgggcgtaaaaagaccgtgttgctcagtctggtgatcactttcgcatcattactgctaccggtctttggtgatagctatttgctgatgttggtctctttctcgttgctcggcattggcaatgcgttgatgcagacatcgctcaatcccgtgctgtcgaatatcgtgagcggcgagcgcttggcaagtaccctgacctttggacagtttgtaaagaccatcgcctccttcctagccccttatatcgctatgtggggagcgatcgaggccatccctaccttcgacttaggctggagagtgctgttccccatctatatggtggtggctgtagtcgctattttgttactcaacgccacgcagatcaccgaagagccggaagagggcaaaccttccactttcggtcagtgtctcgctttgctgggtaaaccctttatcctgctctcgtttttgggcattatgtgtcatgtggggatcgatgtgggtaccaatactacagcaccgaagattctgatggaacgtctgggcatgactctggcggatgccgggtttgcgaccagtctttacttcattttccgtacggcaggttgttttctgggagctttcattttgcagaagatggcggctaaaaccttcttcgctatcagtgtgttgtgtatgctggccgccatgttcgggttgttcgttttccaggaccaggcgatgatttatgtctgtattgccctgatcgggtttggcaactctaatgtattccccatcattttctcgcaggcaatgctctatatgccggacaagaagaacgaggtttccggcctgatgattatgggacttttcggtggaacgatcttcccgctggcaatgggagtggcttcggatgctgtgggacaaagcggagcggtagcggtgatgctggtcggagtactctatctgatgttttatacatggagaatcaagaaataa

SEQ ID NO: 5081 - DNA, 375 bp, B.fragilis
aggaactcactgtataaaagcaatacatccatgaaagattataaagaaaataaatctaatttgtccgaaactttttgtaatgaagtatacagtgtcgtgcgtgagattcctgccggtagtgttactacttatggcgatattgccgctttgctcgggatgccgcaatattcacgcatggtggggcgtgccttgaggcaggtgcctgccggtttaaacctcccttgtcatcgggtagtcaatgccataggccgattagtgcccggatgggacgagcagcggcggctgctggatgccgaaggtgtttctttccgtaaaaatggatgtgtagacctcaggcttcacaggtggagggatgacagtgtgctggccgattga

SEQ ID NO: 5082 - DNA, 1239 bp, B.fragilis
accctattatgtatgagtaaaataacgattaaagacttgtatctcatttttggcaatgacaaacagcatgctttacgcatgttgaaggaagaaaagagcaaaagtgagatattgaaggctaccggatgtacggtggccgtaaaagatgcaaacctatctatcagggaaggagaaatatttgtgattatgggactttcgggaagtggaaaatcaactttgctgcgttgcatcaaccgattgataaaaccgacctcgggcgaagtgatcattaacgggagagatatttctaacgtcactgataaagaattgctccgtatccgaagaaaagaactggctatggtgttccagcattttgggttgttgccccatcgctcggtgttgcataacatagctttcggactggaactgcaaggagtaaagaaacaggagcgggagcagcgggcgatggaaagtatgcaactggtaggactgaagggctacgagaaccagatggtcggcgaactgtcgggaggtatgcagcaacgtgtcggtttggcccgtgcgttggccaatgatcctgaggtgctgctgatggatgaggctttttccgctctcgatcctttgattcgcatacagatgcaggatgaattgctgaccttacaatctaagatgaagaagaccattgtgtttattacccacgatttgaatgaagccattaaattgggcgaccggattgctatcatgaaagatggtgaggtggtacaggtaggcacttcggaagagatcctaacagaaccggccaatgcttatgtagagcgctttgtgcagagtgtggaccgtagcaagattattaccgctgcatcagtgatggtagataaaccccttgtggcccgattgaagaaagagggaccggaggtgttgattcgtaaaatgctcgagcgtaacctgactgtgttgcctgtggtcgatgtaaacaatgtgcttgtgggagaggtccggctgaaagatttgctccgattgcgtcaagaccaggtgaagtcgatcgagtcggttgtccgggaggaagtgcattcggtgttgggagatacgatactggaagatattttaccgttgatgacaaaaaccaattcgcctatctgggtagtgaacgagacccgtgagtttcagggagttgttccgttgtcatcgcttatttacgaggtaaccggaaagaacaaacaagaaatcaatgaaatcattcaaaatgcaatagaattatga

SEQ ID NO: 5083 - DNA, 309 bp, B.fragilis
gcattggccggttctgttaggatctcttccgaagtgcctacctgtaccacctcaccatctttcatgatagcaatccggtcgcccaatttaatggcttcattcaaatcgtgggtaataaacacaatggtcttcttcatcttagattgtaaggtcagcaattcatcctgcatctgtatgcgaatcaaaggatcgagagcggaaaaagcctcatccatcagcagcacctcaggatcattggccaacgcacgggccaaaccgacacgttgctgcatacctcccgacagttcgccgaccatctggttctcgtag

SEQ ID NO: 5084 - DNA, 579 bp, B.fragilis
catcaaatcttgaacattatggattacgagaagcttgaacaactaaaacgcctccacgacagcggagcgttgaacgatgaagagttcgaaaaagaaaagaaaaagatattggacgaagaagctacggctaaacctacagccgtacttcctatgggactgacggaaaatgcttatctggcactgatgaatttcgccatgttcataccatacgtaggctggattgcccctattgtattctggatcatgggtaaagagaattctatactcgtcaatcgccaaggcaaatacattctgaactggtacatcagttggttcctgtacggcatcgcgctgacagtactttttgtaatattcatgttcagcggcatcttatccataaacgacatggattacgcaaatgatcagacttctccgttagcagttctgctgggtatattcggcggaggtgccggaatcttgctcctcttgatacttggaataggctgttttctttgtctgctgttccccatcatcggaggcatcaaaggactgaacggaaaaacatggaagtatccgctttccataccgtttttgaaataa

SEQ ID NO: 5085 - DNA, 1197 bp, B.fragilis
ttgatgctaatgacgaatctgctttacttgtttaatcccgatcaggatctggctcttgccagtggcgaagtcaattatatgccgcctgcctccgcccgcagaatggcggaagagttggcattgcttcccgtatggtttgcggacgggccgtgcagtgtgcttgctccgtctgcctataatcagtcttttctggaagagatgctcgacttatttccgcttcccgcatcattgagaacccaggccgaagatttttcggaagtccgttcggtggttccttggggatggaatccggcactccggaaacgtctgctttcattgggagtacccgatgctgcgctaccttcgatggaggatataggacggttgcgcgatctgtcccatcgtttgcaagccgtacggttgttgtccggtctgcaagtggatgaagtgttttgtggagagtcttgctacctgactgctttgtccgactgccgggcatttgtagagagtctggaacgctgtctgctcaaagcccccttgtccggaagcggtaaagggctgaactggtgcaagggagcgttcactcctctgatagagcgttggtgtgcccgggttatagagcagcaggggggagttgttggtgaacctatatataataaggtagaagattttgccatggagttttattcggacggaaaggggcggattatttttgccggatactctttgttccgtaccaatgccggtggggcttacgaaggaaaccggttgttgcctgatgcggagattgaacgaagattgtcggcttatgtgcctgtggcggctttacaccggcttcgggaggagttgcaaagacggttgtccgtctctttggggacggagtatgccggttatctgggagtagatatgatgatttgccggttcgctctccttccggagtttcgcatccatccttgtgtggagatcaacctgcggatgaatatgggacttgtgtcccggatgctatacgatcgttatgtacgacccggggctggcggaacgtttcgtatctcttatcatccgtctgacgggcaagcattgcaggagcatgatgcaatgacggttgcgcatccgttgcacacccgaaacggacgggtggtgaaaggctatctgccattggtgcctgtccggaagtcgagccgctatcgggcttatatcttggtggaaaccggcggataa

SEQ ID NO: 5086 - DNA, 3582 bp, B.fragilis
attacttacttaaatattatttttattatgactaaacagaagaaattcatcacatgtgatggtaatcaggctgctgcacatatttcatatatgttctcagaagtagctgccatttaccccatcactccctcttctacaatggctgaatacgtagacgaatgggctgccgcaggacgtaagaacatcttcggcgaaacagtattggtacaggaaatgcaatctgaaggtggtgcagccggtgctgttcacggttctcttcaggccggtgcactgactactacttacactgcttctcagggtcttcttttgatgatcccgaatatgtataagattgccggtgaattcctgccttgcgtattccatgtatctgctcgtacactggcttctcacgcactgtgtattttcggtgaccaccaggacgtaatgtctgcgcgccagacaggtttcgctatgttggctgaaggttctgtacaggaagtgatggacttggccggtgttgcacaccttgccacaatcaaagcccgtgttcctttcatgaacttcttcgatggtttccgtacttcacacgaaatccagaagatcgaaatgctggaaaatgaagatctcgctccgttggttgaccaggaagcgcttgccgaattccgtgcacgtgcgctgaatccgatgaatccggttgcccgtggtatggccgaaaaccctgaccacttcttccagcaccgcgaatcatgcaacaactactatgaagctgttcccgccatcgtagaggaatacatgaatgaaatttctaagatcacaggtcgcaaatacggtttgttcgattactacggagcagaagatgcagaacgcgtaattatcgctatgggttctgtaacagaagctgcccgcgaagctatcgactatctgacaagccaaggagaaaaagtcggtttggttgcagttcacctataccgcccgttctctgctaaacacttcctggccgccgtacctaaaacagctaaaacaatcgcagtactcgatcgcacaaaagaaccgggtgctaacggtgaacctctgtatctggatgttaaagactgcttctatggcgcagaaaatgctccggttatcgtaggcggtcgttacggtctgggttctaaagatactaccccggcacaaatcatcgccgtattcaagaatctggctatgccgatgccgaagaaccacttcacaatcggtatcgtagacgatgtaaccttcacttctcttcctcaggaagcagaaatcgctctgggtggcgaaggtatgttcgaagctaaattctacggcttgggtgctgacggtacagtaggtgccaacaagaactcagtgaaaattatcggtgacaacacagataaacactgtcaggcatacttctcttacgactctaagaagtcaggaggtttcacttgctctcacctgcgtttcggtgacgatcctatccgttctacctatctggtaaacactccgaacttcgtggcttgccacgttcaggcttacctgcacatgtacgacgtaacccgtggtctgcgtaagaacggttcgttcttgctgaacactatctgggaaggcgaagagctggctaagaacctgcctaacaaggtgaagaaatactttgcacagaacaatatctctgtatattatatcaacgcaactcagattgcacaggaaataggtttgggcaaccgtaccaatactatccttcagtctgcattcttccgtatcacaggtgtaatccctgtagaccaggctgtagaacagatgaagaagtttatcgtgaagtcttacggtaagaagggtgaagacgttgtaaacaagaactacgcagccgttgaccgcggtggcgaatacaagactttgactgttgacccggcttgggctaacctgccggacgatgccaaggttgaaaacaacgacccggcattcatcaacgaagtagttcgccctatcaatgctcaggacggagacttactgccggtatctgcattcaaaggtatcgaagacggaacctggtatcagggaacttctaaatacgaaaaacgcggtgtagctgctttcgtaccggaatggaacgcagaaaactgtatccagtgtaacaagtgtgcttacgtttgtcctcacgcttctatccgtccgttcgtactcgacgctgaagagcagaagggtgccaacttcgagatgctgaaagctgtaggtaaacaattcgacggtatgacattccgtatccaggttgacgttctcgactgtctgggttgcggtaactgtgccgacatctgtccgggtaacccgaagaagggtggcaaggctctgactatgaaacaccttgaaagccaattggctcaagctgataactggacttactgtgcagacaacgtgaagagcaaacaacacctggtagatatcaaggctaacgtgaagaactctcagttcgctactccgttgttcgagttctcaggagcttgttctggttgtggtgaaactccgtatgtgaaactgatttctcagttgtacggtgatcgcgagatggttgccaacgctaccggatgttcttctatctattccggttcagtaccttcaactccatatactaccaacgcaaaaggacacggtccggcttgggctaactcactgttcgaagacttctgtgagtttggtttaggtatggaactcgctaacgaaaagatgcgtgcacgtatcgtgaagttgttcaacgaaatcctggcagccgacaatgctcctgcagaagctaaggaagtattgaaagcatggatcgaaaacatgtacgatgcagataagaccaaagaactggctccgcagatcgaagcaatcatcgaacaaggtatcgcagcaggttgcccgatcagcaaagagctgaagggcctgactcaatatctggtgaaacgcagccagtggattatcggtggtgacggtgcttcttacgatatcggttacggcggtctcgaccacgttatcgcttcaggtaaagacgttaacattctggttctggatacagaggtttactctaacacaggcggtcagtcttctaaggctactccggtgggtgctatcgctaagttcgctgcttccggtaagcgcgtacgtaaaaaagacctcggtctgatggctactacttacggttatgtatatgttgcacagatcgctatgggtgctgatcaggctcagactctgaaagctatccgcgaagctgaagcatatcccggaccatcactcatcatcgcttatgctccgtgtatcaaccacggtctgaaagccggtatgggtaagagccaggaagaagaagaaaaagctgttaagtgcggttactggcacttgtggcgttacaacccggctctggaagcagaaggcaagaatccgttcacactggatagcaaagaaccaaattgggatgacttcaaaggcttcctgaaaggcgaagttcgttatgcatcagttatgaaacagtatcctgcagaagcagaagaactgttccaggcagctgaagacaacgcaaaatggcgttacaacaactataagcgtctggctaaccaagcttggggtgcagctgaataa

SEQ ID NO: 5087 - DNA, 846 bp, B.fragilis
  unsure (782),(806),(824),(825),(828),(829),(830),(832),(837),(838),(842),(845),(846): Identity of nucleotide sequences at the above locations are unknown.
cagctttctctcaggatgttaaggccaaaccgggcctataccctggtggccaacacaggaaaacaaatcaggtacggagaattattcaaccgactctccggctatgatgttatcttcctcggggaactgcataactgccccatcacccattggctggaattcgaaataacccgttccatctataacattcataaagatcaactgatgctgggagccgaaatgttcgaaagtgacaatcaactgatttttgacgaatacatgcagcaaaagatctcttacgaccgctttgaggccgaagcccgtctatgggataattaccggactgactattatccggttgttttctttgccaaagaacatcacattccgttcattgcaaccaatatcccgagacgctacgccaacattgtaaaaaataaagggttcgaagcactcgactcgttatccgaggaagccaaacgatatatagctcctttaccgatcgatttcgaatatgatgaagcccaaagcgcagcagctttcagtatgatgaacatgatgggaggacgccgggccggcgacaatcggaagttggcacaggcacaagccataaaagatgctacaatgggatggttcatagcccgtaatatcaaaaataaattcctgcatatcaacggtagttatcattccaaccgacagggaggcatcatcccttatctgctccgttaccgccccaatacgagtatagtgacggtaacctcggtacgtcaagagtccatccggaaacgtcttcacaacggggntggaaggttcaacagtcctcgtgnttcatcgagtctcgtaannacnnnanccggnncatnctnn

SEQ ID NO: 5088 - DNA, 843 bp, B.fragilis
tcttcgttgcgccaccgcggatccttccagccccgtggtgaagacagtgataccaaaaacccagctgtagcagcagccggcacaacactgcttttcggagttccgaatatcatctccgaacagaaacagactcaagaccttacaggataccgcccacgtaaagctcacacttacgattacgcacagactaagggtgacgaactgctggggaccaatgcttgtgttgtcttccgttctgcagaagctaacctcaattacatggaagcctgctacgagaaaaccggttcactggatgccaaggcacaaaagtattggaaagcactccgcacacgcgccggtgttgacgacgattatgccaagactattgcagcaaccgacttgagcaaagaaaatgacttagccgtttactcgggcagcaaaatggtggatgttaccctctataatatccgtcgcgaacgccgttgtgaattcatcggtgaaggtatgcgctgggacgacctgaagagatggcgttcctgggatcaattactgaccaaaccctatatcattgaaggtatcaacttctgggatgccgcttataaagatcacaaggacattaaggacgatggtacccttgatgcaaacgtttcgcccaaaagcgacagcaaatacttacgcccacttcgcagaacctcaatcaataatgaattgtatgacggtctgacttggcgtaaagcattttatctggatccgatcggcatagaagatatgtctttgaccgctaccaatccggaagatatcaacacaactcagttgtatcagaatccttactggccgatgactgccggtaaagcattggaatag

SEQ ID NO: 5089 - DNA, 1854 bp, B.fragilis
agcctttctcactacagtggggaaggctctttacttaaaaggaatattgaaatgaaaaagcagttacgcagttcgttcagcacacagggtcgccgcatggcaggcgcccgggcactttgggcagccaatggtatgaaaaaagagcaattaggcaaacctatcattgccatcgtcaattcgtttactcagtttgttccgggacatgtacatctacatgaaataggtcagctggtgaaaaaagaaattgagaagctgggatgctttgctgcggaattcaatacgattgccattgatgatggtattgccatgggacatgacggaatgctttattcccttccttcccgggatatcattgccgatagtgtggaatatatggtgaatgcccataaagcggatgccatggtatgtatcagcaattgtgacaaaatcactccggggatgttgatggcggctatgagactgaatattcctactgtatttgtatccggaggtccgatggaagccggtgaactggatggacagcatttggacctgattgatgcgatgattaagtcggccgacgaaagtgtgagtgatgaagaagtctccaagatcgagaatcgggcctgtcccacttgcggatgttgttcgggaatgtttaccgccaattcgatgaactgcctgaacgaagcgatcggtctggctctccccggaaacggaacgattgtggcgactcatgccaaccgtacccaattgttcaaagatgctgcgaaactgattgtagaaaatacctataaatattatcgggacggcgatgaaagcgtacttccccggagcattgccacccgtgaggcattcctgaatgccatgacgctggacatcgcgatgggaggatctaccaatacggtacttcacctgctggcgatagcccatgaagcggaggcggactttaaaatggacgatatcgatatgctttcacgcaagagcccatgcttgtgtaaggtggcgccgaatacacagaagtatcatattcaggatgtaaaccgtgccggaggtatcatggggattatgggacaacttgccaaatccggattgatcgatacgtctgtagtgcgtatcgacgggatgacattgggtgaggcgatagataaatatgatataactagcccgaacgtatgtgaagaggctattaaaaagtataagagtgcggctgccggaaagttcaatctggtgctcggctctcaggacgtctattataaagagctggatacggaccgtgccgaagggtgtattcgcgacatagagcacgcatatagcaaagacggaggactggccgtactgaaaggaaatattgcccaggatggttgtgtggtgaaaacggccggagtggacgagagcatctggaagtttaccggtccggcaaaggtgttcgattcacaggaagcagcctgcaatgggatactcggaggaaaagttgtcagcggagatgtagtcgtcatcacgcacgagggtccgaagggaggtcccggtatgcaggaaatgctttatcctacctcttatatcaaatcgcgccacttgggcaaggagtgtgcgctgataaccgacggccgtttcagcggaggtacatcgggactcagcatcgggcatatctctcccgaagcagcagccggaggtaatatcggaaagattaaggatggtgatatcatcgaaatcaatatccccgaacggactatcaacgtgcgactgaccgatgaagaactggctgcacgtccgatgactccggtcactcgtgaacgctatgtgcctaaaagtcttaaagcgtatgcaagcatggtaagctctgccgataaaggagcggtgagactgattgattaa

SEQ ID NO: 5090 - DNA, 1710 bp, B.fragilis
tacatgagtaaagatataatttcaggcggtgaagcattaatgcgttctttggaatatcatggtgtaaagacgatctttggttatcccggaggatctatcatgcccgtattcgatgccttatacgatcatagagagactttgaatcatattttggttcgccacgaacaaggggcggcacatgcggctcagggatttgcccgtgcttcgggtgaggtcggagtttgcctggtgacgagcggccccggtgctaccaataccataaccggtattgcagatgcaatgatcgacagtacaccgattgtagtcattgccggacaggtgggaacagcttttttggggacagatgcttttcaggaggtcgacttggtaggcatcacgcagccaattacaaaatggagttatcagatccgtcgtgccgaagatgtgccatgggcggtggcccgcgccttttatatagcgaaaagcggacgcccgggaccggtagtgctcgactttgcaaaaaatgcccaggtagagaaagccgaatatatgcctgcgaaactcgatttcatacgcagttacgtgcctgtacccgagactgacccggaggccgtgaaagcggctgccgaattaattaacggtgcagagcgcccgttggtattggtggggcaaggtgtggaactgggcaacgcacaacaggaattgcgtgctttcatcgaaaaggcagatatgcccgccggatgtacgttgttgggactgtcggctttgccaaccgagcatcctttgaacaaaggtatgctgggaatgcacggtaatctcggaccgaatatgaacaccaataaatgtgatgtcctgattgctgtcggcatgcgttttgacgaccgtgtgaccggaaacctggctacgtacgccaagcaggcgaaagtgattcattttgatatcgatccggctgaaattaataagaatgtacatgcagatgtagcgggtctgggtaactgtaaagagacgctctctgctgttacggcattgctgcagcccaacgagcataaagaatggctggatagtttcctgccttatgaacaggtggaagaagaaaaggtaatccgtccggaattgcatccgatgggagatacgctttcgatgggggaagtggtgcgtgcggtaagcgatgcaaccaatcatgaagcgatattggtgaccgatgtcggtcaaaaccagatgatgtctgcccgatactttaaatattcaaaagaccggagtatgattacttccggaggacttggtaccatgggattcgggttgccggctgctatcggtgcaacctttggccgaccggaccgtacggtttgtgtatttatgggtgacggtggtctgcaaatgaacattcaggagttgggaaccattatggaacagaaggcaccggttaaaattatcgtatcaaacaataatttcctgggcaatgtacgccaatggcaggcaatgttcttcaaccgtaaatactcgttcacacccatgctgaatcccgattatattaagattgcttctgcttatgatataccggccaaaagagtctttacccgagaagaactggctgatgcgattgacgagatgattgcgacagacggtccgttcctgttggaagcttgtgtgattgaaaagggaaatgtgttgccgatgacccctccgggaggttcatttaacccaatgttggttggaatgctaataagttag

SEQ ID NO: 5091 - DNA, 708 bp, B.fragilis
gacggtagccggtatgtgatggcggcagatggggcagacggactggtgaacgggactgtttgcgggctgaaagcttccttggctgtcgatgtgcagggatatgcttacagggttgtaaaaataggtagcctctactggatgggagaaaatctgaagacaacccaatttaatgatggtactcctattcctaccggttttgccacatctatggattggggaattcagtgcgggaaaggtcttccggcctgtcaagtcgaccgggcggttaatgccaatgctccgggagctatgcaatatcgtaacctgtacggtgtactttacaatcagtttgcaatgaaaggaaatatagctccccaaggatggcatgttccttctaaagcagaactgcaagcattggtagactttgtgggggcagatgcacgtaaactgaagtcgacagctgttgggaaaggaattggaaattggttggaggatacgggaatagaggcgaacaatctgaccggttttacggctttgcctgctaatacggttaatggcggtaatggcagtaccggagcccaggaaacaacagggcagtggtggtcgacggaaacgagttatcgcatccggatgtcctacaaatctaattctgtagaactgttgacttctggcaatgcgttggcgggtgaaggtaacagcattcgttgtgtccgggatgcaaattattaa

SEQ ID NO: 5092 - DNA, 238 bp, B.fragilis
cccaatgttggttggaatgctaataagttaggaattatggataagactttatgtctttcccacggggcctggaaagatcccccgctggctttatcaatggccatagcttgtttctggtgtgaaaattggtattccgttcacaattcccacccaataataacaaactcggaaaacattaaaatgtataaaccctgtgggtgccctaatggagtgaaccctacactcacaattatttgcg

SEQ ID NO: 5093 - DNA, 2157 bp, B.fragilis
cttctggcaatgcgttggcgggtgaaggtaacagcattcgttgtgtccgggatgcaaattattaatttaactctaatgaatatgaatcatataatcaaactattgtttctctgtctgttcttcgcaaccgcctgtagccaggaggagatgaacgaggtgttgaagaatcacgcggaaatggaggggcaggtaaactctatcgaggagttgtgcaaaaatatgaatagggatatcgttgctttgaagctgatcattaattcgtctgaatcaggtgattatattaccggtttcaaggaacttgcagacggaagcggctataccatcagttttttcaaaagtggtacgattgtcatcaagaatggcgagaaaggagacgatggtaaaaaaggagaagatggtcaggatggtcagaatggtcagaacggtaccgatggcaaagacggtcaggatggtaccgacggtaaagacggtcaagacggtatcgatgggcaagacggacaggatggtactgacggtaaagacggtcaggacggtaccgatggtaaagatggccaggacggtaccgatggtaaagatggccaggatggaacagacggtacggacggtccggaaggagacaaaggacagaatgggacagctcctgtcgtcactatgaaaatggatacggacggacatctgtattgggctatcaagaatgccgatggaacatcttcttttcttttggacaacaacgggcaaaaggtcagagcttcgggaaccgatggtattgttccggtcattggggtcaatgcggcaggatactggacgcttgattatgggagcggtcctgtcgaattgaaagatgctgcgggcaatccgatgaaagcgaaaggtgcgtccggtgatcctatgttccggaaggtggtcagtgaagacggttatattgtattttatctgactgatggaaccatatttaaagtgccggagtggggaggggcacaggtagaattggcggcttcgggagtgacgtattttcatcggagtgagtctctgacctttacgtttacttgcagtggcgtaaataaaagtattgctccggtatgtacggctccggtcggttggacagttacggcccaatatacgtcggacaccaccggggagatgacggtgattgctcctgataaaagctcggccgatggagccttgtccggtactgctattcttgaattgacagccaaggacggcaagaagttgtcggcaacgctcggagtcactttattgcttgaatttaaagtgcccgattcttcccgttcgtttgtttatgaactttatgttgagggagtgaaagtaggagaactatgtcatgagtttattcccgattattcatttggatcgggtaaaagtgcctcggtcttttatccttataatgtttataacaaagcgtttggcgaaggaatggtattggataacggagggaaagtagactatctgactaccgtttatacgccgggtaccaatacgcaaccattcacctccctgtttacagaagacggagtgagttttataaccggcgattatatcggctactcggatagtcaggcaaacggactccgtccttatctgactactgataatgaaggcaactcatatcgggtgatgaaaatcggtacccaatattggatggcggacaatctgcggacgataacaaacagtgcaggagtcatttcttcggaatggagaaaagatgctaacccgagatatgctgtatatggttttcccgccggcattacggaagatagccggaccattcgcaatcaatatggactgttgtacaatgcaggtgtgttttccggttctacgtctttagttactgaaggctggaaaataccgaatcatttgggcgattgggataaattgcggaatttcctgggtggggattctaaagtggccgaggcattgagtattgccgggtttgtgggaaaacccggtggacggcgtaatgctgatgaaccttttgctttccaggaaaaagatgaagtcgggtattggtggtttagcagtgtcgatgggcataattgctgggcgctctccatcaatccttcgaatgtatccgtaccacaatctacgaatacatatagtcgtggttacggatttagcatacgttttattcgtcagtaa

SEQ ID NO: 5094 - DNA, 1194 bp, B.fragilis
ttaataatagtaaacatgaaaaatataattgggattctgggagtttttattttggcaatatcctgttccggcggtaagaaggagtctgcggatgccggtctggaactgacagaagattctgttgtttatttattggccgataatgtgacgttaggaataaaggctctattcccttttattgataaagatgggcatgaatacctaacttttcagaatcaattggaaccagagatttgtgtttatgatttgcagtcgggagagtttgtgaaaagcatcttctttgatagagagggggctaatggtgttggtatgttcggaggatatcatattattgattttgatgaaatatatttgcccagtttgcaacaaagtaaagtgtttgtgatggaagagtcgggcaagaaaaaacgtgagattataactgagaaaacggatgatgggatacctctattgcctttcggagccataacctttgcatatcgccctatttactttaataacaggaaaatgtatataccccaaaccatcaatatgcgtttagggaacaaagtgatggaaaaatctcctgtctacgtcgtggttgatacggttaaaaatgtgctcagtccttttccaattaagtttcctcctattatgtcttcggatgatgttactaaaccatccttaggtaatgaactctcatatagttgctgtttaaatgacaaggatcaatttgtattctctttcttttttgatgaagatatttacgtagtttctctacaagatggagaaatgaaaaaaatcaaagtaaagagtcgatatatcgataagcctgcaatcaaggagaatcctccacaggattttgatggggcgatgaaagcaagctcagaaattccttgttacggaaatctgatttatgataaatatcggaaagtctattaccgttttgtatacttgaaaacggatttggacggggagaaaaattatctgaatatatggcaatatgggcgtaaatctttctctataatgattctgaatgaagattttgatgttatcggggagactcgttttccggattttacgtatatatctaccttgcactatataggtaaagacggcttgtatttaagtgacagccattacaagaatccgtcttttgatgaaaacaaactgagattccggcgttttaaattagtacattataataagaaatag

SEQ ID NO: 5095 - DNA, 915 bp, B.fragilis
agatattctaaaacattgaaaacattattatatatattggtattttctttgtgctatacgaatgcatattgtcaaagtataccaagggaagtgacattagatgaagtgataaacagactatctctggaatcatcatcggctaaaatagaattacttaacttccaaaatgacttattgcgatacgagaattataagaaaagctttctccctgcatttgtgctgaattttaatcctatcaattttaacaggtcactgcgattattgcaacaaccgatcgatggaagttattcttatgtagaggacaattcaaataatactaattttggtactactgtacgacagaaaataagcataacaggaggggaactgagtattggaagtaatataaattatttgaatgagttttcacgtaaacaaaacagttttagtacaaatccgttttttataagctattcgcagcagttgtggggaggaggaaaattacaaaggttggaaaacaaaattgaacgtgccaaaaacgaagtggccgtgaaacaatattgttcaaacattgcccagatccagcaacaagcattgacgctttatttatccgccatactgagtaagatggatagtgaacttgctatagatatcaaacagagcaacgacactctgttacatattgcagagataaaattgaggaatggaagtatcactgaatatgattacaagcagatggaattgcagtccttaaacttgcaatacatgtatgaaaatgcggtcaaacactatgcggaatcaatacaaaaactttttacttttttaggaatagaaaataatgccgaaattacaataccggattttgacttacccttaactatcgatgctcgtcttcaccacgggggtggaaggatcagcgcacatgtatcattgacg

SEQ ID NO: 5096 - DNA, 252 bp, B.fragilis
cctcggagtgaaggatatgtggtatactctgtcgaacaggcggaagggagtatcatgttggatgagttaacactggaccgttcgaagaaatatgctgtagttatgggaaatgaagtaaaaggagtgcagcaggaggttattgaccattcggatggttgtattgagattccccaatatggcacaaaacattcattgaatgtatcggtaacagcaggaattgtgatctgggatttatttaaaaagttgaaatag

SEQ ID NO: 5097 - DNA, 243 bp, B.fragilis
actgaccccctcgatccttccagccccgtggtgaagactttatacaaatatcgtgtatttatttctgattttaaagaaaataaagaaaaatttcaagacaataaattccccaatagcataaacgtatcaaagcgcatcaaacagactacgtatcattcattctttatttactcgcatcctgtttgggtgatatacccaaaaccactacctttgcaccctcaaaacccaaacaaaagcgactga

SEQ ID NO: 5098 - DNA, 423 bp, B.fragilis
ttcagaacagatataaaaatgacagcacaagaatttttcaaaaacgacctgtttgccaccaatgcgggtgtagagctgatcgagatacgagaaggatacagcaaagcaaaactggaaataaaacccgaacatctgaatgcgggacaacggacacagggaggcgccatctttactttagccgatctggcacttgcagcagcagctaactcacatggcacattggccttttcgctctcttccaatatcactttcttgcgcgccagcggccccggagacacactctatgccgaagcacgcgaacgctataccggacgcagcacaggttattatcagatagatgtaaccgatcaggaaggcagactgatagctaccttcgagtcgagcgtattccgcaaaaaagacgaagttccgttcactttgtga

SEQ ID NO: 5099 - DNA, 915 bp, B.fragilis
gcacaaagccggacgaacttaaaaaacagaaaccagatgaagacaagaagaaaaagacccgagatagtcaaaacgcaaaccgtagccgccgcaattaggcggaaagagtggatatgtcttattatcgccctgctttttgctttcccatcatcgggcaatgcccagtgtgaagcaaagaacgatgcgtttaagtccggtgagcacgtcatgtacgaactttatttcaactggaaattcatttggaagaaagtgggacttgccagccttactactaactcgacgacttatcactccgagccggcctatcgggtcaatttattggccattagcagtaaagaggccgacttcttctttaagatgcgggatacgctgacaagcgtcatgactgaaaagctggaaccccgctattttcggaagggagccgaagaaggaaaacgttataccgtcgatgaagcccgtttctcgtttcgggagggcatgtgttatgtcaatcaaaaacgggtgcgtaaagacgggagtatcaccgagacggagcaaagtgacaatcgttgtatctatgatatgcttactattctggcgcaggcccgttcgttcgatccaaaggaatataccatcggtcaacgtatccagttcccgatggcgacggggcgtagagtagaagaacagaccctgatttaccggggaattaagaagattactgccgagaacgatactacctatcgctgcctgatattctcactcgtggaatataataaaaagggaaaggagaaagaggtcataacgttctatgtgacggacgaccggaatcaccttccggtacgtctggatatgcaccttaactttggttcggccaaggcattcctgaagagtgtcagtggttaccgacatcctcagacttctattgtcacaaagtga

SEQ ID NO: 5100 - DNA, 963 bp, B.fragilis
cataaacgtatcaaagcgcatcaaacagactacgtatcattcattctttatttactcgcatcctgtttgggtgatatacccaaaaccactacctttgcaccctcaaaacccaaacaaaagcgactgatgaaatacaaactcctcgtactcgacttggacggaacactgaccaacgctaaaaaagagataactccacgcaaccgagaagcactgatacgtgtacagcaacagggtgtgaaactgatacttgcatcgggacgtcctaccttcggcattgcacccttggccgacgaactgcgcatgaaggagttcggcggatttatcctctcctataacggcggagaaattatcgactggagtaccggagagatcgtttatgccaatgtattgccggacgaagtgatacctcggctatacgaatgcgccacacgcaaccaactccctatcctgacttacgaccggcaatatatcatcactgaatatcccgatgacgtgtatgtccggaaagaggctttcctcaataaaatgcagatatatccttccaaggattttctgaaagatatccgtctgccgcttcctaagtgcttgattgtgggtgagccacatcgtctgattcccattgaagccgaactttcggtagaactgcaaggtcaactgagtgtttaccgctcggagcccttcttcctcgaactggtaccacagggaatagacaaggcacaatctttatctgtcttacttaacaagctgaacatgaaccgggaagagatagtggctgtaggcgacggctacaacgatctttcaatgattcaatttgccggattgggtgtagccatgggcaatgcacaggaaccggtaaagaaagccgccgactacattacccttagcaacgaggaggacggtgtagctgcggtcgtaaacaagttctttacaaaagcacccgagaagggggagacaacagcttaa

SEQ ID NO: 5101 - DNA, 1488 bp, B.fragilis
atctcaaacgttatggaacatcaactgacgatttacaacactttagatagaaaaaaagagctgtttgtgcctttgcacgctccacatgtgggcatgtatgtctgcggaccgacggtatatggcgatgcacatctgggacatgcccgtccggccatcacgttcgacgtactcttccgttatctcacccggttgggttataaagtgcgatacgtgcgtaacattaccgacgtaggccacctggaacatgacgcagatgaaggcgaagataagattgccaagaaagcccgtctggaacaattggaacccatggaagtagtgcaatactacctgaaccggtatcataaagccatggaggcactgaacgtacttccccccagcattgagccacatgcctcgggacatatcatcgaacagatcgaactggtaaaaaagattctggatgccggctatgcatacgaaagtcagggttcggtatatttcgatgtagccaaatacaataaagaccaccattatggcaaactctcgggacgtaacctggacgatgtactgaatacaacccgcgagctggacggccaggaagaaaaacataatcctgccgactttgctctttggaaacgggcacaaccggaacatatcatgcgctggccttcaccatggggtgacggtttccccggctggcatgccgagtgtacggctatgggacgtaagtatctgggcgaacacttcgacattcacggaggaggcatggatctgatcttcccgcaccacgaatgcgaaatcgcacagtcggtagcttcacagggtgacgatatggttcactactggatgcacaacaacatgatcaccatcaacggcaccaagatgggcaagagtctcggaaacttcatcacgctggatgaattcttcagcggctcgcacaaattgctgactcaggcttacagcccgatgaccatacgcctctttatcttacaggcacactaccgcagtccggtggatttcagcaacgaagccttgcaagcagcagaaaagggactgagccgactgatggaagcagtagacagtctggaaaaaatcactcctgcagctacttcgaacgtcgatgtaaaaagcttgcgcacgaagtgttttgaagcaatgaacgatgacctgaatactccgattgtgatttcacatctctttgacggagccaagatgatcaataatatcattgccggcaacaacaccatttctgccgatgacctgaaagacctgaaagaagtattccatacattctgcttcgatatcctgggtctgaaagaagaaatcggttcgtcggacggacgtgaagccgcttatggaaaagtggtcgatatgttgctggaacaacgtgtgaaggcaaaagccaacaaagactgggcaaccagtgacttgatccgtaacgaactgactgcattgggattcgaaattaaagatactaaggacggatttgagtggaaactgaataaataa

SEQ ID NO: 5102 - DNA, 645 bp, B.fragilis; identical to SEQ ID NO: 2043

SEQ ID NO: 5103 - DNA, 189 bp, B.fragilis
aattacccgccccacatcagaaaagccataaaggcttttctttattacctcaaaattcctaaaaacacaatcttctttttacctaaaaaactttcaataacctattctttttttacctttaaaaatctttacctaattgaaaatcacttgaaaattttttattaccttaaatctttatctaatacctaa

SEQ ID NO: 5104 - DNA, 222 bp, B.fragilis
agacattcactgcccactgggattattgcaacaaaatactcagatggattcttccttccttcccggaaaacgaatttaataagtattgcacttattgcaacggcattgctttgctacgactggagtctgtctctgaagtggtggagcttactttatatactgatgttcatcatttgtctggctatcccggattatctggtacgacaaaaaacaaaaaaataa

SEQ ID NO: 5105 - DNA, 1359 bp, B.fragilis
ataacagtgccctcccggggtcaggaaggccgtttactaacacattattcaaaaacatcaatgaacaaaagatgcttactgaccatcctcttgggaggatgcgcggcaatgggtgcatttgcacaacaacacgcgacaggcaagaagacagagatgagtgttgacctgaatcctgtagttgtaacaggtaccggtacacaccaaaggctcaaaaacacaccggcaccggtggaagtagtaaccgccaatgaaataaagaaagccggcatcacagactttcagcaggcaatgaccatgctggttccttctctttcgttctctaccaactcaatgggatcttacctgatgatgaacggactctccaataaatatgtgctgattctgatcaacggacgtaaactgaccggagataccgctaataatatcgacctctcacgcattgatatgagccgtgtgaaacgcatcgaagtgctggatggtgccggttcgtcactctatggctctgacgccattgccggtgtgatcaatatcatcaccaacgaaccgaaagaactgatgcaggtgacttctaccacccgatatgaagatcatcgccaactgacacaaatggtaaatgcggatattgcaacagaaaagttcggctcatatacctcctataaacacgaacaaagtgcaggatggcagaacagcgatctggcatatgttactgataaaaaaggtaatgtatcgacagtaccgaccgtatcagctacatccaatggtttccattctaatctggtaaaccagaaattcacgttcgaaccgactgaaaagctctcgttctatgctaacggaggatactattggaagttgacggaccgccctgtatacacagcggatatcgatggaggttccaagtatgatctacattacgaatcgtataacttcggtttaggaggacgttacaaaatcaacaagcgttcttccatccaactcgatttgatgaatgataactatatgcagaactacaaatatactgtagctgacgataaaaataagattgctattggagattacgccaaaaccaaagagcagcacttttatgatgcagagctaaagggaatcttcaactttgccaaaaacaacatgacggtactgggagtggattaccgctctgaaagcctggatcgtcccagtgcaagggtggacaagtcagtgtatacggcatctgcttatgcgcaacacgaaatcaagttatggaactgtttgaccggtattgccggcgtacgctatgattatcacgagctggcaggcggacgcttcactccgaagctggctgtggtcttcaccacgggggtggacagaaccgggcttcatctc

SEQ ID NO: 5106 - DNA, 234 bp, B.fragilis
cctgtaaagcatgacgggaaggtagcttttcaaaaagggatagtcaggaaacctgccgaagcagacatagataacagtgccctcccggggtcaggaaggccgtttactaacacattattcaaaaacatcaatgaacaaaagatgcttactgaccatcctcttgggaggatgcgcggcaatgggtgcatttgcacaacaacacgcgacaggcaagaagacagagatgagtgttga

SEQ ID NO: 5107 - DNA, 630 bp, B.fragilis
agtaaagaaacaattaatgtaaagttaaactttaagagagaatttatgaaaagaaaattaatgctgttattgacttgcctttttatgggtataggtctagtaactgcccaaactcagaaggtaacaggtgttgttatttctgaagaagacgggcaaccagttgttggagcctctgtattggctaaaggcaccactgtaggtgttattactgatgtagatggtaaatttacattatctggtataccaagttctgcaaagactttgcagatttcgtacatcggaatgcagactgctgaggtagcaattgcaccggtaatcaaagtgatattaaagactgatgctaaggcacttgacgaagttgtagtaacagcaatgggtatctcaaaagagaaaaaagcgttaggatatgctgtgcaggatgttaaaggagataagctgactcaggcttcaagcagcaacctttccagcgctttgcaaggtaaggtttcaggagtggaaatatctccgtcatcaggtatgccgggtgcttcttctaaaatgactattcgcggttcacgttcatttacaggagataatactccattgtacgtagtagtcttcaccaagggggttcatccaacggtgttcatt

SEQ ID NO: 5108 - DNA, 207 bp, B.fragilis
tgcagatgctatcaatcacatgctttacaagtttatgcagaaattgagaaaaaagaattgggattggtgcaaccagggaaacagaattcattggatttatttaaagattcttttgaaaataaaaccaaggccctcaatttattgattttttcccacgaaattccaaaaacttctttgaaggaaagcccaaaacgcaattttttttaa

SEQ ID NO: 5109 - DNA, 1845 bp, B.fragilis
  unsure (1708),(1755),(1761): Identity of nucleotide sequences at the above locations are unknown.
aagcaaaccctctctgatacttccagccccgtggtacgcaactgttctatgtcatccaccattaatggttgtggtgtatggatgtgtagtgaccatactatatttatcggaggtacaggagggcttagttcttttctggaaaaagacctgaacaaagaatatcccaaacctaagctctatttttcaagtttatccgtcaacaacgcacggataagtccggatgacaaaagtcgtatactgacagaagggctcccttttgtccgggaaataaatctaaatgccacccaaaataacctgactgttgagtttgcttcttccaactatgtggatatactgaataatacttggtatgagtatcagttagaaggttttgacaagcaatggtcactcacctcacaaacaagcctgaaatacaccaatctggatcctggagactacgtgttacacgtacggcaaaaaggcaactccctgaaaatgcgcaaagcacaagagatcttattacaaatacatatcaataccccatggtaccttacttggtgggcatggctcagttacatcactatcagcatttcagtgacctattttatctggcgcgaaaaaagttccagaagaactttggcgatgtcgctggagaaagaacgtattgaaaaggaacatattgaagagatgaaccaagctaaactacgattctttaccaatgtgagccatgagtttcgcactcctttaactcttattataagtcaggtagagcttatgttacaaaagaatacgatacctccatctttgcataatagtattttcaggataaggaagcatgcccaacaaatgaaacttctaatttcagaattgcttgactttcggaaattcgatcagaactatatccaattaaaactatcggaacaaagtctgaatacatttttagaagaagtctatctttctttttctgcttatgcctctcagaagtccatttcttaccatctgaagctgttggagcaggatatatctatttggatagatgactggcaaatgcgaaaagttttgtttaatttgctttcgaacgcatttaaacatgttccggataaaggagaaataagcatattaacctctaccacaccggatcaggttgttattgcagttaaggattccgggaatggcattagtaaagaagaacaggaacggatatttgatcgtttttatcaggcggacaatcggaataaagcgattcatgttggcactggtatcggacttgcattaacgaaaagtatcattcagctacatcatggtacaattgaggtagaaagtgagttaaatgaaggaagctgttttattgtgaagttacctaaaacccgtgattgttttgaaaaggatactgaagtcgtttttctggaatctccggaaaaggaacctatggtacaagagaataccataccggatgagaattttatgaaaaaggatgattctacattcgaaactcccttgatagatgaacgggaagggaaacggaaagtattattggtagaagataatgtggagcttttgcaggtactcaaagaaatattttcatcactttatcaggtggtgacggctgctaatggcgaggagggactgaaacaggcttttgcagaagttcccgatttgatagtgagtgatgttatgatgccggtaatgacaggaacggagatgtgtctgaaaataaagaataacatanacctgtgtcacattccggttgtgttgttgacagcacttgacactgtngatcanaatatagaagggctaccccgtggagcagacgattatatcacccaaccttttaatgcaaaaaacttaataaccccgtgcaaataa

SEQ ID NO: 5110 - DNA, 438 bp, B.fragilis
  unsure (103): Identity of nucleotide sequences at the above locations are unknown.
gaagattcgaccatatcggtcggtattgaaaggggaaaagtttacactttcgacctgcgctatgtgcccgctccagagcgtttcagcttcgtcattgacaagnaggatacgcagagggtggccatactcgacgaaaaggaacgctcttacggacagaaggaaaggatcagggaggctatcgcgaaacgtaccccgctggatctgggactgaaggacaagaattccggtgtggagttcgaggtcggaaatatcttcatcgacggggatatcctgctgttgcgcatgaccctgataaaccgcacacagatcggttatacgacggatttcatgcggttctacatccaggatgccaagatccgcaaaaagacggcggtacagcagctcgagcagaacatcctgttcactttcgattataccggaagaagtaccggcacatga

SEQ ID NO: 5111 - DNA, 183 bp, B.fragilis
atggaaactgcgtttgccggttatgggatggatccggatgccaaagccgctgctcttcctgaacctgtctttcaggggacaggcgagcgggatcttgtcggatactccgtaccgggagagtatatcccggtagttttccagtgtctccaggcgttcgcacctgtccagtgccttgtcgagtag

SEQ ID NO: 5112 - DNA, 582 bp, B.fragilis
agccgacaaaatattaaggaggatagcccgatgaaactactgctgcccctattgcttttctgcctccccttcaatggctcaaacggcggaaaggaactactcgacaaggcactggacaggtgcgaacgcctggagacactggaaaactaccgggatatactctcccggtacggagtatccgacaagatcccgctcgcctgtcccctgaaagacaggttcaggaagagcagcggctttggcatccggatccatcccataaccggcaaacgcagtttccattcaggtattgacatggccgtaggactggcagccccggtttacgccaccgcctcgggaacggtttctttcgcgggaaggaaaggggggtacggaagatgcgtcattatacgccattcttatggctttgaaacgctgtatgcccatctggccgcctattacaccaccgaaggccaaaaagtcgacaaaggggctgtaatcgcgtttgccgggagcacgggtaaaagtacgggctaccacctgcattatgaaatcagaaaaaacggtaaacctataaaaccatactggtatggctatgacgattga

SEQ ID NO: 5113 - DNA, 354 bp, B.fragilis
accgcacacagatcggttatacgacggatttcatgcggttctacatccaggatgccaagatccgcaaaaagacggcggtacagcagctcgagcagaacatcctgttcactttcgattataccggaagaagtaccggcacatgaaagccggacattcactgtggccatgaacaagttcaccatcccggataagaaacggcttatcatcgagatccaggagaggaacggcggccggcatttcctgtacaagctgaagaacaagtcgctgctgacagcagaggaggtattcagaagcagaaagcaacaggaaacggaggatgaagccgacaaaatattaaggaggatagcccgatga

SEQ ID NO: 5114 - DNA, 354 bp, B.fragilis
aaccatactggtatggctatgacgattgaacaggaaatagaacagctggtactgcagtgtatcgcatcggacgggctgaaggcctgcccgaaagaccttgccttccttgagaaatacggactgaagaacctatatttcttttccctggaatacgcgatggaagggacggatacgacggttctcgacagtaaggcgaaagggttgatcagatggtacctctattcgacggattttcccctgctgcggcagaagtatgaacgggaaggaaaagcggagctgatgaaatgcctgtacctggaagagagatatttccgcaagttcctggaatcaaccggacaggaggagggattatga

SEQ ID NO: 5115 - DNA, 195 bp, B.fragilis
gttgtggcagcggctccttccagccccgtggtgaagacgatgtctgactcattggtggagcgaaaaggggcttccgatgaacaacaccgaaaattactttataaacgttatggcagactgactttccgcgaaggtaaaatcattttcctgaatagccgttgtccggcattctatgtgaagaaggaagagaaataa

SEQ ID NO: 5116 - DNA, 1548 bp, B.fragilis
acctctaaatattgtacgtctatggatagcattcttttttggcttgttccgtttgcctctgttctggctctctgttttgcgctctattttcataaacaaatgatgaaggagagcgaaggtactccacaaatgattaagattgccgctgccgtgcgtcggggcgctatgtcttatctgaaacagcagtataaaatcgttggctgggtatttctcggactggtgattctattctctgtaatggcttatggttttcaggtgcagaatgcctgggtaccgatagctttcctgaccggaggtttcttttccggtctttcaggctttttgggaatgaaaacagctacttacgcatcggcgcgtacggctaatgctgctcgtacgtcattgaatgccggattgcgaatagccttccgaagcggagctgtgatgggactggtagtggtcggcctgggactgctcgacatctctttttggtatctgttgctcaattgggcgatacctgccgatgtgctgacacccactcataaactctgtatcatcactactacaatgctgacttttggtatgggcgccagcacgcaggcgctttttgcccgtgtgggaggtggcatttatacaaaggctgccgatgtgggagccgatcttgtggggaaagttgaggccggtattcccgaggacgatccgcgtaaccctgccaccattgctgataatgtaggtgataatgtgggtgacgtggcaggaatgggtgccgatttatacgagtcatattgcggttccattttggcaacggctgctttgggtgcggccgcctttattcatacgggcgatacggttatgcagtttaaagctgtaatagctccgatgttgattgccgctatcggcatcattctttctataatcggtattttttcagtacgtactaaagagaatgctaccatgaaagatctgcttggttcgctggcttgggggacaaacctgagttcggctttgattgtagcagccactttttttatcttgtggttattacaattggacaattggatgtggatttcttgtgcggtagttgtaggattggttgtgggtattgttatcggccgttcgacggaatattatacttcccaatcttaccggcctactcagaaattgagtgaaagtggcaaaacgggtcctgccacagtcatcatttcgggtataggactcggcatgttgtccacagctattcctgtggtggcggtggtaatcggtattattgcttcctatctgttggcttccggttttgatttcaataatgtgggaatgggactttacggcatcggtattgctgctgtcggtatgctttctacattgggcattacgcttgctacggatgcttatggtccgatagccgacaatgccggtggcaatgcggagatgtcctctttgggtaaagaggtgcgtaaacgcaccgatgcgctcgattcgttgggaaatacaacggcagctaccggaaaaggttttgccattggctcagctgctcttacggagctggcattgctggcttcttatatttga

SEQ ID NO: 5117 - DNA, 900 bp, B.fragilis
tttccattgtcgcaaccgcttcgggccaagctcaaggattactctatgtttgacaagaagtttaacttctacattgctaacgacctgggacgtaacggctactacgatcaaaagccgattgccgaattaatgggaactatgggtgaggaaataggaccggaatttgtgctggctgccggagatatccatcatttcgaaggagtacgcagcgtgaacgacccgctctggatgaccaactttgaactgatttacagtcacccggaactcatgatcgactggtatcccgtactgggaaaccacgaataccggggcaacacacaagctgtactggactacagcggagtgagccgccgctggaccatgcctgcccgttactacaccaagacattcggagaaaaaggagccaccgtccgcatcgtctggatagatactgctcctctgatcgataaataccgtaacgaaagcgcaacctatcccgatgcatgtcatcaggatatgaacggacagttggcctggctggactcggtgctgactgttgccaaagaagactgggtgatcgttgccgggcatcatccgatctatgccgaaaccccgaaagaccagagcgaacgcagcgacttacagagccgcctcgatcctattctgagaaagcataaagtagatatgtacatttgcggacatatccacaacttccaacacatccgcgtaccgggaagcgacatcgactatatcgtaaactctgccggatcactggcacgcaaggtgaaaccgattgagggaactcagttctgcaaccccgaacccggcttctcagtctgctccattgataaacaggaactgaacctgcggatgatcgataaaaaagggaatatactttatacggtaacccggaaaaaataa

SEQ ID NO: 5118 - DNA, 492 bp, B.fragilis
ggtttagtattgaccagcgctgatccttatagacccgcggtgaagacgacccggatcaagacaccgaagaatgaggtggtaaccattccgaactcgtttatcatgtcatcccatacagtgaactatagcgcttcggcccgcgaatacggtctgattattcactcggaagtgaccatcggatatgatgttccctggcgtcaggttcatcagctattgatagaagctgccttgaatactcccggggtgattgacgatccgcgtccttttgtgcttgaaacttcgttgagtgactggtatccggtttatcaaatcaatgcttatatccgtgaggcggataaattggctcagatatattcggacctgcatcagaatattcaggatcgctttaatgaagcgggcatcgaaatcatgtcgcctcactatatggctatgcgtgacggcaatgagtctacgattcccaaagatgatttgaggcccaagactgataaataa

SEQ ID NO: 5119 - DNA, 1002 bp, B.fragilis
  unsure (810),(911),(925): Identity of nucleotide sequences at the above locations are unknown.
tttatcattctcttacctattaagtatgagaaaagtcttttttccagtctttatattacattatctcacattgcctctgtaagaggtaagagcgtagcatacctaatcaacaaattattttctaattattttccagaagctctgcaagctcagcatagctattttaaactcatacccacttcctcggaaggaggagatcgcccacgacccgatcattcactaaagaaacaacaaatacttaacattatgaaatcatttaaaatcatgctcatcacggtattatccgtaatgactctgagttgtagcgagaaaacgacgacagaaattcctgaaacagaattgaaaaacattagttgtagcacccaattagtcactcattcatctgctcaaaccagaggagcggcaccaacaaccttgaatgaaaacgatttcgtgctttatgcattcaaaaaaaacggtgaaggtaactttagttatgaagaagccaaacatgaaacaagtgtcattgatggcggagtttggaaatacaatgcagctttcccggtaggcacctacaaattcatcgcattttataacctggacgagaagaaccaagccgctctcaacacgaccataacaggtatcagtaaccaaacttgggaaaacatattgaagagtattgttattacccattttccttccgccaccgatcaataccatgaagatatgaatgaaatattctgtggcaaaacaaaagatgcaatcgatatctccagtggagtgggcggagatgacaatgaaataaaaatcaaattaactctggaacgcatngtatcacgcatcgacattaagtttatcaaagtggcatcggatgacgaccatatagaagtaccttatgctaccggcaataatttcggtggaacaagtactanctcgtggacttcgntaatcttcacatcggccaacgtacctcttaaatataatcctaatggagaaaatccggattatgttacaggagtttaa

SEQ ID NO: 5120 - DNA, 903 bp, B.fragilis
ttaaatagtaaaatcgttatggcaaaagaaatattattcaatatcgaagctcgcgatcaattgaaaaaaggtgttgatgctttggctaatgcagtaaaagtaacactaggcccgaaaggacgtaatgtgattattgaaaagaaattcggtgctcctcacattactaaagatggtgtgactgtagcaaaagaaattgaactgacagatgcttaccagaataccggtgcacagttggtgaaagaagtggcttctaaaacaggtgatgatgccggtgacggtacaactactgcaactgttttggctcaggctattattgctgagggtctgaagaatgtaactgccggtgcaagccctatggatattaaacgtggtatcgataaggcggttgccaaagtggttgattctattaaacaccaggcagagaaagtgggtgacaactatgacaagattgagcaggttgctactgtttctgctaacaatgatccggttatcggtaaactgattgccgatgctatgcgtaaggtttctaaagacggtgtgattactatcgaagaagctaaaggtactgacactacaatcggtgtggtggaaggtatgcagttcgatcgtggttatctgtcagcttactttgtgactaacacagagaaaatggagtgtgagatggagaaaccgtatatcctgatttacgataagaaaatttctaatctgaaagacttcttgcctatccttgaaccggccgttcagtctggtcgtcctctgttgggtattgcagaagatgtagacagtgaaacggtggctacactggtagggaaccgtctgcgttctcagttgaagaactgtgcagtgaaagctcggggattcggtgaccgtagaaaaaagatggtggaaaaatttcccttttga

SEQ ID NO: 5121 - DNA, 282 bp, B.fragilis; identical to SEQ ID NO: 2291

SEQ ID NO: 5122 - DNA, 372 bp, B.fragilis
agcacctgctctccctgctgggcatttaccgtagacgggagccgggcatgcagcctgaatgtggaagccgtaccgacagagggcacatacgactttacaggcggtacattgtccgtaaacgagggaagcggcaccgtttcttccaaggagaacatgctgctgctcctgcccggcaggcttgaagagaggagagcgcagatccgctatctggaccggacctatgactggtatcttccggcaaacacctttgaagccggtaaaagatatgattacgcgttgaccctgagcaaggaaggggtgctcatactctccggtgtgagtgcccgtccctgggaaacgggaggagactataccggaaccatacaaccctaa

SEQ ID NO: 5123 - DNA, 684 bp, B.fragilis
tccgggataacgagcgggagctcggagcgggaattacggtcccggtacaacagccggttgcttccaggggaaaggaaaaacctgccttgcaggaaaagaaggaagaggaagtacggcccgggcagcgcaaagccatggatagtgtgccccgggcaccgacccgcaggggattcaacacggtccggctcgtcaggcaggaagagaggaatgtcatcaaggcattcgtgcactccacacagaccggtatggtcgggttccaccctcaagatgcagctggccgagaattgcctgaccgatgacgggcagcgcatccgtaaagggactcccgtattcggggaggtgacgggcatcgacggggagcgcgttctggtaaagatcacctcggtaaacctgggtggaaacatacttccctttgaaaagcaggtttattccgaggacgcaatacaaggaatctatgtaccgggcaatgtgaaggcggagacagcacaggaagccggagcggcgggaataagcggtgcgaacaccaatatctccggaggattcgatatgggaagccagctcgtggcaggcgcggccaacagcgtcatcaacgccaccaagtcggcagcaagcaagaatatccggaaggtaaaggtgacaatcaagaccaactaccgcatactgctcaggcagccgaaagagtga

SEQ ID NO: 5124 - DNA, 183 bp, B.fragilis; identical to SEQ ID NO: 5111

SEQ ID NO: 5125 - DNA, 984 bp, B.fragilis
  unsure (135): Identity of nucleotide sequences at the above locations are unknown.
ttaattatttatttttttcagatgaaaatgaaaacaagtttttttctttcagcggtaatggccgcaggcctgctggcttcatgcagtaacagtgaagaagtttttaatgagcaagtgacggacggcgagcattcnggggcacagctgaatatcgtacctaccgtaagttccgaaagcaccgaaacaagggccagtttcgatcccaagacagattgggcggcaggcgacggcgctggcctgttcatgtacaaagtccacggctggggagacgcctacccgcgttatgatgcccagaacaacaagtcgaccaggcaggcgaacggctggtcacaggccagcccggtgtacctgctggtagacaaggccaccatatgggcctattatccgtataaccaggccgtgacggacggtaccaaaataccggttcctatcaatgtcggcacgtccgttgattacatgtggggcaaaagcactaaccaggtatccgtgatcgagaccgatgccagaataccgatgaagcatgcgctttcacagtttgtggtgcggctgaaagtctcacccgagtaccataacgacggaaacctgacctcggccaaactcaaggcaacggcctccaagttcgccactaccggaaccatgaacctgaacgacgggggaaaaattacgttccaacctaccagcacggagctgacctggagcccgaatacaaccgttccggcacagggacagcaggcggtggattatgccgcggccatctacccgatgacactggccgcgggcgaagtgtcgcttgaagtggtgatcgacggtgcgacctatacctatgccatcccgcaaatcacctgggaggcgggaaagagatacatctactcgatcaccatgcgttccaacgatgcggagatcggaggaaagaacggacagtctgtaaccatagaaggctggacttccactgaagaagacatcacccttgttccggtcaaatag

SEQ ID NO: 5126 - DNA, 675 bp, B.fragilis
acaaatggttataaattatataatgaaactttcatgaaagcaaccaaaagcatactcaatatacaaagcatactcaaggatttctccggcctggccgaagccaggaagagctatacgctgcgcaccaggctggtattcattttctgcgggataaccatcgcgatggtcctgttcttcgcgcacagcgtggtgaacaatgcgatgaacaagatactggtggtcaacgaaggcggggaattcgtccatttcaagtccatgcagcaggacctgctgtacgaaagcctcctgaaaagccactgccgccggacggcctatttcctgaacagcttcgacaggctttcccttcaggaaaaccgtgcccgtgccctgttcctggtcaataagccggacgcaaataccgtatttgccaaataccaggcggaccgtgcctatggcgatgcgttggaactcggagttgtctacaagacggagtttgaaaagatcatcgacatacgcgccgacggtgaggagtaccatgtcaggttctcctccatcctgagcatcatcaacggcgatgagaccaggaaagtgcggatcctgagtgagggtaccgccatccatgccaccccgcgctttccggaaaatacgtccggtttcttcttccgtacctatgaccaacaatacgagctcttatga

SEQ ID NO: 5127 - DNA, 1194 bp, B.fragilis
acagcttttaataatataaatattgaagtaaaatttaatatgaaaccaaacaaaatttacatcaccaccctgcttctgctgtttttcctttcagggagagcgcagaagatcgaggaactcaccgcagtccccctgcagatcgggtatgaaaagaccttgcacctgatcttccctaccgaggtgaagtattacagcatcggaggggattacgtcatcggtgagaaagtggtcaattgcccggggatcatacgcctgaaagcggcggaagagaacttcccgggggaaacaaccctgtcggtggtaacggccgacacaaagttctattcgtactccatcagctacaacgcacatccggcccagagttatgtgcgtataggcggagaagcccccacaccgcatacgctgccggtaggaaaagaaaagcagctgttcctgatcttccctgccggtatcacctacgtcgattacggaagcacgaacgtggaggtggacaaggccgagggagtggataacatcctggccgtaaaagccgtccagccctataaggaggatacgaacatatcggtcgtacttgaagggggaaagttctacactttcgacctgcgctatgtgcccgctccggagcgtttcagctttgtcatcgacaaggaggatacccagagggtggccatacttgacgagaaggaacgctcttacgggcagaaggaaaggatcagggaggctgtcgcgaaacgtgccccgctggatctgggactcagggacaagaattccggcatggagttcgaagtcggaaacatcttcatcgacggggatgtcctgctgctgcgcatgacactgacaaaccgtacacagatcggctatacaacggatttcatgcgcttctatatccaggatgccaagatccgcaaaaaaacggcggtgcagcagctcgagcagaacatcctgttcactttcgattatccggaagagataccggcgcatgagagccggacattcactgtggccatgaacaagttcaccatcccggataagaaacggcttatcatcgagatccaggagaggaacggcggccggcatttcctgtacaagctgaagaacaagtcgctgctgacagcagaggaggtattcagaagcagaaagcaacaggaaacggaggatgaagccgacaaaatattaaggaggatagcccgatga

SEQ ID NO: 5128 - DNA, 228 bp, B.fragilis
acaacaactaaaaacaaaaattacaatagaatggaaactatttgggaaaaagtggattacctgggccggatattatgctgcattataatgggaattgcatatatacttataatgatagcccctctttatgcttcacgccacgaacagtcagggcaaagaagtgatgaaaaggcatctgtggatggagaagaaaaagtcccggataatggtccggaacctgaaaagtaa

SEQ ID NO: 5129 - DNA, 2433 bp, B.fragilis
agaagaaacaagatgaaagaggaagaggcatacagcatacttgacattatcagcgagtccgatggacaaagcgtgatcctgacccggagcggcagcatatgtatcccgttcgagctccggcagccggagtgctattccctttccccggaagacatcgacgaaagggacgggatgtaccgggaagccttcaggcacatgcccgacggtgcctacgtacacaaacaggatgtattccttaaaaaagagtaccacccgggcaaaggcaccggctctttcctggaccgtgccgacgcgcgccactttgaaggacgcctgtacatcgaccacacctgtatcctgcactttgtacttgcagggctgaaaagcctggagaaggcgtatgtatcctcacccctggcctataaggaacatctgcacagggaagactacagaaagctggaagcctttctcgaaggggtggacaatgcggtgagcatcctgcagaacatgcgcgggaactcggtgctgcccatgtcctgtgaagggatatccggattcacccgcgcatactccggcctgttcggtgatacggacgccgtggtggatatacacgtcgacgggagcctgcatgtgggaaagaaccatgcgcgctgctatgcggtgtgcgacgagaccttccttccggaaggaaacatcgagtcctatgtcagggacgagtcgctgccaccggccgcttcacaactgtaccatcccctgatggaacagttaggcatgtaccttccctacaaccacatcgtcaaccaggtcatctatttcgagggaaacgagaggctgcgctcccggatcgcacgcaacatagacatttacgggagcaattcttccatgaacaagggcatcgaaagggaatttaaagagctggagaagctccagacagagatcctcgaggagaaccagatgctggtgcgctccttcttttcggtctgtgtcttcgacgggtcggatactgaactggagaaggctgacaaaaggatcagggaaatattgaacctgaaccggttcaaatattacataccgggctacgggaacctggcaaggatgcacttcgcctgtgtccccggacagatcagtctgatgccggtggaatatcttttcctcaccaccctgcccatagcgctctgtttctttctccagtgcggcaagttcagcaatgacgccgaagggatctacgtacatgataggatgtaccaggtgcccctgcgaaaggatatctgggacgcggcgaaaaaaagggtgaatgcccgaaacgggatggtcattgccggcacgggcgggggaaaatcagccttcaccctgaattttacgcagcagctgatcgagcaggactatacgaccatcgtcgtggagttcggaaattcattcagccagctgtgcaagctctatccggatatctccctgcatgtggactatgacggcaagactcccctggggatcaacccgtttgacctgcagggaggggaaccggacaataatgacctggaaacgctctccggcatcgtacagcgatactggaagcacatgttcaccaaggacgagtcggagaaggaagtcgccctgacacggtttatccaggactattacgaacatgtccggcaagggcataactttgagagtttctataattacgtcatagacaattacgatgagatcctggagagaaaacatatccccggcacgtatttcaccattgagtctttcaagctgaactgcggggaattcatgccagggcagcggtacgagaatgtctgcaaggatatgaagatcgatttctccggaaagaagttcatcgtgttcgagcttacgcggatcaagcaggacaggttcctttcaaacctggtcatgagcatgatattcaccgtcatccagaaaaagctgctcagtgacaggagaaagcgcggcatactgattttcgacgagtatgccgaaaccgcgcagatggtggatacggccacaggcagcggcatacacagctccgtggccttctgctaccagaagatccgcaaggagaacggggccgtatataccattgtacagacccctgaccagctgcccgatgacgagaacacgaaaaacatcatcagcaacacggacatgctgttcgtattgcctaccaaggaggtcatctaccggaccatcatcgacaagttcaagctgacgcagcccgggcagatagccctgatgaaatccatgcggaacaacttcgccggttcccgtccttactcggaatgcttcatgcgcatgggtgagaattacgcgacggttacccgcctggagttctccagggagaagttcctcgctttccagacggaaggcgagatcttgtcggacctcgaggacaaaaccggcagcggaaagtccatgcaggaggccatcgaagaatatataaacgaacattaa

SEQ ID NO: 5130 - DNA, 582 bp, B.fragilis
  unsure (481): Identity of nucleotide sequences at the above locations are unknown.
agccgacaaaatattaaggaggatagcccgatgaaactactgctgcccctattgcttttctgcctccccttcaatggctcaaacggcggaaaggaactactcgacaaggcactggacaggtgcgaacgcctggagacactggaaaactaccgggatatactctcccggtacggagtatccgacaagatcccgctcgcctgtcccctgaaagacaggttcaggaagagcagcggctttggcatccggatccatcccataaccggcaaacgcagtttccattcaggtattgacatggccgtaggactggcagccccggtttacgccaccgcctcgggaacggtttctttcgcgggaaggaaaggggggtacggaagatgcgtcattatacgccattcttatggctttgaaacgctgtatgcccatctggccgcctattacaccaccgaaggccaaaaagtcgacaaaggggctgtaatcgcgnttgccgggagcacgggtaaaagtacgggctaccacctgcattatgaaatcagaaaaaacggtaaacctataaaaccatactggtatggctatgacgattga

SEQ ID NO: 5131 - DNA, 615 bp, B.fragilis
caaaaaatgaaaataaaagtgtataaacacatagccatgtttcttttgccggcggcccttacgggctgttccggcaaggaagattccctccccgggacaggagaggcgggacttgagatagaaaactgtttcagccgcagtaccggtacggatacgggccatgttccggtaaaggacttcggcatggtgctgctcgatgaaacgggaggctcatataccggtgtcagcaatccgctgcatgtgacctatggggagagctggaattttccgcaggtgacgcttacccagaaaacctgccggctgttcgctttctccccgttccggagtatcccgggaaaggaagtggctgtcagcctgagtccccagacggattacctggcatcggatgaagtgcgtctggactggcagaacccccaggcgagtattgaaatgaagcacctgctctccctgctgggcatttaccgtagacgggagccgggcatgcagcctgaatgtggaagccgtaccgacagagggcacatacgactttacaggcggtacattgtccgtaaacgagggaagcggcaccgtttcttccaaggagaacatgctgctgctcctgcccggcaggcttga

SEQ ID NO: 5132 - DNA, 222 bp, B.fragilis
gcctcccgtttcatcgagcagcaccatgccgaagtcctttaccggaacatggcccgtatccgtaccggtactgcggctgaaacagttttctatctcaagtcccgcctctcctgtcccggggagggaatcttccttgccggaacagcccgtaagggccgccggcaaaagaaacatggctatgtgtttatacacttttattttcattttttgctattcgtttaa

SEQ ID NO: 5133 - DNA, 423 bp, B.fragilis
ttacgcgttgaccctgagcaaggaaggggtgctcatactctccggtgtgagtgcccgtccctgggaaacgggaggagactataccggaaccatacaaccctaaaaacaaccatcatgaaaagaaaatttctactgtccgcttttttatttgcgtccaccctgcgcggatatgcacaggatgcccgcggcgcgatgaaccagatcctggacggttacaccctgccgatttttgcggcctgcatgcttgtggggcttgccttaggggtggtccagcagctggacaacatcatcgacaaggagaaccggggaacacgcagggacggcctgtttgccctgggctggtatgtgggtttctccctgcttgcgggagtcgtgataacagcggccaaagccgcaatatccggcattaaactgaccatatga

SEQ ID NO: 5134 - DNA, 189 bp, B.fragilis
aaccgatgtgatatggaaacaatacaggaaattatagatatgataaaagagttatcgggacgcgacatactctttctaagcttctattgtggatttattctaatactgtctatacacagaagtgatgaaaaggcatctgtggatgaagaagaaaaagtcccggataatggtccggaacctgaaaagtaa

SEQ ID NO: 5135 - DNA, 1305 bp, B.fragilis
aaacgatgtgatatggaaacaatacaggaaattatagatacaataaaacaatggccatccacaatatggtgggttatgggggctctttttattatctcctggttttgggatacgccactgagaaagaaacgaaataaagataaagtgacggatgataagaataacaacttaaaaagctcaaatatgactgataaaaaagaacttagaggcaacctgatgaaagaaggtgtcatcctgtggaccgtatttaccggggaaggaaaagcagccctgcgtatggataacgaaatacatgctgagaatgggaagatcggccacgggagattattgtcccctgatgtacccgtactgcatgaaatcctcacaccggataacgcttacagttttctttctctttcagaaatcggagtttggatacggatcaggatgcgcctccgatatccgggaattgaggacagtgcagtaaagcaatcggaatatgagccggaaatgtgctttcccgcgtggatcgcaggagagaaaaccggacggatcagtctgttccttcaggaaccttccaccggaatatgtgccattccggatatggtcggaataccgggactgcctgacctgcaaccggacagtgtacccgtaaaagttgaaatgctgatacggaaggcaagtcctcttcttgaacatcccgaatattcggaggatatcaaaaagagggcagacagaaaaagcaacttgatgaaagaaggggtgcttgtgtggattatgttcaccgcaggggagaaagctgtcctatatgcgaatgaccggatacattttactgaagatgggaaatatgttccgggaaaactgctttcctccgatatctccccctttcatcagatttatgactgggatgtacagtatccgtggattcgttcaaagcctgagatatcagtacggtaccggatacggctccggtatccgggagcaaacgatgccggtatagaacagtcggaatatgaaccggaagcatgctttcccgcatggatagtgccacaggagggcggacagaccggcttatgtcttgaggaaccatccacaggccaatactttattccggacatgaccggattaccgggactgccggaattacaaccggatggcatacccctcagagtcgagctgctgatacgccaggcccactggatttcagacgtggccgacccggcatacctgaaaattatcagttactccgcaagtttgaaggctttctctacaaagatatccgataatcaagaagtgaaatcctgtaatatacaaactgaaatttga

SEQ ID NO: 5136 - DNA, 465 bp, B.fragilis
gccctattggacgtccctgagcccccggtgaagaccgtccagcgactgaatatacagatcaacgtctcgggtaataccgctcccctggccggcctgaaaggtaccctcaccggtatttccaccggccggtaccttgtctcgcgggaaaggactggaaacgcaagtgtcacgagcctgttcgcgcgtaaaccggaaaccgaccggtggaagacaagcctgtacgctttcgggttcaaccccgcagcggagaatatcctttcggtaaagattgaaatggacgggaaggattcggtattcaacgaagagcagaaggtggacctgaccccgtatctccggggatttgacagcgatgaactttctctggaactggacctgcacatcggcaaggaactgaccataggagaaccggttgtcattccggattgggaggatatcccggaaacagaattaccaaactataattaa

SEQ ID NO: 5137 - DNA, 852 bp, B.fragilis
ggaggaaaggaaaatagccaggatctcccaggtaataagccagtacgaacagctcaaaagggcattgaggtaagagggatggaagaagcatacggaaatctgaacgccgcgtacctgcagataaagggtatggtagtcatagaggggttctacgcgcttatcgccgggtttgtcataacgactttcgtcttcaagctcgtgggaattatcaaggagatgaccaatgagggaaaaggattcaacgccaggcacttctacgagctgggacgggagtacatcttctgcataggcctgatctgcatcatgcccgtgctgctgggagcgctcgagacggtgctggcctatggagccgacgagctgatgaaatcgctcgcctccggtggggtctataacccgcacaatatctggaaagatccgatcagtgccatgctggacgagctgatgaacggtgacatcaccgacatagccgtcaacgggatcgataccctgaaatggtcccttatctcgggaacggtaggcagtctcttcggagtggcctacgattacatcatgctgctgttcctctgtacccgttacctgatactgctcctgctcgagatcatttctcccatagcgatagcctgcctgtacaataaggacacacgcagctccttctacacatgggtcaagcagatgctgggatgctacatgctctatccggggtttatccttgccagcgttttctcggacctgatcgtcacgaactatgtcctgcaaaggtcctggtcggtgctgctgatggttattttttctttcctgctcaagcttacgatgctcggcacggtaaaggccacagtaaacaaatggttataa

SEQ ID NO: 5138 - DNA, 1647 bp, B.fragilis
cccgcgggggagccttccggttcccccataaaaaagagaataatggtaagagcaataacaacgattgtctgcagtctccttctgctgttggccttttcctgcagccgggaagataccgggccgcaggaaaccattccgggcagcgggatcgtgacatttaccgccatgaccgggcaaggggaaacgcgaagcagccaggaaggcagtttcgagacaggcgatgccataggcgtattcgccatcgaaccgaagaccggcgtgtattgggcagtgaacaacaaatatacgtatgacggacagaagttcaagccggaggcggaagcggacaatatcatagtaaccgtaggaaccgactttgacttttacgtgtactaccctttcaaggcaggccagaccgatataaccggaatttcccatactgccggcaaccaaagcgataaatcgggatggctctcggcagacttcatgacagcgacctataccgatcctatccggaactacacggtcccactgcatttcaaacacaggatgtcgaccgtagaggtcaggatcgatagaaatgacggtgtgagggaagccacgatggagaatgtgaaacgtacaagccgcttcaatcttcttacaggcgggatcaccacggacgaaagcaggggaagctgcacgatgcataaatattctgaaacaggaggtacgacggtattccgggtaaccatccccgcacaaaggcttacgacctcctccaactatgtagcccttacgggaaccactcccataaagctacgcggaacctccgacatggttaccgaagaagggaaaatacataattaccggatggactacaaaaaacaggtcaccatcctggattatgcacccggaggaaccaccacaggtgcgggactgtacaatacgggaagcaactgtacggtgtcggcgagcgtgaagccgggctatgagtttgccggctggtatgaagggggaaggattgtatccggtaccgcacaatacagctttgaggtgcttgccgaccgtaccctcgagcccaaataccggaattacggatcctggagagttaccctgacggccaatccttccgccatttcctggaaaggggggacttcgacgctcagtgcgggcgcctcacgtgaggtgttcgtcaatggggttaaagagactctccagggaggttcgccctctatcagtggaggtacggaaggatttttcctttcagggaacacggtgagcgtatcggagaacaatacggcatccgcgcgcagctgcgtatttacggccagtcatggcggtagttccgctacggccaccatcagtcaggaagctcccccggtcagctatgttttcgagtattcagacggaacggtggctcacagtgagcgtgcggaagcgggggcaggttcattcctgttaagtataacgagccgcaagactataggaaacagcatcaaagagctctcctggagtgcgtcgggtgacagctggattcacgtatcgggaagctcggtcagctatgacgagaatccgaccaaggagatccgcagcggaagcgtgacccttacacaggcggaaagcggaaagacactgacactgaccgtcagacagaagggtaaaacttcaattgatatcaatccttaa

SEQ ID NO: 5139 - DNA, 447 bp, B.fragilis
ggatacatacgccttctccaggcttttcagccctgcaagtacaaagtgcaggatacaggtgtggtcgatgtacaggcgtccttcaaagtggcgcgcgtcggcacggtccaggaaagagccggtgcctttgcccgggtggtactcttttttaaggaatacatcctgtttgtgtacgtaggcaccgtcgggcatgtgcctgaaggcttcccggtacatcccgtccctttcgtcgatgtcttccggggaaagggaatagcactccggctgccggagctcgaacgggatacatatgctgccgctccgggtcaggatcacgctttgtccatcggactcgctgataatgtcaagtatgctgtatgcctcttcctctttcatcttgtttcttcttcagaagttgtctgtttatggttaagttactcacggtcatgccgtacttcgattccctga

SEQ ID NO: 5140 - DNA, 615 bp, B.fragilis
ccaacaatacgagctcttatgacacgggacgggaaaagcagaatagccatactggcgggcttggggattgtagttgtcctgctggtgtgggcattcatcgccagcctgccggcctctgggagcaaggagccggaaacgggtgaggtgatcctcagaacccggatcaaggatagctttactctggatgacatgctccagaaagtcgggaaagagaacacaagcaaatccgcttccctttcaggtttcgacccggtaacggaggagcctgcggatacggccgggaatgaaagggagatccggcgcatacaggagctgatccgggataacgagcgggagctcggagcgggaattacggtcccggtacaacagccggttgcttccaggggaaaggaaaaacctgccttgcaggaaaagaaggaagaggaagtacggcccgggcagcgcaaagccatggatagtgtgccccgggcaccgacccgcaggggattcaacacggtccggctcgtcaggcaggaagagaggaatgtcatcaaggcattcgtgcactccacacagaccggtatggtcgggttccaccctcaagatgcagctggccgagaattgcctgaccgatga

SEQ ID NO: 5141 - DNA, 534 bp, B.fragilis
aacaagaaacgtatgaagaaattatgcttatccttaatcgtgatgatgacggcagacaccgtatcggcacaatgggccgtgacggatgccggcaatttgagccagaaccttaagaacttgaaggagctgcatagacaagtgggctaccttaaggaacagaagagcctgctggacgagagcctggacatgatgcgcaaggtcaactccgtggtgtcggactgtgagacgacccggtatattatcgaacgccaggcaaggctctccgaaaaatgcgtcgatctgctcagcgggaagcagctgaacccctcgacactgcagacactcatcggcagtattgaacagatcatggccggaaacagacgcctgatacagctgtcgagaacgattctctccacaagcgtgaggatgaatgacgccgagcggctgtccaccctgcagaacatagagagacagacccttgaggaggaaaggaaaatagccaggatctcccaggtaataagccagtacgaacagctcaaaagggcattgaggtaa

SEQ ID NO: 5142 - DNA, 456 bp, B.fragilis
gcattcaccataatcaacattatgcccacaaattataatcagttattgaaagaccttgaaataggctccgtttatatcaagatctttatctgctttttgggatgtactttcatgttatatccagtcttgttttatttcacccatttcttccgagaactttccgtatatgagcagatatttttcgcattaggcagttccgctttatataccggattgggagttccgctttcaattacaagtgccataagatatccgggagtattctatcttcctttaatgctactgtcagtttcggtaatagcaactatttacatagtcttctttatggccaggagttatgatcctcttacgacattattatggatcctgcctacaagctacctgctcaatttgattacaggtgtcatttctatcttgagggagaaaaaatatcctaagactgagatgtattattga

SEQ ID NO: 5143 - DNA, 654 bp, B.fragilis
gagctcgtattgttggtcataggtacggaagaagaaaccggacgtattttccggaaagcgcggggtggcatggatggcggtaccctcactcaggatccgcactttcctggtctcatcgccgttgatgatgctcaggatggaggagaacctgacatggtactcctcaccgtcggcgcgtatgtcgatgatcttttcaaactccgtcttgtagacaactccgagttccaacgcatcgccataggcacggtccgcctggtatttggcaaatacggtatttgcgtccggcttattgaccaggaacagggcacgggcacggttttcctgaagggaaagcctgtcgaagctgttcaggaaataggccgtccggcggcagtggcttttcaggaggctttcgtacagcaggtcctgctgcatggacttgaaatggacgaattccccgccttcgttgaccaccagtatcttgttcatcgcattgttcaccacgctgtgcgcgaagaacaggaccatcgcgatggttatcccgcagaaaatgaataccagcctggtgcgcagcgtatagctcttcctggcttcggccaggccggagaaatccttgagtatgctttgtatattgagtatgcttttggttgctttcatgaaagtttcattatataa

SEQ ID NO: 5144 - DNA, 615 bp, B.fragilis
  unsure (208): Identity of nucleotide sequences at the above locations are unknown.
aatttccataaaagaagacccaaccaaagcaatttttttaagaaagaacgagatccacggattctctatttacaagttcgccaacagggacagccgcaagccaaggagcgattccgggacttgtttgtcatcggttgtctgaccgctctaaggtattcggattattcgacattgacccaagacaacctgcaaggatgtttcatagtcnagcgtaccaggaaaacgaatgtggatgtaaaggttcctgcacatgattatgtcaaagagatatttgagaagtacgacggggatattccgacagggctatgtatccagcacttcaacaaatatcttaaggtgatcatgcgtgaaataggcttgactgacaaagtttcctattcatttacccaaggcgggaaactgcatacggtaactaaagagaaatgggagttaatcagcagtcataccgccaggagatcggctgccacgaatatgtatctgaccggccgcatgaaaacattggagatcatgaaactcaccagacaccggagtgagcataacttcttccggtacatacggttaacgggtgatgataccgccagatccataagcggagatatgtttttcagaaaataa

SEQ ID NO: 5145 - DNA, 216 bp, B.fragilis
cgaattttaaaaattatcaccatgaaaaaatttattgaagtttcaacagaaaatggcaaatttcttgtgaatgttaacactatcagttgtctgtacactataaaagacggccgtacgcgcattacactcacagcgccgtcgtccaagggggacatctttattaacgctcaagaatcttacgaagaagttaaggctttgattaaggctgctctttaa

SEQ ID NO: 5146 - DNA, 240 bp, B.fragilis
gatatgaatatagatacagagtttaatgtaggtgatagtgtatgctatctaagtggagacaatatctgtcattccactataagcaaaattactattgaaatatcctatacagatcgcagtttttctatggtatacaaactttctgacggattaagtgtgccgagaaacaattatccacaatgggataaaaaactttttagagacaaggatgatcttataagatatttatcagaatcataa

SEQ ID NO: 5147 - DNA, 450 bp, B.fragilis
ttaaaaagaattttggagaagagcatgaaatcaacagagatattaaaacgtattcaaatccaacatttgttgacatcatcagcggtggattcccttgccaggacatcagcgttgctggaaaaggtgtcggaattgtcggtgaaagaagcggcttatggactgaaatgtatcgagttatacgggaagttagacctaaatacatcatcattgaaaacagcccaatgctccttattcggggatttgaacgagtcctatgcaacctttccgaaatcgggtatgatgcagaatggcaatgtttatcaggcaccgactttggtatacaacagggtcgggaacggttatattgtcttgcctactcctgtgaaatcaacagcaaacggagcatgcaagaatcgatatttcggaagccctacgtcttcaccacggggctggaaggacagcgcgtgcgta

SEQ ID NO: 5148 - DNA, 219 bp, B.fragilis
taccgccagatccataagcggagatatgtttttcagaaaataaacttgttaaattttaaaattacgattatgataaaaaaaattatccggtatttgagaaagcgcaaagatatgaaattgcgcaaatggtgcataacgctggcagcaaacgaattatctcgcggagaggctatcgatgccgccaacgagatctacaagtgggttaaagagcagccttaa

SEQ ID NO: 5149 - DNA, 615 bp, B.fragilis
tcttataagatatttatcagaatcataaccaatttagaaatgaagcaaagtgaactaacgcacggttctctatttagtggcatagagggtttcggtctcggtgcagctttctcgggtataagaactttatggagctgtgagtatgaagactatcaaacaagtataattaaaaagaattttggagaagagcatgaaatcaacagagatattaaaacgtattcaaatccaacatttgttgacatcatcagcggtggattcccttgccaggacatcagcgttgctggaaaaggtgtcggaattgtcggtgaaagaagcggcttatggactgaaatgtatcgagttatacgggaagttagacctaaatacatcatcattgaaaacagcccaatgctccttattcggggatttgaacgagtcctatgcaacctttccgaaatcgggtatgatgcagaatggcaatgtttatcaggcaccgactttggtatacaacagggtcgggaacggttatattgtcttgcctactcctgtgaaatcaacagcaaacggagcatgcaagaatcgatatttcggaagccctacgtcttcaccacggggctggaaggacagcgcgtgcgt

SEQ ID NO: 5150 - DNA, 828 bp, B.fragilis
tacatttcactgtggaggcacagaccttgccggagaagcaatttttccatccccgaccgggtgaaatatgataaagattgttttactatcgaaggaaaggatatttttatactcagtgctgcgttccattacttccgttgcccgcaggaattgtggcgtgaccgcttccggaagataaaagaagccggattcaatactgtggaaacctatgtcccctggaattggcatgaacggaatatgccgaagagtgtggacgactattcgcaatgcaattttgatgatctgaaagcatggctgcatatggcacatgaagagttcggattgtataccattgtccgtcccggtccttttatttgtgccgagtgggccggtggtgcttatccgcgctggcttgccaaattttgcccggacagctatgataccagtttctggcttcggagcaaccatcctgagcacatgaaatggtcggagcattggtacaatgctgtttgccgggtatttagtgaggaacaactcactcgtaagcaaccgggtgagaagggtatcataatggtacaattggagaatgaatacatttactttgatatggagtccgagaaaaaggaagaatttctgcgggtactttcggatgcttgcatccgaaatggcattgatgtccctctttttacttgtgtgactcccgaagtgcgcggttctcatcatccggtgatcagccagctgtttgacatgaataatcaatatgtatggtggaatatgcacgaggctaaatcgcgtatagagaagttagagaaccgagtcttcacctcgcgatggagtaccacgggggtc

SEQ ID NO: 5151 - DNA, 654 bp, B.fragilis
gagaaatttgttctcggatgtataaagcgcatctggggttatccccacattttggaaaacggaatattatatctccttatacgaaagacttgtcgtgccggtaaaaatcatatttcggttacggcagacggactccgggggggcacacggggaattgtaacccggagatacgacggggtatttgtgcctgaagggtatctcgttccctattccggagatgaagaagagggagttgttgtaaaggctactgcttgggaaaacgtcatctgtacaaaaactccgttaaaagtggttcgggttgaggctacttcggaacagaaacgctatgaggcttctcatattacagatggagatgatttttcatggtggattgctgatgatgaatctcagccccagatagttctacttgaattggaacgatctgtgaatgtgtttgccagtcggattcgttttcagaaggatagttctacttatacccataaagtcgaaatttctatcgacggaaagaattgggagactctatacgaacgagaatgtaccggatgggattttaagcctgtgcagatcggtaaggaactgaaatatatgcgccttaccattgagaaaagctcggagggagcagccggattggctgaagttacattgtatcaataa

SEQ ID NO: 5152 - DNA, 1089 bp, B.fragilis
aacccaaagcctatgaaactcaaacatatccccttactcctgttggtactgacctgctgtccggcttgtcaaaacaagaaagcttctgccactaaagagattccttccgaagctacttataccaatccactattggcagtaggagcagaaccatgggctgtctttcacgaaggcaaatattattacacgcaaggagccgagaataaaattatcctttgggaaaccaatgacatcaccgacctggaacatgctgcccggaaagaagtatggattccaaaagaaatctccaactcttatcacctctggggaccggagatacaccggattgacgggaaatggtatgtttatttcgcagcagatgacggcaacatggacaatcaccacatctatgtcatagaaaacagttctcccaacccgttggaaggtgaatttgtgatgaaaggacgaattaaaactgacaaagacgataattgggcaatccatgccagtacattcgagcatcagggtcaacgttatctcatttggtgtggatggcctaagcgccggattgaaacagaaactcaatgtatctatattgccaggatggaaaatccgtggacactctcgtcggacagggtgatgattgcggaaccggaatatgaatgggaacgtcaatggatctcacctgatggcagtaaaacagcttacccaatccacgtcaacgagtccccacaattctttgaatcgaagaacaaggacaaagtgctgatatactactgtgccagtggaagctggactccctactattgcatcggactgctgactgctgatgccggcagtgacctgaccaatgcggcatcctggaagaaacaggatactcctgtctttgagcagcaacccgaagacagtgttttcggaccgggtagtccctcttttgtccctacaccggatgaaaaggaatggtacatgctttatcatgcccgaaaaatccccaacgatgcaccgggagcaacagactcccgtagtccccgtctgcaaaaaataagctgggatgcaaacgggatgcctgttttgggaaaaccttgcaaagaaggaacgcaaattaaatag

SEQ ID NO: 5153 - DNA, 618 bp, B.fragilis
aaggactactatgggcatggtacggaggccaggaagcccggaacggcaatcgcacgtacactcttcggggagctcaatccttcggggaaattacctgtcacttttgagaaacgatgggaagacaatcccacttttcacagctactacgatccggacggagacaagcatgtagagtacaccgaaggtatatttgtcggatatcgtggatacgataaactgaaacgggaagtacaatatccatttggttacggattgtcgtatacccgttttaaactttcggcaccgactgtcggtactccgaaaacggacggttcggtaacagtcacctgtaaactcaccaacaccggaagaacggcaggcgcagaagtcgtacaactttatgtatccaacaaagatacgacagtggaacatccggaaaaagaactgaaaggcttccggaaagtatatctggaaccgggcgaaacaaagagtatagaaattactgttccggcagaagcattctcacattatgatacgggtagccggagactcgtcatcgaccggggtagccacgacatcttgttaggattttcttcccgggatatcaaagcaaagatgtcggtcgggatttcacgttaa

SEQ ID NO: 5154 - DNA, 879 bp, B.fragilis
ttgcccatgaacgccttacacccgtggagaagcactgaggagatcctgaagaagcaagaacaggtgaatcgtaaaaagaaagagcttcagcaggtgaaggttgctaaagaaaatctgttgcgcgaacgggaaggtgaaaaggctaaactggaagcacaggaaaaagaaaaacgtgagatcgttgccggtttgcaaaagaaacagaaaggattgcaaagtgagattagtaagaaacggcgtgaggccaaccaactaaatgcaaaaattgataagctgattgccgaagagatagaacgtgcacgtaagcgtgctgaagaggaagctcgtcgggaagcggcggcccgtcggaaagcagctgccaaagaaagtaaatcgtcttcgacgggaggcggtacggttccagcaaagaagaaagcagaacctttggaacgtttcaccatgagcaaggccgaccgtgaactctcgggtaattttgtaagtaacagaggtaaattgccgatgcctattacgggaccctacattattaccagccattacggacaatatgctgtggaaggattacgtaacgtaaaacttgataataaaggaattgatatacaagggaaaccgggtgcacaggcccgtgctatttttgatggaaaagtggctgccgtgttccaattgaacggacttttcaatgtactgatacgccatggtgattatatctcggtatattgtaatctttcatccgcttccgtgaaatccggtgatacggtaacgacccggcaggctatcggtccgattttctcggatggtagtgacaatggacggactgttcttcatttccagttgcgcagggagagggacaaactgaatccggagccatggctgaaccgataa

SEQ ID NO: 5155 - DNA, 3153 bp, B.fragilis
atacaacacatgcgaatcatcactctactaattaccttatttgcttttgggataacaccgttacaggcattctcctatttttcttttaagaagtatcaggtagaagacggattatcacataacacagtctggtgcgccatgcaagatagctatggctttatatggctgggaacgagcgacggtttaaattgctataacggacgtggtaacaaggtttacagaaatgtcctgaatgataagttttcgctagagaacaactttgtgcaagcactttttgaggaagagaaccacaatatatgggtcggaaccaactggggactttatatctacgaccgtgaatacgatcgtttcacttattttgataagaagacccgctatggcgtttttatcagtagtgagataaagaaaataataaagtccgaaagcggtttgatctggattgccactttgggacaaggattatttgtttataatcctcaaacggatgtgttgacacagaatagtcttcagacctctttcgtatgggacgtttgtgagaataactctggacatatctatgcctcttctttacaggaaggtttgctttgcttcgatgaaaacggtaaattcctgcaatcctatcctcttttgtctgccggcaataatcccgataattatcgtatcaactgtttgctcgatatccggagtgatatctggttcggtgcggggagcaacttgttgtactgtctgaacgagcgtaccggcaacctggactgctataatgcatcccatctgaatttcggtgcgatccgttgtctgctgaactactcggaaacagagcttctggtgggtaccgacaatgggctctacctttttgacttacatgataaaaacttctcacgaatcgataatccgtcagatcccagaagcttgagcgaccagtctatcaatgcaatgatgcgcgatgcagaaggtggaatctgggtgttgaccaatttgggaggagtgaattatctggctaaaccgactaaaagattcgattattatcctcctgtttatcgggatggaggtgtggctgccggaaaagtagtaggtcctttttgcgaaaatgctgccggggatatctgggtgggtactcgtgatgggttgtgtttctttgatgtctccactcatcaactgaccgcttatccgataggcggaggcgtggataagaagtacgacatacgttctttgttgttggatggcgagcgtttgtggattggtacttatgccgaagggttgaaggtactcgacctccggaccggccatgtgaaatcgtacaatcatctgcaggatactccgaacacaatttgcagtgacgatgtcctggcagtatataaagatcgaagcggggatatttttgtaggaaccagttggggactgtgtcgttacaatccccgggaagacaatttctcgacaattaccacagtagggtcaatggtctctgtggttgatattctggaagacatgtacgacaatctttggattggtacatccaacagcggtgtgtttcgttttaatacccggaacgggcattggaaacacttccagcatgaaaggaatgattcgactaccatcactaataattccgtaattacattatttgaagatctgaaaggtaccatgtgggttggtaccaatggaggcggactttgttcgttcgatccgaagaccgaaacatttattgatttcgatccggataatacaatattgcccaaccgggtcatctactccattgaacaagacaagaccggtgacttctggatatccagtaatgccgggttgataacgatcaatccgatcacaaagcagcatttccgccaatttacggtgaatgacggactgcaaggcaatcagtttacagcccaatcttcattgaaaacagcaagtggtaaactctatttcggcggaatcagtggcttcaattcttttgtccccgatcaattcatggataatcagtacatcccttccgtatatattaccgaaatacgcctgccttatacgacggatgaacggctggtgcaggatattcttcatctggaaggtcccctctatcgtgcggaaaccataacgttaccttacgaacataatactttctctgtgagctttgtagccttgagttacgaagatcctttgaaaaaccgttattcttaccgcctgaaaggagtagataaagagtgggttattaactccgaacagaatacggcttcttataccaatttgcctccgggcaagtatgagtttgaggtacggggttcgaacaacgatcataaatggaatgaccagactacttccttgctgattgtagtcacgcctccatggtggctgactacatgggcatattgtgtctatacgcttctcctcctcggtcttgcctattatgcaggctggcattggaaccggcatgtgaagaagaaatacaaacgtcgtatggaagagtaccagactacgaaagaaaaagaggtctacaagtcgaagatcagtttctttattaatctggtgcatgaaatccgtactccactgagtctgatccggcttcctcttgagaaactattggaagataaacgagaagggcgggatgccaagtacttatcggtaatcgaccggaatgtcaattaccttttggggattaccaaccagttgctcgactttcaaaaaatggaaaatggtggggtgcagttgagtctgaagaagtgtgatatcaaccaattggtaagtgatgttcacagccagtttacgagtcccgccgaactgaaaggcatctcagtgatgctcgatctgccggaaggcgagatctttgcttcggtcgatcgtgaaaaggtctgcaaaattatcgtcaacctgataggtaatgcagtaaaatatgcccaaagccgtatcgatatcaaattagtctcttccgatgaaggcttccgggtttcggtgagtgatgacggtccgggtattccggatgttgaaaagcgaaaagtatttgaggccttctaccaggtgaaagacggaaaatcgggagcagtaggtacaggtatcggtttggctttttccaaatcactggctgaagcacaccatggtacgttgagccttgaagatagtgtatatggtggatcgctcttttgttctcactttgccttggggtga

SEQ ID NO: 5156 - DNA, 906 bp, B.fragilis
gccttgaagatagtgtatatggtggatcgctcttttgttctcactttgccttggggtgaagaggctgtatccgaagaaccggaagtagtgataccggatggtcgggaagcggctgacgaagaacagggtaccgagttatcgggcagtaaatttaccattctgttggtggaagataatgtcgacttgctgaatctgacccgggaatctctgagtacctggtttaaagtcttgaaagctcagaatggccggcaggcacttgaggtacttgccaacgagacagtggatgtgattgtcagtgatgtgatgatgccggagatgaacggtctggagttaacggcaaaagttaagtcggacattgaatactcccatatacctgtcatcctgttaactgcaaaaacgacgctggaagccaaggtggaaggcttcgagtgtggtgccgacgtatatattgaaaaaccgttctctatccgtcagttacgcaagcagattgagaatttgctgaagctgcgccaagccttccataaaatgatgtctgaattatcaggtggcaatggggctgcccctatcagcccggtagaatattctgtgtctcagaaagattgtgaattgatggctaaggttcgggcagcggtcgaggcacagctttcggacgagaacttctccgttgatacactggcagagtcactcaatatgagccgttccaatttctatcgtaagataaaggccttggccggtatgccgcccaatgattacctgaagactatccgtttgaataaagctgccgagctgctgaaaagcggagtgcgcataaccgaagtgtgtgagaaaatcggcttcagttcttcgtcctattttgccaaatgctttaagattcagtttggagtattgccgaaagattatcattga

SEQ ID NO: 5157 - DNA, 1950 bp, B.fragilis
cgcaacccggtgaagacactcacccttcaatgtctttttagcaccgcccaaaaacgattcactgccgatgtggaacaacaagcggaaaaaatactctcacaaatgacccttgacgagaaactgtcttatatagggggtatcaattggatgtatacccgtccgctggaacgtttcggcatcccccgactgaagatgagcgatggcccacaagggctgggaacacacgggccctctactgcttatccgtgtgcactgatgctggctgccacctggaacgaacaattggctacggaatacggaagcgccctgggtaaagattgccgcgcacgaggagtacatgtcgttttaggtcccgcagtcaacatttaccgtgctccgatgtgtggacgtaatttcgaatatatgggagaagacccgtatctcacttcacgcatggcaaccggatatataaaaggcgtacaagggcaaggggtcatggctaccatcaaacactttatcgccaataactcggattatgatcgtgatcatatcagttcggatattgatgaacgaactctaaacgaaatttatttcccttcttttcgggcagccgtacaagaagccgaagtaggtgcagtgatgtcaagctacaatctgctgaacggaatttatactaccgaacacccgtggctgctgaaagatgtactaagacagcaatggggcttcaagggaatcctaatgtccgactggggatcgactcatcattgcatccctgccgtaaaaggggggctagatctcgagatgcctgccggaagcaagatgcaacccgaagaactgaagtactacttacgaacaggtgatatcacaatcgaaatgatagacgaaaaggtacgccacatcctgcaaactctccttgctttcggattccgggaaacacagcagccggatactcatatcccactgaacaatccgcaatgtgcccaaaccgctttgaacgtggcgagtgaaggcttggtattgctgaagaataccaaccagatccttccgatccgctccggcaaagtgaaaacaatcgctgtagtaggtaaaaacgcacaaggatatgtttgcggaggcggcagtggtgaagtacatccgttccaatatgtatccgtattggacggtatacgcaaagaagccgccgaaagaggcatccgggtagaatatctggatgtatacaactatttaccgactattatttttaccgatactgaaagaaagcaaaaaggcttccgtgctcagtacttcgataacatgaatttagaaggcactccgaaagtggaacagactgagacgaaaataaactattcctggtcgggtggtacgggattaaaagagatgcccaaagagcaattctccgtccgatggaatggaaccatctgtccacaagaaacagatgaatacctgttcacccttggcggagacgatggatacagactatatatcgatggaaaactcatcgcagacgaatggcacgaaggtgctttccgcaattccacttatcgttgcatgctggaagccggtaaaaagtatgacctgaagatagaatacttccagaaaggcggaggtgctgctgtcaattttatatggaaacagaagaatgcctcaaacaatttattcgttgaagcactgaaccgaaacgacctggtagtggcttgcatcggattcaactcagatacggaaggagaaggacgagaccgtaccttcgaactccccgaagacgaagcacaattactgcagaatacgctgcaatctaaacgtcccgtagtaggtatcgtcaatgcagggggcaatgtagaaatgcaaagctgggaaccttccctgaaaggactactatgggcatggtacggaggccaggaagcccggaacggcaatcgcacgtacactcttcggggagctcaatccttcggggaaattacctgtcacttttga

SEQ ID NO: 5158 - DNA, 651 bp, B.fragilis
ttctgtccctccgagttggatattaggaagatatattatctttgcccgctgaaaatgcgggtgagattccccgttctaaatccattcgttatgaaagtgaaaagatttgtgctttgtctgtttatgcttaccctgatagggggtatttgctttatttcctgtggaaatacttcgaaagcgaaggcagagagtgatgttgctgcggagacagctgaggagaccttccagtcgtttctgaagaaattcacctcaagtgcttctttccagtatacccgtgtcaagtttccgttgaaaactcccatcaccttgatgacggacgatgggaatagtgaaaagaccttcccctttactcaggaaaaatggccgttgctggatgccgagactctgaaagaggaacgcatcactcaggaagaaggaggaatttatgtttctaagtttacggtaaacgaaccgacacataaagagtttgaagccggatatgaagagtcggaagtagatcttcgtgtgatattcgacttgattgatggtaagtggtacgtgaccgattgctataccggatggtatggatacgaccttccgattgacgatctgaacgaaactgtgaaacaagtgaaagaagaaaacgacactttcaaagaattgcatccgtag

SEQ ID NO: 5159 - DNA, 552 bp, B.fragilis
gctataacatcaataacccttatggagaagataggaattttctgttccgcatccggcagcatcgacccgatatacttcgatgccgcccatcagattggcgaatggatggggaaaaacggcaagacacttatctatggtggtgccaacctcggactcatggaatgcgtggccaaagcagtcaaagaaaacgggggacatgtcatcggtgtagtaccttccaaactggaagaaaacggcaaagtgagtacataccccgatgagataatcgccacacacgacctgagcgaccgcaaggatatcatcctgcaacaatcggatgtattggtggcccttcccggcggcataggcacgctggatgaggtatttcatgtcatggcagccgcttccatcggctatcatcagaagaaagtgatcttctacaatgcagatggtttctacaacccactgctcgccgtgctcagcgaattacagacaagaggattcacccgtcaccctctgtcctcctattatgaagtagcaaacacatttaatgaattaacaattaagatataa

SEQ ID NO: 5160 - DNA, 585 bp, B.fragilis
agactgctgtcttccggcttattcagcttatctttgctcgaaaacatagaatttatgatgacattaatccgtattacgagtgctgacgattcacgtctgaaccgtttgattcctttgtacgaggagtcttttcccgaaagtgagagaagaaaaatcgggcagttgaagcgaatgattgagaaccatgccccaatgtatttcaatgctattgaatgtgatggagaattgagtggaatgtttgtatattgggatatgggtgacttctactatctggaacatttggctgtattccctgagatgcggaataaaaagatagggcagcaagtgcttgattatgtggctgaacacctgaaaggggtacgcctgctcgaagtagaacctacggaagatgaaatgactacccgtcgtgtgaattactaccggcgtaatggatatgaagtgctggataaaacttatgtgcagccttcttatcatgcgttggaagatgcttgtccgctttggattatgggaagtgaagattctccccggttggctgagcaggtagaaagaatcaaggaggaggtgtacaggcagcaagtcggctga

SEQ ID NO: 5161 - DNA, 708 bp, B.fragilis
ttcgtatccccggataacaaattatataataacaatcaagtaatcactaatcatcaattaccaatgaaagttgcctatctttcttctgcctatctggctcctgtagaatactacagcaaattgttgaactacgataaaatattcatcgaacaacatgaccattacatgaagcagacctaccggaaccgttgtaccattgccggaccggaaggcgaactggcactttctatccccaccgtaaaaccggaagagcctaaatgcccgatgaaagatatccggatttcggatcatgggaattggaggcatctacactggaatgcaatagagtcggcctataacagtactccattttttgaatattacaaagatgattttcgcccgttctatgagaaaaaatatgaatttctgacggacttcaacgaagaattatgccgactggtttgcgaactgatagatatacagcctgccattgaacggacgaaagaatataaaacagactttgccccgaacgaaatcgattttcgcgaagcgatccatcccaagaaagattttcaccggacagatccggaatttatccctcagccttactatcaggtattcgaagcccgccacggttttctacccaacctgagcatcatcgaccttctgtttaatatgggaccggaaagcctgctgatactgcagaaaacatgtgccgattctcaataa

SEQ ID NO: 5162 - DNA, 1242 bp, B.fragilis
ctgattaaaccaacctcaaataaaaacagacttatgaatcaaccagatatcatgactttaccaaaagacaaactctttttatccgaacaaacctggcgttggtacggaccggacgatcctgtcagcctttgggatattaaacaagccggagctacgggtattgttaacgctttacaccacattcccaacggtgaagtgtggaccgtcgaagaaattatgaaacgaaaggaactgatcgaatctgtcggcctgaaatggtcggtagtagagagtgtcccggtacacgaacatatcaaaacccagactggcaactttcggaaatacatcgagaattataaagaaagtttgcgtaacttgggacaatgcggcatccatatcgttacttacaattttatgcctgtgctcgactggactcgtacggatcttgcctataccctccccgatggctccaaagccctgcgttttgaacgcgccgccttcatagcttttgatcttttcttactgaaacggccgggtgccgaaaccgaatacacagatgaagaaaaaacgaaagcgagaatccggtttgaacagacggacgaaaaggagaaacagctccttgtccgtaatatgattgccgggcttcccggttcggaagaaagcttcacattggagcaatttcagcatgaattggaccgatacagaggcatcgatgcagaaaagttacgcacccacttaatctatttcctcaaagaaataacttcgacggcagacgaagccggtgtgaagctggttatccacccggacgatcctccttgctccattctcggtttgccacgcatcatgagctgtgcagaagattttcaggcactgatcgatgccgtccctaacgaatcgaacggactctgcctttgtaccggatcactcggtgtaagctgtaccaatgacttggaaggtatgatgagacggttcggagaccggatcaactttgtccatttccgaagtacccaacgggatgctgaaggtaatttctacgaagccaatcacctggaaggagacgtggacatgtatcatgtcatgaaagccttcctggagttacaacagagaagaaaagtatcgatccccatgcgcccggaccacggacaccagatggtagatgaccttaaaaagaaaacaaacccgggatactcctgcataggacgcctgcgaggacttgccgagttaaggggattggaaatgggaattgcaaagtcaatcttttaa

SEQ ID NO: 5163 - DNA, 282 bp, B.fragilis
aatacggcaaccgctctgtaccaatgtccattgtcccacatgacaatattgatggagggtaacattgccactcaggatgacacaatcatccaaggtacattctccggcgatggtggtgccgataccggctacacaattatctccgatttgtacatcgtgacaaatgtggactttatccatcaagaaattgccattgcctattttggtagcattcccaccgaaagtagcccgactgataactacgttttcgcggatatggttgttatccccgataatcagtga

SEQ ID NO: 5164 - DNA, 396 bp, B.fragilis
tccatacatttgccgccaattatgacagcatacatcaaactactaatgttatgcctgttgtttttggtattcggtacccagaaaagcagtgctctacagcccgtaaataacggggtggcggtcactactgccgtaaaaagccacactcacaatgttccctcttttgataactccggtcacgatctgtttgacttcaatcaggggatactgcttaagaaatcggtttcggattcagccaatccgtataaacagagcaataacttccatcccgctatcaagacggatgctcagagaccgataacattcaaagaagatacttctacctataccctccgtaacagagttaagcctgcacaaaaatacgatgtatttgcgctcaggcatatccttatttag

SEQ ID NO: 5165 - DNA, 765 bp, B.fragilis
tattttggatataaagtctataaagtcagtaaaacaatgaaaatagcattaataggttacggaaaaatgggcaaagaaatcgaaaaggttgccctcagtcgcggacacgaaattgtcagcattatcgacatcaacaaccaggatgatttcgaatccgaagcgttcaaatcggcagatgtggccattgaattcactaatcccatggtagcctacagcaattatatgaaagctttcaaagcaggtgtaaagttggtttcgggcagtaccggatggatggcagagcacggtgacgaagtaaaagaactgtgtaacaaaggtggaaagaccttattctggtcatctaatttcagtttgggagtaactatcttctcggctgtcaacaagtatctggctaagataatgaaccaattccccgcctatgacgtaaccatgagcgaaacccaccacgtacacaagctcgatgcaccaagcggaacagcgatcacactggcagaaggaatccttgaaaatatggaacgcaaaagcgtctgggtaaaagaggaagcacatgcaaccaatgaattgccgatccactctattcgcgaaggagaagtattcggtatccataccatccgctatgactccgaagcagacagtatctccatcacccacgatgccaaaaaccggggaggtttcgcattgggagccgtattggcggcagagtatacagcagcccatgaaggctatctgggtatgagtgatttattcccattcttaaaagattaa

SEQ ID NO: 5166 - DNA, 975 bp, B.fragilis
agaatactccaaacgccatcacggtggttacttgggcgaaaaatcaagaaaactatgcgtaaagtaatcggcatcggagagactatactcgatatcatcttccgaaacgaccagccttcggcagccgttcccggaggctctgtattcaacggcatcgtttctttgggacgcatgggagtcaatgtatgcttcatcagtgaaacagggaatgaccatgtaggaaacatcattctgcaattcatgcgtgacaatcacatcccgacggatcacgtcaacgtgtttccggacggcaaatcgcccgtatccctggctttcctcaacgaacacagcgatgcagaatatatcttctataaagactacccaaaacagcggctggacgttttattcccgtccatcaatgaagacgacatcattgtcatcggttcatattatgctctcaatccggtattgcgtgataagatattggaactgctggacatagcaaaagaaaaaagagcgattgtatactacgatcccaatttccgatcctcacacaagaatgaagcgatgaaactggctccgaccattatcgagaacctggaatatgccgacattgtaagaggctctttggaagacttctattatatgtacggaatcaaagacgtagaaaaaatctacaaggacaagataaagttctattgtccgctcttcctttgcacagccggagccgaaagaatctcactgcgtacgaacgcaatatccaaagagtatcctgtcgcgccattagaggcagtcagcactatcggtgcaggagacaattttaatgccgggctgatctacggcatgctaaagtacgacgtccggtaccgtgacttgcaacacctgagtgaagagacctgggataaagtgatacaatgcggacaagactttgcagccgaagtctgcaaaagtttcaacaactccatatccggggagtttgcggccaactaccgttga

SEQ ID NO: 5167 - DNA, 186 bp, B.fragilis
ttcataagtctgtttttatttgaggttggtttaatcagtcagtgtgtctgttctgtctcttcccttttcagatatgtgtgggatcagaagttagactttctttacatcgcaaaggcattgaatcctccatccactaccgccactgtacccgttacaaagcttgctgcgtcgctgatgaggtattga

SEQ ID NO: 5168 - DNA, 1236 bp, B.fragilis
caaataacacaaaaaatgaagaagcatctgattttatctgcttgcctgataatggcaataagcagttttgctcaaaaaaaggactttagttataagttttacggacagattcgcacagacctttattacaacagtcgtgccaacgaagagacagtagacggattgttttacatgtaccccaaagacgaagtattcgatagcaatggcagagatttaaatgcaactgccaacggtagcttttacaccctatatacccgcctgggattggatgtaaagggacctaaactgggacgcgccatgacttccgccaaagtggaagcagacttccgcggttcaggtacttcttactctactatacgcttgcgtcacgcttacctgaacctggattggggacgttcggctcttttgctcggacaaacctggcatccgctcttcggtgacgtatcacctcagatcctgaatctttcggtcggagcacctttccaaccgttcagccgtgctccgcaaattcgttaccgctatacacacaaagggttccaactgacgggagcagctatctggcaatcacagtatctgtcacaaggtattgtcggtaaaagtcagacttatataaagaacagttgtgttcctgagttctatctgggactcgactataaagccaatggatggatagccggagcaggaatcgaactgctctctctgaagcctcgtacagagtctaaagtagaggaccaagtctataaagtgaacgagcgcatcaccaccctgtcttacgaaggtcatgtgaagtatagcaataaagattggtttgtaggtgctaaaaccgtattaggctccaacctgacacaaacctccatgctgggaggattcggaatcaaatccatcgataatcggaccggagaacaaaagtatacaccgatccgggtatccagttcatggctgaacgtagtatacggacagaaatggaaaccgggtatcttcctgggatatgtcaagaatatgggaacaagcgatgccctggcatccaatcaagtatacggaacaggaaccaatgtggaccaagtggtgacagccggtgctgaactgacctataatgtcaaccactggaagtttggagtggaatatacctatacttccgccgcttatggctcactgtatcttaaaaacggtaaaatcatcgatacacactacgttggtaacaaccgcatcgtaggtgtagccatgtttatgttctaa

SEQ ID NO: 5169 - DNA, 1587 bp, B.fragilis
ctcaaaaagcagaatatgaaattagatagatttattaatcgtccggtactatcaacggttatctccatcgtgatagtgattctgggtgtgttaggcctgctgtcgctgcctatctcccagtatccggatattgcccctcctactgtacgtgtcaacacgacgtatcagggagccaatgcacaaactgtattaaacagtgtgattgctccgttggaggagcagatcaacggtgtagaaaacatgatgtacatgacttctactgccaccaataccggagaggcctctatcgaggtttactttaaacagggtacggacccggatatggctgccgtaaacgtacagaaccgtgtagccaaagcacagggtctgttgccggccgaagtaaccaaggtaggtgtgattacctcaaaacgacaaaccagtatgttgctggtattctccctgtatagttcggatgacaaatatgataacgaattccttgagaactatgctaaaatcaatctcgtaccggaagttcaacgtgtaccgggtgtaggtgacgccatggtgctcggtgcagactattctatgcgtatctggttgaaaccggacgtaatggcccaatatcacctgatgcctaccgatgtttcggcagcattggccgaacagaatatcgaggctgctccgggttcattcggtgaacagggcaaacagactttccaatatacgctgcgttataaaggacgtctgcagagccaggaagagtttgagaacatcgtgatccgtgccaattctgacgggcaggtgctccggttgaaagatattgccacaatcgagttaggtcgtctgacatacggattctctaacaacgtaaacggtcaccctgccgtaacggttatcgtattccagacagccggttcgaatgcgactgccatcatcaatgacatcctcgacttgcttgaaaaatcagaatcgactttcccgccgggagttaaagtaaatatctcacaaaatgccaacgacttcttgtttgcttctatccacgaagttgtaaagactttgattgaagcctttatcctggtatttatcgtggtttacattttcttgcaggatctacgctcgacactgattccggccatcgcgatcccggtagcattgatcggtacattctttgtgctttacatcatcggattcagtatcaacttgcttaccctctgtgccatggtactcgccattgccatagtggtggacgatgccatcgtcgtcgtcgagggtgtccatgccaagctcgaccaaggctataaatcagctcggttagcttccatcgacgccatgaacgaattgggtggcgctatcgtctccattacattggttatgatgtccgtgtttattccggtaagctttatgaccggtacttccggtacattctaccgtcagtttggtctgactatggctattgctattgccttgtcggcagtaaatgccttgacactgagccctgcattgtgcgccatcttactgaaaccccacgatcctgatgctaaaaagaaatcgattttggcaaccgtttccatgcttcgttcaatgctgcttatgacccagtattga

SEQ ID NO: 5170 - DNA, 855 bp, B.fragilis
cgaagccacaagacaagaagtctaacctttaaaagcaatagtatggcaaacttatttagtgtaaaggacaaagtagtagtcattaccggtggaacgggagtattaggaaaagcaattgcagcccacctggcagaagaaggtgccaaagtcattctcctcggacgtaaaaccgaagtgggtaataagattgtagaatcaattcgtacccaaggaggtgaagcgctgtttctgacaaccgatgtactcgaccggaagatacttgaacagaacctggcggatatactgaaagcttatgggcggatagatgcattactcaatgcggcaggaggcaatatgccgggagctacgatctcacctacaggcgatatctttgacctgaaaatagatgaattccagaaagtattggatctgaacctgaccggtacgatactgccgacacaagtattcctgaaacccatggtggagcaaagagcgggcgctatcgtcaatttctcatccatggctgctttccgccctttgacgcgtgtggccggctatgccgctgccaaggccgggatctccaatttcaccgcatttatggccacggagattgccaaaaagtttggtgaaggaatccgtataaatgccatcgccccgggattcttcctgacagaacagaatcgtgcactactaaccaatccggacggcacctatacacaacggggacaagacgtaatccgtcaaacgccattcgggcgtatgggacgtgccgaagagttatgcggaacaattcaatacctcatcagcgacgcagcaagctttgtaacgggtacagtggcggtagtggatggaggattcaatgcctttgcgatgtaa

SEQ ID NO: 5171 - DNA, 1185 bp, B.fragilis
acatcattaaaaattgaatataaagaaggtatgaaaagtaaaattgttttgtttgcattttgtttagccttgttgtcgggttgcggcaaaaagggcttcaacatgggaggaactcccgaatgtgcagtagagacattgcagcccaccactgtcaatctgaaaagctcctatccggccacaatcaagggtaaacaggatatcgaaatccgcccgcaggtttccgggtttatcactaaactgaatattgatgaaggatctatggtcaaaaaaggacaggtactgttcgtcatcgatccggtgcagtatgaatctgccgcccgtgcagcaaaagccgctgtagccacagctaaagcgaatgtttctactcaggaaatcactgtaaaaaacaaacgtgaattaaacaagaaaaacatcatcagcgactatgatctggaaatggctgaaaatacacttgcatctgcaaaagctcaattggcatctgccgaagcccagctgatcagcgctaaccagaatctggcatacacacgcgtaacaagcccttcggacggtgtagccggaacaatcccttaccgtgtaggtagcttggtaagcgcttcaagtccgtcacctctcactgtgatctcggacatcactcagatgtacgtttacttttcactgacagaaaaggaattactgaacctgatccgtcaggacggttctcaaactgaatttctgaatagcttcccggctgttcaactgacattggctgacggaacgttgtatgccgatagcggtaaaatagagacggtaagcggagtcatcgaccaaaacacaggtgctgtaagcatgcgtgccactttcccgaatcacggacatctgttgagaacaggcggtaccggtaacatccagattccttatagcaaggagaatgtaatcgttatccctcaaaaagcaacttacgaaatacaggataagaaattcgtatatctgctccagccggataacactgtgaaaaataccgaaatagaaatattaaatctcaacgacggacaaaactatgtagtcactgcaggactgaaagccggagacaaaatcgttgtcgaaaacgtcagcaccctgaaagacggtgctactatcaagccgctcacccagcaggaatcggccgaacgctttaaagcagctttggaagaacgcaaaaatcagtaa

SEQ ID NO: 5172 - DNA, 939 bp, B.fragilis
tcaatgggaaagggactcaaatggattatagcttttgccggagcaatggtcatcgtactgttgctccgcggctttgcttttacctcatgcctgataccttcggcgggtatggagaattccctttttcagggtgaacgtattctggtaaataaatggagctacggacttcgtgtaccctatatgtcattattctcctaccaccgctggggagaaagtcccatacataaagacgacatcgtcgtattcaataaccctgcgggtatcaaagaacccattatagaccgaagagagatttatataagccgatgcatcggtgtaccgggggatacgttacttatcgattcactcttcaacgtggtcgaccgtagcacacaactcggaccggaccggaaacaactatatacgtatccgcaaaccaaggaacagcaactggattcattgctttctattctttctattggccctaatgaactgatgggacaacacgaaggaaaaaatgtacggagcttcagccgctatgagtattatttgctcgatcaggctatgaacgggaaaagctggatacagcctttacaacaaagcttacaggaagaagctaaaccactcatcgttccgggtaaaggaaaagcagtccgggtatatccgtggaaccggacattgttacgaaacacgctggtactgcatgagggtaaacaggcggagatccgaaacgatacgctctacatcgaaggacgtccttcacaacattgttatttcaccaaagattattactggatggcttccaataattccgtaaatctttccgattcccgcctgttcggtttcgtaccgcaggatcatgtcattggaaaagcttcacgaatctggttctcaaaaacagaccatacgggaatctttagcggataccgctgggaacgattcttccaaccggtaaaatag

SEQ ID NO: 5173 - DNA, 1476 bp, B.fragilis
  unsure (1014): Identity of nucleotide sequences at the above locations are unknown.
aacctattgaatgggaagacatcgataatacggatgcagaaacagaaattgaacaatacgctaaataggaataaagaaaagaatatgaagaaacaaattataggtatgttgtgtgcaactgctctcttgagcagctgccacatctacaaatcatatgacagacctaaagatattgaagcctccggtctttaccgggacacagtatctgttgccgatacactggtatccgatactgtcaacttcggaaatctgccttggagagaggtcttcaccgatcctcaactgcaagcgttaatcgaacagggattaacccacaatacagatctgctgactgctgcgctgaaagtgaaagaggcacaggcatcactgatgtcagcccgtctggcttacgctccttcactcggattgtcaccacaaggaaccatcagcagctttgataagcatgccgcaaccaaaacctattcgttgccggcaacagccagctgggagatcgatctattcggcaagttgctgaatgccaaacgcggtgcacaagtaacattgttgcaaaccaaagcatatcgtcaggctgtacagactcagatcatttcgggcattgccaatacctattacaccttattgatgctcgaccgtcagctcgatattaccgaacagactgccgacatcatgaagcgtaatgttgaaaccatgcaggcaatgaaagatgcggctatgttcaacactacctctgcaggggtggaacaaagcaaggctgcctatgcacaagtactggcgtctattccggctatccaaaagagtatccgtgaagctgagaacgctatgtccatgctattggcacaagcaccacagactatcaaacggggggttctggaagagcagcaattacctgaagatttctcagtgggcgttcctttgcaactactctctaaccgtccggatgtgaaagcagccgaaatggcattggccggtacttactacaatgcaaattcgacccgtgccgccttctatccgcanatcactatcagcggctcggccggttggaccaatagcgccggtagtgccattatcaatcctggtaaactgcttgcctctgtacttggttcgcttacccagcctctcttctaccgtggtgcaaacattgcccgcctgaagatagccaaggcacaacaggaagaggctaaactggccttccagcagagtttgttgaatgccggaagtgaagtaagcaatgcattgtatcaatatcagagtgcttctgaaaaaactgcttcccgcaaattacaggtagaatcttcagaaaaagcatccgaatatacaaaagaattgtttaaattagggacgtctacttatctggaggtattgtcggccgaacagtctttgctcagtgcccgtttatctcaggtaaacgacaccttcgaccggatgcaggctgtagtgagcctctatcaggcattgggcggcggaagagaagattaa

SEQ ID NO: 5174 - DNA, 939 bp, B.fragilis
aaacagatgaatacattacctatccacctcgctccgctgcaaggttataccgaagcagcctatcgcaatgcccatgccgccgttttcggcggtgtggatgtctatcatactcctttcgtacgaatagatcggggagaattccgccataaggatgtacgggatattcttcccgaaaacaaccgggttcctcacctcattccacaacttatagcctccgagatggacaaaacagagcgaataatcgcccttttcatcgaacaaggctatcgggagatggacattaacctcggttgccctttcccgatgttggcaaaacggcaatgtggatcgggcatgctgccccaccctgataaagtggaaacattactcaaacagatcgaacagtatcccgatgtgagcttctcagtaaaaatgcgcctgggatgggaaaagccggatgaatgtttgaccctgttgcctctattgaatgcggctccgctgaccgagattatcgttcacccccgcttaggtatccagcaatacaaaggagaagtaaatatggagggatttacagctttctacgaagcatgcagacatcctgttatctacaacggagacatcctgaccatagaagatatccggtgcatcaccgaaaagtttccgaaacttaccggagtgatgatcggccgcggattattggcaaaccctgcattgggttgggaatataaagaaggcaagaaacttacgcctgaagaatggagagaaaagttgagagcactgcacacagccgttttccaacactacgagacacagatacaaggtggcgaagcacaactggtgactaagatgaaaacgttctgggagtatctggccccacaaatagaccgaaagagctggaaagctatccataaaagcactacgcttgccaaatacaacattgccgtccgttcggcattttga

SEQ ID NO: 5175 - DNA, 1695 bp, B.fragilis
  unsure (1417): Identity of nucleotide sequences at the above locations are unknown.
aaagaaatcgattttggcaaccgtttccatgcttcgttcaatgctgcttatgacccagtattgaagaaatataaaaaacgtgttctcttcttcatccagaaaccggtgctgaccatcggctccgtagtagtgggtttcgcactgctcatcttcctgatgaaagtgactccgaccggtttggtaccgaatgaagatacaggaacgattatggcagtagtcgatatgcctcccggaagctcactggaacgcactcaggaagtgatgtggcaggtagatagcctactggcctccgacccggctatcgaaagccgtaccatgatcgccggttatagctttatcgccggtcagggtcccagctacggttcatttatctgtaaaatgaagaactgggatgagcgttccatcgctcaacgttctgacttcgtttcaggtatgctgtatctgaaagcccgtgaagtgattaaagacgcccgcgtactgttattcgctccccctatgattccgggttacagtgtatccaacggtttcgaaatgaacttacaggataagacaggcggtagtctggataaattctatgaagtagctcaggactttatcaccaagctacaggcacgccccgaaattcagtcggcacagacttcgttcaacccgaacttcccgcagtacatgatcgatatcgatgccgctgcttgtaagaaggccggattatctccgagcgacatccttactaccctgcaaggatattacggtggtctatattcgtccaacttcaaccggttcggtaagatgtaccgtgtaatgattcaggccgatccgaacagccgtaccaatctggagtcactgaactcggttaaagtacgcaacggcaacgagatggctcctatcactcagtttatgagcgttaaacgtatttacggaccggacaacatcaagcgtttcaacatgtttacggcgatgactatcaatggttcgccggctgacggatacagttccggtcaggccatccaagccatgcaggaagtggcagaacagacgttgcctaccggatacggatatgaattctcgggtatgacccgtgaagaacaaagttcgagcggcagtactactgcgatgatcttcgtcctctgcttcgtatttgtttatctgttgctgagtgcacaatacgaaagttatattcttccgtttgccgtactgctttctataccgttcggtctggcaggtagcttcattttcgcccacctgatgggattggcaaacaatgtccttccgatactgggagcagctaccaacaacatttatatgcagatcgcattgatcatgttgatgggtctgttggcaaagaacgccatcctaattgtagagtttgctctcgaccgtcgtaagatgggtatgagtatcacttgggctgccgtattgngtgcaggtgcccgtctccgcccgatcctgatgacttcattggccatggttgtcggcctgttgcctttgatgtttgccatgggcgtaggtgccaatggtaaccgtgctttgggtacggctgcggtaggcggtatgtttatcggtatgatatgccagatattcgtggttcctgctttgttcgttatcttccagtatctacaagagaaggtgaaacctattgaatgggaagacatcgataatacggatgcagaaacagaaattgaacaatacgctaaatag

SEQ ID NO: 5176 - DNA, 627 bp, B.fragilis
aggtataaagatatgaagaaactgataatattcgatttggatggtactttattgaataccattgccgatttggcacatagtacgaatcatgctctgcaaactttgggatatccgactcatgaagtcgcttcctataacttcatggtgggtaacggcatcaacaaattgtttgagcgtgcattgcccgaaggagagaaaaccgaggagaatgtgctccgcgttcgtaaagaatttcttttgcattatgaccggcataatgccgacgagagtcgcccttatccgggaattccggaattgttggaaacattgcagcataaaggttataaattggccgtggcttccaataaatatcaggcagccaccgagaagctgatagcacattatttcccgggaatccggtttgttgctgtatttgggcagcgtgagggagtgaaggtgaagccggatcctgctgtggtgcatgatattttgcagattgccgatgtttcgaaagacgaagtgctgtatgtcggcgattcgggagtggatatgcagacggctatcaatagcggagttacttcctgtggagttacggggggatttcgcccccgtaccggacttggaatccgtctggccggaattttatag

SEQ ID NO: 5177 - DNA, 516 bp, B.fragilis
gttaaagtggaacaaatacacagaaaaaaaggcaaacttgtaacttccggcatgggtaaagccggacaaatagcgatgaacatcgccactacgttttgttcgaccggaattccctctgtcttcctgcaccccagcgaggcacaacacggcgatctgggcatcctgcaagagaacgacctgttattattgatttcaaattcaggtaaaacccgtgaaatcgtagagttaacccagctggcccacaacctgaatccgggcctgaaattcattgtcatcaccggcaatccggacagtccgcttgccagcgaatcggatgtatgcctgagcacaggacatcctgccgaagtttgtaccctggggatgactccgaccacttcgactacggtaatgaccgtcatcggcgatattctcgtagtgcaaaccatgaaaaggaccgaatttactattgaagaatactccaaacgccatcacggtggttacttgggcgaaaaatcaagaaaactatgcgtaaagtaa

SEQ ID NO: 5178 - DNA, 3093 bp, B.fragilis
ttgttaacggaatgcctggcgatgtgtagcctggcgaccatggctcaacatgacgaatggaaaaaccccgaaattaatgcggtaaaccgtgcaccgatgcacaccaattactttgcttactcttcaagtgaagaagccgcaaaagccgataaggaaaactcaagcaactttatgaccctgaatggcatctggaaattcaactgggtgaaaaatgcagatgctcgaccgaccgacttctaccggacagactataatgataaaggttggggacagatgaaagtccccggtgtttgggaaatgaacggatacggtgatccgatttatgtcaacgtaggttacgcctggagaagccaatacaaaaacaatcctccttatgtgcccatagaaaacaaccatgtaggatcgtatcggaaagaaatcattattcctgccgaatggtcagaaaaagaaatattcgcccactttggttcggtcacttcaaacatgtatctatgggtcaacggtaaatatgtgggatatagcgaagacagtaaactggaagctgaatttaacctgaccaaatatctgaaaccgggcaagaacctgattgcgtttcaggtattccgctggtgtgacggtacgtacctggaagatcaggactttttccgctactcgggagtgggacgtaactgctatttgtacagccgcaataaaaaatatattcaagatatccgtgtaactcccgacttggacagcaattatacaaacggtacattgaacgtggcactcaatctgaacggaagcggaacagtagagttgaacctgacagatccggcaggaaaaagtgttgctacggcacaggttaacggaaatggacaaaagtctgttgtcatggacgtgagcaatcctgaaaaatggacagcagaaacacccaacttatatacactgactgcaaccctgaaaaacggcagcaacacgctggaagtgatcccggtaaaagtaggtttccgcaaaattgaattgaagggcggacagatactggtgaacgggcaaccggtgctctttaaaggtgccgaccgccacgaaatggatccggacggaggatacgtggtttcccgtgaacgcatgctgcaagatattctgcgtatgaagcagctgaacattaacgcggtacgtacctgtcactatccggacgacaatctgtggtatgacctttgcgaccaatacggtatctatgtagtggcagaggccaatatcgagtcgcacggaatgggatatggcaaagaaacacttgccaaaaatccatcttacaaaaaagcacacatggaacgcaaccaacgcaatgtacagagagggtataaccatccttccatcattttctggtcattaggaaacgaagccggatacggcccgaacttcgaacagtgctatacatggatcaaaaacgaggacaaaacacgcgccgtacaatatgagcaggcgggtaccaatgaatttacagacattttctgcccgatgtattacgattatgacgcctgcaagaagtacagcgaaggcaatatagacaaacctttgatccaatgtgaatatgctcatgctatgggtaactcgcaagggggcttcaaagagtattgggatctgatacgcaaatatcccaaatatcagggaggttttatctgggactttgtagaccagtcgaaccattggaaaaataaggatggaatagacatctacggatatggtggtgacttcaataaatacgatgcttcggacaataattttaacgacaacggactgatcagccccgaccgtcgccccaacccgcatgcccatgaagtgggatacttctaccagtcaatctggactactcccggcgatctgtcaaagggagaaataaaggtatataacgaaaacttcttccgggatttgtccgcttattatatggagtggcaattactggcaaacggtgaagtaatgcaaaccggagtcgttcaggacctgaacgtggctccccaacaaacagcgactctcaaactgaatctgaatacggaaaaggtctgtccatgtaaagagttgttgctcaacgtaacttataagctgaaagctgccgaaacactgatgccggcaggaagtacagtggcatatgaccagctgaccatccgtccgtatacagccaaagcattggaattaaagaaccagaaagcatctaatcttgacattgtcgtaccggtcattaaggacaacgaccataattatctgattgtagaaggcgaaaacttcataatcgaattcaataagcacaatggatatctctctcgttacgaagcagatggtatgcaattattaaatccgggagctcaactgactcctaacttctggcgtgctcctaccgataatgattatggagcaggattacagcaccggtatgctgtctggaaaaatccgggactgaagttgacttcattgaaacaaagtatcgaaaacgaacaggcaatcgttcaggctgaatatgaaatgaaagctgtaaaaggaaaactattcctgacttatgttatcaacaatgagggagcggtcaaagtaactcaaaagatggaagccggcaaagaagaaaaggtttctgatatgttccgtttcggcatgcaaatgcaaatgcccgaaaacttcaatgaagtggaatattatggccgtggtccggttgaaaattatgccgaccgcaatcactctactttaattggcaaatatcgccagacagttgccgaacagttctacccgtacatccgtccgcaagaaaccggtaccaaaaccgatttgcgctggtggagagtattgaatatcagcggaaacggtctgcagtttgtaggtgacgctcctttctccgcctctgccttgaactatagcatcgagtctttggatgacggagtacaaaaagaccaacgccactctcctgaagtagcgaaagctcctttcactaacctttgcatcgataaagtacagatgggtctgggatgtgtcaacagttggggaacacttccactggagaaataccgtgtaccttatcaggattatgaattcagtttcatcctgacccccgtacgccacaaagtgaatatgtga

SEQ ID NO: 5179 - DNA, 1353 bp, B.fragilis
ctttatagactttatatccaaaatattagtcgcaaagataagatttttattacatttgtcgagcacattaacgtcttgttaacaatggaacaactcctgcactatgtgtggaaacacaaaatcttccctctccatgaactgcaaacaaccaccgggctgcctgttgaagtgattgataccggattgccgaattctgattccggccccgatttttttaatgccaaactaaaaatcggtggtacgctttgggtaggtaatgtcgaaatacatactgcttcttctgattggtttcgtcacggacatgaccgtgacatagcgtatgattcagtgattctgcacattgtcacagagatcgattgcgagatatatcgttccaatggggaaccggttccgcaactccggttaccttgccccgaacaggtgaaagagcattatgatgagctttgccgggcagatatacacccgccttgctattccattctggaaacccttcctaaattaacgattcactcctggctgaccgctttacagacagagcgctttgatcagaagaaccgaaccataactcggcgactccaacgttgcaatcagcattgggaagatgcttttttcatcacgttggcacgtaatttcggattcgggctgaatggagatgcttttgagacttgggcaaatctgctctcgtttcgtgccattgataagcatcgtgacgatctgacacaggtggaagctttcttcttcggacaagccggtttgttggagggagaatccgccgacgattatttcagttggatgcagaaagaattccgttatttgcaacacaagtttgaacttcctccggtgatgaatccctctttgtggcgtttcctccgtcttcgtccgggtaactttccccatgtgagactggcacaattagcttcactttattacagagaacactctttgttttcacgggtcatggaagcggagactctgaaagatctgaaacagatttttgccggtcacacttctgcttattgggaagaacatttcatgtttggcaaatcctccccacggagagagaaaagtattggtgccggtgcaaaggagctgatcattatcaatacggtcattccttttctgtatgcatatggcctgcataaagccgacgaacggttgtgtgagcgtgcggcctcattacttgaagaactgaaagctgaaaataattatgttacccgtatgtggagcggagccggcattccggttcagacagcggcggatagccaggcgttgttacaattgcagaaagaatattgcgataagaagaagtgtctttattgccgttttggctatgagtatctgagacataaataa

SEQ ID NO: 5180 - DNA, 225 bp, B.fragilis
gagcttttcagattgacagtggtgggctgcaatgtctctactgcacattcgggagttcctcccatgttgaagccctttttgccgcaacccgacaacaaggctaaacaaaatgcaaacaaaacaattttacttttcataccttctttatattcaatttttaatgatgttcattttgtggcaaagtggtttatcgtgataaccttatcaggtatagatgaaaactga

SEQ ID NO: 5181 - DNA, 828 bp, B.fragilis
gcctctatcaggcattgggcggcggaagagaagattaactttaaatacaatacaattatgattagtccattagcatcgatagcccccggggcaaaaatcggaaagaatgtgatcattcaaccgtttgcttacattgaagataatgtcgaaataggggacgactgtatcattatgccctatgccagtgtgctgaatggtacacggctgggaaaaggtaacaaagtatatcaacatgccgtattaggagcagaaccacaggatttccactacaaaggagaagaaagttcactgattatcggggataacaaccatatccgcgaaaacgtagttatcagtcgggctactttcggtgggaatgctaccaaaataggcaatggcaatttcttgatggataaagtccacatttgtcacgatgtacaaatcggagataattgtgtagccggtatcggcaccaccatcgccggagaatgtaccttggatgattgtgtcatcctgagtggcaatgttaccctccatcaatattgtcatgtgggacaatggacattggtacagagcggttgccgtatttcaaaagatgtgcccccatacagcattatggccggtaacccggtagaatatcacggagtaaatgccgtagtattgcaacaacataaaaatacgagcgaaagagttctacgccacatagccaatgcttatcgcctgatctatcagggaaacttcagcctgcaggatgcagtgcaaaaaattatagaccaggttcccatgagcgaagagatagagaatatagtggcttttgtcaaagagtctaagcgtggaatcgtaaaatag

SEQ ID NO: 5182 - DNA, 1302 bp, B.fragilis
acgacaataagttttattgtatttttgtgtcctcaacctaacttaatagtaagaatgaagcagttaagtacccgtgcagaaatgcaatataatatacataccctgtccaatggacttcgcattattcatgaaccctcttcttcgaaggtggcttattgcggatttgccgtagatgccggaacccgtgatgaggccgaaaatgaacaaggaatggctcactttgtagagcatcttatttttaaaggtacccggaaacggaaggcttggcatatcctgaaccgcatggagaatgtgggtggcgatctgaatgcgtataccaataaagaggaaactgtgatatattcggcatttctgaccgagcacttcggaagagcactggaactgctgggcggatatcgttttccattccacctttccgcagaacgaaatcgaaaaagagacagaggtgatatcgatgaaatacagtcgtacgaagacactccttcggaattgatctttgatgactttgaagatatgatcttccgcaatcatccgttaggacgtaatatcctgggcagacccgatctgctgaagaaattccggagcgaggatgccatggcttttacttcccggttttatcaaccctccaatatggtattctttgtcctgggtgatttcaattttcagaaaatagtccgtcaggtggagaagctgttagtggatcttccgttggttacggttgagaatcagcgtacgatacctccgctttatgtacccgagcagttggttgttcacaaggagacccatcaggcacatgtgatgattggcagtcggggatataatgcctatgatgacaagcgtaccgcattgtatctgctgaataatattctgggtggtccggggatgaacagtcgtctgaatgtctctctgcgcgaacgcaggggactggtctatacggtggagtccaacttaacgtcatataccgatacgggagctttctgcatttatttcggtaccgatccggaggatgtggatacttgtctgaaactgacttacaaggagctgaaacggatgcgtgatgtgaagatgacctcttcgcaattgatggctgccaaaaagcaactgatcggccagatcggggtcgcttccgataataacgaaaacaatgcgctgggaatggcgaagacttttctgcactacaataagtatgaatcatccgaatctgttttccggcgtatcgaagccttgacggcagaaggactgttggaggtagccaatgaaatgtttgcagaggaatatctctctacactgatttacagataa

SEQ ID NO: 5183 - DNA, 1497 bp, B.fragilis
aagattaacatcatgagaaaagcaacacgtactcaatggataaagtgttccattgccattcttttgtatctgatattcctgatttgggtgaaaagctggtggggactgatcgtagttcctttcatcttcgacatctacatcaccaaaaagattccctggtcgttctggaagaaatctaaaaacccgacggtccgtagtgtgatgagttgggtagatgccatcgttttcgctttggtagcagtatatttcgtaaacatctatgtttttcagaattatcagatcccatcatcgtcactggaaaaatcgctgctggttggagacttcctctacgtgagcaaaatgagttacggcccccgtgtgccgaacacaccgctatcaatgcccttggcacaacatacattgccgattctgaatactaaatcctatattgaatggccgcaatggaaatacaaacgtgtacccggattcggtaaagtgaaactgaatgacatcgtagtgtttaacttccctgcgggagataccgtcgcactgaatttccaggatgcagacttttatacattggcgtacaacatcggaaagcagatttacccgaacccgatcgacatggacagcctgactcgggagcagcagaagacagtgtatgatttatactataatgccggtcggaaagagatactgtcaaaccctcaacgatatggtaaagttgttacccgtccggtagaccgccgggagaactatgtaaaacgttgtgtaggacttccgggagatacactccagattatcaacggtcaggttatgattgatggcaaggccattgaaaacccggaaaacttgcaattcaactattttgtgcaaactaccggcccgtacatcacggaagaaatgttccgcgaactgggtatcagcaaagccgaccaaagactaactcccgaaggagcaagctatgaagagggactgattgagctgggattggacggacgaaatgcccaaggtggactgaatcctgtttatcatcttccgttaacgaagaagatgtacgacactctatccggtaacaaaaaattagtcggtaagattgtaatagaaccggaagaatactccggagaagtgtatcccctgaatttaaatacccattggaatcgtagtgactacggccctatctggattccggcaaagggtgccaccatcacactgaccccggacaatctgcccatttatgaacggtgtatcactgcttatgaaggcaataaactggaacagaaagaagacggaatctacatcaacggtgtgaagacaaaccaatacactttccagatggattattattggatgatgggcgataaccgtcataattccgccgactcccgctattggggattcgtaccggaagatcacgtagtaggtaaaccgatcgtcgtatggttatcattagataaagaccgtaactggttcgatggtaaaatccgctggaaccgcatctttaagtgggtagactga

SEQ ID NO: 5184 - DNA, 339 bp, B.fragilis
cggagttacttcctgtggagttacggggggatttcgcccccgtaccggacttggaatccgtctggccggaattttataggtaaacaaggcgggaaacttattttgataatggtttgggatgaaaaccagaaaggggaacccggaaaaaggcgtaaaggtctatgggttcttccgctgattgaaaaagaaaccgatatatccctgcgcgtatttgatctccgcccacgaccttgggcgaggaattatccgggtttctatgaagataaaaggctgttggaccgatcgatattgcgtgcaatatggacgcgcacattttttgatataaatgttgcatgttag

SEQ ID NO: 5185 - DNA, 1116 bp, B.fragilis
ttataccatgtaacgagaattcctatctttgcaatcagtgctttcagacaaatacaaactatgtacaagaacctgttcaatttactaactattttacttattctgccttcgtgcacagacatgtctcctaacatttcggtggtttgcgaagagaataatataggaaactgtattcttaaatgggaaacgactcctctcatcaaggggcaggtgaaagtatatacatccgacaatccggaattcatacccgaagataatccggttgccatggccaatatctccgatgcgcgaatgacgattgtgaccaacgatccttccaggcgctcttattacatgctggtgttcaacgataaatactgtgtgaaagtggctccccgcaacgtgaatatgcccggcattcaaaacttccgtgacctgggaggttacaaatccgccaccggaaagcatgtacgttggggcaagctctaccgttcggcacagatagacagcctgcattgctttgccctcaggaaactgcaaaacctgggtatcaagaccattctggatctgcgctccgagagcgaactccataatactcctcccttgcaaaagggattcaatgtagtacatatccccatcaacacgggcgacatggaacatatcctgcacggcatacagcaagagaagatcaagacagataccatttaccacatggtagaagcgatgaatcgtgaactggtggccaaataccaaaaggaatataaagagattttcgacatcctgctcgataaaaacagttatccggtcgtgattcactgctcgtcgggaaaaggacggacaggcattgtatccgcactgatactggcctctttagatgtcaatgcagatatcattatggaagattaccgtttgagcaacgattacttcaacatccccaaagcctccaaatacgcctataacctaccggtcaattcacaggaagccatcaccaccctcttttcggcaaaagaagactttctcaatgcagccaaagacgagatagagcggaaatacggtgatgtgcccacctatctgcgaaaggcaatcggccttcagtccgaagacatacacaggttacgcaccatcttactggaataa

SEQ ID NO: 5186 - DNA, 645 bp, B.fragilis
accatgaaagtaaagaagatcagtattgctaatgtggaggtcgatgcacttcccgaattactggataaagaaaagatcggtttccaacccattgataatgtgaattgggaagcctacccttatcgtccgaaagtggagttccgtatagcacatagcgatgatgctgttttgttacacttcaatgtaaaagaggccagtgtacgggccaagtatggagaagacgatggctccgtatggactgattcctgtgtggagtttttctctgtacctaccggcgacggtatctattataacatcgaatgcaactgtattggaaccattcttattggtgcaggagcagaacgcaacaaccgtgaacgcgcttctcgggaagtgacagatcaggtgaaacgttgggccagtctgggacgccagcctttcgatgaacgtatcggtgagtgcaactgggaggtggcattggtgattccatatacagctttcttcaaacatcacattacctctttggacgggaaaacaatcacagccaacttctataaatgtggcgacgaactgcaaactccgcatttcctctcatggaatccgatcaaaatagaaaagccggattttcaccgtcccgacttcttcggtacgttggaatttgaatag

SEQ ID NO: 5187 - DNA, 1454 bp, B.fragilis
  unsure (1400),(1421),(1422),(1427),(1441),(1442),(1447),(1449): Identity of nucleotide sequences at the above locations are unknown.
tgcgtatctttgcacccgaaaataaagatatacagagatttaatgaagacatttgaagagcttggcgtttctccggagatacgtaaagctattgaagagatgggatacgagaatcccatgccggtacaggaggaagtgattccatacctattaggagagaataatgatgtagtagctcttgcacagacagggacgggtaagaccgcagcgtttggcttgcccctcatccagaaaattaacgtaaaaaacagaatacctcaatcactcgttctttgccccacacgcgagctttgcctccagatagcaggcgacctgaacgactattccaaatacatcgacgggctgaaagtattgcccgtatacggcggttcatccatcgacagccagatacgcagcctgaaacggggtgtgcatatcattgttgccacaccagggcgactcctcgacctgatggaacgcaaaacggtatctcttgccactgtcacaaacgtagtgatggacgaagcggacgaaatgctcaatatgggctttacggacagtatcaatgccatcctggcagatgttccgcaagaacgtaacacactgcttttctcggccactatgagcccggaaatagcccgtatttcgaagaactaccttcacaatgcaaaagagatcaccatcggacgcaagaacgaaagtacgagcaacgtgaagcatgtggtctataccgtacatgcaaaagataaatacgccgctctgaaacgcatcgtagactattatccgcagatttacggtatcatcttctgccgtacccgcaaagagacacaggagattgccgataaactgatgcaggaaggttataacgctgactcgttgcacggagaactctcacaggcacagcgtgacacggtgatgcagaagttccgcatccgcaacatccagatcctggtagccaccgatgtagccgcacgcggactggacgtagacgacctgacacacgtcatcaactacggattgccggacgatacggaaagttatacgcaccgtagcggacgtacaggacgtgccggaaagacaggtacatccatcgccatcatcaatttgcgtgaaaaaggaaagatgcgcgaaatagaacgcatcatcggtaagaaattcattgccggtgaaatgcctaccggtaagcagatctgcgagaaacagcttctcaaagtgatagacgatcttgaaaaagtaaaggtaaacgaggaggatatcaatgatttcatgcctgagatttaccgtaaactggagtggctgagtaaagaagacctcatcaagcgcatggtatcgcatgagttcaaccggtttgtcgactattatcgcaaccgcgaagaaatagaggtgccgaccgatagccgcaggtcttcaccacgggggtnaatgccaacgctattcagttnnttccnaacgctgtctattnntcctnanccgct

SEQ ID NO: 5188 - DNA, 432 bp, B.fragilis
caaaggggcccgttttatttttactcaccctttgaaacaggaggaaaaccgatgaagagactggttgttctattgtttggtttggtcggtgccgccttgtttatgtcagctgccaattcgggtgatcgtgtactgcgtgacagtatctttcatgtctatcggtcgatgcctgccgacaccactcggaccgtttttgcgaaagaggctgcaatgggacacgttaaagaaagctgggcgttggagttactggattcggcattggtgtttgcccgggagataaaagatgtggagggtgagttggaactccaatacgggatttttcgttactatacgttcaggatggacggtgagaatatggaaaagacgtgtgccaccctgagggaagcgtgttatcgttatgtcttcaccacggggctggaaggggccgctcta

SEQ ID NO: 5189 - DNA, 1128 bp, B.fragilis
gttatctttgctaaccttacacaaaatataaagatgaaacagcttatattgtcagggatgttcgttgtatgtggattgtccgtatcccttgcttctgaaaagtgggctgtggatagcataaactggcatcgtgcagagcagaaaatgcaagagaaggattttcaggatgcagcactgacatataaggaattgattacgaaaggagattctttgtttgtggattatgccggccggcatgttgaggatatgcgtgaacaatattccattgacgagttggacttacaaaacggaatgcagcagaagaaaatatggaaattggtgtttatcaccattctatgtctggccgttttgttattcgtaggacttctctatttgaggagagcggagagaaaacttctattttccagagaagagttgcaaaaggcaaaaaggctggccgaagagtctgtccgtaataagagcgtatttctttccaatatgagccatgagataaaaactcccttaaatgcgttggcaggtttctctgaaattttgattactccgggaattgacgatgaagttcgtgcgcagtgtaatgacgtgatcaggttaaactccgatttattgttgcatttggtaaatgacgtagtcgatgtttcgtgtctggatgtggcaaatatgagattctccgtggttccgcatgaggtggtggctttatgccggaatgtggtggagatgctgagaaatatcaaacagacttctgcggagatgatttttgagacagaattgtctgctttggaaatggaaactgatccgtgcaggctccagcaagtattgatcaacctactggtcaatgccacaaaatttacgaaggagggatatatcacattgacactgcggataaatgaagccggggtacctgagtttatggtaacggataccgggtgtggaattccccttgaaaatcaagaggctgtattcagtcggttcgaaaaactcaatgaaggcatccagggtacagggctggggctgtctatctgtaagctgatcattaatcgtatgggaggagacatccgggttgactccacttatagcaaaggggcccgttttatttttactcaccctttgaaacaggaggaaaaccgatga

SEQ ID NO: 5190 - DNA, 375 bp, B.fragilis
  unsure (137): Identity of nucleotide sequences at the above locations are unknown.
ccgagaaataaatatgcttttatcgtggtgaactatgccaatggtgatatggtaggtcataccggtatttacgaagctatcgagaaagcggtagttgccgtagacgcgtgtgtgaaagataccattgaagcagccanagctcaaggttacgaagctatcatcattgccgatcatggtaacgctgaccatgctttgaatgaagacggtaccccgaatacggctcactctttgaatcctgtaccttgtgtatacgtgacagagaataaagaagcgaaagtggcagacggacgtttggcagatgtggcgcctaccatcctgcatattttggatatggttcaaccggctgagatgacaggttgcaatttgattaaataa

SEQ ID NO: 5191 - DNA, 561 bp, B.fragilis
aacaaattatcaaatcccatgcataccaccattttagaaaccgaacgtctccttcttcgtcctttccgggaaacggatctgcaagagctctttgaatgttgccaaaacccaaacttaggaaataacgccggctgggaaccacataaaaatatcgaagattccaaagaggtcttacatactgtatttatgggaaatgaaggagtttttgccataattctcaaagaagataattcactggtgggttctatcggtattattactgaccccaaacgggaaaatacccggacacgtatgctgggatactggctgaaagagtgccattggggaaaaggtatggcctcggaagcgacacgaaccatattggattatggatttaacgtactgggattgcatttgatttcagcgaactgttatccgcataacacccgttcccgacttttattggaacggaacggatttgtatacgaaggtatactccatgaagcagaaatgacttatgacggacatgtatacgaccatttatgcttttatcagaaaaaaggaagagtgcccatggactaa

SEQ ID NO: 5192 - DNA, 198 bp, B.fragilis
cacagggttccacaaagtgaacttaatctattgataactaacgatgctgatctgtggcgtatccgggttttgacacatcctcatttggtgtactcgctctatttatttaaaaaacgaaagaaaatccatcctgtaacattggttacaaattatttgtatctcatttccgacctttgcccactgaataataaaagatga

SEQ ID NO: 5193 - DNA, 348 bp, B.fragilis
aatgaaaaaacaaataagaatatggaacagtcattcaaaaagggaattgtactccatctagcctcattagtagaatattctgaaggtggaattatcagtaagcagttaatcaaaagccctgccggaaacattactttattctcattcgacaaaggcgaaggacttagcgaacacagtgctccattcgatgctttagtacaggtattggaaggatctgcgaatattgttgtaaatggacaagtttttacggtaaatgcaggagaaagtattgtatttccggctaatgcgccgcatgcattgacagctattgaaagatttaaaatgttactgacaatgattaaagagtag

SEQ ID NO: 5194 - DNA, 1215 bp, B.fragilis
tctaacagagcgacaatgaactcaaaaaaagtacttttcatcatcttcatttgtacattgactgtgaccggatgcgatacacaagaacaaactactatagatagtggcttaactctgatacgggctacacaaacacttgattctttatatgcaaattattctgtatcaggaacctgtctgttaatagagaattatccttctaatgtaggaaattacacagccacgtatttggcttctgaagaacaaaaagaaatccccaatcaatattcttacttatggccttattccgggacattttctgctgtaaatgcactatgggcagcaaccggggatgagagctataagacattactcgataacaaggtattgcggggacttgaaaaatatttagatatcagcagaagccctgccggttatgcctcgtacataaacacggcttcccaatccgaccgcttctacgatgataatatctggttgggtattgacttcacagatgcttatctaaatacaaaagaagaaaaatacctgaagaaagcccagcttatctgggaatttatagagagtggagcagatgacaaattaggcggaggtatctattggtgtgagcaaaagaaagtatctaaaaatacatgttctaacgcaccggcatcagtgttcgcattaaaaatgttcaaagctatccgagatagttcttacctgataaaagggcaggaactatatgagtggactaaaaaaagactgcaagattcgaccgattatttatactttgacaatatctctttggatgggaaaattgataagtctaaatatgcctacaatagtgggcaaatgatgcaggctgccactttattatatcaacttaccggttgtagccattttttgaaggatgctcaaaatatagcaaaagcgtgttataactatttttttataaattttatacctgaagaaggggaacctttcaaactccttaaaaagggggatgtatggtttactgccgttatgctgagagggttcattgaactctaccaaactgaccataataaaacatatatcaactctttcaatcaaaacatggattatgcatgggaacatgtgcgtgatgagaagggacttttcgatatcgatttcagtggaagaacccatgatgaccgcaagtggctgttaacgcaagctgctatggtagagatgtatgctcggttagcagtaactaaataa

SEQ ID NO: 5195 - DNA, 933 bp, B.fragilis
tatgacatggcaaaaatacaaattaaatctgagaaactcacaccttttggaggaattttttcaatcatggagaaatttgactccatgctttcacccgttatcgactcaacactgggtcagagatgcagcagtatcttcggatatcagttcagcgagatagtccgttcgctgatgagcgtttatttctgtggcggctcatgcgtggaagatgtaacgtcacaactgatgcgccatctctcgtatcatcctacccttcgtacatgcagctctgataccatcctcagagccatcaaggaactgacacaggaaaacatctcctatacttccgaccaaggcaagacctatgatttcaatactgcagacaaactcaacacattgcttataaacgctttggtttctacaggcgagttgaaggaaattgaggaatacgatgttgactttgaccatcagttccttgaaacggagaagtatgatgcaaaaccgacctacaaaaagttcctcggctacaggcctggcgtatatgttatcggtgacaagatagtctatatcgagaacagcgatggtaacacgaatgtgcgttttcatcaggcagacacccataagagattcttcgctcttctggaatcccagaacatccgtgtaaatcgcttcagggcagactgcggttcctgctcgattgaaatcgtcagtgagatagagaagcattgcaaacatttctacatccgtgccaaccgatgcagttcgctctacaatgacatctttgctctgagaggatggaagacggaggagattaacggcatccagttcgacctcattccattcttgttgagaaatgggaaggcaagtgctatcgtcttgtcatccagagacaaagacgcaacagtggcgaccttgacctgtgggaaggcgaatacacttaccgatgcattctga

SEQ ID NO: 5196 - DNA, 690 bp, B.fragilis
aattattcttatcatccgaatagggaatcttcttattttttctgtctttataatcaagaaatcaattataaaaccaaaaacagaaaacatatgcagaaagtactctttatcaccacaatcctacttacattattcgctctttctatccgtgccgaacacaatcctcgaaaaaggcccgatgtatctgcccaattccaaaccgtctccggtcacagcatcagtttaaatggcatcggactagcctatagttatgaatatgcttttacccccaaagggactattatttttagcgcaggatcttcttatgcttttggaagaatactacagctcaaaatggaatcactccgcgaatttcatatcgacaccaaagactatcatttagtaaccggagatttagccatagaaccacgtttttattataacctgaagaaaagacatcgcaatggcaaacgtacttggggcaattccggcgggtatttatctgttaatttcggatattcttttccaataaccattaccagtggagtgaaagcagcccacatatatgttatcaccccctattggggattccgtcgcgtatggaagcattttctattcgatctatcgggtggagtcggctatatcggatcctcaaatagaacttctgccgtttatccgggtttaagaataggtttaggatacagattctga

SEQ ID NO: 5197 - DNA, 1290 bp, B.fragilis
gcaatgaattatacttatcgacaaatttggcttatcaactatcctgtgatgttgagcattctgatggaacaattaatcaatataaccgatgctgtttttctagggcatgttggtgaggtggaacttggtgcttccgctcttggcagtatttattatcttgctatttatatgttaggatttggttttagcttgggagtacaagtgatggttggacagtacaatggaaagggacattataccggaacaggcggaactttctttcaggggttagtctttctatgtgtacttgctatcttgcttagcctctcttcttattttttttctccgtttcttttgagatattttgtgcactcttctgagatatattgtgccgtgattgattatctggattggagatgtttcggtttgcttttttcttttccctttctggcatttcgttctttttatattggtattgtccgaaccaatgctttgtcatgggcggcactggcagccgttctaataaatattccctgtaattattggtttgtttttgttcttgatagaggaatagcgggtgcggcgatagcttcttctttgtccgaagctgcttctcttctgattattgtggtttatacttggctgaaaatcgatagaacagactttggactaaaatttatatttgacaaatgtttgttagtggagctatggcacctctccgtatggagtatactccatgcctttatcagtgttgttccgtggtttctttttttcgtggttattgaacgactgggagaagctcagcttgctgtttctaatattattcgaagtgtctctacaatcttctttgtgattgtcaattcgtttgctgccactacgggagcattagtcagtaatttgatcggagcaggagagaggcaatacctgtttccgctttgtaggaaaattttaaagttgggctatgcaattgggcttcccctggtagtattagctatggtctttcgtcggcagattactggattctatacggacagttctcaacttattaatatttcaagtatcccttttgcagtgatgttgctgaattatgtgtttgctttgcctggatatgtgtatattaatgcggtgacgggtacgggtaaaacccgtattgccttttggttccagttgataacgattgttatttatttgttctatttgtatctgctaagtcattataccgcctctctggcagtatatctgacagcggaatatctttttgtgattttgttggctgttcagtccgtactctatttgcggatatcatcgtaa

SEQ ID NO: 5198 - DNA, 252 bp, B.fragilis; identical to SEQ ID NO: 860

SEQ ID NO: 5199 - DNA, 255 bp, B.fragilis
tttgcatataaagaatcaagtgtttgtgtagcccgtatcagagttaagccactatctatagtagtttgttcttgtgtatcgcatccggtcacagtcaatgtacaaatgaagatgatgaaaagtactttttttgagttcattgtcgctctgttagattattattgtgtatcattactttcttttaaagaggatatttttaagatatcctcttttcctttgtttataaaacctctttcacctaatcaatttctctaa

SEQ ID NO: 5200 - DNA, 696 bp, B.fragilis
aaatacaaaaagatgaaaaagttaatctatacactttgcctatttaccggcatggcaatctcttcttgtgaagactggttggcaagagacccactggatcagattgcggatgtgaatctgacctatacggcagatgaatgcaaactgtacgtaaatcagttttatacctcattttggggctcgcctaacaactatatttatcatattgaccgaggttcggataacctgcttagtgacaattatcaagataacaaagacttgattgaaggtttgcaccaggttccttccagtggcgaaggctggggaactactgaatggggaaaaatacgcagtgtcaactttttgttggataactgtgacaagtctcccgaaccggaaaaagcccgcaaatacattggtgaagcttacttctttagagctatgctctactatgaacagtttctgcggaagtttggcggtgctccctggattgataaaacactggatcttgaatcaggagaattgtacggccctcgcctgaagcggcacgagttagctgataagattctgaatgacatggatgatgccatagacagattaccgacatatagtcagcaggagaccggacgtgtctcaaaagaggcagctatgctatacaaagcacgaattgccctgttgtcttcaccacggggctggaaggagcagcggatatcataa

SEQ ID NO: 5201 - DNA, 1893 bp, B.fragilis
atcatgaaaaacaagtcaattgcatcttttatgataaaaatcgtaatgatgcctctactctttacaatctcatgtgtaaatgaaatttcagaagatcctgtagatattcccggagagatacccatccgtctttctacacaaattttatgtaaccacacacgtgctatcaataacgaatttcaggaaaaagatgccatcggtctgtatgtattgacacaattatcaaccatcaaccagaaacgatacattgacaatatgcgtttcacatgttcccaagcaaccggtttcgaaccagaagaaacaatctattatcccaagggagacggtaaatgtgattttataagttattacccttttcaagaaacaggtattaaccaagaccaaagtataatgcaagtccaaatacataccgaccaaagttctgtaagcaaacactcgctctccgactttatgatcgctacaaacagtgatattacccccagtcaaaatatggtatctatggaatataaacataaactctgcaaactgaaaatcactataaaaccagctccgggagaagatatagatgaacttttaaatgacaatccatctctatcattaaatggattccattcggacgcatcatatgattttctcacagatcgattcgagccatcgggacaaacaattagtgtcacacctcatggagaatggaaaatagagaataacgctctgacaggcaaagaagtcatattaatacccgaaaaaatagaatctgacaatcactatataaatatagatataaacggtaaaagctatagttgtccatttcctgataattttcaattagccagtgaaaaaaattgttctatagccattatttataaatcatccgaaggtatccaaatcaacaatttcgatcatagcattacagactggacagaaggggattccggtgaaacgacagcccaggaaacatcaggcgtaattcatctctcagctctaaaattcagtaaaagtaacgtttataaggcaattaatgaaggaactcaggtagctgaaatatgtaaagagtatcttttagctgataacatcgacgcacaagccattgtcgtctatcccgtcctaaacggagcaacagatctgaataacggaacagtaatttgtttacttgacgaaccagcatccattcatggaggtaaagtctcttggaacaaagttaataacgcattagactacacgccaggcaatcaaagcatcatcagcgacttctatataacccaagacaactcaatatcaatttctaagccggaaaaccctctaccggtgcgattacaagaagaggtcttgacagatatacgaaatacggaaacccaaacttaccctatagtcaaaataggaatccaatattggatgggacgtagtctagaagcgacacactatactgacggtaaagcaattactttaaaaaaagattttacaacaacagcaggctattacaccggcaaatttaaagatgcacctcaagacttttacttttacaattcagaagctgttatttcaggcaagctatcacctcaaggatggagtattcctaccgaaaccgagtgggaactattaaagcaatatataaacaacgatgcttctaaactgaaattcggaccatggtcgagcgatgaaaatggtgacaagcttcccatactaaacattacgggattcaatggagtaccagaaggatatattctaaaaagtaagaacggatataccaacggcttatatacggtggtatactggtctaccaattcatctggaaatcaaacaaacagagcaatctatttgctgcataccacaaatgaaataaaagatggtaatataacagacagagctctttctgtcagatgtatccgtaaataa

SEQ ID NO: 5202 - DNA, 834 bp, B.fragilis
caaattctgaaacagactgtttatgtaagtatcaatcctcaaaaccatcctattatgaacagatttgaaaataagataatcattatcacgggagctgccggtggaatcggcgcatcaaccacacgccgcattgtatctgaaggcggcaaagtaattattgctgactattcaagagaaaaagcagaccaatttgctgccgaactgagtaattcgggagcagatgtacgtccggtttatttttctgctacagaattgaaaagctgcaaagaactaatcacctttacaatgaaggaatacgggcagatcgatgtactggtaaacaatgtaggaggtacaaatcccagacgggacacaaacatcgaaactctggatatggattattttgacgaagccttccatctgaatttatcttgtaccatgtatttgtcccaactggttatccccattatgagcgcacaaggtggtggaaatattgtaaacgtagcctcaataagtggaatcacggccgattcgaatggtactctttatggagccagcaaagcaggagtcatcaatctgaccaaatacattgccacccaaacgggaaagaaaaacatccgttgcaatgcagtagcaccgggattgatcctgaccccggccgcactgaataatcttaatgaagaggtacgcaaaatatttctcgggcaatgtgcgacaccctatttaggtgaaccgcaagatgttgccgcgaccatcgcttttttagcctccgaagatgcacgttacattaccggacagaccatagtagtagatggcggattgacaatacacaatccgacaataaacttagtataa

SEQ ID NO: 5203 - DNA, 216 bp, B.fragilis
aacaaaacgaaacaagccttttctatccctctttacaacaaatgtaaccgcaccattgcaaaggttacatataccatcgaaaagtataacattcattctaatattctaaatgatggaagtctcgaatgcactggtcagcatatcataatcagcgtcgctgtattctcctttttcccttactttcttcacctgttttataaatgtttccacttgtga

SEQ ID NO: 5204 - DNA, 963 bp, B.fragilis
tttatagatgattttgaaagcaaaatgatttttatattgttattagtgcaatatcaacgttctataagcttgttctatttattaattattaaaggaaacattatgaaaaaaaatctattgttagttggagcacttgtaagtgctttcctgttggcttcttgctcaggcggggataagagtaaagctcctgttgtcagtacggcagatattgaaaatgcggcagaagtaatcaagtattataatacttcgcttggggtgttgaaagatatggtgaaggaaaaagatgtaaatgctgtattggattatatggaacaaaaaggaaaagccccggctctttctgccattgttcctccggccgttgtttcaaaagactcggcaatagtgttgaatccgggtaactgtttcaacgaggagacccgccagaatctgaaacagaactataccggattgtttcaggcaaggacagaattttatgccaactttgatacttatctttcttatttgaaaaagaaagatgtaacgaatgcgaagaaattgttggatgtgaattatcagttaagcacgcagatgtccgaatataaacagaatatttttgatattctgagtccgttcaccgaacaggccgagctggtacttttggtggataatccgttaaaagcacaaattatgtctgtccgaaaaatgtcttccacgatgcagagtattctgaatctttatgcacgtaaacataggatggacggtccacgtattgatctgaaggtagccgagctaacccaacaactggatgcggcgaaaaaacttcctgttgtgaatggtcatgaaggcgaaatgaagtcttatcaggctttcctttcacaagtggaaacatttataaaacaggtgaagaaagtaagggaaaaaggagaatacagcgacgctgattatgatatgctgaccagtgcattcgagacttccatcatttag

SEQ ID NO: 5205 - DNA, 271 bp, B.fragilis
gagagcagaggggtttgggctgaagtcattgctactgacgcccttgcaacccccggtgaagacatttagctatatgctgtttgtgttaatctacttcccgtgcattgccacgttggtagccatcaagcaggaatccggtagttggaagtgggctatcttcacggcaggatataccacggcgttggcatggcttgtttcatttgccgtctatcagataggaggaatgtttagcccaatagcatggatgtcaaacttgctcatgatggtctag

SEQ ID NO: 5206 - DNA, 471 bp, B.fragilis
agaaatatggataaagtgattattaattcttatgaagattttgagaagttgataggtcagcagattggagtctctgactatctggaagtttctcaggaacgtatcaatctttttgctgatgcaacattggatcatcaatggattcatgtggatacggaacgtgctaaagtggagagtccttatcatagcactattgttcacggatatttgacattgtcattgcttcctcatttatggaatcagattattgaggtcaataatttaaaaatgatgatcaattatggtatggacaagatgaagtttggacaagctgtattgtcaggccaaagtgtacgtttgaaagcaagtctccattctttgactaatctgcgtggtgtggctaaagccgagattaaatttgcgattgagattaaagatcagccaaagaaagcccttgaaggtatcgctatcttcttgtattattttaattga

SEQ ID NO: 5207 - DNA, 861 bp, B.fragilis
atcatggaaggaaaaaagacaacgcaagaagaatatcagaagtgtgtaaatgcagtagtagattatattaatctccacttgggtgaagaaattgacctgaaatcattggccagaatttcccatttctcccccttctactttcaccgcattatgaaagcgtttttgggtgaacccatcggtacctttattgtccggacacgaactgaagcagcggcacgcctattacgttattcatcaacttccatatccgatattgcctatcggatcggatatgcttctccatcgtctttttccaaaatattcaaacaaatgtatggtatctctccaacagaatatcgtaataataaaaactatgtaattatgaaaccagcaattattaaaccggatctggaattgaaaaaggaaatcagagaactcccccaacgaaatgtaatttatatccgcctctttggtgattataaactaaatgactatgcaggcacatggatgcacctcattcagtttgtgaaagaacaaaatcttccgatgggagacccttctccactctgtatctaccatgatgaccccaaagtaaccccaaccgataaacttcgtactgacgtatgtatgttgttaccatcaaatgcaaggccgaaaggaaatgtaggattcaagcaattgcctgccggacgttatgcaaccttcctatacaagggttcatacgatcagttgcaagccgtgtatgacacaatttacggcaaatatctacctgaaatggagtgtacactaagcgatgaaccaagtgctgaaaggtatcttaatgatccatcatgtactcctcccgaagagttattaaccgaaatctacattccaatccggtaa

SEQ ID NO: 5208 - DNA, 405 bp, B.fragilis
aatattagaatgaatgttatacttttcgatggtatatgtaacctttgcaatggtgcggttacatttgttgtaaagagggatagaaaaggcttgtttcgttttgtttcattacagtccgaaacggggaaatccctcttgaaacgatatgctgttgaaagtactaataaaactctttattattttcggaataatcgttgttattccaaatctacagctatactctatattttaaaagatttggggggattctggcagtgtctttatccattaattcttattccggctaagctgagggatgcgatttatttattggtttcgaaatatcggtatagaatatttgggaaagcagattcatgtataaaaccgtttggtttttcttcggaagaatctaaaagatcagattaa

SEQ ID NO: 5209 - DNA, 738 bp, B.fragilis
aagaataatgtattaggtaagtttattcttgatttttttaatatctttgttgaaatcaaatcttacctcaatacgatgaatgtcaaaatagaaagtagctggcaacagcgcctgcaagaagagttcgataaaccctatttcgaaaaattagtgaactttgtcaagaatgaatacgggaaggcacatatacttccacccggacatcaaatttttcatgtattcaattcatgtccttttcagaatgtaaaggtagtcattttaggtcaagatccatatcctaatccgggacaatattatggtatatgtttttccgtaccggacggtgttgctattcccggttcactttccaacatttttaaagagatacatcaggatctaggcaagccgcttcccaattcgggtaatctggataggtgggtcaaacaaggagtattccccatgaattccgtacttaccgtacgagctcacgaaacaggttcacaccgtaatataggatgggaaactttcaccgacgcagtcatcaaaaaattaagtgaagaacgtgaaaacctggtattcatgttatggggatcatatgccaaagaaaaagcatcactaatcgataccgataaacatttaatattaaccgccgtacacccttctccccgatccgccgattatggatttttcggttgcaaacatttcagtaaagccaatacctttttacgaagcagaggcatagaagaaattgactggtag

SEQ ID NO: 5210 - DNA, 3189 bp, B.fragilis
aaaataaatgtctttttaatcaaagttagtattatgaaaataaaaaaacacattctaatacctctaatggtattgctactttttggaagtatggacgcgatggccgccatagagcaggctatacaagtaaaaggtaaggttgtagacaatattggcgaacctgtaattggtgctaatgtagttgtaaaagggaccacgaccggagtgattactagcatagacggtagttttgccatcgacgctgtaaaaggttctactattgtggtatcttttatcggttatttatctcaggaagtaaaagtaactggtaattttctaaatattacattagagaacaatacggaattgttagacgaagtagtggtagtgggctacggtgtacaaaagaaagccaaccttacgggtgctatcgccacagtaggggcgaaggaacttgaggaccgtcctgtaactaatgctgccgcagcacttcagggtaaggtagccaacttgaatatctccaatggagacggtggtccgggtaagaaggcatcgttcaatatccgaggttatgccggactggacgcaacctacagtccattggttatcatagacggtgtaactggttatttcgatgatttgaatcccaatgacattgagacgttgactgtattgaaagatgctgctgcaagtgctatctatggagcgcaagctgcctacggtgtgatattggttaccactaagtcaggtaagaagaatgaaaagactgtcatcaattataacaataatttttcgttcaacagtccgaccgtactacccaaaacacccggttcattggagttttccagactttttagagaagctgacatcaatggaggcggtagtggtattattgacctggagacgatggagcgtattgaaaaatattactatgatccgaccagtattcccaacaacgtgccgcaacgagataatccggaccgttgggctgattggggagacggacgttcaaatgccaacgaagactggcaaaaagctatgtttaagaataaccagcttaaccaacaacacaacatctcaattcggggtggtagcgacaagactacatacgtcatgtctctgggatatctgaaagacgaaggcaaactgagatattacgatgatcattatcaacgttacaatgcgttggccaaaattacgactgacgtgacgaagtggctgaccgtgggcttgaatgtacgttattcacacgaaaagagtgtatctcccgcttacggcatgaatccgggtggcagtgtcaacgatatgattggttggacacaagtagtgtggcctactattcctgtgcgtgatcccaatggacatttctctccggccggacgtatggtattcattgccgatgccaatcctcagacttcatacaccgataacttctggggcactgctaacgtagtcatcaagccattgaaaggttggactatcaatgccgactttacctacaacaaatggatgaacaaacgtagttactccaaaggtctcatttattcctactcggtgagcaacgagccttaccttgaaggtggatttggaactgaagatacgcgtgtatggcaggaatctaacaatgatgacttcacatcaatgaatgcatatactacgtatgaaaaagagttcaagggacacaatttcaagataatggccggtatgcagtcggaatataagaagaacttcggtctttatgccaataaaatggggatggtattaccgggccaaccgtccatttctaccagtacaggaaagatagaggcctgggattctttggatcattatgctactctcggtttcttcggtcgtttcaactatgactacaagagtcgctatctctttgagttcgacctgcgcagagacggttcttcccgttatgccaaaggacaccagtggggaactttcccagctttttccgccggttggaatgtggctaaggaagctttcttcgaaccttatacttcaatactttccgaattacgtttaagaggatcttggggagaattgggcaatatgcggggaaaaaattaccaatatatctctaccgtaccttataacgctacgaccgattatattatgggtgacaaacgaatcagtgcctttggtgctcctaatatgattgcctataatacatgggagaagaatcgtactttggactttggcgttgacatcgccgcactgaacaatcggcttactatgtcgttcgactggtacagaagagatattatcggacttattacaaagggtgtcactttgcctgccgtgctgggtgtaaactctcctgatacgaacaatgccgatatacgtaatgagggttgggaactgacactcggatggagagaccagttctcgctggcatctaaatcattcaactacagtgtatcgttcaatctttcagattaccaaggaactgttttgaaatattcaaatcccaaggggctgatatatgactactacgtaggtaagaagatggggaccatatggggatataccaccgatcatataatgaccgatcctgctgaagcgaaagccattaacgattctggcgtacagaacaagtttggtggtgactgggttgtaggtgacatcaagtatgtgaatctggatgatgatcctaacattaacgatggaaatcagacgctggaagaccatggagacctctctatcattggtaatgatactccccgctataattttggttttggcttcaatgcagactggaacggtatcgacttttcgatgttcttacaaggaaccatgaaacgtgacttatggctggaaggtcctgttgcctttggactcggaggtgggcaatggggttccaatgtatggaaaaacacactggactgctggcgtgaggatggaagtaatccggatccatggttaccaagactctatttgtggagcaccagtaagaatttgcagaaacagacccgttacatggatactggtgcttattgccgcctgaagaacattcagttgggatattcgttaccgggagctattattaataaggtagggctggaaaaagtacgcatttacttcagtggagataacctgctgactttctccggtattaacgagaactttgatcccgaagctccgtggggcggtgcatatcccatctccaagtcaatttcctttggtgttaacgttacattctaa

SEQ ID NO: 5211 - DNA, 318 bp, B.fragilis
cggcatccagttcgacctcattccattcttgttgagaaatgggaaggcaagtgctatcgtcttgtcatccagagacaaagacgcaacagtggcgaccttgacctgtgggaaggcgaatacacttaccgatgcattctgaccaacgattacaagtcatcgacgagggacattgctgaattctacaatctgcgtggcggcaaggaacgtatctttgacgacatgaacaacggattcagttggagcaggctgcccaagtcattcatggcagaaaatactgtctttcttctgcttactgcattgtacactatttactactag

SEQ ID NO: 5212 - DNA, 741 bp, B.fragilis
aagatgaaagttatgaaagattataaactaatggcggttggacaaattgtagccgattgttttgattatgcaaaggtcttcaataagtatggtattgatttttgctgtaatggagatgtttccctggctgatgcttgcgggaaaatggggatagacgcagattgtttgcttgaagaattgaagcaaataaaatcggaacagtccttaactcttgactttaaaagttggcctatagatttattagtagattacattttgaagttccatcatcgtaatatccgttatcagggaccgcaaattctccagttgcttgatagggtttgtgaagcacatgccagaaagcacccggaactttatgaagtgcgtgaactgtttcaggaatcctggatagatttgaacaatcatcttactaaggaggagatggttttgtttccttatatatatgatttatttgatgcggtggctcaacatcgtcctattccggctttccattgtggaagtgtgagtagccctatttcggtaatgatgagcgaacatgatgccgaaggagaacgttttcgcaggatttccgggttaactcatggatatctggtacctggtgatgcttgtagtagttataggttgctacttgagatgttgaggacgtttgaagataatttgcaccatcatattcatttggagaacaatattgttttcccaaaggctatagagttacaagagaattgtgaacgaatgtgttaa

SEQ ID NO: 5213 - DNA, 204 bp, B.fragilis
tttgagaaaaatggactgaacctacgcctgagctacaactttgcatcggccttcatcgatggaatgggtgaagacacctttcacgaccgctattacgaccgcgtgaactatctggacgtaaacgccagttacacttttgcgaaacactacaccctttatgccgaaagcaacaaccttgtggaaacacccctccgcttttattag

SEQ ID NO: 5214 - DNA, 2448 bp, B.fragilis
agactatcagtcatgggcggtcatctctacgccgacgaaaaagcaaacgtagtaaaacaaggtacgatccggggacgtatcatcgacacttccaaacaaacactaccgggtgcctcgatctacatcgagaacctgaagacaggagttatcagtgacgtaaacggtttctataccttcgccaacctcaacccggggacttatacggtaaaagtaacttatgtgggatatgcccccgtagaaatgaaaataaccattcccgaaggcaagacactcgaaagagatgtcatactgaacgaaggagtcgaattgcaggaaattgtaataggcggtgcttttcagggacagcgccgtgccatcaactcacaaaagagcagtctgggcatcaagaatgtagtttctgccgaccaggtaggcaagtttccggattcaaacatcggagatgcactgaaacgtatttcgggtatcaacgtacagtatgatcagggtgaagcccgtttcggacaggtacgcggtacatcggcggacctcagttcggtcaccatcaacggcaaccgcattccttcggccgaaggggatacacgcaacgtacaacttgacctgattccggccgatatgattcagaccatcgaagtcagtaaagtggtaacttcggatatggatgccgatgccatcggcggatctatcaatctggtcaccaagaattcaccctataaacggacgctgacagctactgccggttcgggctacaactggatcagcgagaaagcacagttgaatctgggactgacttatggcgaccgtttctttaacgacaaactgggggtcatgttatcggcttcctatcagaatgccccatcgggttcctacgataccgagtttctttgggagaaagacgacaaaggaaacgtatatatcaacgactaccaaatacgccagtactatgtaacccgtgaacgccaaagctattcggcagccttggactgggatatcagcgaaaaccacaaattgatgtttaaaggaattttcaataaccggaacgactgggagaaccgataccgcactactctgaaagatatggatgaagagggaaaagcaactgtacgcgtacagactaaagccggtacgccggacaatcgcaacgcccgcctggaacgccaacgcacgatggacttcacattgggaggcgagcatctgttcggaccggtgtctatggattggaatgccagttacgccaaagcaacagaggagcgtccgaacgaacgttacattgatttccaactgaagaaacagcaattcgacatggatctgagtaacgaacgcgaaccgctggctacaccaaagtccggttctacaatgacactgaacaaagatttcggcctgaaggaactcaccgaacaacaggaagacatcaaggaaaaagacctgaaattctccatgaacttcaaactccccttccggaacggaaacaaactgaaattcggtgccaaggtggtacgcaaaaccaaagataaagaggtagacttttatgaatatactccgaaagatgaagaggcattcatggccaacagcctgcagaacacggtagatcaaaccaacaaaaacttcatgccggaccataaatatcaggcaggcatttacgccgacaaacaatatgtaggttcactggacctgaacaatccctccctctttgacaaagaacaggtgcaggaagagttagccggtaacttcgaagcacgtgaaaccgtaagttcgggctacatccgtttcgaccagaagctcacggacaacgtagaactgatgaccgggctccgcatcgaaaacaccagcctcagctataccggacgcacgtatgacgacgaaacagaccaaacctcgaagactgcccgagaaacgaacagttacatcaacttcctcccgtcactcctcatgaaatggaacgtaaacgaggatttcaaagtacgcggttcgtttactcagacattgtcacgtccgaagtattctgccctggtacccagtgtcaacatcaaacgttcggataacgaagtgacagtgggtaatcccggcctgaaacctactctttcttataacttcgacctgagtgcggattattatttcaaaagtatcggtctggtcagcgcaggagtattctataagaaaatagacgatttcattgtcaaccaagtgtctacaaactacgaatacaacggcaacctatacaaccgctttatccagcccaagaatgcgggtaatgccaatctgataggtatggaactctcttaccagcgtgatttcggatttatcgctcctgccctgaaatgtatcggtttttatggcacttacaccttcactcactcccgtgtggaagacttcaacttcgaaggacgcgaaaatgaaaaggatctgagcctgccgggttctccgaagcatacagccaatgcatcgctctaa

SEQ ID NO: 5215 - DNA, 225 bp, B.fragilis
ttcctagttcttatggaacttggaaaataccccggacggggagtaaaagcaaagcgaatcaaaacagtagaaataaatcatttaataaattacaagtatggcaaaagcaagttggtgcaatgtaagccccatgtcgggcaagagagatggcgttttgacaatcagtgcgggtgctcacacaggacgtgtagcacgaaatacagtagttaccgtaacagcggctaa

SEQ ID NO: 5216 - DNA, 405 bp, B.fragilis
agacttccgctgcgcaaaggacgcccttgccaggtgaaactgcgttcccttaaacttttgcagccctacgacctggacaaggagcaggaattggtgccgatgactccgcagcaggcgacatggaaggtctttacctatttcgacagggatatggaactcagggtgcaggagttgcgggagcagccggggatcatcagggtcgatgtcgtggcaaaagaggtgctgaccaggccggaagagggtgatttcgacatgtacccgccaccatccttgcaggatgttgccgacagaaggaagatcatgtacacctataaggggaagctcaaatacagaccgtatccaccggggcttacacaggaggaggttgtaaactacagggcgggagtcattgccgtaaagatataa

SEQ ID NO: 5217 - DNA, 1200 bp, B.fragilis
gtgcgtatgagtttcgagattatcagaaaaaccggagagatcgcctttgtggcaaaccctatcgcctttgaggtaaaaacctccggggaggccgaaattgaaatccgtctcagggttggagcacaggaggtgttttcagcctcctacgtaccttttggtgacaggatccatttcgacattgccgaaatcttgcagcccttcgttacttccggacccttggaggactcggaggatctgatcctgcccgtatccggttttatggccggttacacgctcgaggtaaaagggcgggagacccggacactcaccggcaaggtgatatgcggggggatcagcaaacaggcggcaagggaaatggccggcaggggaacggactttatcctgaaccggctcagggattattcatcgcaattcctctttaccacgcggacccgcgggaagcatattgcgataagggaaaccgaagtctcccccctgatcttcattcatccggacaaaaggatacaggtggaatccgaatatggaaacagaataaaactgcctgaagggacagccggagaagtttatgctttaaacatagggcggatccggcgggagtttttccacaggtataaccagatcgtgtcattcatccgggtattggtgccggccgaagaagcctttgacatctctttcacacccggggaagtgtcagaaaacggactgtcatttctcttcagaaactctttgggatgctatgaagtgatagaaatgccggggaaaatgatttactcccttgaccggggggatgatgaaaactaccggacattcgatgaagagggcggtgattatataaccggacgtccaaggcccgacctcctgcaaaaaatgaagctgaatacaggattcaagaggaaaacagagttgaaattcattcaggacctgctctcctcggatgatatccggctgcttaacggaaccgcccgaaggcgtgtactggtaacttgcgaagagtacggttatgaagaacccatgaaggagccgacatccctggtgctcgatatcgaggttgccgagcgggaatccaattacaccccggacatggacggggagaacgccccacctttcatcgaacttctgcccggggaggtggaaataccctcagaaggagggcaggtcagggtacgggtcgaatcaaatatcatgtgggaggtggtttga

SEQ ID NO: 5218 - DNA, 435 bp, B.fragilis
attacaagtatggcaaaagcaagttggtgcaatgtaagccccatgtcgggcaagagagatggcgttttgacaatcagtgcgggtgctcacacaggacgtgtagcacgaaatacagtagttaccgtaacagcggctaacggaacgagaccctcagccagtatagcggtatctcaggcaggtgcaggggtattcccaaccatggatacaagcaaaccggacctttcctcttcccgaggagtcgttaacataaacgggacgtctaatatttcaaaattaaagtggacctgtcccgcaagaattatgggagtagatatgcctatagacggtaattattttaaaaatggcggtaaaacggtgggaatattaggaaataatgggggttattccggggaaccccggacattggggccgtttaaactttgttggcgactttaa

SEQ ID NO: 5219 - DNA, 762 bp, B.fragilis
attatttttgctgtcagatatatggaaggcgaagctggcaataataacaacttattcacttatgctatggctacaggtagtacgaaagacaattatctggctaatggcgagaaattcctggatgctttgaatattgcaaatacgggcagtcagcagttggaatacaaacatgaaatttataatagttttgatgtggctgacacacgtcgtgaagccacattcattgcttcatattctaaaaatactgaaaccaaagagttaactttaagaggaacacacgttcgcaaaaacatcggttatgtgaatgctcaaggtagtcgtatctattgtggggattatattatttatcgtctacctctcgtatatttaatgcttgccgaaattgagaatatgcagggaggagatgttgccaaatatattaacttagttcgtgaacgtgcttatagcaccaattgggataaggcgatttatgggtatacaaatgccgatttcacaactaatgaattggccattcttcatgaaaaggataaagagtttattcaggaaggacagcgttggtgggatattcgccgaatgacgttaactaaggggggcaaacatcttgtctttgtcaaagaaggtagtatcggaacagatatgcctactttagatgaagcgactgaagcgcataaagtcctttggccggtagataaagatttgttgggtaatgaccctttaatttaccagaccccgggatatgcaacttataaaaaagcagaatag

SEQ ID NO: 5220 - DNA, 1083 bp, B.fragilis
  unsure (924),(1039): Identity of nucleotide sequences at the above locations are unknown.
aaagcaatacttatgaagaaaaccatcttcttgattttgtgcattttatgttctcttggggccatggcgcaaaagaaatctatcacgggtgtgattacagatggtgccggtgagtcaatcattggtgcaagtgtcgttgaagttggtacaactaatggtaccataactgactttgacggcaagttctctttaacgatagctactggtgctaaatttacagttagctatattgggtataaatctcagacgattactgttggtgctgaaaatacctataatatagtactgaaggaagacacagaagtgttggatgaagtagtgataacaggatatggaggttcacaaaagcgtgctactttgactactgctatctctaaattggataactcggtacttaaaaatgcggctttcagcaacgcaggacaatccttgcaaggctctgtaacaggactccgtgttgttaacaaaacaggtcaacccggtagtgaaccggatattacattacgtggtggtgccactattacaggtgataatagtaaagcacttatcgtagtcgatggtattgtccgcaatagcatgagcgatatcaatccttccgatattgagtcgattcaagtccttaaagatgctgcttcaaccgctatttatggagcgcgtgccaatggcggtgttattttggttgagactaaaagtggtaaagaaggtaaagcatctgttaactataaattcaaaatgggtgtgaatttcgctcgtaaaggttatgacttttgcgatgcgcacgactacatctactacaatcgtttaggttacaaaagaaccggacgtaccaatgtagatacacaaatgggatatggtattggtaacaatctatttgacatccgttatttgacagatgaaaacgctaacttaaagaatgaaggttgngcttctatggcagacccattttatgatggaaaaacaattctatataaagactactcaggtgagttggatgatgttgttttcaataatagcgctttgacacaagaccattatgtanacattacaggcggtaacgataaaagaaccttcctgccagcctag

SEQ ID NO: 5221 - DNA, 216 bp, B.fragilis; identical to SEQ ID NO: 1094

SEQ ID NO: 5222 - DNA, 2256 bp, B.fragilis
ataccaccaggggctgatattagcccattggtatacccctttccaacttttctccgtggaagaggtggaattctgacccaaatattttcgttaactttaggggctttggtcggcatcctgttatttgccagggttgcatttgcattaaactatgataggtattatcaagaaccggaaaatctttttctaactttacgtacagttgtttcgcaaggtgaaaagaaagagcctgtttgtagtaattacggaaaacttccagcagcaattcgtgaaaattttcctgatgaagtggaagatgcaactttgattgacttatttagtcgcagttcgctttaccatgaaggccaggaaaagaaagatgcaatactggctacttcccgaagccatattttttccactttgggcgttaaagtactttccggaaatgtgtctgaattggataatatggatgcactgtttatatcccgttctcttgctcaaagtctttttgcagatgccgatcctattggaaagacagtaatgattaatattgattatccattgactgttcgaggtgttttcgaagatattccggaaaatgccgagtttcggtttgatggggtctattcatttgtgactcgtgctaatagattcagagatgaacgtggtggatggcggggtgatatcagctatacatgtatggttcgttttcgccatccggaagatgtagagaaagtggcggcacgtatgcctgatatgatgaagaagtatatacagtataataaagactggtttgaagaattttcgtttataactccttcacagtttcatttgcagaaaaaggaatcacgtaaaattatcagtattctatcgattctcggatttgctattttgctgattgccgggatgaataatgtacttatttctatttcttctttgccacagcgggccaaatcagtaggagtgcataaatgcagcggagcttcaaccggacatatatatcgtatgttcttatgggaatcggcattattgattctcgtttctcttttgggggttatagtccttctgctctattttaaaccggaaatagaagacttgtctggtgcctcattagcaaccctgtttacatggcgtaccctatgggttcctgcattagtaaccatttttttatttttactgattggcttgcttccgggaaagcttttctcttccatccctgtgacacaagttttccatcgttttaccgggtatcgtgcttcctggaaatatccgttgttgtttgtacaatttacaggagttgctttcatattgggattgctaatgatcattcttttacagtacaatcaagtcatgaatcgaagtatgggctataaaatagataatttagttatagggtgggggccatttgattcaatggataaaatagatggcattctccggggattgccttttattgaagcatcttgtaatagtgcttcatttatctataatggtcatacaagacaatcttttactgatattaacggaaaacgttttatggggtgtatcgattttatagatgagcattacgtcccgattttaggtttgcagattttgcagggtcgtaacgttcatcaggatggtgaagtattggtaaatgaagaattgctacggcaagtaggttggactgattcgcctataggacggaaactgatggaagataactatgaatgggggactgtggttggggtagtcaaagattatgtagcacaaagtgcgtatcagccacaaacctctgtggcattggtgagtagcttggaaaggagatgggaagccaataaacggaatctgattttgaaagaaccatttaaagagaatctttctaaaatcagggctttgatgaaagaaacatttcctacggaggatattcagttccgttctgctcgtcaggaggtcgataatctgtatcaggtagtacgccgtttccgcaatattgtgattgtagcttccgtttcgattgtagtaatcgtattgatggggttattcggatttgtgaatgatgaagtacaacggcgcagtaaagaaattgccattcgtaaggtgaatggggctgagtcgggaaatattattaatcttttgaatcataatattttctggattgctttaccggctatctttgttggaatcgctttagcctatgtcgtcggacataaatgggtggaacaatttaccgatcagatcgtcctgtcttcaccgcgggatgtgagcgaccaagggggtcagtaccacggtggtcag

SEQ ID NO: 5223 - protein, 139 aa, B.fragilis
NKERFRTIFHQETNDQTKAVHFLLDQGKKTIILVGATGKREDHTLGNISLLIDYMKAGAQVTMLTDHGMFIPASGRNCFKSYPGQQISIFNFNATGLRADGLVYPLSDFSNWWQGTLNEATGTEFTIHAEGDYLVYLNY

SEQ ID NO: 5224 - protein, 611 aa, B.fragilis
SHRSILPAPWGRQTTGFETAAVQKSVSVLPTQTYYTFTCGPVELDLVFTAPLMMDDLDLLSTPVNYISYRVRSLDKKQHDVQMYVETTPQLAINELTQPTRSKVIRRNGINYVQAGTIDQPILARKGDGICIDWGYAYLAGNIGANTAVSLGNYYGMKNEFATKGSLLPTQAECVTRRADQMPAMAYTDDLGEVGTDGKSGFLMLGYDDIYAIEYFYQPRMAYWKHDGKVSIFDAFERAKANYASVMERCRAYDEMILNDAEKAGGKEYSELCALAYRQVIAAHKLFKDADGNLLFFSKENNSNGCINTVDLTYPSAPLFLAYNPELQKGMMTSIFEYSASGRWNKPFPAHDLGTYPIANGQVYGGDMPIEEGGNMVVLAAAIAKVEGNADYAKKYWDLLTIWTDYLAEYGQDPENQLCTDDFAGHWAHNANLSVKAIMGVAAYSEMARMLGMDDVADRYAAKAKAMATKWEQMAREGDHYRLAFDRENTWSQKYNMVWDKMWNLNLFPNNVIEKEISYYQTKLQNPYGLPLDSRKEYTKSDWIMWTAAMSSDKATFEKFISPVYKYANETVSRVPLSDWHHTDSGKFVGFKARSVIGGYWMKVLMDKMQK

SEQ ID NO: 5225 - protein, 249 aa, B.fragilis
CGGLFRWHVLTKSRMTRNTWHMPLRDSTHVWKESYDKERGGLWWNFKHDGKMACINYPTTVGAMTLYNVTKDPDYLEKAKSVYAWSRDVFFDKEKGRIADNMHYHFQRQNGMDIDWTTQLYNQATFIGSAVMLYKATGEKAYLDDAVLAADYVRNEMCDADGLLPFKNGVEQGIYAAIFAQYIIRLIEDGNQPQYMDWLRHNIDVAWNNRDVNRNVTFKDATKPCPTGVMESYDASGCPALMQVISPFK

SEQ ID NO: 5226 - protein, 481 aa, B.fragilis
LKLSVLILATHQLMLFIVQVLVVHGTLCINGYLLFGLVQGFTQLIDAPVIISIFQRTGGIFIDAYIIRYVAQLIVIFITETSGRRNLRMNSICTVFHSFPKSFYIVTFQSFQIGISHYRSGIVTYHTAPVPGTCPFGKESAFLVSICQSLLHLFVHRRIHQVEEREQAAECIPETGIGKHISRQHFTVVGTVMYRFPFGIQFVEASREKYRTIEARVECTEMIGIIVFHLNTSQNLVPFLASFGCNSFQIVFTQLFQVLFCLLGADKRRSHSYVDRLSTTCREPDDTTCMFIFRFQLTRTDVAVGNCCGKSERLIEHQYKIILKVLRHSSTVLGCVADDLVLFRNHFHIRTVVESIYHYIRILTLRKSETKHRRTAGRSNFGRDIMIGQIYFIIIRFGNLSLMREPARTLILIEHDLSRNRHNGKLPVVINPRAGLVSLLKSPDFIGIIGISPSITHLSGLCHPEVHSPRHGNSRICISGR

SEQ ID NO: 5227 - protein, 788 aa, B.fragilis
SFFPLILKIKKTVLVRVICGEFKTINIMKKLALLLVGVLGTAFCTFAKSTTEPVDYVSPLVGTQSKHALSTGNTYPAIAMPWGMNFWVAQTGKMGDGWAYTYDADKIRGFKQTHQPSPWINDYGQFAIMPVTGKVVFDQDQRASWFSHKAEVAKPYYYKVYLADHDVTTEIAPTSRAAMFRFTFPESKDSYVVVDAFDNGSYVKVIPEENKIIGYTTKNSGGVPENFKNYFVLVFDKPFTFTAAVTNGNIRPGELESKDKHAGGIIGFSTRRGETVNVRVASSFISPEQAEQNLKELGKDNLEAVAAKGRQEWNKVLGRIEVEDDNTDHLRTFYSCLYRSVLFPRSFYELDAKGKPVHYSPYNGKVLPGYMFTDTGFWDTFRCLFPFLNLMYPSMNEKMQEGLANTYKESGFLPEWASPGHRGCMVGNNSASVVADAYLKGLKGYDIETLWEAVKHGANAVHPQVSSTGRLGYEYYNQLGYVPYNVGINENAARTLEYAYDDWCIYQLGKALNKPEEEIAVYAQRAMNYKNLYDKEHKLMRGKNKDGQFQSPFNPLKWGDAFTEGNSWHYTWSVFHDPQGLIDLMGGQQGFNQMMDSVFILPPVFDDSYYGGVIHEIREMQIMNMGQYAHGNQPIQHMLYLYNYSGQPWKAQHWIREVMDKLYTPNADGYCGDEDNGQTSAWYVFSAMGFYPVCPGTDQYVMGTPYFKQMKLHLENGKTVQISAPGNSDENRYIASMTVNGKTLTRNYLTHKELMNGAKITMKMSSTPNKQRGVRESDFPYSFSKEVR

SEQ ID NO: 5228 - protein, 837 aa, B.fragilis
MVKTIKKESEVMKLKLSTLFLGAAAMLSSCGASQDVKSEKSEMRAPAYPLVMIDPYTSAWSFTDNLYDGPVKHWTGKDFPFLGVAKVDGQIYRFMGTEELELLPLVKTSEQGRWTAKYTTKKPADGWQNADFNDAAWKEGEGAFGTMENESTAKTQWGEEYIWIRRKADIKDNLQGKNVYLEYSHDDDAIIYVNGVKVVDTGNSAKKHMLAKLPEEAVAALKQGENLIAIYCNNRVANGLIDCGLLVEKDNTQNFTQTAVQKSVDVQAMQTNYEFTCGPVDLKLAFTSPLFMDNLDLMTRPVSYLTYEVASNDGNKHNVELYFEAGPQWALDQPHQEAVAESFTEGNLLYLKTGSRNQEILGKKGDDVRIDWGYFYMAADKENSSCATGEGKTLRKSFIDGKLTSSKTDGSDKLALVRSLGETKKAEGHLLLGYDDLYSIQYFGENLRPYWNRNGNETIQSQFAKADKEYDAVMDKCAAFDANLMKEATEVGGRKYAELCALAYRQAIAAHKLVEAPNKDLLFLSKENFSNGSIGTVDITYPSAPLFLVYNPELAKGLMNHIFYYSESGKWNKPFAAHDVGTYPLANGQTYGGDMPIEESGNMLILSAAIAIVEGNADYAQKHWDVLTTWTDYLAQYGLDPENQLCTDDFAGHFAHNANLSIKAILGVASYGYLADKLGKKEVAEKYTQKAKEMAAEWVKMADDGDHYRLTFDKPGTWSQKYNLVWDKLMNLQIFPETVAQKEIAYYLGKQNQYGLPLDNRETYTKTDWIMWTATLAPDKATFEKFIDPVYLFMNETTDRVPMSDWVFTDRPNQRGFQARSVVGGYYIKMLEKKLKK

SEQ ID NO: 5229 - protein, 406 aa, B.fragilis
FVLLFICLKKLSGTPCRSVVNKTQNSLIMRKLAMWALGALFVAGCAETEKATTDSGLVKSNFQTEVGGKKTDLYVLRNQNNMEVCVTNFGGRIVSVMVPDKEGVMRDVVLGFDSIQDYISKPSDFGASIGRYANRINQGKFTLDGVEYQLPRNNYGHCLHGGPKGFQYQVYDAKQVGPQELELTYLSKDGEEGFPGNITCKVIMKLTDDNAIDIKYEAETDKPTIVNMTNHSYFNLDGDAGSNADHLLTIDADAYTPVDSTFMTSGEIVTVEGTPMDFRTPTPVGKRINDFDFVQLKNGNGYDHNWVLNAKGDITRKAATLESPKTGIVLDVYTDEPGIQVYAGNFLDGSLTGKKGITYNQRASVCLETQKYPDTPNKPEWPSAVLRPGETYNSHCIFKFSVDNGK

SEQ ID NO: 5230 - protein, 1085 aa, B.fragilis
RCFYTLKIYRTCFLNLCTMRKKEQMFWLASRSRMWRIPLCMAAFSLLPSAYSFASAENPATETVLAVNSVQQQRTVKGIVIDANGEAVIGANVKEPGSTTGTITDMNGEFSLSVGPKATLEISFIGYTTQKVNVGASNTVKVILQEDTKVLDEVVITGFGMAQKKATLTGAVSAIKSTDIERSAASTASGALVGKIAGLNTRMQDGRPGASTALQIRNMGTPLFVIDGVQSDEGQFNNMDFNDIENISILKDASAAIYGIRAANGVVVVTTKKGQQKSKNTVSVNAYYGWQKNSRWIQPADAKTYVNAYTAAETWAGRTDGERKFSREDYDKWMAGTEKGYTGFDWGDYIWKTSPQYYVNTNFSGGSDKANYYVSVSHINQDATVRNYGGFKRTNVQMNVDMKVNDRFKIGASMNGRIESRKNPGVPGGDDYDLPLYSNLKNWPTMGPYANDNPLYPQKVSTDINTNFALLNYENSGKMTDDWRVLQMQATAEYELLKGLKAKGMVGYYFAYREMENHEYPFKLYRYNQANDTYEVAESMNTPYRERIRHRNEDLFSNFQLNFDRKFGDHYINAIAGFEASQRKSPNFNIISTPVANNLNLIQFKEIKTFNDNGNDTQARMGYLGRINYSYADKYLVEFIGRWDGSWKFRPGNRWGFFPSASLGWRISQEKFWQESKLANIFSDFKIRGSYGVVGDDNVSDYSAFDYLAGYDYNRGGSVIDGQYVVGSAPRGLPNQTLSWIKAKILDIGVDMGFFNNRLTAQFDFFRRLRTGIPESRYDVLLPSEVGFGLPKENLRSDLHIGYDAMVRWADNINDFNYSVGANVTYSRFYDWEQYDDRRSNSWDRYRNSIWHRVGYINWGYEAVGRFENWEQIATYPVDIDRKGNRTVVPGDIIYKDVNGDGVINYMDERPIGYRQDGTPNLNFGINLSASWKGFDLSMDWTGSGMTSWMQKWETARPFQNDGNSPGEVLKDSWHLADVWDADSELIPGKYPLIRMNNAETSAYEKSTFWLHNVRYIKLRNLEFGYTLPKALLAKSGISNLRVYLSGTNLVTLTNVPIIDPEGSKDNGLIYPTPRIINLGINLKF

SEQ ID NO: 5231 - protein, 65 aa, B.fragilis
GSKHQYATILLMVCIPVCYVLFCNLYLVSRTRAAVPEYVDSWAQAPGLMGPGIQDEVKIAPFPTN

SEQ ID NO: 5232 - protein, 724 aa, B.fragilis
QHKHMSKRVLVLIGLFLACGGVYSQTATGTKTNFQTAESWKPETDVRADAVMVYGTLDKKGVTFEQRVQSWRDKGYRAEFMTGVAWGDYQDYFLGKWDGVKDHLKEGQRDREGREIAHGHLIPYIVPTESFIRYMQEKQIKRVIDAGITSIYLEEPEFWMRGGYSEAFKSEWQKYYGFPWRAQHESPENTYLSNKLKYYLYYNALNQIFTYAKTYGKSKGLDVKCFVPTHSLVNYTSWQIVSPEASLASLDCVDGYIAQVWTGTAREPNYYDGVKKERVFENAFLEYGCMKSMTAPLNRKMYFLTDPIEDRAKDWLDYKINYQATFAAQLMYPAVDTYEVMPWPDRIYQGLYQVAGTDRKERIPRDYSTQMQIMVNTLNDIRTSETQVSGTHGIGVLMANSLMFQRFPGHDGYDDPQFSSFYGQTLPLLKRGIPVELVHMENTPFGDTFKGLKVLVMSYSNMKPMEPRYHDFLADWVRKGGALIYCGEDIDPYQSVLEWWNSNGNQYKAPSEHLFEKLGLDRVPAAGTYPCGKGMVTVIREDPKHFVLKSGNDRQYFDAVSAAYRKSAGKEVELKNSFLLERGPYTIAAVLDESVSDAPMELSGVYIDLFDKDLPVLTHKVIRPGEQGYLYNVKRISGRAKAKVLCGASRIYDEKAGKRSYSFVAKSPLHTTNASRILLPKQPIRVCVNGKEEPQPEKLWEERSRTLLLKFENDPAGVQVDIEW

SEQ ID NO: 5233 - protein, 85 aa, B.fragilis
HRVKACSLDVNKKSFKCKRLVICAQEPANLQKALTMLIEKRYKDEDTGSDGVNSLPELELSYSAGVCFFLLKQAKRTIINLKIKK

SEQ ID NO: 5234 - protein, 493 aa, B.fragilis
KPIKIMPGKNSKKMIGACVVTAALLCAPSALKAEGMLSHYTCVADAIQKDNRPEPAKRLFRSQAVENEIIRVQKLLRNSKLAWMFTNCFPNTLDTTVHFRKGKDGKPDTFVYTGDIHAMWLRDSGAQVWPYVQLANSDPELKTMLAGVINRQFKCINIDPYANAFNDGPKGGEWMSDLTDMKPELHERKWEIDSLCYPLRLAYQYWKTTGDASIFDEEWIQAITNILRTFKEQQRKDGVGPYKFQRKTERALDTVTNDGLGNPVKPVGLIVSTFRPSDDATTLQYLVPSNFFAVSSLRKAAEILTTVNKKTALANECKALANEVETALKKYAVYNHPKYGKIYAFEVDGFGNHMLMDDANVPSLLAMPYLGDVSIDDPIYQNTRRFVWSLDNPYFFKGKAGEGIGGPHIGYDMVWPMSIMMKAFTSKDDAEIKSCIEMLMNTDAGTGFMHESFHKDNPEKFTRAWFAWQNTLFGELILKLVNEGKVDMLNSIQ

SEQ ID NO: 5235 - protein, 1207 aa, B.fragilis
ANMKLHIAMLAATLLLSGGASYAQGNKQEKKAKAYMVADAHLDTQWNWDVQTTIKEYVWNTINQNLFLLKKYPNYVFNFEGGVKYAWMKEYYPAQYEEMKKYIGEGRWHISGSSWDATDALVPSTESFIRNIMLGQQYYRQEFGVESTDIFLPDCFGFGWTLPTIASHCGLIGFSSQKLDWRVHPFYGKSKHPFTIGLWKGIDGSSIMLAHGYDYGRRWNDEDLSENEQLKELAGRTPLNTVYRYYGTGDIGGSPTLASVRSVEKGLRGNGPVEIVSATSDQLYKDYLPYKNHPELPVFDGELLMDVHGTGCYTSQAAMKLYNRQNELLGDAAERAAVTAEWLNQAKYPGSTINEAWKRFIYHQFHDDLTGTSIPRAYEFSWNDELISLKQFSNVLTSSIHGIGRELDTRVSGIPVILYNALGFTVTDIAEIELDLPKAPKGITVYDEKGKKVSAQLISYTDGKARILVEATVPATGYVVYDVRTSGTGASNVSTNVNTLENSLYKITLDKNGDIVSLTDKKNGKELVKAGKAIRLAVFTQNKSYNWPAWEVLKETTDRTPVSITNDVKITLVEDGTLRKSLCVEKRHGESVFRQYIRLYEGSRAERIDFYNEIDWQSTNALLKAEFPLNIENEKATYDLGIGSIQRGNNTETAYEVYAQYWADLTDRDGSYGVSVMNDSKYGWDKPDNHTIRLTLLHTPETRGGYAYQDHQDLGHHTFTYSLIPHQGALDKPATVEKAEKLNQQLKAFRTEKHKGNAGKSFSFVASDNRNVLIKALKKAEETDEYVVRVYETEGRKAQSATLTFAGEIISASEANGTEKTIGNATFEGNKLQVNITPYSVRTYKVRLKPSGRETSPIEYAALPLDYDRKCASYNEFRGEGDFESGYSFAAELLPDSLIAGQITFRLGEKEIANGMTCEGDTLQLPAGNKYNRLYILAASTEGDNQADFRIGKQTASFVVPSYTGFIGQWGHKGHTEGYLKDAEIAYVGTHRHASNGDQPYEFTYMFKFGMDIPKGATSVILPRNEKVVLFAATLVAENEPATTVAGTLFRTNNVGNAATAGNDEEAVRENILKRAKIIACSGYTNDEEKPDFLLDGKTDTKWCDVSQTPNYVDFDLGEAQNISGWKMVNAGQESHSYITNGCFLQGKMNPGDEWTTLDAIDGNHANVVSRPLNYDGKVRYIRLLVTRPTQSTGGRDTRIYELEVYK

SEQ ID NO: 5236 - protein, 619 aa, B.fragilis
QTMKKRNFIAVAACALALSSCSGFLDQKPDRIMTEDQVYGDVNLTKSVLANFYERISLGQHVGDTDGFALLDEAITYDTKDDQEVDRNWWRTYDYTLIRNINQFLKGLRESTALSEVEKAPMEGEARFIRAWVYFCTCRTLGGMPIVGDEVYDYTSGMDITTLQVPRATESAMYDYIIEECKTIAEMLPTEPSKNGARATKWAAKMLEARAAVYAGSIARYNTVADYPLLNPETGVVGISSEKATDYYKKALAAAEEVINSGKYSLMRVADDATPQEKADNFFKAVCEKNGNTEVIWSRDYIYPGQTHGYTKSVQPHDGAEDGGNSRLSALLNLVEAFEPIATDTPGEGAKFDVGTKDNPKFYTNPEDLFVGRDPRLAGTILYPGSSFRDRTVVLQTGQWIKNSDGQWEQKLGQSLGEKDDQGRYVTALNGPMVRNDQRECNRTGFYVRKYLDKTTSAGTDRGSEMWNVYFRLSEAYLIAAEAAYELNGGSDATALKYINAVRSRAGVKELASVNHQQIMHENQVEFAFEGHRWWDLKRWRQADKIWTGSEMDITATRRGLWPFLVVSDDDKNGKWVFFEENMNRYYRNPLKCLPKHYYAELDNGWLNNNPKLVKNPYQ

SEQ ID NO: 5237 - protein, 427 aa, B.fragilis
GPADLLLYPYASFYILFLIHIMTHTQTITPKKRINSIDALRGFALIGIMLLHCMERFDLTLAPVVESPFWQAIDTAVYDSLYFLFSGKSYAMFSLLFGLSFFMQMESQAAKGVDFRGRFLWRLALLFLFGYINGLVYMGEFFMVYAVLGVFLIPLYKVSTRWLLVLCILLFLQIPAVISFVSLLSDNVANEPTAAAAYMDRLFERAADVFINGSLMDVLSFNTFDGQSAKCLWVFNNFRYLQLLGLFIAGMLIGRQGIHKSEEKMVKYSRLFLPYCLAFWAVFYAVAFLLPVWGVDGFALRVGQTLFKTYGNLGQMMVYFCGFTLLYYRYKGQKVLDRIAPVGRMSVTNYMAQSIVGVSLFYGFGGNFAVEFNYLQSFLLGAAFCVIQIAYSNWWIKRFYYGPMEWLWRSLTWFQVVPLSRRKASLG

SEQ ID NO: 5238 - protein, 158 aa, B.fragilis
NRYWLMFINSLRKSPFSCSLGLILLGAFTLLSVPVYGQQIQQSERQVQQVPFLQFNFDEQGGETARNSGRGGSKYDARITGGTVEWGPGLQQGSARLSNKGHFKSPDGVLAHVKDFTLSVWVYLNEQSDNQTVCLHHGSWKIGIVNPACFSAPIDLGY

SEQ ID NO: 5239 - protein, 336 aa, B.fragilis
IRGLFLIYIFSMKKLLFSLFTVFSFCVPSIAQQYSNPVINYSLPDPTVIKADDGYYYLYATENIRNLPIHRSKDMVNWSFVGTAFTNETRPTFEPKGNLWAPDINKIGDRYVMYYSMSVWGGEWTCGIGVATADKPEGSFTDHGKLFRSNEIGIQNCIDPFYIEDGGKKYLFWGSFHGIYGAELSDDGLSLKEGMKPQQVAGTAYEGTYIHKRGGYYYLFASIGRCCEGLKSTYTTVVGRSKYLFGPYVDKKGESMLENHHEVLIDKNEAFVGPGHNSEIVTDDKGADWVFYHAVSVANPEGRVLMLDRVNWKKGWPVVEGDTPSLQAKAPVIQHK

SEQ ID NO: 5240 - protein, 147 aa, B.fragilis
INCIMNKKFFIAMLAFALFGMTNVMANTSKDEVVEVSSTNKVTATEYYLEAAGQSGSGLFYSIELLDSSQRKLKITAKRGLRIEINCHGHGIVPDDRLFYTSDSWTGEVITDEINTEAFTISTSYNESAGSSSTTKYETRYYYIRER

SEQ ID NO: 5241 - protein, 161 aa, B.fragilis
GKNMKNKVLIIVAILLLLPNAMAWAHQPADGNLKHFTKKDATTAMDAFHSTFYNPDMKLYAISSDMKGRAAIWVQAIYWDMIMNAYKRTKAPKYRRLIEEVYQGGYEQYDKYNWDNKIEWFIYDDMMWWIISLARAYEITNDPKYLAHASSGFYPCLERVV

SEQ ID NO: 5242 - protein, 240 aa, B.fragilis
KEIMKAISKIFSALLLVMIVVTSCTKDNYDAPESMLTGKVVYEGEALQLRGNEAVRLFLYQRGYEKHDPIEVFVNQDGAYSACLFDGEYQLITKSGNGPWSEEGRDTINVIVSGNTVQNVEVVPYYMVRNAEMKLNGNVVTASFNVEKIAGKEIDRVFFMLGTTQYINDGEHNVDRFDDADGAKMAEINVTGARYEFTPRDYTDNKMFQTALKRGTLFGRICIWPKGSDQGIYSEVIRLK

SEQ ID NO: 5243 - protein, 142 aa, B.fragilis
LLILYIMNKRFIIVLLAFVFVSMANAKADIPKVWEVNGVYTLVEVESPSGYGLIKSITIGNEYAYNSTEIKIVVIDGVNSVRIDWVAEGNRYPVTYSVGYDNTVIIPNFLRRRFIVSVEYTFAGSMAGIQYAYETRVFEIRS

SEQ ID NO: 5244 - protein, 420 aa, B.fragilis
EIPPFGGIFSIMEKFGLMLFTRNGLTLGKRCTSFFGYQFRRIVRSLMSVYFCGGSCVEDVTSQLMRHLSYHPTFRTCSSDTILRAIKELTQENISYTSDQGKTYDFNTADKLNTLLINALVSTGELKEIEEYDVDFDHQFLETEKYDAKPTYKKFLGYRPGVYVIGDKIVYIENSDGNTNVRFHQADTHKRFFALLESQNIRVNRFRADCGSCSKEIVSEIEKHCKHFYIRANRCSSLYNDIFALRGWKTEEINGIQFELNSILVEKWEGKCYRLVIQRQRRNSGDLDLWEGEYTYRCILTNDYKSSTRDIVEFYNLRGGKERIFDDMNNGFGWSRLPKSFMAENTVFLLLTALIHNFYKTIMSRLDTKAFGLKKTSRIKAFVFRFISVPAKWIMTARQYVLNIYTENRAYAKPFKTEFG

SEQ ID NO: 5245 - protein, 857 aa, B.fragilis
RLKESRFTGQRFREAQERDYRHYDRFVEKIIPDSVNFYRTYVNYHSFERYLERLKWYKRGLEKRWAIQDARKRRPDPLLLRFDMFNRQVGRRDSLMKSRMLDNSQRMITRQWWRYGRAWERMNDTLQFQSRHLLERFRFFNNKWADNAAFQSDGLIARKNYFRDKALSTPMWQAKRALYKADPDAAIRIYASRFGYFNDKMERLDATLYRYYRTKGARAESREGVRFLRAFMVGRDTTLSYLNRNQLTEKYIRRYEKVKNFFPMFHFRRPDPDTLSPLWETRTRIDTMQTRHTLLSKLSKEDIYEYYVRQQQGVSDRGMIGPFRGLLPLYTYHRDLPDSIVLRVPGRKTRRDFELSRFDSATTVNRYIGRYEFLRSTYPQYHLIRKLYNIHPPALRHAARQASYEERLARINSLDSTSLIKMFYNTQKIARNEARKAMKDTKYRDIVRFPFNPEAQLDTVIYATDQVHFLYSQKVPADENSARMKVYVVGDVLNSNGSRFSLPYSDTLTYLVSSMTKFVDRTPRFVRKIVTRDAEANASVNFYFPKNSFRMDETIDINRQGVKQVHNLTLALMTDPVYIIDSLTLLATSSPEGNWHVNGEISRKRAESIRNILVEDFKLLYDSLAIGAAIEMDETGNIIRQEMKDGIPNLPELIKIRTVPEGWEKLRRLIVNDKNFQGNKGAILRIIDREQEPDRREWLIKSQYKTEYAYMLDKLYPAVRRVDFLFSLSRRGMRQDTLYTNEPDTMYARAVDYLEKRKYEQALEILRPYEDVNTAIAYMSLGYDKAALRILEQSSQTAETQYMQAILNARLGNEQRAVSLLLSAAEVDDRIRFRANLDPELSLLVKKYGLFKEDDLW

SEQ ID NO: 5246 - protein, 295 aa, B.fragilis
  UNSURE (295): Identity of amino acid sequences at the above locations are unknown.
AIERVYFQPRGEDLLKNDALLPLNKEKIKSVAVVGPFADYNYLGGYSGQPPYSVSLLKGVKELIGKKGKVTYLNGMGTSADSIAQVVKGADIVLVALGSDEKMARENHDMPSIYLPEGQEKLLKEIYQVNPRIVLVFHTGNPLTSEWADTHIPAIMQAWYPGQEAGRALANLLFGNENPSGKLPMTIYRTEEQLPDILDFDMWKGRTYRYMKGEPLYGFGHGLSYTSFEFDNIQGNDTLQPDAILQCSVELSNSGQLAGEEVVQVYVSRENTPVYTYPLKKLVAFKKVKLAFSEX

SEQ ID NO: 5247 - protein, 170 aa, B.fragilis
KLLQCRKRKEALMTSLYDFSVLNQNNQATPLDSYRGKVLLIVNTATGCGLTPQYQGLQELYERYQDQGFEILDFPCNQFMGQAPGSAEEINAFCSLHFQTTFPRFAKIKVNGKEADPLYVWLKDHKSGPLGKRIEWNFAKFLISRDGQVFERFSSKTDPKQIEEAIQTLL

SEQ ID NO: 5248 - protein, 91 aa, B.fragilis
KEENKLKIFKGEFYRISVLTDKLVRLEYSQTGSFEDRTTQLIYNRDFGQVSLDYIETSNVLDIMTDYFHLHFNKGEFNAENLFIELKGNFA

SEQ ID NO: 5249 - protein, 294 aa, B.fragilis
RHARTYMMRNDWQNMYTAATDVMNSGQYNLNTPYDVIFTDEGENSSESVFELQCASTAALPASDKIGSQFCEVQGVRGSGQWDLGWGWHMGTELMGEAFEPGDPRKDATLLYFRRSDTDPITPENTNKPYGESPVSQADGTYFNKKAYTNPALREEFTRHGFWVNIRIIRYGDVVLMAAESANELGKTGEASNYLEMVRARARGNNPDILPKVTSLDQTVLRDAIRHERRVELGLESGRFYDLVRWGIASQVLHAAGKTGYQPKNALLPLSQDEIDKSKSVLVQNPDYLEHTTE

SEQ ID NO: 5250 - protein, 493 aa, B.fragilis
STNTFMNQKLLFSSALLVGIAGTQQALAQKKKVQDQKRPNVVFILADDLGFGDLSCYGQEKFETPNIDKLAQEGMRFTQCYSGTTVSAPSRSCLLTGTHSGHTAIRGNVELDPEGQFPLPADAQTIFHDFQNAGYKTGAFGKWGLGFIGSTGDPKKHGIDEFYGYNCQLLAHSYYPDHLWDNDKRVELKDNTLDVQYGKGTYSQDLIHSKALDFLDRMGKSGESFCMWYPTIIPHAELIVPEDSIIKKFRGKYPEKPFHGTEPGNPAFRKGGYCSQFYPHATFAAMVYRLDVYVGQIVQKLKEMGVYDNTIIIFASDNGPHMEGGADPDFFNSNGIWRGYKRDLYEGGIRVPMIISWPGRVQPSTQTDFMCSFWDVMPTFREILNPKAKNQQMDGVSLLPLLENRKGQKEHEYLYFEFQEMNGRQAVRKGPWKLVHMNVRGKNPYYELYNLNSDPSERHNVLNQYPEKVTELKAIMQSSHIPNPNFPLLPGEK

SEQ ID NO: 5251 - protein, 550 aa, B.fragilis
TMNKKLLSRLAPGLFAVVLFTACRPAATVKGNLDVIPQPQEIVLARDTTPFIIDRSTTIVYPATNEKMHRTADFLATFIKEMTGTEVRVSDKEKSSNAIILAVDSTMGHPEGYKLQITPEKVLLTGGSEAGVFYGIQTIHKALPILKDGKVAAALPAGTVTDFPRFRYRGFMIDVGRHFFPVSYLKQMIDLMALHNINYFHWHLTEDQGWRIEIKKYPKLTEIGSKRDSTIIDWETKKFDGKPHSGFYTQDEAREIVRYAADRFITVVPEIDLPGHTTAALASYPELGCTGGPYKVLCSFGVFPDVLCAGNDQTLQFTKDVLDEIMDIFPSEYIHIGGDECPKSRWEKCPKCQAKIKELGIKALPKHSKENQLQTYFMSELEKEINAHGRRMLGWDEVLEGGLTPNSTIMSWRGIQGGIEAARQHHDVIMTPIQRLYFSNPRINKMTGFEWMNRVYNFEPVPAELTDAEKKFVIGTQGCIWTEWTADSTKMEWQILPRMAALSEIQWTLPEHKNFERFMERLPEMLKIYSSLDYGYREDVFAADTLKTHK

SEQ ID NO: 5252 - protein, 980 aa, B.fragilis
RDRKTSMKNNPYTGFLTWLTVLFTVCCLPLKASHYYYKQISLKEGLPSTVRCVYTEPKGFVWIGTNAGLGRFDGQKLRKYVHRQEDVHSLPHNYIHQITEDIQHNIWILTDGGIAQYRRSSDDFAIPLDDRGHPILAYSACLTEQGVIFGGRNRIYRYDYDSRSIKLLLDFSSDPYFAISAISRWDEETLLCCSRWQGLRLINLRSGERRLPPFDCGKEIMALLIDSHNRIWLAPYNEGLRCFNPEGRLLASYTTDNSGLSNNVVLSMAERDSHIWVGTDGGGINIIHPDSHRITVLEHIPGDNYSLPVNSILSLYNDNYNNMWAGSIRKGLINIREVSMKTYTDVFPGSTQGLSDPTVLSLYQDEPNGRIWIGTDGGGVNSLDPVTEEFRHDRSTWGDKVVSITGFTRESILLSVFSRGLFVYNKENGKRKPLPIDHPDLKQYIYYSGMAVNIYQDEPGSVLLLAGHTYRYDIGSQKIRVVNEEEGMEIAGSMNAIAHNERFTYLHDSRTLYELDRTGNRLKKLFSCTGDTLLYSVSMDEKGDFWIGSNTGLGQYSIRTRQYHPLITSLFGEASSVICDHRGKVWIGADHMLFAWMLQSRKFILFGESDGVIPNEYLAKPRLVSGKGEVYMGGVNGLLCIDNRFPATSSNYPEVVLTDVRVNGEPATNRTAGNPDKLTLPQDSRAITLRVMSHEEDIFRKKRYRYRIDGLNEEPIESYDPELVIRSLPAGNYRIQAACSTQNGDWTPFHPILSLTILPPWYRSGWFIICLLLFVSGGITAIIFAILRRRKNRLKWELKERELQEYEEKIRFLVNVSNELLPSFTEKGERELQIVELIRNRLRNGEKSKAPAEIASSPNIVKEELSQPDETFLRKLNQLITDHLDSPELDVTFLCTEMGLSRASLYNKLKAMTNMGANDYINKFRMEKAIQLISTTDLTFTEIAEKIGFTTSRYFSTSFKQYTGETPTQYKEKIRKSSKV

SEQ ID NO: 5253 - protein, 786 aa, B.fragilis
FLNEQHMRKLFFPLLLFVSGLLSAQTEITLYVSPSGSDHHPGTAEKPMATLEYAWKKASRQAGRRSITIYCEGTNYLSAPILITNETSGTPEHPIRFSSYPGQKAVISGSRILRNLRWKEYKNGIMQAKVEEELIPDQLFVNGKKQISARYPNFDPDIRIFNGYAADACSPERVKNWSNPAGGYLHAMHSREWGGYQYSIEGKDAKGELILKGGFQNNRQMGMHHTYHMVENIFEELDAEGEWYFDKETHTLYFYPPRELDLQTALFEVPQAENLFILKGKTGSPVRHVSVDHLELTQTLRTFMKTNEPLLRSDWKIYRGGALIIENAEKCSVNGCYLHDIGGNAIFFSNYNRNHRVSQNHITRIGASAVCFVGSPDAVRSPLFEYGKSQTWEQMDKGTGPLTPDYPSDCLVDDNLIHSIGETEKQGAGIQLSMSARITIRNNSIYDLPRAGINVSEGTWGGHLIEGNDVFDTVLETGDHGSFNSWGRDRYWHPDRNVMDEFAKEHPQMVFRDATETTVIRNNRWRCDHGWDIDLDDGSSNYHIYNNLCLHGGLKLREGFARTVENNIMVNNTFHPHVWFANSQDIFRHNIVTTPYRPIQVKEWGKETDTNFFVTKQGLEQAQKRGTDLHSLYGDPLFIAPEKGDYRVKENSPALKTGFRNFDMEHFGVQCPHLKALAATPKLPVFKIPEEKPETVQTYSWKGLTLKEVSTEGERSATGLDKIRGILVVQVEKGITALQANDVILRINGKPVDNRTDMETEIRKSPEGNKFRIIFFRNQKENAVTM

SEQ ID NO: 5254 - protein, 535 aa, B.fragilis
SLIEKLLMMNNLPSGILYSLTGAAAVASLTSCATGKQKEEQKPLNIVYIMTDDHTAQMMSCYDTRYIETPNLDRIARDGVRFTNSFVANSLSGPSRACMITGKHSCANKFYDNTTCVFDSAQQTFPKLLQKAGYQTALVGKWHLESLPSGFNYWEIVPGQGDYYNPDFITQDNDTVQKHGYITNLITDDAIDWMENKRDESKPFCLLIHHKAIHRNWMADTCNLALYEDKTFPLPDNFFDDYEGRPAAAAQEMSIVKDMDMIYDLKMLRPDKDSRLKSLYQKFLGRMDEGQRAAWDKFYGPVIDDFYKQNLSGKELADWKFQRYMRDYMKTVKSLDDNVGRVLDYLEKKGLLDNTLVVYTSDQGFYMGEHGWFDKRFMYEESMRTPLIMRMPKGFDRRGDITEMVQNIDYAPTFLELAGAPVPADIQGMSLLPLLKGEQPKDWRNALYYHFYEYPAEHMVKRHYGIRTERYKLIHFYNDINWWELYDMQADPTEMHNLYGQKEYEPVVKELKEQMLKLQEQYNDPVRFSPERDKE

SEQ ID NO: 5255 - protein, 60 aa, B.fragilis
SCSLSTKNVVLLCVTLYYSVLLCGEKAFGELLFMSLQGIRREYIFPITIIQRRINLQHLG

SEQ ID NO: 5256 - protein, 509 aa, B.fragilis
KKKLIMKRIEIYIGLSVFALSAKSQVKESRPNVIYIIMDDLGYGDIGCYGSEKIETPNIDRLYKDGISFTQHYTGSPVSAPARCVLMTGMHSGHAQIRANDEMAYRGAIMNYDSMYVHPGLEGQYPLKAHTMTLGRMMQQAGYVTGCFGKWGLGAPGTEGTPNKQGFDSFYGYNCQRQAHSYYPAFLYKNEDRVYLANKVLDPHTTKLDAGADPRDEAAYAKFSQKEYANDLIFDELISFVGQNRKKPFFLMWTTPLPHVSLQAPEKWVKYYVGKFGDEAPYIGKAGYMPCRYPHATYAAMISYFDEQIGKLIEKLKKERLYDNTVIMFTSDNGPTFNGGSDSPWFDSGGPFRSEYGWGKCFVHEGGIRIPAIVTWPGKIKPSTQSDHICGFQDVMPTLADIVNIACPETDGISFLPALLGETERQKEHEYLYWEYPDPTIGLKAIRMGKWKGIVNNIRKGNSTMELYDLESDLREEHDVAAEHPDIVRKLTRLMEKSHTEPENPKFRF

SEQ ID NO: 5257 - protein, 423 aa, B.fragilis
VHGLFQPRGEDDDAGFIYAIQSLRQWNTGEERGLIFPCVEITDFPRVKWRSFMLDSGRQYQKVSTIKKYIDMASMLKMNYFHWHLTEGLGWRIEIKRYPFLTRIGAFVGQGPEQQGFYSQEEVKEIIGYAADRGITVVPEIDMPGHAEAALNAYPRLGCFNVAVKVPQSGFTQNIFCAGKDSTLIFLKNVLDEVCRMFPSAYIHLGGDEAPKGNWDKCPDCRSRIEKEKLKDSHDLQLWFSARMADYLKQKGRKAIFWGDVIYKDGYSLPDNVVIQWWNWRGHRDLALKNAVRHNYPVICGTNYYTYLNFPLTPWKGYTQARTFDLEDVYLRNPSYRPREENPLILGMSSALWTDDGVTESMIDRRVFPRILALAEQMWHSGNPENFDEFYGKVLSKQLWFEQQGYSFGPALKEDAGTNYKWD

SEQ ID NO: 5258 - protein, 487 aa, B.fragilis
NRIMEQYTFNIAGGVARNPLVRLAQPVTAQIATGEHIAIVGPNGGGKSLFVDTLLGKYPLREGTLDYDFSPSSTRTVYDNVKYIAFRDTYGAADANYYYQQRWNAHDQEDAPTVREMLGEIKDERLKEELFELFHIEPLLDKKIILLSSGELRKFQLTKTLLTAPRVLIMDNPFIGLDAPTRELLFSLLERLTRLSSVQIILVLSMLDDIPSFITHVIPVEDLHVLPKMEREAYLASFCVTDEAEVLDALQQRIAGLPYDGANYDSGEVVKLNKVSIRYDDRTILKELDWTVRRGEKWALSGENGAGKSTLLSLVCADNPQSYACDISLFGRKRGTGESIWEIKKHIGYVSPEMHRAYLKNLPAIEIVASGLHDSIGLYKRPQESQMAACEWWMDVFGIVALKDKPFLQLSSGEQRLALLARAFVKDPELLILDEPLHGLDTYNRRRVKKIIEAFCRRQDKTMIMVTHYESELPSTITDRLFLKRNR

SEQ ID NO: 5259 - protein, 370 aa, B.fragilis
EKIISVELCVICGELKTITIMNKIIELLGNQAEYYLNHTCKTIDKSLIHVPSPDTIDKIWIDSDRNIQTLRSLQTLLGHGRLANTGYVSILPVDQDIEHTAGASFAPNPIYFDPENIVKLAIEGGCNAVASTFGNLGAVARKYAHKIPFVVKLNHNELLSYPNTYDQVLFGTVKEAWEMGAVAVGATIYFGSEQSRRQLVEIAEAFDYAHELGMATILWCYLRNNEFKKDGIDYHAAADLTGQANRLGVTIKADIVKQKLPTNNGGFKAIHFGKTDERMYTELTTDHPIDLCRYQVANGYMGRVGLINSGGESHGASDLKDAVVTAVVNKRAGGMGLISGRKAFQKPMNEGVELLHAIQDVYLDASVTIA

SEQ ID NO: 5260 - protein, 248 aa, B.fragilis
MKKIVLLRHGESAWNKENRFTGWTDVDLTEKGIAEACKAGELLKENGFNFDKAYTSYLKRAVKTLNCVLDRMDQDWIPVEKSWRLNEKHYGDLQGLNKSETAAKYGDEQVLIWRRSYDIAPNALSEDDPRNPRFENRYQEVPDAELPRTESLKDTIERIMPYWKCIIFPNLKTADEILVVAHGNSLRGIIKHLKHISDEEIVKLNLPTAVPYVFEFSDELNLEKDYFLGDPEEIRKLMEAVANQGKKK

SEQ ID NO: 5261 - protein, 768 aa, B.fragilis
KPLSAGERLSNRALNHKHPFGSSRFICEYNEVYLTLHTQCIFHNINNNTMKKLLATLLILVACIHVNAQESIQIRISTDRTDLILEVAPDGRLYQSYLGDRLLNEQDLKNLSGSSRGWEVYPGSGGEDYFEPAVAITNNDGNLSTILRYVSSEQKAVEGGTETIIRMKDDQYPVDVTLHYVAYPKQNVIKTWSEIKHQQKKPVVLWRYASTMLYFSNQKYYLTEFSSDWAKEVQMSTQQLQPGKKILDTKLGSRAAMHMQPFFELGLEQPAQEHQGQVVLGTIGWTGNYQFTFEVDNEGDLRIIPAINPYASDYQLKANETFTTPEFIFTLSNNGTGEASRNLHNWARNYQLKDGKGDRMTLLNNWENTYFTFDEELLGKLMKEAKHLGVDMFLLDDGWFGNKHPRNDDHAGLGDWEAMKSKLPGGIPALVEKAKEAGVKFGIWIEPEMVNPKSDLFETHPEWAIHYPNRETYYFRNQLVLDLSNPKVQDFVFGVVDKIMTENPDVAFFKWDCNSPITNIYSPYLKDKQGQLYIDHVRGIYNVLKRVKEKYPNVPMMLCSGGGARCDYEALKYFTEFWCSDNTDPVERLFIQWGFSQFFPAKAMCAHVTSWNSKTSVKFRTDVASMCKLGFDIGLKDMKADELTYCQEAVANYKRLKPVILDGDQYRLVSPYDGNHMAVMYTAPDASKAVLFTYDIHPRFGEKLLPVKLRGLDAQKMYRVKEINLMPGRKSNLSGNEKIFSGDYLMKIGLNAFTTSQTNSRVIELVAE

SEQ ID NO: 5262 - protein, 405 aa, B.fragilis
MMKLFREILIICLLGKLIACSPLASGEINDVWGHKQVATIEMAGSDSVWVCHLSMLKDTVTVPLSYFVEELEMVKLDNRDAALVSSSKTIIGKQYILVHKMGHVPFKLFTKSGTYLRDIGSFGQGAGEYGLAYDAQMDEENNRLYVLCWQADHILVFDLQGNILQPIRLAHWSPKGVFHVETERGRVHVCALSFNRDFVGDRHSPMIWTQSLDGKIIKELPAGYLAVNDYGNEIKSLNNGTVMDIGFWFGGQYRNDSLYHYNNQEFRLLPRFTLDYGGHELTPHSFGELPNHFWGEISYPVRLSPHSSTTTPPEYYMVDKHTLRGAFVEIYNDFLGGIPADWFFSSHDGYYVWNVEPVRLKQMVEDRLSSGEIVSDSDRRKLTELLRSTKENDNNYIFYGRLKCR

SEQ ID NO: 5263 - protein, 400 aa, B.fragilis
LIFATPLFYEIIHLSQCLFNFLGISMRLIYFINSKYDRNTCCCCMINGFFGLGHYIIIGSYNNNCDIGHLCTTGTHCSKCLMSRSIEERNLTSIFQCNMICTNMLCDTSGFTCNYICFTNVVKQRSFTMVYVSHDCNNRSTMFQIFRRIFLFNNGLGYFCTDIFSLKSKFFSHKINRFCIQTLIDRNHHTNAHTSSDNLIYRYVHHACQFISSHKFCQFQYLAFCHFLIFQFLHTVGRHVTFFFTIFGTFVLTFACQTSQRFFNLLCYIFFAYFLLYYRLFEAVFIIVITVSILSAATLLISSTVIIRTLTVWSRVCKIRSNIVHIYFFLIIVDAITFLLTVRIKVFLTNDLSLFTIFFTDFLDDGFLHLFLLILTKLFLLFTLFPLFLFRFLLRTCRLI

SEQ ID NO: 5264 - protein, 174 aa, B.fragilis
FNAAKSICPITLILDTNSVGRILNTPSSSFSTGVTGASATGFSSFFSVFSGDTTTFGSSFLTSSTTFFSVSTGFSTTTGFGSSFTGFGSEVAGVTVTSSFFTSITTGLTSSATFFSSAATGCGFGSSFIGSFSTFRFSLSKSIFPTGLNFGRTSSGMTVLITSSATVFSGSFLS

SEQ ID NO: 5265 - protein, 422 aa, B.fragilis
IIMAKKEETISLIDTFSEFKELKNIDRTTMVSVLEESFRSVIAKMFGTDENYDVIVNPDKGDFEIWRNREVVADEDLTNPNMQISLTEAQKIDASYEVGEEVTDEVIFAKFGRRAILNLRQTLASKILELEKDSIYNKYIDKVGTIINAEVYQIWKKEMLLLDDEGNELLLPKTEQIPSDFYRKGETARAVVARVDNKNNNPKIILSRTSPVFLQRLFEMEVPEINDGLITIKKIARIPGERAKIAVESYDDRIDPVGACVGVKGSRIHGIVRELRNENIDVINYTSNISLFIQRALSPAKISSIRLNEEERKAEVFLKPEEVSLAIGKGGLNIKLASMLTEYTIDVFRELDENAQDEDIYLDEFRDEIDGWVIDAIKAIGIDTAKSVLNAPREMLIEKTDLEEETVDEVLRILKSEFEDNE

SEQ ID NO: 5266 - protein, 284 aa, B.fragilis
LPFYYYADGRKFHITMVGRGYFWKRIDNEIIDKIMLEIKDLHASINGKEILKGINLTVKPGEVHAIMGPNGSGKSTLSSVLVGNPAFEVTKGSITFYGKNLLELSPEDRSHEGIFLSFQYPVEIPGVSMVNFMRAAVNEQRKYKGLPALTASEFLKLMREKRAVVELDNKLANRSVNEGFSGGEKKRNEIFQMAMLEPRLSILDETDSGLDIDALRIVAEGVNKLKTPDTSCIVITHYQRLLDYIKPDIVHVLYKGRIVKTAGPELALELEEKGYDWIKKELGE

SEQ ID NO: 5267 - protein, 64 aa, B.fragilis
LWGYWQQKPLYTSLAVKLCPTVTDSMTVAQILAFIIIWIAVAANLYIGGFSINQGIGGGFTWLA

SEQ ID NO: 5268 - protein, 115 aa, B.fragilis
YKPLNETRIMLLATTPIIEGKRITTYYGIVSGETIIGANVFRDFFASIRDIVGGRSGSYEEVLREAKDTALKEMSEQARQMGANAVIGVDLDYETVGGSGSMLMVTASGTAVFLE

SEQ ID NO: 5269 - protein, 553 aa, B.fragilis
ISLYIPTTGQGYTGYFTLQKQHLMKKKKVTTYCCLLLLASFFTTVTAQNTNTPMMGWSSWNTFRVHINEELIKETADAMVNRGLKDVGYGYVNIDDGYFGGRNSEGRLFANKKKFPNGMRVLSDYIHSKGLKAGIYSDAGSNTCGSIYDADTLGIGVGLWKHDDIDCQTFLKDWGYDFIKIDWCGGEATGQSEQQRYTDIYKAIRRTGRTDVRYNICRWQFPGTWATQLAGSWRIHTDINPRFTTIDRIIERNLYLAPYASPGHYNDMDMLEVGRGLTEDEEKTHFGIWSILSSPLMIGCDLRTIPEKTLSIITNKEVIALNQDSLGLQAEAIERGKDYLILSKAIQKREGKLRAVALYNRSNTDQQIRVDFDKLYLSGDVRVRDLWNHQEMGTFTDYYETLVPAHGTALIRLEGSKRHDRTCYEAEYAFMQEFLPDNKQAAHFTPKSGASGEYIMKNLGNSPSNWAEFRNVYISKGGDYQLKLTYYSGDKRDIQIAVNGTEYKQSNLYSGTWDQAATTTIKVKLRKGYNTIRLYNSYGWAPDIDKMEIIKGR

SEQ ID NO: 5270 - protein, 449 aa, B.fragilis
ITRQFMKNTNRSILHKDGVSYILPFILVTSCFALWGFANDITNPMVKAFSKIFRMSVTDGALVQVAFYGGYFAMAFPAAMFIRKYSYKAGILLGLGLYALGALLFFPAKMTGDYYPFLLAYFILTCGLSFLETSANPYILSMGTEETATRRLNLAQSFNPMGSLLGMYVAMNFIQARLNPMDTVERSQLSPAEFEVLKESDLSVLIAPYLIIGLVILAMLFVIRAVKMPKNGDKNHNIDFIPTLKRIFKIPHYREGVIAQFFYVGAQIMCWTFVIQYGTRLFMSQGMEEKAAEVLSQEYNIIAMIIFCISPFRVYIYSSLPESGDASQDSCDCGWCFYVRCDFFARHMGIVLFSSCFGLYVTNVSHDLWPLLFVVWVMMPNLGAAGLIMAILGGSVLPPLQACIIDQHTLLGMPAVNLSFILPFICFVVIIIYGHRTCARVKKIKAARK

SEQ ID NO: 5271 - protein, 573 aa, B.fragilis
AKRHIPLIRLSNWNRNLTSLTKGLNFKALVSFKNWSKTTVNRSFSPYFYELQNPQEQEDGSYLYDYNSISKGRTALETSTSTTGDRLMNLQATLNYQRMFGDKHDVGAMLVYLQREYNLNNPDNNYYNTLPERNQGLAGRVTYAYDGRYLAEFNFGYNGSENFEKGSRYGFFPSLAVGYLISNEKFFEPLTKVISNLKIRASYGLVGNADIGSNRFPYLTKVDLGGAGFVFGDQWQTSSNGATITTYGAEKVTWEIGKKYNVGFDLGLFNKLSLNVDFFREDRKDIFLRRNTIPAESGITGDLRPYGNLGKVRNQGVDMSLDYNHAVSKDFMISAKGTFTYAKNQYMEIDEPDYEYAYMSQVGRPLNQYKGYIALGLFKDQEEIDNSPKQILTGVVQPGDIKYADLNNDGKIDGNDQTYIGNPELPQISYGLGVSIQYKKWDASIFFQGVGKRSIMLSDIHPFGGESYGVMQFVADNHWTEANPNPEAMYPRLTNGKNNNNNPNSTYWLRDGSYIRLKNVELGYSYKFLRAYISGQNLLTFSKFKLWDPELYTSNGLKYPTQIMGSIGLQFTF

SEQ ID NO: 5272 - protein, 555 aa, B.fragilis
NQCKCMKKKAIPCHKAGRITSFFLLISIFLLIPSITTPVYAVETYTQQTVFTLHATNKTVKEVFEYIEKNSEFVVLYSKDLLPVLQKKVSVSIDKQNVESILNILSKEAGLKYNINDRQITITKVTAEAPQQEKKIKITGQVLDENGEGIPGANIVIKGNSTLGTVTNVEGNFTLMAPENSTLVASFIGYTPVEIPLKGKKIVVFKLVPDAQSLEEVVVVGFGTQKKASVVGAVQSIKPAELRVPSSNLSTSFAGRIAGVISMQRTGEPGADGANFWIRGAATFSGTTDPLIFIDGVEVSAGDMNAIPSEAIENFSILKDASATALYGARGANGVILITTRTGKDLEKARINVRIDNTFTAPTRTLKLADAVTAMKLRNEAILTRNPDGTPAFSDDKIQGTLEGRNQYVYPNVDWFDYMFKDYSMNQSANLNVMGGTKKVDYFISASINNDNGMLKKDPNNTFDNNIQNLRYSFQSNVGAWLTSSTKVNVRINSQIVNYNGPSTSMDDLYKYVMEAPSMYFAPVYPNINREDHTIFGNKSGGPIGSEGFSIYRNP

SEQ ID NO: 5273 - protein, 136 aa, B.fragilis
ILRKEVYILYFCSAHMVTITLYMNNNIEYISKIKKGEETSFRHFVNSYSKDLFYYAQCFVRSKETAEEVVSDVFLDVWRHREEIDEIKNIKAWLLTLTHNKAIFYLRKAENSSEIASWEEIDDFQIIGNLQLPMKR

SEQ ID NO: 5274 - protein, 616 aa, B.fragilis
IIMKLKNIIVALLIGASLHSCDYLDIVPDDTPILADAFKNEQTAENFVFACYSFIPNYLNFRQNFSWCTTPETVGSAHWTTTWFTFMRMQQGLYNSADPIIDVWQSSYNGIRQCYTFLDNIDDVKPSQISEADLAAKKVLWKGEVKFLIAYYHYLLLQNYGPIVILDEAIPLNAPKEELFKPRVPYDECVSRIAQMFDNASADLPMTVKASNYGRATKVIAQALKARMYLYAASPQFNGNADMYKNFKNKDGQLLMNLTYDKNKWKTAMDECKKAIDMAHQAGAELYKYTKKGNLPEFNQAIANARKPVVDAWNKELIWGYSGWKETWADGNSIQTHVIPKGISTSSGAPYGALGATAFSADMYLTKNGLPIDEDPEFDYAHRFTVAEGDSVAVLHRNREPRFYGSIGFNRGDYLINGDTINLKMRFKEQNGTRDAGSDQLYGSYAIAKLAHPETFVSGTSNSLVAFPFPIIRLGELYLDYAEAYFEYNGTLEGDALTYFNLIRQRAGIPNVEVSYKGLPSGDKLREVIHRERTIELMFEGHMSYDYRRWLIALKEWSGMENGMIGLNSYGTTNEEYYKNARLDAQPFIFRDEQYLSPIKQDYLNVNSNLVQNPGW

SEQ ID NO: 5275 - protein, 112 aa, B.fragilis
TIKKEKGCRNPSFIIYLYGSVVGSNTVRYLLRLPLVDGGKTDLLPKKVKDRALKSFNTFQQAPIKHKKMSQKQQLSRHFNICQNTHASEHLTDPFDTSYKSINFLFCIIHGK

SEQ ID NO: 5276 - protein, 377 aa, B.fragilis
KQHESNIENRMRCLTILLGNCFLLLVSLASCGKVSLAEEAVFSIPVDTTFMRLRQWEWYCQKRADSCLTENNYQGALSWLDSARIQVEHYGRPYYILARGDVYYSIHQYDSARRYFSMAVHSIHPHIAIEAWRKLAELELMEGNEKQGFYSTQKADALFRVEIGHVQSDNSEALYQEERLKNELNQLKIAKQNREIAMLTLSLCLIILIALFIFYRQNKIKREKERLLLEEKAKLEQENQILKQTEELSALREKEAVLRESLFRKVDVLRKIPSLNEEEQESGEHRIALSEREWEEIRQTVDNAYDGFSQRLLARFPLLTLKDIYFCCLVKINVSIKDLSDIYCISRTSVSKKKFRIKREKLGAEDSDSLDDFLRGF

SEQ ID NO: 5277 - protein, 156 aa, B.fragilis
  UNSURE (76): Identity of amino acid sequences at the above locations are unknown.
SMIEKRTVCQIVEEWLEDKDYFLVEVTVSPDDKIVVEIDHAEGVWIEDCVELSRFIESKLNREEEDYELEVRSAGXRQPFKVLQQYYNHIGLEVEVLTKGGRKLSGVLKDADEEKFVVTVQKKVKPEGAKRPQLVEEDETFTYDDIKYTKYLISFK

SEQ ID NO: 5278 - protein, 521 aa, B.fragilis
PNKEGAVLVILSYGKLCGDLLSCSKRGYTTIYIQIKMMQQEEPNKYVKELTQEKYKYGFTTEVHTDIIEKGLNEDVVRLISSKKNEPEWLLEFRLKAYRHWLTLEMPTWAHLRIPEIDYQAISYYADPTKKKEGPKSMDEVDPELIKTFNKLGIPLEEQMALSGMAVDAVMDSVSVKTTFKETLMEKGIIFCSFSEAVREHPDLVKKYLGSVVGYRDNFFAALNSAVFSDGSFVYIPKGVRCPMELSTYFRINAANTGQFERTLIVADDDSYVSYLEGCTAPMRDENQLHAAIVEIMVHDRAEVKYSTVQNWYPGDAEGKGGVYNFVTKRGNCKGVDSKLSWTQVETGSAITWKYPSCILSGDNSTAEFYSVAVTNNYQQADTGTKMIHLGKNTRSTIVSKGISAGKSENSYRGLVRVAEKADNARNYSQCDSLLLGDKCGAHTFPYMDIHNETAVVEHEATTSKISEDQIFYCNQRGISTEDAIGLIVNGYAKEVLNKLPMEFAVEAQKLLTISLEGSVG

SEQ ID NO: 5279 - protein, 81 aa, B.fragilis
PRHWRRFHLAGLNRMLEAGLGALKYLLLVSLVICVIQFIDSDSQLISQTKKEQSLLYYLMESFAGIFFPAAKEVTQQYIFK

SEQ ID NO: 5280 - protein, 446 aa, B.fragilis
LFTWFLVLGNLFVHANLRNILYNMLIYSVVSYFFLKYFVYIPFCFSSARWLILQYQNFKNVRDMLNRLNYFIMLAGLLVLVACSSNSGKQVEVANTPFVYDGLKEYPVKELKLSDLAVSDYVLLKDDENSLLGRLPTNPCMQVTEDRIYIQDEEQQAIFIFDRQGNPLLQMRHKGGGPQEWASLNSFYVDSPNKEIIVLDWAKKFIVYDLNGKFKRSFPTPGCSWKFANLNDEAVLIYCPFTNRNNGEAVCILSKKDGKKLYVCPITIDNFVWDSEGRIGYEPLKPAYGGILFSDLSLKGVYFIDAETYEVKQVIDEVTEYKFENAEFVKLHPAIDAKDYTLYTTLGTKWLTPDMPMNYYYFDKKEQKMYTLKNETGWAVLKDICNVQRTRTTNTPGIGIGYYWPSTMKGESMQAEKEQFDSRFRAIMDSIPEEGNPVLQIMNFNK

SEQ ID NO: 5281 - protein, 89 aa, B.fragilis
LQLRVSVFVLHRMTTIDIIILIALGAGVIVGFMKGFIRQLASILGLIVGLLAAKAFVHLTGCEVMPYGDRLHDCGADTGIYHYLDRCGR

SEQ ID NO: 5282 - protein, 456 aa, B.fragilis
EGIRRMSLIMNAEQQYIDLFSQCEAMICRHSAEALNAPRATAFADFERQGFPTRKQEKYKYTDVSKFFEPDYGLNLNRLPIPVNPYEVFKCDVPNMSTSLFFVVNDAFYNQVLPKSGLPEGVIFGSLRNMAEQHPELVKKYYGKLADTSKDAVTAFNTAFAQDGVLMYVPKNVIVDRPIQLVNILRADVNFMVNRRVLIILEEGAQARLLICDHAMDNVNFLATQVIEVFAEENSVFDLYELEETHTSTVRFSNLYVKQGANSNVLLNGMTLHNGTTRNTTEVTLAGEGAEINLCGMAIADKNQHVDNNTSIDHAVPNCTSNELFKYVLDDQSVGAFAGLVLVRPDAQHTSSQQTNRNLCATRDARMYTQPQLEIYADDVKCSHGATVGQLDENALFYMRARGIAEKEARLLLMFAFVNEVIDTIRLKALKDRLHLLVEKRFRGELNKCQGCSICK

SEQ ID NO: 5283 - protein, 253 aa, B.fragilis
RQCRIMKTKRVGWLLIFLSYVGVVLAQNLDDQERRWAISGSWGGNWPIVTKNTLSGKAVSAGHIHTLMLEYYIPYTRFSLKGGYTGEEIGLNPGISASMSNLEIGGRYYFLPQRFAIQPYGGLSTGWNLSPRRQEGMGSSSYYDPSRQEFRKDYDYRYRIKEPLFTVSPVVGADIYFLSCLALTLEYNFRMGIAGKISGEIEKTNSRGTGFVRSNGMRQTVSVGVKVNFPFTITQTDGNSILQWLDEVIFGKE

SEQ ID NO: 5284 - protein, 292 aa, B.fragilis
EDGGGSSMDTAKAIGIITNNPEFSDVVSLEGVADTKKKSVPIIALPTTAGTAAEVTINYVITDEKNQKKMVCVDPNDIPSIAIVDAELMYTLPKSLTAATGLDALTHAIEGLITKGAWEMSDMFEIKAIEMINRYLVTAVEEPSNAEARNGMAVAQYIAGMAFSNVGLGVVHGMAHPLGAIFDIPHGVANALLLPIIMEFNAPAALDKYVEIAKAMNVYSTDMTKEKAAEAAVEAVKTLSLRVNIPQHLSDLGIQESDLDRLATAAFADVCTPGNPREVTKEIILDLYKKAL

SEQ ID NO: 5285 - protein, 215 aa, B.fragilis
ESIMITNEHIEQYLAQAHRYGDAKLMLRSSGNLSWRIGEEALVSGTGSWVPNLQKEKVSICNIATGTPQNGVKPSMESTFHLGILRERPDVNVVLHFQSEYATAVSCMKNKPSNFNVTAEIPCHVRKEIPIIPYYRPGSPALAKAVVEAMKEHNSVLLTNHGQVVCGKDFDQVYERATFFEMACRIIVQSGGDYSVLTPEEIDDLEVYVLGKKTK

SEQ ID NO: 5286 - protein, 388 aa, B.fragilis
CNPIKIMRKNKFKSFASRLNKDGDHPEKISFESPEEQAEYDKLDFLWNRCLPEETGEPDIWAKVQAKINADNTPVRLALKSNKTARLFSILKYSAVAASVALLIGAGCFLLLNDEERHDLNKIAQSLQTEIPQDIKEVTLVVSDQKKIELDNNAQIVYSATGQVQVNSNKLVEDDIKEEYNQIIVPKGKRSQIVLADNSKIWINSGSKVIYPRAFEGKYREIYVEGEVYLNVTHDTSKPFIVNTSGFEVRVLGTSFNISAYKNQEKAAVVLVEGSVNVKDQQNHHIKMVPNEKVELNQEGISGKEKVNARDYISWIDGIWTLQGESLKQVLLRLQNYYGQNIRCDAAIENEQMFGKLFLNDDLNQVMKSILSILPAEYTMKNNVIYIE

SEQ ID NO: 5287 - protein, 488 aa, B.fragilis
LGGICIGKENKIDNDYQLMSTYLAADFGGGSGRIMAGTLTEGKLKLEEVYRFANRQIKLGNCVYWDFLSLFEEMKNGLRVAARKGYEVKSMAIDTWGVDFGLIDKDGKLLGNPVCYRDSRTDGIPERVFKQIDQTVHYAEIGIQVMPINTLFQLYSMKQNDDVQLRVADKLLFMPDLFSYFLTGVANNEYCIASTSELLDARQRNWSDNLISELGLPRQLFGEIVFPGTVRGKLKQEIADETGLGCINVVAVGSHDTASAVFAVPSNEPNRAYLSSGTWSLLGAEVDQPILTEEARVAGFTNEGGIQGKIRFLQNITGLWILQRLMAEWKEQGKEISYDCAIAEATVSDIRSVIDVDDSAFCNPDHMEESIIKYCHKHHLRTPVSQGEFVRCVIESLAYRYKLGVEQMNRCLPAPVKQLHIIGGGCQNRLLNQLTANALGIPVYAGPVEATAIGNILVQAKAQGEVDSWEELKEIIINSVEPQVYYPE

SEQ ID NO: 5288 - protein, 1016 aa, B.fragilis
NMTIRLNKVTRDLNVGIATVVEFLQKKGYTVEANPNTKITEEQYAMLVKEFSTDKNLRLESERFIQERQNKDRNKASVSIDGYDKKEPEKTVADDVIKTVIPEDVRPKFKPVGKIDLDKLNRKVEKEPMKEEPKPQPVAAEEKKVAEEVKPVVIEVKKEEVTVTPATSEPKPVKEEPKPVVVEKPVETEKKVVEEVKKEEPKVVVSPEKTEKKEEKPVAEAPVTPVEKEEEGVFKIRPTEFVSKINVIGQIDLAALNQSTRPKKKSKEEKRKEREEKEKLRQDQKKQMKEAIIKEIRKEDSKQAKVVGKENLDPNGKKKRNRINNNKEKVDVNNVASNFAHPTPNSERTNNNRGGNQQGGGGQNRNRNNNNKDRFKKPVVKQEVSEEDVAKQVKETLARLTSKGKNKGAKYRKEKRDMASNRMQELEDQEMAESKVLKLTEFVTANELASMMNVSVNQVIGTCMSIGMMVSINQRLDAETINLVAEEFGFKTEYVSAEVAQAIVEEEDAPEDLEHRAPIVTVMGHVDHGKTSLLDYIRKANVIAGEAGGITQHIGAYHVTLEDGRKITFLDTPGHEAFTAMRARGAKVTDIAIIIVAADDDVMPQTKEAINHAAAAGVPIVFAINKIDKPHANPEKIKETLAQMNYLVEEWGGKYQSQDISAKKGLGVPELMEKVLLEAEMLDLKANPNRNATGSIIESTLDKGRGYVATVLVSNGTLKVGDIVLAGTSYGRVKAMFNERNQRVAQAGPSEPVLILGLNGAPAAGDTFHVIETDQEAREIANKREQLQREQGLRTQKLLTLDEVGRRIALGNFQELNVIVKGDVDGSIEALSDSLIKLSTEQIQVNVIHKAVGQISESDVTLAAASDAIIIGFQVRPSASARKFAEQEGVDIRLYSVIYAAIEEVKAAMEGMLAPEVKEVVTATIEVREVFHITKVGTVAGAVVKEGKVKRSDKARLIRDGIVIFSGSINALKRFKDDVKEVGTNFECGISLVNYNDLKVGDMIETYEEVEVKQTL

SEQ ID NO: 5289 - protein, 416 aa, B.fragilis
VPGMFYLQIISDKMNIHKIREDFPILSRTVYGKPLVYLDNGATTQKPRLVIDSIVDEYYSVNANVHRGVHFLSQQATELHEASRETVRQFINARSTREVIFTRGTTESINLIVSSFGEEFMQEGDEVIVSVMEHHSNIVPWQLLAARKGIAIKVIPMNDKGELLLEEYENLFSERTKIVSVAQVSNVLGTINPVKEMIATAHAHGVPVMIDGAQSIPHMKVDVQDLDADFFVFSGHKIYGPTGIGVLYGKEDWLERLPPYQGGGEMIQSVSFEKTVFGELPFKFEAGTPDYIATTGLAKALDYVTGIGLDPIALHEHELTVYAMQRLKEIPNMRIFGEAEHKSSVISFLVGDIHHLDLGTLLDRLGIAVRTGHHCAEPLMRRLGIEGTVRASFAVYNTKEEVDALVAGIERVSKMF

SEQ ID NO: 5290 - protein, 67 aa, B.fragilis
ARFVCTFILRYLNPGMLLKILAIAGGAFTLGVIFLQDIWGLYCLVAVSACMSLMFPTIYGHCSSWFG

SEQ ID NO: 5291 - protein, 695 aa, B.fragilis
YQKSNCMNERINYLKTYILDKRHHSQRRTPSSIGLDKLNTIYAQQGLSPVERTTACFAALMNAELPVILPGEKIVFTRTLTQVPDIYTPEEWNEIKNKYYIHEKGTVCNISPNYAYTIQHGLEARKQEIRKRQENPSLNERERVFLNSMYQCIISLQKLIEKYEQYALLNNETEIAHTLHTIKTEGAQNFRQALQLLRILHFSIWEAGNYHNTLGRFDQYMYPFYQRDLENGTLTKEEAFDLLEEFFLVCNKDSDLYPGMQQGDNGQSLVLGGRDPEGKYLFNDLSRMCLQASYELKLIDPKINIRVAPKTPDEIFTLGSRLTKIGLGFPQYSNDDIIIPGLIRKGYSKEDAYNYVVAACWEFIIPNRAMDIPNIDAVSLIGCVDRCLEKLNTCSNYSSFYTLVEQEIQKEVNAICEKHRNLYIIPSPMMSLLMDGTIERAKDISEGSYYNNYGIHGTGIATATDTLAALKKYYFEEQSLDYTTLLTAIRSNFKGYEELQKKLREEAPKMGQDNDYADLIAKDLLDSFDRSLADKRNERGGVYRAGTGTAMYYIFHSNQLRATPDGRNDGEMIPANYSPSLFLKQKGPISVIKSFTKQHLDRVVNGGPLTLEFDQSVFSNDETIEKLGMLVKTYIVLGGHQLQLNTVSRETLLHARKHPEQHKNLIVRVWGWSGYFVELDECYQNHVINRIEFGL

SEQ ID NO: 5292 - protein, 694 aa, B.fragilis
NQCTMKTTKHLSVAAVLTVLMQMGCQSHTDNTRQTLHLPELNEVRIEDAFWSPKLDIWRKITANDVLNKFEGKYTPFPGSTDTRNAFRNFDRVAEGQRDIKQHDGPEWYDGLVYESIRGIAYFLASHPNKELEKRIDGYVDRIYAAQQTEPTGYINTHTQLMENNHRWGDNGGLLRGQHDVYNAGMLIEAGVHYYQATGKTRLLEIATRFANYMADYMGPEPRKNIVPAHSGPEEAVMALYWLYKNEPELKDKLSIPVRESDYYNLATFWIENRGHHCGFPLWGTWGYRKSEKWIKDACYHQAEFGTHSRPSWGEYSQDSIPVLEQKTIEGHAVRATLMATGLTAAALENQSPQYIETAKRLWENMAGKRMFITGGVGAIHEDEKFGPDYFLPTDAYLETCAAVGAGFFSQRMNQLTCNARYMDEVERVLYNNVLTGVSLSGDKYTYQNPLNTDKPDRWEWHVCPCCPPMFLKIMAAMPGYIYAYQGDNVYVNLFIGSEVRIPVGDNSVRLKQLTSYPWHGAVSIQVNPDKASTFSMKVRIPGWAQGTENPYDLYQSNLKAPVKLKVNQEDVLLRIVDGYAEINREWKKGDHIELELPMQPRLITANKAVENLRGQVALASGPIIYCFEDADNPELQTFKLQAQTPLELSHDSNLLNGVNIIKCQGDIPAKAIPYYAVANREESHSYKVWIPQK

SEQ ID NO: 5293 - protein, 260 aa, B.fragilis
KNIAAFGISLRLKDIKDLTMQKFRLTMLFIICGNGFAYAQTFNETPIPAFTLHKEMKTPQIFKLPEIKNTLSETNPAFNNSMPLVKQYELRKKFSYLDPVFTGYFNQQQYRLFNSRYFGYELYGSSYSLRGVGTQNMAGGRLVYRLNRQLAIRIGGNAYQYRSNGRMFNDFTLNADLTYRLNNWLTAYIYGQYRLDCNPNSGVQGFPLSPQSHYGASFRINLLERKEYGLDLNLGTDRSYNAATRQWENTYKIGPTIRLK

SEQ ID NO: 5294 - protein, 263 aa, B.fragilis
NIMYIFAIVNPNTMKTGTIFSVEEFAIHDGPGIRTTIFLKGCPLRCAWCHNPEGISPQPQYMIKKGVKSICGYQITVEELVTMIEKNRSIYTLNRGGVTLTGGEPLFQPDFVIELLRQLPDIHTAIETSGYANTHIFNEVTSLADLILFDIKHTDPEMHRKYTGVDNTIILENLALLCNSGRDFIIRIPLIPGVNDTRENMSAILEKIKDARNLIRVEILRYHRTAGAKYAMIGETYHPPFDTGKAPQIYNVFEENNIKNLIV

SEQ ID NO: 5295 - protein, 76 aa, B.fragilis
AYIHIILRILIAQITFIGNVYGSKDDYSTFTNNGCLRSLLRRNGPNKMAKRSVYWLLPFLNSLGVTPQKRLNVLLK

SEQ ID NO: 5296 - protein, 235 aa, B.fragilis
TEKHHMNTWFDSFWSLLFPRCCVVCGAPLSKEEECLCIRCNMNLPRTGFHLRKDNPVECLFWGRIPVLERASSFLFYRKGSDFRRILHLLKYSGYKELGEVMGRYMAAELISCGFFDHVDVIVPVPLHKKKQKLRGYNQSEWIARGISSVTGIPLNAKSVIREKNTETQTRKSTFERSENVDGIFKLCDVACFQGKHVLIIDDVLTTGSTTVACASTLFEVEGVRISVLTLAVAE

SEQ ID NO: 5297 - protein, 88 aa, B.fragilis
ILFKRMKITSYVSFLYCLCLMLASPTVQASEVRTAIFEGKPCINPPHVVGNYPATPFLFYIPTSGERPIKWHAENLPKGLKLDKRNGG

SEQ ID NO: 5298 - protein, 1368 aa, B.fragilis
ISVCDHKYLFDSFLFQTFVLYVIKRRMKKSTFTLILFFSSVILYAQQNELMFHSLGSQHGLTYSAVRDILQDSKGYIWIATLKGLNRYDGYNIKQYYKSDDGLSSNCIEKLLLLGQDTLLMGTNEGLCLYDMMREKFTTIVPQTKAPLYVLDMAYDGRSVFIASDSGLYVYNKTEQSMPLLHKGLIVKVTLDINGNVWAVSPNTIYCFRPNGQMTRKITATEVSPDYPVEFTSIYKDSQGTLWLGTTENGLYRYNKNYNQFVSVEFASQDRKDMRYIRCIQEDMRGNLWIGTENGLFIYDYTDNSYIQYRQHAKDVQSGLTDNAIYTIYKSRGDIMWIGTFFGGVSYTSLTENNFHYLIADNGKQYLKGKAISNIIKDKNGALWFASEDHGISILYPDGHIRYLNKSTHPSLNGDNVHALAEDHSGNIWIGNFIDGLQKVDLAKGYIRSYKNIAGGHAGLSNNSIYKLYVHNPDTMFIGTSQGVNIYHFRTDSFTPFLPDVFRLIRIDDITRDLKGNIWFSTHFNGIFRYHIPTHSIHRYQKGVTGCKTMTSDNIYCSFVDSKGEVWFGTSNGGLMKYNARADSIQAFGKENELRQRDIYSIQEDSFGYLWMSTDNGIFSFNPESRSFAHYKVSDNLVSNQFNACPGYKDPDGTLFFGSINGVCFFRPEGLNHNSPTNDIHLTFSDFRIFNKHVQPSPDGILQNNIDSTSAIRLPHGMNTLTFDFLVINYNENCQSQLSCEYYLEGMETEWNATQQIPQSVTYTNLDPGTYQFHVRVIGKNGVVFDRRKITINIRPHFLLSGFMITIYSLIGLLISFIIVRFYQVRMRDKMDIRIERMEKNNLRELNKHKLNFFTYITHEFKTPLSILMAVFEDISIGRNNTITGEEMKIINRNIQRLQFLINQLLEFRSVETDHARIEYVKGDIMTYGRSIFELFIPVFRQKQIVFQYATSADSYYTVFDRDKIEKIISNLLSNAFKHSDPQSEINFRIDVDKASGQLILSCHNSSSYIHPEQREAVMQPFHKTDSSDQKYSNTGIGLALVNGLVQLLSGTVEIESHQNSGTTFKVKLPLVEDSKDMIAPDETLDIVNSPDVVADTVYLLNNSGLKEDMNAANAEKKMTVLLVEDNPDINNILKSKLLRLYKVKTAYNGQEAVELLKTHIIDIIISDIMMPYMDGYELSKYIKTSREYSHIPVILITSQPSKENELQGLSAGADAYIEKPFTFDELNLRITNLLKAKNNIREHYHDMKIFQLNEELNNKDEEFIKSLTQFVIEHIEDPELSVDQLTTHMNISRTQLYNKLKKLLNLSATEFINKIKIDVAKVKIIKTNLTIAEISWQLGFNNPSYFSKTFKRFCGVTPNEFKNGKSQ

SEQ ID NO: 5299 - protein, 69 aa, B.fragilis
HWPWPNKCSDKYEGALKHPRIYLKSFNYQIGCQHFLDCLSKSLEMGGCRMYIHGTLVFVLFVENESYGL

SEQ ID NO: 5300 - protein, 382 aa, B.fragilis
KIGGIMKSFTFCILLAHVLAFPLFAQKNAAAVTLNLAKAVTQSPKTVLMSELASDVRYFPLETTDNCLLGNECSIIYAGNSIIAGDAQTRSFYRFDKNGKFMNKIGRQGQGPEEYAVGLLFFTDPDNQKLYVQDFQDIICYGFNGKFLRRIPAPHLNMGTGAVDGQGSILYCDNNYFMRKDNPQQLFLIDENGKKLKIWKGYMEPGKKYGVNLSTRDVMYRYGGDIYFKPALENLIYKIDANRKKTLAWKFDCSGKDVDVSANEIDPGKRFQSIAVQQVFESDRYFFVLYVLKNESFVGLYDKQKKSFSNVIIKDDLAAGFDFTPPGTGLGSQLANARMVGYLSKGKRYSKALLPERKKELDELINRLDEEDNPVMVVVTLK

SEQ ID NO: 5301 - protein, 418 aa, B.fragilis
KKRGIIKGKVVEKGTYKVMLKAENALGTDTQELLINIGDELLLTPPMGWNSWNTFGRHLTEELLLQTADAMVENGMRDLGYAYINIDDFWQLPERGADGHIQIDKTKFPRGIKYVADYLHERGFKLGIYSDAADKTCGGVCGSYGYEEIDARDFASWGVDLLKYDYCNAPAGRVEAMERYEKMGRALRATDRSIVFSICEWGQREPWKWAKKVGGHLWRVSGDIGDLWNRSTDEKGGLRGILNILEINAPLSEYARPGGWNDPDMLVVGIGGKSKSIGYESEGCTNEQYQSHFALWCMMASPLLCGNDVRQMNDSTLQILLNKDLIAIDQDPLGIQAERAIRADHYDVWVKPLSDGSKAIACLNRISGPVDVELNVKTVEGLSLDRVYDVIEGSLVAEASTGWVVKLAPGECKVFICK

SEQ ID NO: 5302 - protein, 96 aa, B.fragilis
IIIMEKKTIVARVEVLPGKEQAFLQAADALIKGTRAEEGNISYNLYQNPSQPVAFIFYEEYKDQRAMDIHAASPHFQAFGKAIKEMLASDLIIETF

SEQ ID NO: 5303 - protein, 1060 aa, B.fragilis
  UNSURE (916): Identity of amino acid sequences at the above locations are unknown.
ITNIMNLKDLNNLRADTEGRIKAVFLICMFVLVSAGGFAQNTKSISGTVREKGSNETVIGATVQVKGTHNGVITNENGEYTIKNVSPGQVLVFSMIGMNTVEKTVGSQNRIDVLMDAGVLIDEVVVTGYQTQRKVDLTGSVSSLSSDQFMQTNPLSLEQALKGKISGVQVMNNDGAPGGGITIKIRGASSITAGSSPLYVIDGFPLPISDDPLESPLATISPDAIESISILKDVSSTAIYGAQGANGVVLITTKKGSAGMSEISVKATYGISKLANSIPMLGAEDYMRAYMRDMIMSGRWQNADFYQEYKDQIWNTNPSRFQFYPDLCLQNGTKQNYEVSYRGGTDRIQNSTIFSLMNEDGIAINTGFKRFYFQTNNSIKLLPQLTLNTNLSYEHNIRSGAFWTEGNIFNEIQTFSPLVPKEWTFQEIDDNLYYTGKMDNPYRKLKDIDYSNKNNTFFGQAELVYNINDNWFVKGGIGVRIPKGEVKEFIPKTIQRGYDNNGLATYATQSGLNMRGVVQAGFNKVFNKVHSLSVNAVYEANTNKYETFNQEYSQFNTDLGWEGIYDAKSGNHVKSPGVSYEKIAMLSGVLMANYSYKGRYLLKASMRADGSSKFSPDNRWGFFPSGALGWRVSEEEFFKNVSWLEKNVNNLKLRFSYGQVGNDQIAPYAYAQTLSSSQRQAIFGDGAIPALFTSRMANPEISWEVTEEFNGGLDLDMFNNRLNISLDLYTKTTRDMLLEQNLPRTSGFGKVTRNIGSVRNRGFEISVGGVLIDKKDFTWNATVNFSSNQSKVLSLGAETQMLEGRPVGSASGSENVLIKKGYPLGLFYGLQMEGIRSNWHSDYNGIGSADSPWWYATEREMPYGFPSFADTNGDGKVDMSDRVVIGDVNPVFIGGLNTRLRWKFIELAMEFSWSYXNDISNGNVYHLMTNGDIRNKSAVYYKDAWFANNPTGTLQGPGAIDWSGYMWAASNSEMVEDGSFLKMNNLAVTFRMPKNILKAWKIKDLALTYTINNVFCLTNYSGYDPEVRSGSSVNNRILPGVDISAYPYARSHIFSLNFKY

SEQ ID NO: 5304 - protein, 382 aa, B.fragilis
TKNMNRMKTKLIILLILTTMIHTNTVNAQHSQLKRADFQQTIDGKQTDLYFLRNKNGIEIAITNFGGRVVEFWTPDKKGHFEDIVLGHDHVDKYLHYKGERFLGATIGRYGNRINKGKFTLNGQTYQLPINDTPNSLHGGFKGFDMVVWDVEQPDSQTLQLTYLSKDGEEGYPGNLQVSMSYKLTDKNEFIITHQAQTDKETVINLTHHSFFNLHGAGNKDINDHILMINADKFTPVDQILIPTGILQDVEGTPMDFRRPTPIGKRVNDSFEQLEFGHGYDHNWVLNRKTSNTPELAATVYEPASGRYLEVWTTEPGLQFYGGNFFDGTMTGKHEKKYNYRASLALETQHYPDSPNQPAFPSTTLLPGDTYKHICIYKINVQ

SEQ ID NO: 5305 - protein, 271 aa, B.fragilis
KSNMELDLQQLTTEVCRIATEAGNFLRKERRSFSRERVVEKHAHDYVSYVDKESERLLVAQLSALLPEAGFIAEEGSAVYKNEPYCWVIDPLDGTTNYIHDNAPYCVSIALRSCTELLLGVVYEVCRDECFYAWKGGKAWMNGDELHVSKIENIEEAFVITELPYNHRQYKRTAEYLLKQLYGVVGGIRMNGSAASALCYVAAGRFDAWAEAFIGKWDYSAAALIVLEAGGKVTDFFGSEYFIEGHHIIATNGPLHPVFQRLLKEMPPLEM

SEQ ID NO: 5306 - protein, 95 aa, B.fragilis
GTAMKKILLALLTSCALVSCEGYFDQLPKTELPSETFYTSYDAALRNVAILYANAGHVNDGIMTTDRFMMPSLMNEGPFDLTSTSVFTTGLQGCT

SEQ ID NO: 5307 - protein, 443 aa, B.fragilis
YICIMKNTAKNFMFYVAFVASLGGLLFGFDTAVISGAEKSIQVVYDLSDFSHGFTIAIALIGTIIGAFVCSKPVEKHGRLKALKIIAFLYFVSAVGSAAIIDWYSFLFFRFAGGLAVGASSVVGPMYIAEISPSRWRGRFVAFFQFNIVLGIVLAYFSNYWIHGIAHDWQWMLGVEAIPAIAFALLLYTVPESPRWLVKQDREAEARHVIKKVSNANIEQEIHEIKESLVTIGASGEKLFQHKYRKPILYAFLIATFNQLSGINAILYYAPRIFEMSGVFTDSAMMQSIVIGLTNLTFTMIGMILIDQVGRKKLLYIGSIGMTFSLALVAKGFYQGAFSGYYMLICLMGFIAFFAISLGAVIWVLISEVFPNNVRSKGQVLGSMTHWVWSALLSWMFPVFIRTGGTFIFSFFAIMMFLSFFFALRLPETKNKSLEQIQKELTN

SEQ ID NO: 5308 - protein, 65 aa, B.fragilis
ASTIPSTILNWKNATKRPRQREGDISAMYMGPTTDEAPTAKPPAKRKNKKEYQSMMAALPTAETK

SEQ ID NO: 5309 - protein, 68 aa, B.fragilis
SQRSLSQRYCIFSNATNQSIFFIEDWHYLLVLFYWKSEGISIPFFNPIAIPNPATPYSDKQRMKDNRS

SEQ ID NO: 5310 - protein, 79 aa, B.fragilis
KNFPYYGWDAFANDKSKQDAIVPLPMILPDFDSQERCYYYSAQPVISDVCEISRDYFNKDFSKNYKLEFKLKIVNYFFN

SEQ ID NO: 5311 - protein, 162 aa, B.fragilis
ITMLSLQSEIDSLCAVSHELLHLGLDGEPIYSDRFRQLNTDVYHRCEHLFGSHGRTLEEEASLCIALLTGYNATIYNHGDKEDKIQSVLNRSWDLLDTLPVSLLKCRLLVACYAEVFDEELAAEAHAIIDGWKDRELTREEFEIVEHLKSLEENPYPNTDIE

SEQ ID NO: 5312 - protein, 209 aa, B.fragilis
RDRPFNNTNHHNSNKIMAATKIFNLWAKRSPEWETKYEDTLLKAFCDYGKGSTSYQETRAKLFGAGYELYILAFFIGLYHGQTKDLVADKAKRKDFGWAIENWGTAEARGGRKQYGQIREYMFMALVARTGIDWIALDKGDITPRKVVDLLIDKMEKYANFGFDFMQDKLEDNPDYFYKETAFLQVFLNFMQPSTSENAEEEEEAESLD

SEQ ID NO: 5313 - protein, 200 aa, B.fragilis
YFCTLFSQEIDQEMIEDIKKACQVMSEGGVILYPTDTVWGIGCDATNEDAVRRVYEIKRRADSKAMLVLVDSPVKVEFYVQDVPSVAWDLIEVADKPLTIIYSGARNLASNLLAEDGSVGIRVTNEAFSRRLCQQFRKAIVSTSANVSGQPGAANFNEISEEIKSSVDYIVNFRQDDMSRPKPSSIIKLDKGGVIKIIRE

SEQ ID NO: 5314 - protein, 640 aa, B.fragilis
RYQTDRVTYQEILKQYWGYDSFRDLQEDIITSIGNGKDTLGLMPTGGGKSITFQVPALAKEGLCIVITPLIALMKDQVQNLKKRGIKAIAIYSGMTRQEIVVALENCIFGDYKFLYISPERLDTEIFRAKLRSMKISMITVDESHCISQWGYDFRPAYLKIADIRDLVPDAPVLALTATATPEVVKDIQERLRFREENVFRMSFERKNLAYIVRPTDNKNGELLHILNRIQGSAIVYVRSRRKTKETTELLVNEGITADFYHAGLDNATKDLRQKRWQNGESRVMVATNAFGMGIDKPDVRIVIHLDLPDSPEAYFQEAGRAGRDGQKAYAVILYAKSDKTTLSKRITDTFPDKDYIKDVYEHLQYHYQMAMGDGLGCMYDFSLEEFCRKFKYFPVPADSALKILTQAGYLEYTDEQDNASRIIFTIRRDELYKLREMGEAAEKLIQMILRSYTGVFTDYAYISEQTLAVRTGLTRQQIYDLLVMLSKRRIVDYIPHKKTPYIIYTRERIDLHYLQIPRAVYEERKERYETRIHAMVEYVTSENVCRSRMLLRYFGEKNEHNCGQCDVCLSHRAEPDISQSTFDGLREQICALLKEHPMTPAEIASHINTDKEQLSEVIRFMLDEGLLSSENGLLTEKTS

SEQ ID NO: 5315 - protein, 579 aa, B.fragilis
KEKTIYKMNHKWNYRPITQEQAEISRALAQELGISPVLGRLLVQRGITKAQDAKKFFRPQLPDLHDPFLMKDMDIAVERLNMAMGKKERILIYGDYDVDGTTAVALVYKFIQQFYSNLDYYIPDRYNEGYGISKKGVDYAAETGVGLIIVLDCGIKAVEEIAYAKEKGIDFIICDHHVPDDVLPPAVAILNAKRLDNTYPYTHLSGCGVGFKFMQAFAISNGIEFHHLIPLLDLTAVSIASDIVPIMGENRILAYHGLKQLNGNPSVGLKAIIDVCGLSEKEITVSDIVFKIGPRINASGRIQNGKEAVDLLIEKDFSAALEKAGQINQYNETRKDLDKSMTEEANKIVAELEGLADRRSIVLYNEDWHKGVIGIVASRLTEIYYRPAVVLTRTDDMATGSARSVSGFDVYKAIEHCRDLLENFGGHTYAAGLSMKVENVQAFTERFESFVSEHILPEQTSAVIDIDAEIDFKDITPKFFNELKRFNPFGPDNQKPVFCTHHVYDYGTSKVVGRDQEHIKLELVDNKSNNVMNGIAFGQSSHVRYIKTKRSFDICYTIEENTHKRGEVQLQIEDIKPIE

SEQ ID NO: 5316 - protein, 400 aa, B.fragilis
TNTAIVMNTTEYLQTWSDSYKNDMISNIMPFWMKYGWDRKNGGVYTCVDRDGQLMDTTKSVWFQGRFAFTCSYAYNHIERNTEWLAAAKSTLDFIEAHCFDTDGRMFFEVTETGLPIRKRRYVFSETFAAIAMSEYAIASGDHSYAVKALKLFNDIRHFLSTPGILEPKYCERVQMKGHSIIMILINVASRIRAAINDPVLDRQIEESIAILRKDFMHPEFKALLETVGPNGEFIDTNATRTINPGHCIETSWFILEEAKNRNWDKEMVDTALTILDWSWEWGWDKEYGGIINFRDCRNLPSQDYAHDMKFWWPQTEAIIATLYAYQATKNEKYLAMHKQISDWTYAHFPDAEFGEWYGYLHRDGTISQPAKGNLFKGPFHIPRMMTKGYALCQELLSEK

SEQ ID NO: 5317 - protein, 85 aa, B.fragilis
LVFATFANCEKTLSFKGWNCQFMIQFYNEYNQQFTNTKQPVSYLDDVSLYLPVMHLSWSHNIVLMQKVKDLKARNWYMIQSLKNG

SEQ ID NO: 5318 - protein, 439 aa, B.fragilis
ISEAMNTKYWEEEIETMSRKKLQELQLQRLKKTINIAANAPYYKKVFQEHGITPESIQSLDDIRKLPFTTKADMRANYPFGLVAGNMKEDGVRIHSSSGTTGTPTVIVHSQHDLDSWANLVARCLYCVGIRNTDVFQNSSGYGMFTGGLGFQYGAERLGALTVPAAAGNSKRQIKFITDFKTTALHAIPSYAIRLAEVFQEEGIDPRSTTLKTLVIGAEPHTDEQRKKIERMLGVKAYNSFGMTEMNGPGVAFECTEQNGMHFWEDCYYVEIINPETGEPVPEREIGELVLTTLDREMMPLIRYRTRDLTRILPGNCPCGRTHIRIDRIKGGSDDMFIIKGVNIFPMQVEKILVQFPELGSNYLITLETVNNQDEMIVEVELSDLSTDNYIELEKIRKDITRQLKDEILVTPKLKLVKKGSLPQSEGKAVRVKDLRNNK

SEQ ID NO: 5319 - protein, 279 aa, B.fragilis
KTMAIAYDGINYFPVGVNFMEENAMEVIEAKYGIKGSAIVLKLLCKIYKEGYFIRWDEEQCLIFANKAGREVQAAEVQGIIEILFIKGILDRNSYLANGILTSANIQKIWMEATKRRKRDLKALPYLLVNDLTQQETEAPEGENVTISPGNVVHDVAVNAKNACNSGQSKVKEKKAEENKELPPSAPPKGKEKEWEEVSAPLPIPGYAFNTMTHNYPGLTDTLKRLGITEVGEVNAILRLSDYGRKGTRVWQLIANTCWSDIGAKGRYLIAALNKAKRK

SEQ ID NO: 5320 - protein, 211 aa, B.fragilis
GRNFLIEAINQDYYHVHGALAHNFDTTLPEIQAKQVKETLKDPYIFDMLTFTDEYDERDVELGLVKHIEKFLVEMGAGFAFMGRQYYIEVSGNDFYIDILMCNAFMHRYLVVELKRGEFQPEYIGKLNFYCSVVDDILCRAGDNQTIGLLLCQNKNRIMAEYALRDVHKPIGISDYELGKALPKDIKSGLPSIGELESKLSRELEDNTQSL

SEQ ID NO: 5321 - protein, 640 aa, B.fragilis
IYFYITMNIRFYYKYLSSRVASKWLILAVDVLLVIFSMFLASLLQIGLSALVFEFSLWVWTTLFCVIFNVCFFHLNRTYVGVIRYSSFIDISRIFISLTLGYLVTCVGNLLWMGWSGREVLPISVILTAYIVNFSLMVCLRILVKMIHELMTFDRRHSIRVFVYGSKGSGINIAKSLRVSRSNHFRLKGFISDDTGFIGKQTMGCRVYANNESLFDILEEERIEAIIVSSEKVHRLETSGMIDRLIAEDIRILTVPPFNDLGKEGMQIKDIQIEDLLQRDPIHVDIRKISSHIEGKRIMITGAAGSIGREMVRQIAGLNPYKLILVDQAESPLHNVQLELLDNWRDIDAKMLVADVTNQTRMESIFKDYRPQYVFHAAAYKHVPMMEDNVSEAIQVNVLGTRIMADLAVKYGVEKFVMVSTDKAVNPTNVMGCSKRLAEIYVQSLAHQLSKYANDGALVKFITTRFGNVLGSNGSVIPRFKQQIEKGGPVTVTHPQVIRYFMTIPEACQLVLEAGSMGNGGEIYIFDMGNPVKIVDLARRMIYLSGQKNIKIEFTGLRHGEKLYEELLNVKEFTCPTYHEKIMIAKVREYDYEEVKQEIQKLIDLSYTSDTMGIVASMKKIVPEFVSKNSEFEILDKASF

SEQ ID NO: 5322 - protein, 101 aa, B.fragilis
IISLNNYISYDVVSNSFWIKYFNLYIKNMYQYAFSPNKSHLIYSTIAFGDEPEIIIMGKGQITNDDEIQMYPSINDNGDVEILFIKQEIKKLSILWVGCFR

SEQ ID NO: 5323 - protein, 705 aa, B.fragilis
FTEYSNLTQTDKHRLMKRNVSLLKYALLIALCCVACVNEKDLYEPSGEDPGETEELDLSFKFALRADKQIHISVTRADGKAAEGIGVGVYLQQPYEEDGIISGKPLYMGYTDGNGQIDATISVPANSDKLYVASLTAGYPGVQEMDVQPSMTCNLTATAFQIKTATTRMVATRSETGLDVPVGQKLSNLYELYSPYTDSEIGKDGIPLLNASPLVTKEELSAKFLNLMNSWYPEQKNVQDVDLKKSSDLVVTDELGAEVWATYVGDGGFYVNNATVYNVLAYYSYQEGELGRREDIQGHRMTLLLPNTHQQKCPSGLKVQLLYWDGKQYSKVFPKGARIGFAVARDGLNIANVNAANGGVNSKSSYKFKNQTFPNGDVNGFYYSTPSLNATKRTNAVIRNVPDYNCCIMGFDIRPYDDPKADYDFNDVMIKLTASPVSAIKPEEDIPVIDEFTPSEAVYGTLAFEDQWPKMGDYDFNDFVMNYSYELEKGDNNMITALKLTFTPIAKGAASWTHIGVGIELPLSADNIDKAKSEGATLEEGNDRATFIVWNDVNTAFGTTEGYVNTEGAVVGVSAIPVEVTVRLKTPVSSLLTQKFNPFIFVNSRQREIHLVDYKPTKHADTSLFGTENDRSDPGAEVYYRMDNRYPWALDFPRKEDSSPAWNYPKERVIITKAYPNYEKWVLDQSNLSWFDASVSGNVNREFLY

SEQ ID NO: 5324 - protein, 461 aa, B.fragilis
KGDFRGSLSFNIDGYMRVMIRIKRKIDSSPFLKSVVVLFSGNVFANLISLLSIPILSRIYSDIAFGDYAIVISTATIVNGISTLGLTSAIMIPVEENKAKSVFTTAWISHILVSTFCFVLALILLPVYSIYSITGSYSCSLLLMYLYVLLVGTFSLLSVYANRLRKNRILFWNAMINSLALLCLAIPFGLWGWGGTGFLMASTGGYLVANIQMLYHMNPFKKIAYRDCVSVYKDFKDFIIYQFPSNLISTFTIQLPNQLFSAYFGNASLGGYAMCERILGVPMRLIGAPITTIYFRHSSECIRECKDISGFTYILITRILILAFLPVLILFSCSEVLFTFILGDSWLLVGKIVSILIFPYVLLFCSNCVSYCLVVIGKQKINLYLSLLYLMLIVASVVSGFYVFSDFVSVVICFAVALIVFNLLNLLVIFYYLRKDFGRFVRFIGIYLLLIYLGLILIKYL

SEQ ID NO: 5325 - protein, 856 aa, B.fragilis
SEYLMRRFITLFFLIFTLSGVAVAQQMSDDQVVQYVKDAQKMGKTQKQITTELMRRGVTKEQVERIQEKYENGSGSTGTQNNQNSTRSRTRTQQNDESDYSNRSQKNLKDQKNQKNQKNQKNIKGLRQSNNQKNKRGMGDENLEMTDEDMMNEEDWSDEYTVKPEEDPTQQIFGHNIFTNENLTFEPNLNIATPVSYRLGPGDEVIIDVWGASQTTIRQTISPEGSILVDNLGPIYLSGMTVREANNAVRREFAKIYAGISGPNPNTSVDLTLGNIRTIQISIMGEVAVPGTYALSAFSSVFHALYRAGGVNKIGSLRSIKVVRNGKKIADLDVYDFIMKGKLNDDVRLQDGDVVIVDPYESLVQITGKVKRPMFYEMKPSETMATILKYSGGFTGDAYKKAIRLIRKTGREHQVYNVDEMDYSVFKLDDGDVLAVDSVLERFENRVEVRGAVYRAGMYQIDGTVNTVKQLIKKAEGVRGDAFLNRAIIDRENDDLTHEMIQIDLKGLLNGTVADIPLQKNDILYIPSIEDLKEEATLTIHGEVANPGTYLYSSNMSVEDLVLQAGGLLEAASTARVDVSRRIKNSKSTELSNVVGKTFSFELKDGFLVGGDQDFHLEPFDEVYIRRSPAYHQQQNVTVGGEVLFGGRYALSKKNERLSDLISKAGGITQDAYVKGARLIRKMTEEELRRKEDALRMANKGGADSISVKTLDVSDTYSVGIELEKALANPGSDFDMVLREGDILFVPEYVSTVKINGAVMYPNTVLYKKGESLKYYINQAGGFASLAKKKRAFVVYMNGTVSRLRTGNSKAIEPGCEIIVPSKDPKKRMSAAEIIGMGTSAASLATMIATMVNLFK

SEQ ID NO: 5326 - protein, 965 aa, B.fragilis
MNFQDLHILGELKEELLYRILYSTDASAYREMPIAVAYPKDSSDVQKISNFAKKNQINLIPRAGGTSLAGQVVGKGLVVDISKYMNHILEINQEERWVRVQPGVVLDELNLYCKPYGLFFGPETSTSNRCCLGGMVGNNSCGSHSLVYGSTRDHLLEANVVLSDGSEVVLKGMTSKEINEKCKLDSLEGRIYSQIITLLSNFENQKEIVDNYPDVSLRRRNSGYAIDELLRSNYFDKNCSESFNLCKLLAGSEGTLALITELKLKLVPLPPTEKAVICVHCSTLEESFAANLVALRHAPVAIELMDSTILELSKQNISQNKNRFFIQGDPAAILIIELAEQTRGEVDKKANEIIDDLKIHHYGTHYPLVYGKDISRVWALRKSGLGLLSGMPGSAKPVSLIEDTAIAPERLAAFIADLKVMLSKYGLDCIYHGHISTGELHLRPVLNLKKEKDKKLFRLVATETAELVRKHRGSLSGEHGDGRLRGEFIPLLLGDKIYSFLRDIKETWDLPHIFNIGKIVDTPFMDINLRYEQHNLGVKTYFDFSKQKGWLCAIEQCNGSGDCRKSNLFGGTMCPTYRATREEKNTTRARANTLRELLIHPAHDRIFSQPEILEVLDTCVSCKACKSECPSNVDMARYKAEYLQHHYDETFVSLRSRLIANLTKVQKLGMVAPWLYNAFVTAQFTSSLLKRILKFAPQRSIPRLYKITLKSWLYNNPDMNKCNRKVYLFADEFTNYMDVEIGIKFIKLLRTLGYEVIIPKHLESGRTEISKGLLKKAKKIAEKNILFLKDIVTEEIPLVGIEPSCILSFRDEYPDLVDEELQGYARKLSVNCLLYDEFIVREMRKGNIKQKQFTQSYLYIKLHGHCHQKSLASIEPSKEMLSLPKNYQVDIIPSGCCGMAGAFGYEKEHYDLSMQIGEQVLFPAIRQAKEDVCISAPGTSCRQQIKDGTGRRAYHPIEVLYDALI

SEQ ID NO: 5327 - protein, 1084 aa, B.fragilis
ATLHHERADRQVAGSQQVLSSNMSFTTSINIERDFGKIPHYIVTANARQTIGKIINHFASGIHSFCLIGSYGTGKSSFILALENCLCGKTVGKNVLLSQRGQFNSFEQFSFINIVGDYASLANLLASHLNAESKNVISVLDNHYNRLQKTNQFLVIVIDEFGKVLEHAAKNNPEKEMYFLQKFCEYVNDTSKNILFLTTLHQGFGAYAKGLKAEQKQEWTKVKGRIQDIVFAEPIEQLLNLTATHISSADKKPTLNTDKIYNLAVASKFAASTLDANVARALYPMDIVSAYVFTQANQRYGQNERTLFTFLETRGEGTVNDFEASINRLYSLADVHDYIVYNFYSYLQEAHEDSANWSAIKIAIERTEGLNADATTITDAIKIVKAVGLLNIFASSAASIDKQFLIVYASYAMDVCQVGSVIDLLEKNQILRFAKYKSKYILFEGTDVDLEAGLYEAARECKRSDVIAEKVCEYFDDKIALANAHYFRTGTPRYFQYCLTSSPIEYIVSGETDGIINVILTRQEDLVAVKAACTDINGKAILYCIFENTTEIADHLFEIDKLHWVRDYYVADENDKVANREIANLLVHEQSMLNKTIMESLFSDNVTWIFNGEILASITSRKMLAQQLSTICDSVYYATPIYRFELINKHRPTGNMSLARQSYLQALLDHSSEPYLGFERDKYPPEKSLYLTLLKNTGIHTTAGLGSPTEPSFQPLWDACENFLRSTIGKPHKLGELFTLLEAAPFRLKQGLLYCWIPTYLIIKRDDFALYNSDGTYVPYINKEVLDLILRSPNGFLIKAFAVDGVRRTFFDKYREAINMGSSELSTQSFIETIRPFLTFYKKLNSYARRTKDISPNARKFRDVIAKATDPEKTFFEVLPDELGFKEITLSQNPEAIESFVAVIQEAIRELRNCYSELVGNIEQYLLKTLRLEEVGFSDYHHLIAERYKSVKTELMPVNMRNFQARLVGNYDDKTAWIEAVSYVALNKPLTEIRDTDKSFLLATLKDMLFQLDDYVEMHKTASEDVIRLHITQNKSKAVTTQVILSEAMRQEVNSLENKLESILSGDNSLDVAALIAILKKKLK

SEQ ID NO: 5328 - protein, 88 aa, B.fragilis
FYSHCVDQHCKGEHLQEDDKRKQGIRIKLYRISYNHHIISAITYFFLYIYFTYSAIVRLFILYPFNEISPVLYLAWHKTGDETKIYTH

SEQ ID NO: 5329 - protein, 143 aa, B.fragilis
KNGQNLQSDGSMSFWNEANVILWISRNSLKISLADIESSPYISKQLLRHTLEHLQELDFIESTGRASGLRYILHKSKIQTTGEKIKYSQLKRQGKAKQREAVIRYINTVGTITNAEAREILNLTETSQSYVPRCYPNYGVKDI

SEQ ID NO: 5330 - protein, 291 aa, B.fragilis
MFTNLIKRVIMKYAFSGHESFQCKGLWLKKGYDYAKAGLSFTDDYAVVELGVGKNMVASIRYWLRAFGITNDNGVPTEIGKYLLDDNGADPYIEDTTTLWLLHYMLVTSRVATLYNIVFTEYNKTRKEFTKADLANAVRRMFADKCFDSTPYNEKTVWRDIDTMLKNYVTPDSIKACDDFSALLIDLKLIGKTGHEDYTFNCSARAKMEPLVFLFAVLDITQGKQQVIEFEVLLRLANIFGMSVNELYDVFDQLHTIDPHITFCNTAGEQLFTMKERIDKWQVLNKYYQAT

SEQ ID NO: 5331 - protein, 109 aa, B.fragilis
KNANTKTQPPITEPIKETRGRKAGAQIPGIISNNEGVIKALIESYILDAKEQNIKTCKDSLARYIEGKKLFGKIRNGVFKPLVLSTIRTYVNEIWNKMERKKKNQEGKR

SEQ ID NO: 5332 - protein, 64 aa, B.fragilis
TFHKVKPRLNIESRIFQTLHYYILTLMFRSKGKIRILSFFSSGYENPQKGKENILPLIILFSIK

SEQ ID NO: 5333 - protein, 64 aa, B.fragilis
RGNKRENETFSLLNCLTLNEIVLKKVSVSINDRLIERKDRGYFHNCKMFNKKNVFLHGLIYLIV

SEQ ID NO: 5334 - protein, 531 aa, B.fragilis
DMSKQLLLGDEAIAQAALDAGLSGVYAYPGTPSTEITEYIQMAPITSERNIHNRWCANEKTAMEAALGMSFVGKRALVCMKHVGMNVAADCFINSAITGVKGGLIVVAADDPSMHSSQNEQDSRFYGDFSLIPMYEPSNQQEAYDMVYNGFEFSEKIGEPILMRMVTRLAHSRSGVENKAQKPQNEISFSEDPRQFILLPGNARKRYKVLLTRQEEFIKASEESPYNRYIDGPNKKTGIVACGIGYNYLMENYPEGCEYPVLKVGQYPLPKKQLMQLIDACDEILVLEDGQPFVEKQLKGYLGIGLKVKGRLDGTLSQDGELNPDTVARALGKENSSEFNVPNIVEMRPPALCEGCGHRDMYITLTQVLKEEYPTHKVFSDIGCYTLGANAPFNAINSCVDMGASITMAKGASDGGLHPAVAVIGDSTFTHSGMTGLLDCVNENANVTIVISDNETTAMTGGQDSAGTGRLEAICAGLGVDPAHIRVVVPLKKNYEEMKQIIREEINYKGVSVIIPRRECIQTLARKKRSK

SEQ ID NO: 5335 - protein, 142 aa, B.fragilis
ILSNRNTFDPTYLWGDNLSINPLNHIRMKQKKRPASQTEAMKLRWKKRIVFEKGYTEMCAEWMAERLEALTDHLQYGHAAIAYQKQNGDFRLVKATLIYYETEFHKKYDPTQIEGAVVYWNVDEQRWTTFQMENFMEWRPIV

SEQ ID NO: 5336 - protein, 410 aa, B.fragilis
ILPKLLIYMKQHLLKEIELGTKSALLKKKIITHYIYNGSSTITDLSKELDLSVPTVTKFISEMCEEGYINDYGKLETSGGRHPNLYGLNPESGYFIGVDIKRFAINIGLINFKGDMMELKMNIPYKFENSIEGLNELCKLISNFIKKLTIAKDKILNINVNVSGRVNPESGYSFSQFNFEERPLSEVLAEKLGYKVTIDNDTRAMTYGEYLKGCVNGEKDIIFVNISWGLGVGIIIDGKIYTGKSGFSGEFGHTSTFDNEIICHCGKKGCLETEASGSALHRILLERIQNGENSILSNRIGDINNPITLDEIIASVNKEDLLCIEIVEEIGQKLGKQIAGLINLFNPELVIIGGTISLTGDYITQPIKTAVRKYSLNLVNKDSAIVTSKLKDRAGIVGACMLARSRMFEC

SEQ ID NO: 5337 - protein, 94 aa, B.fragilis
IRQKENNPDRKVQFAVDKKASIPVSIRKVLCREWKTGRTFKQMIYSHFRAQYFNLQKLYFNVTLKFVFRLQIANSLNAKDLLFADKNKAIGKWH

SEQ ID NO: 5338 - protein, 195 aa, B.fragilis
AMKKDIILSGVGGQGILSIATVIGKAALKDGLYMKQAEVHGMSQRGGDVQSNLRISDQPIASDLIPSGKCDLIISLEPMEGLRYLPYLGHEGWLVTNETPFVNIPNYPAESDVMAEINKLPHKVVLNVDKVAKELGSTRVANIVLLGATIPFLGIDYEKIQDSIREIFQRKGDAIVELNLKALAAGKEIAEKTMK

SEQ ID NO: 5339 - protein, 322 aa, B.fragilis
SMKNFALIGAAGYIAPRHLRAIKDTGNRLVAAYDTFDSVGIMDSFFPESSFFVEQELFDRHCTKLKGTDKQIDFLSICTPNYLHDAHMRYGLRLGADVICEKPLVLNPWNVDALQEVERETGHHIYTILQLRLHQSIIDLKKKIENGPKDKIYDVDLTYITSRGNWYYTSWKGDMHKSGGIATNIGVHFYDMLSWVFGPVKKNIVHVYTHDRAAGYLELEKARVRYFLSINSENLPENAVQGEKLTYRTINIDGEEFEFSKGFTELHTESYKDILAGNGFGIEDARNAINIVYDIRHAEPIGLKGDYHPLAKLPLSKHPFGW

SEQ ID NO: 5340 - protein, 89 aa, B.fragilis
KYEKNRKCGGYTEKNNCHCPRYKILFAHILERYYRDFEAFIPIWAGCPGIHTPWKREVMQESGCCKPYLPKKLPDSSRIEFCFDVFVIC

SEQ ID NO: 5341 - protein, 376 aa, B.fragilis
FIMNKRIWLSLAHMGGREQDFIKEAFDTNWVVPLGPNVDAFEQSLAEYLHEDRRVVALSAGTAALHLGLILLNVKPGDEVICQSFTFAASANPISYLEAKPVFVDSEKDTWNMDPVLLEEAIKDRLRKTGKLPKAIIPVHLYGMPAKMDEIMDIAGRYGIPVLEDAAEALGSELNGRKCGTFGELAALSFNGNKMITTSGGGALICRTEEEARQTKFYATQARDAAPHYQHTHIGYNYRMSNICAGIGRGQMFVLDEHIARRRAIHSLYVDLLKDVAGITVMENPDSRFASNFWLTCILVDPKLAGKSREDIRLKLDSENIETRPLWKPMHLQPVFTDAPFYGNGTSERLFDIGLCLPSGPTLTDEDIRRVVDMIR

SEQ ID NO: 5342 - protein, 522 aa, B.fragilis
KKMKQKQFYFIYVFLLSMTFLGACSKDSPNELIPNTIVKIEIDELPGKRIYFIGEELDVSDMTLKVFYSNETSEIVPVKKDEVTGFNSTVPENDQILEVHKGSFTVTFKIQVLINDIQAISIKTLPSKTVYTLGEPLSLSNMVLEINYADGTIKENSAPSADWVQGFNSSVPAQLQIVTLELDGKQVSFDVQILPVKVDGDKVVSVIDSDFTSITFPDGIRTIGSKAFENKNIKASELLFPASLSTIEQAAFAYCRNLKIVDLSHTSIKELPEEAFLFSGIKKIALPASLEIVGKEAFYGCTDLNVIDISHTSVKELQNGAFGKSGISSISLPSTFKIVGTSAFIETKNLKELTLPEGSEVIDLEAFSGSSIQKVTLPNTIYHIDRSFYNCPELTTIETYGTRTTPSPVDRTAAIVSECFNHSPKLTVLKIPASIAKIGISALNKCQVKTLILPASVKALDFNAFGNAVSLDEISLMSPTMVTADYYPVAPGIQKIRVPQNLVETYKQNKAWKPFAEKIVAL

SEQ ID NO: 5343 - protein, 325 aa, B.fragilis
IMKKEDLRIVYMGTPDFAVEALQCLVEGGYNVVGVITMPDKPAGRGHKIQYSPVKQYALDHQLPLLQPEKLKDEEFIQALREWKADLQIVVAFRMLPEVVWNMPRLGTFNLHASLLPQYRGAAPINWAVINGDTETGITTFFLKHEIDTGEVIQQVRIPIADTDNVEIVHDKLMHLGGRLVIETVDAILEGKVKSIPQEEMAVAGELRPAPKIFKETCRIDWNQPVKRVYDFIRGLSPYPAAWSELVNPEGEAVVVKIFESEKLPKVHTLAPGSIVTDGKNFLRVAVPDGFVNVLSLQLPGKKRLKTDELLRGFHLTEAFKMKAV

SEQ ID NO: 5344 - protein, 181 aa, B.fragilis
RFIERMEETARKIKENTSCWYAVYTAPRAEKKVKEQLDKIGVENYLPLQPVVRLWNNRKKKIFIPVVPGCLFVHISSEEIAHVAGIHGVAFLLKEKGQYVSIPEVQMETFKTMIEHSCELVEFAPNEFVPGTIVRVISGQLQGLEAELVDCQGNNKLLLRVEGLGCALVTVSTDCVASKEE

SEQ ID NO: 5345 - protein, 341 aa, B.fragilis
KEIEMSEVRHVLGISGGKDSAALAIYLKDKYPNLHIEYYSSDTKCELDETIQFIDRLRSYLGHITTLIAAEGSPEPTPFDHFLKVSGGYLPSVQARWCTQKMKLAEFEKFVGDTPTVSYVGIRGDEDREGYVSTKPNIQAIFPFRKNIWSMDVIHEVLHDKNIENFAECYRNVADDETYQTVEAALTSKLTKHFYYSKKLNMLLDADVITFNHAVFSFLKQYTDYPVGKLDYFPLIDNDEVLVREEIFRILEDSGVGIPAYYNLIDFEVDGKKGQYCRSRSGCYFCFFQQKIEWIWLYEQHPDLFKKAMEYEKDGYTWIQGEPLSELIRSGVVCGKSSLTR

SEQ ID NO: 5346 - protein, 393 aa, B.fragilis
MGNEKKKVVKIVPTYFEHETRDLKEISVLNSLGCNVIVVAKGDNAVIIEESCYILHRLCSRPLMPFVSNLFLNRLFSLYIWVRYVRKLHGELLSCHDLFCLCIGWLSTLGLRKKPFLVYDSHEFEYGRNCKRNFVSKLFIKTLERFLCKKTALNIVVNESIADAVQTLHGLNNRPLVVRNVPLYWNIDVNKCVLRRKKICEAYGIPIDSFIIMYHGVIAAGRGIENAIYAVENVENTCLLILGNGEKSYIALLEKMISSLRLEQKVFFHTAVEHSILWEYIGSVDVELSVILNTCISYYYALPNKIFESIQAMIPLIVSDFPEMERVVKMYDIGVCCKSDDVNSLVEAIRLMNKDKVLYSRFKANMQDAKKELCWENEKEILEGAYRSILMDI

SEQ ID NO: 5347 - protein, 606 aa, B.fragilis
RWSDQDYSRMMEKEKISLLQRFIIWRENKIKEKQFILILSFLVGIFTAIAALLLKFFIHTIQNFLTDNFNTTEANYLYLVYPVVGIFLAGWFVRNIVKDDISHGVTKILYAISRRQGRIKRHNIWSSTIASAITIGFGGSVGAEAPIVLTGSAIGSNLGSMFKMEHRTLMLLVGCGAAGAIGGIFKAPIAGLVFTLEVLMIDLTMSSLLPLLISAVTAATVSYITTGQEAMFKFHLDQPFELERIPYVILLGIFCGLVSLYFTRAMNSVEGVFGKLSNPYKKLALGGVMLSVLIFLFPPLYGEGYDTIELLLNGVSNADWDTVLNNSLFYGYGNLLLVYLVLIILLKVFASSATNGGGGCGGIFAPSLYLGCIAGFVFSHFSNDFDFTSTLPEKNFALMGMAGVMSGVMHAPLTGVFLIAELTGGYDLFLPLMIVSVSSYLTIIVFEPHSIYSMRLAKKGQLLTHHKDKAVLTLMKVENVVETDFVSVRPEMDLGELVKAISTSHRNMFPVTDKDGVLLGVVLLDDIRNIMFRQELYHRFTVSKLMTSVPARLYDTDSMEQVMQTFDDTKAWNLPVVNEEGKYLGFVSKSKIFNSYRQVLVHFSED

SEQ ID NO: 5348 - protein, 83 aa, B.fragilis
NHGEKSGGSECYSCGYSSLSLDACLIKANDSDPVYLSTNGVKSHIKSVEDFNKVGFDWDKIKVMSPAEVDAIPTAPEYEIANW

SEQ ID NO: 5349 - protein, 311 aa, B.fragilis
YKNEIIMEKIIGLINAPFTPFYENGEVNYEPIEAYAKMLVKNGLQGVFINGSSGEGYMLTDEERMKLAERWVEVSPKGFKVIVHVGSCCVKSSRKLAEHAQKIGAWGIGAMAPPFPKVGRVEELVKYCEEIACGAPDLPFYYYHIPAFNGAFLSMVAFLEAVDGRIPNFAGIKYTFESMYEYNQCRLYKGGKFDMLHGQDETILPCLAMGGAQGGIGGTTNYNGVNLVGIIEAWKAGDLEKARELQNFSQEVINVICHFRGNIVGGKRIMKLIGLDLGKNRTPFQNMTDDEEVRMKAELEAIHFFDRCNKF

SEQ ID NO: 5350 - protein, 370 aa, B.fragilis
YKMEEYKRCTRCVMDNKSDETITFDKHGRCNYCTDALNLIGKVYFPNAEGEQKLRQMIEMLKYEGKGKQYDCLMGISGGLDSAYLAYLGSVKWGLRILAVHVDDGYDTELATSNIKNLCEACGIELMVEAPDSEQFNAMTKAFIKAEVPNIAIPQDNILFACLYNYARKYKVYNFLSGGNFALECVLQKGNTYEVFDMIHNRDIQKKFGSKPIDKLSFLSSYQKIVDTYLYKIKSLRPLNYIDYNKECAIHELNDFCGFTYYEAKHLENILTKVTQLYWFYHKFHVDKRTSHLSSLIVSGQMSREQALAELEKPVYDKNKMEKDIEFVLKKIEMSREEFEELINRPGKQHSDYRMDKFLPFLHKIKTFFD

SEQ ID NO: 5351 - protein, 490 aa, B.fragilis
ERFWKVCKIHWNLFAVNILRSYFNKIFMTAIFIVVFSVIYLLVLYNFYIAICGRIRVFTITSFFCLCYISFAYIGSILLNIMHFEAEDYLGMYARPDIFFLVWVFTLLGLLFLLLGFAIANIVFKNICYPRKNRDLQLIKVSISCFDNSNKNFFVILFLFILSFFVLLVYRNAIGGFPLESVFSADNGTALAFLRSEATNNFSGKFYRYVMFMETLPLFLFIVVSFIKSCKKKKWKYLYIALFLYNLFYSLSTIQKAPILKFLLLCCIIFFYKNGFINKKIILKLVVFSCGLVLVMYMCFMGLEDAPIEVIIEGALHRVFIGAIHPFYWYIKYAEEFGFLYGTSFPNPAGIFPFESFRLTVEIMNYAKGDLLGDLVGSMPTVYIGEMYINFGLYGLALASLMFGFILQTLDILFVRYLLVNKSVLVSSLYIYMIYYFSQFTETGISGIIIDTDLYIVLFISFIYCLINRYNLRRYGKKKGLPCYKCTSCR

SEQ ID NO: 5352 - protein, 125 aa, B.fragilis
YRLCKTFTQTVYALADIMTLFELFLNKLLYRFYRSVLSSFSIYSLVFIHHITRYAAHKTGKYLRKQISKQLRVKFKQTSKGNDFFSEWLPGFVLLVCFDKVLGNSYLLNSWRYGVIVGSNHRRRH

SEQ ID NO: 5353 - protein, 70 aa, B.fragilis
SMDCIMQNNIFDYAALLRQVKARVALAQKKAIYAANGEMLSMYWDIGKLLSESQTQIGWATIRWSSCPVI

SEQ ID NO: 5354 - protein, 165 aa, B.fragilis
KRRCRNMALFYKAVKSTMATKSGDKKWHLNLVKVGKVVSTQQLAEMIAEKSSLTPGDVHNVVRNLMTAMRSALLDSKTVRLDGLGTFTMKARTRGRGVDKEEEVNPNQVAALLCHFTPEYTRPAAIGTTRALFQGVEFQKASGIGASGNNGSGGGDGDIVDDPTA

SEQ ID NO: 5355 - protein, 416 aa, B.fragilis
PLIFIMKNSKIYPWIVVALLWGVALLNYMDRQMLSTMKDAMQVDIVELQSATNFGRLMAVFLWIYGLMSPISGMIADRLNRKWLIVGSLFVWSFVTYLMGIAETFNQVFWLRALMGVSEALYIPAGLSLIADYHTEKSRSLAVGIHMTGLYTGQAIGGFGATVAAAFSWHTTFHWFGIVGIAYALVLIIFLRENEEHARGIRAMHTDKSKKIPLFKGVTLLFGNIAFWIILFYFAAPSLPGWATKNWLPTLYAENLDIPMAEAGPISTITIAVSSFIGVILGGLLSDRWVCKDIRGRIYTGAIGLGLTIPALLLLGLGNGFISIVGAGFLFGVGFGMFDANNMPILCQFVSAKYRATAYGIMNMTGVFAGAVVTSLFGKWTDGGNLGLGFAILGGIVLLALGMQLCFLRPHTDNME

SEQ ID NO: 5356 - protein, 227 aa, B.fragilis
FKYRRFNLPVSICKYHKYGLFIPEISVSLYRTITIIIMQDIINGRCGWCGSDELYVKYHDQEWGKLVTDDKTLFEFLVLESAQAGLSWITILKKREGYRKAFCNFDAESVAQMTDEDVERLMHFDGIVKNRLKIKSTITNARSFLAVQKEFGSFYDYTLSFFPDRKPIVNTFQSLSEIPVSSPESDAMSKDMKKRGFKFFGTTICYAHLQASGFMNDHLVDCICRKR

SEQ ID NO: 5357 - protein, 73 aa, B.fragilis
HPCRTGMGRGIVPLNQSLNEKAVVITDFTDENGIDRMKEQIQEKYNRIKADVRQIVADELQRIQNDPALAHLI

SEQ ID NO: 5358 - protein, 209 aa, B.fragilis
NDIRCKANNRISKLDRKVFHYPGVPQLYPFVNNSINKSWYALRITYSRELAFKEYLDSRGVRNFLPMRYEYVFRGERKIRKLVPVVHNLVFVYATRSEVDEMKSTVGASLPIRYIMDRETRQPITIPEVQMRSFIAVAGNYDEQVVYLDPSVVSMKRGDRVRVTGGIFEGVEGEFVRIKGDRRVVVSIQGVMAVATAFIHPSLIELIKN

SEQ ID NO: 5359 - protein, 411 aa, B.fragilis
NRGRNKNLYPLGHILLILSDHIHHSPDILICQCRSRRQTQADIEQPLTRTIPIERSIREHRLKMHRLPQRTCLYVLGVQLQTDILTTLTRKLRINQNTSKPKVGSKPRIRVLHDRNTRHIFQQINIQRVNGTATGNMFIEDKHLPTTDTRTDVAHTVIVTDMGMLVMRSGITSLRSVELCLSGLLFRTTDQSTSTGSRDHLVAIERESGQFTECATLPSVQFRTQSLRGILQYGDTITTRNIHDLVHLGRHTVKVDRNNSLRELTRLAQTVLYSLLEQYRIHIPGILLTVHKNRFGLQIGNRIGRGGKSKALADHFITGLHIQKNQAQVKCSRSSTQSHYTTVFMQIFGQRLLKSIHVRSQRDNPVRIKSLFYKVLLTATHVSKRKPDSFVHNKLFIIISFSYVIGNQEEK

SEQ ID NO: 5360 - protein, 771 aa, B.fragilis
NQLRQLLYIIYNKVCPMLKSDVIWPNSRRFKSRTEWEPLGFFSEALCNSTQFDLKLGFFSSSAINVLADGFATFLYNGGKMRMIINDILSTEDKRAIIVADSCDDVDYFNLQDLGGMSDTLSKRNQHFFECLAWLIRHNRIEIKVVVPKAGEGIAHSKCGVFFDGLNRVAFDGSCNFSKTALIANIESITAFCDWDGQSDVCRIKDVVDDFERTFSGNDESVTYLNTDHIRIHITDTYKNKDIQELLADEAQLINDRLENDLPKTVTAFLGRAKNKVKSIIERIHQNEIQRGKEAAPRFPYSQGPREYQQLAFENWKANKQKGLFAMATGTGKTITSLNCLLEIYKRCGYYKAIILVPTITLVGQWEEECKKFNFKNVIRVCSKNSKWAEQIETITLSERLKGSDNNLSYIIISTYASFIKDKVFKSLSVFPKTKLLLIADEAHNMGSRRMLNILDGIPYLRRIGLSATPERQFEEEANQTLYHFFGAENGFTYEYSMQEAIDKGVLCRYYYYPHVVRLTMSEMEEYMRISVQLAKFFNNNHFADSNEILTALLLKRKRIIHKAENKLEVFRNILEQRFQEKGNLKYTLVYVPEGLKPDTADADVYDDTDQLQDDDYSEKLINEYTAVVSGIDSKVTVRKFTSGIKEREELLKGFADGDIEVLTSMKCLDEGVDVPRSELAIFCASTGNPRQFIQRRGRILRKHPDKHMAVIHDLVVAPEVNIGEGSYAMERSLMATELRRVRNFSLLSENSDDTINELEDIMNYYNLSLF

SEQ ID NO: 5361 - protein, 92 aa, B.fragilis
IKKRFLFCEIFCLLNSSIVLSINSIATGACRKATRFAAKDSSNVEQCTHITAFSVGGRGTNFSFNSVIKANVPSEPANNLQRLKDSEQFLSK

SEQ ID NO: 5362 - protein, 198 aa, B.fragilis
KIFFNKYSMQDYFAHETATVDDGCRIGAGTKIWHYSHIMTGCVLGERCNIGQNVVISPDVVLGNNVKVQNNVSVYTGVTCEDDVFLGPSCVFTNVINPRSAVNRKSEYAKTRVGKGATIGANATIVCGHDIGEFAFIGAGAVVTKTVPPYALLVGNPARQIGWMSEHGYRLEFDERGIAECLESKECYQLRDGKVFKM

SEQ ID NO: 5363 - protein, 74 aa, B.fragilis
IRLRIGIDKSEIKLAKTFPENKTTTLFKNGELSIFLLIRIITLIYPSILNDKLPLKSPFHFPNIILSWHLAYLL

SEQ ID NO: 5364 - protein, 177 aa, B.fragilis
KSSRDKNRFFVDYLTWNTNGRWAAEYKDGVFYHYENGDTTKCHTDSILNYISDAGENWQMKIEGDHFVHAPNGDYSRAHTDTVMHYIGWDGRKWRAELLTLIDGLHPDLASDCPEGMLLKADNADAVYLVQFGSLHHIPNPDVYFALFPAWDKITVKSQEEVNAIPVGIPLSLWMLV

SEQ ID NO: 5365 - protein, 60 aa, B.fragilis
ISASLLLHPITLVGLTALSVETITNFSTPYLTAKSAIIRVPSTFTCMASDTLSSIMGTCL

SEQ ID NO: 5366 - protein, 446 aa, B.fragilis
RWQSIQNVIFNFKRPRVMYNKLVNKEAKLALVGLGYVGLPIALEFAQKISVIGFDINEDRLAKMREGIDPCGELDSSAFENVDIEFTSSIEKLKEASFFIVAVPTPIDKYNKPDLTPLLGASRSVAKALKPGDYIVYESTVYPGCTEEDCLPVLEEVSGLKAGIDFKYGYSPERINPGEKVHTLPNTIKIVSGCDPEALDTVARVYELVVKPGVHRAPNVKVAEAAKIIENTQRDVNIALMNELSIIFSRIGINTYDVLEAAGTKWNFLKFYPGLVGGHCIGVDPYYLVQKASELKYHCQIISAGRYINDSMGGYIAKKLVKRLISLGKGVLGARVLVMGVTFKENVADIRNSKVVDIVNELKDFGCDVDVVDPYADSDEVHREYGFRLVEKPRDNYDAVIVAVAHDEYKNLEEKYFKNMTYDHAVLVDIKGMYRDRIHKLKYWSL

SEQ ID NO: 5367 - protein, 370 aa, B.fragilis
EDMGKKRVCHVTSVHPADDIRILHKECVSLSNAGYEVYLVAPEVSNQLKNGIQIIGVLNKPVSRFHRILFYIRYVYKKALWVNADIYHLHDPELLLYALLLKKKGKIVIFDSHEDIPRQILSKEWIPFFIRKFISFSYTKYEKFILKQLDAIVTVNQDIASRLVQYNKRTYVVSNYPVFRNNVERSSVMERTIGFAGNIKQEYMHENILIALTNLGNVRYLLAGNAEEGYLKQLQTFKGWDFVDFYGRISKEKVLLLYDKVAIGMAIHDYTLNVGGKKGGLGFIKNFEYMEAGIPLICTDFDIWKEIVEEYYCGICVNPHDVNSITGAIQYLIDNPVIARKMGDNGRRAVKEKFNWETQEEILLQLYDSL

SEQ ID NO: 5368 - protein, 180 aa, B.fragilis
CDFMNDGERKETVLSFFYRKILKKSSPPYYCYYSLLTICAKPIRKWFSVVVIPIIPFSNLRVQCYRWCGYKIGRHTFIGMRCYLDDMCYDLIEIGENVTISYGVFFACHGRKQGHNRIIIKDGAYIGMNSSIISRREEGLIIGKEAIVGACSLVNRSVPDNKTVVGVPAKELNAVLHGNK

SEQ ID NO: 5369 - protein, 399 aa, B.fragilis
KEIIILWQNFLCQSIRLAGNKVTDIIMKLQMVDLHGQYLNIKPEVDAGIRQVIETSAFINGPQVKEFAENLKAYMGSKYVITCGNGTDALQIALMALDLKPGDEVIVPAFTYVASAEVIGLLGLIPVMVDVDYATFNVTVSNLEKALSPKTKAIIPVHLFGQSCDMEPIMQFAKQHGIYVIEDNAQAIGAVYTFSDGSKKHTGAIGHIGCTSFFPSKNLGCYGDGGAIFTDDDELAERLRMIANHGQQVKYHHKVIGCNSRLDTLQAAILNVKLKHLDEYSHARHEAAQYYTFQLQGVKGIITPEELPLSTHVYHQYTLKVLDGKRDVLKQHLADAGIPSMIYYPLPLQQQEAFQTIARAAEPLDTAEKLAYSVLSLPIHTELSTEQQDLVINSIKDFF

SEQ ID NO: 5370 - protein, 373 aa, B.fragilis
VITMTEDKNINKTTPQSEEQEIDLIELAQKVWAGRKLVLKVCGVAVLVGLVVAFSIPKEYSTSVTLAPETGSKSSTGGMGALAAMDGINLGSSTGEDALSPELYPDIVSSTPFLLEMFDVKVADQKGKINTTLYEYLDKYQRAPWWGAVASAPFKALGWVVSLFKDAPEEQGDAKIDPFYLTADQAGIADALSHRISVSVDKKTGVTTLTVTMQDPLISAALTDTVMHCLQNYITDYRTNKARHDLAFTEKLFNEAQENYYEAQQKYARFMDGNQNIIMQSFRTEQERLQNEMNLAYGVFTQVSQQLQLAKAKVQEITPVYTVVQPATVPLRPAKPNKIMILIGFVFLAGVGSIGWILFVKDLLNGWKKQPEK

SEQ ID NO: 5371 - protein, 226 aa, B.fragilis
FCAIILRMMNMKPIISPSILSADFAYLAKDIEMINRSEADWVHIDIMDGVFVPNISFGFPVLKYVAKLTSKPLDVHLMIVNPEKFIPEVKALGAHIMNVHYEACPHLHRVVQLIREAGMQPAVTINPATPITLLQDIIRDVYMVLVMSVNPGFGGQKFIEHSVEKVKELRELIERTGSKALIEVDGGVNLETGARLIAAGADALVAGNAIFAAENPEGMIHAMKGL

SEQ ID NO: 5372 - protein, 348 aa, B.fragilis
IFYMNKKRKKIFLSILATFFFICIAGAGTVYYYLFYPQFHPSKTTYIYIDRDDTTDSIFNKIKKQGNPHSFNGFKWMSHFREYSKNIHTGRYAIKPGDSTYQLYSRLSRGYQTPVNLTIGSVRTLDRLVRSVGKQLMIDSAEIAMALYDSIFLEKMGYTEATIPCLFIPETYQVYWDVSAADFLARMKKEHDKFWNKDRLSKAQAIGMTPEEICTLASIVEEETNNNAEKPMVAGLYINRLHAGMPLQADPTIKFALQDFGLRRITNQHLDVQSPYNTYLNAGLPPGPIRIPSPKGLDSVLNYVKHNYIYMCAKEDFSGTHNFASNYADHMVNARKYWKALNERKIFK

SEQ ID NO: 5373 - protein, 296 aa, B.fragilis
IFNIMKNKRKRPSKKQHHNSFKSFWIIALFAILPLIYGVYLCTPEIQAVFFQATKVSRPNVARPNYSHDENLKIPVSQFPLTEQIIHHKGYTVSYNKDKKIPNWVAYELTKQKTQGNIKRNERFIADPVVKGGMANNSDYSRSGFDKGHMAPAADMKWSNEAMKESFYFSNVCPQHPELNRRKWKTLEDKVREWAVADSAILIICGPVTNKKSPVIGKSRVTVPSKFFKVILSLHGSTPKAIGFIFKNERAIAPLRNYAVSIDSIEQLTGLDFFSSLPDSLENEIESRIDTTLWSI

SEQ ID NO: 5374 - protein, 410 aa, B.fragilis
FMNILLINHYAGYPNLGMEYRPYYLSKEWVRMGHQVRVLAANYSHLRIKQPLDSFSVIDGIHYRWISAGRYSGNGAKRVCSMFCFVLKLRLYFRNYLDGFIPDLVIASSTYPLDIYPAHKIAQYYHAKLIYEVHDLWPLSPIEIGGYSKYHPFIALLQKAENDAYKFSDKVISLLPNACSHMVSHGMDANKFVYIPNGYDPEEWTSQCDLSPLHMQFISELKNKGKKVIGYAGGHAKSNALDYLLEAMKIVFDKNQNIVCLLVGNGQEKGRLVERVQKEGIKNIYFLDPVPKKKIPELLNQMDVLYIGWEKNPLYRFGISPNKLIDYMMSQKPILHSVCAANDWVKEADCGITVNAESPQEIAAGIIEIFSFSDVELINKGGRGRKFAEENLSYPFLAKKFIEECINNRV

SEQ ID NO: 5375 - protein, 333 aa, B.fragilis
NYYICNQTKKTLIMPNFFKSFFAGKTENPEEEKQKNAKKNFEIFKYDGLRAQRMGRPDYAIKCFNEALAIEEDFETLNYLSQLYIQTGEFGKAHELLERMIALEPELTSTYLTLANLCFMQEDYQEMADAAQKAIALEEGNAMAHYLLGKANHGLDNGIMTIAHLTKAIVLKDDFTEARLLRAEALYKMQQFAEAMEDIEAILTQNPDEEAALLLRGKIKEATGKEEEAETDYLHVTEINPFNEQAYLYLGQLFITQKKLTAAIELFDEAIELNPNFGAAYHERGRAKLLNGDKDGSIEDMKKSLELNPKEGENLNGQFNNQQAETTPNVLGL

SEQ ID NO: 5376 - protein, 269 aa, B.fragilis
YIYIIVMIFYFSGTGNSKWIAEQIAKAQNEVLVFMPNAIRDGIEEFVLADDEKVGFVFPVYSWGPPLSVLRFLDWITLSNYHSQYVFFVCSCGDDTGLTEELFRRALSRKGMECNAGFSVAMPNNYVLLPGFDVDKKELEKKKLDEAVGRVEEINDSITGKKIGFHCNEGSFPWFKTKVLNPLFNRFMTSAKPFYATDDCIGCKRCERICPVGNVVMIGWRPVWGMDCTSCLACYHVCPKHAVQYGRRTKRKGQYLNPNVSISHEAAAQ

SEQ ID NO: 5377 - protein, 724 aa, B.fragilis
YMIIKSVTINNFRSYYRENTFEFSKGLTLIIGGNGDGKTTFFEALEWLLDTAHETKDPSLISEMRKSELDEDEADTMSVSMFFEHNGEKEVSKSLTFEKRNGVCQVTNFAFKGYETNGAERMQRKGSSLIDVCFDAFIRKYCLFKGESQLNVFNEKEALRTLVDKFSDIRKFEDYVAVATELEAKSDRAYAKECQSDKKISQRVSELQCKKEHLGQQIDEIKCDIRKQEDVVSTYSVKLEDLEKHQVTSESYQDIKKRIDTQREKLAKLRSMTMVRYNTNLLDEFWALMPYQNVFEEFQKKVSALSKEKRRLSDLDIQEKAAAKAKKEVVDELTSSLQSDFTRLPWYLPDGETMQEMLDEEVCKVCGRPAKKGTPEYRFMENKLREYLEHKSQELAAKQEELPDTPLFGTQYIEELHSLSISFGGMTARDISKKYREVVDKLELVARIKRDIAEKEAELLELEDEKSRLLIQADGLTEAMLDKNFRDIKGFYEQRDRAKNRISDYRERLVKVQMEYDKVKEEFEQLNPTTGMAKVYNRVHTLLDKVMRAFVNAKSENLRRFLASLEERTNSYFEKLNKNDFRGVIRIVQTASDSAEIKLFSSNGTPIKNPGGAQETTMYMSLLFAISDLTTLKREEDYPLIFDAPTSSFENFKENVFYNIIDKIQKQCIIVTKDLLEVDKLTGKKTLNEAQIEALTCSVYRIEKQTGYNETDLSTIRTIITPIK

SEQ ID NO: 5378 - protein, 156 aa, B.fragilis
FCPIITKVKRKQMEEIEFHHSLPIQLRFNDVDKFGHVNNTVYFSFYDLGKTEYFASVCPGVDWEKDGIVVVHIEADFLAQIFSSDHIAVQTAVCEIGTKSFHLLQRVIDTETMEVKCICRSVMVTFDLERHESKPLTEEWIEAICRFEGRDLRKKK

SEQ ID NO: 5379 - protein, 71 aa, B.fragilis
RKPINNQIVINFYFWLLVEKASIMGHVLLRLPLLIRYLASTDISRSINDYFSMLCVTFHNFKKLNIYLVCN

SEQ ID NO: 5380 - protein, 174 aa, B.fragilis
RVGMCFGYSLNGLCSFKRGIMKLITEGLLDKVTDQAKENSRLRMNYNFHDSMDAPIHRMLNALEPGTYLPPHRHKNPDKEEVYLVLRGSLLAILFDDEGNVTEKVHLNPAEGHYGIEIPPCVWHTIVVLESGTVIYEIKQGPFAPLIPENLASWAPPATDEEAARVFMQRMLEL

SEQ ID NO: 5381 - protein, 325 aa, B.fragilis
SRLVNFQYLHRYPFIRLLFPLIAGFLVGNGLFFRGVCVSKGVLAGGLAGLFLLLLVVYFSHRYSLRWMFGCILYLFVFFGGAGGINQALQQTLYSFSEQKCVYRAVVLEQPEPKEHSFLCRAFLEERQDSVCTMPVNRKVLLYISKDSLSEGLRSGDELIFFAHVSPPSNNGNPDEFDYARYLRYKGISGIAFVASGNWKITGYRFSRSCRQIALEYRDRILDQYRALKFNPDEFAVLAALTVGYKEELSEDIRETYSVSGASHVLALSGLHIGFLYMMLLFFLKWLPGNAFGVRLFRAVVIITALWGFAFFTGLSPSVVRSVVF

SEQ ID NO: 5382 - protein, 83 aa, B.fragilis
LIIVLTMAHYNNNSNRILQAVLADEKLIEFGEYNPADYQSLDEALVSDNLVVNTVARIINEVNEESSSREIYNMVTTYLKNNI

SEQ ID NO: 5383 - protein, 204 aa, B.fragilis
KMNVNITAVLLKSLFDHIVAFLGLLFLSPILLVTAILIRVKMPGGPVIFKQKRVGRYGRLFTMYKFRSMTVGHSGGSVSVKGESRITPLGAKLRKYKIDELPELWNVLIGDMSLVGPRPDVPGYADNLLGDDRRMLLLKPGITGPASLKYRNEEELLAGQDNPQKYNDEVLFPDKVRINIEYLDNWSFWNDIKIIVYTVFGKDM

SEQ ID NO: 5384 - protein, 308 aa, B.fragilis
EPIVERWQGAHYGTYNDQQDHRLLQLQAEVSLALWDAKAKRAKGKSDEARRLNQELDNVKAQITRHYQYVCDHDSLVTAKSVYNRYLGFGDDYHTLMGLFREQLASYKEKIGKEKAASTYRGLVADYKNLQLFLKEKRRIEDIAIAELDKKFIEDYYNWMLGTCALASSTAFGRGNTLKWLMYTAQERGWIRLHPFIGFDCLSEYKWRSFLTEEDLQSVIHVKLNYKRQRAIRDMFLFMCFTGLAYADLKEITYKNIHTDSEGGTWLIGNRIKTDVAYVVKLLPITIELVERYRGTMKRKVRLTRCFP

SEQ ID NO: 5385 - protein, 82 aa, B.fragilis
NILLIKRDSKDLLNKIHSLLLLIKNNRETSFHLINPKLINKLTIFVDITKIINLYETTSFKRNRTRYQKRSSQKENYYTLYI

SEQ ID NO: 5386 - protein, 190 aa, B.fragilis
IMQLLKKRILQDGKCYEGGILKVDSFINHQMDPVLMKSIGVEFVRLFAGTNVNKIMTIEASGIAPAIMTGYLMDLPVVFAKKKSPRTIQNALSTTVHSFTKDRDYEVVISSDFLTPKDNVLFVDDFLAYGNAALGVIDLIKQSGANLVGMGFIIEKAFQNGRKTLEERGVRVESLAIIEDLSNCRITIKD

SEQ ID NO: 5387 - protein, 67 aa, B.fragilis
DIFSNSLSTQAVFQGEDEAGFASAVRADEAKRMNATGKVIDNFADGLASIGSDDIVGYLAKVTLYVD

SEQ ID NO: 5388 - protein, 123 aa, B.fragilis
YFASFYFFRDKIYFIFFLRTYEGIPKRAIEPEFSSFRNSYKSEEHNKFQELVKKYGFYPELCDTCRKGNLLKIKSKRRFYKSLCGGMTRDLLIKPFFVYKGLSFNSICVTEPGRTVRPADHIS

SEQ ID NO: 5389 - protein, 335 aa, B.fragilis
INKSIMVKIILGVLSLLVMLSCSTAVKENTTQPDIMETNKKNLGNLLALYPKPMTVVGAEVEGKVNWLVVGHTGVIGHDRILVSMSKSHYTNQGVKKSKRLSVNLVSREMLPKADYVGSVSGATVDKSEVFAYHIGENDTPVIDASPLTMECEVVDIYETDGFDNFICAIVNTYAASDVLDSDGKLDYTKLKPVLFEFPTYSYLATGEIIGKCLNPDKPGMCVKEPMTTDGIVRLSKIEVYPQYLDEYMNYATEVGEISLRTEPGVLTMYAVGEKENPCKVTILETYASREAYEQHIASEHFQKYKQGTLHMVKSLVLSDQTPLNPANKLNNFMQ

SEQ ID NO: 5390 - protein, 415 aa, B.fragilis
KKESMNKEIDIKDMAPVKASERHVILDALRGFALLVICFANFPEFSLYTFQKPEITEAMPTAEIDKVIRFPQYLFVDGKFYTIFSLLFGIGFSIIISNAAKKGTDGFRIFYRRMIVLAAIGFLHLMFIWSGDILLLYALLGMLLPLFRHVSDRVLLGTSAVLLLLPILIDWLAGTFGVSRSSPAVRMQQHYCNLYGITEYNFGIWLRDAENYGGVFQFLVQGAWVRLQEFIDGNRYFKVLGLFLLGFYIGRKQIYADLEANRVLLKKTVTYGFLLGLPLSVLYAWSAVNGHPFGTAAHTAIYTASVYPLGFAYVSAICLLYLHGREWRLWRCLAAPGRMALTNYVGQSVWGMVLFYGIGFGLGAGIGLTGTESIAFYVFLVQMAFSALWLSYFRFGPLEWGWRMLTYGKWLKIRK

SEQ ID NO: 5391 - protein, 75 aa, B.fragilis
AVCPLLEVLPHNLSVWFLSGNTFVGYADQHPLVSVIDYDTVTPILHTHSQFSVYALYKGMGVTLLSGLVAWNSVG

SEQ ID NO: 5392 - protein, 78 aa, B.fragilis
ITIPSRPSCIRTANFQSMHFIKGWALLFSPDLLHGTPLGNHIKDFSFFSYQSNEAGEHIRCHIIDMAKSKLINGEQIM

SEQ ID NO: 5393 - protein, 208 aa, B.fragilis
ILKPTRNMEITNAEFVISNTDVKKCPAGTFPEYAFIGRSNVGKSSLINMLTGRKGLAMTSATPGKTMLINHFLINNSWYLVDLPGYGYARRGQKGQEQIRTIIEDYILEREQMTNLFVLIDSRLEPQKIDLEFMEWLGENGIPFAIIFTKADKLKGGRLKINISAYLRELRKQWEELPPYFITSSEERLGRTEVLNYIKSINKELNSK

SEQ ID NO: 5394 - protein, 175 aa, B.fragilis
KNKTMQNIIITFIAFFVLRLLSLSYSIRNEKRLLKSGAVQYGKVNSLLLTLAHIVYYFSALYEAYTSGTTFNYFSVCGVFIMGFAYAMLFYVIYKLHDVWTVKLYIIPDHRIEKSFLFRTVRHPNYYLNIIPELIGIALLCNAWYTLLIGLPIYACLLAIRIRQEERAMKELLEN

SEQ ID NO: 5395 - protein, 495 aa, B.fragilis
NSGTRKLVSQTNALVHNLMGTGKGKTDYLLSLIREGKQMTLGQQLRLTAYLSVPAIMAQISSIAMQYIDASMVGSLGANAAASIGLVSTTTWLFWELCAAAATGFSVQVAHKIGAGDFVGARKILRQSIAATLVFSSLLAAVGISISGMLPGWLGGDEVIRSDSSLYFWIFALFLPALQLNFLAGGMLRCSGNMRVPSMLNVLMCLLDIVFNFFLIFPSRQVEWFGVTFTTPGAGLGVEGAILGTVLAELITAGGMMWYLCRRSPMLRLSGERGSFLPRKETLSKAFRISLPMGFEHMAICGAQIATTVIVAPLGIIAIAANSFAITAESLCYMPGYGISEAATTLVGQSLGANRIRLLRRFANITVWSGMLIMGVMGTLMYMAAPQIIGVMTPVEEIRTLGIEILRIEAFAEPMFAASIVAYGIFVGVGNTFVPSLMNFGSIWGVRLTLAAWLAPTMGLRGVWFAMCIELCFRGVIFLARLWGSNWIYKLRINR

SEQ ID NO: 5396 - protein, 360 aa, B.fragilis
NNTAMKLQAIAILTFLTFANVMAQETTTTKYINSTDMEALKLTQEWDKTFPQSDKVEHTKITFHNRYGITLAADLYKPKNTQGRLAAIAVSGPYGAVKEQVSGRYAQTLAERGFLTIAFDPSYYGESGGTPRYLTSPEISTEDFSAAVDYLTSRADVDPERIGILGICGWGGFALNAAANDPRIKATVTSTMYDMSRVNANGYFDAMSSDDRYKLREQLNAQRTEDYRDDSYVRDGGVLDPVTDDTPQFVKEYHDYYKTERGYHRRSPNSNEGITKTSVLAFINMPLLTYISEIRSAVLMIHGEKAHSRYFSEDAYKRLTGSNKELLIIPGANHVDLYDNLNVIPFDKIDAFFKNALKEK

SEQ ID NO: 5397 - protein, 213 aa, B.fragilis
LNRYTCLYMNQQYPSTLLEKAVGEFSKLPGIGRKTAMRLVLHLLRQDTSVVEAFGSSIITLKHEVKYCKVCHNISDTETCQICANPQRDASMVCVVENIRDVMAVEATQQYRGLYHVLGGVISPMDGVGPGDLQIESLVRRVAEGGINEVILALSTTMEGDTTNFYIYRKLEKMGVKLSVLARGVSIGDELEYTDEITLGRSIVNRTTFTGTV

SEQ ID NO: 5398 - protein, 388 aa, B.fragilis
VMRYDFDTIVPRRGTNSYKWDTPEEKNVLPMWVADMDFRTAPAIVEALQRRVAHGIFGYTKVPETYYDAVVRWFESRHRWQIDPRWIIYTSGVVPALSAIIKALTAPGDKVIVQTPAYNCFYSSIRNDGCELSANNLIYRDGRYMIDFDDLAAKAADPKAKILLLCNPHNPVGRVWTPEELRHIGDICLRNGVFVVADEIHCELTYEGHDYTPFASLSERFQQNSVTCISPSKAFNLAGLQIANIIALDEEVRRRIDRAININEVCDVNPFGVIATIAAYNEGGEWLDALRKYLRGNYEYLCHFFAERLPQYPVLPLEGTYLVWIDCRALGIGSDATTLHLQEQQKLMVNSGTMYGPSGEGFIRLNIACPRTLLADGLERMARVLECC

SEQ ID NO: 5399 - protein, 204 aa, B.fragilis
KQGYQMKRKLLSFAVLITLLLVPTVNRAQSIKDLFNKDNISKVVNAVTGHTETVDMTGTWRYTGSAIEFESENLLKKAGGTVAASAAEQKLDEQLAKVGIKEGQLSFTFNADSTFVSTLGKRKLNGTYSYDAGTQMLHLRYMKLIPMNAKVNYTTQQMDLLFEADKLLKLITFLSSKSSSATLKAISSLADSYDGMMLGYELKR

SEQ ID NO: 5400 - protein, 109 aa, B.fragilis
KQYQKFVTILVLLAGIVPVYAIMNIVFDPNDDGNLLITLGTLTPILGDLLMVYAFKDKYQILISNHRLQNKCYLCARYDDTCHYCMLLCHSLADSPYHRTERRFECSVF

SEQ ID NO: 5401 - protein, 179 aa, B.fragilis
MMKQSFLANERIYLRAVEPEDLDLMYEMENDPSMWDISSFTVPYSRFVLKQYIEGSQSDMFADKQLRLMIMRRKDNCTLGTVDITDFVPLHSRGAVGIAVHSNYRQEGYASDALKLLCEYAFNFLFIKQLYAHIAVDNEPSLRLFNSCGFTQCGVLKEWLLTHEGYKDAVLVQCMNPKR

SEQ ID NO: 5402 - protein, 149 aa, B.fragilis
MEEQIKRIVKSQKVQYISFWIIPLLLVLLGEAGVLPVGIKADNVRAVYVFETVGILMTAVCIPLSLKLFSFVLTKKIDQLTFPVALSRYMLWGAVRLALLEFVVVFNLAGYYFTLSSTGALCALIGLTASFFCLPGEKRLRAELHIDKE

SEQ ID NO: 5403 - protein, 70 aa, B.fragilis
HRVKACSLDVNKKFFKCKRLVICAQEPDNLQKALTMLIEKRYKDEDTGSDGVNSLPKLKLSYSACVYFFL

SEQ ID NO: 5404 - protein, 230 aa, B.fragilis
IKTKNMRPYIISHMMTSVDGRIDCPMVGQLSTDEYYIALEKLGPCSKLSGRITTALECSAVKEESTPMEGTPIGHKSVYVASKSDEYTIIVDTYGKLRWQEGEADGHPLLCIVSEQVSEEYLETLRTLGISWIAAGAERIDLPQAMELLHEHFGVERLAIVGGGHICGGFLEAGLIDEVSIMVAPGIDGRKGQTAVFDGISRMECNPYKLKLESVEQWETGIVWLRYKVK

SEQ ID NO: 5405 - protein, 406 aa, B.fragilis
NITKMKIYIFIILAAATSISLISCDSKQSDTRSASSSEVHRNDDGHDHRESDGDNHSEIENSGKGHEDEIIFTRQQAEAIGLEIYNVVPGSFAQVIRTSGQIQAAQGDEETIVATTNGVVSFPGQNIIEGATVGVGSTIVTISAKNLYEGDPVAKAKIAYETALKEYQRAEGLVKDKIISAKEFEQTRMKYENARTAYEAQAANVTVSGVKVTSPISGYVKNRLVSQGEYVTVGQPVATISKNRRLQLRADVSENYFNELKKIRGANFMVSYNNKVYRLEDLHGRLLSFGKAAAESSFYIPITFEFDNIGDFIPGSYVEVYLLTTPQNNVFSIPVTALTEEQGIYFVYLQIAEEEFVKREVGIGESDGKNVRILSGLKEGERVVVKGAYQVKLASSSSVLPEGHSH

SEQ ID NO: 5406 - protein, 123 aa, B.fragilis
ITKKEIGYGKITINSISNDNRQTLPRFQPEAMRANTRIVNALQAFGRTRSMTSAQVALGWLLQKAPWIVPIPGTTKLSHLEENLRTLDFNISSGEWKELEDAVAAIPVVGDRYNAEQQRQVGR

SEQ ID NO: 5407 - protein, 379 aa, B.fragilis
KIMDRRNFLRTASSFALLAAGATTGVSRVFTEPPISSLSGNLSDKNTPNAGDTMEYRKLGELDVSAIGLGCLPMVGYYGGKYDKKDMIALIRRAYDKGVTFFDTAEVYGPYISEEWVGEALAPFRDKVKIGTKFGFGVEEKQPTAINSRPDHIRWAVEGSLKRLRTDHIDLLYQHRVDPKVPMEEVAGTVKDLMQEGKVLHWGLSEASASSIRRAHAVCPLSAVQSEYAIWWREPETKIFPTLEKLGIGFVPYCPLGRAFLTGIINENSRFYEGDRRWNLPQFTPEALKHNMPLIALVRKWAERKGVTLAQFALLWMLSRKSWIAPIPGTTNPAHLDDLLGAGTVRLSAWEMEEFDKEYAKIDLMGHRADPFTESQIDK

SEQ ID NO: 5408 - protein, 225 aa, B.fragilis
SITLTKGCWSAYPTKVFPDRNHTDRLWGRTSNNGQTAQTADTLPAILRVVLNNGIEMPQLGVGTSTLKETAAECVKHAIGLGYRLVDVAQGYDNEAEVWYGIKESGIGRSEVFIISKVSPDAVRSGKVRESLDRTIEAFGGTYVDLMLIHWPVARKVKERWRIMEKYVDVGKIRAIGVSNFNPHHVDELLAYARIKPVVNQIKIHPYMEHQEVVGNTFAKGIQVQ

SEQ ID NO: 5409 - protein, 342 aa, B.fragilis
KNNSMDKRKLGQLEVSPIGMGCMGFSHGYGQVPPEAYAIEAIRGAYDYGCTHFDTAEAYGKEQFYAGHNEELVGKAIEPFRKKVVLATKFHIGELSKPDETNLYREVRRHLEDSMSRLRTDYIDLYYLHRISEAVRLEDVATVMGRLIQEGLIRGWGLSQVSADQIRAAHKITPLSAVQNIYSMVERDCETEIFPVCLEKGIGVVPFSPIASGFLSGKVTPQDQFGFDDVRKFVPQLSKENIEANQPILDLLHRFAVEKHATNAQISLAWMLHKYPNVVPIPGSKNQERILENLGAWNVTLSDDEFRQLQSALDECKVHGHRGCVETEQTSFGKQWSEETDK

SEQ ID NO: 5410 - protein, 292 aa, B.fragilis
NKESMKVISNAEFGGERPLFESHDLRLENVIIRAGESAIKECSNIEAVDCRFEGNYPFWHVHGFVIDRCFFDVGGRSALWYSDNLKMTNTRIDAPKMFREMHDIEIENVEINDADEVFWRCKNLDIKNLKLHGGTYPFMFSSNIRIDGLESDSKYVFQYVKNVELRNAKITTKDAFWEVENVTIYDSELNGEYLGWHSHNLRLVNCHITGEQPLCYAHDLVLENCTFGPDCDRAFEYSSVQATIKGAIGGVKNPRTGCITAESYGEIILDENIKAPADCKLKLWDEKTCFTD

SEQ ID NO: 5411 - protein, 287 aa, B.fragilis
RYYGMDFKELNNGVKMPIQGFGVFQIPDATECERVVTDALAVGYRLIDTASVYGNERAVGMAIRKSGIPREELFITTKAWISEMGYERTLRALDTSLARLGLDYLDLYLIHMPFGDYYGAWRAMEKLYAKGRVRAIGVCNFEPDRLLDLCHNANVIPAVNQIEVHPYTPQTDAIRTMQELGIQAEAWGPLAEGRNGLFTDDILTGIARKYDKSAAQVVLRWHLQRGVVAIPKSVHRQRMQENFNIGDFMLTPEDMAAIASMNMGYDMILDLHAPEEVQRLYGIECPA

SEQ ID NO: 5412 - protein, 227 aa, B.fragilis
LEIMIKAIGLTKIFRTESVQTIALNEISINISEGEFVAIMGPSGCGKSTLLNILGLLDNPTSGELWFIGKEVSRYSENDRTDMRNGNIGFVFQSFNLIDELTVFENVELPLLYAGVPVRERVDRVNKALERMQISHRTEHYPQQLSGGQQQRVAIARAIVTNPKIILADEPTGNLDSTNGNEVMLLLKELNKDGATVVMVTHSEENAQEAGRIVRMMDGCILTENRR

SEQ ID NO: 5413 - protein, 455 aa, B.fragilis
VDYIYLCDTIYKATKRNMKDTPIKRHLIDETIEEFQITDFSKATIREVKAIAAKAETASGVEFIKMEMGVPGLPPSTVGVKAEIEALQNGIASLYPDINGLPELKSEASKFIKAFIDIDLKPEGCVPVTGSMQGTFASFLTCSQCDEKKDTILFIDPGFPVQKQQLVVMGQKYETFDVYDYRGDKLKEKLESYLKKGNISAVIYSNPNNPSWICLKDEELKIIGELATQYDVIVLEDLAYFAMDFRQDLSTPYHAPYQPSVAHYTDNYILLISGSKAFSYAGQRIGVSCISDKLYHRHYPGFDKRYGGGTFGTVFIHRVLYALSSGTSHSAQFAMAAMLKAANEGKYNFLNEVRIYGERARKLKEIFLRYGFHLVYDKDLEDPVADGFYFTIGYPGMTSGELAKELMYYGVSAISLVTTGSQQQGLRACTSFIKEHQYAQLDERMKLFAENHPIS

SEQ ID NO: 5414 - protein, 498 aa, B.fragilis
LAIIVCKISVTFALVMMILATIVCYFAILLLIARITGRKGGSNAAFFKGENQSPWYVVAFGMIGASISGVTFVSVPGMVKAMDMTYMQTVFGFFFGYLAVAHILLPLYYKLNLTSIYTYLDTRIGKRAYRTGASFFLLSRMLGTAAKLYLVCLILYTYVFRDMGIPFWSIAAGSVALVWIYTHKSGIKTIVWTDTLQTFCLIAALISILVFVTAKLNLDFSGVIQTISSNEHSRIFVFDDWMSRQNFFKQFLSGIFIVIVMTGLDQDMMQKNLSCRSLRDAQKNMYCYGFAFAPLNLLFLGLGILLLVLAQEMQLELPAAGDDILPLFATQGYLGEGVLILFTIGIIAAAFSNSDSALTAMTTSFCIDLLDTGKDTEEEARRKRNRVHIGLSVLLIFFICLVDALNNQSVIDAIYIIASYTYGPLLGMFAFGLFTQRKTNDRWVPFIAIASPLICYAADRFARQETGYQFGYELLMLNGILTFAGIWIVSKKQLKNEF

SEQ ID NO: 5415 - protein, 141 aa, B.fragilis
YPTIGRQPRPIADTSSSPSLRYSIVSPAFGVFLSDKFPDKEEIGGSVNTRETPVVAPAASSAKLDAVLKKFLRSIIFYFFIVHFMIANLPRLNKSACIRFTDIYTRILEIVHELRFPSIQYFSFLFKKIMGLAPNEYRLIN

SEQ ID NO: 5416 - protein, 164 aa, B.fragilis
HCNMFATWLQEIYSIFVPKVKTKQMKRIFFVYPLAIATLFLIVLSAIPHHHHKEMMCTVMELCEQDDIYNDGHTDHEAGQDAHNENTCVSQAGYIFPSSVDKSNLHDGSLMNIHLPVLYLFADILTIHFDIPISENTYDRYVVSYTSVVLGESSGLRAPPYFFS

SEQ ID NO: 5417 - protein, 199 aa, B.fragilis
IRGMNINTDIFKIQSNNVMPSRGKILISEPFLHDVTFGRSVVLLVDHTEEGSMGLIINKPLPLMLNDIIKEFKYIEDIPLHKGGPIGTDTLFYLHTLHEIPGTLPINNGLYLNGDFDAIKKYILQGNPIKGKIRFFLGYSGWECEQLIQEIKENTWIISKEENTYLMNEDIKGMWKEALGKLGSKYETWSRFPQVPSLN

SEQ ID NO: 5418 - protein, 75 aa, B.fragilis
CTGNKNSATVGSFQPRGEDYLFMYHWLDEFAYRTTMSWWLFLGGGLIIAGITLLTVIGQTWRTASQNPVRSLRYE

SEQ ID NO: 5419 - protein, 82 aa, B.fragilis
NPCFGRDEQFLTRNTTFPNSHTDRPFISIDRSGVDEPIADGKRIGNNSFALGGIGYLKDTKALYRHLYSVIQFFEIHTIISL

SEQ ID NO: 5420 - protein, 140 aa, B.fragilis
KTKFMDLKKTTFYLFTLFSLMLISCSNDDENKNDAQVTVTVVSADGKPLPNEIVQMFDEKTYEEFKKDNRTTPTAYALTNSTGVATFIFTYDKWFESNKDRFFTFAVQYGSGTENYEIWSAGRTVRPGSVTQIELKLKPL

SEQ ID NO: 5421 - protein, 61 aa, B.fragilis
TSSSDILFLNFIRSTCVFFISFVIVMVVMIAIFGNKKQKSKKIDVYFLAFLHGDDSCHGIP

SEQ ID NO: 5422 - protein, 127 aa, B.fragilis
VKESVRIFRFAVIGTLNALITAFVIWLMMDELSYDYIPANITAYIVAQIHNFIWSKYWIFPIENKKNNIWKQMLFFCSAFGLAYSAQFLFLVTLVECGDVNEYLAQFLGLFIYGTVNFIVNKKLTFR

SEQ ID NO: 5423 - protein, 1058 aa, B.fragilis
KSSPYQSITSHQPLIVNCMFSKFFINRPIFATVLALIIVVAGLVTLNILPVAQFPEITPPTVQVSAFYPGANAETVAQTVGIPIEQQVNGVDGMLYMSSTASSSGAYSLTITFAVGTDIDMATVQVQNRVSVAQSSLPEPVIVQGVTVQKQSSNIVMFLTMQAQDSVYDGLYLTNYAQLNLVDQLTRVPGVGAVNVMGAGNYSMRVWLDPEAMRIRNLSPAQIYQAIQSQNIEVSAGYIGQPIGKNNNNAYQYTLNVQGRLTSPEEFGNIIIRTEEGGKMLRLKDVARIDLGSSSYNVVSKLKGHPTAAIAIYQQPGSNSLDVSKGVKAKMQELAQNFPAGVSYNVTLDTTDVINASIDEVLVTFLETTLLVVLVIFLFLQNWRAVIIPCITIPVSLIGTLAVMAALGFSINTLTLFGLILAVAIVVDDAIVVVENASRLLETGQYSPKEAVTKAMGEITGPIVGVVLVLLAVFIPTTLISGISGQLYKQFALTIAASTVLSGINSLTLTPALCALFLEHNKPSNFFIYKGFNKVYDKTQNLYDRIVKGLLVRPGLALISYGIITAVAVILFMKWPSTFVPDEDDGYFIAVIQLPPASSLERTQAVGRKVNQILDSYPEVKDYIGISGFSIMGGGEQSNTGTYFVVLKNWDQRKGKEHTAAAVVERFNEMAYGIQEAQIFAMVPPAIPGLGASGGLQLQLEDRNNLGPTEMQRAVETLMATYHTQPALASISSMYQANVPQYFLNIDRDKVQFMGIQLDNVFSTLSYYMGAAYVNDFVQFGRIYQVKIEAGEQAQKVIDDVLKLSVPNAKGDMVPFSSFTKVEERLGMDQISRYNMYSTASITCNVASGSSSGEGIQQMEDLIKEQLGNEFGYEWTSVAYQETQAGNTTTIVFIMALLVAFLVLAAQYESWTSPLSAIMGLPMALLGAMIGCSVMGTPVSIYTQIGIILLIALSAKNGILIVEFARDFRAEGNSIRDAAYEAGHVRLRPILMTSFAFVLGVMPLLFATGAGAQSRIALGAAVVFGMALNTLLATIYIPNFYELMQKFQENILDRKKKK

SEQ ID NO: 5424 - protein, 149 aa, B.fragilis
MLSLNLPVFDTKIATRNGKNVIFDVIRRRYVALTPEEWVRQHFVHFLIVHKGYPSSLMANEVLLNLNGTKKRCDTVLYKRDLSARMIVEYKAPHIEITQAVFDQITRYNMVLKVDYLVVSNGMQHYCCRMDYDTQSYSFLSDIPDYDAL

SEQ ID NO: 5425 - protein, 141 aa, B.fragilis
RLKPMKAFLPLLLSFFFIISCQQHKEATISPIDEEDELQEEADSLPRATAIFWLDKYHMKELKKDDVLTFRTAKAKVIIRNDGTIELLSFVEQQPGNAQRYIRYRLKDFKVKKILMDNGYINPGEQYVQLRYIPALARRVK

SEQ ID NO: 5426 - protein, 353 aa, B.fragilis
MMEPTCMSENKKKIIFIVNPISGTQSKELVLSLLDEKIDKEMYTWEIVYTERAGHAIEIAADAADKNTDIVVAVGGDGTINEIARSLVHTNTALGIIPCGSGNGLARHLQISMDPRKALEILNDGIIDIIDYGKINGTDFFCTCGVGFDAFVSLKFANAGKRGLLTYLEKTLQESLKYQPETYELETEDGTSKYKAFLIACGNASQYGNNAYIAPQATLTDGLLDVTILEPFTVLDVPALAFQLFNKTIDQNSRIKTFRCKKLCIHRSSPGVVHFDGDPMQADEDIKIELIQKGLRVVVPGDKKKDNPNVLQKAQEYVNGIKLINEAIVEDIAHKNKVILKKNKQLIQKLTKK

SEQ ID NO: 5427 - protein, 316 aa, B.fragilis
MIMPKNYTLQNASNLGWLFYKDYYRQEPNVDFISTQGKESDTTADFFRKTNQRITAYQLNSESPLVAAFNNHFGTPLQLKTIYPGLITGSGLPHQTGSKGEFKLGFQFDYTTGLPYIPGSSIKGTLRSMFPFSLKDKGSTKRILPEYRKERMEYIRDLIIEVTNINEISDTEIQALEYAIFTNSTPSGKTIEFSLEEKDVFYDAFVADSKDGVMLSDDYITPHGENPLKDPKPILFLKIRPDVTINFYFKLCTTHLYKEKVCSSKQIEEIKKQNDFSSSDYKMITAHQKRNLFEKILLCIGIGAKTNIGYGQLKKL

SEQ ID NO: 5428 - protein, 93 aa, B.fragilis
GEKFRHNGLDKIVMDFGIAFNIGKMINKQEKKKRGRTNLLVTILISCGIAYQKYTKAIILRGCPKSKVPPKSRIAPFTIVYFGEKPHITVVKN

SEQ ID NO: 5429 - protein, 134 aa, B.fragilis
LIDTIRNMHISHIAIWTTRLEELRNFYITYFNGTSNEKYINPKKGFESYFISFDQGFASLEIMQREDITTPALKDCLGLAHFSFSVGSKEAVLELTEQLRKDGFVIESEPRTTGDGYFESAILDPEGNIVEITI

SEQ ID NO: 5430 - protein, 236 aa, B.fragilis
LRVTLDRVIEDKELGRLVVRDNVRAKRLVFRTKADAIYISIPLGVTMREVKEAIEKLRPRLLDSRQKLVRPLIDLNYRIETEYFKLSLVSGKRERFLAHSELGEMRIICPPTADFTDSNLQDWLRKVIEEALRRNAKIILPPRLYMLSEKHRLPYESVQINSSRGRWGSCSSRKKINLSYFLVLLPKHLIDYVLLHELCHTCEMNHGDRFWDLLNGLTDGKALELREELKRYKTEI

SEQ ID NO: 5431 - protein, 82 aa, B.fragilis
PLKTNRSMRNFFVSAFLLLVGIAVMTVCRMNNKQCLSELALVNVEALATGEGDVPTSCYGSGNVDCPISDSKVSYVMNGRSF

SEQ ID NO: 5432 - protein, 501 aa, B.fragilis
HSRTDKTIRIMIYSYHIFYFPFKWEIMGLENQAFSDQVNLDNIQYNRNSYWERSQKPDPGEEESLYNEKNYYYTFVHNILYDEEHSPLNLIHHFERKEPKLSNHIYYYIKKKGRNNPYKLIVDAMNINLYATGVGFLSFYLKNEDCTQNSPEDILAINQYGRRIMPPFFNDTRLRNEISEYIRIEGLNQTVYFEDFKSYTPYDSWQPSSSIKKLICELVTNLSIDPIIDDRMFVATWYKNNQLSQQFTNNAKAYFDSQDPFSDYWYRFLFIDGSNATCQNEKMKKELLEEHTYYRWQQWSSLYGISKYSLVYLTNNEVPDYLIEYFQTIYARMAELVLVQRASMLRFSGEITKVSQLSNQDVEAVSKRVSSLYKEYIRFVNQIYFREITAQDQGIEMYNKLHSCLQMESYIKDLDGEIEELHQYISLMEDRERNKKASLLNDIATLFLPITVITGFWGMNQISEVMEENGELSTGFIIQSLLLIIGTLCAICIIYKRKRKL

SEQ ID NO: 5433 - protein, 265 aa, B.fragilis
YMGTIDISYFNLLIGLLLLVIPLFYLWKFKTGLLKATLIGTARMIVQLFLIGMYLKYLFLWNNPWINFLWVIIMIFVAGQTALVRTGLKREILLIPISVGFLCSVVLVGMYFIGIVLQLDNVFSAQYFIPIFGILMGNMLSSNVIALNTYYSGLKREQQLYCYLLGNGATRQEAQAPFIREAIIKSFSPLIANIAVMGLVALPGTMIGQILGGSSPNVAIKYQMMIMVITFTASMLSLMITISLASRKSFDEYGRILQVTKESQK

SEQ ID NO: 5434 - protein, 667 aa, B.fragilis
EYMTVKEKIEQLRLQLHQHNYNYYVLNAPEISDKEFDDLMRELQDLEQEHPEYKDENSPTMRVGSDINKNFTQVAHKYPMLSLSNTYSENEVTDFYDRVRKALNEDFEICCEMKYDGTSISLTYENGKLIRAVTRGDGEKGDDVTDNVKTIRSIPLVLHGDNYPEVFEIRGEILMPWEVFEALNREKEAREEPLFANPRNAASGTLKLQNSAIVASRKLDAYLYYLLGDNLPTDGHYENLQEAAKWGFKISPLMRKCQTLQEVFDFINYWDVERKNLNVATDGIVLKVNSLKQQRNLGFTAKSPRWAIAYKFQAERALTRLNMVTYQVGRTGAVTPVANLDPVQLSGTVVKRASLHNADIIEGLDLHIGDMVYVEKGGEIIPKITGVDTSARFMIGEKVKFITHCPECGSKLIRYEGEAAHYCPNETACPPQIKGKIEHFISRKAMNIDGLGPETIDMFYRLGLIRDTADLYQLTTDDIRGLDRMGDKSAENIIKGIMQSKEVPFERVIFALGIRFVGETVAKKIAKSFKDIEELENADLETLINIDEIGEKIARSILNYFANESNRKLVDRLKTAGLQLYRPEEDLSGHTDKLAGQSIVISGVFTHHSRDEYKDLIEKHGGKNVGSISSKTSFILAGDNMGPAKLEKASKLGIKIMNEEEFLKLIS

SEQ ID NO: 5435 - protein, 202 aa, B.fragilis
IYLAKLVKIHNMCGISFIFVSLINERDMILNERDSRHEHVLNVARQMMTAARTAPKGKGIDIIETAIVTGEEIQQLSDTLKAMFEEFGMKFFLRDADNILQAECILLIGTREQAQGLNCGHCGYATCSGRSEGVPCALNSIDVGIAIGSACATAADLRVDTRVMFSAGLAAQRLEWLKGCRQVMAIPVSASSKNPFFDRKPK

SEQ ID NO: 5436 - protein, 604 aa, B.fragilis
NNNAMKYIAITLGPITRTIEMAESTKELWAASYFFSYLAKKIVEPFVKKNRTFQLPLINEEMQKPHCGAGLFPDRYIFKSEPEDLELLKQHSDQVLIEIAGHIASPSLPGTAKDVSQIYHYLKSYIKIYFIERTLESDDPHVVIPACEKYLNIIENQETFPEQEETMISHQKSDFLKFLITNVNGKIYRKDKNSIPRFTGSFLTRDAFGDMNGERLFESILEISASELNINIQQKALEVITANEKNKGEKYSDQIWDAEEIILNDNKAQLRPYHKYIAIIKSDGDSMGETIKSMGAYNIPITQLSKALLSFNIESINEIVAYGGKPIFIGGDDLLCFAPVCCNGNNVFNLVEKLSTCFDQCINQHLQQYINACSEAQRPLPSLSFGISITYHKYPMFEALHTTDYLLEMVAKDNLFKYTLSNKNILNENMKRFILKNKLAFSLQKHSGQIYHTAMSKKGKSYVKFNMLLQKYILKNKDMSKTQESEKFLSSVIQMIRAHAEILQIILQNEDKRTEMLKNYFDNNFNESCHLGYTGLFEDIQTLLCLRYQENIQDYQNRNEIIQQNTILTSDEKEILIVSPAMDAIHTIFTALQFIHFINYNKDE

SEQ ID NO: 5437 - protein, 305 aa, B.fragilis
TIMADLSVNIGKLQMKNPVMTASGTFGYGEEFADFIDITRIGGIIVKGTTLHKREGNPYPRMAETPSGMLNAVGLQNKGVEYFSNHIYPRIKDIQTHMIVNVSGSAIEDYVKTAEIINELDKIPAIELNISCPNVKQGGMAFGVTTKGVSEVVQAVRSAYKKTLIVKLSPNVTDIAEMARAAEANGADSVSLINTLLGMAIDAERKRPILSTVTGGMSGAAVKPIALRMVWQVAKAVNIPVIGLGGIMNWKDAVEFMLAGASAIQIGTANFIDPAITIKVIDGINDYLERHGCKSVPEIIGALEV

SEQ ID NO: 5438 - protein, 431 aa, B.fragilis
YDMAKIQIKSEKLTPFGGIFSIMEKFDSMLSPVIDSTLGQRCSSIFGYQFSEIVRSLMSVYFCGGSCVEDVTSQLMRHLSYHPTLRTCSSDTILRAIKELTQENISYTSDQGKTYDFNTADKLNTLLINALVSTGELKEIEEYDVDFDHQFLETEKYDAKPTYKKFLGYRPGVYVIGDKIVYIENSDGNTNVRFHQADTHKRFFALLESQNIRVNRFRADCGSCSKEIVSEIEKHCKHFYIRANRCSSLYNDIFALRGWKTEEINGIQFELNSILVEKWEGKCYRLVIQRQRRNSGDLDLWEGEYTYRCILTNDYKSSTRDIVEFYNLRGGKERIFDDMNNGFGWSRLPKSFMAENTVFLLLTALIHNFYKTIMSRLDTKAFGLKKTSRIKSFVFRFISVPAKWIMTARQYVLNIYTENRAYAKPFKTEFG

SEQ ID NO: 5439 - protein, 761 aa, B.fragilis
IYNLNMPDYYHSITTLHALQNAWRAVRAKNAAGGIDGFTLSHFEKRLNDNLIELQHELISQTWNPEPYLRIEITKNETEKRKLGLLCIKDKIVQQAIKTAIEPQLEKTFLNLSYGYRPNKGPERAIKRVVHDLKKLKSGYVAKLDIDNYFDTINHERLFTRLANWLKDDETLRLIRLCIQTGIVTPQLQWQEINKGVPQGAILSPLLANFYLHPFDQFAANKVPMYIRYADDFLIATSTEKQIKEAVELVKEELESQFYLQLNTPIIHNFHDGIEFLGITISDTGLSITEKKKKTLQERINSIKFIKSSLSSQSKETLQGIKNYYAKLLPESTLKELDCFLMNRLNALIIRNQNSINNKKELVSNLQKIEFYSENSNKNKSQLIQQLCSTYIVHSTKSKTRLTSTHIDNTKLITQKKKEYQKRENEGAELVISIPGSYIGATYKGITVKLQGKIINKPSPALKHITVVGKGISLSSNAITYCMNHKIPIDFFDGRGKQYGTVLNPVFLDVTLWNKQVELPLEQKIKLATQIIIGKLKNQLNLIKYYHKYHKDILGGKLSEKYVEVVLKIDKLIEKAKNYSQRNEKYTAELMAIESQAAIAYWSYIRVLTADDGIDFIRREHQGATDLLNSLLNYGYAILYARVWKNILAAKLNPSIGVLHAKQDGKPTLVFDVVELFRAQMVDRVVISLIQKKVSLKMHDGLLNESSKRVLIRYILERLNRYEKYRGEEITFSQIILRQAQEIALFISGDNLIFKPYVAKW

SEQ ID NO: 5440 - protein, 72 aa, B.fragilis
SHNFPFKWKIKYVITIYHNSNSFICSTMLSISFVVRRLRTVPINPLIPPPQKILLIGVYRFNIFWIEFIPFP

SEQ ID NO: 5441 - protein, 345 aa, B.fragilis
RHTYIYMAKQELTCDDILKELRAKQYRPIYYLMGEESYYIDLIADYITDNVLTDTEKEFNLTVVYGADVDVATVINAAKRYPMMSEHQVVIVKEAQAIRNIEELSYYLQKPLNSTILVVCHKHGALDRRKKLAAEIEKTGILFESKKIKEAQLPAFISSYMKRKGIDMEPKATAMLADFVGTDLSRLTGELEKLIITLPGGQKRVTPEQIEKNIGISKDYNNFELRSALVEKDVLKANKIIKYFEENPKTNPIQMTLSLLFNFYSNLMLAYYAPDKSEQGVATMLGLKTPWQARDYLTAMRKYTGVKTMQIVGEIRYADAKSKGVGNTSISDGDILRELVFKILH

SEQ ID NO: 5442 - protein, 777 aa, B.fragilis
FNPLYSVLLDLMKKNLLLLFLFLLFLPMLVQAQKVGLVLSGGGAKGLTHIGIIRALEENNIPIDYITGTSMGAIVGSLYAMGYSPDDMETLLKSEDFKRWYSGEVEEKYMYYFKKNLPTPEFFNIRFSFKDSLSLKPQFLPTSVVNPIQMNLVFIDLYARATAACDGDFDKLFVPFRCIASDVYNKKQLILKRGDLGDAVRASMSFPFMFKPIEIDSMLAYDGGIYNNFPTDVMREDFHPDIIIGSVVSTNPGKPKENDLMSQIENMVMQKTDYSLPDSAGILMTFKYNDVSLMDFQRIDELEKIGYDRTMSLMDSIKSRIHRRVNVDNIRLRRLVYKSNYPELRFKNIYIDGANTHQQVYIKKEFHTSDDKEFTYEDLKRGYFRLLSDNMISEIIPHAVFNPEDDTYDLHLKIKMENEFSVRVGGNVSTTSSNQIYLGLAYQNLNYYSKEFTLDGQLGKIYNNAQFMAKVDFATTIPTSYRFIASISTFDYFKKDKLFSKNDKPAFNQKDERFLKLKVALPFLSSKRLELGFGIAQIEDRYFQNNVIDFDKDKYDKSGYLLFGGSVSFNGSTLNSRQFPIQGAREALVAQIFTGNESFRPGVNSENKKPVKEKHSWLQLSYMKEKYHKMGANWILGWYLDAVYASKNFSENYTATMMQASEFAPTAHSKLTYNEAFRANQYVAAGIRPIYRLNQMFHVRGEFYGFLPIFPIERNSINKAYYGKAFSRFEYLGEISVVCQLPFGAISAYVNHYSSPRREWNVGLTLGWQLFNYRFIE

SEQ ID NO: 5443 - protein, 74 aa, B.fragilis
VAMYGNGVTIGTLKNTLKTVNLSIPDGHLMVHLPFSAGSCEVVVGVVLQKAAECHILTMTCQTIVMNMEVLGLF

SEQ ID NO: 5444 - protein, 99 aa, B.fragilis
PKNLKSSRTMTSTDSILQLISEIHIPGFFITVDFLQIGKAIPQGISGFLKEKYDKISHGASGRKFIYQKSGWRMAFTFYPTDRVVDEKYAMKNKMIKKR

SEQ ID NO: 5445 - protein, 61 aa, B.fragilis
LPVHRIIYLQKKFPKSLQIQEKAVSLHPLNKNNGRVAQLNRVADYGSAGYRFESCRDHFKV

SEQ ID NO: 5446 - protein, 283 aa, B.fragilis
KTNHMTTRMYVINTLSNMHVGSGEVNYGVIDNLIQRDSVTNLPNINSSGLKGAIREYFKENENLVRELFGSAPKDEKTLPGKVRFFEANLLSMPVRSDKVPFLMATSDEVLQELITKMKFFNCEEATQYISHLSTLLDNIKTQAQGTDFAYVFDPSLQGAIIEEVSIRATCPSHIPLQLSLKKLLGDRLVILSHKYFSILSDDNHLPVLSRNNLENGQSANLWYEQVLPRYSRLYFMLMDGNAQSEYLKKFRDTLCTPSTIIQIGANASIGYGYCQISELSPF

SEQ ID NO: 5447 - protein, 179 aa, B.fragilis
NHCFLPLFFCCKNPAMSVWMYIAVTDPGYGNEQNDEFMKNMGIEAFVKYNYFHKEQKRTWNKDAFTIQNLKKASIAGHLPSIFILNRYFYKRSSALKHFTNLPIAKSICSLECVAINEKRINVSFGEHAGGTTGFTNTPSSNNILVTINVFSISRTYRGMIGVEVCPISKPSSRKHFKE

SEQ ID NO: 5448 - protein, 265 aa, B.fragilis
GSNKKDMQKQAKEIKKHLFLLGGHDLEMQTIVQILTDRNVIFKDRYLQWDNALLSQYEEEIQQYGNKEPFIIYGVELKEDITPPTNYIRIDHHNEYATYPSALEQVASILDHPLNRYQTLVAANDKAYIPGMLEIGASHEEINLIRQEDRKAQGVIEDDEKLAQEAITNGTEKIGSLYVVFTTANKFSPICDRLYPYEKLLIYTPNELIYYGKGINSIQKILKRYTPISNIFWGGGINGFIGTVRNRLTTNEILNIVEQIKLLEL

SEQ ID NO: 5449 - protein, 248 aa, B.fragilis
KRNKMKTIFRMLSVLLLTTGLLSSCIQIGEGIQPSKKLITRDYKVKEFNKIDAGTVGNIYYTQSTDGKTDLQIYGPDNIVALIQVAVKDNTLFLSIDKSKKVRNFKKMKITITSPTLNGISFKGVGDVHIENGLTTDNLDIESKGVGNVDIQSLTCQKLNVQSMGVGDVKLEGTAQIAALHSKGVGNIEAGNLRANAVEASSQGVGDITCNATESIDAAVRGVGSIKYKGSPTIKSLSKKGVGTIKNI

SEQ ID NO: 5450 - protein, 784 aa, B.fragilis
KQNKKGSNNMIRHYLKIACRNLLKYKTQSIISILGLAIGFTCFALAVLWIRYEMTYDTFHEGFDRIHLVYQKSALSDTGVTTTIPYPVSTSLEKQFPEVEDACGFLFYEQEVTVDDGAIRQLYEINADSCFMHMFGIQVLSGSLDFLESEERIALTEHAAKELFGTENPIGKEIKLYGAPKTVCAIVNGWNRHTNLPFSILTGGIRQWHNAWYHGGFHVFIKLHKEVNAETFQKKLEQTKLEADSKGGIQNLMVMPISKCHYTVLADQNAIQFSYILFFSIVGGLVILCSLINYLSLFVSRLRMRSRELALRKVCGSSDLHLFTLLVTEYLLILLAAGLMGMALIELVLSPFKELSGVKEGDIYWESFLYFALVIGCSLATFLPVTFYFNKRTLQSNIQQKTVNRYGYLGRKISIVFQLSISICFIFCISVIMKQLYYLSTTDIGIERKNIATLSMYPQNNLLPAADKIEQFPYVTQVLKGHFSLLPKTASMAMHFKDWDGKQPGDAEIDMEVLMESEELAQFYGIRLLKGKMLKEGERDAGTIVINETAAKALGWNDPIGKKLIRPNGTGTTVIGLVKDFHTTSPTTPIKPIAFIAKGFSGFDLGKGDVLIKYREGEWPKLKKDIEQLCQKEYPENKIRLSNMEETYDNYLKSEQTLLKLLSCVAVVCILIAVFGVFSLVTLACEQRRKEIAIRKVNGATLGNILSIFIKEYLILLLCASFLAFPVSYMIMKAWLENYVEQISIGVSMYVTIFTGIGIIITACIGWRVWKAARENPAEVVKTE

SEQ ID NO: 5451 - protein, 131 aa, B.fragilis
QLVKGDDFVNTIYKFGCKRFIQSLLNHAAREFFIVKTALSGKTDSTPKLFQLAGSDIRCHDNNSILEVNHSAITVSQPTFVHHLEKQIEHIGMRLFYFVKQYDRIGFTAYFLCQLSAFLVSYVSRRRSNQA

SEQ ID NO: 5452 - protein, 383 aa, B.fragilis
IIIKMNRHYLITLTPMDWFFFGGERTLDDGKSADYISHSNKFPQQSALLGMIRYQLLKQHNLLSQFPYTENKPTEKEIMKALIGEQSFRMTERKAKSLGLGVIKQISPLMLIECKDDTSSRSIYFPLPLDDGYKVSFNETSNEDKVFYNGIECPIPNVYPASEEQDSGNQKRKFFDHKTYNNYLFWCTQGNNQIKKLLSDEIWISKMQIGITKHVEEGEDNDKSFYKQEFLQLKKSFIYAFYITLSGESELSSDIIQLGGQRSVFRMEVESIEENSDIQEKYQTAAQFLTQSDRLLILSPTYVDNLKELSALCNFMWSDSIVFRNIQTTNASNFYGKPIKSSSKYHFLKPGSVLYFKQGKRKEVEKLLMDYTYLRLSGYNIYI

SEQ ID NO: 5453 - protein, 60 aa, B.fragilis
QVPKAISMIHLASMAKFMQKDVIYQMFWQQYKEIREIYLFTRGTASPSPTARIYLHALVG

SEQ ID NO: 5454 - protein, 98 aa, B.fragilis
GLTNGRVAQLNRVADYGSAGYRFESCRGHSKKITINGRVAQLNRVADYGSAGYRFESCRDHKNLHNQIMEVFCFPCIISFIGSYLNSEGFLFLIGSLY

SEQ ID NO: 5455 - protein, 94 aa, B.fragilis
ILKKIFMNYKKKIICLLVLFTIVVVNVLNVVVKSDDAETLTLSGIEAVAATYENSPGNYTGAHNQYCTSPKNATGCVSDPDPTRTCSYSIFCKK

SEQ ID NO: 5456 - protein, 476 aa, B.fragilis
LNRKKNIMNQLTAILKQHTPMIHFQHNESGATLRASEVKPLLDKFILTKLGNGDIREGRLYAKKNNWLIDNEKNYALNYKLSISLQKKSRLEYLITSSTFPLPTERPSNFFTIQNSPYFAQEKCVGINTNSTIILKKSNSDPRKKEAEFKEKNWSQIDKKGLEWQDFTIKIFSLKGDLINKIQTYLPAFFICHNFGTRNNKGFGSFTVEYINNQKNICNVEDTLKENFAFVYKKKIALSCQSTLDFIYIYNQIFSTIKKDYQILKSGYNFRNEYIKSLLFCYFVSKYPNYRWEKRKMKQLIKARGYELKGDHSPISGIRENDNSWNDPNPNGYNYAYIRAILGLAEQYEFQLETPYQKAIVKIKSANNCISRYKSPLLFKIINNSIYLVGNEINTEILNKPFQYNYIEQTKNKNMRTGKSEITERTMHINEIEMNYNNRINYHYTPTSFSLIDFMQYAMSYKKNGKNILNYIPLKQ

SEQ ID NO: 5457 - protein, 295 aa, B.fragilis
SMRKIKVGIIQQANTSDIRINLMNLAKSIEACAANGAHLVVLQELHNSLYFCQTENTDLFELAEPIPGPSTGFYSELAAANRIVLVTSLFEKRAPGLYHNTAVVFDRDGSIAGKYRKMHIPDDPAYYEKFYFTPGDIGFEPIQTSLGKLGVLVCWDQWYPEAARLMALKGAEILIYPTAIGWESTDTDDEKKRQLNAWIISQRAHAVANGLPVISVNRVGHEPDPSGQTNGILFWGNSFVAGPQGEYLAQAGNDRSENMIVEVDLERSENVRRWWPFLRDRRIDEYGNLTKRFID

SEQ ID NO: 5458 - protein, 612 aa, B.fragilis
TFGNNTESELICTFADYFNKNINNILNMFRTHTCGELRISDVNKQVKLSGWVQRSRKMGGMTFVDLRDRYGITQLVFNEEIDAELCERANKLGREFVIQIVGTVNERFSKNSHIPTGDIEIIVSELNILNSAITPPFTIEDNTDGGDDIRMKYRYLDLRRSAVRSNLELRHKMTIEVRSYLDKLGFLEVETPVLIGSTPEGARDFVVPSRMNPGQFYALPQSPQTLKQLLMVSGFDRYFQIAKCFRDEDLRADRQPEFTQIDCEMSFVEQEDVITTFEGMAKHLFKVIRNIELTEPFPRMPWSEAMRLYGSDKPDIRFGMQFVELMDILKGHSFSVFDNATYIGGICAEGAASYTRKQLDALTEFVKKPQIGAKGMVYARIEADGTVKSSVDKFYTQEVLQQLKEAFGAKPGDLILILSGDDAMKTRKQLCELRLEMGNQLGLRDKNTFACLWVVDFPLFEWSEEEGRLMAMHHPFTSPKPEDIHLLDTNPAAVRANAYDMVINGVEVGGGSIRIHDSQLQNKMFELLGFTPERAQEQFGFLMNAFKFGAPPHGGLAYGLDRWVSLFAGLDSIRDCIAFPKNNSGRDVMLDAPAALDPSQLEELNLIVDIKE

SEQ ID NO: 5459 - protein, 415 aa, B.fragilis
YSMKKYPKIGIRPTIDGRQGGVRESLEEKTMNLAKAVAELITSNLKNGDGTPVECVIADGTIGRVAESAACAEKFEREGVGATITVTSCWCYGAETMDMNPYYPKAVWGFNGTERPGAVYLAAVLAGHAQKGLPAFGIYGRDVQDLNDNSIPADVAEKILRFARAAQAVATMRGKSYLSMGSVSMGIAGSIVNPDFFQEYLGMRNESIDLTEIIRRMAEGIYDKEEYAKAMAWTEKYCKKNEGNDFNIPEKTKTRAQKDEDWEFIVKMTIIMRDLMQGNPKLKELGFKEEALGHNAIAAGFQGQRQWTDFYPNGDFSEALLNTSFDWNGIREAFVVATENDACNGVAMLFGHLLTNRAQIFSDVRTYWSPEAVKRVTGKELTGMAANGIIHLINSGATTLDGTGQQTNANGLNHG

SEQ ID NO: 5460 - protein, 136 aa, B.fragilis
LKTNKSEKMNYMIQHYLKTAIRNLLKYKTHSIISAICLSVGMTCFSIIHFFINEIDGASRNMPNFEQRISIRMINSNHEVGGWGWSLNSSEIRTLTEHPIPGIKQICFHSFQREDEVVFINREQGRKALHHLIYGY

SEQ ID NO: 5461 - protein, 164 aa, B.fragilis
KKKKTMNWKLVECEIALIVSLTVIECVNMGQNSPKDITCLTVFFCIMIVLLPLIGVLQQWHLSCFQNRQKEKEYQAKQETDEKMKTWLLAREAIIKDKEKEELTNKVNGLQQKCDSLIENQENELKKFYLSILSIIGTKDDLKSIEENFKKMKDFFEEYKKITK

SEQ ID NO: 5462 - protein, 61 aa, B.fragilis
GAGKKSLTSSHIWILILISFHIIMHPSYMANAFPTTPKEVVLSESCARKVYGKEQPGRAHY

SEQ ID NO: 5463 - protein, 105 aa, B.fragilis
RVNLQPKCSFPVRLSEKISPNHLVRVVSYIVDALDISYLLSAYNGGGTNSYHPRMILKVLFYAYLNNIYSCRKTQKALQKNIHIMWLSGNSTSNFRTINDFRGKV

SEQ ID NO: 5464 - protein, 61 aa, B.fragilis
FKSLYFIYTLQQKMYRVQKERLFLILALMVGIRKIDQSSDPKEWVVKSRKEFKMFFSIPIF

SEQ ID NO: 5465 - protein, 255 aa, B.fragilis
CNEDSQKYRVFPWRARTAYCCCLTHPLSVDTLNILWRTMLNERQKFPIRTGLKLTVSDNNGVVRSSFSPDSLSCLSYSSIFTYYVGYRCEIEILGFVSISFFSVFVNIVWTLIGVVVAFVLCVILTIYIYKLSVHPPKIKEVTTYVQTVAVKKGTLPIYDLKDDLKLDVGKGVLICENMEVSLTPQQRVLLVLFIKAENHTLSMSQIMADVWPGKSISPDCFHKAIERLRDLLRQLPMTIQIEYLGEEIYQMQIL

SEQ ID NO: 5466 - protein, 67 aa, B.fragilis
FILDKQDKMVCYTTSKAENKAIIYSNHLLYNQQSYSYLNIEKHPLCYKKSKSIDFTNLKYKSKSIFL

SEQ ID NO: 5467 - protein, 608 aa, B.fragilis
GTLLKIVKLKESEKDKSTYYKVVNVIRNLPKTLNVETDIYFSHLREENRQQGYITEGTLETADGLNKANESLKGITTLHNNEMAYFIANKEADSYHDPQRMIGIAFITFLSSLILLSGMINFLKFIIQSFYNRNRELALRKSLGASPKSLFALLFTEAFWMLTFSLLFSLVLSECTCLLLTTYIPPKEMIPIDIQTLYGIQVKLYIGLLLICTLVMLYPIRRLQRSGLAGHMKTNSHRHLFRNIMMCVQLCVCIFFLGMSIAIHLFNSVGSVLYLPLSDKETNSTLCFEMNSVTLGKNKDAILSQIKMLPGVENISSALMSGNYNSFLTSDYESADHRTLTVRVRQGDPSYFQFFRIPFRGEIVEPHTSNVVYISEAFQKQLENDSVSGNVKLGKENYRIAGTYKACYGENISEHNQYNISVFFPTEEASVIYIRFRDDISFGKAKSEIERVCRNYVPESLPLDIQRLDIRRSTTQGIRDLMGDASLLLGIISALLVILSIYSAISMDTVSRQKEVAIRKINGATPKIIALMFGKAYIIQFILAYTITYPLLRLLVIDITKDSPISSITGFAWGIYLFILIGLLIFVTTAYKIYRIMHLNPAEIIKNE

SEQ ID NO: 5468 - protein, 297 aa, B.fragilis
MKTLLNIKLHLSKKNIFTILVFILVLSGTTGCIQHKSDQKRLPALSFTVNGESFEMIPVEGGTFIMGGTSEQGNDCENNEKPTHEETLPFFYIGKYEVTQKLWKAVMGTDFDQSYNSGCEDCPAEYISWNDTQKFISKLNTLTNKTFRLPTDIEWEYAARGGKYSEKYKYSGSNDIDEVAWYIENYQKSKYGDKGTTHPVGMKKPNELGLYDMSGNVWEWCDNWYTQEYSQNGKSVHPGWPFNGTSAFFRRVLRGGSWGGTAKGCRVSYIDYDVPNYRDEYGGFRLVLVPDSVQTAN

SEQ ID NO: 5469 - protein, 279 aa, B.fragilis
ITVCTISRIFAGRIRIYFQQYMKKFILDLTVTENLRLHTNYVLLKLTSQTVLPDMLPGQFAEIRIDGSPTTFLRRPISINYVDRQRNEVWFLIQLVGDGTKRLAQVNRGEIINVVLPLGNSFTMPEKPSDKLLLVGGGVGTAPMLYLGEQLAKNGSKPTFLLGARSNKDLLQLEDFAAYGEVYTTTEDGSHGEKGYVTQHSILNKIKFEQIYTCGPKPMMMAVAKYAKGNDINCEVSLENTMACGIGACLCCVENTTEGHLCVCKEGPVFNINKLLWQI

SEQ ID NO: 5470 - protein, 101 aa, B.fragilis
TLCCEMVKAKKIFCVVAYDIQDDRSRIQISKILEKYGTRINYSVFECMFTDRQFQKIQINLERWINRRYDTVVYYPMCINCYTRIIYQPIRKKIIKTVEIV

SEQ ID NO: 5471 - protein, 247 aa, B.fragilis
DCFRQKYGFLFKYLYFCEKLKIMRIDIITVLPEMIEGFFNCSIMKRAQDKGLAEIHIHNLRDYTEDKYRRVDDYPFGGFAGMVMKIEPIERCINALKAERDYDEVIFTTPDGEQFDQKMANSLSLSGNLIILCGHFKGIDYRIREHLITKEISIGDYVLTGGELAAAVMADAIVRIIPGVISDEQSALSDSFQDNLLAAPVYTRPAEYKGWKVPEILLSGHEAKIKEWELQQSLERTRRLRPDLLED

SEQ ID NO: 5472 - protein, 279 aa, B.fragilis
IFISKMAREAKNEPKELTVEQKLKALYQLQTTLSKIDEIKTLRGELPLEVQDLEDEIAGLSTRIDKIKSEVDELKSAIAGKRVEIEAAKASVEKYKSQQDNVRNNREYDFLTKEIEFQSLEMELCEKRIKEFTAEEQEKSEEIEKNTKALEERQKDLDQKKNELDEIIEETKQEEEKLRDKAKDLETKIEPRLLQSFKRIRKNSRNGLGIVYVQRDACGGCFNKIPPQRQLDIRSRKKIIVCEYCGRIMIDPELAGVEIEHKVEEAPVTTKRAIRRKAE

SEQ ID NO: 5473 - protein, 452 aa, B.fragilis
YLSSQKMAVARGRLSASSCNSSSSSIGDIVASLCCWHEIIKKKERSNGKNAFIGLSLYKLGGKYIKKSIKARQGAIFFLYLQANFLLKMKIKEIVSALERFAPLPLQDGFDNAGLQIGLTDAETTGALLCLDVTEAVLDEAIASGCNLIISHHPLIFKGYKSITGKDYVERCILKAIKNDIVIYSAHTNLDNVPGGVNFKIAEKIGLKNVRILDPKESSLIKLVTFVPSAQAEEVRNALFTAGCGCIGNYDSCSYNTEGEGTFRAQEGSHPFCGTVGELHRETEVRIETILPEYKKGEVIRALLSKHPYEEPAYDLYPLHNSWAQVGSGIVGELEEPESELEFLKRIKKIFEVGCLKHNKLTGRLIQKVSLCGGAGAFLIPQAVRSGADVFITGEIKYHDYFGRETDILLAEIGHYESEQYTKEIFYSIIRDLFPNFALQFSKVNTNPIKYL

SEQ ID NO: 5474 - protein, 63 aa, B.fragilis
TYNGEEQCEELCFHIQCKFVKGDMEVICMNIALNYANVSRSKMNQELLRFIGYISFNCVSVLI

SEQ ID NO: 5475 - protein, 396 aa, B.fragilis
VASGIYYYWCSVRSLFMIYSLKTKKMGIMVGLPTSGGTEKDLQLNFGLTVNDQVEMLAPFLPAEWFLQSGIQLTWPHAGTDWAYMLAEVQECFINIAREIAKRELLLIVTPYPEEVRKQIIGTVNMDNVRFLKCDTNDTWARDHGAITLMDTGGASLLDFTFNGWGEKFEARLDNQITRRAVEAGALKGQYKDCLNFVLEGGSIESDGAGTLLTTSECLLSPHRNSPMNRVDIEEYLCRVFHLQRVLWLDHGYLSGDDTDSHIDTLARFCSPDTIAYVKCTDSEDEHYEALCKMEEQLKTFRTTSGAPYRLLALPMADKIEVEGERLPATYANFLIMNDVVLYPTYNQPENDKLAKEVLCEAFPTYEVVGIDCRALIKQHGSLHCVTMQYPTGVIK

SEQ ID NO: 5476 - protein, 815 aa, B.fragilis
KPGGSSKNRIKKSNNMIQHYFKIACRNLLKYKVQNILSIVGLSIGFTAFLLGGYWHYWEYHFDSFHPQSSRTYALTTTGIFKTADGSVGELNQIHQMVEKDLVTFPEIAKVCHVSKVKYEFEKDTKSWIGMKIDSTFFDIFQCKLIEGSYYKVPFNVNHVILTQKMANFYFGDSSCVGKELKINDKLSYTIAGVMENYPQNSDFKFEYLILATPSPNQVKRNTTYVWLHPSADAAHLSKKIAAYRVKEPDTKWSKYSEWRFHLRPLPEIHTRCSPELKGRLQHIRILATAGILAFASALMNLLVLFIGQQQRKARYNATFSTLGASIYSLIGKNLLELTLPLFIAFLLSMAFIEFLFPFYKDYTSLVAESSSYYNGVIQSITRQEVLKASYWIYPLCCLIFLVLSTVPIVGLLKRNSRGTSLALRNGLIIGQIFIGSLFLLTSCMFYSQYRFMSRTDKGLVTDHIWQIDLGFDATYNTDCTPFIEALKQNSAIDDVTALTQPLLVLRGEWYCSFITQFPIEGRNNVDEATEDNCIVVQKNFLSFFGMKMKEGEWIQDQGTRDIVINETGARELNIPSLTGRLILSDDEDSENHAVPTRISGILRDFYYCPMQYPLSKVFFMYQNNADAARGYNGFRYFYIKVHPDNEKQALQYARRIYSQYSKKEISEDMQIIQLSTLMELFNRPEKTMFRIFLLLAVLCILISSFGVFFLVSLSTEQRKKEIAIRKVNGAQFSDILYLFLKEYLWLTLVSNAIALPLGYLFIKRWLETYAYHTDIHGWLFVCVFLFTCIIVILSVMRQVVVAAKINPAESVKSE

SEQ ID NO: 5477 - protein, 396 aa, B.fragilis
LFMGLLQEKLAKYDLPQQIKAKGVYPYFRCIESEQNTEVIMSGRKVLMFGSNSYLGLTNHPKVIEAAVEATRKYGTGCAGSRFLNGTLDLHLQLEKELAEFVGKEDAIIYSTGFQVNLGVVSCVTGREDYVICDELDHASIVEGRRLSFSTILKFKHNDMESLEKELQKCRPDAVKLIVVDGVFSMEGDIANLPEIVRLSKKYDANIMVDEAHGLGVLGNHGRGTCDHFGLTKEVDLIMGTFSKSLAAIGGFIAADESIINYLRHNSRSYIFSASNTPAATAAARAALQIMKNEPERIEHLWDITNYSLKCFRELGFEIGHTSTPIIPLYVRDMEKTFMVTKMLFDEGVFVNPVVPPACSPNDTLIRFSLMATHSKEQIDFAIGKLVKCFKALDLL

SEQ ID NO: 5478 - protein, 189 aa, B.fragilis
FVFMRKSNDIIFYSLLALCLFTNCLFIGYYYYQQNREVLLGQELEHQKKQNYELIVNQIESGIIPHVISDKKEFAGYFVLVFPNGICDVCNKWLFKQISELSSTSDLVVVVPDKLKKNMEIYNTVYKLKLSSIFCSEKYAMPQEEFKDMTYIFYCSKTGTVLYPLALHHKNIDLDLYFKLVKSIDLDFL

SEQ ID NO: 5479 - protein, 261 aa, B.fragilis
WNLMKTKQEIVANWLPRYTKRNLEDFGEYILLTNFNKYVEIFAEKFNVPILGKDANMISASAEGITIINFGMGSPNAAIIMDLLSAISPKACLFLGKCGGIDKKNKIGDLILPIAAIRGEGTSNDYFPPEVPSLPAFMLQRAVSSAIRDYARDYWTGTVYTTNRRIWEHDDTFKEYLKRTRAMAVDMETATLFSCGFANHIPTGALLLVSDQPMIPEGVKTDKSDNIVTKNYVEEHVEIGIASLRMIIDEKKTVKHLKFDW

SEQ ID NO: 5480 - protein, 464 aa, B.fragilis
QLLMKTVRETILEPIINIVQVPKMLQDVFRILIQPALVHIQFFVKNNSYLFKCYRKRCFPLPVYSNNMLVMKYLNLFIFVLLLAGCNRPVKHSDIIQADTMVSIIPQEDTITLSALFSRCEIVKLNDIVLASINKVFKYDSLWIVQGKSDQGGVHLFNNEGRYLKTVLKWGQGPEEAYDIWSIKLLDGSIYLLINSGTEVVEYSLQKQKMVERFRLPSEILSATDFVVDNGGNYIFLKSISREKKKEEYKLYVYNKKEGTIVNRILNMDKKSSEYISFDQSDCLYRVQDEIYYYEVFRNGICRLSANDMTGYIAFKQNEYTFPEKELYNEDHTFQSFIDVCENSPFIWAHRNLFEGERFVSSTYMYKKELFWNIIDKSDYSVHSYKWVYDDLILNEVVPVEDYLYRANVQENIHYYTLSFYDFDRIMQLKKKCKKSVGEKWMVKLDDMLDENSNDIIVCFYEKK

SEQ ID NO: 5481 - protein, 471 aa, B.fragilis
PKLMKLRIGSITFLLFLSSVAFPQATSRYLDKPLPQGWEEDTQIFQQVLPVDDQWWKAFQDPVLDSLISVAVKQNYSVLTAIDRINMAKANLRMERGNFFPTIGLNAGWTRQQSSGNTSDLPQSTQHYYDASLNMSWELDLFGSIRNRVKAQKENFAASKEEYTGTMISLCAQVASAYINLRELQQELAVVQKNCASQEAVLKITEVRYNTGLVSKLDVAQAKSVFFSTKASIPQIESGINQYITTLAILLGTYPQEVRPALTAPGTLPDYMEPIGVGLPADLLLRRPDIRSAERSVNAQAALVGASKSDWLPQVFLKGSVGYAAKDLKDLTHHKSMTYEIAPALSWTLFKGTQLVNATKLAKAQLDEAINQFNQTVLTAVQETDNAMNAYRNSIKQIVALREVRNQGQETLTLSLELYKQGLTPFQNVLDAQRSLLSYENQLVQARGYSLLQLIAMYQALGGGWSGNLNN

SEQ ID NO: 5482 - protein, 135 aa, B.fragilis
NNIMAHRLNTNKQFMVGNGILAFAVIFVVVIFVYMSLRLQREKEANRHFSETYSIQLTKGFVGDSISLFVNDSLIMNKQIKEEPTAIEVERFAEQSALMIVNNQTETVAAFDLSEKGGTYRFEKDIDGIKQLPQK

SEQ ID NO: 5483 - protein, 63 aa, B.fragilis
KLIIWLSVMGCNTIVAGWIMILKVIRFCRIFRIMTLYKINNVNDSFRHLLSSFQEVNIVNARS

SEQ ID NO: 5484 - protein, 152 aa, B.fragilis
CYSILFIISVIKIVICFIHYKNNDTFAEINCEKRMVMSWGKTILGCLIGGYALLGLLGGNYAYEQEVKALHVYADSVFHEAFHVELQKRGMDQVESWRYGCEDSFVSSVDTAFKKVTIQDEYGTYSFRVDAMKIRKNIVSSPGEQGLHTVVV

SEQ ID NO: 5485 - protein, 125 aa, B.fragilis
AMNIEEFREYCLSFKGVHDRMPFKKATSEYDRDLLVFYVMDKWFCFVNIDAFDFCNIKCNAGQIEDLLDKYEGVQPGYHMNKKHWISVYFDKDVPDKMIKDLVKQSYEIVVSSLARREREILQAM

SEQ ID NO: 5486 - protein, 247 aa, B.fragilis
TSIFLLFCFLLPNIAIITTITITNDMKNTHVLLIKFKNKISDDEVQFFRSSIIQKLGDQPDILYHNHVEKNKYRYSYPLIQYKNIEQQATIVCIDQGTKAIEKFFSQCDFNFQLGNRKVNMKFASVTPYKLLIERQSKMINYHIHNWLPLNSDNYKKYQNISILSERINFLEKILIGNILSFTKGVNYFIDFPLQCKLLQLSFAKLISNKNIKLMSFDADFQCNLNLPDYIGIGKHTSIGYGTITRN

SEQ ID NO: 5487 - protein, 383 aa, B.fragilis
RLVIMKKLMYIFLILPLIMSGCKGKKETERGGMPTPEISVAYPLVQNITLTKDYPGYLTTEQTVNLVARVNGALQSASFTPGTRVKQGQLLFVIEPTIYKDNVTQAEAQLKTALAQLEYARNNYSRMKEALKSDAVSRIQVLQAESNVAEATAAVSNAEATLNTAHTNLGYCYIRAPFNGTVSRSLYDVGSYISGAAQPVTLATIYKDDRMYTYFNVADNQWLSMLLSQNGKEKELPKNVIVRLGENGTQNYPATLDYLSPNVDLNTGTLNVRANLDNPKGILKSGLYVSITLPYAEAKQAVLVPEASIGTDQLGKYLYIVNDSNIVRYRHIEPGQLVNDTLRQIKSGLSPKEQYVTTALMKVRDGMKVKPVSVNHESPTSNR

SEQ ID NO: 5488 - protein, 412 aa, B.fragilis
HICIIECYIHANDFHITFYKFALNMKTQFFTLFFTIICLSLQAQQPCIIEGNINGIPDGTVISMMRQQGTGMKRIANDTIDNGKFKFIIHTLNNQTEALRIVSKGEGFPNTWLDVYASPGETVSIIGSDKLLRTWNIVSNIKEQQEENQYTNEGFRNLTDQRQRLQALSSDMWKKIAISDSPKEKIQMTDSIQNILYPQLDSLELLLSKEEINLMKNLPVTSIWLDHLEALSRQSVYLKGFPISEAQVLYQQLTSTQRNSQIGKKIEACLTPTKAKIGDDMPDTELSNIDGNHHRLSDYKGKYLLLDFWSRSCGHCIESLPEMEILSDMWKEKVTFIGINIDDEKSWKEFSQRKNIKWIDLNDPKGAFGLYIRYKANGTPFYVLVTPDGKITDIWYGYNKDSLSERLKQGIK

SEQ ID NO: 5489 - protein, 211 aa, B.fragilis
IYCMKQLIDLENWNRKEHFKFFSAFDDPFFGITTLVDFTNTYHQSKDEKKSFFLYSVHFLLQCVNEVEAFKLRIEGEQVVKYDFIHLSPTIGREDGTFGFGFFEYDADLEVFIQNAEKEIERVKNSTGLSFSENIGRLDLIRYSALPWFAFSEMKHAVSFGRGDSVPRISTGKLIKENGVYLLPISISGHHALMDGRNVAELIEKLETTKK

SEQ ID NO: 5490 - protein, 143 aa, B.fragilis
TVLILIILEYIYILMLWSVLCQRGRSLNPYYTGIHLHKDENGYYIKSVTRLNPYYTGIHLHLNRAAKKLNCFCLNPYYTGIHLHEKEKDEVGEMTSLNPYYTGIHLHCLCSIREEGYRRLNPYYTGIHLHITCLGSYLSCIVS

SEQ ID NO: 5491 - protein, 94 aa, B.fragilis
QVLILIILEYIYIVCVPSVKKAIGVLILIILEYIYILLVWAVICLVSCLNPYYTGIHLHVTINNQDMGLGVLILIILEYIYMNSDILYRTPHVS

SEQ ID NO: 5492 - protein, 139 aa, B.fragilis
KLEMKISKKQIEYAIEALRANNIITNDNQYPKVFKGYISSFGAAVIQSGLIPAIIFFENEDNDANADRHKIIGVLKDIINAMRQQYTVTDATILVSSQIPANYSMAQYIIEHGNTDQLLKEITEAAVAMKLALRMYKSE

SEQ ID NO: 5493 - protein, 749 aa, B.fragilis
NEEINISMILHYLKIVFRQMAKRKVQTAISILGITAGLLCFSVCNYYNRIFSTGNKDLATYENQAEICIKERSYQVNIPIEDFEKKIGKDKFEAVAFYVNSSSTITLDETIYCKVDKTECNADYFKVFPTECIDGSLKQFGISGNEAVVTTEFVKQFCGGVPPLGKTILNQRGKIHTIIAVIKPYPAGMNNYHSSYDVFLPLPENASFGIHKLLLKRPEDAEHISQLLPKLGLFPNHPEWIPQIVLDSQTEHKAGAELWVAILGLLVLLVGMINYFSFSIGAFANRYKEISLRNTLGSTYWGLFILLFLEQAVIILICGIITLAITESLLPWFISTFSNEIQRNLYIDIHRLWVYECQYIGGLLLISLLISFISSWHIAHKTIAQGLRGGTTTGQRHIIRNTLLSVQLLFSFLFIVGTVGIRMQMKEYDLSANPNLSTEVKKEIMVVNIGRYDRIREHQPELINFLRSRRWNAETAYTNRDYSQEYGFTELCFVSDDYFNLMNIKCHHKPGEPFCYVNEQLYQTLQADSTSESFRFQNQVYPVKGLVHIGPDSPSAKQLALLPLSAMNDEIGKIYIRLVPDAPRKEVKAEMSKEMNQYLPQNEPFEFISLYEEQTGLGTISVMWLFVVCSSICLVITVLGVYGAISIDTIRKQKEVAIRKINGARLPDIYWLFAKNYLILFLIASVVGGLISLFVMVIGSQHRVILFDYADPWLWMGPLMLLIGIITATISWQIYYIARTNPAEVIKNE

SEQ ID NO: 5494 - protein, 141 aa, B.fragilis
CCGIKDKYLRSESALMTLLGIVSIVCVIISIFGIFSQVTLSCEQRRKEIAIRKVNGATIGSILQMFIKEYFVLLLVAALIAFPASYGMMRVWIESYVRQTSTPFWIYIVLFAGIGIIIVISIFWRVWNAAKQNPAEVVKTE

SEQ ID NO: 5495 - protein, 331 aa, B.fragilis
PLLIRMKITFGQQTTKVKQLADKISFDISMGVYKSGDSLPSINQLSQAYEVSRDTVFKAFLDLKERGIIDSTPGKGYYVVGRLKNVLLLLDEYSPFKYALYNSFVKRLSIRYKVDLLFHQYNERLFNTIIRESLGRYNKYIVMNFDNEKLSPNLYKINPSKLLLLDFGKFEKEGFSYVCQDFDQGFYNALFQLADRLRKYQKLVFVLVDDSMHPRSSRDFFERFCADQHLGCEVVSDIEGLQVRRGEVYIAIRQIDVVSIIKKSRVEGLQCGVDFGLIGYNDTPAYEVIDQGITALSVDWEKMGDKAAEFVLQGKTIQDYLPTEVRLRASL

SEQ ID NO: 5496 - protein, 228 aa, B.fragilis
KITIMIKTINLQKIFKTEEVETWALNNVSVEVKEGEFVAIMGPSGCGKSTLLNILGLLDNPTGGEYYLNGKEVSKYTESQRTNLRKGVIGFVFQSFNLIDELNVYENIELPLLYMGIPASERKQRVEKAMERMAITHRSKHFPQQLSGGQQQRVAIARAVVANPKLILADEPTGNLDSKNGKEVMGLLSELNKEGTTIVMVTHSQHDAGFADRVINLFDGQVVTEVTI

SEQ ID NO: 5497 - protein, 209 aa, B.fragilis
RYTMLQIDNACIAFGEDILFSEFCMRLNKGETACIAGQSGRGKTSLLNAIMGFVPLRKGKIKVGGILLEPTTIDAIRRHIAWIPQELALPSEWVKEMISLPFALKANRHISFSKEKLFTCFDELGLDKELYQKRVGEISGGQRQRIMIAVAAMLEKPLIIVDEPTSALDAGSTDKVLAFFRNQAEKGTAILAVSHDRTFAYGCNQLITL

SEQ ID NO: 5498 - protein, 170 aa, B.fragilis
TLYFCESTNKSYICKSSKDMEIKDRIKIIMEKENMASGAFAESIGIQQSTLSHILNGRNNPSLDVIMKVHQKYNYVKLEWLLYGQGNISEESIQSASDFQPSLFAENAIIPPNGTVTPENRREMPLESSQNTPKEIVKQEIRYIEKPSRKITEIRIFFDDNTYETFRGEK

SEQ ID NO: 5499 - protein, 62 aa, B.fragilis
FIFVKYPPSMNIPIDVIDSIIFGLFCISFELSYHIQCLYVCLFQYNPEDLDYIGNLHQTTLI

SEQ ID NO: 5500 - protein, 686 aa, B.fragilis
KIYVIMQKGNIGVTTENIFPIIKKFLYSDHEIFLRELVSNAVDATQKLNTLASISEFKGELGDLTVHVSLGKDTITISDRGIGLTAEEIDKYINQIAFSGANDFLEKYKNDANAIIGHFGLGFYSAFMVSKKVEIITKSYKEGAQAVKWTCDGSPEFTLEEVEKADRGTDIVLYIDDDCKEFLEESRISALLKKYCSFLPVPIAFGKKKEWKDGKQVETAEDNVINDTIPLWTKKPSELSDEDYKKFYRELYPMSDEPLFWIHLNVDYPFHLTGILYFPKVKSNIDLNKNKIQLYCNQVYVTDSVEGIVPDFLTLLHGVLDSPDIPLNVSRSYLQSDSNVKKISTYISKKVSDRLQSIFKNDRAQFEEKWNDLKIFINYGMLTQEDFYDKAQKFALFTDTDGKHYTFEEYQTLIKDNQTDKDKNLIYLYANNKDEQFAYIEAAKNKGYNVLLMDGQLDVAMVSMLEQKLEKSRFTRVDSDVVDNLIVKEDKKSDVLEASKQEALSAAFKSQLPKMEKVEFNVMTQALGENGSPVMITQSEYMRRMKEMANIQAGMSFYGEMPDMFNLVLNSDHKLVKEVLADEEKECSAAIAPIQTELEDVTKRRDALKKKQEGKKDEDIPTAEKDELNDLDKKWDELKQQKDSIFAGYAGKNKVVRQLIDLALLQNNMLKGEALNNFVKRSIELI

SEQ ID NO: 5501 - protein, 133 aa, B.fragilis
NHSVKKEWELSRISNITNQKSMKKYILSSLTITFLLLSITACSQGKQISGSSNYITKNIKVGSFDQIKSMSSSDIVYTQKQGAPTVQIYGPDNIVELMETSVSGRTLTIKFKKNTSIRNSGKLEIRVSSPSLT

SEQ ID NO: 5502 - protein, 303 aa, B.fragilis
RLLLILMIQTRLKGMGVALITPFKEDESVDYDALMRLVDYLLQNNADFLCVLGTTAETPTLSEEEKKKIKKMVIDRVNGRIPILLGVGSNNTRAVVETLKNDDFTGVDAILSVVPYYNKPSQEGIYQHYKAIASATELPIVLYNVPGRTGVNMTAETTLRIAKDFQNVIAIKEASGNITQMDDIIKNKPANFDVISGDDGITFPLITLGAVGVISVIGNAFPREFSRMTRLALQGDFANALTIHHKFTELFNLLFVDGNPAGVKSMLNAMGMIENKLRLPLVPTRITTFEAIRKVLNELNIKC

SEQ ID NO: 5503 - protein, 745 aa, B.fragilis
KDAFLQPRGEYVLLAILKDKDNLAATVLEANHVNYQQVFEQLSLQPDISAGMGFTEDDDDEEEMNQSRSSHGSGERQQQAQTASRKPTNDTPVLDNFGTDMTKAAEEGRLDPVVGREREIERLAQILSRRKKNNPILIGEPGVGKSAIVEGLALRIIQKKVSRILFDKRVVALDMTAVVAGTKYRGQFEERIRSILNELQKNPNVILFIDEIHTIVGAGSAAGSMDAANMLKPALARGEIQCIGATTLDEYRKNIEKDGALERRFQKVMVEPTTADETLQILRNIKDKYEDHHNVNYTDAALEACVKLTDRYITDRNFPDKAIDALDEAGSRVHLTNVSVPKEIEDQEKLIEEAKNNKNEAVKSQNFELAASFRDKEKELAVQLDVMKKDWEERLKDNRETVDEEEIANVVSMMSGIPVQRMAQAEGIKLAGMKEDLQSKVIAQDDAIKKLVKAILRSRVGLKDPNKPIGTFMFLGPTGVGKTHLAKELAKYMFGSSDALIRIDMSEFMEKFTVSRLVGAPPGYVGYEEGGQLTEKVRRKPYSIVLLDEIEKAHPDVFNLLLQVMDEGRLTDSYGRMVDFKNTVIIMTSNIGTRQLKEFGRGVGFATQSRLDDKEFSRSVIQKALNKSFAPEFINRVDEIITFDQLSLEAITKIIDIELKGLYNRIESIGYKLVIEDKAKQFVASKGYDVQYGARPLKRAIQTYLEDGLSELIISADLNEGDTITVSLNEEKGELEMKNEAKTAE

SEQ ID NO: 5504 - protein, 238 aa, B.fragilis
SKSSGLYWNRQTYKHWIWYDNSKLIQKRPKMIESITSIGIFIDGGYFTKINQALEEKLSLNIDITFFFKFIKEKIAYEYNLNTEFCQITESHYFRGRYRVNDANNKHLLFSERKFEDSLIENDVIFHYKHLREIQKEGEINVIEKGIDVWFALEAYELSLFRKFDFVILITGDADHEMLIKKLKALKIHTILLTWDLSPESATARLLREEACKHIELSEIAIEDKDLIKKICRSKQKR

SEQ ID NO: 5505 - protein, 256 aa, B.fragilis
KIMSENIRVSEVSDILRQQLEGIETKVQLDEIGTVLQVSDGVVRIYGLRNAEANELLEFDNGIKAIVMNLEEDNVGAVLLGPTDKIKEGFTVKRTKRIASIRVGESMLGRVIDPLGEPLDGKGLIGGELYEMPLERKAPGVIYRQPVNQPLQTGLKAVDAMIPIGRGQRELIIGDRQTGKTSIAIDTIINQRSNYEAGDPVYWIYVTIGQKGSTVASIVNTLRQYGAMDYTIVVAATAGDPAALQYFAPFGGGCHR

SEQ ID NO: 5506 - protein, 265 aa, B.fragilis
KGALSMELRTVNVTRYIMPLREGGSLPALAEADDSFKYVVKFRGAGHGTKALIAELIGGEVARVLGFRVPELVFLNLDEAFGRSEGDEEIQDLLQGSRGLNMGLHFLSGALPFDPVVTEVDEKLASQVVWLDALLTNVDRTVKNTNMLMWHKELWLIDHGASLFFHHSWVNWHKHALSSFTQVKDHALLPLAGKLDEVDAEFRKLLTSEKIREIVDLIPDSWIEWRDKDETPQDIRDIYYRFLKERIEHSEIFVKEAQHARKAYL

SEQ ID NO: 5507 - protein, 146 aa, B.fragilis
SVFTMNMSITKRNFLGYLSILTLVGGGLGALVLHYLEPGHYFGGYPLIPVYFYIFGVFYIYMFDACRRHAPEKMVMLFLVAKVLKMIVSVFLLIIYCVAVPDSAIEFLLTFLAFYLGYLIYESWFFFVFEWNQKLTKKSKKYETVA

SEQ ID NO: 5508 - protein, 461 aa, B.fragilis
KYVTLHYMAQQTDPRILGTEPIGKLLLQYSIPAIIGMTITSLYNIIDSIFIGHGVGPMAISGLAITFPLMNLVVAFCVLISAGGATISSIRLGQKDIKGATDVLGNTLMLCLTNAVLFGGLAYLFLDPILFFFGASTGTLPYARDFMQVILLGTPITYTMIGLNNVMRATGYPKKAMLTSLVTVIANVIIAPVFIFHFGWGIRGAAMATVLSQFIGMIWVVNHFRNKESFVHFMPGFWKMKKRIIGSIFSIGMSPFAMNVTACIIVILINNSLQKYGGDMAIGAYGIINRLLMLYVMVVMGLTMGMQPIVGYNYGAQKIDRVKHTLRLGIIVGVLITSSGFIICELFPHTVSAIFTDSDELIDMASSGLRICTLMFPFVGAQIVISNFFQSIGMAKISIFLSLSRQLVYLLPGLLLLPPLYGVKGVWISMPVSDGLAFVTAVVILMVYIKKVKEKTSGQKL

SEQ ID NO: 5509 - protein, 330 aa, B.fragilis
TEVTMNRFIGYIQVACCCLLLCACCVRDGMDEDCNCYVRFVYDYNLQYIDLIHKQATKMNLYVFDEKGVFVTESEEESGACAPDYLMTLPGAMAGRRYIFVAWSGLYDKSYDKVTLTPGVSTLEDLEVSVNNLKTRIGGGVVDRELHLLWHGKQTEVSPQYNNDITTVSLLKNTKKFRIIMQMLDDSSIHVDDYDFRIISPNGRYNHENGLLGDETDEKVEYTAYHTEDDPETGAIAKLNTLRLMTDTENRLVITHKSSGNVILDIPLNKYLNALRLQQYADIPLQEYLDRADKHGIILFFKGMDGNGNYISVDVQINGWLIRKQEVDGV

SEQ ID NO: 5510 - protein, 768 aa, B.fragilis
KDKTMKQFHYTIQTLIRDRRSCVIKVISLSLGLLVSIILFSRVAFELSYDNCFQDVDNLYIVKTEWIKDGVIKGNAGSYTLIPIASTVAEEFPKEVESAVCSSISFEAIFKIGNRKMNKSFILSDSLYFRTMGIEVISGNPNDLTNPDVLFLSQSVAREAFGEENPIGKTLHMMVWGTPVETLVKGVFADLPYNVSLERHEAVLSFASHSKYGWGRPGWTSGGNYNAFIRLKDGERSADVINTDIDKVIAKHIPSDMNMHLHMIVVPLRTIHLEHSDVKRTILILSLLGFAILFAATMNYVLIFVSSLSQRAKGIGIHKCNGASDKAIFSMFIYETALIIGVSLVLMIIFLFQFQEKIEELAEVSLSSLFTWHNLWAPLSVVTFLFVIGGILPGKIFSLIPVTQVFHPYIKENRGWKRILLFIEFAGVAFIFGLMCVAYLQCHYIINRDMGYQPKGVASCKHDFAEPDNARNNLKSLPYVEGVASIRGSMTWFGNREVTDEGGKVLFTPRCAAFDKDFVPLLGLHIKTGRNFTGERQFLVNQPYVEKMGWKGSGVGEIVPNRGTVVGVLAPFCCGVLPADNEPLEIEYGTNLRNVHVRLKEPFTENLHRLNNEMKKIYPQEDIEFRSLEQDLERYYRPTIIFRDATFLAFITILFITLMGLIGYINDEVRRRSKEIAIRKINGAEARSILFLLSKDIFWVAILSVAIGTYGAYYMSLLWISQFEDTICVYAGWYVVTAICLLVFIFVFIIGRSWHIANENPVNSIKSE

SEQ ID NO: 5511 - protein, 404 aa, B.fragilis
  UNSURE (99): Identity of amino acid sequences at the above locations are unknown.
RTATSRTRKNNINCRMATKLWTLHFMRICLANLLLFISLYLLYPVLPVMMASRLGVPVSQTGVIFIFFTLAMFFIGPFHAYLVDVYKRKYICMLSFGGXGCSNQPGYTLVQNATHLLMLCIVQGLSFGMAATAGITLAIDITNSTFRSAGNVVFSWAARLGMIIGAALGVYLFRTHGFETLLYVAVALGALGILFVSRVYVPFRAPIGMKVCSMDRFLLLRGLIPAFNLILIAFIPGLMLPVLAGAPSDVPVGGETVPFFALVGCGFLLSVLIVKLFFRYDNKMWLQIVVGLVTVIGSMAMLFSPETSWNAPAAVLMGLGLGLVTPEFLMMFVKLSQHCQRGTANTTHLLAWELGVGLGIASACHLHLTANEQAVYRVGLLSAIVSLAFFVLLTYPYFKRKKVR

SEQ ID NO: 5512 - protein, 466 aa, B.fragilis
NARTLPAPWWKTDPTTSGRTEEQVVNHVRMVLYETKNNTVRYSWDLNVSTDGMNEFTGGDVVRGEDVPSATPTVSRFVTVGREVVKQDYELLILINPPGELLEITEQGNPRSYLSRAANMTKESLIQPYGIAADNNFYMTNHQDLIFVPEVELRDNQRMAEENPVRVEVERAVAKVVVSGVPEVVPHGDRIDNLKWGLDVTNMYTYWMRKMTFIANSGGVPNEMEQLNAGYREERYAEDPNFTRFSSWNGGNPVGQFEYLSGTPELSKNFDDYDYTLENTMDAADQRHDVTTRVVISGTYTPNGFGSVATRNGGGISFYYFKGNAIRVEAMRDMVNDRGQIPQELRDAGLEQAIENVLAWNPNAFNSPTVSFSEGGIHFYYQGVCYYTVLIRHFSNNMVPVLMGYGRYGVVRNNVYQLSINKIIGPGQPVINPPGTDPDDEDTSWISADVNIMRWYIRNQNVEELL

SEQ ID NO: 5513 - protein, 464 aa, B.fragilis
GNVANFVADKLLFVFNILLTKMGTIIIVDDNKGVLTAVQLLLKNHFSKVITLSSPVSLSTVLREENPEVVLLDMNFTSGINNGNEGLFWLHEIKRQYRDLPVVLFTAYADIDLAVRGIKEGASDFVVKPWDNQKLLETLLNAASQAKDGKKKNRKKESSPVSAMYWGESSAMQQLRTLIEKVATTNANILITGENGTGKEMLAREIHALSPRSAESMISVDMGAITESLFESELFGHVKGSFTDAHADRTGKFEAADRSSLFLDEIGNLPFHLQAKLLTAIQQRSIVRVGSNQSIPVDIRLICATNRNLQEMVDKGLFREDLLYRINTIHVEIPPLRKRKEDIVPLAERFIARFCKQYDKASISLSPAACEKLTAHAWYGNIRELEHSIEKAVIISDGETIPAEMFQLVQKTENPETETSTLEDMEKAMIRKALDKCGGNLSAVAAQLGITRQTLYNKMKKFGL

SEQ ID NO: 5514 - protein, 409 aa, B.fragilis
KCYFCSLNNIILFYMDSNHLSPLRKGVVGVQFLFVAFGATVLVPLLVGLDPSTALFTAGIGTLLFHLVTKGKVPIFLGSSFAFIAPIIKATELYGLAGTLSGMVGVAMVYFVMSALVKWQGIRLIERLFPPVVIGPVIILIGLSLAGTGVNMAKENWTLALLSLFTAVIVSIRAKGLLKLIPIFCGIIVGYIAALIFYDVDMSGVRNAAWLGFPQFVFPQFSWEPILFMMPVAIAPVIEHIGDVYVVNTVTGKDYVKDPGLHRTLLGDGLACLCAGLLGGPPVTTYSEVTGAMSLTKVTNPQVIRIAAITAILFSVIGKVSALLKSIPSAVLGGIMLLLFGTIACAGIANLVNNCIDLSRTRNIIIVSLTLTIGIGGAVLAWGEFSLSGIGLAALVGVGLNLVLPKEER

SEQ ID NO: 5515 - protein, 310 aa, B.fragilis
TPYANMGRWIILLWWRLQLETRLHCNILLRLAGAAIGEYFRDTGRHALVVYDDLSKQAVSYREVSLILRRPSGREAYPGDIFYLHSRLLERAAKIINQEEVAREMNDLPESLKGKVKGGGSLTALPIIETQAGDVSAYIPTNVISITDGQIFLDTDLFNQGNRPAINVGISVSRVGGNAQIKAMKKVAGTLKIDQAQYRELEAFSKFSGDMDPVTALTIDKGQKNARLLVQPQYSPMPVEKQIAILYCGIHGLLRNVPLDKVEDFEAAFLNTLALDHQADVLDVLKTGVINDEVTKAIEETAAMVAKQYS

SEQ ID NO: 5516 - protein, 292 aa, B.fragilis
KIMASLKEVKTRINSVQSTRKITSAMKMVASAKLHKAQGAIENMLPYQRKLNKILTNFLSADLPVESPFCVERPVKRVAIVAFSSNSSLCGAFNANVLKMFLQTVGEYRELGQDNILIYPVGKKIEEAVKKLGFFPQGSYQKLADKPSYDEAAALAKLLMELFLEKNIDRVELIYHHFKSMGVQELLRERYLPIDLSAVQNDEERGGVVNDYIIEPSAAQLIADLIPQVLSQKIFTAALDSNASEHAARTLAMQIATDNANELIQELTKQYNKTRQQAITNELLDIVGGSMA

SEQ ID NO: 5517 - protein, 285 aa, B.fragilis
RKLYLCIEFSCTKIKIMRQIKGITAIFLCCLLVAGCDLIDYHPYDVDIKGERDINAKNIQKIEAKCLGKSTIRFIAMGDSQRWYDETVDFVNAVNKRDDIDFVVHGGDFSDFGLTDEFLWQRDIMNKLKVPYVGLIGNHDCLGTGEDAFRQIFGDTNFSFIAGGVKFVCLNTNAMEYDYSEPIPDFDYIERQLTERADEFNKTVFCMHARPLCDQFNNNVAKVFQMYVRQFPGLQFCTVAHEHRISASDVFDDGVMYYGSNCMKNRSYLVFTIKPDGYDYEVVEF

SEQ ID NO: 5518 - protein, 326 aa, B.fragilis
SITQTAVMKNYIVNELIAAMKERIPRGINLANYLTDALCMGKEAVYRRLRGEVAFTFDEIAMISCKLGISIDQIIGNHQSNRVTFDLNLLHSPDPLESYYEIIERYLRIFNYVKDDISTKIYTASNVIPFTLYSSYEYLSKFRLCRWIYQNGKIRTPNSLSGMHIPDKAVHAHKLLSEAVKACRKTCFIWDSNVFYSFVKEMKYFAGLNLISETDLIHLKNELELLLHELEQISAKGEFSNGNKVAIYLSNIDFEATYSYIEKKDFQISLLRVYSINSMDSQSPRICGIQKDWIQSLKRHSTLISESGESQRITFLEQQKSFIDTL

SEQ ID NO: 5519 - protein, 328 aa, B.fragilis
TEKQYKLKIMITNELNIGLIEAAKEKMPTGTNLANTLMDILYIGKEAIYRRLRGEVPFTLAEAAVISRKLGISLDKMIGVSFSNNAVFDLNVVHHTNTFETYHDILTKYVNAFDNIREDPTTEMATSSNILPQALYLKHDVLSKFRLFKWMYQNENIKCKHFDELEIPHKIYNIQKDFVNMTQQMKTTDYIWDNTVFEHVVRDIQFFSEIHLVSEEDKELIKDDLLLLTDELEELAGKGKYETGNDVRIYISNIKFDATYSYVATSNSHISMIRIYSINAITTQDDGMFRSLKEWVQSLKKFSTQISESGEMQRIRFFNEQREIINTL

SEQ ID NO: 5520 - protein, 463 aa, B.fragilis
QFFLVPFFLLSNNFLILSEYLIIAFKRFASWGSCTFASKITRTMIRKFFILFFLGFFGFAEAQQPSVGLTLKEAEQRFLKCNLSLLAERYNVDIAQARLLQAGLFDNPVISFEQNVYNRLNGKYFDFGKKGESVVEIEQVIRLAGQRNKQIRLEKINKEIAGYQFEEVMRTLRQELGEAFTEVFYLSKSLSVYDKEINSLEHLLTGIKEQHAKGNISLMEMARLESMLLSLKKDKNECESNYLSRRGELNLLLNLPADFRTEPVIDEGDLRQLNMDRLSYADLQERVHGRPDQKLARSCVTASQADLKLQKALAFPEFAVKGSYDRQGNFINNYFAIGFSMSVPIFNRNQGNIKMARFNLLKADREQEYSRNKAEAELYAAYTALEKACQLYQSTDMGLEQNFEKLIAGANENFIKRNISLLEFIDFYDSYKETCIRLYEIKKNVLLGIENLNAVAGQPIFNY

SEQ ID NO: 5521 - protein, 225 aa, B.fragilis
QTRKRMFMDATKKITALFDCDGVIVDTEGQYTVFWNEMGQKYVNDANFGSKVKGQTLVQIYDKYFAGEPEKQRDITEALNRFEIKMNYDYVPGIVEFIADLRRHGVKIALVTSSNTAKMENVYHAHPEFKSLFDEILTAERFKRSKPDPECFLLGMTIFGSDSKDSYVFEDSFHGLQAGRSSGAIVVGLATTNSREAIADKADYVIDDFRGMTYEKLLTITSRYI

SEQ ID NO: 5522 - protein, 228 aa, B.fragilis
YHFNLKIMTYLATNPLFHGISPETLSRDFDGIVSHLRMFRKGDILARQGDVCNRLMILLKGSVRGEMIDYSGRLIKVEDIIAPRAIAPLFLFGADNRYPVEVTANEATEVFEIPKESVLKLFRRNEKFLENYMNLSANYARTLADKLFFMSFKTIRQKLASYLLRMLKQQGDSPIQLDRSQQELADYFGVSRPSLARELAHMQDDGLIKTDRKLVHILRKEDMMQLIQ

SEQ ID NO: 5523 - protein, 70 aa, B.fragilis
SLHNAKHQQMCSVLHQRITRLVAATKTPKRKHTYIFPLVNIDQIGMERADKKHCKRKKYKYDSRLTDRHA

SEQ ID NO: 5524 - protein, 131 aa, B.fragilis
KKHNMPEKHIYEYAVVRIVPKVEREEFINVGVILFSKQAAFIRMRYEINKKRLEALSPEPDIDSFRKYLEAFSKVCAGCPTGGGIAKLEVPERFRWLTAHRSSCIQTSRPHVGYSDNLEETLERLFEELVL

SEQ ID NO: 5525 - protein, 68 aa, B.fragilis
FRGKYTVFVRENGHFSTEREYADTFFSIRILHKNVRFIREIEKKDKNRSFLLGNMSYFVTFAPPYSIA

SEQ ID NO: 5526 - protein, 92 aa, B.fragilis
TILKLKIMLLSVLLQAAAAGVGLSKLGAALGAGLAVIGAGIGIGKIGGSAMEGIARQPEASGDIRMNMIIAAALVEGVALLALVVCLLVLFL

SEQ ID NO: 5527 - protein, 379 aa, B.fragilis
SYIKMNMEINPSEYKILIVDDVMSNVLLLKVLLTNEKFNIVTASNGNQALDQVKKENPDLILLDVMMPDMSGFEVSQKLKADPEAAHIPIIFLTALNSTADIVKGFQVGGNDFISKPFNKEELIIRVSHQISLVAAKRIIEAKTEELKKTIIGRDKLYSVIAHDLRSPMGSIKMVLNMLILSLPKEKIGEDMYELLTMANQTTEDVFSLLDNLLKWTKSQIGKLKVVYQDIDMVEVVEGVGEIFAMVAGLKNIRLRIESPECQAVHADIDMIKTVIRNLISNAIKFSNEGSEVLIKVEESDGMSVVSVKDSGCGIDEESQKKLLHTDTHFSTFGTNNEEGSGLGLLLCQDFVVKNGGKLWFTSVKDEGSTFYFSIPLKK

SEQ ID NO: 5528 - protein, 532 aa, B.fragilis
ICTKFRDYMKTVKTHITQLLHAMNKGIFEKEHPIALSLLSAISGESIFFLGPPGVAKSLIARRLKLAFDQSTAFEYLMSRFSTPDEIFGPVSISKLKDEDKYERIIEGYLPSATIVFLDEIWKAGPSIQNSLLTVINEKVYRNGQYTIQLPLKGLIAASNELPAQGEGLEALWDRFLIRYFIGNIEQEFAFDQMIASVNDMEAEIPTGLSITEEQYTDWRTQISQIKIHYTVFELIHSIKRQIEKYNIQKEEVPHSTLYISDRRWKKIVSLLRTSAFLNETDTIRFSDCTLLLHCLWNEIEQIPIIEQMVSSALDECISHYLCGERTLEQKLSSIREDMKSEHSLRETKDPALQIVDTFYHQIERYPVAGNLLIFASDYQSLQKDTQKLFYIQRDKYRPVNWILKVYDHVRNRNISQSAIVSLKKGTRSVFINNQEYPLACNAGYDIAYPQEASLPFEFRFQEVIDLYHNRENELKRMTDIELTYCKEHLFMDDKQRNMVKQILNRQKEMLEIYQNEIREIAYTHGLENKEY

SEQ ID NO: 5529 - protein, 996 aa, B.fragilis
SKQKIQQTGKRIHAAPLPNGIQKHHRLSVVCRRRNNRKSMKTFLQLVAQDLYCKIGNDLSRTAIIFPNKRASLFFNEHLANQSDQPLWSPAYLSISELFQHLSVLKLGDPIRLVCELYKIFREETNSDESLDDFYFWGELLISDFDDVDKNLVHADKLFTNLQDLKNVMDDYEFLDQEQEQAIQQFFQNFSIEKRTLLKEKFISLWDKLGDIYRRYHKKLEELGFAYEGMLYRNVIEQLEPDSLKYDCYVFVGFNVLNKVETHFFQQLQNAGKALFYWDYDVFYTQLPSRQKQRHEAGEFINRNLKLFPNELPAELFNELIKPKKVRFISSPTENAQARYLPQWVHENLSNEEKENAVVLCNEALLLPVLHSIPEVVRNVNITMGFPLAQTPVYSFINAILELQTSGYRTDSGRYIYDAVQTVLKHPYTRRLSDKAEPLQRELTKTNRFYPFPSELKKDKFLDILFTPRNGIRELCVYITELLKEVSVLYRQEQESDDIFNQLYRESLFKSFTLVNRLLNLIDNNELQVRIETLKRLLNKILNAANIPFHGEPAIGMQIMGVLETRNLDFRNLLLLSLNEGQLPKSGGESSFIPYNLRKAFGMTTIEHKNAVYAYYFYRLIQRAENITLMYNTSSDGLNRGEWSRFMLQFLIEWPHEISREYLEAGQSPQNSKEIRITKTPEIIDRLYRTYDFSRNPDALILSPSALNTYLDCRLKFYFRYVARLKAPDEVSAEIDSALFGTIFHRSAQLVYLDLTANKRDVHKEDLERLLRDNIRLQNYVDIAFKEIFFHVPIDEKPEYNGIQLINSKVITSYLRQLLRNDLQYAPFRMMGMEQEVVEDIRIEGPVGKLSLRIGGTIDRMDSKEGTLRIVDYKTGGSPKVPTNIEQLFTPAEGRPNYIFQTFLYAAIMARQQALKVAPSLLYIHRAASESYSPVIEIGEARKPKLPVDDFSVYEDEFRERLLKLLEEIYDDKEEFTQTEDTKKCEYCDFKAMCKR

SEQ ID NO: 5530 - protein, 60 aa, B.fragilis
YRQKKGPVSAKPSLSFMELKHYSDLMLFTGFSLAICQDLPIMKTKIKTNKQIAVTTYQPA

SEQ ID NO: 5531 - protein, 122 aa, B.fragilis
KSKNMKVIDLTKESFVEKVAEFQEYPNKWDFKGDKPCLVDFHAPWCVYCKALSPILDQLAVEYDGKIDIYKVDVDQEPELEAAFAIRTIPNLLLCPMGGKPSMKLGTMNKTQLKALIEEVLL

SEQ ID NO: 5532 - protein, 448 aa, B.fragilis
VEKKKMKKIYVLALLSCLLMLSACDSYLDIRPVGSVIPQTAEEYRALLARAYLNVPNDRGLACLRSDEMLVNDNEYDRNSYGDIERWNDVSPFPGTSQFTWSNFYNVLFIANQVIESQKEITEGTPEVVNQLVGEAHLLRAYLHFVLVNLHGQPYTKSGALNSKSIPLKLDTDLEKTLGRNTVEEVYTSILSDIEHARELINKEKWETVFSYRFNVLSVDALQSRVSLYMGAWPKCLESAEAVLAKKSVLVDMNETPLALPNHFESVESITALEQVMGSSVNNAVWVPATFLALYQEGDKRLAAYFAAPDENGNRKSSKGGKREFSCTFRVGELYLNAAEAAANMDKLPHARMRLLELMRKRYTPEAYDKKENAVNVMDKNALISEILNERARELAFEGHRWFDLRRTTRPRMVKVLQGKTYILEQDDPRYTIPIPRDAIAANPGLAN

SEQ ID NO: 5533 - protein, 560 aa, B.fragilis
MCRNYKMEQEQRFIGYIEQSIINNWDANALTDYKGITLQYKDVARKIAKFHIILEMAGIQPGDKIAVCGRNSAHWAVTFLATVTYGAVIVPILHEFKADNIHNIVNHSEAKLLFVGDQVWENLNEDRMPLLEGISSLTDFTPLVSRNDKLTYAHEHRNEIYGQRYPKNFRPEHISYRKDMPEELAVINYTSGTTGYSKGVMLPYRRLWSNIAYCHEMLPVKPGDHIVSMLPMGHVFGMVYDFLYGFSAGAHLYFLTRMPSPKIIAQSFAEIKPRVIACVPLIVEKIIKKDILPKLDNKIGKLLLRVPIVNDKIKAAARQAAMEIFGGNFDEIIIGGAPFNAEVEAFLKQIGFPYTIAYGMTECGPIICSSRWETLKQASCGKATSRMEVKIDSPDPENIAGEIICKGTNLMLGYYKNTEATSQIIDVNGWLHTGDLATMDSEGYVTVRGRSKNMLLTSSGQNIYPEEIESKFNNMPYVSESLVLLQKDKLVALIYPDFDDAFAHGLLQSDIEKIMETNRIELNQQLPAYCQITKIKIHFEEFEKTAKKSIKRFMYQEAKG

SEQ ID NO: 5534 - protein, 83 aa, B.fragilis
GIMKELHLNIVSPEKEVFNGEVKSVTLPGTSGVFSILPQHAPIVSSLQEGTVSYTTTDGEEHTLDIHSGFVELSNGEASVCVS

SEQ ID NO: 5535 - protein, 189 aa, B.fragilis
KRKNTMHKFIDNIVAFSLKNKFFIFFCTTIAVIAGVVSFKHTPIDAFPDVTNTKVTIITQWAGRSAEEVEKFITIPVEIAMNSVQKKTDIRSTTLFGLSVINVLFEDHVDDFVARQQVYNLLNDADLPDGVTPEVQPLYGPTGEIYRYTLRSDKRSVRELKTIQDWVIDRNLRAVSEVTDIVSFDGEVF

SEQ ID NO: 5536 - protein, 76 aa, B.fragilis
SFRKCKSEMKVLNANIEEIHVRVKPIKTSYCLMLQSKALIPDNTPYPLLFILLNILYCVIRPKINISLWLYVSYLL

SEQ ID NO: 5537 - protein, 248 aa, B.fragilis
MIRNKVMEQSFIEYSLGKDASSAVLWVYPVRKPRGKAIIMCPGGGFNQIASDHEGRDFAAWFNNQGITYAVLNYRMPNGDVEVIREDIREAIRLIRRQSAEWGIHQLGVMGASIGGYIAATAATLYTGTDRPDFQVLLYPVISMTDRLTHWPSRERMLGETISEGLKETLSLELHVTADTPPTFIVLAEDDQAVSPLNSIVYYTALLKHGVSAGLHIYPEGGHSFGFRDSFIYKELWTDELQKWLLTF

SEQ ID NO: 5538 - protein, 67 aa, B.fragilis
RESDKIKDLFIFRLPILKIASKDILEQTALSTSFGNSSATVDAIGINVYDPAFPLITPSLIHSVFTM

SEQ ID NO: 5539 - protein, 254 aa, B.fragilis
VLREAIPAALSIPGREGYPVYAIFAIKTAGLDEEGYPLFYDKEGKKVTLKELYRWQDPFGLGFTVNSDVTPAEERSFYSYIGSQDTPYTGGLINTFSYKNWELTANLSFNLGGYVRTTPSYNFINFDRGQNVNSDILDRWTPENTDGRLPALITSEKRADEYYWYDQKSEIYKNLDIWVKKLNYFRLQNLRLGYRLPEKMTKSLGMGSASVAIEGRNLLVFGSSYKNFLDPESMYNPYAPPIPKSITFSLNLNF

SEQ ID NO: 5540 - protein, 349 aa, B.fragilis
HLREESLSFAWYLKREKAMYKQTIRPVLFLMEPEKVHALLVSCLKCYRHLPWCRCWIRHLYTCSDKQLIWNHLTFRNRIGLSAGFDKGAEIFDELADCGFGFIEVGTVTPDSQDGNPRPRIFRLPQCESLISRTGFNNPGLDVIKRRLEQKSGSYVLGVNINKNPSSEGEQAVADFLRLYKELHPHVGYFTLNWGSVDVALMKQVLQGLAAFRVEQNIHVPLLLKLPADITEEGMDDVIDCTRLYRVDGVIATGPTMERSYLKGYSPAQLQKIGSGGISGRGIGERSLKAVSYLRAHAGKSLLIVGAGGIITPADARRMLDAGANLIQIYSSFIYEGPGIVKKMIQEIK

SEQ ID NO: 5541 - protein, 1057 aa, B.fragilis
MSELIVYKASAGSGKTFTLAVEYIKLLIRNPRAYRQILAVTFTNKATAEMKERILSQLYGIQIGDPDSDAYLKRIIAETGHSEDEIRTTAGIALGYMLHDYSRFRVETIDSFFQSVMRNLARELELSPNLNIELNNVEVLSDAVDSMIEKLGPNSPVLVWLLDYIDERIADDKRWNVSDEIKSFGRNIFDEGYIEKGDGLRRRLRDPNVIHNYRKTLKEMETAALEQMKEFAQQFENVLSSQSLKPTDLKNGAKGIGSYFNKLKNGILGDEIVNATVIKCLDDETNWAAKTSKQYTDIILLASSILMPLLQNAEQYRSRNNRIVNSCRLSTQHLSKVRLLTNIDEEVRQLNRENNRFLLSDTNALLHQLVKDGDSSFVFEKIGTNIRNVMIDEFQDTSRMQWDNFKLLLLEGLSQGADSLIVGDVKQSIYRWRNGDWGILNGLNKQLGYFSIRTETLKTNRRSETNIIRFNNSIFSAAVDYLNEMYNKQLGSICEPLINAYADVEQESPRNKQQGYVKVEFLEPDEEHDYTEQTLISLGMEVEHLLQSGVKLNDIAILVRKNKSIPRIADYFDKQLNYKIVSDEAFRLDASLAICMMLDALRYLSDPENRIVKAQLATNYQLQILHSEYDLNSLLLHKAEELFPPAFLERMAELRLMPLYELLEELFSLFELHRIEQQDAYLFAFFDAVTDYLQSHSSDPDSFIRYWNETLSGKTIPSGEVEGIRIFSIHKSKGLEFHTVLLPFCDWKLENETNNQLVWCVPQEAPFNELDIVPVNYSSAMAESVYRTDYLHERLQLWVDNLNLLYVAFTRAGKNLIIWSRKGQRNTMAELLTGALPQAANKLDQEWDEEQVYELGDLCPSENEKKIDSGNKLTRKPEKLPVNMESMHPDIEFRQSNRSADFIKGLSEEESDDRFINHGQLLHTLFSAIETKDDIEPAIHHLIFEGIIGSKEAEERIRSLTVKAFSLPEVQEWYSGEWRLFNECAIIYKDKGVLQTRRPDRVMMKNEQVVVVDFKFGKANKKYNKQVKGYMQLLSRMGYKNITGYLWYVEEEIIEKV

SEQ ID NO: 5542 - protein, 364 aa, B.fragilis
FMNWTKYLPCLLILGMGSGCSSEVKHPGENQDLCLTDSLLKIVSVDTVHLHDVADELTLNGRVTFNQEQVAHVYPMFGGTVTELRAEVGDYVRKGDILAILRSGEVADYERQMKEAEQQVIIARRNVNATRDMFDSGLASDKDVLQARQELINAEAEENRIKEIFSINNFSGRSFYEVKSPVSGFIVEKSVSRNMQLRPDQGEEIFTVSGLEHVWVMADVYESDISKVAEGASVHITTLAYPGKVFSGNIDKVYHMLNTESKTMNVRVKLCNEDYLLKPGMFTTVNVECKSSGKQMPRINAHALIFEGGKNYVVTVTPDNRLKVKEVDVYKRQNQECYVRSGLSEGDRVLNQNVLLVYNSLNAD

SEQ ID NO: 5543 - protein, 208 aa, B.fragilis
VPSCVSTWYETLFSAGYGFDRQTLTTKPVVFPDEDRARQFPLHQKTYKENAYVSFFSTASYSLMNRYTFGGSIRFDGSDLFGVDKKYRYLPLYSVSGLWRLSNEPFMQGTRKWMDNLAFRVSYGIQGNIDKNTSPFLLGKYIVDNILPGGSEHMIDINSAPNKKLRWEKTQSVNVGLDFSVLNQALNLSVDYYYRKGTDLFRSSNDST

SEQ ID NO: 5544 - protein, 857 aa, B.fragilis
TYGWQHPKRVQTSQSFCLNWYRHSMLQDKLSAPRHQEPKCLFLQMRQHLTSNKESLFGSKPTAQRFVLPKCPFWQAILCLQVLSYYLILLIHAQKYKKRKRTPYKTRKKTIFTDDKFELLMERDEFFTKEERELLFSLYKKLLRLTGETLQKGDCRKLKKHLIDSTQNNTMQRDSFGLNPVIKDMQTAVIVAEEIGMKRASILGIMLHTPVRCHSYTIEYIQQEYGEDVAGIIRGLIKINDLYDKSPTIESENFRNLLLSFAEDMRVILIMIADRVNVMRQIKDAENDEARRRVANEAAYLYAPLAHKLGLYKLKSELEDLSLKYTEHDIYYHIKEKLNETKKSRDRYIANFIAPIQQKLEEAGLHFHMKGRTKSIHSIYQKMKKQKCQFENVYDLFAIRIILESQFEKEKQECWQAYSIVTDMYQPNPKRLRDWLSVPKSNGYESLHITVMGPEGKWVEVQIRTERMDDIAERGLAAHWRYKGVKGESGLDEWLTSIREALENTENDLEMMDQFKLDLYEDEVFVFTPKGDLFKLGKGATVLDFAFHIHSKLGCKCIGAKVNGKNVQLRQKLNSGDQVEIMTSNTQTPKQDWLNIVTTSKARTKVRQALKEMVARQHDFAKETLERKFKNRKMEYDEAVMMRLIKRLGFKNVTEFYQKIADEVLDVNDILDKYIEQQKRDSERDEVTYRSAEEYNLQNQIDETTVTKEDVLVIDQNLKGLDFKLAKCCNPIYGDDVFGFVTVSGGIKIHRNDCPNAGQMRERFGYRIVKARWAGKSEGTQYPITLRVVGHDDIGIVTNITSIISKENGISLRSIGIDSNDGLFSGTLTIMVSDTGRLEALIKKLRTVKGVKQVSRN

SEQ ID NO: 5545 - protein, 492 aa, B.fragilis
YSLLMIFTAENILLIGSILLFVSIVVGKTGYRFGVPALLLFLLVGMLFGSDGLGLQFHNAKIAQFIGMVALSVILFSGGMDTKFKEIRPILSPGIVLSTVGVFLTALFTGLFIWYLSGMSWTNIHFPLITSLLLASTMSSTDSASVFAILRSQKMNLKHNLRPMLELESGSNDPMAYMLTIVLIQFIQSDGMGTGNIIGSFIIQFLVGAAAGYILGKLAILILNKINIDNQSLYPILLLSFVFFTFAITDLLRGNGYLAVYIAGMMVGNHKITFRKEIATFMDGLTWLFQIIMFLMLGLLVNPHEMIEVAVVALLIGVFMIVIGRPLSVFLCLLPFRKITLKSRLFVSWVGLRGAVPIIFATYPVVANVEGSNMIFNIVFFITIVSLIVQGTSVSFVARLLHLSTPLEKTGNDFGVELPEEIDTDLSDMTITMEMLNEADTLKDMNLPKGTLVMIVKRGDEFLIPNGTLKLHVGDKLLLISEKNKQETVKNE

SEQ ID NO: 5546 - protein, 103 aa, B.fragilis
LLMLFTQQVVHSLYRIESGKWNLHKYRTPIAHSTIPQTGKFKSFQILTTLRLIRDEAGSFIHIFRQIKFMTLIITYGANQIDRVEVRTLFKHFLCFRIIHIDL

SEQ ID NO: 5547 - protein, 415 aa, B.fragilis
  UNSURE (158): Identity of amino acid sequences at the above locations are unknown.
HSWRSIWAILYMKAGFSSFSSGIRNLQRNQKNMKQLRNIVAGMLVLIGGMLPATTFAQEPVPGDTTGTLQHEIIVGKDTINQEANQVDVKGIVFGPIGDSYEWHITNIGKTSICIPLRLIVYSELSGWHAFLSSRLEENGGKYEGFYIAPAGSKYEGXVVERNATGEEVRPWDISITKVTLSLFINSAILLAIILSVAHWYRKREQGAYAPGGFIGFMEMFIMMVHDDVIKSCVGPNYKKFAPYLLTAFFFIFINNIMGLIPIFPGGANVTGNIAITLVLALFTFVIVNIFGTKHYWKDIFWPDVPWWLKVPIPMMPFIEFFGVFTKPFALMIRLFANMLSGHMAMLVLTCLIFISASMGPAINGSLTVASVLFNIFMNLLEVLVAFIQAYVFTMLSAVFIGLAQEGGKKEEVKE

SEQ ID NO: 5548 - protein, 885 aa, B.fragilis
VLIRFNMRLKTILLTTMATGSFLCEPVAAMCIEPPATPDMGWFLKKKKKSNPQDSIKVKNEYEKLTGSDSVVRRGMFNVYQKKNDYYFEIPSTLLGRDMLVVNKLQRVPAELNEAGVNRGTNYENQMIRFELDKSANKLLIRQSRPLPISPSEDAISQSVKDNYISPLIAGFKVEAYNNDSTSILIKVNDIYDGTETSINNVFTNINLGTSAIKNLSRILSIKSFDNNVVATSELTTRVTEGTTTIYVTVEVSSSILLLPEVPMTGRLDNPRVGYFTNPLTNFSDGQQRVNKKQFITRWRLEPRPEDRAAYLRGELVEPRKPIVFYIENSTPYRWRKYIKQGIEDWQVAFERAGFKNAIIAKDITEDMEVDMDDVNYSVLTYAASTKANAMGPSILDPRSGEILEADIMWWHNVLSMLQEWITVQTGVVRPEARGVALPDSLMGDAMRFVACHEVGHSLGLRHNMMGSWAFPTDSLRSKTFTDRMNSTSSSIMDYARFNYVAQPGDGIKALSPHIGPYDMFAIEYGYRWYGKQTPEEEKELLQDFLAKHTDRLYKYSEAQDPRDAVDPRAQNEDLGDDPIRSSQYGIANLKCIVPQIIQWTTTGEKGQTYEEASRLYYAVINQWNNYLYHVMANIGGIYIENTTVGDGEKTYTFVEKEKQQAALRFLLDEVLCYPKWLFDPEIAQYTYLLKNTPLGVVENAPTQVLKNAQAYVFWDLLSNNRLMRMLENESVNGKKAFTAVELMDGLHKSIFAVTERGGLPDVMTRNLQKGFVDALITAAAESEGVKVNKKLIDNHFLFDFQTPICSCDDHAHRSAHTDRMGARRELNFYGSQINRISDAISVKRGELLRIKDLLQSRLGTSDVATKYHYKDLILRINTALGISK

SEQ ID NO: 5549 - protein, 310 aa, B.fragilis
NTNRADMRQLYYTFRTLLRGRGGNLTKIISLTLGLLVGILLFARVAFELNYDSYYQEPENLFLTLRTVVSQGEKKEPVCSNYGKLPAAIRENFPDEVEDATLIDLFSRSSLYHEGQEKKDAILATSRSHIFSTLGVKVLSGNVSELDNMDALFISRSLAQSLFADADPIGKTVMINIDYPLTVRGVFEDIPENAEFRFDGVYSFVTRANRFRDERGGWRGDISYTCMVRFRHPEDVEKVAARMPDMLKKYIQYNKDWFEEFSFITPSQFHLQKKESRKIISILSILGFAILLIAGMNNVLDFYFIIGSTS

SEQ ID NO: 5550 - protein, 132 aa, B.fragilis
QKLRMEKFSTRKRIRSFGYAWKGIRSFVSKEHNAWIHCTAIIIVTVAGFCFGITRNEWMAIILCFGVVLAAEGFNTAIERLVNLVSPERNPIAGDVKDIAAGSVLICAIVAAIVGIIIFMPYVLAVLLCNMG

SEQ ID NO: 5551 - protein, 511 aa, B.fragilis
YIKRLLMSQIIGHISQVIGPVVDVYFEGTESDLILPSIHDALEIKRHNGKKLIVEVQQHIGENTVRTVAMDSTDGLQRGMKVFPTGGPITMPVGEQIKGRLMNVVGDSIDGMKELNRDGAYSIHRDPPKFEDLTTVQEVLFTGIKVIDLLEPYSKGGKIGLFGGAGVGKTVLIMELINNIAKKHNGFSVFAGVGERTREGNDLLREMIESGVIRYGEAFKESMEKGHWDLSKVDYNEVEKSQATLVFGQMNEPPGARASVALSGLTVAESFRDMGAKSGARDILFFIDNIFRFTQAGSEVSALLGRMPSAVGYQPTLATEMGAMQERITSTKTGSITSVQAVYVPADDLTDPAPATTFTHLDATTVLSRKITELGIYPAVDPLESTSRILDPHIVGQEHYDVAQRVKQILQRNKELQDIISILGMEELSDADRLVVNRARRVQRFLSQPFTVAEQFTGVPGAMVAIEDTIKGFKMILDGEVDYLPEPAFLNVGTIEEAIEKGKKLLEQANK

SEQ ID NO: 5552 - protein, 602 aa, B.fragilis
QMKRHVFILLLSFAGVLTSAFAASRQVQGVVISSEDNMPLIGASVYIKAEDLSKDGNSPTITGVITDIDGKFNISVPEGVTRLFCSYVGHEVQELKLVPGKDQYEITLFPSAQMLDAVVVTGYQTVERRKLTAAVGKLNISDETIGAVKSIDQALAGQIAGLSVTSTSGAPGAPAKIRIRGTSSLNGTQDPLWVLDGIPLEGTDVPQSNVLNDVSNIQQSSIAGLNPADIENITVLKDAAATAIYGARAANGVIVITTKKGKVGKPVINFSSKFTYMPTLSTNRLNMLNSQEKVDLELELLRSNFAYGDNKGGVSKIISGYGLTDAYKKGGWSALTPEAQTDISRLRNTETDWGDILFRDAFNQEYSLSLSGGNERVTYYTSIGYYQENGNVKGVGLDRLNIVAKTSYKVNRMLKFGVSLFVNRRNNKTYLTDTYGLVNPVYYSRKANPYYQPFDVNGNYVYDFDVQNNSDTDLGFNIFEERKNTSNEETINALSSIFDAELRFNDKLKFTTQLGLQLDKASKEQIADKESFSMRIIRKNSKYWDSASQSNKYFIPDGGVHKAYENTNSQITWKAMGEYRDSFNDIHELEVMVGTELRKHLV

SEQ ID NO: 5553 - protein, 530 aa, B.fragilis
FFSGFCRVSSSFFCIFGHELIKLDSMITPEDKELLAKKGISEVQIAEQLACFQKGFPYLKLDAAASVEKGILAPDAEEQKAYLAAWNAYTNSDKTIVKFVPASGAASRMFKNLFEFLDADYTEPTTKFEQTFFESIEKFAFYDDLNTACVRTEGKGIPTLIAEGNYKAVVSGLLNVAGLNYGALPKGLLKFHKYEEGSRTPLEEHLAEGAMYAAGKSGKVNVHFTVSTEHRELFKSLVTEKVDAFAKRYGVDYNITFSEQKPSTDTIAADMENQPFRDNGKLLFRPGGHGALIENLNDLDADVIFIKNIDNVVPDKLKGDTVLYKKLIAGVLVSLQKQAFQYLELLDSGRYTHEQVMDILQFVQKKLFCKNPETKDLEDAELVIYLKNKLNRPMRVCGMVKNVGEPGGGPFLAYNSDGTISLQILESSQIDMNNPEAKEMFEKGTHFNPVDLVCAVRDYKGHKFDLAKYVDKATGFISYKSKSGKDLKALELPGLWNGAMSDWSTVFVEVPLSTFNPVKTVNDLLREQHQ

SEQ ID NO: 5554 - protein, 864 aa, B.fragilis
LIIILLSSFFCFNFVAKYYCMEENHEIELAWQVIENTGTHLFLTGKAGTGKTTFLRRLKELTPKRMVVVAPTGIAAINAGGVTIHSFFQLNFAPYIPESTFNSAQQGFHKFGKEKINIIRSMDLLVIDEISMVRADQLDAIDAVLRRYRDRSKPFGGVQLLMIGDLQQLAPVVKEEDWSLLSSYYDTAFFFGSHSLKETEYITIELKKVYRQSDTEFVGLLNKIREKEADDAVLEELNKRYLPGFRPREEEGYIRLTTHNYQAQQYNDRQLLSLSGRAFSFQAKVEGTFPESAYPADEMLTVKEGAQIMFIKNDSSGEHRYYNGMIGLVTAVSKDGIRVKGNGESQDFLLETEEWTNSKYSLNPQTKEITEEVEGTFRQYPIRLAWAITIHKSQGLTFERAIIDANASFAHGQVYVALSRCKSLQGLVLSSPLRRESIISDDTIDEFTRNAGEMTPDKHKLALLRQHYFYELLCEQFDFHPIEQHFLRLLRLLDEHLYRLYPKLLERYKTTADLYKTQIMKVADTFKLQYSALLMEAEDYTANPKLNERVMAGAHYFRQHLEDLLTPLITSTKVETDNKELKKKFSEAADAMKTALHVKLGTLCYTEKEGFSVSAFLKQKAVLTLSVSGGEAASSSGRSERKSRTAEKIEVPTDILHPELYKQLIAWRNSEAAKAGLPVYTIIQQKAILGIVNLLPNDAASLIRIPYFGKRGAEKYGDALLEMVNRYVEEHGIERPQMPTATLTVNNGIKTSKEPKPLKEAKSVKEPKPDTKEVTYRLFRQGKSIEEIARERELVSGTIAGHLEHYVRSGEVKIEQLVAREKITKIIRYVQAHGSDKGLTVIKAALGDDVSYADIRLVLAAGIK

SEQ ID NO: 5555 - protein, 528 aa, B.fragilis
INPMKNYLGLIFLLFAFTATAQNNRSALLPMPNHIEQVQGKPFSLTGKNITIHPGQPELKFAATTLQSILKDRMQVDIPLSGSRQSPIRLIIDPQLEGKEHYQLKVDQKGMTISGASAAAVFYGVMTVDQVLLGDVCSSNRKEMTPISIDDAPRFGYRALMLDPARHFLPIEDVKFYIDQMVRYKYNVLQLHLTDDQGWRIEIRKHPKLTAGQSFYTQEELADLIRYAAERHVEIVPELDIPGHTVAVLAAYPELGCTHTDTIAKNVGETVNLMLCANNEKVYEVYNDIIDEVSALFPSRYIHLGGDEAVIEKNWTKCERCQKMMKELKYEKASQLMIPFFSRMLSFVEADGKYPILWCELDNIRMPANDYLFPYPKNVTLVSWRYGLTPTCQKLTQQHGNPLIMAPGEFAYLDYPQFKGDLPEFNNWGMPVTTLETCYQFDPGYGKPAAEQAHILGVMGTLWGEAIKDINRVTYMTYPRGLALAEAGWTQMEHRNWDSFKERLYPNLNNLMKKGVSIRVPFEIVKRK

SEQ ID NO: 5556 - protein, 315 aa, B.fragilis
NNYMKRILVSGGAGFIGSHLCTRLINEGHDVICLDNFFTGSKENIIHLMDNHHFEVVRHDITFPYSAEVDEIYNLACPASPIHYQYDAIQTIKTSVMGAINMLGLARRLNAKILQASTSEVYGDPEVHPQPESYWGNVNPIGIRSCYDEGKRCSETLFMDYHRQNNVRIKIVRIFNTYGPRMLPNDGRVVSNFLIQALKNDDITIYGTGEQTRSFQYIDDLVEGMIRMMNTGDDFIGPINLGNPNEFSMLQLAEKIIQKTGSKSKITFKPLPHDDPQQRKPDIRLAQEKLGWQPTILLDEGLDRMIDYFKMKYKL

SEQ ID NO: 5557 - protein, 124 aa, B.fragilis
FCDISRKACFLCQTPKAITMDLEKVLIREINNDSRIFLYKEGDCWSAHDNSARHLCFLYSQFNAYDRIYQAYEIVLKCVMLSNAMIEKFIEHTLVSTVHEDEIEICIPKEKRAEFESWRSTSGV

SEQ ID NO: 5558 - protein, 459 aa, B.fragilis
LIRMDWKIRNIRLQELREIYQEKLKNIAYRVYESHFQNGIVKQEELEGEIMSYYQHTQPSLQEFYSHYATQWEHFYEGHELTDSAFLRFLENSAYPLQMKYNRGDLNLQYYIDRFHTLKKRSKEWKHLRNLFFDKWYHLLANNEYNYQIERINNLCERFYRLQKNIADQLPQRGNARLMWLLRTHQELAKQLFHYDEIAKNHPAIRELTKILGKQHYGKEKKFRMVAGIHREQIITHATKSDITGVCEGNDLNSLLPIEYCYLSDPALQPLFFERFNKKKLQMMDYESKDQHRIKDIKIQGNEIVEEQSGPFIICVDTSGSMSGEREEFVKSAILAIAELTEQQDRKCYLINFSNDIACIEIERLGQNIQELANFLCQSFHGGTDLTPALLHAIHILKTKSYRNADLVMMSDFEMPPLNEELSEEIKKIKQNKTHLYALSVHKQSENTYLNVCNKFWFV

SEQ ID NO: 5559 - protein, 547 aa, B.fragilis
YVKIMSMFCFQCQETAKGTGCILSGVCGKTPEVANMQDLLLFVVRGIAVYNQALRKDGRSSARADKFIFDALFTTITNANFDKHSIIEKIKKGLELKKDLSNQVTIEHAPDECTWYGDETEFEEKAQTVGVLRTSDEDIRSLKELVHYGIKGMAAYVEHAYNLGYENPEIFAFMQYALAELTREDITVDELITLTLATGNHGVQAMAQLDTANTSHYGNPEISEVNIGVRNNPGILVSGHDLKDIEELLQQTEGTGIDIYTHSEMLPAHYYPQLKKYKHLVGNYGNAWWKQKEEFESFNGPILFTTNCIVPPRPNATYKDRIYTTGATGLEGATYIPERKDGKQKDFSVIIEHARRCQPPVAIESGKIVGGFAHAQVIALADKVVEAVKSGAIRKFFVMAGCDGRMKSRSYYTEFAEKLPADTVILTAGCAKYRYNKLPLGDINGIPRVLDAGQCNDSYSLAIIAMKLQEVFGLKDINDLPIVYNIAWYEQKAVIVLLALLALGVKKIHLGPTLPAFLSPNVKQVLIDNFGIGGISTADEDIAKFLA

SEQ ID NO: 5560 - protein, 169 aa, B.fragilis
TKKIMSLLLPDSGLIFWMLLSFGIVFAVLAKYGFPVIIKMVEGRKTYIDESLEVAREANAQLSRLKEEGEAIVAAANKEQGRIMKEAMQEREKIIYEARKQAEIAAQKELDEVKRQIQIEKDEAIRDIRRQVALLSVDIAEKVIRKNLDDKQEQMGMIDRMLDEVLTKN

SEQ ID NO: 5561 - protein, 189 aa, B.fragilis
QKKMEVGIISMRYAKALMAYAEERGAEERLYHELVTLAHSFRTVKGFCAVLDNPIVSVNEKFNLICTAADGDHKPSEEFIRFIRLVLKERRETYLQFMSLMYLDLYRKKKHIGVGKLITAVPVDKATEERIRQTAAHILHAYMELETVVDPSIEGGFVFDINDYRLDASIATQLKKVKQQFIDKNRRIV

SEQ ID NO: 5562 - protein, 478 aa, B.fragilis
TMYLISISSLAQRAKSVGIHKCNGASDGHIYRMFLYESALLILLSLLFVTVLLFTFKLEIEDLSGASLKALFTWQTLWVPILVSLVLFLVIGLFPGKLFAAIPVTQVFHRFTAHRFVWKRSLLFIQFAGIAFILGLLMVILLQYHQVMTRDMGYKVDNLAVGWSPYREIDKMDGILRGLPIVEEFCNASTIIYGGYMGQPYTDAHGKEFMGRIEFVDEHYVPVMGLQIIKGRNIQQDKEILINEEMVRQIGWTDSPIGKNLEDGKNNFGTIVGVVKDYVVQSAYMPQAPVALMSNLEWMNVLNKRNIILKEPFGENLAKINTLMKEAFPTVDIVFRSARQEIDKQYQEVRRFRNVVIIASIAILLIALMGLFGFVNDEIQRRSKEIAIRKVNGAEVPDILRLVSGNIFWTALSAVLVGIVFAYIVSNKWLEQFSDRVSVNGGHFLVVIIIILLLIIGSVIGRSWNVANENPVNSIKNE

SEQ ID NO: 5563 - protein, 95 aa, B.fragilis
SFIVILLIFYFCIFMNMYVGNLSYNVKESDLRQVMEEYGVVESVKLITDRETRRSKGFAFVEMPESSEASNAIKELNGAEYAGRPMVVKEALPRN

SEQ ID NO: 5564 - protein, 306 aa, B.fragilis
PFNVDPLIYSLLLVWYELKVIPLRPIFNLKRLDMAGYISDDTRKVTTHRLIEMKQRGEKISMLTSYDYTMAQIVDGAGIDVILVGDSASNVMAGNVTTLPITLDQMIYHGKSVVRGVKRAMVVVDMPFGSYQGNEMEGLASAIRIMKESHADALKLEGGEEIIDTVKRILSAGIPVMGHLGLMPQSINKYGTYTVRAKDDAEAEKLIRDAHLLEEAGCFGLVLEKIPAALASRVASELTIPVIGIGAGGDVDGQVLVIQDMLGMNNGFRPRFLRRYADLYTVMTDAISHYVSDVKNCDFPNEKEQY

SEQ ID NO: 5565 - protein, 443 aa, B.fragilis
DEKVWFMKIHLKLLTERYWFRLGLSLCFAITAALSYADRDFIWMGLSLCLLLFSIWWQLSLYRIHTKRVLFMIDALENNDSAIHFPEEQIMPETREVNRALNRVGRILYNVKSETVQQEKYYELIMDCINTGVLVLNENGAVYQKNNEALRLLGLNVFTHIRQLNKVDIQLMKKIEFCRPGDKIQTIFNNERGTINLSIRVSGITVREEQLRILAFNDINSELDEKEIDSWIRLTRVLTHEIMNSVTPITSLSETLLSLADTRDEEIRRGLQTISTTGKGLLSFVESYRRFTRIPTPEPSLFYVKAFIDRMVELARHQNKCDNITFHIDIAPADLIVYADENLISQVVINLLKNAIQAIDAQADGKIEIKGRCNAAEEILIEIKNNGPAIPSDIADHIFIPFFTTKEGGSGIGLSISRQIMRLSGGSITLLQGKETKFILKFK

SEQ ID NO: 5566 - protein, 240 aa, B.fragilis
NLMVMIMKWLNFNSIIGMAVLSLLFYTENVAAQTDKNDTKQKIDTIQTTQPEYSKYDKRIHRFRKGWNSLIPTHNKIQYAGNMGMFSFGTGWDYGKRDQWETDLFFGFIPKHDSHRAKMTMTLKQNYMPWSLELGKGFSTEPLACGIYFNTVFGHEFWVHEPSRYPEGYYGFSSKIRTHIFLGQRLTYDIDRERRFFAKSVTLFYELSTCDLLLISRVTNSYLRARDYLSLSFGLKFQWL

SEQ ID NO: 5567 - protein, 84 aa, B.fragilis
LDIFNSQGEGFSGPGGGFIDNEFAHSQFVLDNDYFLFTISNGTRIETPFFIKLFRLGYKRSLKESQLRCSIWVHPASASARPRG

SEQ ID NO: 5568 - protein, 422 aa, B.fragilis
LSFSLFYRNHLVARSGFIGRKVVFLRHYILKYSIMKKILLLGSGELGKEFVISAQRKGQHIIACDSYAGAPAMQVADECEVFDMLNGEELERIVKKHRPDIIVPEIEAIRTERLYDFEKEGIQVVPSARAVNYTMNRKAIRDLAAKELGLKTAKYYYAKSLEELKEAAEKIGFPCVVKPLMSSSGKGQSLVKSAAELEHAWEYGCNGSRGDIRELIIEEFIKFDSEITLLTVTQKNGPTLFCPPIGHVQKGGDYRESFQPAHIDPAHLKEAEDMAEKVTRALTGAGLWGVEFFLSHENGVYFSELSPRPHDTGMVTLAGTQNLNEFELHLRAVLGLPIPGIKQERIGASAVILSPIASQERPQYRGMEEVTGEEDTYLRIFGKPYTRVNRRMGVVLCYAPNGSDLDALRDKAKRIADKVEVY

SEQ ID NO: 5569 - protein, 214 aa, B.fragilis
  UNSURE (33): Identity of amino acid sequences at the above locations are unknown.
NKRFMRSLIGKQAPKFDATAVINGHEIVQNFRXDQYKGKKYVVFFFYPMDFTFVCPTELHAFQEKLEEFEKRDVAVVGCSVDSEYSHFSWLQMPKNEGGIQGVKYPIVSDFSKSISESYGVLAGSYAPDENGNWVCEGTPVAFRGLFLIDKEGVVRHCVINDLPLGRNVDEVLRMVDALQHFEEYGEVCPANWSKGKDAMKATEDGVANYLSKH

SEQ ID NO: 5570 - protein, 77 aa, B.fragilis
DHLFCVIICNLILKNNSLFFIRNKRHYYVLKKSLKYLPFKNKGLPLHPKSRTLDGNALLAQLVEQLTLNQWVQGSSP

SEQ ID NO: 5571 - protein, 299 aa, B.fragilis
TLTPKKSEYSPLYHNNMHTIQINDDCYRVPESWDELTEKQLSYLVNLTQSDIPIEELKVHMMLYCLNAHVCRYRDIYRHQVKISIGTPGNKIPFRTHKKKYLLLPEEVNRLAKLFNFLLMCEKDTEMKYHVHPELTVNPYRAFFCRFRKFRGPEDGLLDIRFEQFMHLQHYLDAINQDPEQINHALACLWHTSKTFNINRLEKDASILSHLPHRVKMIMYWYIIGSLAYLANGFPRIFSGNGKSNGRVFDSQMRLLDSLAQSDMTKKPEIKKGFLIDALYTMDESLRKQQELNENMQNK

SEQ ID NO: 5572 - protein, 165 aa, B.fragilis
PLTFMEIYNHFEYGKTLAIRLKPIAHTPEKPRFFTAFGLEDLYNFNDKLSSVSGMILIAVDGCESESKRNESDALNNNDIFSFIVVQNTVSDRPETVNQAAKECKAIAKQIRNHILQDPDISEFIDDTIQFNGIGPIGDNFYGVVLTFSLVQPETYFIDQTYWED

SEQ ID NO: 5573 - protein, 67 aa, B.fragilis
IYPPTSNVYLKMHMSDKYEMLSLIHNTIVFKEESYMTTTHHQVNILSCKVFLMKNGRRNMSTLFSYL

SEQ ID NO: 5574 - protein, 237 aa, B.fragilis
MSQPFFQFKQFTVWHDKCAMKVGTDGVLLGAWTPVESSARILDIGTGTGLVALMLAQRCSASVIALEIDGTAAQQAAENITRSPWGSRIEVVCQDFRLYSNKNNSLKYDTIVSNPPYFTDSLKCPDSQRNTARHNDNLSYEELLKGVSNLLSPNGTFTVVIPMDASDSFKDIASSQGLYPSRQLLVITKPGAPPKRTLISFTFIKQDCKEEKLLTEVSRHRYSDEYIKLTREFYLKM

SEQ ID NO: 5575 - protein, 159 aa, B.fragilis
EPEPNLSRKKIIAGYHNRQVNSFSNLNIKTMSVNKCIFIGNMGRDAEVRTTETGIKVAQFSIACTERAYTNKAGQTIPERTEWIPVVAWRRLAETIEKYTHKGSKLYIEGRFTTRKYETNDGQKRTVSEIVAESIEMLDPKRDAPSLPPEPEQKLSYNP

SEQ ID NO: 5576 - protein, 202 aa, B.fragilis
SRKFMYQFIETIRIERGVVYNLDYHTERMNQTRAVFWPDEPPLNLSESLQPIMNVEMIKCRVVYSRWIEEILYTPYQIRPVHSLQIVHSDNIDYTYKSTDRSAINELYMHKREQDEILITRNGLLTDTSIANIALFNGKEWHTPKHPLLKGVQRAALIDKHLIREKEITVDQLFNYSQICLFNAMIDFGKIKIDVNRELIRI

SEQ ID NO: 5577 - protein, 419 aa, B.fragilis
TMKFSELQLNDNVLEALDAMRFEECTPIQEQAIPVILEGRDLIAVAQTGTGKTAAFLLPILNKLSEGGHPEDAINCVIMSPTRELAQQIDQQMEGFSYFMPVSSVAVYGGNDGILFEQQKKGLMLGADVVIATPGRLIAHLSLGYVDLSRVSYFILDEADRMLDMGFYEDIMQIVKYLPKERQTIMFSATMPAKIQQLANTILNNPAEVKLAVSKPAEKIVQAAYVCYENQKLGIVRSLFAEEVPERVIIFASSKIKVKEVAKALKMMKLNVGEMHSDLEQVQREFIMHEFKSGRINILVATDIVSRGIDIDDIRLVINFDVPHDSEDYVHRIGRTARANNDGVALTFVNEKEQTNFKNIENFLEKEIYKIPVPAELGEAPQYNPRSYTNAGRGGRNFRNGNRKNNNGGRSTAPRSGRR

SEQ ID NO: 5578 - protein, 156 aa, B.fragilis
MITTKIEVPPHLCEYIRGKYCNLTSDPVRFPDNLNIYHVIFDLLQKRPSEAPVDRGNLEICLPERSIGKSPVTYNYLGLRSQVIISRKIELMMWAELHEYLDEQKHRYGIKYIDGVQFFMRRYGIDSLTEEAFLKHYQRWRAKVRRKEKRSYKKRE

SEQ ID NO: 5579 - protein, 103 aa, B.fragilis
EDDTGDNGYTFTSCIPTSSYNSGLDSDKTYNNTKVYHSSSLIQVIKSELTHEAALLHVLFLSVMCLRIIGYRRGLMLSSYSWHSPFFSFSIWLIRLRIAINLS

SEQ ID NO: 5580 - protein, 103 aa, B.fragilis
AGCTSLLANKTKAQIQAINDIVIAIVFNIRSWPLVNAPSGIPLPIIFELAGINEKRVEDVAAVAIQVVISPTPATTCPATKEEVEVDRVNMQIPPIIVTTAAR

SEQ ID NO: 5581 - protein, 380 aa, B.fragilis
LQCTMSLTANIYPSTIALAGNPIKLTINSSSVVSYTIRQADRTIFSGSGEGEFSVFLQDILSGILSPKHLLNESTDILLLDSTSATDIAISVQNTQGETKTLSLKAVIGGISKRLLRRLLDENSNIFTWKLFNSSVNFFKTTRTNGRIITIRETELLPIPFLYPDGALKVVAAGIETSLSGTAGQPVALNLYRLRKKLFQTNQKLASVFDIYSGSTKSCTIVITPGTVSRERYLLEFLNSYGAYERIEVTGIGNIESEIESDSTYQIYDESIDDYIEARERQSARDKLLVESGYRNTEELVHLMDMLASDDIKILGLSGRNIRVNAVADNLTHAIRSTVPESIKMTLHFVDSDVRYTGSLSEDEIGNPRIHTEQFTPQFN

SEQ ID NO: 5582 - protein, 322 aa, B.fragilis
KYRFNLRNRRKMNAIIPDIDTLKKVVKINATLPDEAINPYIDDAMDIYLTPYIGIKTVEKALTGTDKRLNDKILRTLGPLTLMLATPELGIRIGDSGITVENKQGTYSPANEAKIAAAKESFYFRGMQALDRLLTFLTDHPETYPEYAEHCKQATDSSCFIRDAREFQDTGLVNIEYSTVSFRMMLPTVRQLQERNVREMLKEDLYQRLLDAHTAGKELTPKEKVLLGHILRYLANKTAELYTSQTSREQRTINDTPEFTPIIRPIYQDQAATGNFFADQATYYAGKIQNFISENAEELGVTPTVTAINFNSKEKRIFTSIS

SEQ ID NO: 5583 - protein, 262 aa, B.fragilis
NMITWDNFYLFAVASICLWLTGAIFALRSSVRSRMAVVLTIAGITCLGIFIAGLWISLQRPPLRTMGETRLWYSFFMGIAGLLTYIRWKYRWILSFSTLLSTVFVIINLLKPEIHDQSLMPALQSIWFIPHVTVYMFSYSVLGCAFIIALCGLVHHKEEYLVTADNLVYSGVAFLSIGMLLGSLWAKEAWGNYWSWDPKETWAVVTWMGYLLYIHLRLRRKFRKKMLYVILIFSFLALQMCWYGVNYLPSAQQSVHLYNRNN

SEQ ID NO: 5584 - protein, 1249 aa, B.fragilis
INETVSNMANDLNRSIKLYIDGSEATNKIDLVKESISRLEDKLRSLTGKEVDYAKRSQDLKKELDAKNRTLQNYEKQLAETERVLKSLSGATYNELLAVQSRVRKELRNAVPGTKQYTAALEQNRRVTEALSRAQANMRVEVGAQGNIWSRASGFINKYIGLIGTVIAAITGVSMKLNQLREQRNKREEAKADVEALTGLSKDDINWLEQQAVQLSTTMTESGIRIRQSATEILDAYKLVGSAKPEFLDNKEALAEVTKQTLILASASGMTLKDAVDAVTLSLNQYGDGADQASRYANVMAAGSKYGAAAVESVTTAVTKSGVAAASAEIPIEQLVGTIETLAEKGIKDEIAGTGLKKFFLTLQTGADDTNPKIVGLEKALDNLQKKQLSAAQIKKQFGEEGYNVASVLINEADKVKYYTEAVTGTSVAMEQAATKSETAAAKLSQAKNRMQELGIELLEKLNPALISAANGAVSWTGKLIKLLNFINENKRAITLLTIALIAYTAAKNSDVIISKVVTFWNNNIAKSLKAIKKELMTNPYGIIAVVAATAIAYLINLKKKNDELKDSVSGIKKVNEETNKSFIQQESKIRALTAVINDNGIALGVRRKALNDLKEIIPDYNAQLTDEGTLTKNNTDAIKDYLVQLEKQIKLKAAQQELENLYAQKRTLEKDEETQSDQYWKIRQTNTLQGYNRNSLTAKISRLFGTEKEGKALETLNETRKNLSSISEKIDEITKEIGESALAIEEVNKANEETTNNKITTPIIDEEKAKALLKKKLEEEAKLYSQHQSELKEAYLKRQDETLQTEQQFNDRMETLELEHQQRIINIAGAKSKEGIDAQNRINDIKIKQQKEQMNRQLAEEKTLYENQQKDLKLLYVSGKDENLKTEKEYNEAMEHLTIMHLERVLKIANLDADQRRTIEQQLLDFKVKCLQDEEKERKKLEDAAQKKKDELARKEKQRLTEQAQQYRQYGEQIGDTLGQMISGQENALQNFADTMLDILFDVLSQMIDIEIAKATGVAVGAVARSAAEAYAMPDSVATFGATGAARAAVLSGLIMGALAAAKSTLKGLIKRGSSSTSAIDNNTDSTKTAQVQVKQWASGRYDVIGEDDGRTYRDVPYIGDSPTGIVRRTSLISESGAELIINAEDLSRLQHHINYPIVVQAIQDARSGRVPQRAEGNYDPIRNSISRTSQTTSSPTDKEANLAQLIKELHALIEKLKYLKAYVVLRELNEAQELADKSKEPFTRKKQ

SEQ ID NO: 5585 - protein, 153 aa, B.fragilis
TMETLTALQWAKKGFIPNEGVKGTEQWTNCYYSAKAVYFKDSEVHEDKDAAKAILSAKRKEYRDAAKKREEKRKKNAAYREKMKTRWQWLQEGRIPNDNARWKVGEELNKTFCTCAYGSNYCYCHERYTHEPKNDEEMQKAIFDFHKNGNSWV

SEQ ID NO: 5586 - protein, 365 aa, B.fragilis
RLMTKLIRTFHPVGHGAFYTEKHVLEDQTINIVYDCGSKTLEKQLPSIINNTFKKGEEIEFLFISHFDADHVNGIEYLKTYCKIKKVVIPLIEDKDAILIIKAINTSKIGSNKLDTLIDSPEEYFPGSEIIKVKAVNEGYDDDRYFANDLNNGGTIPSGSEIILHKSSAENKWCFIPFNYNYTERVNLFKDKIKEKGLIFNKLNNIDYVQISQKTIKSIYKAIKGKANGNSLVVFSGGDYAISATHYFSTDKKIVLEYDRCSYISCIYLGDSFANKSDFYSQLKGRLDKLTESIGIIQIAHHGAKGNFSPNILKLGTNPLAIISCKSTDKHHPSVNVVKQIQENGSIPFIVTEKPTTEVEQIGYY

SEQ ID NO: 5587 - protein, 116 aa, B.fragilis
LFYFTLFSTESVESRSNLKLLLFLNLFINFYFFYFMNMYIGNLSYRVKEADLRQVMEEYGTVDSVKLIIDRETRKSKGFAFVEMPNDDEAKNVISELNGAEYEGRQMVVKEALPRN

SEQ ID NO: 5588 - protein, 432 aa, B.fragilis
KNIAKVSFIFITGQLSYNFIPLHFITTIKSMRKFIISFCCYVFFIFTLAAQDKAPHYTVIVSLDAFRWDYPAMYDTPNLNQMAREGVKATMLPSYPASTFPNHYTLATGLVPDHNGIINNTFWDVKRRRQYSMGDPATRNNPDYYLGEPIWITAQKQGVKTGNVYWVGSDIAIKGGYPTYYREYAEKPRLTFEQRVDSTIALLEKPEAERPRLVMLYFEEPDGVTHHHGPRSVEAAAIIHRMDSLVGMLRQGIASLPFGKDVNLIVTADHGMTEISDDRVVDMNKYLRPEWCEAVDGRTPTSIFTKPEYRDSVYNALKDVPHIHVWKKEEIPVELNYGSSDRIGDIVVAPELGWQFTDVPRALKGAHGYFPQSPDMQVMFRACGPDFKAGYESKGFVNVDIYPLLAHLLKITPEKTDGQFERIKDILKDVSF

SEQ ID NO: 5589 - protein, 322 aa, B.fragilis
YIYFMTRNEQLEKWLSNRQRRYADGMELFNALAKANTKSSYGNYLSQAPENPHIFDPHFTQLVNILTKIAREIKDAPSVYPAAFEEILIVQTLNDEQRTQETDIRTEAIDRLQEEIDGLHNRISELESDTENHADELSALNEEFEEKMKELSAIRGELDALNTPGVKIVTEESLTPALRKAYARIKEIAPLYASLHNDIANPDIPAEERHPLAEELCKLDDERRKLWKQIDDYAEGKQATLELDAKRPEYSENAVVRGFEIARQIKRLKQNITNSKTAAERAGKEGKQAVLQNALDRIAKYETELAALTAELSAEQGEKVSG

SEQ ID NO: 5590 - protein, 63 aa, B.fragilis
FAIAQVGTFIRPRYASAYRGFVFWGRSPFTPFCLEERFEQLYLRRSKAGNKVSIYYFYFFFLL

SEQ ID NO: 5591 - protein, 574 aa, B.fragilis
GMTAQASPIPSAYELRMKQANVIRKFFNKMQRQAMAIAAHDEYIVASRGTGKSEGIDARFILRNVWEMPGSLGGMISPSYAKAWGNTLPAICKALAEWGYIQNIHYVVGHKAPPSMGFAKPVRPVLGDGWSNAFHFWNGTVMVILSFNQGMSANSMSLDWVIGPEAKFLSYDKIKNEVNPANRGNRQYFGHCPHHHSVCYSTDMPGSSMGRWILDKQEEMQPPHIQLIRNLYKELQDYKRKPLTEHTMRMIRELQRDLDIARKFQPALKPNDKKKREYTVFYGEYDVFDNLEVLGEDFIWQMQRDSPPLVWRTAFLNERLMKVPNGFYSALDDRIHFYQPADNGRLKNLGSNWKQLSSCGCLGDGDLDFDKELHIAFDSNASISTAVVAQLDGNTMKIIKSFYVKTPSKLGDLVQQIADYYRPKLNHDVVVYYDHTFTWESGSTTETYADIIERVFKENRYTPAMVYVGQAPKHEWKHLNIDLALKGDPQFLWIRFNLYQNEFLKIAMEQTGIKQGKNGFEKDKAPEGTDDTPDNPDQYKTHVTDAFDTLWLGMNFYFTRPGTGTGGIFFLNRK

SEQ ID NO: 5592 - protein, 1018 aa, B.fragilis
TMYFNDDEIRRIKDAATGHLLDVAQDFHELKRSGVNYNCDCPRCKAAKKLSISPAKQIFKCFGCNELKGGDSVSFLMSAEGMTFNDALEYLAKKFNVILDQRPAIKKQPAKKMKKSSKAAKGIDVDSYCARMLAESGLTFEDVTAKVYKTGDTQSIFEQRTFRPGTIDERGMLTTKGDDVIIEYYDLEGMPVVFTRKDNKRRDVGTPQEYYRIRWQFPDAHLDKEGKPYKYKSPRGSGTPIYIPERIRSLYKSKTKIPRLYIQEGEKKAEKACKHGIPSIAVSGIQNLGLYGALPEDLVKIISTCEVQEVAFIFDSDWDDISSNIRINDQVEKRPRCFFYAAKNFKEYMRSLKNRNIFVEIFVGHINKNEAGDKGLDDLLANSLRGKEEELAADIEFACNEKKGLGKYIEMFKVTTWTDHKLQELWGLHSHEVFAERHADLLRNLPEFLFGRYRWKFDEHGKVILAQPFDDDEKFWREVTKYDRSQNERIEYEFCYVNSQNFLQNRGFGRLRRIDKSYQFIHLEPPVVRAIDASDARDYLFQFAKHNCKTEVNEMLIKGVSQYVGPDKLSLLEFIQPNFVKPNRESQYFYFDKNCWLVTKDSVSELGYENITHHIWEEQRKMTPAKYLGKPLVTFSRQDNTFTYELSEAGKKSHYLQFLINTSNFTWRKSAEEIEPEEENENRIHLLSKLCAIGYMVMEAKDNNVARAVIGMDGKQSEVGESNGRSGKSLVGELMRNIIPTAYIPGKRSDLFNDQFVWNDIQENTKLVFIDDVLQNFNFEFLFPNITGDWSVNYKGGRRITLPFARSPKMYIATNHAIRGSGSSYTDRQWLLAFSDFYNDTHKPVDDFGVLFFSEWDFEQWNLTWNLLANCVQLYLTYGVVQAPGERLEQRKLRQEMGETLISWADEYFSGEEHLNVRLPRKDLYDAFCQYDNQQRKFVSPTAFKKKFIMYCSWKGYVFNPHKYDSITGKPFQVDKDGKAVVDDKSGGVEYFTVGTGAQPIPKEDNSRLPQPTGKLVF

SEQ ID NO: 5593 - protein, 279 aa, B.fragilis
KLPAICIKKKRIMKIRFISLASGSSGNCYYLGTEKYGILIDAGIGIRTIKKSLKDINVTMDSIRAVFITHDHADHIKAVGHLGEKLNIPVYTTARVHAGINKSYCMTEKLHGSVRYLEKEEPMQLEDFRIESFEVPHDGTDNVGYCIEIDGKVFSFLTDLGEITPTAARYICKAHYLIIEANYDEEMLRMGPYPTYLKERISSKTGHMSNIDTANFLAENIMEHLRYIWLCHLSKDNNHPELAYKTVEWKLKSKGIIVGKDVQLLALKRNTPSELYEFE

SEQ ID NO: 5594 - protein, 113 aa, B.fragilis
CKEAYQCKIIEAGFDSRKPTLILIIMKTVHSSPSLSPSGTKRQKANLFTNENPETIAQMRMQSAQKEQHKVMVRLDNRTHVLVAPQNVTPEYIEMLRKKYQITYNAPARGGRR

SEQ ID NO: 5595 - protein, 73 aa, B.fragilis
IRHFVHVLTEVTIVIAMRDIPMNLKMMKRCKKLFLIFIRTEIAGYDYKQDQKGSNMKLRKKELKYGIRNYKNR

SEQ ID NO: 5596 - protein, 359 aa, B.fragilis
SVNFAHMIELAQHIEVLLLENDCVIVPGFGGFIAHYAPAMRVAEENLFLPPTRTIGFNPQLTLNDGVLVQSYMAVYDTNFSDATKMVEKEVAELISALHEDGKTDLPNIGEIRYTIHNTYEFVPYDNKITTPYLYGLDSFEMKELSALRRPEKEQILPTVLKKKTSYEFRANWAFLRNAVAMIAAVALFFFMSTPVENTYIEKGNYARLLPTDLFEKIEKQSVAMTPVMLKSVDAIPQTKPATAKKKSSTVRKASVVKPVAVKEVKVNQPEKTMKATETKVVEKTFPYHIIIASVANTKDAEAMAGELKAKGYTGARVLTGDGKIRVSIMSCADREDANRQLLKLRENEAYKNAWMLAK

SEQ ID NO: 5597 - protein, 674 aa, B.fragilis
YILFMEKTLNLIKNDPWLEPYKDAIVGRFEHAMDKKAELTNGGKSTLSDFASGYLYFGLHHTDKGWIFREWAPNASHIYMVGTFSNWEEKPAYKLKRLKNGSWEIKLPIDAIQHGDLYKLHVYWEGGQGERIPAWANRVVQDDNTKIFSAQVWAPEKPFKFKKKTFKPSTDPLLIYECHIGMAQQEEKVGTYNEFREKILPRIAKEGYNCIQIMAIQEHPYYGSFGYHVSSFFAASSRFGTPEELKQLIDTAHGLGIAVIMDIVHSHAVKNEVEGLGNFAGDPNQYFYPGGRREHPAWDSLCFDYGKNEVMHFLLSNCKYWLEEYHFDGFRFDGVTSMLYYSHGLGEAFCNYGDYFNGHQDDNAICYLTLANELIHEVNPKAITIAEEVSGMPGLAAKVEDGGYGFDYRMAMNIPDYWIKTIKEKIDEDWKPSSMFWEVTNRRQDEKTISYAESHDQALVGDKTIIFRLIDADMYWHMQKGDENYIVHRGVALHKMIRLLTASTINGGYLNFMGNEFGHPEWIDFPREGNGWSCKYARRQWDLVDNKNLTYHYLGDFDADMLKVIKSVKNIQQTPVQEIWHNDGDQVLAYQRKDLVFVFNFNPSQSFTDYGFLVTPGTYEVVLNTDNIIYGGNGLSDDSVKHFTLPDPLYKKEKKEWLKLYIPARTAMVLRRTK

SEQ ID NO: 5598 - protein, 381 aa, B.fragilis
RMNLYLKHTLFYLLGISYALISSAQSNPDKLQCKVTGRMLLDGGVYLKNDNNFGNGVEFSDLRIGAKVAYQNWDMKLEIGYTGNKATIKDAFAKYTYKNHSIQVGQFYEPFSLEMMCSTFDIRFNQSPGAVLALTNGRRMGITYGYRNKRHYMSGGAFMDNEVNNLKKASHGYALDGRVVYRPVLDSKKLIHIGFAANYRTPNESLNEEDKNIFIYKSPGVSTIDNRNIAMATIDHVAYQIKFGTELLVYYHRFCLQSEYIRTHVERDNAFKNYVAQGAYLQCSWLLSGETYLYDESVACAGRPEGKSLEVCSRFNYLTLNDEDASIWGGEQKDISIGLNYYINKYIGIKLNYSYLMPGASIKEISRKNFSVFQGRFQFIF

SEQ ID NO: 5599 - protein, 171 aa, B.fragilis
RQNYRQNKVKRFQDNFPLALCPGSIEPFMHKGDWAIHEVLPSLLSEIGPADIRIATFSISEDSLRPLFFLADDKKITGLTLLLDTTVKRHKLDLLLFASNITPRIRIDSCHAKVLLVENDKYQFGIAGSANLNQNHRWENGFYFTSGKHFNYFLEMFEQAYNQAISYEILE

SEQ ID NO: 5600 - protein, 193 aa, B.fragilis
EIDYYWGQLISPGPQANDMRIQFEIKEKLPDIIGEILNSEKWMTLIKEDISGRKLVVIRDQAFDSEATVEIYSREVTIKTAWSRYTYRLFVLGDCVWCEYNGAYRGLLEQKLLPSITPKESLLDSEVLDSSLYGHEKKKLREYAEDNLKLKKFRRENFNENRTGVAPFDHPKKVYDEFIKEDYIAPSSKENNK

SEQ ID NO: 5601 - protein, 408 aa, B.fragilis
GIDYMVQSQTQPIRRIAFPILIALSVSHCLNDLLQSVISAVYPLFKEDLSLSFAQIGLITLVYQMSASVFQPLTGLIFDKRPIAWSLPIGMSFTLIGMLNLAFASNLNWLLASVFIIGIGSSVLHPEASRITFLASGGKRGLAQSLFQVGGNLGGSLGPLLVALLVAPYGRHHIALFAILALAAICVMFPICRWYRSYLNHLKKRPIHAKAYIERPLPPQKTVFAITILMILIFSKYIYMASLNSYYTFYLIHKFNVSIQQSQLFLFVFLVATAIGTLMGGPIGDKIGRKYVIWGSILGTAPFSLLMPHAGLVWTIILSFCVGLMLSSAFPAILLYAQELLPNKLGLISGLFFGFAFGVAGIASAVLGNMADKFGIDAVYNVCAFMPLLGLVTWFLPDLKKVRSEKQE

SEQ ID NO: 5602 - protein, 64 aa, B.fragilis
DTILYGRDGTSKGELLIDIKLCNMVKEFTPDMANSMQKIVRKCFPRTLQIVNKIHVFTLVYEAM

SEQ ID NO: 5603 - protein, 827 aa, B.fragilis
TNLYEMKKERYLREMDDQNDNAFSLIADFDGNEDQVFDIKVGETLPVLPLRNMVLFPGVFMPVSVGRKSSLRLVREADKKKSYIAVVCQKMAETDEPAFEDLHPIGTIGKIVRVLEMPDQTTTVIIQGMKRLELKNITETHPYLKGEVNIVEEEIPSKDDKEFQALVETCKDLTIRYIKSSDTLHQESAFAIKNLTNHMFLVDFICTNLPLKKDEKIELLRIDSLRERTYRLLEILNREVQLAEIKASIQMRAREDIDQQQREYFLQQQIKTIQDELGGSGQEQEIEEMRQKAEHMKWSTEVRETFLKELAKLERTHPQSPDYSVQLNYLQTMLNLPWGVYTTDNLNLKNAEKTLNKDHYGLEKVKERILEHLAVLKLKGDMKSPIICLYGPPGVGKTSLGKSIAAALKRKYIRMSLGGVHDEAEIRGHRKTYIGAMPGRIIKNLIKAGSSNPVFILDEIDKVSADRQGDPSSALLEVLDPEQNTAFHDNFLDVDYDLSKVMFIATANNLNTIPGPLLDRMELIEVSGYITEEKVEIARKHLVPKELEANGMKKTDIKIPKDTLEAIIESYTRESGVRELEKKIGKILRKSARQYATDGFFLKTEIKPTDLYDFLGAPEYTRDKYQGNDYAGVVTGLAWTAVGGEILFVETSLSRGKGGRLTLTGNLGEVMKESAMLALEYIKAHASLLNLDEEIFDNWNIHVHVPEGAIPKDGPSAGITMATSLASALTQRKVKANLAMTGEITLRGKVLPVGGIKEKILAAKRAGIKEIIMSAENKKNIDEIQDIYLKGLTFHYVNDVKEVFAIALTQEKVADAIDLSVKKASQE

SEQ ID NO: 5604 - protein, 65 aa, B.fragilis
QIIYITLNIGCRLFLLSKDEKQSLNIELSREEIEYFFKPYPADETEAYEICNDFIKKISTDKSIL

SEQ ID NO: 5605 - protein, 70 aa, B.fragilis
YIIYYQRFILLWEQGVVGSNPATPTGNKSNHTCQCGYSYFILCYGGIPIIRNDATGTERRLLHFQIKLPG

SEQ ID NO: 5606 - protein, 231 aa, B.fragilis
KYDFTIKRGKKIWKESLDGISQIDAFPVLKARLGKSLPQFVYTLSPDKQTATLQIMNLYQLPQLKQFCDSVFSVINREHVPNLVIDVRNNKGGSSAGVDMLLSYLSHDAYTLYIKTDLKISSYSKRYNEQKHPETYEEIKNLPDGSLFAIRDSFVEGNRDKADIYKGSVTVLVNESTYSGASTFASAIKKSHAGKVLGETGCPTVYFGNYMSFTLPNSRLEYYISLNKFYE

SEQ ID NO: 5607 - protein, 183 aa, B.fragilis
LNKYFIMKRILCPKCENYLSFDETKYSEGQSLVFVCEHCGKQFSIRLGKSKMKAPRKEEKLDEDVYKEEFGCIVVIENVFGFKQVLPLQEGDNIIGRRCVGTDINTPIETGDMSMDRRHCIINVKRNRQGKLVYTLRDAPSLTGTFLMNEILGDKDRIRIDDGAIITIGATTLILRAAKKEEI

SEQ ID NO: 5608 - protein, 69 aa, B.fragilis
ERRYEMGRIKEEAWVEKCTVLHEGKATPNIYYNVFADGEQLCEISYDRLIAIRNLINQIEKEKKGECHE

SEQ ID NO: 5609 - protein, 170 aa, B.fragilis
PNHLMDIIDRIKQYLNHKGISDYRFEKTLSLSKGYINKAKNPTADILMKMCGIYTDISTEWLLRGEGEMLREKREDLGLHRAESASTDENSLIYKMYKEKDDENKTLIKQNAVLEERIRQLEADNESLRSQSGADRITDTFSDLPLVDYEEDYPPVERPSSSKHPLAGKA

SEQ ID NO: 5610 - protein, 192 aa, B.fragilis
ISFHMIDNNIFSCGPLPSNDGYTWTIVSRLGDMLNEAEALFGERDKRYTILGIELANIKQPQIWYPNDCNHVIIQVTEDCSNNMERAIFQVAHEAIHCLCPNPKKKTTILEEGLATYFSMYYTRKRKIYYNIDNLQYQKPYEFCSKLLNYDSELIKKARIIEPDISFINKEILLNICPKIDHTLLDELTKKF

SEQ ID NO: 5611 - protein, 110 aa, B.fragilis
LIFHLVPVYAYKVHLLHSDLYFCKCNRYYPNEQSVKNVLGVFDKVCIGSLLSIDYRLLYTLSFLHSLLVAGFPIDLMAVRLAKKQHASGSFALCDNPNYTLLLSLYVSFQ

SEQ ID NO: 5612 - protein, 81 aa, B.fragilis
SKHHICNMNDDKTITAAIETSNVTALLAAYRKFTSSSGATTDEFFRFITTPTPEREEFLALYCSSTSSVSGTIIQTNYNAL

SEQ ID NO: 5613 - protein, 106 aa, B.fragilis
SSNQLRNIRIEMELSDETLQQIREMAAALLPPAEIAILISLPAGERSYFCDICRNHHHSPIYEAYHQGRLQTKFELRKTVIKLAKAGSPAAEPLADKYMKEQIIND

SEQ ID NO: 5614 - protein, 66 aa, B.fragilis
LHDQFCFIDSGSNETIYNGLAEDCLWEIVLFSNGFVYHALQKFRIFIEEKDFNHTVLYNSHFHLNF

SEQ ID NO: 5615 - protein, 374 aa, B.fragilis
KECQQDYKFMRSNRFIKRLDLYIIKKFLGTYVFAIALIISIAVVFDFNEKMDKFMERSAPWSAIIFDYYMNFIPYFANLFSPLFVFIAVIFFTSKLAENSEIIAMFSTGMSFKRMLRPYMISAGIIAISTFILGSYVIPRGSVTRLDFEDKYVKKKKTTYVHNIQLEIDTGVIAYIDNYQDYNKTGNRFSLDKFVDKKLVSHLTARSITYDTTAVNKWTIKDYMIRNLDGLKETIVRGDKMDSIIPMEPADFMIMRNQQEMLTSPQLSAYIDKQKQRGIANIKEFEIEYHKRIAMSFASFILTVIGVSLSSRKTKGGMGLHLGIGLGLSFSYILFQTVASTFAVNGNMPPMIAMWIPNLLYALIAFYLYRKAPK

SEQ ID NO: 5616 - protein, 81 aa, B.fragilis
GLSHLHSFLSSIFGFGLAGVLLTKYCPDPTLFESREAWEVASVNAHYIWYYFAAIGLVAAIALLIFAKITDFIDKKKKTNV

SEQ ID NO: 5617 - protein, 506 aa, B.fragilis
NNNQRMMNQELLMSPNRLVTFLQKPAAEFTKADIINYIQQNEIRMVNFMYPAADGRLKTLNFVINNASYLDAILTCGERVDGSSLFPFIEAGSSDLYVIPRFRTAFVDPFAEIPTLVMLCSFFNKDGEPLESSPEYTLHKACKAFTDVTGMEFQAMGELEYYVISEDDGLFPATDQRGYHESGPYAKFNDFRTQCMSYIAQTGGQIKYGHSEVGNFMLDGKVYEQNEIEFLPVNAENAADQLMIAKWVIRNLAYQYGYDITFAPKITVGKAGSGLHIHMRMMKDGQNQMLKDGVLSDTARKAIAGMMQLAPSITAFGNTNPTSYFRLVPHQEAPTNVCWGDRNRSVLVRVPLGWSAQTDMCALANPLESDSNYDTTQKQTVEMRSPDGSADLYQLLAGLAVACRHGFEIENALAIAEQTYVNVNIHQKENADKLKALAQLPDSCAASADCLQKQRTVFEQYNVFSPAMIDGIISRLRSYNDATLRKDIQDKPEEMLALVSKFFHCG

SEQ ID NO: 5618 - protein, 189 aa, B.fragilis
NMDQLQLIQSKIYEIRGQKVMLDFDLAEMYGTETKYLKRSVKNNIKRFPSDFMFELTKEEFDSLRCSFSTSKRGGTRYMPYAFTEHGVAQLSSVLNSDLAIEINIQIIRAFIAVRQLISNPPVDRVDKLKEEIKALKDYIEEAFTDYNDINDDTRMQLELINQTLAELQAKKKAEEKPRNPIGFIKPKH

SEQ ID NO: 5619 - protein, 76 aa, B.fragilis
QKRHSGIDQIVCCHQVLFFVMDKTAEGYDESTSQYGIGEHIDGDMGNKPNTLQSRHKRLVMYLRFQQIDYYKDSGQ

SEQ ID NO: 5620 - protein, 333 aa, B.fragilis
IVKQRIMQFYSRNEAINRINKLAGAGKAFLFIIDYKQECSFIEKVDDIDSSELLYNLNGFTNCTSVVTPFRYPIIWQPQPISLSQYKRSFDIIRKNILSGNSFLTNLTCMTPVNTNLGLKDIFYHSRALYKLWLKETFVVFSPEIFIRIENGRISSYPMKGTIDATLPSATRLLMEDEKEAAEHATIVDLIRNDLSIVADNVSVTRYRYVDTLYTNHGPILQTSSEISGVLPKNYVDHLGEILFRLLPAGSITGAPKYKTIEIIEQAEEYERGFYTGITGYFDGRKLDSAVMIRFIEEQNGQIFFKSGGGITCKSDLENEYNEMKQKVYVPIY

SEQ ID NO: 5621 - protein, 178 aa, B.fragilis
TMKHHVHLIIYFACISVGILLCACRSSSLHSNQFKENGTFQHNYNELNTGTGTIASQVKTTKDEHGSSWKITYHFDTAQTPDPTTGLPPLSGIEIEGSEKQSKTAQESNDTVHSSNSSSKREVSGQTIQRESGTETKKDSKVATGTDDGIRNGLSIGIPLLFIIIALSYYAKRQNTSK

SEQ ID NO: 5622 - protein, 275 aa, B.fragilis
VILHKIKQMIKYIATLLLTVLFVACNNGKGQQPSEENEDPKAKEILQGIWLDDETETPLMRIIGDTIYYSDAQSAPVYFKILKDTLYTYGKDVTHYQIDKQSEYSFWFHSLADNIIKLHKSEDPNDTLAFSFKSVEIIPTYTEVTKKDSVVMFDGVRYRAYVYINPSQMKVVKTTYSEDGISMDNIYYDNVMHICVYEGKKSLYAKDITKQMFVDVIPTDFLQQAILSDMNFTGIDRKGYHYQALVCIPESPVCNLVNLTISFDGKLNITAAKYK

SEQ ID NO: 5623 - protein, 126 aa, B.fragilis
NHFNTLNYLIMGLDIAIASAVVEIITLIFFFVLCRNVSKIKKEIVSNDNLPGMFAMYISLGETDKAKKILYKAISKEPEFIAAFCYNGNNSAQQSTLKRKYKPYLEILGLELDFELVNKFIQEREK

SEQ ID NO: 5624 - protein, 470 aa, B.fragilis
VIIKNRILIIPAFFLLPKRRRKGKAPKILNKMATKEYFPGIGKIKFEGKDSKNPMAFRYYDAEKMINGRSMKDWLKFAMAWWHTLCAEGGDQFGGGTKQFPWNGDPDPVQAAKNKMDAGFEFMQKMGIGYYCFHDVDLVTEADSIEAYEANLKELVAYAKQKQAETGIKLLWGTANVFSHARYMNGAATNPDFDVVARAAVQIKNAIDATIELGGTNYVFWGGREGYMSLLNTDQKREKEHLAQMLTIARDYGRARGFKGTFLIEPKPMEPTKHQYDVDTETVIGFLKAHGLDQDFKVNIEVNHATLAGHTFEHELAVAVDNGMLGSIDANRGDYQNGWDTDQFPIDNFELTQAMMQIIRNDGLGNGGTNFDAKTRRNSTDPEDIFIAHIAGMDAMARALESAANLLNESPYQKMLSDRYASFDAGKGKEFEEGKLSLEELVAYAKANGEPKQTSGQQELYEALVNIYSL

SEQ ID NO: 5625 - protein, 198 aa, B.fragilis
MIYNINVITNNKFSMKKNRLTLVAAIFLSGTILFSSCVGSFGLFNRISSWNQSIGTKFVNELVFLALNIVPVYGVAYLADALVINSIEFWSGTNPMANVGDVKKVKGENGDYLVKTLENGYSITKEGEDSAMELIYNKEANTWNVVADGVSTELLKMNNDGTAEMNLPNGDKMNVTLDAQGMMAARQATMGGLLFAAR

SEQ ID NO: 5626 - protein, 510 aa, B.fragilis
TTNKLINSIMFLLGYDIGSSSVKASLVDAETGKCVASAFFPKTEAGIIAIRPGWAEQEPESWWESLKLSTRSILSESRVDAKDIKAIGISYQMHGLVCVDKRQRTLRPAIIWCDSRAVSYGQRAFEAIGEKFCLAHLLNSPGNFTASKLAWVKENEPDIYEQIDKIMLPGDYIAMKLSGEVCTTIEGLSEGMFWDFRNNRPADFLMQYYGIDPSLIADIRPTFAEQGRLTGTAARELGLQEGTPITYRAGDQPNNALSLNVFNPGEIASTAGTSGVVYGVNGEINYDPQSRVNTFAHVNHTAADPRLGVLLCINGTGILNSWIRRNVAPEGISYAEMNRFASSVPIGSAGISILPFGNGAERMLDNRATGCGIHGVDFNRHDKSHLIRAAQEGIVFSFKYGIDIMEEMGIPVKKIHAGHANMFLSSVFRETLAGTTGATIELYDTDGSVGAAKGAGMGAGIYKDHEEAFATLDKLTVVEPDAGKQQEYTDAYARWKQCLTQSMQTETENK

SEQ ID NO: 5627 - protein, 84 aa, B.fragilis
AMNKQMTIAKKRYSFKKAYERVPLGQIESLKKELYSVFSINNRTSWYNKLKGITSPSIEVVEAVETVFLKYGIENCWEITEIKL

SEQ ID NO: 5628 - protein, 78 aa, B.fragilis
SEDNQSHIYLLCFSRSLTAGMHIIKIEVNTIAIPQQIKILAIPKLSAINPVMNNPMIEGNKLTLSKRENTRPKYAGLN

SEQ ID NO: 5629 - protein, 385 aa, B.fragilis
FIRKESQPGMTFELQYTDAKSNARAGLITTDHGQIQTPIFMPVGTIGSVKGVHQTELKEDIQAQIILGNTYHLYLRPGLDVLEKAGGLHKFNGFDRPMLTDSGGFQVFSLSGIRKLREEGAEFRSHIDGSKHIFTPEKVMDIERIIGADIMMAFDECPPGDSDYAYAKKSLGLTHRWLDRCIQRFNETEPKYGYSQSLFPIVQGCVYPDLRKQSAEYIASKDADGNAIGGLAVGEPVDKMYEMIELVNEILPKDKPRYLMGVGTPVNILEGIERGVDMFDCVMPTRNGRNGMLFTKDGIMNMRNKKWEADFSPIEADGASYVDTLYSKAYLRHLFHAQELLAMQIASIHNLAFYLWLVGEARKHIIAGDFSTWKPMMVKRVSTRL

SEQ ID NO: 5630 - protein, 355 aa, B.fragilis
LKSKKQVMKKFFRFQLCCICLLVLIVSACKVKRPDSVISESEMENLLYDYHIAKAMGENMPGGENYKKALYVEAVFKKYGTTEEVFDSSMVWYTRNTKILSEIYEKVNKRLKAQQNAINHLIALRDNKPKMSAPGDSIDVWAWQRIAQLTEAPLNNKFTFTLPSDTNFKKRDVLLWKMQYNFLSEIPDSTMAPIMAMQIVYENDTVTHSCVKHIFKSGIQNIRLQSDTMNIKEIKGFIFCPLSEESITLLVSDISLTRYHANDSITQIGRDSLKTDSIKEKSKDDSIQKKTPKDTIQASSPHQRTNPNDLNRPNNDVRPIKPEQREKEMQIEKEKQQLERQQRTNPRRPLRRQNN

SEQ ID NO: 5631 - protein, 60 aa, B.fragilis
LLINGSRVRVPEGVQKEIINNLLFVFGGILKYCFIFATAKINLMKTTYQFNILVNHLELA

SEQ ID NO: 5632 - protein, 133 aa, B.fragilis
YIPNKQDISLIININFIIMNFDLKAFRKRFGLKQVEVAHLFNCGQSNISDIETGKRGLEEYQTRILFDKYGEEVVKEYLIPESAIHQGNINGDNINGHNVTVNKADFDKLISLLNKRDEQIDRLLRIIENLNK

SEQ ID NO: 5633 - protein, 206 aa, B.fragilis
ERNNIMTLKQAQKLYDDSVQAKMTHADYCMTQSQLEYIGRTMWGFTPDKQAKVLFTKVGKRVSVVIASREAFIKEIGKPVICKCSVCDMYYLAYRKSVDAHDELNAQCPKCDSLGCDSDIVHFETSRKFWLNEKIVKILTPNKDPERVEAMYDSAPEDFPAQYEMLLPDGKRCTDCVRCATCCSVFGQKESATICQWHPSRYSAGE

SEQ ID NO: 5634 - protein, 229 aa, B.fragilis
HSLNSFNHQCLILKRQNMKTPSLILMTIILCNLSIPINAQILTSRQQKEDFDTLYSLLHQVHPDLFVYQTQKEFEKKHDSIYSSLNKERNLSDFYFIVSPFVASVKDGHTNFTIPATQDRITYLNNGGLTLPLRLKIVENKILVDFPLISCSIQENDEIICMNNINSQTILSQLYLLLGAEKGNAIKENQLTSYLSTLLWYKYNWGENMILQLKEEKRYGKNHWMVSAK

SEQ ID NO: 5635 - protein, 158 aa, B.fragilis
HIVNQQNMNTNNIGGVIQADFLFTDEISLFSVINHSAVISLHRPNTWRNLPITYMGVSPDVEADDTQAGTLYKQTLTIRLKRTGLTDSELHILRTINVRGCVVRCKDANGNIRLYGSKEYPLLGTVIEKTGTKASDLSGIEATFSGKGAYPPLPVTEL

SEQ ID NO: 5636 - protein, 80 aa, B.fragilis
KGSKMGTGFTEYEESLIQAICSLYYIQTRTYKQGVFIGMIPKNTRITLNGIYMMKLLNTGNAVYIEVKGGINVLTIIHQQ

SEQ ID NO: 5637 - protein, 202 aa, B.fragilis
IMPKKDTTYDRIERSLFKDRGESALQLSPKEMEIKNRMMLCVSKKMESPLIEDQELVTFLMHGCGGQAEPVSQSQAYRDIGMINRLVGNIQLAAKSWYRYMIVEGGKKAFQLAIDNGDAKGAAAALDKIGKYTRSDKDDDAFDFSQLIPPSFEPSDDVTTLEGIEVIDNLEQRRQELRSLCKDMLTKQATDIQTIEEEDIEE

SEQ ID NO: 5638 - protein, 120 aa, B.fragilis
RTAKMENIFDSAKTIQEKRTILKGLSKPLQILVKEAAIPTVNDGLKAIYAQSGHTELKTLKQWNKEGRSIKKGSHALCLWGAPKKVETTQVEEAQGEDNDPMNFYPICFVFSNLQVYEKQ

SEQ ID NO: 5639 - protein, 64 aa, B.fragilis
IAQNCILYAQCINRTKTYHVSYGYKPIIINTLCDKTAQFTQLHKKGVPFLQGGLVCSGKSCLCP

SEQ ID NO: 5640 - protein, 252 aa, B.fragilis
TIKNTITMKKIILLLALCFTANNFFAQTTDPNQLKNEGNDALNAKNYAVAFEKYSEYLKLTNNQDSVTAYNCGVCADNIKKYKEAADYFDIAIKKNYNLANAYIGKSAAYRDMKNNQEYIATLTEGIKAVPGNATIEKLYAIYYLKEGQKFQQAGNIEKAEENYKHATDVTSKKWKTDALYSLGVLFYNNGADVLRKATPLASSNKEKYASEKAKADAAFKKAVDYLGEAVTLSPNRTEIKQMQDQVKAMIK

SEQ ID NO: 5641 - protein, 122 aa, B.fragilis
NMKKKKETPMHPVVENIRKIIMDKGITQVAASELVGTSASQMSKILNGEVQISIWQISNFATNLGMEIIDVFTYPNKYVKAEDRNDNKEPIEAVLQIKLRKDKKDQVLKLIFGEHNLEILNK

SEQ ID NO: 5642 - protein, 359 aa, B.fragilis
TIRKEGCLMAVYNRIPDRFTNLDIRDTLNAYGGSVGDNSLNYFSAAAHINMWSKRKPVKRNIMFNTEDPNWFRADSGNYGINVPRAADIALLTGTYTYDIPVQGSYNLRVGDFAGYNPEATVPFTTMLPSGLILASGSATVVKLMLKSLDSTYNVVPADIFPSNSYLGCAVTYGNRTLIKTLSVTIFNGGVTLNISDCELLKSDKTGVRIKVFICTSQVPSWQGETTQSYYSLNAEDGFDESTVDIVTPHADVYSFGILGLSIIEARKISLIGTAIINSGSLFQEGRLISRLDNNYYLKSVKVVATRASDGVTVAEKAQSITSSTTPTRLGNDWMAGESVNFRTPVSRSSPGAGGEHVV

SEQ ID NO: 5643 - protein, 83 aa, B.fragilis
TLGNTGFTERQFLNNSFFNLSNYKLKVMSRRRQLEHEVSLAQERIKKAPKDTPKEILKTWEQELVDLELELNNLVDDEEDNNE

SEQ ID NO: 5644 - protein, 331 aa, B.fragilis
NRLKNILSIAQFHQICAMILQKYITLHPQIKLKNKNMKAFVFPGQGAQFVGMGKDLYETSALAKELFEKANDILGYRITDIMFNGTDEDLRQTKVTQPAVFLHSVISALCMGDDFKPEMTAGHSLGEFSALVAAGALSFEDGLKLVYARAMAMQKACEATPSTMAAIIALPDEKVEEICASVTAEGEVCVPANYNCPGQIVISGSVPGIEKACELMKAAGAKRALPLKVGGAFHSPLMDPAKVELEAAINATEFHTPKCPVYQNVDALPHTDPQEIKKNLVAQLTASVRWTQTVKNMVADGATDFTECGPGAVLQGLIKKIDSTVSAHGIA

SEQ ID NO: 5645 - protein, 157 aa, B.fragilis
CIMKNLEILPLSAESKKRIEEFARQYQRYAHIAIEIVSYSEGRLIVRAEQKDLVNDKFLSKKELTERVRDMFKDEIPEDWKLTVSAVNFDRKDIDGITLDWIKKRMERLGLKNKHLSNYTGIDKCTVSSILSGDKELTKWHKVALYYFFKYYEVANF

SEQ ID NO: 5646 - protein, 111 aa, B.fragilis
HTMNLSSFKLTNINELISVYKENPERFNRFYNAVYLLLDGIPECGSIRVMDHCEASSYDLFIKCACWIIQEETEQKELTDALLEFSDDYTIIRRCAKFVKSKSWVHFYSRR

SEQ ID NO: 5647 - protein, 439 aa, B.fragilis
KNMKIAIVGTGYVGLVTGTCFAEIGVDVTCVDTNSEKIEALKKGIIPIYENGLEEMVIRNTKAGRLKFTTSLESCLDDVEVVFSAVGTPPDEDGSADLSYVLAVARTIGQNMKKYKLVVTKSTVPVGTACKVRNAIQEELDKRGAKIEFDVASNPEFLKEGNAVNDFMSPDRVVIGVESERAEKLMTKLYKPFMLNNFRVIFMDIPSAEMTKYAANSMLATRISFMNDIANLCELVGADVNMVRSGIGSDTRIGRKFLYPGIGYGGSCFPKDVKALIKTAEQNGYQMRVLQAVEEVNENQKSLLFDKLVKQYNGNLEGKTVALWGLAFKPETDDMREAPALVLIDKLLKAGCKVRAYDPAAANECKRRIGETIYYARDMYDAVLDADALMLVTEWKEFRLPSWAVVKKTMSQQVVMDGRNIYDKKEMEEQGFIYHCIGK

SEQ ID NO: 5648 - protein, 166 aa, B.fragilis
NKMKNVSSAKSAEAKAVVLSNVANKKNETAPLIVLPSLPTEKEETKEQVSAKVETPVQTSKKESSSVVAAPNKRLSIDELTDKAERVYLLRQKYQEVREKRKQLESFTISHDKNNAQLTLVDAKGLSISTSNPVAIGKLLSDWMLDLNNHLAKTEEEIRSELERLN

SEQ ID NO: 5649 - protein, 82 aa, B.fragilis
KEMNSDGNKILDAIKRMAADDNKGLRMTTTIVDVKDDPLGSIVGFGTEKVCGDDAFAQTMGLPGKYMACAFFIDREELKKYL

SEQ ID NO: 5650 - protein, 174 aa, B.fragilis
LKPNYMRHVKWIFVVLLISSLTSFVEKDKPTGGLNVGDVAPDFTIESTSDAQYNFDLTDLKGKYVLLSFWASYDAQSRMQNASLSNALRSTSQDVEMVSVSFDEYQSVFQETIRKDQIVTPTCFAETKGESSGLFKKYRLNRGFTNYLLDGNGVIIAKNISAAELSAYANKIKG

SEQ ID NO: 5651 - protein, 187 aa, B.fragilis
YHQKRMNYIQTEIDGVWIIEPKIFFDPRGYFMEAFKQQEFDATIGQINFIQDNESQSSFGTLRGLHYQKGAYSQAKLVRVIKGEVLDVAVDLRKSSPTFGKHISVLLSDENKRQLFIPRGFAHGFLVKSEIAIFTYKVDNIYAPQSEASILYNDPALAIDWPIADSQLVMSEKDKQAGAFREAEYFE

SEQ ID NO: 5652 - protein, 206 aa, B.fragilis
GDKNMESKFHELKNRLLKNIDQTSESRLYMDIQLAQNCETLMSIIKKDIGYLAKEGILSPGIAEDFKDVFLSAGIKCNSGGSSGYMLIWDGTAVDISGTATAVIWKSERAFIKGRACAFLLGEVSAITCERSMVIAAGSSTILAEGDSVVGVSGYHASVKASDYATVVNMNCPNIDLRDNTRLWLPARGSFAARKNCDIIIKNKEE

SEQ ID NO: 5653 - protein, 74 aa, B.fragilis
PKKKEGKPMFKDIIELDKQVVDRIVDKVHENNLEIEMEMGVVKDGMVKVLFLYKDPELLQSVINESVTEEYDLP

SEQ ID NO: 5654 - protein, 228 aa, B.fragilis
TEKNDTMSNIPVIFRFLKDLTANNNREWFNEHREEYEIARLEFENFLSTVIARISLFDESIRGIQPKECTYRIYRDTRFSSDKTPYKNHFGGYINAKGKKSYHSGYYIHIQPEGCMLAGGSLCLPSNILKALRQSIYDNIDEYRSIVEDPEFQQFFPIVGEDFLKTAPKGFPKDFKYIDYLKPKEFTCAYSVPDSFFLTPDILDKIEEVFRQFKRFADFTNFTIDDFE

SEQ ID NO: 5655 - protein, 113 aa, B.fragilis
LRENMKRFAAHYLFVPGSGFLKQYAIEIEGGYICHIFPFSEEIESVEWFPGVILLTPQEESDINTLFNFTNIEKQSIYIPKVTIDMKWRAYLLYPFNFVTMQPVAETLHRQLQ

SEQ ID NO: 5656 - protein, 357 aa, B.fragilis
RERKDMEIIKTGLAAFGMSGQVFHAPFISTNPHFELYKIVERSKELSKERYPQASIVRSFKELTEDPEIDLIVVNTPDNTHYEYAGMALEAGKNVVVEKPFTSTTKQGEELIALAKKKGLMLSVYQNRRWDADFLTVRDILAKSLLGRLVEYESTFARYRNFIKPNTWKETGESGGGLTYNLGSHLIDQAIQLFGMPEAVFADLGILREGGKVDDYFIIHLLHPSLAPNVKITLKASYLMREAEPRFALHGTLGSYVKYGVDKQEAALLAGEIPERPNWGEESEQEWGLLHTEINGKEICRKYPGIAGNYGGFYQNIYEHLCLGQPLETHAQDILNVIRIIEAAYQSHRDNKIVNLK

SEQ ID NO: 5657 - protein, 181 aa, B.fragilis
IINLNMTAKFIIMVLVLAYIMVIIAISIYLIKIICTRYNQNSDQILPPPNMHSIQESASMHLVRIGQLPHPGPGYCYYELGGMRYQALTGFDIGVHEGYAKAELNNRYDKYAVGVYREGDHKLMGYVRREQNRELYEFMLNNNCIAKAKFRIWIHQGEIYGAAYIKEEWKSSLGFKSDIKI

SEQ ID NO: 5658 - protein, 174 aa, B.fragilis
KLIEMLNEKRTQRIMKSKFLIFLSAVAMLLLFSNCGSKTTSNDQATTEVKDTVTSKEEAVPDSVSILGDQVYDIVNTAPEFPGGMKACLEFLYKNITYPAQAIESKQEGQVVIQFVVTKNGKIIDPKVVKSVSPSLDAEAIRIINLMPDWTPGKQKNGQEVNSRFTLPVRFTLK

SEQ ID NO: 5659 - protein, 145 aa, B.fragilis
TMYDIVAQRLRLFLAKKDITCKKLSAMIFMSEATLKGKLNGTRTLDLNTIISIAIRLEDLSVEWLLRGEGDMFKSSSGVSILSSSVPIFTGETSFIYSMYKEEREEVKTLLKQNGILEERIRQLEDDNRLLRDQVVTELNLNTKL

SEQ ID NO: 5660 - protein, 122 aa, B.fragilis
KMHDIVTQRLNQFLVEKNITYKELSGMILMSETSLCRKLTGSRSLDLHTLISIVACLPDVSSEWLLRGKGRVCNSSSSISSDVLVEELKMENNLLKRKIQVLQELLEFKMEKIRAENGNIKK

SEQ ID NO: 5661 - protein, 303 aa, B.fragilis
QKSDHYVSSLLYSVFIYHMVRKSSINKYELDVRKGLQELFDKCRHNMKHSGDLLLCQQNGFIDYKGRPCVGLGDEGLNCMQQVNFISFNGIGNITDDNDYYKKEGNNFFYGNSEFEADIMRQHITYMNIWENSYFLRVFTQVVNVLNGLNYNWNLTFKNLKPNQKSEQIREGIIKLLDLSPNFQRILKDAYVGQIRNAVAHTQYHCIQGGILYDNYSPSSKYSILQGLSYEEWEKKYVYSFFIFIGIFQMLKQITNEFYLPCSQLTFAKGVPIQIPLSDNKGYAETYLYPNQKGDIWRFTRII

SEQ ID NO: 5662 - protein, 70 aa, B.fragilis
AYRLNEKQLSMYIHHLMVKDHKRKYYYLSYEKRFIFIINLVSAKLQNSNGLKKKKQSNSSALICFYRNMA

SEQ ID NO: 5663 - protein, 81 aa, B.fragilis
RWRETSVNNFSSLQSCFINVNEIKVRFGGAPGLVMTKSWRDGYRPCEDAMSLKESLASIGMTTVKVPFGESKFDTPFSNSS

SEQ ID NO: 5664 - protein, 69 aa, B.fragilis
SKLFARLLTLIHLKVGSSTPFSLLLKGVKLPTMVCYASGLPDSQEVHVSQKDVYAAFGRYLLRFAFNVE

SEQ ID NO: 5665 - protein, 71 aa, B.fragilis
YKMELETIGENAGKVWRTLNEMRGEISIQELSRKINLSAEDVALAVGWLARENNIFIQRHNYLLYVSHDAF

SEQ ID NO: 5666 - protein, 268 aa, B.fragilis
MKMENSVLTGKPYNIGYALSGGFIKGFAHLGVIQALLEHDIKPDIISGVSAGALAGVFYADGNEPYRVLDYFSGHKFQDLTKLVIPKVGLFALGEFIDFLKSNLKAQKLEDLKLPLIITATDLDHGRSMHFHKGNIAERVAASCCMPVLFTPVKIGNTHYVDGGLLMNLPVSTIRNECEKVVAVNVSPLMAEKYKMNIVSIAMRSYHFMFRANTFPERDNCDLLIEPYNLEGYSNTELEKAEEIFEQGYNTASEVLDQLIEEKGKIWK

SEQ ID NO: 5667 - protein, 406 aa, B.fragilis
RDADSLQLFCQHFCYNWIINLFYPMKVHEYQAKEIFSTYGIPVERHALCHTADGAVAAYHRMGVNRVAIKAQVLTGGRGKAGGVKLANNDRDVYQYAQTILEMTIKGYPVTKILLSEAVNIAAEYYISFTIDRNTRSVTLIMSAAGGMDIEEVARQSPEKIIRCSIDPLIGVPDYLAHKFAFSLFEQAEQANRMATIIQDLYKAFIEKDASLAEINPLVLTPVGTLLAIDAKMVFDDNALYRHPDLQKLSEPTEDEKLEAIAKERGFSYVRMDGEIGCMVNGAGLAMTTMDMIKLYGGNPANFLDIGGSSNPVKVIEAMRLLLDDKKVKVVFINIFGGITRCDDVAIGLLQAFEQIQTDIPIIVRLTGTNGNMGRELLRKNNRFQVAQTMEEATKMAIESLKKESI

SEQ ID NO: 5668 - protein, 480 aa, B.fragilis
HQSLFLMKKKQPEPQLFQKGYETYAVTKGGKGIIKFSDNSDITTDRETSTVEVVPKGKEAPIKFVPRGRNNNMMYDIMKKIGANVTVGSNVEFKNKVVYGDSVLVYRKYRDKETRKIIKEEVLPEEYPDIFDFIENNDIPFIRMEIANDLVIFYDAYVEYIFNQDTQPRLVQVKAKEATCSRISVIDERTGKSEYHGYSAKWHEGMPDDVIATPLLDRQAPLRDLKTRMGLFPNEKGIKEIVKDRRFIHNIRIATPGRFYYSKPYWWSVFVSGWYDFGNAIPIFKKALIKNQMALRYIVYIKEDFWGKLYADEKITNEADQAVRRETFLQDMNDFLAGEENAGKGFVSHFRYDRVKGFEDKDIIINTLDSFFKGGEYIEDSEEVSNTICYGMNVHPSIIGAAPGKGKSINGTEARELFIIEQALMKMFQEATLTPLYFAKAVNGWPKDIYFSVTNCQLTTLDKGTGATKNTGLTSETEEK

SEQ ID NO: 5669 - protein, 214 aa, B.fragilis
SNILGGLTMGYYKRLSTYRAEVKRYNASRRKATQLTNAPASGLIRLETVSETERFSMAQDADRLTAYNKAVEKWQDSVARQLRAGIAGRSMRIARELEPRAYTDKYGIINRLGFSFPRHGIYIHKGAGEGQGGFIGSKWNYLKKINGVEIDTGIVRHTNLKSLGRQNEGNRRAYEWFDPVIRNRINELADIVTDYFDTMLIDATRIYIDKRNSL

SEQ ID NO: 5670 - protein, 733 aa, B.fragilis
HMSLKIKNQLGIFDLQNDFSIEIEDTSPIYNERGSQSVPATLPASRNNLSLITHVHRPDSTYSPAPDARVTVSDGVYNRIGKMNITQASKSGGIVSNIGFDESELYSEWNAVSLRSLSAPVIRPEGGTTGVISLLNSIMNETIVDDALSIFPICVSIPSHATTVDDTETTTYYPEYINKITKLENGTYSLQGAARQETFLINNEPVLTSVPEGYAISPFLKVSWILNFIFVRYGYTVLENPFSTHRQLSRLVVLNNMADSIVKGFIDYSDLLPDCTINEFLQALYCRFGMVYFVDGKNKTVNLKFIKDIISTPASLNWSLLKSARPAINYAAAQQLKLSASTNISGPYTNLVATPTADSLDKFLKTFGHVLSSNTAKGYLTYSLWDGFYYVRNNLTGVREARSSDFFPWDKGANISYMEISSIDECLPMKGSYPDDQPVCPAYLLGKVHKYTNISSASVELSEEQNTQTPLCFCFSMPRASTPYPYGSPRCYTPGGEAIAINGHTFDISMTFTGDNGLFSRFWKGFDAILRHSNHTVEVPVHLNPIQLLNIDFSQTINIDGQRLLLDTVRYTLPKLLSRPATIRLRTLRLLIPVGETDLDLDAEQGIQTIEQLYKWAFHNNRENIVELKIRAQVEEWKKAITPPAQWLGVLRKNEVSDQVSDIEIPFTVPTQEDYEANKEFFIKEINYSFDLYYKVRVPNGQTSQGDIIWKDKEYGGVHYAITYGLSVKAELL

SEQ ID NO: 5671 - protein, 73 aa, B.fragilis
QFPLLPLARLINLIFIILFFLMQIAGNFYGKLSANIHKKGNNQTLVFFFLSMKSVIFAKISKAIAATKPIAAK

SEQ ID NO: 5672 - protein, 149 aa, B.fragilis
KYKLMIYKFLFPLKPDSAGASLFLLILRISFGLLLMNHGIQKWSNFQELSISFPDPLGLGSPLSLGLAVFAELACSMAFIIGFLYRLAMIPMIFTMVIAFFVIHANDVFAMKELALVYLIIFVLMYISGPGKYSVDYVIGRQLKNKRKL

SEQ ID NO: 5673 - protein, 79 aa, B.fragilis
FEICMTYNTGIYLNSINFFEVIPFGTDEATLTFAGALVDVDSMSREGETKTVDNTVFVGVGPWLKFTGYSHTAAGYSGS

SEQ ID NO: 5674 - protein, 221 aa, B.fragilis
LVTCITDSLTKMKKLLTKGQIAILVIFSVLIIDQVIKIWIKTHMYWHESIRITDWFYIYFTENNGMAFGMELFGKLFLTTFRIVAVGLIGWYLYKIVKRGLKTGYIICVSLILTGALGNIIDSVFYGVIFNESTHSQIASFMPDGGGYSTWFYGKVVDMFYFPIIDTNWPTWMPFVGGEHFIFFSPIFNFADAAISCGIIALLLFYSKYLNDSYHHSVTKK

SEQ ID NO: 5675 - protein, 334 aa, B.fragilis
PYHCNKISAMSQKRIILSDSSLNRYGYRVLTAGLLLEAFIDNPVMLYGHFRDEGSPLWCDYKAIGYWDDIKIEDDVLSAIPVFDKVDDLSKTIAAKYEAGTLRAASIGIRILATSSEKEYLLPGQTRETVTKAEVMEASIVDIPANSHAVRLYDRSSSVLLAAGMDTNIVPALTIPKEKAMNYKPSWTGFLSFLGISKDKAETTELSAENLDSIHAEMERLKTENATLVQAKTDIEEKLNSANAKITELNGSTSGKDNEISTLKNSITEKDSKITQLEEQVKNLKNGPTPGHAGLTPEQEPEGSGTQEELSAFCDQNAGNYQAITEKLKAEGLY

SEQ ID NO: 5676 - protein, 468 aa, B.fragilis
LKECTMKKSTKFIIALLVTVGALAITYRVVNQAPSKDLAADAQMQEIITSGGCLQCHSGSPDLPFYANWPVASGMVQKDVTQGYRAFDMTEMAEALKAGKPVGKVALAKVEKVIMDGTMPKHAYYMVHWGSSVTDAKKEMAMAWVKQHRLAHYANGLAAAEFANEPIRPIADSIPVDMRKVILGDMLYHDTRLSADNTVSCASCHGLNTGGVDNKQYSEGVGGQFGGVNAPTVYNAAYNFVQFWDGRAGTLAEQAAGPPLNPVEMACQSFDEIIAKLEQDANFTKAFLAVYPDGYSEQNITNAIEEFEKTLLTPNSRFDLYLKGEKTAINDIELAGYELFKKYDCATCHVGETLGGQSYELMGVKRDYFADRGIELTEEDNGRFKQTRNERDKHRFKVPGLRNIALTAPYFHDGSMKTMKEAVDYMAKYQMDLNLPEDELNKIVAFLETLTGEYKGKPLTNDNQTKAL

SEQ ID NO: 5677 - protein, 63 aa, B.fragilis
VTTCSPPAPGEDLETGVLKLTDSPAIQSFPKRVGVVEDVMLCAFSATVTPSLARVATTFTDFK

SEQ ID NO: 5678 - protein, 262 aa, B.fragilis
ISIRFVLYSQICRYMKNSDLTTYGEYLEKLSPKHGREKVFNDFLQIVVCCLSMGRKEELYFKTIKPYDKTELDLFSQAFAALVMQMDRQPLVDPFGDYFQEFLSNAQNGQFFTPFGVCELMNQLITAPKVNDQPKQGDRRVLDPACGSGRLLLSAAQKDRALTFVGIDISYTCCLMTIINLCLNSLNGEVLHMNALTDQCWHRWLIIVDSVTKIPTVYEVEAGIINQPPACADDLKPLPVTGIIQPVKNMIPANFVRYTPKC

SEQ ID NO: 5679 - protein, 121 aa, B.fragilis
RNLRPIRVSEPIPLRTIFTSAPTNSHRLAMSFMKLIRVANIEFAAYLVISAEGISMNITRKLFSMNGLYSLVINFSARSDSTPITTRSGLIKSLTALPSFRNSGLEATSNSILAPRLSNSS

SEQ ID NO: 5680 - protein, 300 aa, B.fragilis
NGYRIIKERIDMSILIDKSTRLLVQGITGRDGLFHAKKMAEYGTNVVGGTSPGKGGTMIDDTFPVFNTMHEAVRRTQANTSVIFVPARFAADAIMEAADAGIRLIICITEGIPTLDVIKAYRFVELKGAKLIGPNCPGLISPGESLVGILPGQVFTPGNIGVISRSGTLTYEIVSHLTAKGMGQSTAIGMGGDPVVGLYFRDLLGMLQNDPQTDAIVMIGEIGGNAEELAATYIREHVTKPVVAFIAGRSAPPGKQMGHAGAIISGSSGSATEKISALEAAGIRVAGEPSEIPDLLKGSF

SEQ ID NO: 5681 - protein, 586 aa, B.fragilis
SKRLIKAIEIIKLSILNSIYKMKNENKMIIYQVFTRLFGNNNNHCIYNGDISQNGCGKMADFTAKALGEIKKLGATHIWYTGIIEHASQTDYRRYNIRPDHPAIVKGKAGSPYAIKDYYDVDPDLATDVPGRMKEFENLVSRTHRAGLKVIIDFVPNHVARQYHSDAQPDGTTQLGANDDPNYSFSPYNNFYYIPQSELHGQFDMTGNALEPYHEFPAKATGNNRFDAYPNINDWYETVKLNYGVDYQNGGTCHFSPTPDTWTKMLDILLFWSSKNIDGFRCDMAEMVPVEFWEWAIPQVKQEYPNIIFIAEVYNPHEYKNYLFRGKFDFLYDKVGLYDTLRNVACGYDSATAITRSWQSLGGIEKRMLNFLENHDEQRIASDFFAGDPRKGVPALIVSACMNTNPMMIYFGQEFGEMGMDSEGFSGRDGRTTIFDYWSVDTIRRWRNEGKFDGKMLTEEQKHLYAIYQRVLTLCNEEQAISNGVFFDLMYANENGWRFNEHKQYTFMRKYKNELLFIVVNFDNQPVNVAINVPSHAFDFLQIPQFDSYKAVDLLTDKVEEISLLPYKATEIALGAYTGKILKIKF

SEQ ID NO: 5682 - protein, 64 aa, B.fragilis
CNIRRFHDDFMLNTLSQFITSNKRDGTRYMPFAFIELGVAMLSSILNSEVVIEINKRLYRRSVY

SEQ ID NO: 5683 - protein, 258 aa, B.fragilis
FQSRSMCSEPDTFVQTLKNIKMKKVIIIGATSGIGKGLAERFLREGNTVGITGRREDKLQEICSQNKNCFYSVSDVTKDTDTVRQLSNLVNRVGGMDILIFCSGIGELNPELDYLLEKPTLLTNVIGFTNVVDWAFHFFQKQEWGHLIVISSVGGMRGEGIAPAYNASKAYQINYTEGLRKKTAKLPYPIYITDVRPGFVDTAMAKGEGLFWITPLDKAVQQIYRAILRRRKVAYVSKRWKYVALLLRMIPASIYCKM

SEQ ID NO: 5684 - protein, 472 aa, B.fragilis
KHKRMKNFMDKNFLLQTETAQELYHNHAAKMPIIDYHCHLNPQMVADDYRFKSLTEIWLGGDHYKWRAMRSNGVDECFCTGKETSDWEKFEKWAETVPYTFRNPLYHWTHLELKTAFGIDKVLNPKTAREIYDECNEKLSSQEYSARGMMRRYHVETVCTTDDPIDSLEYHIRTRESGFEIKMLPTWRPDKVMAVEVPSDFRTYIEKLSEISEITISDYNDMILALRKRHDYFAEQGCKLSDHGIEEFYAEDYTEGEIKTIFNKIYGGSELTKEEVLKFKSAMLIVLGEMDWEKGWTQQFHYGAIRNNNSRMFKLLGPDTGFDSIGEFATAKAMSKFLDRLNSKGKLTKTILYNLNPCANEVIATMIGNFQDGSIPGKIQFGSGWWFLDQKDGMERQLNALSLLGLLSRFVGMLTDSRSFLSYPRHEYFRRTLCNLLGCDVENGEIPLSEMERVCQMVEDISYFNAKNFFHF

SEQ ID NO: 5685 - protein, 257 aa, B.fragilis
SGGRDSYLPLHKLNNYLIMKRFILCISCLLICCLFLLPEVQAAIPDTGNWISHHLLTSDGLTVLAAGPAFAPLKWNIGQNNMGGYKGRLLFIPYDAPSTVPMIPAKPTTNEDLITASGSFTFPSGGTYTQPIYLYSTKGKVGYKAEIQGETDGKSFKQTLEFFFPGNTPGMHAFSTLVKNTPGYFVFEDSDGQQFLMGKPGMYADVSPSFDGGKLAADQRGTAYTATCDANESAVVLGTPIDMEVIAGLKPAPSPGG

SEQ ID NO: 5686 - protein, 130 aa, B.fragilis
IIMSLNDRLRIVVNEFFHGNKAAFARAAKISDQRAYSCLSVRSNTEPPARVLENLAKYLPNLNATWLLTGEGEMIQDKSTPEMPITLVSVNEYKSRLQQMEVRLEALRAQVVLKDKLLAGLLRKVENKTK

SEQ ID NO: 5687 - protein, 198 aa, B.fragilis
NNMSPRKLMFWLFACIFLVCALRAGLLTSADQYIYHLRNMHASTFAYRYDDFLPYLPIVAMFVLKLTGVKSRSNWKRMLVSTAFSYILMGAIVLTMKSLAGVLRPDGSDFLSFPSGHTATAFTAATLLYKEYGFKTPLAGIATFLPAVVTGFTRQLNNRHWLSDVLAGAIIGIMMVELAYFLTDRLLMKTGAQTCSKS

SEQ ID NO: 5688 - protein, 532 aa, B.fragilis
KLSGYKDKAYLCNVFLIQVTMDYPHKINKVQIRNLQIEDYAQLSQSFTRVYSDGSDVFWTHEQIEKLIKIFPEGQIVTVVDEKIVGCALSIIVEYDKVKNDHTYAQVTGKETFNTHSPQGNILYGIEVFIHPEYRGLRLARRMYEYRKELCETLNLKAIMFGGRIPNYHKYADKMRPKEYIDRVRQREIYDPVLTFQLSNDFHVRKVMTNYLPNDEESKHYACLLQWDNIYYQPPTQEYLAPKTTVRVGLVQWQMRSYKTLDDLFEQVEFFVDAVSDYKSDFVLFPEYFNAPLMSKYNDKGESQAIRGLAQYTEEIRDRFINLAISYNINIITGSMPLIKEDGLLYNAGFLCRRDGTYEMYEKLHVTPDEIKSWGLSGGKQLKTFDTDCAKIGILICYDVEFPELSRLMADQGMQILFVPFLTDTQNAYSRVRVCAQARAIENECFVVIAGSVGNLPRVHNMDIQYAQSGVFTPCDFAFPTDGKRAEATPNTEMILVSDVDLDLLNELHTYGSVRNLKDRRNDVYEVRFKKP

SEQ ID NO: 5689 - protein, 139 aa, B.fragilis
KLLGNYRDQIMNRNAILSKRQKQFIERIAWGASYKEVADFFHVSWSTVDNTLRNAKTKLGLSKVTELGAWWFCTNYGISFDLSPIARQCTAGVILLLFSLGEVTTVTNISYTMQRVRRPRTEYRIRRHETSIYQPYIIN

SEQ ID NO: 5690 - protein, 430 aa, B.fragilis
VFQGGILFFLLLYRCNREIISFFIKLIMNNWKKKFIIIWTGQLFSILSSSIAQFSIVLWISLKTGSAEVLSFATIAALLPQALLGPFAGVFVDRWNRKWTMIGADSFVALCSGVIALLFYLDIIELWHIYLLLMLRSVGGAFHTPAMKSSVPLLAPEKELMRIAGINQAIQSICNIGGPALGAILLLAFDMSLVMLLDVLGAIIACTALLFVYIPNPKQENTSAKNVLYDMRDGFNVIMRNKGVSWVMVTEVLVTFFVMPMVALMPLMTLKNFSGTAYQVSLIETLFGAGMLAGGALLGVWNPKIRKTLLIAISYFLLGAALAFCGILPADGFVLFAALTVAQGIVVPFFSGPFTSLLQTQFKPAYLGRVFSLFDSVSLLPSIIGLFITGFIADSLGIANIFICCGIAIVFTSILMMCIPAVRDLEKQSK

SEQ ID NO: 5691 - protein, 131 aa, B.fragilis
EYIIPIYYPIKIRLLFDIHNIIMIKKENKIFVVISPDPVEREQLIARLAVRLGFAKIPSDALKIISKDIYSFDLATAYFVLCSNYHFRGSIVTTQRLYELAARGICVCVGVKSLPREYELLSQVFYPNDLR

SEQ ID NO: 5692 - protein, 431 aa, B.fragilis
TLTIKKSIQMAANKLIDVSKLNEALVIYDQALRALPFATLTEVANLLKLNVMDLQGKHARINERRRAGGTQSYKIGKNFGLVDKLLGYEPSVIEPKDVVCITKENSQKYDDNELLIIGGTPVSNTTKKHPMETKVAFTLVRSHLEDIVYSLFSAERDEDSNSPGGAFDGIYTKMDMLITRGDVNAARGNFSISGEFAAPTSDTDYTAYENLVEWIGGANTYLRSSIGGVPQLLCAETVLKAARSALRNKLRMQEYPSMQRMLELLREDAMCPNLIVSSHEALGQGSRLTLQKVGNIDVAFNTQAASKFCQIRDIYEDPNEWQFWLQAGYDTRINDWHEKVFRCNEQKNESLDLAGDYCKTGGVQVAITGTDKGQWSIQGKVAKRGNGQCIIGLPPGKYTIEFTDADGKTKPANTQVTVVAGEVATATGAYT

SEQ ID NO: 5693 - protein, 115 aa, B.fragilis
VLYIMEQLFEAILAIAKQNPDGFTVDLTTLKKVTKGISVAYLETQDSFGEEGLKRVLNHAEMHEKKVGGWLNEENQEFYFDSVRIFTNLEEAKRFGCENKQIAIFDISHMRLIKL

SEQ ID NO: 5694 - protein, 255 aa, B.fragilis
YLYICSNQRLNIMHDIPKQIPLANNHISVDCVVIGFDGEQLKVLLINRIGEENGKVYRDMKLPGSLIYMDEDLDEAAQRVLFELTGIRNVNLMQFKAFGSKNRTSNPKDVHWLERAMQSKVERIVTIAYLSMVKIDRALDKNLDEFQACWVALKDIKTLAFDHNLIIREALTYIRQFVEFNPSMLFDLLPRKFTASQLRILFELVYDKAVDVRNFHKKIALMDYVVPLEEKQTGVAHRAARYYKFDRKIYNKTRR

SEQ ID NO: 5695 - protein, 773 aa, B.fragilis
KPYMKKGILYTILLYLALSLASCSATKFVPDGSYLLDEVKIHTDNKEIKPSDMRLYVRQNPNSKWFSTIKTQLYVYNWSGRDSTKWFNRFLRKIGDAPVIYNESDAIRSQEEIAKAVQNLGYMGASVKRTTKTKKKKLKLFYEITSGKPYIVRTLKYDISDKKIAEYLRNDSTQSMLREGMLFDVNVLDAERQRITDYLLCNGYYKFNKDYITYTADTARNTHQVDLTLHLLPYKTYVGDTPKEHFQYKINKINFITDYDVLQSSALSSIEINDSLHYNGFPIYYKDKLYLRPKVLVDNLRFASGDLYDERNVQKTYTYFGRLSALKYTNIRFFETQNGDSTQLNCYVMLTKSKHKSISFELEGTNSAGDLGAAASVSFQHRNLFRGSETFMVKFRGAYEAISGLQPGYKNHNYTEYGVETSINFPNFLFPFLTSDFKRRIKATTEFGLQYNYQLRPEFSRTIASASWSYKWIQKQKIQHRIDLLDISYLYLPWISSQFQEDYINKDKDNYILKYNYENRLIVRMGYNYSYNSAGGTLVNNTITTNSYSIRAGFESAGNILYGISKMINMRKNKDGEYAILGIPYAQYLKGDFDFAKNIIIDHRNSLAFHAGIGIAVPYGNAKVVPFEKRYFSGGANSVRGWSVRNLGPGSFAGDGNFMNQSGDIKLDASIEYRTRLFWKFRGAAFIDAGNIWTIREYENQPGGVFEFDKFYKQIAVAYGLGLRLDLDFFVLRFDGGMKAINPKYKKAKERYPIIHPRFSRDFAFHFAVGYPF

SEQ ID NO: 5696 - protein, 88 aa, B.fragilis
HYRIMPSDRIHQSKVWELMEQRKEGKPIEFSIEFCKKSTGELITYERAVLSSFHSSGSTVNILQIGEYAPRKIRRCLITRFNNIKVYF

SEQ ID NO: 5697 - protein, 509 aa, B.fragilis
YLLIISPYFTVCRLLLPADRNSKKANAMNHTNEGSKLYLYSITSVAILGGLLFGYDTAVISGAEKGLEAFFLTATDFQYDKVMHGITSSSALIGCVLGGALSGIFASRLGRRNSLRLAAVLFFLSALGSYYPEFLFFEYGKANMNLLITFNLYRILGGIGVGLASAVCPMYIAEIAPSNIRGTLVSCNQFAIIFGMLVVYFVNYLILGDHQNPVILKDAAGTLSVSSESDMWTVTEGWRYMFGSEAFPAAFFGMLLFFVPKTPRYLVMIDQDQKAYSILKKVNGATKAQEILAEIKATSQEKTEKLFTYGAAVIVIGILLSVFQQAIGINAVLYYAPRIFENAGAEGGGMMQTVIMGIVNIVFTLIAIFTVDRFGRKPLLIIGSVGMAVGAFAVALCDSMGIKGILPVLSVIVYAAFFMMSWGPICWVLISEIFPNTIRGKAVAIAVAFQWIFNYIVSSTFPALYDFSPMFAYSLYGIICVIAALFVWRWVPETKGKTLEDMSKLWKRR

SEQ ID NO: 5698 - protein, 196 aa, B.fragilis
NYVMDEEVKGFNRYMSKVDFQPVTEFIFQNGQLTDYKKGEFFSRQNESCKMVGYVTEGSFRYCCTDSRGGSKIVGYTFDHSFVGNYPAFRLGDNSNVDIQAICNCSVYVINNRQLEEFYSRNEANQKLGRQIAEILLWEVYERMISLYSMTPEERYTEILKRCPELLNLISLKELASYLMICPETLSRLRRKLVQK

SEQ ID NO: 5699 - protein, 67 aa, B.fragilis
DLRMAYRWQIMKNETAFSMAGIYDIGVDKESGKQHATFSIITIVTDPLTDYIHNTKYRMPVIFVIQR

SEQ ID NO: 5700 - protein, 319 aa, B.fragilis
YKLIALLYVYWHIFTYFAPYKGTTMHKKLLVTAYFVIAALLQTLAGNFPLSFFAFPLNVIVAVIWIYSLWRLYKEGNKLPLTRFLLSSRTSVLSILLLIGGSLVIGLFPQLSEAEADSMPGVLASLGCYNFMTSWIFIAILFLLLSNLAMVIIHAFYHCVPAKKRFILNHLGLWLALFAGFFGSSDVQTLRIPLYTGQPGREAYSMDGKAYYLDYELELYSFNTEYYPNGMPSRFAADVRIGNRRTTLEVNHPHCYRLGEDIYLTGYDTRNMGNTRYCILQIVRQPWKYVMVVGILMMLTGAVLLFINGPKKLKHDNLG

SEQ ID NO: 5701 - protein, 119 aa, B.fragilis
FKSIKEMNKSYFETRKTEIQSEIDSWKQGLRDLEDEYISSNQKFPIGSKVCITTPAHEGWALSTREKITFPERKRYSYVTGYEICHNEVVPILMKAKKDGTISKIRDYITLERVIVELA

SEQ ID NO: 5702 - protein, 71 aa, B.fragilis
FPPILYVIPLNVSNMEKVLQCVRLPQNGKGTIGFNLKGEYLKKYGFQLGDKVKVEISKNKIVLFKTGNVLE

SEQ ID NO: 5703 - protein, 1149 aa, B.fragilis
YSKIVNIAMSKKFAEYSQFDLSKVNKDVLKKWDENQVFAKSMTEREGCPSFVFFEGPPSANGMPGIHHVMARSIKDIFCRYKTMKGYQVKRKAGWDTHGLPVELGVEKSLGITKEDIGKTISVAEYNAHCRQDVMKFTKEWEDLTHKMGYWVDMKHPYITYDNRYIETLWWLLKQLYKKGLLYKGYTIQPYSPAAGTGLSSHELNQPGCYRDVKDTTVVAQFKMKNPKPEMAQWGTPYFLAWTTTPWTLPSNTALCVGPKIDYVAVQSYNAYTGQPITVVLAKALLNAHFNPKAAELKLEDYKAGDKLVPFKVIAEYKGPDLVGMEYEQLIPWVNPGEGAFRVILGDYVTTEDGTGIVHIAPTFGADDAQVAKAAGIPPLQLVNKKGELRPMVDLTGKFYTLDELDEDFIKQRVNVDLYKEYAGRFVKNAYDPNLSDQDESLDVSICMMMKVNNQAFKIEKHVHNYPHCWRTDKPVLYYPLDSWFIRSTACKERMIELNKTINWKPESTGTGRFGKWLENLNDWNLSRSRYWGTPLPIWRTEDNSDEKCIESVEELYNEIEKSVAAGYMQSNPYKDKGFVPGEYNEENYNKIDLHRPYVDDIILVSKDGKPMKREADLIDVWFDSGAMPYAQIHYPFENKELLDSHQVYPADFIAEGVDQTRGWFFTLHAIATMVFDSVSYKAVISNGLVLDKNGNKMSKRLGNAVDPFSTIEQYGSDPLRWYMITNSSPWDNLKFDVDGIEEVRRKFFGTLYNTYSFFALYANVDGFEYKEADLPMNERPEIDRWILSVLNTLVKEVDTCYNEYEPTKAGRLISDFVNDNLSNWYVRLNRKRFWGGGFTQDKLSAYQTLYTCLETVAKLMAPIAPFYADRLYSDLIGVTGRDNVVSVHLAKFPEYNEKMVDKELEAQMQMAQDVTSMVLALRRKVNIKVRQPLQCIMIPVVDEVQKAHIEAVKVLIMSEVNVKEIKFVDGAAGVLVKKVKCDFKKLGPKFGKQMKAVAAAVAEMSQEAIAELEKNGKYTFDLGGAEAVIESADVEIFSEDIPGWLVANEGKLTVALEVTVTDELRREGIARELVNRIQNIRKSSGFEITDKIKLTLSKNPQTDDAVNEYNSYICNQVLGTSLTLADEVKDGTELNFDDFSLFVNVVKE

SEQ ID NO: 5704 - protein, 181 aa, B.fragilis
RGKISPLSVGRPRTALGKSFASNFFFSLICCPPPQKSSHMRYRSGTLCRFSVLYVSACTQYICNKKAMNEILNYIMVFLFGGGLVGTATAFVTIKYTKKRAEADAMKAMQDVYQEMITDQRSYINSLKQDKEDSEARWENKVETLSKRIETMDLKINENNRLITELKTMKCTDLICQNRKQ

SEQ ID NO: 5705 - protein, 424 aa, B.fragilis
ILGIFPYFCRILNEHSAMQPSKTELILIRITGEDRPGLTASVTEILAKYDATILDIGQADIHNTLSLGILCMTEEQLSGFMMKELLFKASSLGVTIRFYPITEEEYESWVNMQGKNRYILTLLGRKLTARQIAAVTRILAEQDMNIDAIKRLTGRIPLDERKMHTRACIEFSVRGTPRDKEAMQGQLMKLASELEMDFSFQLDNMYRRMRRLICFDMDSTLIETEVIDELAIRAGVGAEVKAITERAMRGEIDFTESFRERVALLKGLDESVMQEIAESLPITEGVDRLMYVLKKYGYKIAILSGGFTYFGQYLQKKYGVDYVYANELEIVDGKLTGRYLGDVVDGKRKAELLRLIAQVEKVDIAQTIAVGDGANDLPMLGVAGLGIAFHAKPKVVANAKQSINTIGLDGVLYFLGFKDSYLNM

SEQ ID NO: 5706 - protein, 78 aa, B.fragilis
MNHFSLITEKPVHKNCTGFFKGNRIFSRLPSGMATHKGYTAPSIYQLCNIYNKTELEVLCSASAHVLTVYFHIYLIIQ

SEQ ID NO: 5707 - protein, 353 aa, B.fragilis
NLYVMNYGISVLFRAIPLAMALFCFGYGAFISAYGDDSNRLVAGPVVFSLGMICIALFATAATIIRQIIHTYGRGSLYALPIIGYLAAVVTIIGGICMFTRSTSTSSFVAGHVVAGVGLITTCIATAATSSTRFSLIPANSKMIGNGIPEGAFTKGQERILKTIAITISLIAWIWAFVLLAKSDVHPAYFVAGHVMVGLACICTSLIALVATIARQIRNVYTDRERKRWPKLVLLMGTVSLLWGLFVIFSDSSTTNGVIGYIMIGLGLVCYSISSKVILLAKIWGREFALANRIPLIPVLTALACLFLASFVFELGTTHDDYFIPARVLAGLGAICFTLFSIVSILESGTSSK

SEQ ID NO: 5708 - protein, 1643 aa, B.fragilis
EIPVYIPNSSHLNLIDMADQQQIIDELIDYIDKAVLKHSVSNRHVAEVLYWLNEGLKKVSTDGLKDIFISKKQIDETNFLLRLLGGVEFSSGDDPYRITQKGEAFLKKLTLNGGLIEYDPTERVWKLNGNMLISGNITFGWDNGTYTAPTLLDLLPYDPTTLSKEGGRLSVINAGSDFDELAMWGVLSKEGVQQIDKSHLSGALAGYATEKFVTDKGYITSSALTGYATETFVRENFVTLAGAQEITGEKDFTGGLKVNGGLLDYDPTERVWKLNGNMLISGNITFGWDNGTYTAPTLLDLLPYDPTTLSKEGGRLSVIGSAGSSFDESSMWTALLKSGSQQIDKSHLDTALAGYATENFVHTNLNALKGTGLPTTEGYRNVTEIANTLLTFLTGSDTDSTINKWKELEAFLAGFSETDTLATALSVKADKTRSIITGTGLSGGGDLSADRTLSLSPSGIKAGTYTKLTVDAYGRATSASGLIASDIPTLEISKINGLQDRLNTFVTLAGAQEITGEKNFTGGLKVNGGLLDYDPTHKVWKLDGNLLITGSTTWNAVGDYTAPTLLDLLPYDPATLSKEGGKLSVIGGGGSGGGGNIMLNGTLYEAANGVITLPDLYQKTPNGTASQFLKADGSLDSNLYALAYGGDQNSIQYSSKSNYLRVIDRRNDTILPTSYDNYNISGLFHMSGMPSSNWWSGIHVKGWGEGYATWELVGPSSTDNTNNRLYYRDGKGSSWATDWKGIAFLEDCNKVATPYFEGQNIYSDYGWWVVALCKLSPADSEYNYASGTMFYRRGNGIYPNGSVQFNVIKRYNQTNVNFGVLYNGYGINEGEDAPKPCTFTYNGVKYAGLKWASAASLDSIKTLIYDISTTGLPFYVKYFNSQSGEVFNTEIKNSIVELGSDISGTGLGTIGTIRILNRKAIDIKGEDWGYIQQASADRMFHVAVAKSTQSGLGGGLGNYEIRCNGTSEEGIFVRYSGSSYGKLGVVNRNGQESSISYYNNNTAVGADKPLWTVGAGIRNAYSFDWWFGTNGYRMTLDSDGKLFINRTNNNEGGLSVSLAIGDSDTGLHWQADGIIEFRSNAKQVGYWGYTNGRLFNCYFREPSGVTYEKASLMINGNGSTISPSIGFHQPGVVGCHLELDNGGNFRFKDSSGYRNVYAGNLIADAGFLYSRYNGIEIKIGSENDSYVHFITKPARSLYFANSLFVNGSVLPYSSSTYSLGDAGHLWNYVYGNHFMGNSASATFILPNYVGGQQANPQTYFNNSMGVKVAMTGVNPDSYWGDTLWINGYGGTDVPDMCALHFSRGGAPLIYISSQKYHATSYGTMYHIWTGYNSNHSSAAWTCSTLNANGRISTTSDIYSAGWVRAGGSNGFYCESYGGGIHMTDSTWVRVYNGKQFYVSSTSSDAIHTAGGINASGRIYAGGHLSTNGGLAVSGIYGGSGASGFNVYAVFQGRSDHGGIEVRASDNTFGIGVHSNDHMYWWWGTSTSTNSSSGKSYIMDYGGGNWSFTGNHYVSGYSTWGSDSRYKTYLGEVTLQLDQIADSPTIYYRWNSKKRDRDGLLHVGGYAQYTEQILPELTHDTSNFKTMDYAVCAYVYAVHAARFLRDHLLSDYKWKSDTELRMYALEKENIKLRNRIEQLERRAA

SEQ ID NO: 5709 - protein, 130 aa, B.fragilis
TVKVMAEKTRYSDAELEEFRAIINEKLELAQRDYEQLKLSLMGLDGNDTDDTSPTYKVLEEGANTLSKEETTRLAQRQLKFIQGLQAALVRIENKTYGICRETGKLIPAERLRAVPHATLSIEAKNSGKK

SEQ ID NO: 5710 - protein, 253 aa, B.fragilis
MSILSKNRIKYIRSLELKKIRKEEKVFLAEGPKLVGDVLGYFPCKLLIATSDWLEEHPAVQAAEVIEVTSEELSRTSLLKTPQQVLALFEQPEYEIDMEAIRNSLCLALDNIQDPGNLGTIIRLADWFGIEHIFCSPNTVDVFNPKTIQATMGGIARVKVYYTALPDLMHSLGNVPVYGTLLDGENMYEQPLSKNGIIIMGNEGNGISPEIEKLVNRKLYIPNYPAERETSESLNVAIATAIVCAEFRRQAAL

SEQ ID NO: 5711 - protein, 343 aa, B.fragilis
QYVFLPSVNDSNCRKYRKPGSLYNQFFRSSHTLKRYEGLIVFYRVCHFVSSLFLSYLCHQTIKKTKMKTYPVVLSIAGSDCSGGAGIQADIKTISALGAYAASVITAVTVQNTRGVKAVHTVPAEIVQGQIEAVMEDLRPDALKIGMVSEPALVKIIAGCLLKYPHCPIVYDPVMVSTSGRKLMAKDAIQLIKEELFPLTSLITPNLDETEVLTGKKITTAEEMKEAARQLSEEYHTAVLVKGGHLEGNEMQDVLFTDGNAYIYKEKKIESRNLHGTGCTLSSSIATYLALGLPMDQAVGKAKSYVSKAIDAGKEIIIGHGNGPLCHFWGPEKARIWDDNKVE

SEQ ID NO: 5712 - protein, 68 aa, B.fragilis
NISFNPRLVLTGVMQVRFVKKLFPLKIFFRIISNDLLYWLKEIGWGCHIIGYLKGVTTDVQFVKPFRL

SEQ ID NO: 5713 - protein, 66 aa, B.fragilis
ILTSKKMHCFKKAMHFLSVLQKKYNVSIFLISDLLYQQYKKSNYGLSIFLSILFVHYMDIYRKKYT

SEQ ID NO: 5714 - protein, 413 aa, B.fragilis
MNNSPQPAAKGFTRAFYVSNTVELFERMAYYAVFIVLTIYLSTILGFNDFEASMISGLFSGGLYLLPIFTGAYADKIGFRKSMLVAFSLLTAGYFGLGVLPTLLESTGLVSYGASTHFSGLTDSVFRWLIVPVLFIIMIGGSFIKSVISASVAKETTEATRARGYSIFYMMVNIGAFTGKTVIDPLRNMIGDQAYIYINYFSGFMTLIALLAVFFLYKSTHTVGEGKSMREIGQGFLRIVTNWRLLILILIITGFWMVQHQLYATMPKYVIRMAGETAKPGWIANVNPFVVVCCVSFVTRWMAKRSAITSMNIGMFLIPVSALLMACGNLLDNEVVSGMSNITLMMIVGIVVQGLAECFISPRYLEYFSLQAPKGEEGMYLGFKSSSFFFIFHFRIWSCRRSADQVLSGSNFV

SEQ ID NO: 5715 - protein, 328 aa, B.fragilis
KKYSSMISDTTIRKLVDYISLNACSVNSSGLYNGKSGISLALFETAKCLQDTEIEDKAFSLFQESLIRKTNDYGFENGMSGIGYVLIYLITNKLIDADFEDLFGDQREAIIKHFENIDKQPDKLLVSYKIIYFLFVLDKLQKQDERIYSIIEKIFQGLELYLSLQFFDWKNIYYINSKDYVLQMYEAYLKLVDFCNYKYFSKSLMDSYVTLYSEGRIASSLVRGYYLGSIITKNNMVGFNDVIRDHIRYGQKNINPAILFLDQKINLTGIIENADENRVKIQRIEMDLFEESLERIKRMVRPNCIHVGYQYGLARYLGFCANKKFPLL

SEQ ID NO: 5716 - protein, 103 aa, B.fragilis
MMASVSRILARNLFPSPSPLLAPFTSPAISTISTVVGTMRLGCTSSASLFKRSSGTVITPTFGSIVQKGKFAACAFALDRQLKSVDLPTFGSPTIPHCNAIIL

SEQ ID NO: 5717 - protein, 204 aa, B.fragilis
RVGSYCGSSHERRTFGNCFLLRIILKRIIYKKDLDMMKPIAVNQLSDNFFETISKEWMLVTAGNKDAFNTMTANWGGIGFLWNKPVVYVFIRPERYTFGFMEKNDYFTLSFLGEENKSIHKICGSKSGREVDKIKETGLKPMITDKGNVLFEQGRLSLECRKLYTDVLRKENFLDPSVYEQWYTTHGGLHHVYVAEITSAWIKD

SEQ ID NO: 5718 - protein, 64 aa, B.fragilis
NINTKKNNTWSFVIEFIFNIIYKDYQYLVSSGSSSFRQTISQPFRIPYHITIDTPDFTTGRNDS

SEQ ID NO: 5719 - protein, 316 aa, B.fragilis
KEWFVPIVYMLDINMDWPVILAFARIKNFLYFNNLITMCEISVVMPVYNAEMHIKDAIESVLEQSFVDFEFILIDDGSTDRTSSIIQSYNDKRVRLIQNSHNFIESLNLGIENSLGKYMARMDGDDIMHIDRLKIQYAIMQEYPDVTVCGTWMNSIGTYSQTNGLLSTLSGLVEQPLLKFTKGNFLFHPTTMIRMDFLKKNALKYENCPYAEDFKFWVEIAKSGGRFYIDSQPLLYYRISDSQVSSQKSSEQRATTESIINEVLEYLMELNKNEYPELAAAYGDLCKLYEKQLLTKCEVLTLFQTLFSKNEKKLNL

SEQ ID NO: 5720 - protein, 208 aa, B.fragilis
RHITDKRNYQSKINQIMTKSIKGTQTEKNLLTSFAGESQARMRYTYFASVAKKEGYEQIAAIFTETADQEKEHAKRMFKFLEGGMVEITASYPAGVIGNTLQNLQAAAAGEHEEWSLDYPHFADVAEQEGFPMIAAMYRNISIAEKGHEERYLAFVKNIEVASVFAKEGEVVWQCRNCGYIEVGKEAPEVCPACLHPQAYFEIKKENY

SEQ ID NO: 5721 - protein, 682 aa, B.fragilis
NTITTLDMNESISILSIFLLVNMTLITSTCHAQNRSDYPWEEVMENLSISDEEGDIRNWENELEELTDLVNNPVNINSATKEQLQRFPFLNDVQIENLLAYIYIHGSMQTVYELQLVEELDRQTIQYLLPFVCVEPVDKKESVTLKQILKYGKHEAVTRMDVPLYKRKGYEKNYLGPAVYNSVKYGFHYREKVYAGIVAEKDSGEPFGALHNKQGYDYYSFYLLLHDIGILKTGIVGNYRLNFGQGLVLGQGSMFGKTAYSSSFTFRSTGIRRHTSTDEYNYFRGSGIALKWKQWTLSVFYSHRSLDGVIKGGEITSIYKTGLHRSEKEADKMNQLTMQMSGGNISYTGNSYQLGITGVYYCFNRSYEPELKDYSKYNLHGRSFYNLGMDYKYRFHRFSIQGEAALGISGMAFMNQVLYSPLQDIRLMLVHRYYSHDYWAMFAHSFSEGSSVQNENGWYLAASVNPFNRWTFFVSADLFSFPWWRYRISKASKGVDLLFQANYVPSKTVDMYVNYRYKQKERDVTGTQGKVILPTYHHRLRYRLNYLRCSSLFLRTTVDYNHFHSSGKTAGQGYQLTQTAGWKLPWLPLTAELQGSYFHTDDYDSRIYIYEKGLLYSFYTPSFQGEGIRLAIYFRYDMNKHWTAIAKLGQTTYFDRDEIGSGNDLIRGNKKTDVQMQLRLKF

SEQ ID NO: 5722 - protein, 158 aa, B.fragilis
NSTTMKKLTRKSLNELAKTMPIIEESLQMSYVGGGNGTSANPYTQEEYESMVSSGIWNGGYVENWGYTFPEMAVSSYDPNNLPKTGVDSYDLMYQGGFAIGYKAGLSGSTLDDIGIGAWSALAVISAGSEIGGVNSDMIWYSKGLRDGLTKGRGARGN

SEQ ID NO: 5723 - protein, 119 aa, B.fragilis
LWRTVENKSTMDDIVKVLVIMAAFALPLIRQIKKSKTERSAQKPFVPIPDTEEPEVLKVTRKYQPLHSQSTSQKVEVKKNKTVSQKIETTPANDPEFTIHSAEEARKAIIWSEILNRKY

SEQ ID NO: 5724 - protein, 219 aa, B.fragilis
VNAARKTININLILYFCKMNMRLTIGLLMLSIALLFSSESLAQEKTNLGGYLVPMCVYNGDTIPAFQIPTIHIFKPLKFRNRKEQMEYYKLVRNVKKVYPIAREINRTIIETYEYLQTLPNEKARQRHIKRVEKGLKEQYTPRMKKLSFAQGKLLIKLIDRQSHQSSYELVKAFMGPFKAGFYQTFAALFGASLKKQYDPEGEDKLTERVILLVESGQL

SEQ ID NO: 5725 - protein, 308 aa, B.fragilis
HCYLIPTHKMISKPTKSDVMRELRDYIFITLGLISYALGWTAFLIPYQITTGGTTGIGAIIYYATGFPIQWSYFIINAVLMTFAIKILGPKFSIKTTYAIFMLTFFLWFFQLIIVDDKGAPLQLVGEGQDFMACIIGAIMCGLGLGVVFNNNGSTGGTDIIAAIVNKYKDVTLGRMIMFCDIIIISSCYFIFNDWRRVIFGFVTLFIIGFVLDYVVNSARQSVQFFIFSKDYAKIADRITKETHRGVTVLDGLGWYSQNNVKVLVVLAYKRQSLDIFRLVKDIDPNAFISQSSVIGVYGEGFDRLKIK

SEQ ID NO: 5726 - protein, 75 aa, B.fragilis
ELIALSIFDCQEKLVFATQSYDRADSRMEGATEQDCAKKRTDANNIKYFITGVFINFLSASVSPLFFPVFVLFSL

SEQ ID NO: 5727 - protein, 145 aa, B.fragilis
FINLLTFRQKSDKMNRIFHARIVWYQYFLLVVLGVNAFGFLWCKNIILATLMMLFLIVVIEQIIHTVYTVTADGLLLLNHGRFIRKKTIPIAEITSIRKVHSMKFGSFSVTNYLLIEYGKGKYASVLPVKEKEFMELIEKTRNLI

SEQ ID NO: 5728 - protein, 211 aa, B.fragilis
FSKYMLILLTGFKPLSTPMLTRKELLLQHTNRNDIIMRKLKITELNRISIEEFKEADKLPLVVVLDDIRSLHNIGSVFRTADAFRIECIYLCGITATPPHPEMHKTALGAEFTVDWKYVNNAVETVDNLRSEGYVVYSVEQAEGSIMLDELTLDRSKKYAVVMGNEVKGVQQEVIDHSDGCIEIPQYGTKHSLNVSVTAGIVIWDLFKKLK

SEQ ID NO: 5729 - protein, 448 aa, B.fragilis
TMKYQVIIIGGGPAGYTAAEAAGKAGLSVLLFEKQNLGGVCLNEGCIPTKTLLYSAKTYDGAKHASKYAVTVPEVFFDLPKIIARKSKVVRKLVLGVKSKLTSNNVTIISGEATILDKNTVRCGEETYECDNLILCTGSETFIPPISGIDSVNYWTHREALDNKELPASLAIVGGGVIGMEFASFFNSLGVKVTVIEMMDEILGGMDKELSALLRADYAKRGIQFLLSTKVVSLAQTEEGAVVSYENAEGAGSVIAEKLLMSVGRRPVTKGFGLENLNLQRTERGSIVVNGQMESSLPGVYVCGDLTGFSLLAHTAVREAEVAVHAILGKEDRMSYAAIPGVVYTNPEIAGVGQTEESLTAKGIAYRAVKLPMAYSGRFVAENEGVNGVCKVLLGEDDTILGAHVLGNPASEIITLAGMAVEMKLKAAEWKKIVFPHPTVAEIFREAL

SEQ ID NO: 5730 - protein, 83 aa, B.fragilis
GQGYFQQDEPAFSVFDPVLDYFNTHVIHRSGAMHALPDGEYPFTGKGQGLKIAAVSGHHIRFPDGSRRAVIQGWEFNRIFSIN

SEQ ID NO: 5731 - protein, 82 aa, B.fragilis
YYSLFYIINQLCISIKWKSNPVKLKKSNYSDNIPFWGAKIINFRLMQSSAFSFCPKRGCLLLPGSQTMRENLCHSAVLKEIS

SEQ ID NO: 5732 - protein, 318 aa, B.fragilis
QATHKISINMESTNRLRYLIAGTGGVGGSIAGFLSLAGKDITCIARGAHLQAIQQDGLKLKSDLKGEHALRINACTAEEYNGKADVIFVCVKGYSVDSITELIKRAAHDRTIVIPILNVYGTGPRIQRLVPGVTVLDGCIYIVGFVSGPGEITQMGTIFRLVYGAHRGILVPAGLMEAVQRDLQESGIKVEISPDINRDTFIKWSFISAMAVTGAYFDVPMGEVQKPGKVRDTFIGLSTESAALGKKLGIEFKEDIVTYNLKVIDKLAPESTASMQKDIARGHESEVQGLLFDMITAAEEQGIDVPTYREVAKKFIKQ

SEQ ID NO: 5733 - protein, 199 aa, B.fragilis
NKLHTMKRKLVFATNNAHKLEEVSAILGDKVELLSLNDINCHTDIPETAETLEGNAYLKSSFIYRNYGLNCFADDTGLEVESLGGAPGIYSARYAGGEGHNAEANMLKLLHELEGKDNRRAQFRTAISLILDEKEYLFEGIIKGEIIKEKRGDSGFGYDPVFVPEGYDRTFAELGNEIKNQISHRALAVNKLCEFLRSI

SEQ ID NO: 5734 - protein, 493 aa, B.fragilis
RYSKTLKTLLYILVFSLCYTNAYCQSIPREVTLDEVINRLSLESSSAKIELLNFQNDLLRYENYKKSFLPAFVLNFNPINFNRSLRLLQQPIDGSYSYVEDNSNNTNFGTTVRQKISITGGELSIGSNINYLNEFSRKQNSFSTNPFFISYSQQLWGGGKLQRLENKIERAKNEVAVKQYCSNIAQIQQQALTLYLSAILSKMDSELAIDIKQSNDTLLHIAEIKLRNGSITEYDYKQMELQSLNLQYMYENAVKHYAESIQKLFTFLGIENNAEITIPDFDLPLTIDARLVIYYVKKNNPISNQQEIQQLEEEKNLFSIKLKNRFNGNISLNYGINQYAETLADAYRHGNTRQSVIIEFQIPIFQWGINKNNIRIAKNNYDASRLRIEKKMFEFENEVKEKINAYDHSVKLWLTASRAYALSKEQYKMLTKKFSLGKVSVYELATAQKERNDAMQRYYSAIKDSYESFFTLRNLALYDFKKNVELEKILFND

SEQ ID NO: 5735 - protein, 192 aa, B.fragilis
FIYKPLIITAMKKLTKKNLSELAKTMPVIEESLQMSYVGGGNGTSANPYTKVEFDSMLSNDNWNGGYVEGMGYVAPNTYIYGNSVYWGSVSQDYYTFPDYVTSLSSDGLNQMAESLAGAIPGVGSYTAYLSQELGDMSREIQSELLKKGYNGSSSFTIVRTYMGSSVKFSVYNANNGELITSKTINMFGFWQ

SEQ ID NO: 5736 - protein, 506 aa, B.fragilis
HENNTIIMAFKSISAAEAASLVKHGYNIGLSGFTPAGTAKAVTSEIAKIAEAEHAKGNPFQIGIFTGASTGDSCDGILSRVKAIRYRAPYTTNPDFRKAVNNGEIAYNDIHLSQMAQEVRYGFMGKVNVAIIEACEVTPDGKIYLTAAGGIAPTVCRLADQIIVELNSAHSKNMMGMHDVYEPLDPPYRREIPIYKPSDRIGLPYIQVDPKKIVGIVETNWPDEARSFAAADPITDKIGQNVADFLAADMKRGIIPSTFLPLQSGVGNIANAVLGALGRDQTIPAFEMYTEVIQNSVIGLIREGRVKFGSACSLTVTNDCLQGIYDDMDFFRDKLILRPSEISNSPEVVRRLGIISINTAIEADIYGNVNSTHIGGTKMMNGIGGSGDFTRNAYISIFTCPSVAKEGKISSIVPMVSHLDHSEHSVNIVITEQGVADLRGKSPKERAQAIIENCAHPDYKQILWDYLKLAGNKSQTPHAIQAALGMHAELAKSGDMKNVNWAEYER

SEQ ID NO: 5737 - protein, 148 aa, B.fragilis
SCYNEVLYKSIRKTNSKKNRSQYMNIAFLTTLNPADINNWSGTTFHLFHALSRKHHVKVIGQNTLPQAAYFTKDNCIKKNPLENYVSVFGKLCTEQLTNYDLVFFGDLYLAPFLDVNVPVVHLSDVTYHSFQSYLNPLKNEERYRKLE

SEQ ID NO: 5738 - protein, 457 aa, B.fragilis
RTGKKMNSRIQKQEQPICSPKIILPNPNKKSDVIARSEEVQAIIDRMPTYWTKWVILCVGVLMGMIILLGFLIQYPDTVDGQISVTANAAPVRLVANSNGRITLFQPNKALLHKNDVISCIESGADYKHILWIDSFLKTLNDKSTIRVALPDTLLLGEVSSAYNSFLLSFLQYERLLTSDIYSTMRQKLQQQIISDEAVIANFNNELRLKKQILDNSQNQLSKDSILLSMKGISEQEYQQKFSTHLSLKESQLNLQSNRQMKQSEISRNQLEIQRICLEETEAKEKAYSDYITRKNELSNAIKLWKEHYLQYAPVEGELEYLGFWRNNRFVQSGQELFSIIPDKTNILGEVVIPSFGAGKVEVGQTVNVKMDNYPYDEYGLLKGVVKSVSRITNKIKTQNGDMDTYLVIISFPDGTLTNFGKILPLDFETKGTVEIITKRKRLIERLFDNLKSKGEK

SEQ ID NO: 5739 - protein, 607 aa, B.fragilis
IILNMNSITKLHVLFFFVFIFYTVSCTAKLEKQTYTNVYDLHFAMRSDSAVVYPWRENGAYSNYTIPAYIQDSNRNLFAKKYFKGFPFSKRLRSEYEQRILLPNNNIKEAVIGFEGKGDNIKLVSIILDAIGKQENILFSDTLRFRPDSILSLVTQNINLTNAEMLNVRINVEGEIDKNAYIAFSRLDILIDGKPIDEFPVRTLSPLIVDKKINYTGINVDRKIGLEQINEINDKKIIGLGESVHGNDGIKNLAYQLIIQAVERLNCKLVLQEMPLEQSFAYNRFIQDDNYELDSSLVINHATINFLKRLRSFNSGKTKDSKVKLYGMDYNSILSSTQSSAMDIFDFITGLNKKSQIPEVDQLSLLLMKKDRNCAINFLDIHRDKIKKLLTAEEIECILHILRVSKQAGDGGIERFIRRDSIMFVNARFLIDKFAKDENVKTVIYGHAGHINPISSYPAVPCIPFGRYMRKAYGESYSPLLFLIGSGEAMAYDEHYNRKDNWLSSPPENSMEYFLSLIDDNVFYTPLTVDFNELTLSRLQGSHHIPQEFYPFNLYQRFKGVFFIKSTDCTHKDEKEISFEKASDRLIMKIKQRQEKIKEIQKRIENL

SEQ ID NO: 5740 - protein, 84 aa, B.fragilis
MKIKKYCRYIHLWLSLPAGILISIICFTGAILVFKEELLTIMGYDSIRESPLMIVMKLHRWVKDDNRPPGKMIVSIFTFFSSLS

SEQ ID NO: 5741 - protein, 104 aa, B.fragilis
NIKKGRRRLMFDYHSVLGLYAALILLVCALTGLMWSFQWYRDIVSFIFDAEVKRGAPIWKIVRALHFGTYAGMFSKIVTFIAALIGTSLPVTGYWMYLKRKKLL

SEQ ID NO: 5742 - protein, 538 aa, B.fragilis
FMKNNCLICSLLFASGIQNAWGTQITDRKANPDQAKPNIILIMCDDMGFSDLSCYGGEVHTPHIDFLAENGIRFSQFKNTGRSCPSRAALLTGRYQHEVGMGWMTAVDEHRPGYRGQISDRYPTIAEVFRENGYHTYMSGKWHVTVEGAFTQPNGSYPVERGFEKYYGCLSGGGNYYTPKPVFSGLQRITEFPKDYYYTTAITDSAVSFIRQHPVDEPMFMYLAHYAPHLPLQAPKERVEACREKYKAGYDVLRKQRFERIRRNGLIDIERELPVFEKEFGGKRPAWNSLTPQQQERWITEMATYAAMIEIMDDGIGEVIKATKEKGIFDNTIFLFLSDNGATNEGDMITQLRADLSNTPFRSYKQWCFQGGTSAPLIIMYGGGQPDGKKEAVRHEFTHIIDLFPTCLDMASIEYPREFRNHAIDAPGGRTILPALKGKKLSKRDLFFEHQTSCGIISGDWKLVRANGKQPWELFNLLQDPFEQNDLSARYPDRVKTLEKKWNQWAEKQQVFPFEYRPWTKRINYYKSLYPDQSGKDL

SEQ ID NO: 5743 - protein, 338 aa, B.fragilis
KKRKNKNIMNREEWVNKGFVDEPVDKSIDLKAAINELKKEKNAVILGHYYQKGEIQDIADYIGDSLALAQIAAKTDADILVMCGVHFMGETAKVLCPDKKVLVPDLNAGCSLADSCPADKFAEFVKAHPGYTVISYVNTTAAVKAVTDVVVTSTNAKQIVESFPKDEKIIFGPDRNLGNYINSITGREMLLWDGACHVHEQFSVEKIVELKAQYPDAVVLAHPECKSVVLKLADMVGSTAALLKYAVNSDKQRFIVATEAGILHEMQKKCPQKTFIPAPPNDSTCGCNECNFMRLNTLEKLYNCLKYEFPEVTVDPEVAREAVKPIKRMLEISAKLGL

SEQ ID NO: 5744 - protein, 474 aa, B.fragilis
NTMKNKLFILFAFCISVHVYAQQPSREIPLKYGATNIGKRQDDAMKRFRNNRLGEFIHWGLYAIPGGEWKGKVYNGAAEWLKSWAKVPAADWLELMKQWNPVKFDARQWARMAKEMGVKYVKITTKHHEGFCLWPSQYSQYTVAQTPYRKDILGELVKAYNDEGIDVHFYFSVMDWSHPDYRYEITSKEDSIAFSRFLTFTDHQLKELATRYPTVKDFWFDGTWDASIKKNGWWTAHAEQMLKELVPGVTVNSRLRADDYGKRHFDSNGRLMGDYESGYERRLPDPVKDLQVTKWDWEACMTVPENQWGYHKDWSLSYVKTPIEVIDRIVHAVSMGGNMVVNFGPQPDGDFRSEEKELAMALGCWMKRYGECIYGCDYAGWDKQDWGYYTRKGQEVYMVVFNRPYSGLLKVKIPKGTEIERAVLPDGQVVKVTETARNEYNVAMPSQDPGEPFIIKLQVKEASGAADGYRDALT

SEQ ID NO: 5745 - protein, 304 aa, B.fragilis
QQPKSKVSMCLLIGKLLKNSSNNKEINMNNLLLSINWNPNPELFNLFGISIRYYGLLWAIGIFFAYIVVHYQYRDKKIDEKKFEPLFFYCFFGILIGARLGHCLFYDPGYYLNHFWEMILPVKFLPGGGWKFTGYEGLASHGGTLGLIISLWLYCRKTKMNYMDVVDMIAVATPITACFIRLANLMNSEIIGKVTDVSWAFVFERVDMQPRHPAQLYEAIAYFILFLVMMFLYKNYSKKLHRGFFFGLCLTAIFTFRFFVEFLKENQVDFENSMALNMGQWLSIPFVIIGIYFMFFYGKKKSVK

SEQ ID NO: 5746 - protein, 244 aa, B.fragilis
HGTEHGSMVKHPVRNYRHLLYVFLRKEKECKMKHIIDIKTWERKENYEFFLGFQNPTISITSEVECSGARTRAKTAGESFFLHYLYAVLRAVNEIKEFRFRIDSEGRVVYFDTVDMLTPIKVADNGRFFTVRLPWYPDFKTFYTEAKAIISGIDPDKDPYEAEKTGGSDLLDVVLLSATPDLYFTSLTCTQEHRHGGNYPLMNAGKAVIRGGVLVMPIAMTIHHGFIDGHHLSLFYKKVEEFLK

SEQ ID NO: 5747 - protein, 627 aa, B.fragilis
AYNENKTKTGKNKGDTEADRKFIKTPVMKYFILLASVLFLAQSCSVAPSMRESARSYDWVANTNFSWQSKIDSAISSYPLLLHPSYEAKGSVGFTVPVFYRMDKKRVGVEVRIKYKTENCNDLCLKLSGIGECGKVISADTFRLSAAEAWTVARRSVDMASPLLLGVALEARGEKPGKKDFPADPLGWENNSFKPGEYSKIWIDSLDILIDGKYAVELPSLNNGTAASVRESDVMPANGGDLKSLPFSGKRILAIGESVHGTGTMNDMGVEIIKNRIEHGKCRLVLLEIPLTLSFHINRYLEGDERFKPDSIASYFDKVLFSSSSFVSLMRWVKEYNRHLEEKVSFFGIDRNIYRLQSSIDLFYFFYTLRRGKGDEGLKAICESLLLSDEKFPFKGADSVLHANHGFKGILTRREAEIMSYCLNSEEEATADELNRFRGRDSGMYENAKFLMKTMLKKDETTTVYCHLGHANYTSIAGWLRPDMRPFGEYMKGSYGDDYSAVGLLAGGGSYLTWVFPGKMGIRRLQSSSSAGLEYCIERSGISPCYLPMDKLSDADVLKMRYIGNTESKIGQFQWVFPKCMMDGVLFTKNASATNKREEFFKMNLDYHVQTLFALMYLYEKKRKWIP

SEQ ID NO: 5748 - protein, 374 aa, B.fragilis
YKKDYNIMALQCGIVGLPNVGKSTLFNCLSNAKAQAANFPFCTIEPNVGVITVPDERLNKLAELVHPNRIVPTTVEIVDIAGLVKGASKGEGLGNKFLANIRETDAIIHVLRCFDDDNVTHVDGSVNPVRDKEIIDYELQLKDLETIESRIQKVQKQAQTGGDKAAKQAYDVLVQFKDALEQGKSARTVTFETKDEQKIAKELFLLTSKPVMYVCNVDEASAVNGNKYVDMVREAVKDEDAEILVVAGKTEADIAELETYEDRQMFLAEIGLEESGVARLIKSAYKLLNLETYFTAGVQEVRAWTYEKGWKAPQCAGVIHTDFEKGFIRAEVIKYEDFLQYGSEAAVKEAGKLGVEGKEYVVQDGDIMHFRFNV

SEQ ID NO: 5749 - protein, 735 aa, B.fragilis
NQKEKNKNMLLHRFPVEYQMDSQDCGPASLKIIAKHFGKFYSLQFMRDRCGITKEGVSLLDLSTGAESIGLRTLAIKCTIDDVVNSIPFPAIVFWNDSHFIVVYHSDRKYIWVSDPAKGRIKYTHEEFRKGWYQRDESQGVLLAVEPTTDFKNSKAEQEQKRNSFSSILKYFFPYKKSFGLIFIIMLVVTVLQGMLPFISKAVIDVGIKTSDRNFINMVLIGNICILLSVMIFNVLRDWILLHITARVNIALISDYLIKLMKLPVTFFENKLLGDILQRAQDHERIRSFIMNNSLALIFSTLTFAVFSIILLIYNTIIFYIFLSGSVLYACWVLLFLSIRKKLDWEYFELLSKNQSYWVETVSTIQDIKIYNYDKYRRWKWEEIQARLYHVNKRVLAITNAQNLGAQFIENIKNMAIVFFCAMAVIKGEITFGIMISTQFIIGMLNGPLVQFINFVVSAQYAKISFLRINEIRQLENEDELLSIGSTTILPERKTILLENIHFQYTPNSPLVLRNIYLQIPENKITAIVGGSGSGKSTLLKLLVRLYKPSHGEIKMDKMNVSAINLRQWRNMCGVVMQDGKIFSDTILNNIVLDDEQINYTRLREVCRIAQIEDEINAMPKGFETTIGETGRGLSGGQKQRLLIARALYRDPKFLFMDEATNSLDSINERKIVNALNNAFEQRTVVVIAHRLSTIRNADQIVVLDKGFIVETGTHEILMEKKGHYFELVSSQIQD

SEQ ID NO: 5750 - protein, 397 aa, B.fragilis
  UNSURE (44): Identity of amino acid sequences at the above locations are unknown.
LPLLRLARPDADEPFRTEVWYKGTIEHDTLRGDIYVVGGFDPEXDDERMNALVEEVITFPFSVLKGNIYGDISMKDSLYWGSGWAWDDTPSSFQPYLSPLMYHKGMVKVTAVPGATRGDSARLSFEPSSSYYTMTNETKTRTSSAGKFSVSRGWLENKNNLIVSGNVENRRIGDVNVYSSQDFFMHTFVERLRNKGIEISNHYAFDSFRSDSLSICMARWECPVQDVIDQIMKESDNLSAEALLCRLGARATGKKQVSAKDGIEEIYRLIQDLGHDPDNYKIADGCGLSNYDYLSPALLVDFLKFAYSRTDIFRKLYKALPVAGIDGTLKNRMKQGAAFKNVHAKTGSYTAINTLAGYLKMANGHQVAFAIMNQNILSAAKARNFQNKVCEILANHQ

SEQ ID NO: 5751 - protein, 527 aa, B.fragilis
TLKLMVKKFDFLVIGSGIAGMSFALKVAHKGKVALVCKSGLEEANTYFAQGGVASVTNLLVDNFEKHIEDTMIAGDWISDRTAVEKVVREAPAQIQELISWGVNFDKNEKGEFDLHREGGHSEFRILHHKDNTGAEIQDSLIRAVQQHPNITVIENHFAIEILTQHHLGVTVTRQTPDIKCYGAYILDPKTGKVDTYLAKVTLMATGGVGAVYQTTTNPLVATGDGIAMVYRAKGTVKDMEFVQFHPTALYHPGDRPSFLITEAMRGYGGVLRTMDGKEFMQKYDPRLSLAPRDIVARAIDNEMKNRGDDHVYLDVTHKDPEETKKHFPNIYEKCLSLGIDITREYIPVAPSAHYLCGGIKVDLNGQSSIERLYAAGECSCTGLHGGNRLASNSLIEAVVYADAAARHCLSVIDQYTYNEEIPEWNDEGTRSPEEMVLITQSMKEVNQIMSTYVGIVRSDLRLKRAWDRLDILYEETESLFKRSVASKEICELRNMINVGYLIMRMAMERKESRGLHYTVDYPHAGK

SEQ ID NO: 5752 - protein, 261 aa, B.fragilis
TELSMTIIFPSPIFGPVHSRRLGVSLGINLLPSDGKVCSFDCIYCECGYNGEHRPKSSLPTREEVRMALEEKLKEMKSNGPAPDVLTFAGNGEPTAHPHFPEIIEDTLALRDAYFPDAKVSVLSNATFINRPAVFDALNRVDNNILKLDTVDEEYIRTVDRPNGRYDLNGTVGLLKAFKGNCIVQTMFMKGKYKGKDVDNTSDKYVLPWLKVVKDIAPRQVMIYTIDRETPDQDLQKATHEELDRIVALLTKEGLSATASY

SEQ ID NO: 5753 - protein, 892 aa, B.fragilis
VDLRETAIFALLFMNLKRRLSVSNDIELTPMMKQFLDLKAKHPDAVMLFRCGDFYETYSTDAIIAAEILGITLTKRANGKGKTVEMAGFPHHALDTYLPKLIRAGKRVAICDQLEDPKTTKKLVKRGITELVTPGVSINDNVLNYKENNFLAAVHFGKSACGIAFLDISTGEFLTAEGPFDYVDKLLNNFAPKEILFERGKRGMFEGNFGSKFFTFELDDWVFTESSSREKLLKHFETKNLKGFGVEHLKNGIIASGAILQYLDMTEHTQVGHITSLARIEEDKYVRLDKFTVRSLELIGSMNDGGSSLLHVIDKTISPMGARLLKRWMVFPLKDEKPINDRLNVVEYFFRKPDFRELIEDELHRIGDLERIISKVAVGRVSPREVVQLKVALQAIEPIKEACQQADNPSLNRIGEQLNLCISIRDRIEKEINNDPPLLINKGGVIKDGVDTELDELRQIAYSGKDYLLKIQQRESELTGIPSLKIAYNSVFGYYIEVRNVHKDKVPQEWIRKQTLVNAERYITQELKEYEEKILGAEDKILVLETRLYTELVQALSEFIPAIQINANQIARIDCLLSFANVAKENNYIRPVIEDNDVLDIRQGRHPVIEKQLPIGEKYIANDVLLDNATQQVIIITGPNMAGKSALLRQTALITLLAQIGSFVPAESAHIGLVDKIFTRVGASDNISVGESTFMVEMNEASDILNNISSRSLVLFDELGRGTSTYDGISIAWAIVEYIHEHPKAKARTLFATHYHELNEMEKSFKRIKNYNVSVKEVDNKVIFLRKLERGGSEHSFGIHVAKMAGMPKSIVKRANEILKQLESDNRQQGISGKPLAEVSENRGGMQLSFFQLDDPILCQIRDEILHLDVNNLTPIEALNKLNDIKKIVRGK

SEQ ID NO: 5754 - protein, 599 aa, B.fragilis
VVNIDNNLVYFMKTKLPLLLLFFVLFLFKCDLKADPGHKSPLEYRWVNHPLDFYLNVTVDSTTTPHSLLFETMYEKKGIASFLLPIYQLEKNSLTFEIKIRYKTENCENLFLAITSVGDCENINSIDTIQLNATQDWKECTRILKTKKAYFLNISVGAVGYGQRKGKIWISDLEVLGDGKAIGDNPQQEYKKEDIHLKATDLIHWNNKEYDNLPFLNKKILGLGETAHGTETMNDIGIEISKERILKHQCRFILLEIPLEFSLYINRYVQNDKNFKFEYISERFEPYLFSDSILSFIRWIKEYNSAHNQKISILGFDLNTTPLLSRADLFNFFYNLKSGGHVEEIDTICESLLDSKTSFEKIISKFDKSIRLADCLDKGELKLIHRCLEITGRSSSSYFRFVERDRYMNDIVTFIIDHFLNTNETVTLFGHLGHLNYKGNRVELMDYFSLGYYLKSRYAKNYSCIGLITNRGTAMLPVSATNGGVTKLEQAPQGSLEFQVNKLKMDSVYLSMSKFTCSDVFLLRELGSGFSQNKKIIPNQFQYMIPKSRMEGVIFTKESVNFMKGKEFFKKNMNVEVVTMRFYIKALEKLTQKKIDLNI

SEQ ID NO: 5755 - protein, 470 aa, B.fragilis
SSIFADANLNSEFMNELTGADFKSATADDNKKLFIETYGCQMNVADSEVIASVMQMAGYSVAETLEEADAVFMNTCSIRDNAEQKILNRLEFFHSMKKKKKHLIVGVLGCMAERVKDDLIEHHHVDLVVGPDAYLTLPELIASVEAGEKAMNVELSTTETYRDVIPSRICGNHISGFVSIMRGCNNFCTYCIVPYTRGRERSRDVESILNEVADLVSKGYKEITLLGQNVNSYRFEKEGGEVVTFPMLLRLVAEAAPGIRVRFTTSHPKDMSDETLEVIAQVPNVCKHIHLPVQSGSSRILKLMNRKYTREWYLDRVAAIKRIVPDCGLTTDIFSGFHSETEEDHRESLSLMEACGYDAAFMFKYSERPGTYASKHLEDNVSEEIKVRRLNEIIALQNRLSAESNNRCIGKTYEVLVEGVSKRSRDQLFGRTEQNRVVVFDRGTHRIGDFVNVRITEASSATLKGEEVFS

SEQ ID NO: 5756 - protein, 228 aa, B.fragilis
KNIIRIMGTNNSDFYLPVYVINLKERTERRQHIEEQFQGKVEFALHWIEAIEHSIGAVGLWQSMLKAVQTAIDKRDDIMIICEDDHIFTPAYNKDYLFANIIGANAQGSELLSGGVGGFGTAVPVDTNRYWMDWFWSTQFIIIFKPLFQKILDYDFKDTDTADGVLSVLAKDKMTIYPFISVQKDFGYSDVTVYNGTPGMISNYFSQANYRLRMIHHVSHKFKEQAKR

SEQ ID NO: 5757 - protein, 238 aa, B.fragilis
NTAINYSSEWAKQSTINYYDIEPGKIHVVEFGANIPTPSDYKIDIQTDICNLVFIGKNWQKKGGDKVLGAYRKLKSDGFRCTLTIIGSIIREPYDEDENLVIIPYLDKSQPEHLERFCNILQEAHFLVLPTEFDAFGIVFCEASAYAVPSIAANVGGVSQPVREGKNGYLLMPDATAEDYAEKIKSVFADKENYLKLRMSSRQEFETRLNWEVWSEKVNKILEEIVEEHHKNNGNKQQ

SEQ ID NO: 5758 - protein, 94 aa, B.fragilis
ELRILVHAGIPAPKTIQFISGRFLLRIQAVAHYFRFPPGKYALEAMIGMQHRVRPFKRELLVRQQKRLAYRFQAFVAFTSAERVKEVKQVDTAL

SEQ ID NO: 5759 - protein, 88 aa, B.fragilis
LVSIMKKLNLFILFSFCFSIITWGQANFAAIDSLIKKELPQGSEVGISVYDLTARKTLYTYRDTKLSRPASTMKLLTTITALGPAGRR

SEQ ID NO: 5760 - protein, 562 aa, B.fragilis
KKEMKVLDFKPRLFSTLKNYSKETFMSDLMAGIIVGIVALPLAIAFGIASGVSPEKGIITAIIAGFIISLLGGSKVQIGGPTGAFIVIIYGIIQQYGEAGLIVATLMAGILLILLGVFKLGAIIKFIPYPIIVGFTSGIAVTIFTTQIADIFGLNFGGEKVPGDFIGKWMIYFRHFDTVNWWNAVVSILSIIIIAITPRFSKKIPGSLIAIIVVTIGVYVLKTYAGIDSIDTIGDRFTIKSELPEAAIPTLNWEAIKDLFPVAITIAVLGAIESLLSATVADGVTGDKHDSNTELIAQGTANLITPLFGGIPATGAIARTMTNINNGGKTPVAGIIHAIVLLLILLFLMPLAQYIPMACLAGVLVIVSYNMSEWRTFKALLKNPKSDVTVLLITFFLTIIFDLTIAIEVGLVIACILFMRRVMETTEISVIKDEIDPNDELDIAVCEEHLIIPAGVEVYEINGPYFFGIATKFEETMAQLGDRPKVRIIRMRKVPFIDSTGIHNLTSLCKMSQKEKITIVLSGVNEKVHKPLEKSGFYELLGKQNICPNINVALDRAKEIIN

SEQ ID NO: 5761 - protein, 810 aa, B.fragilis
FNAVKCMKQIYSTLLLLVLLIFPSLLFATEPESVDRVPAIRGVVYDETDTPLASATVQIEGTTIGTTTNSEGRFILRNLARKVYKINVSFVGYATQTRTVDLTSRSVAQLSFTLLPDDNLLSTVEVFGERYKQPKKLDAITRMPLRPSEQIQSISVISEKSITEQGALTVTDVARNVPGVTLFGSYGGVRESMSIRGYRGVPILKNGVRIDSDFRTGSALSEMQGVESIQVIKGSAAVTQGIGNDLGSAGGVINVVTKTPKFTNEGEVSLRAGSWGLFRPTFDVQSVLDKNQTIAFRMNGAFERSDNYRPVIHSNRVYINPSLEWRPDDKTSVTIEMDYLNDNRTPYTSSVNLSKDTEENLYDMPHNKFLGFKNDNVNNKTLTYAARITRQLTDNISVRAAYFGSSYKVDNTSTSVKTVVNKEYNMRRRTISRSLRDDRNSTFQLDFIGRDIFTGPVKHTFQLGFDYKNTDLSITNYTPVNIDTINVLAPSISNVLPVAVKFVPEIPVESNSSSYGIMAQEVMTFNKYIKAILGLRYSYISSQDGTSAGPTTGDAWNPMLGIMLTPVKNINLFGSYTTTTSLLHAARRMENGDEIGPSKTRQFEVGIKSDWLNNRLRFNLTYFDILTKNLSYSTYHPGTTQPTGYFDKAGSLKRKGIETELSGSILENLQVMMGYAYLDAKYENSPAFKNGSAPMNTPKHTANGWIQYRFDKGVLKRLSAGIGVYFVGKRPVNDFAIKPDGHGSMTNEKPFDMPGYTTINAQLAYSIHKFTARVYLNNLFDALGYNSYYRGGYINQIDPRNFSAVISYHF

SEQ ID NO: 5762 - protein, 372 aa, B.fragilis
THAVMSMAINLDNQFNLPADYGSLDSRWNRNQVGPFIKLLKKFVKDSRFDAFYHSNENLYQEAVSRFMPIYKSIDTQWYNDFYGQKSNDRFHIILSMSNGPGNYGPSVTDKENIHNVFSVMGAWVTDSVGMVVYPPELILPILIHEFNHSFINFDPEMFRTSGEQIYAAVGEQMARQAYGQWSIVLTEAMVRAAVIKYMKDHNFPAVEITKETVIQKTRGFVWISKLVDELEKYSSDRTTYPTLNSYMPRLAEAYTGFAQYTANYDSIRPKVVSIDEFTNGDTTVRSDIKTITVHFDRPLVGRGHSFNYGHLGMEAMPKIINVNYANDNRTVIIGVELLPGKEYGITLLGLSFRTPEGDAIKPYEISFKTAE

SEQ ID NO: 5763 - protein, 373 aa, B.fragilis
IPILDPIINPLHNTIMKNKSACFFVLSLFVCSMFTSCNKESTTECQTIDFSTLFDGQPEKIPLKEWAKSIHFVQLETNDSILIGNIRATILHKDKILVHHNNLSLFDLSGKFICNIGSKGGGPTEYSGINNAWTDDEGIHIFDIANKIKTYNWNGKWIKTEPIPESNIKEVFPLASGNNIKAGYIQNITGNEPHKIYLFKDSTILAKIPYGKSFQKGEMTMVFYNECYPFHANGRTFFKEMFNDTIFSIDNQYQPVPRWYIELGKYKIAEDARYTLTDPRKSVFDNAATLTPIGKWDNKLFFSARANKQNYLFYYDLKEKKSNSIQISYPENSFAIPEEHSFIPKCMSDDGKYLISYEIQENDENPVIILAEK

SEQ ID NO: 5764 - protein, 965 aa, B.fragilis
SCKFAPSYKAYIINHYKQKVIAMEYNFREIEKKWQKIWVDNHTYQVNEDASKQKFYVLNMFPYPSGAGLHVGHPLGYIASDIYARYKRLQGFNVLNPMGYDAYGLPAEQYAIQTGQHPAITTVNNINRYREQLDKIGFSFDWNREIRTCDPEYYHWTQWAFIKMFNSYYCNDEKQARPIEELIEAFSTNGTQGMNVACGEEMDFTADEWNAKSEKEQQEILMNYRIAYLGNTMVNWCPALGTVLANDEVVDGVSERGGYPVIQKVMRQWCLRVSAYAQRLLDGLETVEWTDSLKETQRNWIGRSEGAEMNFKVKDSDIEFTIFTTRADTVFGVTFMVLAPESELVAKLTTPEQKAEVDAYLDRTKKRTERERIADRSVSGVFSGSYAINPLTNEPIPVWISDYVLAGYGTGAIMAVPAHDSRDYAFAKHFNLEIRPLIEGCDVSEESFDAKEGIMMNSPRPGAPEGGLVLNGLTVKEAIAKTKEYIKATGLGRVKVNFRLRDAIFSRQRYWGEPFPVYYKDGMPYMIDESCLPLELPEVAKFLPTETGEPPLGHATKWAWDTVNKCVTDNENIDNITIFPLELNTMPGFAGSSAYYLRYMDPRNHEALVSPAVDQYWKNVDLYVGGTEHATGHLIYSRFWNKFLHDWGISVAEEPFQKLVNQGMIQGRSNFVYRIKDTNTFVSLNLKDQYEVTPIHVDVNIVSNDILDLEAFKAWRPEYETAEFILEDGKYICGWAVEKMSKSMFNVVNPDMIVEKYGADTLRMYEMFLGPVEQSKPWDTNGIDGVHRFIKKFWSLFYDRNGEYLVKDEPATKEELKALHKLIKKVTGDIEQFSYNTSVSAFMICVNELSSLKCNKKEVLEQLIVVLAPFAPHVCEELWDTLGNITSVCDAQWPAFNEQYLVEDTVNYTISFNGKARFNMEFPADAASDAIQATVLADERSLKWTEGKTPKKVIVVPKKIVNIVI

SEQ ID NO: 5765 - protein, 250 aa, B.fragilis
MSFSLVTVTYNSAQTLRDTITSVLSQTHQAIEYIIIDGFSKDNTVAIIKEYEPLFNGRLKWISEKDNGLYDAMNKGFQMATGDVIGIINSDDLISDPNAIEKVIKCFESDTSIDAVYADLYYVAQNDISKIVRYWKSGGQRPFCKGWHPAHPTFYVKKEVYQRYGLFDLDFKFAADFELMLRLIDKEHIKLYYLPEPLVRMRLGGTTSKNLSNIRKGNLECINAFKKNGIKVSMLYPLYRLLPKIRQYFQ

SEQ ID NO: 5766 - protein, 211 aa, B.fragilis
NKRFEFMNTLLMSLIFTTMTYEMPKLPYANNALEPVISQQTIDYHYGKHLQTYVNNLNSLVPGTEYEGKTVEAIVASAPDGAIFNNAGQVLNHTLYFLQFAPKPAKNEPAGKLGEAIKRDFGSFENFKKEFNAASVGLFGSGWAWLSVDKDGKLHITKEPNGSNPVRAGLKPLLGFDVWEHAYYLDYQNRRADHVNKLWEIIDWDVVEKRL

SEQ ID NO: 5767 - protein, 126 aa, B.fragilis
RFESGDGLDTCQEKKSVTLFFFLQLAQQIPIVIFKFKRQIIRVAVVFENRVEVRAVVNAFVSNAGNAEIMRNIGYCIMQLFGKGVGGIYQKANVVLATESFQGSPGHGAAQAYAMMQVDILFVTFG

SEQ ID NO: 5768 - protein, 283 aa, B.fragilis
SVRSVTLSLPVSNFRLLTFNNLSSIMKAVILAGGFGTRLSEATNLIPKPMVEIGGKPILWHIMKTYSHYGINDFVICCGYKQYIIKEYFANYFRHNSDMTVDLSNNTTTILDNHSENWKVTMVDTGLNTQTGGRIRRVQKYLGNERFLLTYGDGVTDLNIGDTLKAHESSGCLLSLTAYKPGGKFGALQLDLDTDKVLSFQEKPDGDRNWINAGYFVCEPEVFDYIPEGDSTIFERQPLESIAKAGRMHAFRHTGFWKPMDTLRDNTELNEMWDQGVAPWKVW

SEQ ID NO: 5769 - protein, 374 aa, B.fragilis
NVGSGSRSLESVVSRMGIDIFDNFYRGKRVLVTGHTGFKGSWLSIWLHELGAEVIGVAQDPFTARDNFVLSGIGEKIKADLRADIRDGERIKAIFQEYQPEIVFHLAAQPLVRLSYDIPVETYETNVMGTIHVLEAVRSTDSVKVGVMITTDKCYENKEQIWGYRENEPMGGYDPYSSSKGAAEIAIASWRRSFFNPEQYDKHGKSIASVRAGNVIGGGDWALDRIIPDCIKALESGAAIDIRSPKAIRPWQHVLEPLSGYMLLAQKMWDAPTDYCEGWNFGPHSESISTVWDVATRVVSEYGRGELRDLSTPDALHEARLLMLDISKARFCLGWEPRMNIGQTVGLTVDWYKRYREEEVYDVCVDQIKDYLLK

SEQ ID NO: 5770 - protein, 61 aa, B.fragilis
LMMSVIWLFNSPEESDCSLGVIIGILLSQALSSLPQDIKTKKNRLRKSGTKYFIMFRLGYK

SEQ ID NO: 5771 - protein, 477 aa, B.fragilis
TKRSYLLNQRTFGFKPKKSSFATQKLMPMLLIIDDDSGVRSSLSFMLKRAGYQVIAVTGPREAMEVVRSEAPSLILMDMNFTLSTSGEEGLTLLKQVKVFRPDVPVILMTAWGSIQLAVQGMQAGAFDFITKPWNNAALLQRIETALELTATPKDTPQEQSGTLNRSHIIGKSRGLMEVLNTVARIAPTNAPVLITGESGTGKELIAEAIHINSQRVRQPFVKVNLGGISQSLFESEMFGHKKGAFTDATADRMGRFEMANKGTIFLDEIGDLDPSCQVKLLRVLQDQTFEVLGDSRPRKTDIRVVSATNADLSKMVSEHTFREDLFYRINLITVKLPALRERREDIPLLARHFADRQAEINNLPRTEFSSDALNFLSRLPFPGNIRELKNLVERTILVSGKEVLDAIDFENQYQRHDESVATSSSFAGMTLDEIEKQTILQALERYKGNLSQVATALGISRAALYRRLEKYDIGDK

SEQ ID NO: 5772 - protein, 107 aa, B.fragilis
CADPSQPLVKTYPTFDTMLQQLKDNKTKQVTLVPFMFVAGDHANNDIAVDWKEALEKEGLKVDVRMQGLGEIPAIQQLFIDHAQFMLKHEMVDIMKKKAKYAKDKDE

SEQ ID NO: 5773 - protein, 500 aa, B.fragilis
LHAFRILYFIMMITKFMYTIHRVLGTLLSILFLVWFLSAFVMMYHGFPRASQAEKLEKLEPLSPSLPSVSEITSRLPEGEKVKGIRLDRYLGQTIFHIRTDKGEHNLPADSVQALPVIDGSRIHRVASLWCNAPIDRIDTLNRLDQWIPFGGLKREFPIYKFHFADTEKHQLYIGSQSGEVLQFTTRNERFWAWLGAIPHWVYFTWLRQDAALWSITVIWLSGIGCLMTIAGLWVGMDVWRRSRKQKGKFSPYRKKWYHWHYVTGIVFGLFVLTFCFSGMMSLAEVPAWISKPVLDRNPTREIKKGAPKPVQYLLDYRQILTEYPDVRQVEWSNFRSKPYYIVKRSEGDLYIDASDSLPHPLNLDKKQVTDAVRTIHGDSIHLKVELIDKFETYYRDMSRMYRDRSLLPVWKITVDDPDHSCYYIHPETATVRYVNSTARWKYWMYTALHRLRIQGLNSSPTLRKSVLWVLLLGGTVCSLSGVVLGVRYIERKCRKKTRR

SEQ ID NO: 5774 - protein, 172 aa, B.fragilis
LNTTQTMNKKLLKQIVNERRSNSWLFIELLLVSIVLWYVVDYMFVTLYTYFEPRGFDIENTYRVEFDYLIEKSPDYIANRTDEEAHADMRELLDRLRRRPGVEAVSMSQNSFPYNGSNSGMDVRLDTMESKYNIRRWVTPDFFRVFRYQGANRRNSGTISCSVEGGYFYGIA

SEQ ID NO: 5775 - protein, 347 aa, B.fragilis
KVYTLLCKRRLLIFGVNLNKMKVYIKNISRKKGEFQFYMHQFVEACIRQNIPFVNELHVCVRLKLSAVMIKLGHWINFFFCRCNNKAIIVSTWGGGLMYTSFPYSLLYEIIPVFWDSWPFNWEEQIYSLRRLNCRTCFVTSSQVAQRIKETLPNINVHWLPEGIDILDYVPGQDLTERSIEIYELGRQKADYHKILCDLKSEGIFSSFLCNEYDINGMTTKLAFPTAKALLKALPNIKIVISFPQVDTHPEKVGNIETLTQRYWEAMLSRNLIVGRAPNELIQLIGYNPVIDVDWEDPKKQLSDILLNISSFQKLVDRNYRTARKISSWDNRVKDIITILRTSGYEI

SEQ ID NO: 5776 - protein, 386 aa, B.fragilis
RRLTRRIKRKNKMFSDELEKISWEETTKAIYSKTDADVRRALSKEHCDVNDFMALISPAAAPYLETMARLSRKYTMERFGKTISMFVPLYITNSCTNSCVYCGFNHNNPMKRTILTEEEMVNEYKAIKKLAPFENLLLVTGENPAKAGVDYIERALLLAKPYFANLQIEVMPLKAEEYERLTHAGLNGVICFQETYNKANYNIYHPRGMKSKFEWRVNGFDRMGQAGVHKIGMGVLIGLEEWRTDITMMAYHLRYLQKHYWKTKYSVNFPRMRPSENGGFQPNVVMNDRELAQVTFAMRIFDHDVDISYSTRESAAFRNHMATLGVTTMSAESKTEPGGYFTYPQALEQFHVSDERKAVEVDAALRSLGRIPVYKDWDTALTLPQC

SEQ ID NO: 5777 - protein, 555 aa, B.fragilis
LNITLDIMMKSNENNGAVTKSFAKKMESISPFELKNKLIEMADESIKKIAHTMLNAGRGNPNWIATTPREAFFLLGKFGLEECRRVMYLPEGIAGIPQKDGIAARFETFLKTNHSQPGAELLKGTYQYMLLEHAADPDTLVHEWAEGVVGDQYPVPDRILQFTEMIVQDYLAQEMCDRRPPKGKYDLFATEGGTAAMCYVFDSLQENFLLNKGDGIALMVPVFTPYIEIPQLRRYEFNVTEISADQMTTDGLHTWQYKDEDIDRLRNPQIKALFITNPSNPPSYTLNPETAARIVDIVKKDNPNLMIITDDVYGTFSPHFRSLMAELPQNTLCVYSFSKYFGATGWRDAVIALHEENIFDRMIAHLPEEQKTILNKRYSSLTLTPEKLKFIDRMVADSRQVALNHTAGLSLPQQTQMSLFASFAILDKENRYKNKMQEIIRRRLKALWDNTGFSLVDDPLRVGYYSEIDMLVWAKIFYGEEFVSYLKKTYSPLDVVFRLANETSLVLLNGGGFAGPEWSVRVSLANLNEKDYVKIGQGIKRILDEYAVKWQESRK

SEQ ID NO: 5778 - protein, 595 aa, B.fragilis
TNKTITSPPAPLPSITLREKNTGLRDPNNECMEQRIKFPRSEKVYLSGKLFPEIRVGMRKVEQVPSTTFEGEKKVITPNPHVYIYDTSGPFSDPDIEIDLKKGLPRLREEWILNRGDVEQLPEISSEYGRMRRDDGSLDHLRFEHIALPYRAKAGRHITQMAYAKQGIVTPEMEYVAIRENMNCEELGIETHITPEFVRQEIAEGRAVLPANINHPEAEPMIIGRNFLVKINTNIGNSATTSSIDEEVEKAMWSCKWGGDTLMDLSTGENIHETREWIIRNCPVPVGTVPIYQALEKVNGKVEDLTWELYRDTLIEQCEQGVDYFTIHAGIRRHNVHLAEKRLCGIVSRGGSIMSKWCLVHDRESFLYEHFDDICDILAQYDVAVSLGDGLRPGSTHDANDEAQFAELDTMGELVVRAWEKNVQAFIEGPGHVPMHKIRENMERQIEKCHNAPFYTLGPLVTDIAPGYDHITSAIGAAQIGWLGTAMLCYVTPKEHLALPDKEDVRVGVITYKIAAHAADLAKGHPGAQVRDNALSKARYEFRWKDQFDLSLDPERAFSYFHAGRHTDGEYCTMCGPNFCAMRLSRDLKKTQKQK

SEQ ID NO: 5779 - protein, 257 aa, B.fragilis
PIKTKKHTAMEITLKNQFITLWNTYFPQAGLPITFQYSADTQNLPIVEAPKGHRCIIAQLTQVQRGKTLCMQADSVGCRGGKRYTNFTDKMFPGFECFLSHNEQGEGERYKQTPELAAAALAQLPALPVKGENLIFKRWDKLEAEDMPEVVIFFVSADILSGLFTLACFDNVAPDAVIAPFGAGCASIIYHPYREQLDRTNRAVLGSFDPSARKCMKPDLLSFAIPFNKFKSMVSQMEESFLKTATWDVIKKRIGSS

SEQ ID NO: 5780 - protein, 155 aa, B.fragilis
QARTLFGSLLTTIFAQYSHIKKIKQMKKIILGACAVLFTLASCQQAKQKVFELAAEQVNKQCPITVDEMTRMDSTTYSGKDNTFTYFYTLSGQADDPTMSEQLKKSLEETLPETIKNTEEMKVYRESDVTIKYIYLSGKTKEELIQVTVTPDMYK

SEQ ID NO: 5781 - protein, 408 aa, B.fragilis
MELTLLLIIAALLVALLVLTLTRNNRAQSEEMQRALRQQMQENREELNRSIRELRMEMTQTLNQGLQQLQDAMHKNMMTTGELQRQKFDAMARQQETLIQSTEKRLDDMRVMVEEKLQKTLNERIGQSFEIVRSQLENVQKGLGEMKSLAQDVGGLKKVLSNVKMRGTFGEVQLGALLEQMMSPEQYEANVKTKKSGTEFVEFAIKLPGKDDANSTVYLPIDAKFPKDVYEQYYDAFEAGDAALMESCGRQLETTIKKMAKDIHDKYVDPPFTTDFAILFLPFESIYAEVIRRTSLVETLQKDYKIVVTGPTTLGAILNSLQMGFRTLAIQKRTGEVWTVLGAVKTEFGKFGGLLEKVQKNLQSAGDQLEEVMGKRTRAIERKLRQVEELPHEESRRILPIDDGGEDD

SEQ ID NO: 5782 - protein, 140 aa, B.fragilis
CNVAKNAMILGAKRLVVTIYIQYHLCLKYEFALVRVKELLPLVDDNIPANDKDAVELSVMSDIVIAYGKEHYPIEKPTVAELIELYLEEKGMSQKQLAIEIGISLSRVNDYIAGRSEPTLKIARLLCRILNIPPVAMLGF

SEQ ID NO: 5783 - protein, 251 aa, B.fragilis
GKYFKPMGRAFEYRKATKLKRWGNMARTFTRIGKQIAIAVKAGGPDPENNPHLRAVVATAKRENMPKDNVERAIKNAMGKDQKDYKEMNYEGYGPFGIAVFVETATDNTTRTVANVRSVFNKFGGTLGTSGSLDFMFSWKSMFTITKKEGVDMDDLILELIDYGVEEEYDEDEDEITLYGDPKSFAQIQKYLEENGFEVKGAEFTRIPNDEKDLTPEQRATIDKMVERLEEDEDVQNVYTNMKPADNEGEE

SEQ ID NO: 5784 - protein, 790 aa, B.fragilis
QINFMPDYIEELNESQRAAVLYGDGPSLVIAGAGSGKTRVLTYKIAYLLENGYNPWNILALTFTNKAAREMKERIARQVGEQRARFLWMGTFHSVFSRILRAEASHIGFTSQFTIYDSADSKSLIRSIIKEMGLDEKTYKPGSVQARISNAKNHLVSPSGYAANKEAYEGDLAAKMPAIRDIYSRYWERCRQAGAMDFDDLLVYTYILFRDFPDVLARYREQFRYVLVDEYQDTNYAQHSIVLQLTKENQRVCVVGDDAQSIYSFRGADIDNILYFTKIYPDTKVFKLEQNYRSTQTIVRAANSLIEKNERQIPKEVFSEKERGEAIGVFQAYSDVEEGDIVTNKIAQLRREHDYEYSDFAILYRTNAQSRVFEEALRKRGMPYKIYGGLSFYQRKEIKDIIAYFRLVVNPNDEEAFKRIINYPARGIGDTTVGKIITAATDNNVSLWTALCEPITYGLSINKGTHTKLQDFRALIEQFMADVTVKNAYEIGTEIIRQSGIINEVCQDNSPENLSRKENIEELVNGMNDFCAMRQEEGNTNVSLIDFLSEVSLLTDQDSDKEGDGEKVTLMTVHSAKGLEFRNVFVVGMEENLFPSGMAGDSPRAMEEERRLFYVAITRAEEHCFLSFAKTRFRYGKMEFGSPSRFLRDIDTRFLQLPQEAALGRSVDEGAGRFRREMEEGYSRRSSSERFSARPSADRPERERPKAQIIAPTVPRNLKKVSGTTLSPSSASGAGVAGVQPGQTIEHERFGLGEVIRVEGTGDNAKATIHFRNAGDKQLLLRFARFKVIE

SEQ ID NO: 5785 - protein, 72 aa, B.fragilis
LKFLKQMLKEKAGEIAGKIWNALNGTEGLTAKQIKKATKLVDKDLFLGLGWLLREDKISTQEIEGELFVTLN

SEQ ID NO: 5786 - protein, 442 aa, B.fragilis
VSYYLDQYVFYMIFFKVKTRNLVFSFILLSLLIVSDLLLFTRYSNWGIKTDSIWLFIAIIDVVLLFMLISFFRFKRIVNPSSVYLVFVGLFAYSVLPLSENIRFSNELLLIILCGVAAYFVGVFCLPQIHIITFPVFTNRTKRIFYYILCVLTFSCFIYEIKNVGYIPVFVIGQSLDIYGEVGESNSVLHTFVLLTPILFYWSLILAKEGIIQTRIRNCIVSFLLFVFVNNFGRTSLLMFIITGLIYLEFYTKLSVSKFISIIFLFISLFIIMGNVRSGSTFDGINKVLRRIGNTQYETSILESYLISYSSVNFYKMNDVIQLKEVLNYSSNGRNSLKPIVKLLSISEPLDNVAEFQTQQNLSTYIADPYLDFGYAGVVVLNCLYGMIAVMLFERYEKKNCPEYIISWGVVVFCILMGCFFNAFNTMLVWVIYICNKILLKR

SEQ ID NO: 5787 - protein, 451 aa, B.fragilis
TIHYMSKKETLKQQILDLTREYYKEVHGSSRSFEPGKSFVNYGGRYFDDRELVNLVDSSLDFWLTAGPWARKFEIRFAEWLGVKYCSLTNSGSSANLLAFMALTSPQLGERRIRRGDEVITVACGFPTTVTPCIQYGAVPVFVDVTIPEYNIDVTQLEAALSPKTKAVMIAHSLGNPFDLQAVKDFCDKHNLWLVEDNCDALGSTYTIDGVEKKTGTIGHIGTSSFYPPHHMTMGEGGAVYTDDPLLHKLVNSFRDWGRDCWCIGGVDNTCKYRFSKQFGDLPVGYDHKYVYSHFGYNLKVTDMQAAIGCAQLEKLDSIVEARRSNFAYLKEGLAGTSGLILPEAQKNSDPSWFGFLISVKEDAGFTRNDLSQHLESRKIQTRNLFAGNLLKHPAFDEMRSTGEGYRVIGNLEGTDYVMNHTLWIGVYPGMTRAMLDHMIGTIRDFVSSRK

SEQ ID NO: 5788 - protein, 300 aa, B.fragilis
REHYLMYVKKRNNHFKIYNLMEQRTYLPLVSVITVCYNATTVIEATILSIIGQTYSNIEYIIIDGGSTDGTIEVIKKYEKKISYWVSEPDKGIYDAMNKGIVKSTGEWIHFLNAGDVYLNTHILEDCIRCFNEKKVKADVLYGDVICKFDFGNLLLKPGALSDFESYFPISHPATLVKGELLKENIFDTSYQISADYELLYRLYHKGCTFEYIPIPLVLFDAITGISSTNPLLLYNENTRIQDNRHKIRKCIRIAIIKVRVLLSFIINGFLLNDYVRNNYHKKRLLRNKRFNEIDINNFI

SEQ ID NO: 5789 - protein, 318 aa, B.fragilis
LMYYLIILVLLFLAELFYFRIADKCNIIDKPNERSSHTRITLRGGGIIFYLGALAYFLTNQFEYPWFMLALTLITFISFVDDIRSTSQGLRLVFHFTAMALMFYQWGLFNLPWWTILVALIVCTGIINAYNFMDGINGITGGYSWVVLLALAFINVQIVRFVEEDLIYTMLCAVLVFNFFNFRKKAKCFAGDVGSVSIAFVILFLIGKLIIRTENFSWIVLLVVYGVDSVLTIIHRLMLHENIGLPHRKHLYQLMANELEIPHVMVSLIYMTSQAIIIVGYLLTPGWGYCYLLGTIVILSMVYILFMKKYFHLHPAMK

SEQ ID NO: 5790 - protein, 495 aa, B.fragilis
INEYYMKRYFLLSAFAFCSLALSAQETQEITLNEAIALARTQSVDAAVALNELKTAYWEYRTFRADLLPEVNFSGTLPSYSKQYNSYQNEDGSYSFVRSNKLGLNGALSIDQNIWFTGGKVSLSSSLDFMKQLGSGGSRQFMSVPIALQLTQPIFGVNNLKWNRRIEPVRYEEAKAAFITATETVTMNAITYFFNLLSAKETLGTARQNQVNADRLYEVAGAKRKMGQISENELLQLKLAALKARAAVTDAESNLNAHMFRLRSFLAIGNDLILEPVVPESAPNLKMEYNQVLNKALERNSFAHNIRRRQLEAEYEVATARGNLRSVDLFANVGYTGLNKDLSPAYHNLLDNQVVEVGVKIPILDWGKRRGKVRVAKSNRDVTLSKIKKEQMDFDQDIFLLVEHFNNQAQQLSIANEADKIAQQRYKTSVETFLIGKINTLDLNDAQNSKDDARQKHINELYWYWYYYYQLRSLTLWDFQNNTPLEADFEDIVKK

SEQ ID NO: 5791 - protein, 801 aa, B.fragilis
NGGYNEEKSQICKRQRRMKRIILAALGSALLLPSQAQQKNKEYTNFNDSVFSINEVVVATNYRRKTDALKLDVPAKFIPISTNSITSGMLEKRNIRDIQEASRFLPGVRFRTSYGAFTQFSIRGFDNSVIMVDGVRDERSSIDNSYPFMDLSAVESIELLKGPASVLYGQSAVGGVLNIVRKAPVSKQSVYARLAYGSYYNKQATMALGGKLIGPLNYRASVNWQDQEGWRSNATKRLSGYLALGGHLTENDELDIRIGANRDFYPTEIGLPPTMSYDILSATDGSKYLSKGDALPGLNKKARYNSESDFMYNRGFNASAMYKHTFSEAFKLMEKLSYTYDDIDYFGTESLDYLTSDRPIYDHYYMTKDKQGNDTKKYICLDSIYYSYPLRFSHIAKTVNNQLEASGKFYTGDVAHNYLGGYSFVSLMRDSYMAYGNGSTGATGPGTTGHSSVYNPHSIGWMEAPFRFVTAQKTFTHGFYLQDLVEFSDKLKMMLAGRYDLFMYKTANLNTSDGGRHYDKPDDDAYNKITNGAFTFRAGLVYLPIEKLSVYGSYGTYFKPIRAFYDANTIYIDKDGKEFTPVNGKEVFKPEKGFQVEVGARYEITRTLQTNVSLFYINKDNIRQTLANKGDIANGVELDKKVVGQVGKMDSKGFDIDITWSPIYNLSMSAGYGYTDAKVRDLADNPYMPTTSSKGKQYAYIPKNTFYAFGAYTVSKGVLKGLGVNFSTSFQDKVYRNSDNTSSFDAYWLTDLGFSYTLKSNVRLGVNINNLFNKEYCNQALGNQLIPSMPRNFMLSASYTL

SEQ ID NO: 5792 - protein, 94 aa, B.fragilis
VRFHKIKEIFLFELYKYSLYILGFRRLFSPVGSVCTIQIYTKRRGYPLGVASHKPVNLKLFFDGCLRRCQTCDRHTERRTANVIQTYFMAELNR

SEQ ID NO: 5793 - protein, 299 aa, B.fragilis
SMNLLFTGASGFLGSNLYSLLKDKYQIRTVGLTPRDNYTINLVSDVPKLNIKYDVVLHAAGKAHSIPKTEEEKQLFFDVNLQGTKNLCTALENSGIPKAFIFISTVAVYGCDSGENITEEHPLNGTTPYALSKIKAEKYLEGWCAMHNVKLSILRPSLIAGPNPPGNLGAMIRGIRNGKYLSIAGGKARKSVLMVQDIANLLPMLIEKGGIYNVCDSYQPSFRELEMVICNQLNKKRPISIPYWLAKSMAVIGDCLGKKAPINSLKLRKITSSLTFSNEKAVRELKWKPMNVLETFLIE

SEQ ID NO: 5794 - protein, 478 aa, B.fragilis
SGCHPGKCHSLLSRCGTTQTRKRRIADDRYTDVLFIRIVHYIKRMKTSETTRPTLSSLPVGKRAEEGTPHNLFTVIGLDDSPSPYLSPSVKALIDQGCVFSGGTRHHDIVAPLLPAGAKWIDITVPLDQVFARYAGHPHIIVFASGDPIFFGFANTIHRRLPDAEIRLYPSFNSLQTLAHRLVMPYDDMRTISLTGRPWHGFDRALIERTPKMGILTDREHTPATIASRMLDYGYNDYTMYIGEHLGHPAKELIRRMTLEEAAAETFEYPNCLILTTGDGLQSVNGGILSPRFFGIPDEAFELLDGRARMITKAPIRLLTLSALELNRRTSFWDIGFCTGSVSIEARLQFPHLHVTSFEIRPEGKRLMEINSRRFGTPGITTVIGDFLETDTAIYPCPDAVFIGGHGGRLKEIISRVRHKLLPGARIVFNSVSEESKTHFIEAANESGLCFLGGTRVAINEYNPIEILVASAPDSPYL

SEQ ID NO: 5795 - protein, 632 aa, B.fragilis
IARHPAGEKILFHPHHEYVAELQSFGGMYRHQSHLLAVSLLVGILIGEQGYFGEKVDQRNVRVPLFLTHGTKIIHTVHQFLDVFFPAEIFGRIVLADFIDDAGLTDDFRTYFISILYGHICHKLLDQRTKILQFGMCTFIDGKPVRNGFAECGPEADIVIGGGSNNLAHRGIADAACRIIDNPLERLFVIGVDHQAEVGYDIFDLLALIEREAAVNLIRHAPFAQSLFEDTALGIGTIKDGEVGVFIIVLATQLRYFIGHNVAFFHITVSLKDPDGLTPFLLGEHLFGDLPLVLFDQAVGRTDNGLGGTVVLLQLEDFGIGIYLGEIQNIVNVRSPEGVDALRVVAHHAYTLILLCQLQHDAVLCIVGVLILVDKHIAELLAIACQHVGKVAEKDIGIDQQIVEIHCSGLPATLPVAAVDIPYGRHLCGKIALVRLLVGCVSRRRHQVVLRIGDACLHTAGLIGLLVKPHLFDDGTNQALAVRRIVDGELRRKADMGRLGTKNTGKNRMERTHPKESCTLLAHLPGNTLLHFTGSFVGESQCQDIPGIVTVLEQIGYLISEHTRLSGTGTGDDQRRAITVEHRRTLAFIKFFDIVGHKIYLLNLYSRAKIEESLDNSEHLAPISCYIFREMK

SEQ ID NO: 5796 - protein, 103 aa, B.fragilis
FGFLFLFTVYRCFKITVRDNSSIPATAQSDGGMLLNYDDTENRTYLRFTGYPPLITQLNNIGKEGYINVIDTKSVLKVSPSNNQIEVAPFEDYDAHTTRCVQE

SEQ ID NO: 5797 - protein, 68 aa, B.fragilis
TQFLLSIYFKYQISKYYKIYHHWATGKFLGYYKCSYYQSRYYRCRVDSRSYNSWRFMSTNESYLFRSI

SEQ ID NO: 5798 - protein, 240 aa, B.fragilis
NIAKTMITVCMATYNGEKYIEEQLESVLMQLHSNDEVIISDDGSGDSTVDLIRTFNDPRIRLLVGNNFFSPTQNFENALKYAKGDYIFLCDQDDVWLPDKVESMLQYLLQYDLVVSDCKVVDAELNVISQSFFMGRSSGKGFWKNLIKNTYLGCCIAFRKEVLGYILPFPRNIAMHDIWIGLSVEMHSNSFFLPRQLILYRRHGSNVSFGGEGSKYSLMYKIKYRLCMLFYLLKRKYLNK

SEQ ID NO: 5799 - protein, 68 aa, B.fragilis
ARHNTPEVRGPTSHLPSRISHDFYKKVRDTAKTINHSEQTTNTISYSTNSINYLPNLSRRLENGPYYR

SEQ ID NO: 5800 - protein, 409 aa, B.fragilis
SIHKINIMEKNIFKLDNEQLKGIAHAFREKVEEGLNKNNAEIQCIPTFILPKATDVKGKALVLDLGGTNYRVAIVDFSTEKPIIYPNNGWKKDMSIMKSPGYTREELFKELADLIVEIKREEEMPIGYCFSYPTESIPGGDARLLRWTKGVDIREMVGQFVGKPLLDYLNEKNKIRFTGVKVLNDTIASLFAGLTDKSYDAYIGLIVGTGTNMATFIPSDKITKLDPECHVQGLIPVNLESGNFYPPFLTAVDDTVDATSDSLGKQRFEKAVSGMYLGDILKAAFPLEEFEEKFDARKLTAIMNYPDIHKDIYVQVAHWIYNRSAQLVAASLAGLIALLKSYNRDIHRVCLIAEGSLFWSESRKDKNYNILVMEKLQELLRELELEDVEVHINSMDNANLIGTGIAALS

SEQ ID NO: 5801 - protein, 82 aa, B.fragilis
IRHKATMINPIQLKSTNTASILENDLSNSLKSRNDTNLDKLGTLVYIQFIETDETPFITLNVIPSCPAAALPIVANRIGLKN

SEQ ID NO: 5802 - protein, 439 aa, B.fragilis
ENSNKHKMIKQYFKQALAQLRQQPLLTTISVLGTALTICLIMVVVMQQQIKTAPFAPESNRNRLLHVKQMSTSNKNWSDDGSSNGPMGLQTAKGCFEGLTTAEEVSIYTIPETMQVALPRGVRTGIDALETDGAFWRIFDFSFIDGKPYSDAEVKSGLPVAVITESVARLLFGTSHQVSGKEILVNDAVYRISGVVKDVSSMASTAYAQIWVPYSSTHITGGDNTWCDGIMGVMRVVILARSSSDFEAIRAECERRRLAYNAGLGDYFVFYRGQPDDQLTMSQHKWANVQPDMAAYFRQQVIIFLILLLVPAINLSSMTHSRLRQRVAEIGVRRAFGATRGGVMGQIVAENLVLTLMAGVVGLLFCLIISYCWGGTLFADSRLMYLNTAPVIEWKMLFKFSTFIYALLFCLALNLLSSGWPAWRASRMSIINALSGKLN

SEQ ID NO: 5803 - protein, 95 aa, B.fragilis
LFFNIFLSIIGSHTNCYHRFSNILLHIYITHTNIVLNALKKHPINIQKTTTPHEIMYSGQFFFSYLSNNITAIIPYRQLRTTTPAYPKSRYGSAI

SEQ ID NO: 5804 - protein, 192 aa, B.fragilis
RKLKNKNRMTATERTAEYRKALDVPISQLETDRIVKEILDRPENFDNIYRLTSDDKLLVSWRALWICDKLCRQKPEWLIPFREELTGRLMSCGHDGSKRLLLSILYHAPATKVPSVALLNFCLDAMLSPQESIGVQSLAIRMAYRLCEPEPELLYELRTILESTETEMYSTAVKSAVRNTLKKINQKNKKKK

SEQ ID NO: 5805 - protein, 266 aa, B.fragilis
NELKTRSEMEKLIIAGREFNSRLFLGTGKFSSNEWMEQSILASGTEMVTVAMKRVDMESTEDDMLKHIVHPHIQLLPNTSGVRNAEEAVFAAQMAREAFGTNWLKLEIHPDPRYLLPDSVETLKATEELVKLGFVVLPYCQADPVLCKQLEEAGAATVMPLGAPIGTNKGLQTKEFLQIIIEQAGIPVVVDAGIGAPSHAAEAMEMGASACLVNTAIAVAGNPIEMAKAFKQAVEAGRTAYEAGLGMQAIGFVAEASSPLTAFLNE

SEQ ID NO: 5806 - protein, 109 aa, B.fragilis
KNANTKTQHPITESIKEKRGRKTGAQIPGIISNNEGVIKALIESYILDAKEQNIKTCKDSLARYIEEKELFGKMRNGVFKPLVFSTIRNYVNEIWNKMERKKKNQEGKR

SEQ ID NO: 5807 - protein, 426 aa, B.fragilis
KKNKRHDILMKNIFKDLKSKDHKRYLGGLDVFRYIGPGLLVTVGFIDPGNWASNFAAGSEFGYSLLWVVTLSTIMLIILQHNVAHLGIVTGLCLSEAATQYTPKWVSRPILGTAVLASISTSLAEILGGAIALEMLLDIPIVWGAVLTTVFVSIMLFTNSYKKIERSIIAFVSVIGLSFIYELFLVDIDWPMAVEGWVTPAIPKGSMLIIMSVLGAVVMPHNLFLHSEVIQSHEYNKQDTASIKKVLKYELFDTLFSMIIGWAINSAMILLAAATFFKSGIQVEELQQAKSLLEPLLGSNAAIVFALALLMAGISSTITSGMAAGSIFAGIFGESYHIKDSHSQVGVILSLGIALLLIFLSADPFKGLIISQMVLSIQLPFTVFLQVGLTSSRKVMGDYVNSKWSTFVLYTIAVIVTVLNIMLLFS

SEQ ID NO: 5808 - protein, 95 aa, B.fragilis
MNDKPITDTKAMMERSIFLYEFVKSMMETKTVVRTAPQTIGMSSNISSAMAPPRISASDVEMEASTAVPSMGRDTHLGVYCVAASERQSPVTIPK

SEQ ID NO: 5809 - protein, 448 aa, B.fragilis
NCLNLILYIPIMTVLRSMKDFSSMNITASILLFVTAIAAAVIANSPAASVYQEFLSHELHFRIGGFNLLSHAGHNLTMIEFINDGLMTIFFLMVGLEIKRELLVGELSSFRKAALPFIAACGGMVVPVVIYSMVCAPGTEGGQGLAIPMATDIAFSLGVLSLLGKRVPLSLKIFLTAFAVVDDIGGILVIAIFYSSHVAYEYLLWAALLYVLLYFIGKKGATNKIFFLVVGVVIWYLFLQSGIHSTISGVILAFVIPAKPQLNVGTYIERIRRIISTFPEMGANNIVLTNQQIAKLKEVESASDRVISPLQSLEDNLHGAVNYLVLPLFAFVNAGVMFSGEGEVIGGVTLAVALGLLAGKFLGIYSFTWLAVKSGLTPMPLGMNWKNISGVALLGGIGFTVSLFIANLSFGSAHPVLLNQAKLGVLSGTVMAGILGYLVLHWVLPKRR

SEQ ID NO: 5810 - protein, 337 aa, B.fragilis
PNLNIMKYFVPLFLSLFFLVFMSCGNEDNAWDNNIPIITPNEQSDSSGLLKSQITDIINYSKINFDENFNNTELYKNLILSPKWENVSMVLQKQDTLHLCVPLLAQDNPEHNSYYLFISNIKSANIIRFTIIGLPENFWDIINAPITRAGIIDAGWIPEVTILGDLCRQMSHICSDPYDEAFLEFLHSKWLKEHGNESSSDSSSSGGDYSRLTEAEKRFLMRHPQVIKKFHDNARKASEAAKKFPGQHNGEGDAVRHVYWSALNTLSENANLAKEFGDAHEQNPGQDIAEKNMDLFNNSIGYQLGDLAKQNKWSEERLFKEIIKYKNDGKLQTKLHP

SEQ ID NO: 5811 - protein, 142 aa, B.fragilis
ILSNRNTFDPTYLWGDNLSINPLNHIRMKQKKRPASQTEAMKLRWKKRIVFEKGYTEMCAEWMAERLEALTDHLQYGHAAIAYQKQNGDFRLVKATLIYYEAEFHKKYDPTKIEGAVVYWNVDEQRWTTFQVENFMEWRPIV

SEQ ID NO: 5812 - protein, 827 aa, B.fragilis
KHKKLNDMNISYNWLKEYVNFDLTPDEVAAALTSIGLETGGVEEVQTIKGGLEGLVIGEVLTCVEHPNSDHLHITTVNLGNGEPTQIVCGAPNVAAGQKVVVATLGTKLYDGDECFTIKKSKIRGVESIGMICAEDEIGIGTSHDGIIVLPEDAVPGTLAKDYYNVKSDYVLEVDITPNRADACSHYGVARDLYAYLVQNGKQAALTRPSVDAFAVENHDLDIKVTVENSEACPRYAGVTVKGVTVKESPEWLQNKLRIIGLRPINNVVDITNYIVHAFGQPLHCFDANKIKGGEVIVKTMPEGTTFVTLDGVERKLNERDLMICNKEDAMCIAGVFGGLDSGSTEATTDVFLESAYFHPTWVRKTARRHGLNTDASFRFERGIDPNITIYCLKLAAMMVKELAGGTISSEIKDVCAAPAQDFIVELTYEKVHSLIGKVIPVETIKSIVTSLEMKIMDETAEGLTLAVPPYRVDVQRDCDVIEDILRIYGYNNVEIPSTLKSSLTTKGDCDKSNKLQNLVAEQLVGCGFNEILNNSLTRAAYYDGLESYPSKNLVMLLNPLSADLNCMRQTLLFGGLESIAHNANRKNADLKFFEFGNCYHFDAEKKNPEKVLAPYSEDYHLGLWVTGKMVSNSWAHADENTSVYELKAYVENIFKRLGLDLHSLVVGNLSDDIYSTALTVNTKGGKRLATFGVVTKKMLKAFDVDNEVYYADLNWKELMKAIRSVKVSYKEISKFPAVKRDLALLLDKKVQFAEIEKIAYETEKKLLKEVSLFDVYEGKNLEAGKKSYAVSFLLQDESQTLNDKMIDKIMSKLVKNLEDKLGAKLR

SEQ ID NO: 5813 - protein, 63 aa, B.fragilis
SHKNRRRSSLLECGRTAMDDIPGGELHGVETDRIGRHHRLHGFSQMNDFYFEESSEDIFGNPG

SEQ ID NO: 5814 - protein, 192 aa, B.fragilis
NVKNKLMEHIIHLLIGFIVLSFLLKTGFYPRWGIWLSALVYTVFLICIGPWATEQSPTEINSLLASAPHILTLSVYVTLEASIMIAFCFNCFADTSKQRTLFQRTVTYILNFYPGLLMAGILTYLLIQLFFAFPGVSFGLITGISSVAVFILISGLSLLLKNIVGERKLRLEILFITNLFIVLLSVVSTGNN

SEQ ID NO: 5815 - protein, 240 aa, B.fragilis
ENGNYDLKYSSSPICLSYCLVSLAQETTKEITIINMETISNALFWISNGLLVPVVVLLLLFFARAVLLAGGFFGEFYRRVHTQKSLAEQLEELTPDNIEEKANSLTGDRSTPLQRCVYKLYTHRDNAAYCERLLANFEVDAEQELGRSRTFVKLGPMLGLMGTLIPMGPALVGLATGDIASMAYNMQVAFATTVVGMVIAAIGVVTLQIRQRWYAREINDLEFISKTLIHGTKQTSTQPE

SEQ ID NO: 5816 - protein, 315 aa, B.fragilis
CCLNLNKKMNMKRIKRTPAEKARAQYTGYLVKEPMELMDFLAAKMPDASRTKLKSLLSKRIVLVDNVITTQFNFPLQPGMKVLISKDKNKKEFRHPLLKIVYEDAYIIVVEKKEGLLSVGTERQKERTAQHILSEYVGRSGRGNRIYVVHRLDRDTSGLMMFAKDEKTQYTLRDHWHDIVTDRRYVAVVTGEMEKDSDTVVSWLTDRTLYVSSSSYDDGGSKSITHYRTIKRANGYSLVELRLETGRKNQIRVHMQDLGHPLIGDGRYGIDGGPNPLGRLALHAFKLCFYHPVTDQLMEFETPYPPTFKKLFLKK

SEQ ID NO: 5817 - protein, 601 aa, B.fragilis
KYMKTAIIVISEAGIALAKTLEQELPESEIFSTGTDTDCHSISNLQEAVPEIFHKFDAIIFIGAMGICIRAIAPHIEDKHKDPAVVCVDSTGRYAVSVLSGHIGGANGLTRYVASILGAEPVITTRSDRTGLWALDTLGKKYGWQTVPAESSDMNHLITLFVDCKPTALLLDIRDEGTTQLEHTLPPHVDVFYKFEDMDLRKYDLLLLVTPFIYNTSDTPALYYVPPVLHMGVGLARDAHPVDTVITHLMDVVVQANMIPLAIRTVSSIEEKKDEPVLKLLAEAYQTRLYTASQLSKIEVPTPSEVVNKHMGTPSVSEASALLSSGGGPLLLPKQKGANFTVAIAMDAASVRQGHIEIVGAGPGDPELISVRGRRFLEEADLILYAGSLVPRELTECAKAGATIRSSASMTLEEQFALMKEFYDRGQLVVRLHTGDPCIYGAIQEQMNFFDQYGMHYHITPGISSFQAAAAALQSQFTIPERVQTIILTRGEGRTPMPEKEKLSLLARSQSTMCIFLSAGVVDQVQRELLEHYPPTTPVAACYHLTWKDERIFRGQLQDLAKIVNENHLTLTTMIVVGDAIDNREGLSRLYSHQFKHLFRK

SEQ ID NO: 5818 - protein, 162 aa, B.fragilis
QDMNYLESEISALYASAHELCYLGMDGRPIYSDQFTRLNRDVFSQANALYDKHGDSDEEEARLCLSLLMGYNATLYNNGDKEERIQHILDRCWDVLEHLPASLLKVQLLVYCYGEVFDEELAREAQAIIDTWQDRELSEDEREVMERLKDVQENPYPWSEVE

SEQ ID NO: 5819 - protein, 136 aa, B.fragilis
EEMKGYWKILLILMLAVGFASCEDDQGEIEYVITGRAWTGDVGMNAHNGEPLFSTFEFGNDGFGVETQFYASDGLLYDQFRFQWYWEDSYNRNLVLNYGKNGISYMDDVRIYGDRITGAFYLSDDARGFNFELRME

SEQ ID NO: 5820 - protein, 1326 aa, B.fragilis
DISNENAERKQEDNMKVLTLFRHKRTLYIAGSVLLLAIAFTIGYRYWMAPTRILIVNPLPAQAADIVLNNDSRNIEVTCIQTENLESFKGYDAVVLYGRSLNLNDRQMKEAERAASAGIPLFTISLRNFNTIINRNITPEQEAMLMQYFGDACRQNYRNGLRYLRHIATPTRWNIETFDAPLRLPNNLFYHQEYGKYFETQKALEQYLRQKGIFHENGPKIAFISGVSFPMEGNRAHVDTLISKMTQAGFNVYPIAGKEKREEMLRSLHPDALVYLPMGRLGDDSLINWLHTENIPIFNPFPLIQSREEWLDPMKPVSGGTLTARVLVPEIDGGMTPLLIATQNLHKSGYYLHEPEMERVDNFISHVHKYLDLRTKPNSDKRIAICYFKTPGKDALLASGMEVIPSLYNFLKRLRTEGYDVSGLPATVEEFGKQIYRDGAVMGSYATGAQEKFLQTAHPVWLTKTQYEKWVHEVIEPDKYKEVTERYGDAPGHLLTGTNPQGEAQLAIACLRFGNILLFPQPRPALGDDDFKLVHGMPVAPPHSYLAPYLYVQKGFQADALIHFGTHGNLEYTPGKNVALSHNDWADALVGDLPHFYYYTTGNVGEGIIAKRRTHAVLVTHLTPPYVESGMRQRYTSLLEDIHKILSEDIEKNRTLGIRIKKEVIKLGLHRDLKLDSVSSRPYTAEELERIDLFAEEIANEKTIGAYYTLGETYSARDLLTTTLAVSADPLAYQMAKRDRDKGKITTEQLQDFGYITHHYLPIAKQRLIPLLQNPPKDTTGIAPELQEALRYHALLVSSTGNELNAMLRGLKGGTVFPAPGGDPVLNPNVLPTGRNMYSINVETTPGILSWEEGKRLAEATLKAYRENHSGKYPRKVSYSFWAGEFITTEGATLAQVFWMLGVEPVRDKMGRVVDLRLVPSSELGRPRVNVVVQVSGQLRDIAGSRLTMLTDAVRLVSAADDKAYPNYVSSGTRLQEKLLVEKGVSPKRAREMSVMRVFGPVNSGYSTGMMAYTEKSDRWDHESELVDGYLNNMGAAYGDEEDWGGMQKDLFASALSETDVVIQPRQSNTWGPLSLDHVYEFMGGLSLTVKTLTGKEPDALMADYRNRNNKRMQNINEAIAVEARATVLNPTFVKERMKGGATTAQMFGEIFRNIFGWHATRPSAMDKEIFNDLYKMYIVDENHLGIRDYFQRINPASYQAMTSVMLESARKGYWKASDEQLKVTARLHAQITREAGAACTEFVCDNRKLQQFVEGHLDNNDSESYRLVMQEVHQAGNEKGKDIVLKEEKLTKTENRKKNVVNGILTGVIVLLAFGGVIYLLKRKK

SEQ ID NO: 5821 - protein, 173 aa, B.fragilis
LVADKDTFLIFLQEIKKYKMTKEERISRATELFKSGYNCSQSVVAAFADMYGFTEEQALRMAASFGGGIGRMRETCGAACGMFLLAGLEKGAIDGADREGKAANYALVQELAAEFKKRNGSLNCGELLGLKKKAPVSSEPEARTEQYYAKRPCSKMVEEAARIWAEYLEKEKK

SEQ ID NO: 5822 - protein, 95 aa, B.fragilis
AENETRTRDPNLGKVMLYQLSYFRNVVPRTGLEPACLSTHAPETCASTNSATWALTNQKPAVKKNGEEQITDVLVERKTRLELATLTLARLCSTN

SEQ ID NO: 5823 - protein, 603 aa, B.fragilis
RIKDNVNNVYNDTRIDRLTKHFLAQAVFNEKLNLNKLTMDWIVHQLRVHPELAIFLTLFVGFWIGKIKIGKFSLGVVTSVLLVGVLVGQLDITVDGPIKSVFFLLFLFAIGYKVGPQFFRGLKKDGLPQMGFAAIMCVFCLIIPWILAKIMGYNVGEAAGLLAGSQTISAVIGVAGDTINELNISPETKEAYNNIIPVSYAVTYIFGTAGSAWVLGSLGPRLLGGLDKVKAACKELEAKMGNNEADQPGFMAAARPVTFRAYKIANEWFGDGKRVSDLESYFQENDKRLFVERVRQAGVIVKEVSPTFVLKKGDEVVLSGRREYVIGEEDWIGPEVLDPQLLDFPAEVLPVMVTRKTVAGEKVSTIRALKFMHGVSIRRIKRAGIDIPVLAQTVVDAGDMVELVGTKHEVDAAAKQLGYADRPTNQTDMIFVGLGILIGGLIGALSIHMGGVPISLSTSGGALIGGLFFGWLRSKHPTFGRIPEPALWILDNVGLNMFIAVVGIAAGPSFVQGFKEVGLSLFIVGALATSIPLIAGILMAKYIFKFHPALVLGCTAGARTTTAALGAIQEAVESETPALGYTVTYAVGNTLLIIWGVVIVLLM

SEQ ID NO: 5824 - protein, 595 aa, B.fragilis
YQMDKIRNFCIIAHIDHGKSTLADRLLEFTNTIQVTEGQMLDDMDLEKERGITIKSHAIQMEYTYKGEKYILNLIDTPGHVDFSYEVSRSIAACEGALLIVDASQGVQAQTISNLYMAIEHDLEIIPIINKCDMASAMPEEVEDEIVELLGCKRDEIIRASGKTGMGVEEILAAVIERIPHPQGDESAPLQALIFDSVFNSFRGIIAYFKITNGVIRAGDKVKFFNTGKEYVADEIGVLKMEMVPRKELRTGDVGYIISGIKTSKEVKVGDTITHVARPCDKAIAGFEEVKPMVFAGVYPIEAEEFEDLRASLEKLQLNDASLTFQPESSLALGFGFRCGFLGLLHMEIVQERLDREFDMNVITTVPNVSYHIYDKQGNMTEVHNPGGMPDPTMIDHIEEPYIKASIITTTDYIGPIMTLCLGKRGELLKQEYISGNRVELFYNMPLGEIVIDFYDRLKSISKGYASFDYHPDGFRPSKLVKLDILLNGESVDALSTLTHFDNAYDMGRRMCEKLKELIPRQQFEIAIQAAIGAKIIARETIKAVRKDVTAKCYGGDISRKRKLLEKQKKGKKRMKQIGNVEVPQKAFLAVLKLD

SEQ ID NO: 5825 - protein, 238 aa, B.fragilis
NKREFMERYSRQTMLPEIGEAGQLKLKAAKVLIVGVGGLGSPIALYLAGAGVGTIGLADDDEVSLSNLQRQILYTEEEVGDLKAICASMRISALNREIKVNACPGRLSKENARDLIGQYDIIVDGCDNFATRYLLSDVCSELGKPYVYGAICGFEGQVSVFNYGEGTQRKTYRDLYPDEEGMLHMPPPPKGVVGVTPAVTGSVEACEVLKIICGFGEVLAGKLWTIDLRTLQSNIFSL

SEQ ID NO: 5826 - protein, 148 aa, B.fragilis
QMTLMKTLNFMKTLFLLVAIVGLSSCGDKYYSDDYLRNSNAKLCGKTWVNDSEKNDVDEWVRHTLKFDDNGRLAETYAYYHVNESQPYRTETNNLTWSWIDDTMEGIVFDYGVNGVTYFDNVWVREHNLSGKLNGKVVVFVDSKYNRN

SEQ ID NO: 5827 - protein, 592 aa, B.fragilis
MPVWSILSLIIKNNMKVSDYIISYIESRGVHVIFGYIGGMITHLVDSVSQNPNMQFIQTYHEQTAAIAAEGFAKESGLFGVAISTSGPGATNMMTGIADAYFDSIPVLYITGQVNTYEYKYDKPVRQQGFQETDIVSMVKSVTKYAKLIDKAEDIKYELDKALYIALSGRKGPVLLDLPMDIQREEINQETLIGYSGESILNNPLIAWEEIRLLMESSHRPMLLLGAGCCNSDMVLLNDFIRRHHFPVITSLMGRGAIDETYDNYIGMIGSYGNRCANMGVANADLLIALGTRLDTRQTGARLDQFLSNGHIIHVDIDDNELEYHRLLNRKKVNCTIDCFLQKEKEMPISLGDISEWNFFLHGLKQRYGQDAEIERFVENKSPYRFMQYFDSLTQTDDVICADIGQNQMWAAQTLRLKSGQKFVTSGGLAPMGFSLPVAIGCSFANPNKKVFSINGDGGFHMAIQSLMLISQYNLPIKVIILNNASLGMITQFQHLYFDDRMCGTTLNGGYRVPDIKSLSTAYGLPYFRLTVDRLDDPDLREEMQAAHNCIIECVVEGLTSVSPKLEYDKPISKPLPLLPEEEYKENMLLEA

SEQ ID NO: 5828 - protein, 262 aa, B.fragilis
RAVWKHAKFSKSFVDSERSWQANYGQLTCGHCNLTYFHYKGWFLIKLISNFAKLNSLTKEMKLIVVTTPTFFVEEDKIITALFEEGLDILHLRKPETPAMYSERLLTLIPEKYHKRIVTHEHFYLKEEFNLMGIHLNARNPKEPHDYSGHISCSCHSVEEVKNKKHFYDYVFMSPVYDSISKEGYNSPYTAEELRLAAKDKIIDNKVMALGGITPDNILEVKDFGFGGAVVLGDLWGKFDACSDQDYLAVIEHFKKLKRMAD

SEQ ID NO: 5829 - protein, 109 aa, B.fragilis
SMARNKLLHNQNDTDPMGTVANLFDVAMVFAVALMVALVSRFNMTEIFSKEDYTMVKNPGQENMEIITKEGKEIKRYTPSEQKESSGKRGKKVGVAYELENGKIIYVPE

SEQ ID NO: 5830 - protein, 307 aa, B.fragilis
FRSSNLILISILMKGIVLAGGSGTRLYPITKGVSKQLLPIFDKPMIYYPISVLMLAGIREILIISTPYDLPGFQRLLGDGSDFGVRFEYAEQPSPDGLAQAFIIGEKFIGGDSVCLVLGDNIFYGQSFTRMLREAVHTAKSENKATVFGYWVSDPERYGVAEFDKAGNVLSIEEKPTVPKSNYAVVGLYFYPNKVVEVAKSIQPSPRGELEITTVNQRFLSDRELKVQLLGRGFAWLDTGTHDSLSEASTFIEVIEKRQGLKVACLEGIALRQGWISPEEMKALAGPMLKNQYGQYLLKVIDELSIK

SEQ ID NO: 5831 - protein, 478 aa, B.fragilis
YNSRSTVARKKKELPLLEKVTITDVAAEGKAIAKVDDLVVFVPYVVPGDVVDLQVKRKKNKYAEAEAVKFHELSPVRAVPFCQHYGVCGGCKWQVLPYAEQIKYKQKQVEDNLRRIGKIELPEISPILGSAKTEFYRNKLEFTFSNKRWLTAEEVKQDVKYDQMNAVGFHIPGAFDKVLAIEKCWLQDDISNRIRNTIRDYAYEHNYSFINLRSQEGMLRNMIVRTSSTGELMVILICKITEEHEMDLFKQLLQYVADQFPEITSLLYIINNKCNDTINDLDVHVFRGNDHIFEEMEGLRFKVGPKSFYQTNSEQAYNLYKVARDFAGLTGDELVYDLYTGTGTIANFVSRQAQKVIGIEYVPEAIEDAKVNAEINGIENTLFFAGDMKDILTQDFINQYGRPDVIITDPPRAGMHQDVVDVILFAEPKRIVYVSCNPATQARDLQLLDVKYRVKAVQPVDMFPHTHHVENVVLLELK

SEQ ID NO: 5832 - protein, 168 aa, B.fragilis
YNPSSNTRFIAFIEYNYQNMKFNRKEKTFIMKKTYLWTAMLCTAIAFSACKSNKAGQDTASEAKTEEAVIPGSDKDEHGCVGSAGYVWSEVKKDCIRPFEAGLKISETQKDNATYATYIVFAADSVQAELYTPESEGSILLERADNQWKNDTISVSCKNGQWSISKQK

SEQ ID NO: 5833 - protein, 314 aa, B.fragilis
PDKRLFIEMKILLTGATGFLGSHIAEALLANDVNLMITKRSMSSLNNCTSFIDHVQVINSDNPIWISQACSFSPDIIIHSAWTGVLSGNRYDWPVQLSNIDFMNSLLYIAEKSNVSKFIALGSQAEYGDFDGIVSENAGLFPVNSYGYVKSMVSRMVGSFCDLRGIDWYWLRVFSVYGERESNQWLIPGLLTNMLDNMAGMDLTLGQQRYAYLYVKDFANAVMKVCSGKTPCGVYNLSSSTAIELRVLLEHLRDRLNPAFELRFGALPYRAGQPMLVQGDVSKFVKSFGHFENTPLNAGLEYTITYYKKQHESI

SEQ ID NO: 5834 - protein, 86 aa, B.fragilis
RRRRVMKYVYKTQGTCSTNIELEVENNIVKEVAFWGGCNGNLQGISRLVTGMPVSDVITKLEGIRCGARSTSCPDQLCRALHEMGF

SEQ ID NO: 5835 - protein, 205 aa, B.fragilis
PMLSLQFITHQTENYSYLESARMALEGGCKWIQLRMKEASPEEVEAVALQLKPLCKAKEAILILDDHVELAKKLEVDGVHLGKKDMPIGEARQMLGEAFIIGGTANTFEDVKLHYAAGADYLGIGPFRFTTTKKNLSPVLGLEGYTSILAQMNEAGIRIPVVAIGGIVAEDIPAIMETGVNGIALSGAILQAPDPVEETKRILNI

SEQ ID NO: 5836 - protein, 297 aa, B.fragilis
YWVGYCIIIELNFKKNTYYMSNQREAGITAFLPVYNEEKRLKNVLECFQWCDEILLLDKGSVDDTVKIAKQYPNVTVLTKEHTEKYDSNEIEYFIKNCTTEWCMIVTASDLIHPKLARNMKELINNCNFEYDIVSVPYKPYFLGCCEKYSPWYTEHMNKIFRVSVLNLNLNSVHAVLTPTSSRLYQIPFTDPKVAYYHLTHQSAESIIERNVRYWKGEASSSEPLSLINKIIIRTVLRFVFLRGGLFKGRQALALFYSFLSYYMMTYVCKWEYQNGEVESIYTALQKEIVDLWSKPK

SEQ ID NO: 5837 - protein, 119 aa, B.fragilis
ANNGHWALSFSSTMKYKEHISTNTFAIAPYARFSYYENKIVRLFVDGGFGFATTKVKDGGDAVNGFEIGLKPGIAIKLNQHFSLVAKCGFLGYKDDYMGNGFGFSASSEDLTFGFHYEF

SEQ ID NO: 5838 - protein, 96 aa, B.fragilis
VCLGINESKYKEGCVREKEKTEEIHNPFGSTNCIRFLGYNLSHRVAPLCLYGGKVSEKENKKKVNRGLFHRGVMRNLFLPFLKTHHKKHRVTQRRF

SEQ ID NO: 5839 - protein, 118 aa, B.fragilis
RQRGATRWLRLYPKNLMQLVLPKGLCISSVFSFSRTHPSLYLLSFIPKHTYTNMKVQVNNKEVETAASTLAQLATQLQLPENGVAIAVNNRMIPRPQWDGFGLQENDNLIVIKAACGG

SEQ ID NO: 5840 - protein, 909 aa, B.fragilis
NRIMDKKRVYTFGNGLAEGKAGMRNLLGGKGANLAEMNLIGVPVPPGFTITTDVCTEYYEMGQEKVVSLLKEEVEKAIANIENLMRSKFGDVENPLLVSVRSGARASMPGMMDTILNLGLNDEVVEGLTRKTGNARFAWDSYRRFVQMYGDVVLGMKPVNKEDQDPFEAIIEEVKHAKGVKLDNELEVEDLKELVKKFKAAVKAQTGKDFPTCAYEQLWGAICAVFNSWMNERAILYRKMEGIPDEWGTAVSVQAMVFGNMGDTSATGVCFSRDAATGEDLFNGEYLINAQGEDVVAGIRTPQQITKIGSQRWAQLAGVSEEERASKYPSMEEAMPEIYKQLDELQTKLENHYKDMQDMEFTVQEGKLWFLQTRNGKRTGAAMVKIAMDLFRQGMIDEKTALMRVEPNKLDELLHPVFDKSALKQAKVLTRGLPASPGAATGQIVFFADDAAEWHAAGKRVVMVRIETSPEDLAGMAVAEGILTARGGMTSHAAVVARGMGKCCVSGAGALNIDYKARTVEVDGVLLKEGDFISLNGSTGEVYQGKVETKAAELSGDFADLMKLADKYTRLQVRTNADTPHDAEVARNFGAVGIGLCRTEHMFFEGEKIKAMREMILAENAEGRRKALAKILPYQQADFKGIFKAMAGCPVTVRLLDPPLHEFVPHDLKGQQEMADTMGVSLQYIQQRVESLCEHNPMLGHRGCRLGNTYPEITQMQTRAILGAALELKKEGIETHPEIMVPLTGILYEFQQQESVIRAEADKLFEEVGDRIDFKVGTMIEIPRAALTADRIASSAEFFSFGTNDLTQMTFGYSRDDIASFLPVYLEKKILKVDPFQVLDQNGVGQLVRMATEKGRAIRPDLKCGICGEHGGEPSSVKFCHKVGLNYVSCSPFRVPIARLAAAQAAIEE

SEQ ID NO: 5841 - protein, 472 aa, B.fragilis
IIIMKQSKIIVAGIGPGSEQDITPAVLAAVREADVVVGYKYYFRFIRDFVRPDAECIDTGMKRERARAEQAFEYAEQGKTVCVISSGDAGIYGMTPLIYEMKRERQSNVEIIALPGISAFQKAASLLGAPIGHDFCVISLSDLMTPWERIERRILAAAQADFVTAVYNPKSDGRYWQIYRLREIFLREGRSPETPVGYVRQAGREEQEIHITTLAAFDPETVDMFTVVLIGNSQTYTFNQNIITPRGYYRETRSEATGIGQDIMIRSFRTIETELKNRDIPLDRKWALLHAIHTTADFEMERLLYTDPNAVASLYDAIRTGNLRTIVTDVTMAASGIRKGALQRLGVEVKCYLNDERVAEMATSKGITRTQAGIRLAVEEHPDALFVFGNAPTALMELCDLIRKEKAQPAGIVAAPVGFVHVEESKHMTKPFTRIPKLIVEGRKGGSNLAATLVNAILCYPDAEQLRPGRDV

SEQ ID NO: 5842 - protein, 196 aa, B.fragilis
SRIFIPMNIIKTSIEGLVILEPRLFQDDRGYFFESFNQGEFESNVCQTTFVQDNESKSSYGVIRGLHFQKPPFAQSKLVRVIKGAVLDVAVDIRKGSPTFGKHVSVELTEDNHRQFFIPRGFAHGFSVLSEEVIFQYKCDNFYHPEAEGAIAWNDPDLNIDWKIPQDRVILSGKDYTHPLLHNIELQFDINNTLYE

SEQ ID NO: 5843 - protein, 140 aa, B.fragilis
SMIFMATTFDIQLPHYPRGFHLITRDILSLLPDLPENGLLVVFIKHTSAGITINENADPDVRHDFNTFFNKLVPDGAPYFVHTLEGPDDMSAHIKASLIGTSVSIPIRNHRLNLGTWQGIYLCEFRDGGDKRKLSITILE

SEQ ID NO: 5844 - protein, 156 aa, B.fragilis
PGGMLRYSGVPKEHPDVNDMTTSASIESSMERSQSILSSSALNWYALRITYGRELALQEYLNSEGIENFIPMHYEYTIKNERRVRKLVPAVHNLVFVRSSRSCIDAIKESRSATLPIRYIMDREYHRPIIVPDSQMRNFMAVSANYDESLLYFEPF

SEQ ID NO: 5845 - protein, 436 aa, B.fragilis
SLIINHMSVKGFFFILVFFLVAIMGFLIYISETVVVKYLYIAEALMLLLMLYLILFYRKIVKPMNTIGSGMELLREQDFSSRLSHVGQQEADRVVNVFNRMMEQLKNERLRLREQNHFLDLMINASPMGVIIMTLDEEVSQLNPMAMKMMGVRPEEAEGRKLSEIDSPLALELAAIPNGATSTVRLNDSSIYKCTHSSFVDRGFQHPFYLMEGLTDEVMKAEKKAYEKVIRMIAHEVNNTTAGITSTLDTVEQALYESEGMEDICDVMRVCTERCFSMSHFITRFADVVKIPEPRFTPTNLNDLAFTCKRFMEGMCNDRNIRLQLICDESLDDVKLDASLFEQVLVNIIKNAAESIGQDGQIIIRTSLPTAIEVVDNGPGISKETEAKLFSPFFSTKPNGQGIGLIFIREVLSRHGCTFSLRTYADGLTRFRILFP

SEQ ID NO: 5846 - protein, 96 aa, B.fragilis
VYLIKTTKKMKKIVLFLFVAIATLSVKAQDLYMGGTVGLWRNDDANTTSFKLAPEIGYNLSEQWALGVELQFNHEIQGAYLDKHICHCSLRTFFLL

SEQ ID NO: 5847 - protein, 153 aa, B.fragilis
NIKMMENYKQNYIHKPYLFLAILFSLLSCQKEVVSKVTFERKLSGIKPETEFRLDSLRNDKWQKCYIIPPYQQYNSALNRIKLRKHDLNKIKENAISDGINTFVFINNDGSISIETVSRSIIDIQDTLSDSIFLFYPTTIMKMDSKRKIIDIK

SEQ ID NO: 5848 - protein, 395 aa, B.fragilis
TIKMRKVLSFSAFLIIGLLLSQYLPLLAGEGYATVKIVSNILLYICLSFIMINVGREFEVDKTRWRSYAGDYFIAMATAAMPWFLIAIYYVFVLLPPEFWNSWEAWKENLLLSRFAAPTSAGILFTMLAAIGLKSSWIYKKIQVLAIFDDLDTILLMIPLQIMMIGLRWQLIVVVFIVFLLLSLGWKQLGRYNWRQDWKAIMGYSVLVFVATQAVYYFSKQLYGEEGSIHIEVLLPAFVLGMIMKHKEIDTPVEHKVSTGVSFLFMFLVGMSMPHFIGVNFAETHAGTHSVTGSQEMMSWGMIALHVLIVSLLSNIGKLFPVFFYRDRKFSERLALSIGMFTRGEVGAGVIFIALGYNLGGPALVISVLTIVLNLILTGIFVLWVKKLALRSYTT

SEQ ID NO: 5849 - protein, 311 aa, B.fragilis
SKKINMATIYDGINYFPVGVNFMEENAMEVIEAKYGIKGSAIVLKLLCKIYKEGYFIRWDEEQCLIFANKAGREVQAAEVQGIIEILFIKGIMDKNSYLENGILTSENIQKVWMEATKRRKRELSELPYLMVKTEKEKENDKPEKESDKPDNASTQQEIERPKPLKEGKVAGSTGDVAVSPGNVVHDVAVNAKNACNSGQSKVKKSRAKENKELPPSVPPEGKEEERKEDSVSLPIPGYAFNTMTHNYPGLTDTLQRLGINEVSEVNAILRLSDYGRKGTTVWRLIANTCWSDIGAKGRYLIAALNRAKRK

SEQ ID NO: 5850 - protein, 266 aa, B.fragilis
YMKISVIIPCFNQGKYLAEALDSVVMQTFSDWECIIINDGSIDNSENVALSYVEKDPRFHYICQKNQGVCIARNRGIAMAQGEYILCLDGDDKISRNFLECMYPILDEEQSVKVVTSTVVQFGKIHRVIPSTDYSLEKLMGRNLFVITSMFRKVDFEKTEGFNENMAKGLEDWDFWLSMLESGGEVVCAKQAIFYYRIRGYSRNKSISEDYYSLLRKTIYENHKHLFSTIFFNPKYSFEYYLIAKSYEYKLGKLLFRPIRFLYDLF

SEQ ID NO: 5851 - protein, 254 aa, B.fragilis
KMKIITYNVNGLRAAVNKGLPEWLAEENPDVLCLQETKLQPEQYPAEAFEALGYKAYLYSAQKKGYSGVAILTKVEPDHIEYGMGIEEYDNEGRFIRADFGDLSVVSVYHPSGTSGDERQAFKMVWLEAFQKYVTELRKSRPNLILCGDYNICHEPIDIHDPVRNATNSGFLPEEREWMTRFLSAGFIDSFRTLYPQKQEYTWWSYRFNSRAKNKGWRIDYCMVSEPVRSLLKEAVILNNAVHSDHCPMALEIG

SEQ ID NO: 5852 - protein, 193 aa, B.fragilis
NYRIMKRNLVFVLFALVSVVGFSQVSWNAKVGMNISNFTGDFDMNAKVGFKIGGGMEYGFNEIWSLQPSLFVSSKGAKKDELSVNAVYLELPVMAAARFKVADNTNIVLSAGPYFACGIAGNSKVDLGKGRLEVDTFGDDGLLKRGDVGLGIGVAAEFGKIIAGLDGQFGFVDVMDNVNGKNLNLSISVGYKF

SEQ ID NO: 5853 - protein, 956 aa, B.fragilis
TDTFVVLFYFFCRSLYVVRRHHVTVDGTDDLGRYLVPGPSVYENPAGRGIARRIKAYRNILSSICVVFKIITYICVHNPDTTQIFAMNKRLYTIFLISVFLLLPGFSTAAERIYNVLFVQSYAPETPWHNDLVRGLKDGFGESGLKVNITTEFLDANFWTYQSEKLIMRRFCERARERGTDLIVTVSDEAFHTLLTCGDSLALQLPVVFFNIKYPEGSLIDSLPNVCGYTANPDFGELLRQASRLFPTRTEVVCISDNSLLSSKGKDDFMNEWEGFVEEHPEYTVTFYNSQTDTTNKIIASTCYPRNTHKTLIIAPKWSSFMSFIGRNSKAPFFSCENLALTNGAFGAYDADSYASAHEVGRTAADVLRGKSPSEVGIIESPLKFMYDFKQLVFFKVDPKQASAIGGTIINEPYMEKYRMLYILLYSSILALLVFLIVWLYRINRRESRRRIHAQTRLLIQNRLVAQCDEFDNVFHSIRDGVITYDTDFRIHFTNRSLLKMLHLPKDEAARPYEGLPAGSIFKIYNNGKEILRPMLKQVVTEESSVVIPENSFMQEVHSGSYFPVSGEVVPIRAHGKITGMALSARNISDEEMQKRFFRMAVDESSIYPWQYNIRTGLFTFPAGFLTRFGFAENKTTISRDEMDRMVHPDDQESAYEVFNRALAGLSQSTRMSFRQLSGDGNYEWWEYRTSVLSGLTTDTPYSILGVCQSIQRYKTTEEELTAARDKALQADKLKSAFLANMSHEIRTPLNAIVGFSDLLSDTSGFTEEEVKLFIETINKNCGLLLALINDILDLSRIESGTMDFQFAGHNLPLLMKNVYDSQRLNMPPGVQLVLKLPENSKKYLVTDNVRLQQVVNNLINNAVKFTTQGSITFGYTEEEPGYTSLFVEDTGKGISEDGLRHIFERFYKVDSFTQGAGLGLSICQTIVGRLNGTITVASEEGHGTRFTVRLPDICE

SEQ ID NO: 5854 - protein, 381 aa, B.fragilis
LTMIDFTQFPSPCYIMEEELLRKNLSLIKSVADDAGVEIILAFKSFAMWRSFPIFREYIGHSTASSVYEARLALEEFGSKAHTYSPAYTEADFPEIMRCSSHITFNSLSQFSRFYPLTVAEGSGISCGIRVNPEYSEVETELYNPCAPGTRFGITADLLPARLPQGIEGFHCHCHCESSSFELERTLQHLEEKFSPWFSQIKWLNLGGGHLMTRKDYDTRHLTGLLQGLKKRYPHLRIILEPGSAFTWQTGVLTSEVVDIVESRGIRTAILNVSFTCHMPDCLEMPYQPSVRGAVMGEEGPFVYRLGGNSCLSGDYMGSWSFDHELQAGERIVFEDMIHYTMVKTNMFNGIHHPAIALWTADGKAEIFRQFSYEDYRDRMS

SEQ ID NO: 5855 - protein, 644 aa, B.fragilis
IIMILIFGGTTEGRAAVNVIEEAGKPYYYSTKGDEQDIYLHHGIRLSGAMTRRTLKAFCRQNDIRLLIDAAHPFAEKLHDTVTDVAHDLGIPCIRYERIYDRSYLNPIFEDNCDPDDLPFKFEYDNRDLLRELKKEKEGHRFLFLTGVQSIARFKSLWTKKKYECYFRILDRDSSREIARQAGFPEDHLVYYHPETENLPQLLQELSPQAVVLKESGKSGGFTEKKDMILEYGATPYILLHPELEYYDITVDGVNSLRRTLEKMLPDYFPLRSGLTTGSCAAAAAIAAFRKLKNPILEDFNRNIHTVLPSGETIEIPCQSVSGTFSDEKIEVSATVIKDGGDDPDVTSGLPIVTTLTLNLAEAKQANNAPVQTPETWEFVFHGGPGVGTVTLPGLGLEVGGPAINATPRQMIIDNLRNCIRYYYRYLPNVPIHVTISVPGGEEVAARTFNPRLGVVGGISIIGTSGIVKPFSSEAFVRSIRKEMEVARATGACRIVINSGAKSEKYIRNLYPELPPQAFVHYGNFIGETIGIAAELGISRLTLGVMMGKAVKLAEGHLDTHSKKVTMNKEFLKEIARRCGCTPSSIEAIDHIILARELWNILPETELQAFCSLLIEQCHRHCDVLLPNGELTILLITEEGKIIQ

SEQ ID NO: 5856 - protein, 75 aa, B.fragilis
LSYVSSIAPLPIKEVITGKWCRLMKSFSKTISELQHPAPKSNMGRWDDSINNLISSQAIKGLFKILSPEYPINVS

SEQ ID NO: 5857 - protein, 450 aa, B.fragilis
FQRVFFKNIYNFLQLDAAVIYSSLSKILSGFGGFLTVYLIAKKLTLVEQGYYYTFISVLYIQVFFELGLNSIITQFVAHEKAHLDWKGKDDLVGKEFHLSRLASVLRLCVKYYSYLAIGLLIVLFIGGYVFFSINSNIGVSWKIPWLLLCVSTSLSFFLNPFLSFLEGLNLMKEVCFIRFIQQTVSLLILWVGLIGGMKLYVGGCSSLAGGVAILIFVSYRYRILFLNIYGKVTIHFINYKKEIFPFQWKVAVGWLSSSLVFQFFNPILFATIGSAAAGQLGMTLSVINGVSSVSMNWIYTKVPNLSKLVSLRDFKELDKSFSKILAVLVLLSCMGFIIVALCLIQFNILHIASKLLPMSLFLIMSLSSVFTQITSCWAIYFRCFKKEPFLRVSLINLAVVFLIVFPCTLYYRLSGLVLSYSLAALVGLILGWLLYNNRAEFQKKYVLYE

SEQ ID NO: 5858 - protein, 61 aa, B.fragilis
SLVVKLFVQSRLFFTIESEAILEIKVFLKIIIHYYVKLYTKIINTYFLPFSLIRSIHLSII

SEQ ID NO: 5859 - protein, 305 aa, B.fragilis
NTAFPFLFPTFVLRIKNQDSKMKKFIKGVRFTPSNYPDEIEDKIQKYRKQGYKLPPRKVLRTPEQIEGIRESAKINTALLNHIAENIREGMSTEEIDRLVYDFTTSHGAIPAPLNYEGFPKSVCTSINDVVCHGIPSSTEILKSGDIINVDVSTIYNGYFSDASRMFMIGEVSPEKQRLVQVTKECMEIGIAAAQPWARLGDVGAAIQEHAEKNGYSVVRDLCGHGVGIKFHEEPDVEHFGRRGTGMLILPGMTFTIEPMINMGTYEVFVDSADDWTVCTDDGLPSAQWENMILITETGNEILTY

SEQ ID NO: 5860 - protein, 336 aa, B.fragilis
CVKLYIVLKNKFRNLFLAFGILAVIIMLFTFDVSYDELLDNLRRAGFYLPLVLVLWLFIYLINTLSWYIILRSSGPVNSLSFARLYKFTVSGFALNYVTPVGLMGGEPYRIMELTSYVGVERATSSVILYVMMHIFSHFCFWLSSVLIYVFFYPVGWGMGIVLGLITLFCLLLVTLFIKGYRNGMAVACVRLGSHIPFLKKRAVRFAELHKEKLETIDRQIALLHQQRKSTFYSALGLEYTARIVGCLEVWLILNVLTTDVSFVGCILIVAFSSLLANLLFFLPMQLGGREGGFALAVAGLSLSGAYGVFAALITRVREMVWIVIGLVLMKIGNRR

SEQ ID NO: 5861 - protein, 282 aa, B.fragilis
RPTSSVFSVIREPTGETPEQLAALLKEGTFMVSRNVFESRYKIDLKDYVGKEFCLDQDTAHLSKLVAALQVVRYDDFSSGAYSRSAVILLPENRLASGNEICLRTNKNESAAFAEQLMKDAPSQYRVGNLFLTKVSSFRDIRHTFQLDDVNTLRNYLVGMGFLLLNIFLGLLGTFWFRTQQRKGEMALMMAVGGSKQSVFFRLLSEGWLMLLLVTPLAIGVDFYIAKSELTPSWYFSTFSVGRFMLCEGITLLLMALMILAGIWFPARQSMKIQPAEALHEE

SEQ ID NO: 5862 - protein, 146 aa, B.fragilis
SEIPITTPPFAVPSNLVIAIAVTSVASVNCFACSKAFCPVEPSSTNNTSFGASGTTFFITFLIFVSSFIKPTLLCKRPAVSIITTSALLATAELNVSNATEAGSAPIFCLMTGTSTLSPHITNCSTAAARKVSAAPKYTDLPAFLN

SEQ ID NO: 5863 - protein, 363 aa, B.fragilis
TKLTGKMNKYILLIVLLFLVSGRIAAQSVTVDAKIDSLQILIGEQAKVQLQVAMDAKQRAVFPSFTDTLVRGVEIVDIAKPDTQYLNDRQRMLITQEYTVTSFDSALYYIPPMGVKIDNKEYKSKALALKVYSMPVDTLHPDQFFGQKTVMKAPFAWEDWYGLIACSFLALPLLGLLIYLIIRIRDNKPIIRKVKVEPKLPPHQLAMKEIERIKTEKIWQKGQSKEYYTELTDALRTYIKNRFGFNALEMTSSEIIDKLLEFNDKEAISDLKYLFQTADLVKFAKHDPQMNENDANLINAIDFINETKQLEEENQKPQPTEITIIEKRSLRTKILLICGIVFLSAALIATFVYIGLQLYNLFG

SEQ ID NO: 5864 - protein, 95 aa, B.fragilis
DMRTITFNELRKIKDSLPSGSMHRIADELNLNVDTVRNFFGGHNFKEGKSVGIHLEPGPDGGLVMIDDTTVLDRALRILDELNMSKEEATESVQV

SEQ ID NO: 5865 - protein, 232 aa, B.fragilis
ISRAIISSAVNLGEPSSSITFFKLSVVSCPVSPVTWIGSSEFSTTLSNPPSSRTSAMDEPSTTASLPLCMLTSSTVSSMSISSTTSVLSDSFITSETSSATSTSDDTTSCPFEVSGSTFPFASVSTTFSSAFASSLSTVSVINGSSVVSDIFPDSSSNSSIGVSSKTVFSFSTTVSKCEKGLFMISLKEGSGVKEILVCPSILIRSPVLTFTLSRLLTPINLNVPNPLIFTY

SEQ ID NO: 5866 - protein, 240 aa, B.fragilis
VVMYMSRNKYILFALLLSLSAGAFAQKAERDYIRKGNRLFKDSVFVDAEVNYRKALEANPKSTISMYNLGNTLSQQQKFKDAMEQYVAATSIEKDKAKLGQIYHNMGVLFQSGKDYQKAVEAYKMSLRNNPKDDETRYNLALAQKLLKDQQQNQQNQDQNQDQNKDDQQKQQDKKDQNKQNDQNKDQQQQQPPKSEKNDNEMSKENAEQLLNSVMQDEKGVQDKVKKQQTLQGRRLEKDW

SEQ ID NO: 5867 - protein, 63 aa, B.fragilis
EIDFTYFSFCVTLLFRIRSSKKKRLPNFSNQATPFTKIFAKKDLFDHYIIFSISSNSGPIFRL

SEQ ID NO: 5868 - protein, 355 aa, B.fragilis
ILLLSLLLHRLNIKKRMSTIILGIESSCDDTSAAVIKDGYLLSNVVSSQAVHEAYGGVVPELASRAHQQNIVPVVHEALKRAGVTKEELSAVAFTRGPGLMGSLLVGVSFAKGFARSLNIPMIDVNHLTGHVLAHFIKEEGEANEQPDFPFLCLLVSGGNSQIILVKAYNDMEILGQTIDDAAGEAIDKCSKVMGLGYPGGPIIDRLARQGNPKAYTFSKPHISGLDYSFSGLKTSFLYSLRDWMKEDPDFIEHHKNDLAASLEATVVDILMDKLRKAAKQYKINEVAVAGGVSANNGLRNAFREHAEKYGWKIFIPKFSYTTDNAAMIAITGYFKYQDKDFCSIEQPAYSRVTL

SEQ ID NO: 5869 - protein, 216 aa, B.fragilis
RRYHKIDKKMFRFEEPAYLYLLLLLPLLAAFYLYSNYRKRKAIRKFGDPVLMAQLMPDVSKYRPDVKFWLLFTAIGLFAVLLARPQFGSKLETVKRKGVEVMIALDISNSMLAQDVQPSRLEKAKRLISKLVDGMENDKVGMIVFAGDAFTQLPITSDYISAKMFLESISPSLISKQGTAIGAAINLAARSFTPQEGVGRAIVVITDGENHERGSC

SEQ ID NO: 5870 - protein, 327 aa, B.fragilis
CIIQIIVIMGFFSFFSKEKKETLDKGLSKTKESVFSKIARAVAGKSKVDDEVLDNLEEVLITSDVGVETTLNIIKRIEKRAAEDKYVNTQELNSILREEIAALLTENNSDDVADFDVPVEKKPYVIMVVGVNGVGKTTTIGKLAYQFKKAGKSVYLGAADTFRAAAVEQLVIWGERVDVPVIKQKMGADPASVAFDTLSSAVANNADVVIIDTAGRLHNKVGLMNELTKIKNVMKKVVPDAPNEVLLVLDGSTGQNAFEQAKQFTLATEVTAMAITKLDGTAKGGVVIGISDQFKIPVKYIGLGEGMEDLQVFRKKEFVDSLFGENA

SEQ ID NO: 5871 - protein, 399 aa, B.fragilis
IRDKVRIPIGKTIGISYLLNSINKRIMEEKLVTLAILTYTKAQILKNVLENEGIETYIHNVNQIQPVVSSGVRLRIKESDLPRALKITESSAWLAESIVGEKTPKVEHRTKKVLIPVDFSNYSMKACEFGFNFAKSFDAEVILLHVYFTPIYASSLPYGDVFNYQISDEETVKNVLHKVHDDLNTLSEKIKQKVASGEFPDVKHTCVLREGIPEEEILRYNKEHRPRIIIMGTRGKNQKDIDLIGSVTAEIIERSHTTVLAIPENTPFNRFNEVKRIAFMTNFDQRDLIAFDSFINGLSPFHFSVSLIHLSDVKDTWNEIKLAGIKDYFQKQYPDLEIYYDVVMSNDFLNSLDNYIKTNQIDIITLTSYKRNIFSRLFNPGIARKMIFHSDTPLLVING

SEQ ID NO: 5872 - protein, 122 aa, B.fragilis
LLFNAFIGIFPANTRFTFSKTASLKISLVPKYLQRVCLVISSLVGPKPPVTSTIFALFIEASTASIISSARSRTDTTRITSIPTLFNSRPIHAELVSVTCPINSSSPIVIISANIGLLQSYT

SEQ ID NO: 5873 - protein, 615 aa, B.fragilis
LMIKTSDEMRKLIFLLIALVAMTTQAQADGKVVFTASAPDAVVVGDQFRLSYTVNTIKVRDFRVPSIKGFEVLMGPNRSQRMQSINGVTNNSITFTYILMATAEGEYSIPGATITADGNQMVSNSVKIKVLPSDKTGNTADGKGTASSGNQSGTSSSVSNQDLLITATANKTNVYEQEAFLLTFKIYTRESQLRFENVKLPDFKGFHSQEIEMPANAKWSQEHYKGKNYFTTVYRQFVLFPQQSGKLTIEPARFDATIAKAVQSDDPFDAFFNGGSNYVNVSKVIVTPKITVNVNPLPTGKPANFSGGVGEFSITSSINSKEVKTNDAITIKLVISGTGNLKLIANPEIKFPEDFDVYDPKVDSKVRLTQEGLSGNKVIEYLAIPRHAGVYKIPGVSFSYFDIKSKSYKTLNTEDYEVKVEKGAGNADQVIANFTNKEDLKVLGEDIRYIKLNDVKLQPKDNLLFGSLLYWLFYIVPAVVFIVFFIVYRKQAAENANVAKMRTKKANKVATKRMKLAGKLLAENSKEAFYDEVLKALWGYISDKLNIPVSRLSKDNVEEKLRNYGVSDELIKDFLNTLNECEFARFAPGDESQAMDKVYSSSLEVMSKMENSIKR

SEQ ID NO: 5874 - protein, 93 aa, B.fragilis
NYKNKIEMSKICQITGKKAMIGNNVSHSKRRTKRTFDLNLFNKKFYYVEQDCWISLSLCAAGLRIINKKGLDAALNDAVAKGYCDWKTIKVVG

SEQ ID NO: 5875 - protein, 279 aa, B.fragilis
VMKKILFIALGLLMAVTSFGQDSLITDSTQMIQGDTVSIHNAEFSGSKLEDATKAEGDSAYIRNDFASAIQIYESLLRKGESADVYYNLGNSYYKINEIAKAILNYEKALLLQPGNGDIRANLEIARGKTVDKVEVVPEIFFVTWTKALINSMSVDSWAIWGIVSFLLLIVSLYFFIFSKQVVLKKVGFITGIIFLIVVVMANIFASKQKEELLNRDTAIIMSPSVTVRSTPSENGTSLFILHEGHKVNIKDDSMKDWKEIRLEDGKVGWVPVGSIEII

SEQ ID NO: 5876 - protein, 68 aa, B.fragilis
KEEKLIMAKKAKGNRVQVILECTEHKDSGMPGTSRYITTKNRKNTTERLELKKYNPILKRVTVHKEIK

SEQ ID NO: 5877 - protein, 1129 aa, B.fragilis
YLNDAKVMIKVGFITNYFIFLFSKSKQPPIRTLKKTVRWVIGIILGIYIGTIILLNIPYIQRNMTTFVTKELSRTLGTELTIGKIDIGLLNRIIIDDVLLDDQSGKEMLKITRLSAKFDIIPLFNGKITISSVQLFGFNINLNKPAPHMEPNFKFVLDAFASKDTVKTKKDIDLRINSILIRRGKLSYDVLSEEETPGKFNPQHIKLHNIIANISLKALQNDSINAAIKRLSVDEQSGFELRKLSLKVIANNKGMKIENFAIEMPGTEMKMDTIRMEYDSLKALNHFADNVRFSFRTLPSHVTLNDISAFVPALSNFKEKLDLNIDVEGTLNQLNCRTLEINAGDKFRLKGDVSLQDLSRPQDAYVYGHLANLSANKEGIGFLVRNLSPHYNGVPPVLQHLGNTSFHGEISGYFTDLVMYGLFRTDIGSVQTDLKLSSDKAKALFSYSGGVKTTDFELGQLLGNKQLGKITFNLDVRGNHYKSQYPSITLKGLIASLEYSNYKYENITLDGEFKRGGFDGKVALNDENGSVHLNGNINVVEKVPTFNFNAVIDKIRPHDLNLTKEYPDAEFSLKLKANFRGGSIDEMMGEINIDSLQFTAPEKSYFLDNINITATRQDKENQLKLTSSFLKASIEGNYLYHTLPASVMNIMRRYIPSLIQPDKKPIKTNNNFSFDIHIFNTELLSTVFDIPLKIYSHSTVKGYFNDQAQRLRVEGYFPRLQYQNTFIESGLVLCENPTDQFKAKVRFNNLKKESAVSISLDAQAKNDTINANINWGNNAISTYSGRLSAAASFFRAAEEKSPLKTVVDIKQTDIILNDTLWQVHPSQVVVDSGKIDVNDFYFSHQDRHIRINGRISEQAKDTLKVELKDINVGYVFDVVNFDDVDFKGDATGTAYASGILKEPVMNTRLHFKNFTFNDASLGAMDIYGAWKNDMRAIFLDAHMEEEGVSKTHVIGHVYPLKPESKLDLNIETDHTNIQFLQYFMRSIVEDLHGRTSGKAHFYGKFKALNIEGNLMTDASLKIGILNTSFTVTDTIRLSTSGISFDNIRIADMEGHQGTMNGKLNFRHFRDLSYHFEFNVNNMLLMNTKENPDINFYGKVYGTGNAMLIGNPQELQVNAAVTTNRNTNFV

SEQ ID NO: 5878 - protein, 492 aa, B.fragilis
KISLKKHFRMNEKLTIQDLVELLVNRHEVSQEDADVFVREFFLLIEQALDADQYVKIKGLGTFKLIGVNSRESVNVNTGERIKIEGHTKISFTPDPSLRDIINRPFSHFETVVLNENTVLEDTPIEELEEESGNISETTELPLITETVEREEAKAEEKVVETEANGKVEPETSKGQDVVSSDVEVAEDVSEVMKESERTEVVDDIDILETVEDVSIHKGSEAVVEGSSIAEVREEGGLDKVVENSEEPIQVTGDTGQETTDNLKKVIEDEGSPKLTAEEIIAREIQKAEVSTIPVKKEKRPKKEVKPENQKSPVPYLIVIIVVVMSLCGAALVFIYYPDLFSKKESEQSITTETVEKKEPIREIPLDTVAKADTIVKVVAKTPNQQEIKQMSERVNVSEKVDKTSESESVSREKSTKTVAIPVKPDSVNYTITGTKATYTIKEGETLTRVSLRFYGTKDLWPYIVKHNRGVIKNPNNVPYGTVLKIPELVKK

SEQ ID NO: 5879 - protein, 847 aa, B.fragilis
RRLLEQDRIIKINIEEEMKSSYIDYSMSVIVSRALPDVRDGFKPVHRRILYGMMELGNTSDKPYKKSARIVGEVLGKYHPHGDSSVYFAMVRMAQEWAMRYPLVDGQGNFGSVDGDSPAAMRYTEARLNKLGEEMMQDLYKETVDFEPNFDNTLMEPKVMPTRIPNLLVNGASGIAVGMATNMPPHNLSEVIDACEAYLDNKDVTVEELMEYVKAPDFPTGGYIYGISGVREAYLTGRGRVVMRAKAEIESGQTHDKIVVTEIPYNVNKAELIKAIADLVNEKRIEGISNANDESDREGMRIVIDIKRDANASVVLNKLYKMTALQTSFGVNNVALVNGRPKMLNLRDLIVYFVEHRHDVVIRRTQFDLRKAKERAHILEGLIIASDNIDEVIRIIRAAKTPNDAISGLMERFNLSEIQARAIVEMRLRQLTGLMQDQLHAEYEEVMKQIAYLESILADDEVCRKVIKDELLEVRAKYGDERRSEIVYSSEEFNPEDFYADDQMIITISHMGYIKRTPLTEFRAQNRGGVGSKGTETRDEDFVEHIYPATMHNTMMFFTQKGKCYWLKVYEIPEGTKNSKGRAIQNLLNIDSDDAVNAYLRVKSLNDQEYINSHYVLFCTKNGVIKKTSLEQYSRPRQNGVNAITIREDDRVIEVRMTNGNNEIIIANRNGRAIRFHEAAVRVMGRTATGVRGITLDDDGQDEVIGMICIKDLETESVMVVSEQGYGKRSDIEDYRKTNRGGKGVKTMNITEKTGKLVTIKSVTDENDLMIINKSGITIRLKVADVRIMGRATQGVRLINLEKRNDQIGSVCKVTSESLEDEVPEEEREGNIPSDPETNTPVNETEE

SEQ ID NO: 5880 - protein, 331 aa, B.fragilis
IINRMVFANIEYLFLLLLLVPYIVWYIMKRKKTEPTLQISDARVYAHAPKSYKNYLLHVPFGLRIITLILIILVLARPQTTNSWQNSEIEGIDIMLAIDVSTSMLAEDLKPNRLEAAKDVAAEFINGRPNDNIGITLFAGESFTQCPLTVDHAVLLNLFQGIQCDIIEDGTAVGMGIANAVTRLKDSKAKSKVIILLTDGTNNKGDISPLTAAEIAKSFGIRVYTIGVGTNGMAPYPVRVGGTTQYINTPVEIDEKTLTQIAGTTDGNYFRATSNSKLKEVYEEIDKLEKTKLNVKEYSKRQEEYRWFALAAFLCILLEVLLRNSILKKIP

SEQ ID NO: 5881 - protein, 289 aa, B.fragilis
METSEILKKVRRIEIKTRGLSNNIFAGQYHSAFKGRGMAFSEVREYQFGDDIRDIDWNVTARFNKPFVKVFEEERELTVMLMVDVSGSLEFGTVKQLKKDMVTEIAATLAFSAIQNNDKIGVIFFSDRIEKFIPPKKGRKHILYIIRELIDFKPDSRRTNIRLALEYLTNVMKRRCTAFILSDFIDQENFKNAMTIANRKHDVVAIQVYDRRVAELPAVGLMRIKDAETGHEQWIDTSSAGVRRAHHEWWVNKQTELDETFTKSNVDSVSVRTDQDYVKALLNLFAKRN

SEQ ID NO: 5882 - protein, 454 aa, B.fragilis
GYGRPTGVPQERICRLLIWRECMKRKTIDIITLGCSKNLVDSEQLMRQLEEAGYDVTHDSEKPTGEIAVINTCGFIGDAKEESINMILEFAQEKEEGNLEKLFVMGCLSERYLKELAIEIPQVDKFYGKFNWKGLLQDLGKAYHEELHIERTLTTPKHYAYLKISEGCDRKCSYCAIPIITGRHVSRPIEEILDEVRYLVSNGVKEFQVIAQELTYYGVDLYKKQMLPELIERISEIPGVEWIRLHYAYPAHFPEELFRVMRERDNVCKYMDIALQHISDNMLQRMRRHVTKKETYRLIEQFRKEVPGIHLRTTLMVGHPGETEEDFEELKEFVRKVRFDRMGAFTYSEEEGTYAAANYEDSIPQELKQARLDELMAIQQGISTELSASKVGQKMKVIIDRIEGEYYIGRTEFDSPEVDPEVLIRCEGDNLMIGNFYQVQVIDSDEFDLFGEII

SEQ ID NO: 5883 - protein, 415 aa, B.fragilis
LCKSPMFAEIITIGDELLIGQVTDTNSAWMGRELNKVGIEVIRVVSVRDRADEIIEAVDASMKRANIVLVTGGLGPTKDDITKQTLCKYFGTRLIFSEAVFENVKRVLAGKIPMNALNKSQAMVPEDCIVINNRVGSASVSWFEKDGKVLVSMPGVPQEMTTVMSEEVIPRLCAKFRTGAIIHRTFTVQNYPESVLAEKLESWEMALPACLKLAYLPKPGLIRLRLTGRGQNRSEIEACVNTESAKLEAILGEDILDEEDTPIEILIGELLKKKNLTLSTAESCTGGSIAARITSVAGSSEYFKGSIVAYANEVKTELLSVSMETLEKRGAVSEETVIEMVKGAMKALKTDCAVATSGIAGPSGGTEEKPVGTVWIAAAYKSEICTMKQETNRGREMNVERASNNALLLLRKLVK

SEQ ID NO: 5884 - protein, 334 aa, B.fragilis
LVFMAESIDIRELNERIERQSAFVTNLTTGMDQIIVGQKHLVESLLIGLLSDGHVLLEGVPGLAKTLAIKTLASLIDAKYSRIQFTPDLLPADVVGTMVYSQKDESFQVKKGPIFANFVLADEINRAPAKVQSALLEAMQERQVTIGKETFLLPEPFLVLATQNPIEQEGTYPLPEAQVDRFMLKVIIDYPKQEEEKLIIRQNINGEKFNVKPILKAEEIIEARKVVRQVYLDEKIERYIVDIVFATRYPEKYDLKELKDMIGFGGSPRASINLALAARTYAFIKRRGYVIPEDVRAVAHDVLRHRIGLTYEAEASNVTSDEIVSKILNKVEVP

SEQ ID NO: 5885 - protein, 418 aa, B.fragilis
NRRIDIILIINQTTIMKRVLFSMVLLMAVSFAFAQEKNVKEAKSIAGEVKPDFAKAEQLINEALTNPETKDNAATWDVAGYIQKRINEKEMENAYLRKPYDTLKVYNSVLNMYNYYVKCDELAQIPNEKGKIKNKYRSANSKTILAERPNLINGGIQYFNLNKNEDALKYFAAYVDAATLPMMEKENLLEKDTILPQVAYYATLAADRVGDKDAVMKYAQYALKDKENGQFAMQLLTDAYKAKGDTAKWVEKLQEGIVKFPENQYFFANLVDYYSSSNQNDKAMQFADDMLAKDPNNKLYLYVKAYLYHNMKDYEKAIEFYKKTLDIDPAYAEACSNLGLVYLLQAQEYADKAPADINDPNYATAQAEIKKFYEAAKPYYEKARELKPDQKDLWLQGLYRVYYNLNMGPEFEEIEKMM

SEQ ID NO: 5886 - protein, 100 aa, B.fragilis
NCRILNNKEFTSELSRRLGYNTKYTSELITSLLSDITQELQESNAIGIQGFGTFEVKKKAERIVINPVTKLRLLVPPKLVLAFKPSPILKDKFKETFPYE

SEQ ID NO: 5887 - protein, 146 aa, B.fragilis
LPMVKIMKGGAVEAGKKAAKKGIQVNVLGVGLPDGAPIPIEGSNDFRRDREGNVIVTRLNEAMCQEIAKEGNGIYVRVDNSNSAQKAINQEINKMAKSDVESKVYTDYNEQFQVIAWMILLLLLVEMLILDRKNPLFKNIRLFSNK

SEQ ID NO: 5888 - protein, 71 aa, B.fragilis
SFLSSKQDAKILKMGELCSFFIYNFKRGHTKVIYKSAGLWIDNRPVYGFSKDKRSPFPALLFQREPYILEN

SEQ ID NO: 5889 - protein, 516 aa, B.fragilis
TNLPPRLLQGLINLNRNRRMEKKKIPVALMIAAGMLLYNNTVAAQSLPPTQETSQHQLSFNEALQLLHKGNQSLKIADKGIDIARAERGKLNAFWMPSLQSTGAFVHLSEKIEVKQPLSQFTDPAKDFVHSILPDDKIISSILDQIGTNTLIFPLAPRNLTTVDLTAEWVLFAGGKRIHATKIGNTMIDLARENRAQTDATQRTLLAESYYGLRLAQEIVGVRLESYKALKLHYENALKLESTGMIDKAARLFAQVNMDEALRELEAARKEEAVVQRTLKTLLNLETSGDISPSSPLFINDTLPPKMEFMQVVGISNYLLNQLSLQEHMAKQQVRIDQSGYLPNIALFGKQTLYSHGIQSNLLPRTMIGVGFTWNLFDGLEREKRIRQSRLTQQTLALGQEKARDDLSVGVDKLYTGLQKALDNVRALNTTIELSEELVRMRKKAFAEGMVTSTEVVDAETLLSKTKVARLAAYYEYDVTLMNLLALCGIPEQFGSMKDITSLPITENRRNEIEIE

SEQ ID NO: 5890 - protein, 66 aa, B.fragilis
KTQPSFGVNAYFFWSKYRLFEVKTQTLPLPKPGFLGKEAESSGTFSPIWVRKQKGIVSRKCHYLSF

SEQ ID NO: 5891 - protein, 144 aa, B.fragilis
FLYTLPDFVCWLPGAWGSGIHLCHFLSSGTPLERLQSVFGHINGMPALSSASEAKKMCMFLRWMIRRDSPVDLGIWRSFSPSDLIIPLDTHVHRISTDLGLTNARKCLKTARCITDALREIWPDDPVKGDFALFGFGINEPVKS

SEQ ID NO: 5892 - protein, 268 aa, B.fragilis
QGGAGMANWITLKQLSEKRGIAESDLRTWANLGYITSSRIENVLMIDDESLTQYLDVHQTKDLGENYLEKIIKEKELEREVLLSQCDDELFLLKTQKLHQPLFHILIQELGQLITDDHEREIFLSVSSGEPIARVAKRNKMTYARVATCYSSILRTLGEHKGRIATFRSRTMELMFDKCNAVTPVNTPLSNLVGAHAYNVLYGEMGFRTVRDLLQYATQNGWQSLRRFKGMGLVTYKSVMNALRDANFIIVRKDGNIELSPEIAALVI

SEQ ID NO: 5893 - protein, 413 aa, B.fragilis
  UNSURE (379): Identity of amino acid sequences at the above locations are unknown.
EKRYSQWDSVLLCGKSKLKDNLIMQHSPITRVIQCEWQRMTSRRLYFGVCLVLPLFTLFFMATIFGNGQMENIPIGIVDRDNTATSRDITRRMSAVPTFRVTRHFVDEAEARKAVQQKEIYGYLSIPPRFEQDMISGQDATLNYYYHYALLSVGGELMAAFESSLAPVALSPIVMKAVALGVNEQQIETFLLPVQANNHPIYNPSLDYSVYLSQPFFFVLFQVLVLLITVYAVGSEIKFGTAGQWLQAAGGDITVAVTGKLLPYTLIFSLIGILGNFVMFGILHIPFQGSWLLLNVMTVLFIISTQALALFIFSLFPAVAIIISIVSMVGSLGATLSGVTFPVLNMYPLVRDASYLFPVRHYTEITQTMLYYGGGFIHXWPSAVILCIFPLLALAMLPHLRRAIISRKYENIR

SEQ ID NO: 5894 - protein, 250 aa, B.fragilis
IKNLYFMEIFWKTIAYYNSATWIYQLLIIVAGLLLTVMLIKNPRPWVKMGMKLYMIFLYLWIAIAYYAICCDERSYNGALAMFWVVMATIWVWDAITGYTTFERTYKYDILSYVLLILPFVYPLVSIARGLTFPGITSPVMPCSVTVFTIGLLLLFSRKVNMFLVLFLCHWSLIGLSKTYFFNIPEDFLLASATIPALYLFFREYFLNNLHADTKPKAKYINWLLVFVCVSIGILLTTTLFLELMPGKQP

SEQ ID NO: 5895 - protein, 500 aa, B.fragilis
RDEHDMNKNLHPLMLAGTGSDVGKSIIAAAFCRIFLQDGYHPAPFKAQNMALNSYATPEGLEIGRAQAVQAEAAGVPCHTDMNPLLLKPSSDHTSQVVLNGRPIGNRNAYEYFRREGREELRKEVHAAFDRLAARYNPVVMEGAGSISEINLRDSDLVNLPMAMHAGADVILVADIDRGGVFASVYGSVMLLRPEERKHIKGILINKFRGDIRLFESGVKMLEDLCGVPVVGVVPYYKDIYIEEEDSVMLQTKNIRAGQGKVNVAVVLLRHLSNFTDFNVLERDPRVHLFYTNNTDELMKADIILLPGSKSTLSDLYELRRNGVAQAIVRAHREGATVMGICGGYQLMGREVCDPDHVEGEIERLPGLGLLPVSTRMQGEKVTRQVRFCFLEDSAVCEGYEIHMGTTTPLADVPVSPLNHLADGREDGYFVDRTCMGTYVHGILDNPSVIDYLLEPFADKLKETAFDYKAFKEEQYDKLAAHVRKHVDLPLIYQILTDND

SEQ ID NO: 5896 - protein, 400 aa, B.fragilis
SVVNMKTSGKLSQISFIIAREFRAISTSYAVLLVLMGGIFVYGLLYNYMYAPNIVTDAPVAVVDNSHSSLSRQYIRWLDATPQVAVYAQAMDYREAREWMKEGKVQGILYIPHDFETRVFQGREAVFSLYATTDAFLYFEALQEATSRVYLAINDAHRMDGAVFLPPQGLLAVAMAKPVNVTGTALYNHTEGYGSYLIPAVMMVIIFQTLLMVIGMLTGDEYQHRATEPLLPGGRTVDKSGLWGGAMRLVAGKTFVYCGLYTVFSMFLLGLLPHFFSIPNIGNGLYITAMMVPYLMATSFFGLAASRYFTDSEAPLLMIAFFSVGLIFLSGVSYPLELMPWYWRMAHYILPAAPATLAFVKLNSMGADMADIQPEYITLWIQVIVYFGLSVWVYKKKLEA

SEQ ID NO: 5897 - protein, 321 aa, B.fragilis
PSPKALWEHLKNWPCRSGLSQQTLTPELRHPQNIIFAADHGIVDEGVSLSPKEITWQQISNFLHGGAGVNFLCRQHGFELKIVDAGVDYDLPYEKGIINMKVRKSSRNYLYEAAMTEEEMNLCIERGAEVVRQCHAEGCNVLSLGEMGIGNTSSSSMWMTCFTHIPLELCVGAGSGLDNAGVRHKYNVLQQALDHYQGDGSAHDLIRYFGGLEMVMAIGAMLQAAELKMIILVDGFIMTNCILAASQLYPEVLHYAIFGHQGDESGHKLVLDAMGAKPLLNLGLRLGEGTGAICSYPIIDSAIRMINEMDNFAHAAITKYF

SEQ ID NO: 5898 - protein, 206 aa, B.fragilis
SHAKINIVSEIPIAMAQYFASGNGNIKYYRTFANQKYTDRFMKQIILITGGARSGKSSYAERLALSLSPNPVYLATSRIWDEEFRQRVLRHQANRGPEWTNIEEEKELSRHSLEGRVVLIDCVTLWCTNYFFDLEADTDKALTAVKAEFDRLTQQDATLIFVTNEIGMGGTSENLIQRKFTDMQGWMTQYIASRANRVILMERGFL

SEQ ID NO: 5899 - protein, 502 aa, B.fragilis
KKKNIMAKELKDLTKRSENYSQWYNDLVVKADLAEQSAVRGCMVIKPYGYAIWEKMQRQLDDMFKETGHVNAYFPLLIPKSFLSREAEHVEGFAKECAVVTHYRLKNAEDGSGVVVDPAAKLEEELIIRPTSETIIWNTYKNWIQSYRDLPILCNQWANVFRWEMRTRLFLRTAEFLWQEGHTAHATREEAEEEAIRMLNVYAEFAEKYMAVPVVKGVKSANERFAGALDTYTIEAMMQDGKALQSGTSHFLGQNFAKAFDVQFVNKENKLEYVWATSWGVSTRLMGALIMTHSDDNGLVLPPHLAPIQVVIVPIYKNDEQLKLIDAKVEGIVARLKQLGISVKYDNADNKRPGFKFADYELKGVPVRLVMGGRDLENNTMEVMRRDTLEKETVTCDGIETYVQNLLEEIQANIYKKARTYRDSRITTVDSYDEFKEKIEEGGFILAHWDGTVETEEKIKEETKATIRCIPFESFVEGDKEPGKCMVTGKPSACRVIFARSY

SEQ ID NO: 5900 - protein, 168 aa, B.fragilis
VYMKQELKEKLLLLADKYEVKEFIMDDPIQFPHRYTDKADIEISGLIAFWIATGNRKAIIKSGDRIDHELFLNAPYRYILSEEWRKYRGSNIQFFIAITPGMISIYSARLCMLATGSMGIWNPFVPFSLFRYAIGKIAIGVRTYQWDACFVKCFRSKENVYVSALDDS

SEQ ID NO: 5901 - protein, 114 aa, B.fragilis
SVVKFIITYSFVKLVPYKMFSGSKRQVMAFSANYPFLFSYPYRGECPGTFCFFAQKTGLGKGKSLCFHFEEPIFRPKEVSIYSERRLCFSKMNKSFAQYLYMFSSITYIVLIWE

SEQ ID NO: 5902 - protein, 333 aa, B.fragilis
EMENSESKKGRTLSIAFIVVLVAVALFTVIGMIAMRHQPLVLQGQAEATEIRISGKLPGRIDTFLVEEGQWVKQGDTLVVINSPTVEAKYRQVDALKQVAVEQNKKIDAGTRKQIIATAQQLWNKTQSDLTLARTTYNRILTLYKDSVVTSQRKDEVEAMYKAAQAAERAAYEQYQMAVDGAQSEDKASARSMVNAANSTVDEVSSLLVDARLIAPEDGQIATIFPKRGELVAPGTPIMNLVVMDDIHVVLNVREDLMPDFRMGGTFIGDVPALAQKGIGFKIYYISPLGSFATWKSTKQTGSYDLQTFEIHARPTKKVEGLRPGMSVLVEIK

SEQ ID NO: 5903 - protein, 136 aa, B.fragilis
EPEKASQDRPKNYLQNLSEKGKVMIEIHTIVTFDKEMKRLSKKYHSIIKDYAALIEDLKKNPHIGVDLGNGIRKVRMAIASKGKGKSGGARVITDTSAIISVEEGRVTLLTIYDKSDRENISDNEIIRLQQEILKK

SEQ ID NO: 5904 - protein, 165 aa, B.fragilis
KQFDMIALDILSDGFFAAIAGIGFGAISDPPLRAFKMIAILAAAGHACRYCLMTFLGVDIATASLFGALVIGFGSLWLGRKVYCPMTVLYIPALLPMIPGKFAYNMVFSLIMSLQTMNEPERLGKYMETFFSNGLVTCTVIFMLAVGATFPMFLLPHKAFSLTRH

SEQ ID NO: 5905 - protein, 279 aa, B.fragilis
NDLCAFSFLSFLYFCARFKKVSNFMTTNESLISISKFIAGYSAHLMGAGVHTSRVIRNSKRIGEAYGVDVKLSVFHKNIILTIIDNETREACNEVIDIPPHPISFEHNSELSALSWEVYDKHLSLHELSDKFNKIISAPKIDPLFVLLLVGFANASFCKLFGGDIISMGIVFSATITGLFLKQQMQKKKINHYIIFIVSAFVASLCASTALIFDTTSEIALATSVLYLVPGVPLINGVIDIVEGYILTGFARLTEAALLIVSIAIGLSFTLLMVKNSLI

SEQ ID NO: 5906 - protein, 580 aa, B.fragilis
SPLRGYVNKYSINITFYTMELLRNLFEGYPNLWGGGVAHSVLILSLVIAFGIMLGKIKVAGISLGVTWILFVGIVFGHFNLNLNEHLLHFLKEFGLILFVYSIGLQVGPGFFSAFKKGGFTLNMLAMIVVFAGVIITLALHFITGIPITTMVGILSGAVTNTPGLGAAQQANSDLTGIDAPEIALGYAVAYPLGVVGCIMSLLGLKYLFRINTKQEEAEAEQGLGHLQELTVRPVSLEVRNEALHGKRIKDIRPLVNRNFVVSRIRHLNGKKESELVNSDTELHLGDEILVIATPIDIEAITAFFGKPIEVEWEQLNKELISRRILITKPELNGKTLAQLKIRNNFGASVTRVNRSGVDLVASPQLQLQMGDRVTIVGSELAVSHAEKVLGNSMKRLNHPNLIPIFLGIALGCILGSIPFMFPGIPQPVKLGLAGGPLIVSILISRFGPQYKLITYTTMSANLMIREIGISLFLACVGLGAGDGFVETIIHEGGYVWIAYGMIITIVPLLLAGFIGRYAFKLNYYTLIGVLAGSTTNPPALAYSNDLTSCDAPAVGYATVYPLTMFLRVLTAQLLILSLG

SEQ ID NO: 5907 - protein, 191 aa, B.fragilis
MMKRIYTRTGDRGTTGIHGGERVEKDDIRIEANGTIDELNAVIGIIRSLLPQEHDWQKLLHHLQRELMVVMSHVATPSAIRDKNPNVLSPGLAAFCEQEMDTMTAGLKENGYFLLPGGTPVSAQLQFARTVARRAERRLWTLNRQDAVPEDILSFINRLSDLFFVMARFDMQQQDWPEERWQAFAYKTKKK

SEQ ID NO: 5908 - protein, 260 aa, B.fragilis
QNVRRRMCFRSVMRYTSFSTPATVPILDGYRISADHAVSALHTDETEVARLYRRLLRSTVSSKRTVFLPGNSYTNVYIVMEVILIRHTSVDVPKGVCYGQTDVPLRDSFEEEASITAQQLQNDVFDAVFTSPLSRCTRLADHCGYPDAIRDARLKELNFGEWEMQEFDKICDPRLEEWYNDYFHVAATGGESFMMQLQRVSEFLNEVSGKEYKRIAVFAHGGVLICAQIYAGILRMEDAFNALTPYGGVVRLQLNSKTEE

SEQ ID NO: 5909 - protein, 325 aa, B.fragilis
DRESMDGMFFWYISLVYFCRLFPLPLAWLFDRWQGDPSWLPHPVVGFGKLIAWGEKCLNAGRARVWKGGMMSVALIVGVYFFTFLFFKVIGEYSIILTALIQTLLIFCCLAGTTLIREVRMVFEAVDRSLDEGRKQVARIVGRDTSALSAQEVRTAALETLAENLSDGVIAPLFWYAVLGVPGMMAYKMVNTLDSMIGYRNERYRQFGCIAARIDDVANYILARLTALLMILVTERFSLLRFVGKYGSRHASPNSGIPEAALAGILNCRFGGPHYYFGEEVWKPFIGNNERALTTEDMKKAVCVNRQAEVLMVVLVWLTILLSLS

SEQ ID NO: 5910 - protein, 132 aa, B.fragilis
FIIFVFVLKETRCIMKEPEKYKQPEEETTRLSEPTVAYNSMAYLELEAEKAELIRTIANIDSKEIIDKVKQKLHDVLGLDKNRETEPECKKYILANIKEAFCEQERVRTGESKSRPAEELLAELIREREGND

SEQ ID NO: 5911 - protein, 1084 aa, B.fragilis
INLIDNHMNKKLILSIFVLAGAPVLLSAAGEARLLRFPATNGNEIVFSYAGDLYKVPASGGEAQRLTSHVGYEMFPRFSPDGKTIAFTGQYDGNTEVYTMPATGGEPLRITYTATNSRDDLGDRMGPNNIVMTWTPDGQRIVYRNRISDGFSGKLFTVDKEGGLSEVIPLPEGGFCSYSPDGKQLAYNRVMREFRTWKYYKGGMADDIWVYNPGNKTVENVTNNVAQDIFPMWIGDEIFFLSDRDRIMNIFAYNTKTKQTVKVTNFTEYDVKFPSVHGNTIVFENGGYIYKMDAAARKAEKVNITLASDNIYARTDLKEGANYVTAASLSPDGARMVVTSRGEVFNLPVEKGVTKNITRSPGAHDRDAQWSPDGTQIAYISDATGETELYLQNAAGGEPMQFTHKNDTYIRDFKWSPDSKKIVYMDRKNRVNLLDVASGKVSLLLQDPVGVPGGVTFSPDSEWLTYTRMGKNEINVVYVYNIAEKKEYPVTDKWYNSSSPVFSADGKYLIFSSARDFNPTYGSLEWNHVYNNMYGVYIALLSKDTSSPFMQKDAEVAVSNATPKSGDKKPADKKEVADASLVKFDPDGITDRIVRLPLSPSYYGNFYSDGNKVYYWGRGGTKMYDLASQKEESIADGASMDVTYDGKKALFFKGRQIYVTNLPSGKTELTAPVDLSNMKITVDYPKEWAQIFDEAWRAYRDGFYQESMHGVDWKAIKEKYAVLLPYVKTRLDLNYIIGEMIGELNCGHAYVNPGETEQPKRINTGLLGAEITRDKSGFFRLEKIFPGASWSKELRSPLTEPGVDVKVGEYIVAIDGVPTNTVKDMYSLLVGKAEIPTEISLNAKPQLSGARKVVISPLANEYPLIHYNWVQDNIKKVDQASNGRIGYIYIPDMGPEGLNEFARYFYPQLDKEGLIIDDRANGGGNVSPMILERLSREPYRLTMGRGTSHVGTVPDAVQVGPKVCLINKYSASDGDLFPWGFRALGLGKLIGTRTWGGIVGISGSLPYMDGTDIRVPFFTSYDPKTGKWIIENHGVDPDILIDNDPVKEWNGEDQQLNRAIEEVMKQLKDRKPLPPVPAPRDFSK

SEQ ID NO: 5912 - protein, 448 aa, B.fragilis
KPTIMECRMISQFLIAAPSSGSGKTTVSRGLMALLIKKGLKVQPFKCGPDYIDTKYHTAVCRRPSINLDTFMASAGHVKELYARYATGADACITEGMMGMYDGYDRDRGSSAEVAGLLNLPVILVVDAKSAAYSVAPLLSGFIHFRPEIRIAGVIFNRVGSPRHYEMLQEVCTELGITCLGYLPKQESLVQESRYLGLDFSHSKGTDALEELTGLMEKYIDYNRLLEETKLPAPIPPVSNISLQEDLKISVACNSESFSFIYQEHLDVLCRLGTVILFNPEDNRPLPEGTDLLYLPGGYPEKHYEKLRQAWQRMQSIRNYAESGGRVLAECGGMIYLSKGILLDRSEHSDSEVGLQAGVLPFFISNRKADRRLTLGYRQFDYNGQHLRGHEFHYTQFEPKPEESLESVTQVYNAKRMPVSTPVFRYKNVIASYTHLYWGEIDLLKLFE

SEQ ID NO: 5913 - protein, 821 aa, B.fragilis
LFPFQNKANMIISKNPLGDIAKLNRICASAQIGWWEVNFTTGKCFISETLLKSLEVSSVWLDIDELMSTVRQDYRKRITDEFTSIPRKGVFEQTFPVTSGRGNVFWIHCALSMEEENEEGQLIATGYGQRIESPETQGYQCAWNQRINNLLYCQNSIANSLLKLLSNDTGDELFEEMLADILYFFKGARVYIVRYNWKNGNQSCLYEVAACNVITLKEKLQNICSEDAPWFYQQIHANRPVILNSPDELPPLAVRDREVLAENGTNSMMLAPLMREEGVWGYMGIDIVDGYRKWNSEDYQWFSSLANIISICMELRMIKERVMHSEKLFHDIFTNIPVGLELYNKEGMLLDCNNRNLEIFGVGDKNRIIGLNLFESPNMTRDIHESLRAGRPGTFHLKYDFDEERRLFQSERRGVMDLDIRSLMLYDAEDNLSNYLLVNIDNTERNNALSKVHDFENFFSIISDYSKVGYAKINLLDHTGFAVRQWYRNLGESHDTPLADIIGIFSHMHPDDRKSVLDFYEKAKAGTERFFDGDLRIRPADGADRWNWIHKSSMVTAYQSPNPRLELVEVNYDITVQKETEAELRAARDKAEESNRLKSAFLANISHEIRTPLNAIVGFSDLLMTVDDPAEQEEFRRTIQKNNTLLLQLFSDIIDLSKIDAGSFEYMPKPVCLYQFCAMMVQKMRNKVPEGVELQIDEDSPLDTWFSADSGYLNQVVTNFMSNAIKFTHRGTITVGYRIDARQQLEMFVEDTGIGISIENQEAVFDRFMKVDSFVQGTGLGLPLCKSIIEKMGGHIGVISELGKGSRFWFTLPAFSCIPTR

SEQ ID NO: 5914 - protein, 289 aa, B.fragilis
QTMIEGHGDDSYKYRHPIRSNFSSNVYNKVNLDGLRAHLCGRISAISAYPEPEPYTLEARLADRHALPAASVCVTNGATEAIYLIAQTFRGTNTAILMPTFSEYADACRMHGHKVTSLYTLDAVPEDVHMVWLCNPNNPTGEVRDKKYLTELIAKHPRVCFVIDQSYEYFTLKELFTAQEAAGFPNVILLHSMTKRYAIPGLRLGYVTAHPGLIGRLRTNRMPWSVNQLAIEAGLYLLSEGIPAGLSMKDYLAECARLKSSLEAIGGLEVWPTDTHFMLVCLRFGKAAL

SEQ ID NO: 5915 - protein, 103 aa, B.fragilis
ASPMRFELRITREVCTPAPIKWAEYPAMNLDMEIKDSFVVIKLLTFLNRAQKYKKERKEKAHKSFHFTRLSLSHCLSLLLFRTQPNERINNCAVSTRRNIVSG

SEQ ID NO: 5916 - protein, 250 aa, B.fragilis
DLPMNILAAFIFFTRLPFWRIREVPAECFKHVVPYWPLSGWLTGGIMAGVLWLSAQILPFSVAVLLALAARLLITGALHEDGLADFFDGFGGGTNRERILSIMKDSHIGSYGVIGLIFYFLLLWSLLMSLPLSFACITLIAGDTISKLTSSQIINFLPYARKEEESKAKVVYNRMSGGECAFGLLCGILPSALLLPYRYWMAIVFPLIMLYLLCTLMKRKLQGYTGDCCGALFLLSELSFYLGIVILMFI

SEQ ID NO: 5917 - protein, 66 aa, B.fragilis
YFIFPFPDAKYCAIAMGISETIFIFAWLYKIKATHAVVAQLAERRLPKPQVTSSTLAYRSKVYLLN

SEQ ID NO: 5918 - protein, 176 aa, B.fragilis
LKSSTNRFSYIIIFSIGNTKIPSAPSAFSLPMISQNRFSSSTVCTEHQPSCANGITVGLFIPGSTAIISSSLSLGAFISTYFLSSAVFTASMRKSNSSNISFFSLLIFLLPISKASDLITTSTSFRRLLTRVEPELTISKIASANPMPGATSTEPVMTCTSAFTPLLFIKASKIPG

SEQ ID NO: 5919 - protein, 103 aa, B.fragilis
LSSPIILVMVNVIRRMKANTSIIEKESIRFLINLSQLFLGTAFIPQIEFNELCISAKIVVAPKIEIPKLTKAADLEESVFSAFSIIERRASVTSGPTIGCSWT

SEQ ID NO: 5920 - protein, 64 aa, B.fragilis
LRLLSIRFSSADTCLVALLSAAYVVTEYKVTAITISAILKDLPTVNVVFPMFVLCLFMMHVVQS

SEQ ID NO: 5921 - protein, 434 aa, B.fragilis
TLKLKIMKLIKYPDRSQWNEILKRPVLETENLFDTVRNIINRVRAGGDWVVMEYEAVFDKAELTSLAVTSAEIEEAEKEVPIELKAAIYLAKRNIETFHSAQRFEGKKVDTMEGVTCWQKAVAIEKVGLYIPGGTAPLFSTVLMLAIPAKIAGCKEIVLCTPPDKNGKVHPAILFAARLAGVSKIFKVGGVQAIAAMAYGTESIPKVYKIFGPGNQYVTAAKQLVSLRDVAIDMPAGPSEVEVLADESANPVFVAADLLSQAEHGVDSQAMLVTTSEKLQTEVVYEVERQLGYLTRRDIAEKSLANSKLILVKDMEEALELTNAYAPEHLIIETKDYMEVAGQIVNAGSVFLGAFSPESAGDYASGTNHTLPTNGYAKAYSGVSLDSFIRKITFQEILPSGMSAIGPAIEVMAANEHLDAHKNAVTVRLEEIRK

SEQ ID NO: 5922 - protein, 119 aa, B.fragilis
KRKFNRYIFRERRHRQNYYYQYKIKRMKKKYYAALLAVVVIAFTGYNVYQSQKADASLSDLAMANVEALANGELSNGNCEGSWSQECCKCDYIHYTYACAIEVTGNSCYTVSGCSHYTN

SEQ ID NO: 5923 - protein, 68 aa, B.fragilis
CISTSFKFITDQFFSEETKNQSNSSTKQRLSKMSSPHYNLTKPQILFFSFHKKVIKPDLQKQIKRLPL

SEQ ID NO: 5924 - protein, 636 aa, B.fragilis
LCTTCIINKHKTNIGKTTFTVGRSFNIALIVIAVTLYSVTTYAADNKATRHVSALLNLIDNSLNYSKEAPNDSIIQWGNELAPLLKKQKEYKTLFQLKQLIVTAYASRGDMNMAIDHARRMYKEAKELNSPIGIALSSRAIGDAYLNANMQQPAIESYKEALELLDKIPGSEILEQEILPKFILTLIQASHMDEVRIYLQKFENLYADNPNPTFHFFICACNAYYNIESGDPEKGKAELDKARKIHEQLNYLYLRSIYNYILAQYYQAVGKYELALQQYECLTKVPKAPAPNKHIGLQLECAQLLTQMGRTEEAYRIYQKANRQKDSLNALSYARQINDLRGMYQIDRMEIRNQIQRNQIILWIIIVSIFILMLVLLLIVRIRQESNRLLRSKEELEIARKYAENSIRTKSLFLSNMSHEIRTPLNALSGFSSILTDESIDNDTRYQCNDIIQQNSELLLKLINDVIDLSNLDPGKLTFNFKECDAVNICRNVINTVQKVKQTQAGVSFVTSLDRLTLRTDEARLQQVLINLLINATKFTTEGSITLTLEKESETIALFTVTDTGCGILREKQDQIFNRFEKLNEGAQGTGLGLSICRLIIEQIGGRIWIDPDYTEGARFRFTHPVRPAKGKEAER

SEQ ID NO: 5925 - protein, 389 aa, B.fragilis
ECQTDWSTEKISIGKMKKKVLFIDRDGTLVIEPPVDYQLDSLEKLEFYPKVFRNLGFIRSKLDFEFVMVTNQDGLGTSSFPEETFWPAHNLMLKTLAGEGITFDDILIDRSMPEDCASTRKPRTGMLTKYISNPEYDLEGSFVIGDRPTDVELAKNIGCRAIYLQESIDLLKEKGLETYCALATTDWDRVAEFLFAGERKAEIRRTTKETDILVALNLDGKGTCDISTGLGFFDHMLEQIGKHSGMDLTIRVKGDLEVDEHHTIEDTAIALGECIYQALGSKRGIERYGYALPMDDCLCRVCLDFGGRPWLVWDAEFKREKIGEMPTEMFLHFFKSLSDAAKMNLNIKAEGQNEHHKIEGIFKALARALKMALKKDIYHFEMPSSKGVL

SEQ ID NO: 5926 - protein, 938 aa, B.fragilis
KKKTTVVIWTGCLNDDRFVPLAMKKTIQQLVLERILILDGAMGTMIQQYNLREEDFRNERFAHIPGQLKGNNDLLCLTRPDVIRDIHRKYLEAGADIIETNTFSSTTISMADYHVQEYVREMNQAAVKLAREVADEYTALNPDKPRFVAGSVGPTNKTCSMSPDVNNPAYRAVTYDEMADAYQQQMEAMLESGVDALLIETIFDTLNAKAAILAAERAMKATGVKVPVMLSVTVSDTGGRTLSGQTLEAFLASVQHADIFSVGLNCSFGARQLKPFLEQLAARAPYYISAYPNAGLPNSLGKYDQTPADMAHEVKEYVHEGLINIIGGCCGTTDAYIAEYPALIAGAKPHIPVCKPDCMWLSGLELLEVKPEINFVNVGERCNVAGSRKFLRLINEKKYDEALSIARKQVEDGALIIDVNMDDGLLDAKEEMTTFLNLVASEPEIARVPVMIDSSKWEVIEAGLKCLQGKSIVNSISLKEGEEKFLEHARTVRQYGAAVVVMAFDEKGQADTATRKIEVCERAYHLLVDKIGFNPHDIIFDPNVLAVATGIEEHNNYAVDFIEATAWIKKNLPGAHISGGVSNLSFSFRGNNYIREAMHAVFLYHAIQKGMDMGIVNPGTSVLYTDIPADVLERIEDVVLNRRSDAAERLIELADRLKEASAGNTSAGQPVKHDAWRDGTVEERLQYALVKGIGDFLEEDLAEALPKYDKAVDVIEGPLMNGMNHVGELFGAGKMFLPQVVKTARTMKKAVAILQPIIESEKVEGTASAGKVLLATVKGDVHDIGKNIVSVVMACNGYDIIDLGVMVPAESIVQKAIEEKVDMIGLSGLITPSLEEMVHVAMELEKAGLDIPLLIGGATTSKLHTALKIAPVYHAPVVHLKDASQNAGVAARLMSPKSKEELAKELSGEYEALRDKSGMMKRETVSLKEAQENRLKLF

SEQ ID NO: 5927 - protein, 788 aa, B.fragilis
IKWTSFAVIIVTFYATKVHFYEEKKSKRRQKPKLFIIFAALKHSEPLQRETNSDFRFSQTSLIHHLKIIAFVKFPTSASQLQPYVFQRIKLKYLNNSLYCMYNIIQLNDKNLSELQAIAQELGIKKTDSLKKEELVYKILDEQAIAGATKKVAADKLKEERKEDKKKRSRVTVKKENADKVFSSTKNGELTKTDAKTPAAKTQPQPKTTEPTPETAKEANAETNATPAESVKVTPYATPKKKPGRPRKNQVETEAKPAEETTEKPETVPSAQEEKPAAQPETEKRPISKPILKPKPAVVDEESSILSDIDADDDFIPIEDLPSEKVELPTELFGKFESTKAEAATAPEPVAQPQRPRVIRPRDNNNNNNYNNNNNNQRNNNQRQPVQQRPMPQQNAAEAAPVQERRVIEREKPYEFDDILTGTGVLEIMQDGYGFLRSSDYNYLSSPDDIYVSQSQIKLFGLKTGDVVEGVIRPPKEGEKYFPLVKVSKINGRDAAFVRDRVPFDHLTPLFPDEKFKLCKGGYSDSMSARVVDLFSPIGKGQRALIVAQPKTGKTILMKEIANAIAANHPEVYMIMLLIDERPEEVTDMARSVNAEVIASTFDEPAERHVKIAGIVLEKAKRLVECGHDVVIFLDSITRLARAYNTVSPASGKVLSGGVDANALHKPKRFFGAARNIENGGSLTIIATALIDTGSKMDEVIFEEFKGTGNMELQLDRNLSNKRIFPAVNIVASSTRRDDLLLDKQTLDRMWILRKYLSDMNPIEAMDFVKDRLEKTKDNDEFLMSMNS

SEQ ID NO: 5928 - protein, 380 aa, B.fragilis
SNFATPTQDLANMNKRIFLVIGVIILFIMIAIGASTYTIIHSLIQKEKEAFKPQVENILKEAVANNTIQKCKDIPLNGFNNSPNKIGTYETRTFCSRDTLFTYQHKIQDVDSEILFARQLGLLMMDSLQSSDIQALIIKDLNKNDIKGYINTGIIVSKHLQREIWSQPSNSIPRNAEMITYRLENEIVSVDYIMYIDYSFSTLWKRMPKTNIYINLVVEVILIYTITLFVLYYRKQQKNRSVSTVDITSDPNIITDPISVDNTVETEKRTNSTIKEELSFKDQFVFEKDFVLFNDRPIKMPNQQQKILLFFLNRPNYRVNKHELKEEFWPKNSDPTNNMTSAINKLKKILEEINSKYTIITDKTNEEYYVLIRDKSAEKI

SEQ ID NO: 5929 - protein, 133 aa, B.fragilis
MEILFPELLYSIIVLNKRLRYSYLNIIMLTFTDNFENDKELILRDHLALERTKLANERTLFAYIRMALYLLTVGIGIFQIESISRLDGLAWGCIIAGIFLFFLGFVRFEQMRKHLKQYTKTCRDTENESSRKK

SEQ ID NO: 5930 - protein, 642 aa, B.fragilis
KMNYGFVKVAAAVPRVKVADCKFNSERLEGLITIAEGKGVQILTFPEMCITGYTCGDLFAQQLLLEQAEMALIQILNSTRQLDIISILGMPVVVNSTVINAAVVIQKGKILGVVPKTYLPNYKEFYEQRWFTSALQVSENSVRLCGQIVPMGNNLLFETAETTFGIEICEDLWATVPPSSSLALQGAEIIFNLSADDEGIGKHNYLCSLISQQSARCISGYVFSSSGFGESTTDVVFAGNGLIYENGYLLARSERFCMEEQLIINEIDVECIRAERRVNTTFAANKANCPGKEAVRISTEFVNSKDLNLTRTFNPHPFVPQGNELNSRCEEIFSIQIAGLAQRLLHTGAKTAVIGISGGLDSTLALLVCVKTFDKLGLSRKDILGITMPGFGTTDRTYHNAIDLMNSLGVSIREISIREACIQHFKDIGHDLNIHDVTYENSQARERTQILMDIANQTWGMVIGTGDLSELALGWATYNGDHMSMYGVNAGIPKTLVKHLVQWVAENGMDETSKATLLDIVDTPISPELIPADENGEIKQKTEDLVGPYELHDFFLYYFLRFGFRPSKIYFLAQTAFSGVYDDETIKKWLQTFFRRFFNQQFKRSCLPDGPKVGSISISPRGDWRMPSDASSAAWLKEIAEL

SEQ ID NO: 5931 - protein, 289 aa, B.fragilis
PYIHPPVIRKRDLCVTKKTKVMHLRTYYPTVVLSDIHLGTQHSKTEEVTHFLKSINCDRLILNGDIIDGWHLQKSGLGKWKAKHTDFFKVIMKMMENFGTQVIYVRGNHDDFLDNLAPLNFYNIRIVKDCIYESHGRRYYVTHGDIFDTVTTQMKWLAKLGDTGYTFLLWLNKVYNLRRMKQGKPYYSLSQSIKNRVKTAVSYISDFEKELVGLARAKKCDGVICGHIHHPANTFYEDIHYLNSGDWVETLSALTEDEDGNWTIRYFDSGLLKEDNHKEKQTISITIAS

SEQ ID NO: 5932 - protein, 192 aa, B.fragilis
HCDLCSTILKRGKVMKRHLILVFALLASSVALNAVNSLPDDDKSDNKNKTELNSVVKKTWEFYSTIKQPSADALANAGNYKFGQEAGYLYNQFMKIYVVREEVVPGDPTRRTVIRKPTIYNAVRSIEKQLNKELKSNQMTREQVAAEFTNVLKVAISAYDSESESFEDALQINRKNATDLLSVFQNVKLTEI

SEQ ID NO: 5933 - protein, 198 aa, B.fragilis
KTYQKAFLNHIFPYFCFLIFINIEFTLLYIVEMIEVTDASLQKAAGEGMDEFIQVFTDKYKEVIGGELTAETMPLLTGEQHSLLAYQIFRDEVMFGGFCQLIQNGYGGYIFDNPFAKVMRLWGAEDFSKLVYKAKKIYDAHRHDLEKERTEDEFMAMYEQYEAFDDLEEEYLDIEEEVTALVASYVDDHLELFAKIVK

SEQ ID NO: 5934 - protein, 676 aa, B.fragilis
PGLHRRCAIPVYTPRPARKGKGGRKMKRLILIIIVCCRALGWCHANTQTETDSLYRVTQSLPHDSTRLEMFKRLAQIEQLTPKCITFSGLLREEATLQKNDRYNAIAAYLHTVYYYNQNNRDSVKKWLDTMEPYARKSQTWDLYFDALRFQIDLCTYEEQYELAINEANQMYERAQKVNCARGLIGAKQCLGNAYISTERWDEGMKALEAAYQLSSQTDNAVVRISILCQLISITKDQKNNQLLSEYLAKLKETLHHHTSTNPMLKKAFYDVYLFCEVYYTYYYLYAGQPEQAHKNLVNAGKFLNGNTFFLYRVLYYDAYAAYFRACKAYDRALAKIDSTIMLLQEDFNSNYIHQKLTKADILAEAGRSAEAIPLYIETLHLKDSIETTVLDKQMQQIKAKYNIDKVALEEEQLKSYIQLGTLIVVVIILIILVAFMLRISHVRKALERSEKETRETTRMAEEANEMKNRFLSNISYHIRIPLNGVVGFSQLIASEPNMPDELRKEYSSIIQKNSEELMRLVNDVLDLSRLEAGMMKFNIQEYGLAELCNEATYMARMHSEGCTVIRLENEIETDLNIRVDTVRFTQALLSALTYPQKYKEKREIDFKVTLDTEKHFINFRITNSPLADERFTSQEVCIRHEINRLLFEYFGGSYKVQTNPDGKPAILFTFPSGRN

SEQ ID NO: 5935 - protein, 252 aa, B.fragilis
SGWQPDTLSSVDEKGEVKYHKPDCAVKGSMDLNRKFLLRQYLKDYLSAVVGDKIEGANHSDFSDACLLHQIVDTPKVSYQVAYPQSRKRYRYIRYTSTPEKTLQLAELQLFRKVDDQEKITAKVIDGSNAFIADDRFDRFKVNDGDGLTFFLTKEKGAFVTLDLGKPEKIEKIVYMPRNDDNFIRLGDQYELFYQDGFRGWISLGRQVASELTLHYDNIPQNSVLWLRNLSRGREETVFRNEDGRQVFFVKW

SEQ ID NO: 5936 - protein, 315 aa, B.fragilis
KRIKMEIHSERKKRLSLSLLFKIIKDTVWGFIDDSVMRLSASLAYATLFSIIPFLSLLVTVGVFFHMDLANQLYVQLQPIVGPEVTEALRSIIENAENTDSSRSAAFVSLGISIFGATTIFAEIQSSLNSIWGIKAVPKKSWLKFIKNRILSFSIILVFAFILLITFTITNIIGELSQKFIFKYPEAADSLVKVVGIIINMSVTTIIFTLIFKILPDAKIKSKDVCIGAVVTTILLLIGQWGISFYIGIANVGTVYGAAAFMVVFVTWIYYSSIIIYTGAEFTKAWANEMGSKIFPDEYAVATKTIEIHEDKPIE

SEQ ID NO: 5937 - protein, 63 aa, B.fragilis
KTSNIHYLSLLKYLALDYKPRQSPADILALVMTTYHPHSLLPKLLSPIGLLKDPFVLSLRMIL

SEQ ID NO: 5938 - protein, 726 aa, B.fragilis
FFYKLMNRLKLYLLALTALAVCSAKADEGMWLLQLMQQQHSIDMMKKQGLKLEAQDLYNPNGVSLKDAVGIFGGGCTGEIISPEGLILTNHHCGYASIQQHSSVEHDYLTDGFWATSRDKELPTPGLKFTFIERIEDITDIVNLRIAAKEITESESFSSTFLNKLAKELFEKSDLKGKKGIVPQALPFYAGNKFYMFYKKVYPDVRMVAAPPSSIGKFGGETDNWMWPRHTGDFSMFRIYADANGEPAEYSASNVPLKTKKHLNISIKGLKEGDYAMIMGFPGSTSRYLTVSEVKERMEASNAPRIRIRGTRQDVLKEAMNASDKVRIQYANKYAGSSNYWKNSIGMNKAIIDNNVLGTKAEQEAKFAKFAKEKNNTDYMNVVAKIDEAVAKTSPIKYQQTCLTETFFGGIEFGSPFMVMDKLKEALEQKNDSSIEANIKVLKEVFNDIHNKDYDHEVDRKVAKALLPLYAEMIPAGQRPAIYDVIEKEYKGDYNAYVDAMYDTSILANQANFDKFIKKPTVKAIEKDIATQYSRAKFDKYTNLAEQMGKLPEDWLLLHKTYIRGLGEMKLPVPSYPDANFTIRLTYGNVKPYSPKDGVYYKYYTTTDGILEKENPEDREFVVPAKLKELIEKKDFGRYALPNGEMPVCFLSTNDITGGNSGSPVLNENGELIGCAFDGNWESLSGDINFDNNLQRCINLDIRYVLFILEKLGGCGHLINEMTIVE

SEQ ID NO: 5939 - protein, 347 aa, B.fragilis
ELILILHWRNMIYRNWLGIIGVACILFVSCKPTEVDVPITYYSSFLLKDTTVMLSKVEMDPMQVNARCMVWDGDKRVLVRTSTTDSIYAVFAYPEMKFLSYTGSLSEYKQILAKCNEGFYLVKDDSLYLYHLTDKDLLQKTTTHFLYNSNKIRLSKIKKLNDKMYTAHAYTDPSYNDIRLNEFYMLDAENNILYPKGHYPERTEVRFKTIFDFKFAYAHEVWPKPDGSRILVNYVRTRRFRIYDLSARLLHDVCLDYASNKYVVDADPKRWTTFIRDCFVTDKYIYLLCPEGEQSSLVIVDWDGRPIARYRLDEKIFFFFIDPDRNLFCGINSNNGQSFYFLDLDIN

SEQ ID NO: 5940 - protein, 265 aa, B.fragilis
ILIKCFICIRIRCTFVVEKVVYPMNKVLPFLLLLFVFTSCSRKYKIEGASSVTSLDGKMLFIKVLQNGEWLNIDSAEVVHGLFSMKGKVDSVVMATLYIGDESIMPLVIEKGNIQVSITNTELVAKGTALNNALYAFIDKKNSLDVQIEELQRKEARMVMDGADLADIHEQLTHEGDSLMQDMNGFIKKFISDNYETVLGPSVFMMLCSTLPYPVMTPQIEDIMKDAPYSFKNNKLVKDFITKAKSNMELIEEHQRMEQNATLNH

SEQ ID NO: 5941 - protein, 385 aa, B.fragilis
GKTNYIHNNSIMKFLFIVQGEGRGHFTQAITLEDMLLRNGHQVVEVLVGKSSSRTLPGFFNRSIQAPVKRFTSPNFLPTAENKRADLKKSFAYNLIHVPEYFRSMCYINQRIKETGAEVVINFYELLTGLTYALFRPSVPYVCIGHQYLFLHNHFEFPRKSVIQLSMLRFFTRMTSLRASRRLALSFRKMESDRTERISVVPPLLRREVTAMQSAQGNYIHGYMVNSGFADSVEAFHALHPEIPMHFFWDKQDADEVTKVDATLSFHQIDDVKFLNRMAGCRAYASTAGFESICEAMYLGKPVLMVPAHIEQDCNAYDARQAGAGIIGESFDLESLLRFAGTYVPNREFIRWVRSCERQIIGELERLADQHSAVTVPTLTNYFPI

SEQ ID NO: 5942 - protein, 93 aa, B.fragilis
SGKNRKETDQKKRNFFYLFCKIDCKSLNGLILLFFDRILASLILFFLKLCKVNQCRKYDYNEVETGSSWDDVANLGNYDVGHHILSNSRREMS

SEQ ID NO: 5943 - protein, 290 aa, B.fragilis
IFMKYLYVLLAFSFLFSCKDENKKHAESVLREWMNKEIVFPNKMYFSIQGKENVDFRIKDTEYKIVAYVDSAGCTSCKLHLSKWKELIHYVDSIQSERVQFLFFFFPKNGRDIYHTMRMDKFTYPVCVDTLDSFNKLNHFPDDVRFQTFLLNKENKVVAVGNPIHNPNIRDLFLNIISGGTSLPDEKRPQTEVKIEALSMDLGMFDWKKEQKCIFTVENTGKELLVIDDVNTSCGCTTVEYSREPVQSGKTIDITVVYKAEYPEHFNKTITVYCNSPVSPLQLKIKGDAK

SEQ ID NO: 5944 - protein, 136 aa, B.fragilis
SVMNLNEVDIHYLIAAISVITSALVFYTIGVWGERLQKRLKFWHLVFFLLGLLADSVGTALMENIARLTHLHDEIHTVTGIIAILLMFIHAMWAIWTYVKGSERAKEHFNRFSIVVWCIWLIPYCIGVYLGMSLHH

SEQ ID NO: 5945 - protein, 355 aa, B.fragilis
NLMKYCLTFLFLLVIFTGCTSDLPKDRMLYASFPKEETLHSKVIQLDSVYMRYPFRVHVSGDQAVVLDLHGTDVYCHLFHYPDFHYLSSFGRRGDSPEEMLSVETVKCIDGSFWTLDANKGELTRFEFVSDRDSLLRAEAISFDKDSILRALDFVAFNDTTFLIPDYSGDSRFCWVNRQGKFLKKSGVIPSLNEEALKEARPALAQAWRSFIDYNPHNGVLVAATQLGEVLEIYNLQNGFHRVCLGPKGEPEFKLAGGYAIPDGIMGFSDVQVTDEAIYAVFHGHTFKEIMAQHQKEGRATDGGQYIYVFNLQGEPLCKYTLDRYITGFHVDERNKTITATDVNNDQPIVEFRFG

SEQ ID NO: 5946 - protein, 187 aa, B.fragilis
DEMKKFRCTVCGYVYEGDAAPEKCPLCKAPASKFVEVVEEEGGALTFVDEHVIGVAKGCDEEMIKDLNNHFMGECTEVGMYLAMSRQADREGYPEVAEAFKRYAWEEAEHASKFAELLGDCVWDTKTNLEKRMNAEAGACEDKKRIATRAKALNLDAIHDTVHEMCKDEARHGKGFEGLYNRYFGKK

SEQ ID NO: 5947 - protein, 723 aa, B.fragilis
IMMKRNLLSAAFALMALAVSADEGMWMLTDLKAQNEAAMMDLGLQIPIEEVYNPDGIALKDAVVHFGGGCTGEIISAEGLVLTNHHCGYGAIQQHSSVDHDYLTNGFWAMNRNEELPCKGLTVTFIDRILDVTTYVNEQLKKDDDPNGINYLSPKYLATVADRFAKAENIQITPATRLELKPFYGGNKYYLFVKTVYNDIRMVGAPPSSIGKFGADTDNWMWPRHTGDFSLFRIYADKNGQPAEYSKDNVPLQVKKHLTISLAGVKEGDFTFVMGFPGRNWRYMISDEVKERMQTTNFMRHHVREARQAVLMDQMLKDPAVRIHYASKYASSANYWKNAIGMNEGLVRLKVLDTKEKQQEQLLAMGREKGDDSYQKAFDEIRSIVAHRHDAMYHQQAISEALVTALDFMKIPSTDGLKKALESKNATKIKEETDKLKAEADKYFASVPFPEVERLVGKKMLETYAGYIPEDQQIGIFKVIDSRFKGNKDAFIDACFKYSIFGSKENFNKFIAHPTLNKLDKDWMILFKYSITDGLLKTALAMKDANKNYDAAHKVWVKGMMDMRQVAGTPIYPDANSTLRLTYGQVLPYEPADGTVYNYYTTLKGVMQKEDPDNWEFVVPQKLKQLYHAKDFGHYAMENGEMPVCFIVNTDNTGGNSGSPVFNGKGQLIGTGFDRNYEGLTGDIAFRPSSQRAAVVDIRYTLFIIDKYAGASHIIKELDIVEE

SEQ ID NO: 5948 - protein, 519 aa, B.fragilis
NTMNTFTLGLIVIAYLLSLAYLGFLGYKKTSSASDYLVGGRQMNPFVMALSYGATFISASAIVGFGGVAAAFGMGIQWLCFLNMFIGVVIAFIFFGLQTRRMGAKLNVSTFPQLLGRHYRSRGIQVFVAAVIFLGMPLYAAVVMKGGAVFIEQIFQIDFNISLLIFTLVIAAYVIAGGMKGVMYTDALQAVIMFGCMLFLLFSLYRVLDMGFTEANQALTDIAPLVPEKFKALGHQGWTAMPVTGSPQWYTLVTSLILGVGIGCLAQPQLVVRFMTVESSKQLNRGVFIGCFFLIITVGAIYHAGALSNLFFLKTEGVVATEAVKDMDKIIPYFINKAMPDWFAALFMLCILSASMSTLSSQFHTMGASVGSDIYGTYKPRSRGKLTNVIRLGVLFSILVSYIICYMLPNDIIARGTSIFMGICAAAFLPAYFCALYWRRATRQGVMASLWIGTIGSLFALAFLHQKEAAAMGVCRWLFGKDVLIEAYPFPMIDPILFALPLSVAAVIIVSLLTEKGKK

SEQ ID NO: 5949 - protein, 500 aa, B.fragilis
TNKKLIRNYKMKKIILLIVSVWMCVSCGNLEEMNIDPDNATQTHPKLLLTQICMNAFKRGTDGMYATKKVIQADGESADQYYKWTRGSFGYYDNLRNVQKMGEEAERVNAPVYTALTKFFRAYYFYELTLRFGDIPYSQALKGEKEEIYTPEYDAQEDVFAGILQELREADEILANDASVIDGDIIYNGNSTQWRKLINSFRLKVLMTLSNHTTVGNINIASEFKNIATNSPLMNSLADNGQLVYLDQQGNRYPQFNAQWSGYYMDDTFIQRMRERRDPRLFIFSAQTNKGKTEGKPIDDFSSYEGGDPAAPYSDAIIKVSEGTISPINDRFRTDPIVEPTMLMGYAELQQILAEAVVRGWISGNAQTYYEKGIRASFSFYETHAKDYAGYLNENAVAQYLKEPLVDFTQASGTEEQIERIIMQKYLVTFYQGNWDSFYEQLRTGYPDFRRPAGTEIPKRWMYPQGEYDNNGTNVETAITRQFGAGNDKINQATWWQKKS

SEQ ID NO: 5950 - protein, 670 aa, B.fragilis
RMKKLSSFLLLLLVVFTAQAQIQEPVKFKTELKTLSGAEAEIVFTGTIDAGWHVYSTDLGDGGPISATFNVEKMSGAEVVGKLTPRGKEVSDFDKLFEMKVRYFEKTAQFIQKIKFTGSDYSIEGYLEYGACNDENCLPPTQVPFKFSGKAAATAEVSAKETPATPVKEPVATVTDSIVEPTATTVTTAIGSVDLWKPVINDLKKFGEANSQEDMSWIYIFITGFLGGLLALFTPCVWPIIPMTVSFFLKRSKDKKKGIRDAWTYGASIVVIYVALGLAITLIFGASALNALSTNAVFNILFCLMLIVFAASFFGAFELTLPAKWSTAVDSKAEATSGLLSIFLMAFTLSLVSFSCTGPIIGFLLVQVSTTGSVVAPAIGMLGFAIALALPFTLFALFPSWLKSMPKSGGWMNVIKVTLGFLELAFALKFLSVADLAYGWRILDRETFLALWIVIFALLGFYLLGKIKFPHDDDDTKVSVSRFFMALVSLAFAVYMVPGLWGAPLKAVSAFAPPMKTQDFNLYTNEVHAKFDDYDLGMEYARQHNKPVMLDFTGYGCVNCRKMELAVWTDPKVSSIINNDYVLITLYVDNKTPLTEPVKIMENGTERTLRTVGDKWSYLQRVKFGANAQPFYVLIDNEGNPLNKSYAYDEDISKYINFLQTGLENYRKEK

SEQ ID NO: 5951 - protein, 343 aa, B.fragilis
YMWKKLSLYVCLITILCSCQKQRSAYAPPTFPEVKKIHAHRLSDELLISYLLDMAVSEDYIFILALADNAWLQVYDKTTGQLLGSFVTRGQGPGEATTANMCYYNAREKKISVYDESSMKLLTYQFDKDADNWGALIEEWSFYDLGGTLRRVWELRNGRFLVDGQLGTKSDQQKRFQMLADAKVVADYNDFPIDTPKERSVWSSPAIAISPDCKKMAVGTLYGGILELFDLSQNIELRAIRKFYPPVVQYLSGTIQNTEETVWGFSALCATDERIYSVFIGDKNPNLFNNLSVFDWDGRELIKYNTDCLVLRICASTQEPNKLYGIAFSETHEFYLVSFSLGS

SEQ ID NO: 5952 - protein, 258 aa, B.fragilis
NDYLCERFENRDYVFLIISLKKELIMTYSHEVEHMCVVKKGPNHGPAPIPEEGKWVKSKEIVDISGLTHGVGWCAPQQGACKLTLNVKEGIIQEALVETIGCSGMTHSAAMAAEILPGKTILEALNTDLVCDAINTAMRELFLQIVYGRTQSAFSEGGLIIGAGLEDLGKGLRSQVGTLYGTLAKGPRYLEMAEGYIKTIALDKNDEICGYEFVHMGKFMDEIKKGTDANEALKKVTGTYGRFTAEQGAVKHIDPRHE

SEQ ID NO: 5953 - protein, 64 aa, B.fragilis
LFSDMKLNKTDYMLERTSDGGYYAWLTVNMQCNAYGDSPEEAVKNLEQTMEDLVEEMYLVEDFI

SEQ ID NO: 5954 - protein, 193 aa, B.fragilis
INVESMTIMKLRLGVRGMMWLTLVIMMWGIISCRTQEEKCLEEVLSLPLANKEELQKVLDHYKDDSLKYQAVCFLIRNMPFHAGYEGNALKYYYQYFDIYAQGKLGPHEVIDSLKENSFSVSQLKRIEDIANIDSSLLVQNVDWAFKVWREQPWGKNVSFDNFCEFVLPYRLGDEPLGFWREDIYKRYNPILD

SEQ ID NO: 5955 - protein, 341 aa, B.fragilis
GGKEIMIREVKFESQDRRIKGIIEALNANGIKDIEEANAICEAAGVDPYKTCEETQPICFENAKWAYVVGAAIAIKKGCKNAADAAEAIGIGLQAFCIPGSVADDRKVGIGHGNLAAMLLREETKCFAFLAGHESFAAAEGAIKIAAKADKVRKEPLRCILNGLGKDAAQIISRINGFTYVQTQFDYFTGELKVVREIAYSDGPRAKVKCYGADDVREGVAIMWKEGVDVSITGNSTNPTRFQHPVAGTYKKERVLAGKPYFSVASGGGTGRTLHPDNMAAGPASYGMTDTMGRMHSDAQFAGSSSVPAHVEMMGFLGIGNNPMVGCTVACAVDVAQALAK

SEQ ID NO: 5956 - protein, 116 aa, B.fragilis
KMKEYIDVLKKWKDFDGRARRREYWMFVLFMAIFAIVASIIDAILGTICVFVGIYYLAMLLPMIAVSIRRMHDIGKSGWWLFITFVPVIGSLWYLFLTIQDGQPGSNQYGENPKGI

SEQ ID NO: 5957 - protein, 351 aa, B.fragilis
IGGDKKMKTLQELTRPNIWRLKPYSSARDEYSGAAASVFLDANENPYNLPHNRYPDPMQRDLKLELSKIKKVAPAHIFLGNGSDEAIDLVFRAFCEPGRDNVVAIDPTYGMYQVCADVNDVEYRKVLLHDDFQFSADELLAVADERTKMIFLCSPNNPTGNDLLRSEIIKVINDFEGLVILDEAYNDFSDEPSFLSELDKYPNLIILQTFSKAFGCAAIRLGMAFASEGIIGVLNKIKYPYNVNQLTQQQAIEMLHKYYEIERWVKTLKEERGYLEEAFVELPWVLQVFPSNANFFLARVTDAVKIYNYLVGEGIIVRNRNSISLCGNCLRVTVGTRAENAKLIGALKKYQ

SEQ ID NO: 5958 - protein, 197 aa, B.fragilis
NIKLRNNLNYKALFQIAMSLISSPAKAWEEIRLEDRRAVLTVFVYPMIGLCGLSVFIGALWTNGWGGPQSFQLAMTQCCAVAVALFGGYFLAAYAINQMGIKMFGMTNDIPLAQQFAGYALVVTFLLHIVTGLLPDFSIIGWLLQFYIVYVVWEGARVVMLVEEKNRLRYTIFSSILLILCPAVIQVVFNKLTAILN

SEQ ID NO: 5959 - protein, 724 aa, B.fragilis
SNLCIFVKIELIHYIIKSHKNMKKMLMAAGMAAVMTACGTAGQKAATDAGNPFLAEYSTPFGVPPFDLIKVEHYKEAFLKGMEEQKKEIDAIVNQRSVPDFDNTIAAFDQSGELLNKVSTVFSGLNSCNTNDEMQAFNKEITPLLSAHRDDISLNPALFARVKEVYERREKLGLDKEQNKLLEETYKKFVRGGANLDSVDQAKLRQLNSEISMLQLTFGQNLLKETNAFELVIDKKEDLAGLPESLVASAAEAAKGAGMEEKWLFTLHNPSVMPFLQYADNRELREKIFKGYINRGNNGNEADNNEIVKKLVALRLEKAKLMGYADYASYILEDRMAKNEENVYRLLNQIWTPAVAKAKEELSDIQSEIKKEGANFTPEGWDWRYYFEKAKKAKFSLDENEVRPYLELNNVREGAFYVANRLYGITFTEIKDIPKPHEEAQAFECKDKDGTHLGVLYMDFFPRNSKRGGAWCGTYRSQTYRDGKRLAPVVTIVCNFTKPSSGQPALLSADEAGTLFHEFGHALHNLFKDVHFHAVSGVPRDFVELPSQVMEHWVFEPEVLKIYAKHYRTGEVIPAALIEKLDKSGKYGQGFATTEYLAASLLDMDYHVLKEIPRNMDVTEFEAAVLKERGLLSQIPPRYRTTYFNHIMNSGYTAGYYSYIWAEVLDSDAFEAYKETGDLFNQEVASRFRRYILTPGGIDDAMDMYKNFRGKEPGIEPLLRNRGL

SEQ ID NO: 5960 - protein, 245 aa, B.fragilis
IIQCVLPLRCYFNYLFLYLSAKAVFYSCKITLFVSNIHYKRMLIIGIAGGTGSGKTTVVRKIIESLPAGEVVLLPQDSYYKDSSHVPVEERQNINFDHPDAFEWSLLSKHVALLKEGKCIEQPTYSYLTCTRQPETIHIEPREVVIIEGILALCDKKLRNMMDLKIFVDADPDERLIRVIQRDVVERGRTAEAVMERYTRVLKPMHLQFIEPCKRYADLIVPEGGSNQVAINILTMYIKKHIGRP

SEQ ID NO: 5961 - protein, 464 aa, B.fragilis
AMKRHLIIYSLLFLLFCVLSCRNKQAVAIEESSAHDLEQIKDSGELVVLTLYSSTSYFIYRGQDMGFQYELSEQFAKSLGVKLRIEVAKNVPELIRKLLNGEGDIIAYNIPITKELKDSLIYCGEEVITHQVIVQRTNGKTKPLKDVTELVGKNIYVKPGKYYERLVNLNKELGGGILIHQVTNDSITAEDLITQVAQGKIPYTVADNDVAKLNATYYPNLNTSLSISFDQRASWAVRKDCPQLAAAADEWHKQNMTSPAYTASMKRYFEISKAMPHSPILSLKEGKISHYDNLFKKYAQEIGWDWRLLASLAYTESNFDTTAVSWAGAKGLMQLMPATARAMGVPPGKEQNPEESIKAAVKYIAATDRSLSMVPDKQERIKFILASYNAGLGHIFDAIALADKYGKNKTVWTDNVENYILLKSNEEYFTDPVCKNGYFRGIETYNFVRDINSRYESYKKKIKS

SEQ ID NO: 5962 - protein, 476 aa, B.fragilis
SNIRLVSRFVASKLQDSVGLLQKVLMDFACLWNNPIFPFCFPAGPHLGPSVVSWRAGSCREFADLVVYVMRALGIPCGTDYMPMRGDNNVPHFWNFTLDKDGKTYITEFPDPNWKRAVSMYNPKAKVYRNTYGLNWKDVKRQQGKMMHPAFRKPLYQDVTAVYADSLNRDLVVSSDILCKEVHKGDIVYFCLSTRMDWVPIAWTVFEEDSLRFQDTEGSVIGCLATWNGKRLVMQSEPFTYDKMSGTIALLTPQSEKEDITLYFKFPLFCDLGILRMPGGVFEGSNDSQFRSADTLYYVKQWPFRLNNTIFPEKEKSYRYVRYKGPKGSYCNIAEMAFFEDTSDTLALKGRIIGTPGCFQKDGSHDYYKVYDGNPYTYMDYKTPDEGWVGLDFGIPRRIKKFTYIPRNSDNFIHKGDVYELFYWHDKKWNSLGRQVAKADSLNYVIPKGVALFLKNHTEGKDERIFKKTDGRQQFW

SEQ ID NO: 5963 - protein, 239 aa, B.fragilis
ERKSMKTVVDKASSRGYFNHGWLKTHHTFSFANYYNPSRMHFGVLRVLNDDSVDPEMGFDTHPHQNMEVISIPLKGYLRHGDSVKNTRTITPGDIQVMSTGKGIFHSEYNGSDKEQLEFLQIWVFPRIENTEPEYNNYDIRPLLKRNELALIISPDGKVPASIKQDAWFSMGTFDAGKSFEYKLHQEGNGVYLFIIEGDVEVAGNRLSRRDGIGLWDTKSFKVEITQEATLLLMEVPMR

SEQ ID NO: 5964 - protein, 493 aa, B.fragilis
VFRRKLQSTDKSGRKAGHPLHVSLRKKLTSSPIRSSTSTESCIFATCKLKPFFMYTNKQIWSVSYPILLSLLAQNVINVTDTAFLGRVSEIALGASAMGGLFYICIFTIAFGFSTGSQIVIARRNGEARYGDVGPVMIQGVLFLLVMALLLFGFTKAFGGNIMRLLVSSESIYDATMEFLDWRIFGFFFSFVNVMFRALYIGITRTKVLTINAVVMALTNVVLDYALIFGHFGLPEMGIKGAAIASVIAEAASLLFFLIYTYITVNLKKYGLNRLRSFDPVLLMRILSISCFTMLQYFLSMATWFVFFVAVERLGQRELAIANIVRSIYIVMLIPVNALATTTNSLVSNAIGAGGINYVMPLINKIGRFSFLIMLGLVIITALFPQALLSVYTNETALINESVSSVYVICVAMLIASVANVVFNGISGTGNTQAALMLEAITIAIYGSYIIFIGMWVKAPIEWCFTIEILYYTLLLATSYIYFKKAKWQNKKI

SEQ ID NO: 5965 - protein, 422 aa, B.fragilis
YMTGVAEKKKRMIKIYLLWVLLVGSLCCSCTGNKRLEYALEFAGENRGELEKVLEHYNDSGLKQDAARFLIENMPRYFSYEGWQLDTLKAIHAATEHTDGWVNKKDRKKWEHFSFRTLKKVYDAKVIKAEFLIHHIDQAFEVFEKRSWNKYLPFDDFCELILPYRIGDEPLEEWRGWYRERYESILDSLYQGTDVVEATDRLGAYLRQEKDFRYSVELDLPHLGAGFLLANRVGSCEASCDFTVYVLRALGIPAATDIYHYGPGKGAGHVWNVLRDTTGGYVPFWFIQTKVERGGSDKREKGKVYRRCFGAQQEKVSGIRRDRSVPFPLKDPYLKDVTSDYFPANQVTIEIDPQVDKKYICLGVFTLEGCMPIDITVQKGNKATFMNVEPGILFQPLYDNGMKWVAAGYPFQCRRKGRGEVS

SEQ ID NO: 5966 - protein, 167 aa, B.fragilis
NEKGMKKIINPWKGMEGYNCFGCAPNNEAGVKMEFYEDNDEVISIWRPRPEYQGWIDTLHGGIQAVLLDEICAWVILRKLQTTGVTSKMETRYRKSISTNDSHVVLKAHIKEVKRNIVIIEARLYNKDEELCTEALCTYFTFPKEKAREEMHFLSCEVEDEEILPLI

SEQ ID NO: 5967 - protein, 338 aa, B.fragilis
PIFIMKKIILSSVLLLSGFFIQAQQAPEKISFNSNGEFKIAQFTDMHLGHDQEKDRIVGDMIKEVLDSEKPDLVIFTGDNTTMDEVRQAWEAISAELSARRIPWTAVLGNHDDEYAVKRDEIIRIIREQPYCMMKQVAEGIKGEGNHILPIYSSKDGNKTAALLYCLDTNAYSKIKTVKGYDWIGRSQIDWYSRESRKYTERNEGQPLPALTFLHIPLPEYTQAWESFETKRYGDRNEKECSPHINSGMFANMLECGDVMGVFAGHDHVNDYIATLYNIALGYGRASGGKNTYGDKTPGSRIIVLKEGKREFDTWLREKGNMAKLNVCTYPGSFVKEK

SEQ ID NO: 5968 - protein, 1054 aa, B.fragilis
LVLMNSKFLLLLCSMLLCTSLAFAQSVKVTGTVTDKMGAVIGATIMVKNSSNGTVTDIDGRYSIEVPKNATLLFSFVGYSTVEKEVGNNTVINVELSDDIQAIDEVVVTAIGIKQQKKKIGYTTQQINSEVLNATPSLNVGSALSGQVAGLLVANPTGIFQAPSFKLRGNAPLVVLDGVPVETDFFDISSENIESVNVLKGTAASALYGSRGKNGAILITSKTAKKEGLEINFSTNNMITAGFAVLPETQHQYGSGSNGKYEFWDGADGGISDGDMTWGPKLNVGTKVAQWNSPIRDKVTGKEIPWWGDVKGTQYDDKSRYERIPIDWVSHDNLKDFLQTGLVTNNNISIAYKGEKARYFVTGQYAYQKGQVPSTEMHSGGINFNSTFDLAKNLQLDANLAYNKIVAPSYPRYGYGPKNHMYTIVVWMGDDVNGKELQKHKYVPGQEGYRQASYNYAWYNNPYFAAEELQQSESRDVVNGQVRLNYQILPNLNIQGRAALRQKTILQEMKVPKTYMNYGDSREGDYKVWNDRQTNVDADVLATYTQDLTPDILFTLNAGTSVFYRNYRQEYQSTDGLIVPFVYSIKNTQGPSITDANRNEKSIRSIYGSINLDLYKYAYLTLTGRNDWSSTLAKGSNSYFYPSVALSTMVSEYIKLPTFMDYLKMYGSWAVVSTDLSPYQIMSTYTKDSNYGSNPSISYPSSLVNYYIKPQKTTSWEAGLSTAFFRNRLSFDLTYYHTIDENQIIDLNISNASGFTSRKVNGNQYTTNGWEIMANVQAIKNKDFQWDFSLNWSKSVKKLTEIYGGQKKFGDLKVGDRADAFYGSQWQKSADGELILDENGMPTKDAYKQYLGHLDPNFRMGMQNTFRYKDFTLSVDLDGAYKGVIYSVLSEKLWWGGKHPESVEYRDAQYAVGHPIYVPNGVVVTGGELKRDIDGNVISDTRTYKRNTTAVDWQQWCQNYPYQAYVSSKENAKFANVFDRSYIKLRRVALTYNFTKLLSKQSPVKGLTATVFGNNLAVWKKVPFVDPDYTGDSNDGGANDPTARYIGMGVNIKF

SEQ ID NO: 5969 - protein, 416 aa, B.fragilis
PYIIEMSTYAPFAKPLYVMLKPVGAVCNLACDYCYYLEKSRLYQENPKHVMSDELLEKFIEQYINSQTMPQVLFTWHGGETLMRPLSFYKKAMELQKKYARGRSIDNCIQTNGTLLTDEWCEFFRENNWLVGVSIDGPQEFHDEYRKNKLGKPSFVKVTNGINLLKKHGVEWNAMAVVNDFNADYPLDFYHFFKELGCHYIQFAPIVERIFPHQDGRHLASLAQREGGELAEFSVTPEQWGNFLCTLFDEWVKEDVGDYYIQLFDSTLANWVGEQPGVCSMAKTCGHAGVMEFNGDVYSCDHFVFPEFKLGNIYNQTLVEMMYSERQTAFGQMKQKSLPTQCKECEFLFACNGECPKNRFCRTANGEPGLNYLCKGYHQFFKHVAPYMDFMKNELMNQRPPANVMDAIKENKLIID

SEQ ID NO: 5970 - protein, 204 aa, B.fragilis
KEIMVIKKAVYVWVIGILGMISFAACSSASQGEVPSTSNAALDNIFARKSVRAYLDKEVEKEKIDWMLRAGMAAPSGKDIRPWEFVLVTDRVALDSMAAALPYAKMLTQARYAIVVCGDVAQSSYWYLDCSAAAQNILLAAEAQGLGAVWTAAYPYEDRIRVVRKYTELPGNIVPLCVIPFGYPATAQEPKQKFDEKKIHYDKF

SEQ ID NO: 5971 - protein, 282 aa, B.fragilis
KVTIMTANEVHLIYFSPTHTSKQVGEAIVRGTGITNVINTNLTQQATQDLVIAESALAIIVVPVYGGRVAPLAMDRLASVRGSNTPAVIVVVYGNRAYEKSLMELDYWAIQQGFKVIAGATFIGEHSYSTEKYPVAAGRPDERDLAVAADFGKQISDKIASATEPEKLYAVDVRKIRRPRQPFFPLFRFLRKVIALRKSGVPLPRTPWVEDESLCTHCGTCAKMCPVSAIAKGDELNTDAERCIKCCACVKGCPQKARVYDTPFAVLLSQCFVKQKDPCTLV

SEQ ID NO: 5972 - protein, 301 aa, B.fragilis
NVYIYMKKEVWIKLVKRIGNWIVNICFYSCVAFVAWMVLQVFCLTSFKIPSNSMEPALLSGDKILVDKWTGGARLFNIFASLRGEEVDIYRLPGFGSFQRDDVLVFNFPYQDGSDSIGFDIMKYYVKRCIALPGDTLEIRKGYYHIKGITDSVGNVQAQHRIARVRREDSHGIVMDAFPWDGRLGWTIQEFGPLPVPAKGQVVKIDTLSCLLYGRLIHWEQKKRLRQKGEAVCLGDSAITEYKFTENYYFVSGDNMENSKDSRYWGMLPESYIVGRAFTIWRSDDPLRGKIRWNRVFKRIK

SEQ ID NO: 5973 - protein, 426 aa, B.fragilis
  UNSURE (175),(416),(423),(424): Identity of amino acid sequences at the above locations are unknown.
FKDMFDNLSERLERSFKILKGEGKITEINVAETLKDVRKALLDADVNYKVAKGFTDTVKEKALGQNVLTAVKPSQLMVKIVHDELTQLMGGETVEIDTKGQPAVILMSGLQGSGKTTFSGKLARMLKTKKNKRPLLVACDVYRPAAIEQLRVLAEQIDVPMYSEIDSKDPVSIAXNAIKEARAKGYDLVIVDTAGRLAVDEQMMNEIAAIKEAIQPNEILFVVDSMTGQDAVNTAKEFNERLDFDGVVLTKLDGDTRGGAALSIRSVVNKPIKFVGTGEKLDAIDQFHPARMADRILGMGDIVSLVERAQEQYDEEEAKRLQKKIAKNQFDFNDFLSQMSQIKKMGNLKELASMIPGVGKAIKDIDIDDNAFKSIEAIIYSMTPEERSNPGILNGSRRTRIAKGSGTTSLHRGFQXRSIGISXXDH

SEQ ID NO: 5974 - protein, 216 aa, B.fragilis
KRYIIMKKLQFLVCFLLLSVASYAAERTIQLPKPDMNRAGLLMKALSERHSTREYASKALSNTDLSDLLWAANGINRSSEGKRTAPSAMNRQDIDIYVVLPQGTYLYDAKGHKLNLISEGDHRSAVAGGQAFVNNAPVSLVLVSDLSKLGDAKSNHVQLMGAMDAGIVSQNISLFCSAARLATVPRASMDLVRLKAALKLKDTQMPMMNHPVGYFK

SEQ ID NO: 5975 - protein, 199 aa, B.fragilis
RNLIRTYYCHKKRHTKAILYARFLFNQKNIRILFAKIKRTLYLCIRFKMVMNTFLERRKKMESYNRLLEHNIKPSMQRIAIMNYLMEHKTHPSADEIYTELSSSMPTLSKTTVYNTLRLFSEQGAAQMLTIDERNTNFDADTSQHAHFLCKRCGRIYDLKCQVEMKQVEGLQMDGHEVSEVHYYYKGVCKKCLNNIRID

SEQ ID NO: 5976 - protein, 340 aa, B.fragilis
TKLMKQINAVITGVGGYVPDYILTNDEISRIVDTTDEWIMGRIGIKERRILNEEGLGTSYMARKAVKQLMQRTQSNPDDIDLVIVATTTPDYRLPSTASILCERVGLKNAFAFDMQAVCSGFLYALETGANFIRSGKYKKVIIVGADKMSSVIDYTDRATCPIFADGAAAFLLEPTTDHLGVIDSVLRTDGKGLPFLHMKAGGSVCSPSYFTVDNHMHYLHQEGRTVFKYAVANMSDACESIIERNQLTKDEIDWVVPHQANQRIISAVAQRLDVPLEKVMINIEHYGNTSAGTLPLCIWDFENKLKKGDNLIFTAFGAGFAWGAVYVKWGYDGKTNNAC

SEQ ID NO: 5977 - protein, 287 aa, B.fragilis
DIVIMLRIAVQAKGRLFEETMALLEESDIKLSTTKRTLLVQSSNFPVEVLFLRDDDIPQSVATGVADLGIVGENEFVERQEDAEIIKRLGFSKCRLSLAMPKDIEYPGLSWFNGKKIATSYPGILDAFMKSNGVKAEVHVITGSVEVAPGIGLADAIFDIVSSGSTLVSNRLKEVEVVMRSEALLIGNKNMSKEKKEILDELLFRMDAVKTAEDKKYVLMNAPKDKLEDIIAVLPGMKSPTVMPLAQDGWCSVHTVLDEKRFWEIIGKLKALGAEGILVLPIEKMII

SEQ ID NO: 5978 - protein, 153 aa, B.fragilis
ENKMKLAPINIKNKRATFDYELIDTYTAGIVLTGTEIKSIRLGKASLVDTFCYFAKGELWVKNMHIAEYFYGSYNNHAARRDRKLLLSKKELNKLERGTKDAGFTIVPVRLFINERGLAKVVVALAKGKKQYDKREALKEKDDRRDMDRMFKR

SEQ ID NO: 5979 - protein, 158 aa, B.fragilis
KQRMKKVLSLVALAMISTIMFAVNDGVKADQNKKEAKSGEVIVMNKEMFINDVFDYQNSKEWKYKGDKPAIIDLYADWCGPCRMTAPIMKSLAKEYDGKIVIYKVNVDKEKELAALFNATSIPLFVFIPMEGEPQLFRGAADKATYKKAIDEFLLKQK

SEQ ID NO: 5980 - protein, 192 aa, B.fragilis
FTPIMKWMILIFLNFLFCAQLVGQVSRPDRNLLRGETYVIEVPKGWKRPSAVHSCNDEPLKRVNGKYETTKFMRVYSKRKDRCGAVLTIMEIQKCASFQEIFKEDSIWASTDTTQVKVIYKSVNSKNGVKKMAFTSYKAERHPETNELSALQKAEWYLQGRENVYYISFTSCSLFLELLPQIKDIVASLKEL

SEQ ID NO: 5981 - protein, 485 aa, B.fragilis
MHWIMENGVMMQYFEWNLPNDGNLWKQLKEDASHLHEIGVTAVWIPPAYKADEQQDEGYATYDLYDLGEFDQKGTVRTKYGTKEELKEMIDELHKNHISVYLDVVLNHKAGGDFTEKFIVVEVDPNDRTQALGKPFEIQGWTGYSFHGRKDKYSDFKWHWYHFSGTGFDDAKKRSGIFQIQGEGKAWSEGVDNENGNYDFLLCNDIDLDHPEVVTELNRWGKWVSKELNLDGMRLDAIKHMKDKFIAQFLDAVRSERGDKFYAVGEYWNGDLNTLDAYIKSVGHKVNLFDVPLHYNLFQASQEGKNYDLQNILKNTLVEHYCDLAVTFVDNHDSQSGSSLESQIEDWFKPLAYGLILLMKDGYPCLFYGDYYGVKGENSPHTQIINILLDTRRKYAYGDQIEYFDHPSAIGFIRTGDEEHVGSGLVFLMSNDEAGSKKMDLGEEHKGEIWHEITGNIQQEITLDEKGSGEFSVNTRNIAVWIKKN

SEQ ID NO: 5982 - protein, 158 aa, B.fragilis
MHNFCFFRYAKIPFPDYRRMNVRLLYDEQNRDFSVIIIKQITIFAPCKRGLYIYQKKGKIMEKFEDLIQSQSPVLVDFFAEWCGPCKAMKPILEDLKQQVGEKARIVKIDVDTHEELAVKYRIQAVPTFILFKKGEAVWRHSGMIQASELKGVIEQYT

SEQ ID NO: 5983 - protein, 337 aa, B.fragilis
IMNVRCFLWGILFITVSSCIESDRIMHYAQFEHTINLKSDRIQVPSVLLYPRSLVLCDSNLIVFNEKMDTMFQCFHLPDLTFQYGFGTQGQGPNDFVLPSITPVKYQKNGFVMLDGINLKHISVKKDKAIVQTSTLNYGFNCFNDLISISDSSYCCNGGFENEKEFRFLYPDGNHESWGEYPETEERFGSVLDRNQAYIKMTVAKPDKSCFVSFYQHIRRFRIYGKDGELKRDVILDILPGQERPEVDDYLRFIHPISVYATDSYIYTLNLDMTTEEIENRKTTPNIQVFDWEGKPLTQYKLDCFINTFVVDEVANKIYGAFVEDEDHIYVFNLPRL

SEQ ID NO: 5984 - protein, 349 aa, B.fragilis
KGCVSCNICDTSFCNFIKVMHKIILYIISVLTVFTSCTTTDVPDKVSLQPQVMNDSLLTTMPGDLLLIDDYLVWSDPFSDNKFLHVHRSSDGKYIGSMGQKGEGPQEFVSPLINRFSINRCIAAHDANGKTRGYLSIDSLIVGKEPFMSLSDFDRNIRMAKLDEQLYLTETENGENDYFKVSSNGKKSTFGVYPIREVKHHMGTYKTYDKDRGLLAFGPFNFSYLALYKKEGDNFKLLWERMPEKENYSVVDGAIRFDRSVMGVRDICMTKDYIVTLERDREVDPLDERTVGRNASKCPRTVFVYDYDGKLLKIVNLGMPVMRIAADGRSNALYVIGVNPDFALAKYDL

SEQ ID NO: 5985 - protein, 598 aa, B.fragilis
VFFVFLRKNLMKMNTHSLFGYLFIALFSLLVVSCYSTPDGVMSSLSQAEKIMESRPDSAMAILQHIPTPETLHGKAQADYSLLMTQAMDKNYINFTSDSLIKFAVGYYGGHTEDLVAKGKSFYYYGRVMESLDKVEDAMTFYLKAKDVLQSSDQFKLLGLISEGIGTLNRKQKLFDTALNSYKESLTYYSLVPDSLCMTYANRNIGRVFLYKNRLDSAYYYYDKAIYISNANKYVAVGSLLLELGVIHRSEKDYIGAERYFLTFLEKEKTPNKLYSGYLALGNLYLYMNRFEDAEHFLMLCLDSPDPVVKRDACECLYDLEKESNKFKEAVIYKDIADSLRMMTQDIDTQNAIADLQGRYNNEKWQRESLQSSIEKKNILLISSFVGFIAVMVIIYIYYKYRTNQKLVKDINERIRKNDVDIKMYQRQILNYQDLQKETLQDYRNQIGELHGKMSVLEDQNKALSLRLTEKKHDIPESEADDLYAIYMQALHILIMLRGKNIENTSGQKLLLDADWDKLFHLSNAIHGDFITRIKNDFPTLTKHDIEICCLLRFGIEHEVLGSIFLTETDSVTKAKRRMKKRLNLSASDDLDVFLLKY

SEQ ID NO: 5986 - protein, 103 aa, B.fragilis
NNNVMVKHIVLFKLRDDVPVEEKLVVMNSFKEAIEALPAKISVIRKIEVGLNMNPGETWNIALYSEFDNLDDVKFYATHPEHVAAGKILAETKESRACVDYEF

SEQ ID NO: 5987 - protein, 70 aa, B.fragilis
RNVFGRGFYIGQEFIAYQMLKLRKNFIDNQKRQGTPFERKCTLSFYYSSTISSSLMMCEAPAYLSIINRV

SEQ ID NO: 5988 - protein, 287 aa, B.fragilis
VSAFTYCELEFISLQTLKNRFMKQLKLMVLTLTLLMGTMFTSCMDSGESGPQQWAGVVKVNDRMGYVTFTDAAGTELIPTNTIPVTLNARMAYIYCQVDEGQDLSTNPKSIKITLLADPTGIDATAITTPKVESSDVTTNAPVGSLSFASGYSTVAPFQFSENTIVLPVLYRVKNVTTTEDIKNELAKHTFTLVCYTDDIKSGDTILKLYLRYKVEDEPAAIAERATRTSSFKAYEISQILREYTLKSGQTKPAKITIVAQQNEYNNKLEDTSTIEKVYEIEYKTAE

SEQ ID NO: 5989 - protein, 130 aa, B.fragilis
NMKLRVILSLIVVLFIGQSMCAMSTQILRRPIILDGEIIEEEASRSINPLIPISADIDGTTLFIEFTKVIGNVDITVKDDTKKEVYSSSVDVTAANQATSFSIADLAPGTYLLEFTNSNGGYVYGQFIVE

SEQ ID NO: 5990 - protein, 237 aa, B.fragilis
MMASMLLKALSSISISLMALPTPGIIEASSFRLPIFLIWDIWLRKSLKSNWFLAIFFWRRLASSSSYCSCARSTNETMSPIPRIRSAIRAGWNWSMASSFSPVPTNLIGLFTTERIERAAPPRVSPSSLVSTTPSKSRRSLNSLAVLTASCPVIESTTNRISLGWMASLMAAISFIICSSTARRPAVSTITRSYPLARASLMAFMAMETGSLLSISEYIGTSICSANTRSCSIAAGR

SEQ ID NO: 5991 - protein, 78 aa, B.fragilis
CGFPGVFFLLAKKKCFVFKRLVLCKQNTCFNTLLNQAFYILKVKSFKLLIQSGSLLFLVFLLSCLSGCDDRWYLSKPQ

SEQ ID NO: 5992 - protein, 382 aa, B.fragilis
YSSLNKRIMIKRIKILATGALLLAGLGACSPSGKKTGADSTVDTLRTAETVNLLNNLRKVPTQGIMFGHHDDPLYGVGWEGDEDRSDVKSVCGDYPAVMSFDLGHIELEREKSLDNVPFRKIRQETINQYKRGGVVSFSWHLDNPLTGKDAWDVSDTTVVASILPGGVHHAKFISWLDAVAAFMNTLETEEGTKIPVIFRPWHEHTGSWFWWGQNLCTADQYKALWRMTHDRMHARGVKNLLYAYSPGSEPKDSTAYLERYPGDDIIDLVGFDTYQFDRTQYMEQLDKSLAILTEVGKAHDKPIAITETGFEAIPDSVWWTQTLYPVISKYPISYVLVWRNARERVNHYYAPYPGQVSADDFVKFYREPKTLFVSDVKNLYK

SEQ ID NO: 5993 - protein, 519 aa, B.fragilis
SQRPLATIVDRPDHLSDSPVCRRRMSVQYVCTHPCGRRAKTAPLADFYLPADLRNPFPRNSIFYRRFLNKQVMTKKNLLKGICLLWLLLAVTPVLQAQDRAQQASELLDRLIAGQGDSVYVHLDDNIRKMLSVEMLNGLFKQLEQQAGKYQSHGEWNTEPINGMTIYYCDVKFERLPLRFLTAFNPDGKVNTIRFVPVPAEKTTPPTTSVQDKIKETDIQVCTGNFKLPGTLTLPKNGKDLPVVILVHGSGASDRDETVGANKPFRDLAYGLAERGIAVIRYDKRTKVYGADSAPAGKEITFDEESVDDALSAIKLARSIPTINPERIYILGHSLGGTLAPRIAQRSDKVPAGIILLAGAARPLEDLFISQVKFLASALPSAKDIEKEIAELQKQVDNVKRLGTDTFDITTPLPMNLSQAYWMLANQYKPLEVVRKLTLPILVLQGERDYQVTMQDFELWQSALAKHPNAIFKSYPRLNHLFQEGEGKSTPLEYSRPSSIPSYVTDDIAAFINRPKPGN

SEQ ID NO: 5994 - protein, 522 aa, B.fragilis
YIITMNKKIIIPLALAPLAAPALQAQHQQPNGRTDTRPNIILFMVDDMGWQDTSLPFWTQKTHYNEVYETPNMERLAKQGMMFTQAYASSISSPTRCSLITGTNAARHRVTNWTYPKGQQTDRPSDVFNVADWNVNGVCQVPNIDHTFQATSLAEILKDNGYHTIHCGKAHFGAVNTPGESPYHMGFEVNIAGHAGGGLASYLGENNYGNRTDGKPNPWFAVPGLEKYWGTDTFVSEALTLEAIKALDHAKEYNQPFFLYMAHYAIHVPIDKDKRFYQKYINKGLTPKEAAYAALIEGMDKSLGDLMDWLDKNGEADNTIVIFMSDNGGLSSEPEWRDGKLHTQNSPLNSGKGSAYEGGVREPMIVRWPGVVKPDTKCDKYLIIEDFYPTILEMAQIKHYKTVQPIDGISFMPLLTHTGDPSKGRSLHWNFPNHWGNDGPGIGPTCTVRKGDWKLIYYYDSGKKELFNIPEDIGEKNDLAALHPDIVKSLSKELGDYLRKVGGQRPSFKATGKPCPWPDEIK

SEQ ID NO: 5995 - protein, 106 aa, B.fragilis
KRITNGCSCGKLHGYPFLIPQYAIEPQFAITMKIIIAGAGAVGTHLAKLLSREKQDIILMDDDEEKLSTFSSNFDLMTVTASPSSISGLKEVGIKEADLFISGHSR

SEQ ID NO: 5996 - protein, 469 aa, B.fragilis
NKKTKNRMTAMITLKEKIGYGLGDMASSMFWKLFGSYLMIFYTDVFGLPAAVVGTMFLITRVWDSAFDPIVGVIADRTQTRWGKFRPYLLYLAVPFALIGIFTFTTPELNDTGKLVYAYITYSLMMMVYSAINVPYASLLGVISPDPKERNTLSTYRMTFAYIGSFIALLLFMPMVNLFGGAEDEQRGWMLSVVVIAVMCAALFYLCFALTRERVKPIREVQNSLKDDLKDLLHNRPWWILLGAGVAALVFNSIRDGATVYYFKYFVVEEDYSTVSFFGVSFVLSGLYLAVGQAANIVGVILAAPVSNRIGKKNTYMGAMSLATLLSVIFYWFGKGDITLIFVFQVLISICAGSIFPLLWSMYADCADYSELKTGNRATGLIFSSSSMSQKFGWAIGSALTGWLLAYFGFRANEVQSVEAIHGIKMFLSWLPAVGTVLSVVFISMYPLSEKKMREVTSELEKRRKAIQS

SEQ ID NO: 5997 - protein, 664 aa, B.fragilis
KARTMKKNLLYIFSLASVLCSCNDFLDKEPLDAVPTDKYLLAESDLAAYSANLYDQLPSHTPGQYSMGVFATDNNSDNQAASNPNGSFVKGETRVAQSGGAWDFGKIRNVNYFINKVRPRLEAGELSGVEANNMHYLGEMYFFRAYIYFTKLVALGDFPILKHWISEDYETVREASKRRPRNEVARFIIQDLDSAYYYMKATPPMSNRLTKDCAALMKSRVALFEGTWEKYHKGTARVPGGPGWPGANKDYLKDFTINIDSEIKYFLTEAKTAAQIVADKYTLFNDYPSLFNSQSLANASEVLLWRAYDASLTPAVNHFVVGYIQRNGGGNTGWTRSMMQSYLMENGLPIYANNSGYQGDKTYEAVATNRDPRLIYNTLLPGDLLSEGGSNIEYLVKGYGYYYRAPIVLGQDENKCPTGYSVKKGLATDAAQGPTLPSTTACVIFRAAEAYLNYMEADYELNNSLDANSSKYWKALRNRAGMDTDFQKTIDATDLSKEIDFARYSGSEFVSTTLYNIRRERRIEFAAEGLRLNDLKRWRALDMMQGYHVEGFDLWSENYQRYKTPSPIPVADVTLSVINLIESGNNNANVSAKSESRYLRPYRINTNNIAYNGYNWNQNKYLNPIAFDHFRLTTAEEGSTDYTTSTIYQNPGWKIETSSLPEGD

SEQ ID NO: 5998 - protein, 216 aa, B.fragilis
MIKAMNNLNELYEAILAGKLEQAVSVTREAVAGGAAPQEIINEYMIKAMEAIGARFESGQVFVPNLLMSARAMRGALDILKPLMQGQVNSYIGRIVIGTVKGDLHDIGKNLVASMFEGCGFEVINLGVDVSSDKFISAALENKADIICMSALLTTTMNYMKEVIDALETSGLRGKVKVMVGGAPVSDAFAKSIGADAYTSNANAAVIMAKKLINAC

SEQ ID NO: 5999 - protein, 637 aa, B.fragilis
IMEYTILILLLPFLSFLALGIGGKWMSHRTAGTIGTLVLAAVTVLSYVTAVHYFSAPRLADGTFATLIPYNFEWLPFTETLTFNLGILLDPISVMMLIVISTVSLMVHIYSFGYMKGERGFQRYYAFLSLFTMSMLGLVVATNIFQMYLFWELVGVSSYLLIGFYYTRPAAIAASKKAFIVTRFADLGFLIGILIYGYYGGTFGFTPDTVSMLSGGAGMLPLALGLMFVGGAGKSAMFPLHIWLPDAMEGPTPVSALIHAATMVVAGVYLVARMFPLFIEYAPDVLHLIGWVGAFTAFYAASVACVQSDIKRVLAFSTISQIGFMIVALGVCTSSDPHHGGLGYMAGMFHLFTHAMFKALLFLGAGSIIHAVHSNEMSAMGGLRKYMPITHITFLIACLAIAGIPPFSGFFSKDEILAACFQYSPTMGWVMTVIAAMTAFYMFRLYYGIFWGGTAPGQKSTSDGTSHVHTPHESPLTMTVPLIFLAAVTCVAGFIPFGHFISSNGESYTIHLETSVAVTSVVIAVASIVLATCMYLRQQQPLADKLAKRFAGLHRAAYHRFYIDEVYQFITHRIIFRCISTPIAWFDRHVVDGFFNFIAWGTHATSDEIRGLQSGRVQQYAYVFLLGALILILILIL

SEQ ID NO: 6000 - protein, 439 aa, B.fragilis
IKYLMIMKILSTILLTLLIVFGACTSPQVSPDPFVRVSNGRLTVNGNPYYYIGTNFWYGAILGSQGQGGNRERLLRELDYLKALGINNLRVLVGADGKDGIPTKAEPALQVEAGVYNDTIFDGLDFFLSEVDKRDMYAVLFLNNSWEWSGGYSQYLYWAGHGEVPMPNVAGWDAFSNYVAQYAKSEKAHHLFRDHITHVVNRVNRYTGKKYSEDPAIMSWQIGNEPRSFGEDNKKSFAAWIADCAALIKSMDSNHLVSIGSEGMAGCEGDLSLWTSIHADANVDYTTIHIWPNNWGWIDKKDIPGTIGQAIENTCSYIDMHVQEAFKINKPLVLEEFGLPRDSVKFTSNTSTVQRDRYYRAVFDIVEKHAAEKGVFQGCNFWAWGGFAEPQHLFWQRGDDYMGDPGQEEQGLNSVYATDSTINMIKEAVSDINQIIQKQ

SEQ ID NO: 6001 - protein, 396 aa, B.fragilis
FRHHMDEILKQEMQKELTTRILPYWMERMVDQENGGFYGRITGQEELIPRADKGAILNARILWTYSAAYRLLGREEYKEMANRAKRYLIDHFYDSEFGGVYWSLNYRGEPLDTKKQIYAIGFAIYGLSEFHRATGDPEALMYAVRLFNDIESHSFDGLKNGYCEALTREWNEIADMRLSEKDANERKTMNTHLHILEPYTNLYRVWKDARLERQLYNLIGLFTEKILDKDTSHLQLFFDNDWQSKYPVVSYGHDIEASWLLHEAARVLGDAGLIAEIEPVVKKIAAAASEGLTSDGGMIYEKNLTTGHIDGDYHWWVQAETVVGYYNLFRYFGDRGALQHSIDCWEFIKRHLTDDVHGEWFWSLRADGSLNRDDDKAGFWKCPYHNGRMCIELLGE

SEQ ID NO: 6002 - protein, 602 aa, B.fragilis
  UNSURE (380): Identity of amino acid sequences at the above locations are unknown.
IVFQTFCTFGHNLPNMKNKHVKRINLLLSILLGAGVFIFFGVYYSYHLHYQEQFQMFLFTSDYFVEQVSHPGGMADYLGGFLTQFYYYSWAGAAILTGAIGGIHRLMVWIANRLGGHPAWYPLTLLPSLCFFILFCDENFLLSGAISVGMVLGALIGYTFIENRQIRLIYWGVGIPLLYLLAGGCAWLFIPLIWITEFCRFAGRRLPWWILVGGTLGIAGVTYWISLAVFPYPADRLLWAIGSYRFPLVFPQMQVIAWLAVILVPLLVARLPEKMTWRYYSGAWVLQFILMLFVLNLYGKYGIGLNKEEVMGYDYHVRMQEWDEVIAMAEKKAPDTPMSVSCLNLALAMKGQLRERMFSFYQRGKEGLLMSFVNDFTILXVAGEPYYYLGLVNVAQQFVFEAMEAVPDYRKSVRCFKRLAETNLINGRYEVARKYLRILQHTLFYKDWATETLACLNDEDRVNAHPEYGRLRRLTPRTDFFFNPDLPEMTLEFLLHANPRNRMAYEYLMACTLLKKDVGRFVHYYPLGADLGYSSVPKGYQEALLFYWLMSKHTATDTIPWKIDPQTENRLREYAQIFTSARSADALSARFGDTYWFYADFR

SEQ ID NO: 6003 - protein, 258 aa, B.fragilis
IYLQEKFHVAYNRGNVMTFCRHYYNPVTGGNFYDTTQVVRHILPGGSYHATFKADLKIIADFAHNAKGDDAELIPIIFRPWHEFDGNWFWWAKNHCSVEEFKKLYRFTVTYLRDSLEVHNFLYAFSPDCGFTTEAEYLKRYPGDKYVDVVGMDNYWDFRPYGGDTSLVVLKARILTQYAQKHGNLSAITESGTQTRDSLWYTQLLSILRSEGVALNYVCTWSGFSPYKGHPAAADFCRFKRDTLVLFADEIPNFYTWH

SEQ ID NO: 6004 - protein, 398 aa, B.fragilis
STGQSCWPGALPVFQTMDRYRLKIIALTALVCLTGSSCTDDENNGQGNNIIYGENIIGNGEQTFEIKDHQYLKRGTYLMKGWCYVTYGSTLTIEAGTVIKGDKETRAALIVEPGGKLIARGTVDAPIVFTSEMPAGKRKPGDWGGLILCGYARNNEDIMQIEGGPRTMHGGPNNADNSGVLSYVRVEFAGYPFKKNQEINGITFGSVGNGTQIDHLQVSYANDDAFEWFGGTVHAEYLVAYHCWDDDFDIDNGYSGTCRHLLGIRHPRIADITGSHAFECSNNGTNTPATPTTAATFEDVTIYGPASGDASFVNHPDFINGGGLRPENESMLGLFGAALYMGNNTSVTFRNCRISGYPSDMEGTPASADNVVFSEREETGYPEWTQGWCNFNPQETEY

SEQ ID NO: 6005 - protein, 377 aa, B.fragilis
KMSKNMEYRKHRIEYLRTTVEYSLFGGEGGTREAHLMFHVDPEAGSYEEQLTAIRKAYHRILSRKVKIRGMVPVFCRYFLSDAANQWEALQAVLQKEPSCAVSVVQQPPLDGSKIALWVYLTSEPNAAYKHYWTAGAGVSCGKSERQMKTLLKSYEADLVGKGCTLASDCIRTWIFVQNVDVNYAGIVKARRENFLGQGLTESTHYVASTGIEGRHADPKIHVLFDAYAVKGLQPGQVTYLHALSHLSPTALYGVTFERGTSVEYGDRRHLFISGTASIDHRGEVVHVGDVREQTRRMWENVEKLLEEGKAGFEDVAQMIVYLRDASDYPVVRALFAKRFPDTPIQFVVAAVCRPAWLIEMECIAIVANSNSSYESF

SEQ ID NO: 6006 - protein, 398 aa, B.fragilis
ITIKTLSIMSLFNDKVAKLLAGHEALLMRKNEPVEEGNGVITRYRYPVLTAAHTPVFWRYDLNEETNPFLMERIGMNATLNAGAIKWDGKYLMLVRVEGADRKSFFAVAESPNGIDNFRFWEYPVTLPEDVVPATNVYDMRLTAHEDGWIYGIFCAERHDDNAPIGDLSSATATAGIARTKDLKNWERLPDLKTKSQQRNVVLHPEFVDGKYALYTRPQDGFIDTGSGGGIGWALIDDITHAEVGEEKIIDKRYYHTIKEVKNGEGPHPIKTPQGWLHLAHGVRNCAAGLRYVLYMYMTSLDDPTRLIASPAGYFMAPVGEERIGDVSNVLFSNGWIADDDGKVFIYYASSDTRMHVATSTIERLVDYCLHTPQDGFSSSASVEILKNLIERNLRLMK

SEQ ID NO: 6007 - protein, 140 aa, B.fragilis
GIKNHSNRLLMKRIGIYIVIVVCILSCISSRRNLLTETRLMLVDTRATEHTAALFYNLRQLTGKRVVYGQHNYEMDGFDSDSTRWEDEANRCDAYDVTGAYPALASFEFLHFTNPRSWGNKRIEFTYRKNSMLHIIGEML

SEQ ID NO: 6008 - protein, 160 aa, B.fragilis
KMKNEEYTYLGGLMQGIGSLLTGMKTTIKVYFRKKVTEQYPENRAELKMFDRFRGTLNMPHNENNEHRCVACGLCQMACPNDTIKVTSETIETEEGKKKKILAKYEYDLGSCIFCQLCVNACPHDAITFDQVFEHAVFDRTKLVLQLNREGSKVIEKKKE

SEQ ID NO: 6009 - protein, 1075 aa, B.fragilis
NKRKMKRMAYHLLAILIWGMAASAVKAQILLTASATPIEEYAAVELQRYYYQLSGRLLSIDHEEVPDRKTEFVLTRLDHPLVKSWRDKGVLPLKSMPGEQGYVIRTVKEKGRELVVIAGVDANGLLYGVYGLLEDHLGMRFYMNGDVYPDKKEVQTRIPLIQDERTPTVAIRGFLPWTNFPQSATIYSWDDWRYIIDQAARMRMNFIMIHNYNGFCGHNELFHNFEYKGHLSRGWMPTIKTGHGWGCPGWNINEYLFGASEVYDDYDFGADYGLHNETLTNGQIKEKGATIFRKVIAYAHLRGVKIGLGLDIDVVLPEYQSEPDNKDLIKVQVAEIAREYPELDYLLCFQSEGQKNEAFYARWRRVFDGFYEEMKRKSPSTHIAVSGWGLTAESVNSLPEDVICAPISYYSAAFEPGSVYGNREYWGCPWLERDFNSSEYYYPYNVDLSETIRAFGDASANMNGFYALTWRLADAISPKMWYISKAPWYNHEVLDSSEKVYRDFALANYGENAVDAITDIIDQNEPFATDFGECQETPGFNQMVHTYPLMNLYSMTFGGKNGKDVEIKATVYAEKKGTKNAPCDEGGECVGYIMADDWLQYPAVDFSNSPERMSIRIASASSGGVATVYLDRLGGPVIARFEVKNTEGWQSWKSLTVPVKGLKGVHTLYVRFQPFNVIAKAGKLADKQLKTIDSCMAVTSDVLQQLRLSRLRARIQGAACHIALNTDFENYQWNDLPGKMDEWARSFLYRIEDISSYGNIMSTQNRFVKQNYVEKINQLRKQQRVQAPSHIIAKGTLEGAQISWRNEEPAVSSFVVCRNGEEIDTLASDVNCYQDKFHGAASYTVYAVDIEGHKSPLGIPADCLAGSADREAPVIVINSPLTSIMEGTPLHIRFSVVENRLPEFVSGIFHYRRTGEKVWKKIPFKHRTRGVFTLTLPASEITRQGIEYYISVSDSDNVFCYPGSAPARNHTVVVTEVPGDDKPEVPMIKPICGKRMFWSRVPNVEMYRIYRSRTPDFKIGADTFVTFVAGNTQSFADNGFDFDGTSLKGTYYYCVTSVSFWDHESEASKIIQIDY

SEQ ID NO: 6010 - protein, 426 aa, B.fragilis
NSMNMKTNYLKLNSWAVAALMGMCSLAACSDDNSGEGGGNGDSEEVIANNGTLKGSVDGSKTVILTKGYNFSLDGEYIVKAGSTLKIGEGVTISAKSDDATIDYILVEQGAKIEAVGTASAPIVMTADTKEPGAWGGIHICGKAPINIGSTGKSEVGDAAYGGSDPADNSGILKYIRLEYAGYKFTTEKECNGFTFYGVGNGTTLEYLEAYKGTDDGFEWFGGTVNAKYLVSVSNSDDSFDWTEGWSGKGQFFVAYQEDPATLGYTCDCLIEADNYDKNMDAAPISCPTLANLTLIGANNDEGKRGIRLRAGTQAKIYNALVTGKANNLTTETEQTEKFLIDGPSVLNYIAIARDIKASGDGGYSSALFTAEGNHNAINQTLSFSNIFIGTQDGGADLSADSFFEKAAYKGAVKADNEWTKGWTKL

SEQ ID NO: 6011 - protein, 405 aa, B.fragilis
IIMNRINTTLLLLFCSVYCLAQQATIPVPKPFQLKWHQAEMGAVFHYDLHVFDGVRYGQGNNRINPIEDYNIFNPTELNTDQWVLAAKAAGCKFAVLTATHETGFGLWQSDVNPYCLKAVKWRDGKGDIVRDFVNSCRKYGLQPGIYIGIRWNSLLGIHNFKAEGEGEFAHNRQAWYKRLCEKMVTELCTRYGDLYMIWFDGGADDPRGDGPDVEPIVNKYQPNCLFYHNIDRADFRWGGSETGTVGYPCWSTFPAPCSHHKRIESNVDQIELLKHGDKDGKYWVPAMADTPLRGANGRHEWFWEPDDENNIYPLNELMDKYEKSVGRNATLILGLTPDPNGLIPTGDEQRLKEFGTEINRRFSSPLAQISGQEKKCDLETGQKATGELLRHSRRHTERRTYPPI

SEQ ID NO: 6012 - protein, 901 aa, B.fragilis
KDMKQQIGRLLSTLLLATFSLGITAGVIQGTIIDKQTKEPLTGATVQIAGTTTGTVADVDGNYTLTLSNGTYTIEVKYIGYKTLRMNEVKVKANATLNFELEVDAQTLDAVTVVARKNLEGEKALLQERQKATLAIENMGAKEMTLKGISNVQDGVKKITGISIASAGQLIVRGLGDRYSTTTLNGLPIASPNPDNKLIPLDLFPASTVKNITVSKVYAAGAFADYSGAHIDISTKENTGSDFFSIGFNVGGRFNTVGKDFYYSDRKGGLFSTGNLRNKDRILAMGKSEFRDYARNNDPFGTNFAISKHRSLPEFGGNLGGGKSWTLPNGNRLSVLASVGVSNENQILKDAYVTTMTAQGTHLDKFNYDSYSSALKIAGLGNIGYSFRQADHINFTVFYARNAINDYMSREGIDAEKNNITSSNSVFHAYSLLNNQLLGHHELTSQWDVNWSASYGLTNSDEPDRRQVVFFRNEGSDKLNLFKLNQTTNRYFGELQEKEIVGDLRTSYKWGDANLIRVGGTYKSKKRDFESVNFYYDINALNADVTNIYDTNGYLNQENIANGTIKANIDAQPRYNYYAGMDVWAGFAEIEYYPMESLLVNVGLRYEQAKQWVRYWTDGGQEKKTNLDKGDFFPALNLKYSLNETNSLRLSVSRTVTRPSFIEMAPFLYQESYGSAYIRGNNELKNAYNYNIDLRYDFFPKRNNGDMFSVTGYFKKLKSPIEQTQESSGGTVIRSFRNAEDGIATGVEIEFRKELFKNFRIGANGSYMYTNVVLPEGGVYTDSERALQGASPFLINADLSYTPQLRGESDLTLALVYNVQGPRIETVGIYGTGNIKQQTLHTMDFIASYAINKHLSLRLQMKDLLNSTIRFKQELPATGQKVEVESFRPGTHAEIGVSYRF

SEQ ID NO: 6013 - protein, 239 aa, B.fragilis
  UNSURE (232),(236),(239): Identity of amino acid sequences at the above locations are unknown.
DKMKNNRLIITLIALFLLGFGLKAQTASTEETAAQKEKRMEWFAQAKLGIFIHWGIYAVNGVSESWSFFNNYLPYEEYMAQEKGFTASAYNPQEWVKLIKESGARYTVITTKHHDGVALWDTKAGDLSTVKSTPAGRDLIAPFVKEVRKQGLKLGFYYSLLDWSHPDYPNKTRTEVRYKNDPDRWAKFVKFNFGQLSELNKTWKPDLYWFDGDWEQTAEAWDSKSSPRGWKXARHXELX

SEQ ID NO: 6014 - protein, 279 aa, B.fragilis
YMFDFSIITSWIHQTLTSVMPEGLAVFIECVVIGVCIVALYAILAILLIYMERKVCGFFQCRLGPNRVGKWGSIQVLCDVLKMLTKEIIELKHSDKFLYNLAPFMVIIASFLTFSCLPISKGLEVLDFNVGVFFLLAASSIGVVGILLAGWGSNNKFSLIGAMRSGAQIISYELSVGLSILTMVVLMGTMQVSEIVESQANGWFIFKGHIPALIAFVIYLIAGNAECNRGPFDLPEAESELTAGYHTEYSGMHFGFFYLAEYLNMFIVAAVAATIFLGG

SEQ ID NO: 6015 - protein, 836 aa, B.fragilis
PRIDNYEYLLPKNKEFFQKLGVDSLIYPEMLAAKEIVSSMRMSWVRQWWEFCGGSLILIGTKMREKAEILNVTLAELGAPDIPYHVVAIKRGTETIIPRGDDTIKLHDIVYFTTTRKYIPYIRKIAGKEEYADVRNVMIMGGSRIAVRTAQYVPDYMQVKIVDNDINRCNRLTELLDDKTMIINGDGRDMDLLIEEGLKNTEAFVALTGNSETNILACLAAKRMGVSKTVAEVENIDYIGMAESLDIGTVINKKMIAASHIYQMMLDADVSNVKCLTFANADVAEFTVPENAKITKNKVKDLGLPKGTTIGGLIRNGEGILVTGDTLIQAGDHVVLFCLSMMIKKIEKSLIDGMINSKMIYRITGFLLLIETGLLLCCAGVSLIYREDDLSSFLLSAGLTTLVAILLLALGKGAEKQLNRRDGYVIVSVAWVVFSLFGMLPFYLSHYIPSITNAFFETMSGFSSTGATILDDIEALPHGLLFWRSMTQWIGGLGIVFFTIAVLPIFGVSGVQLFAAEASGPTYDKVHPRIGVTAKWIWTIYAGLTAIEVILLLFGGMGLFDSICHSFATTGTGGYSTKQDSIAYYNSPYIEYVIGVFMFLSGINFTLLLLLFTGKLKKVSQNAELKWYVMSVILFTAFIAAVLYRTTPMGAEESFRKAFFQVASLHTSTGFVTADYMQWVPVLWGTLTVIMLIGACAGSTTGGMKCIRMVILAKVSRNEFKHIVHPNAVLPVRVNKQVISPAILSTVLAFSFIYAVIIIVSVLLMLAMGVGFTESIGTVISSIGNMGPGLGSCGPAYSWDGLPDLAKWLLSFLMLLGRLELFTVLLLFSSDFWKRN

SEQ ID NO: 6016 - protein, 625 aa, B.fragilis
CRVELVKEGSFYGTIPLFNSACNINLTKMIMRKIQYLFIALFICLEIQAQDKFNIRGVLPWHNFLSGPTSWNLSDYRIYLDECRKNGINFIGFHNYTGGGERYATYVEPMIKIEYKNILPQACFDNSMTARWGYLPMAVKDFAFDTGKIFQLPVGAEAFGNNGSITSHSSREHYEKAQSLMRDVLKMAHERGIRMAMGFEFGVIPSEYFSLNVAGDCFYWAGESNMIPNPKSQIAAEIHYAAIDDILNTYPDIDYIWMWLNEHSFMGVDVQKALRDKPFARAYQENQALFKEAADSSARFVGVWALEYMKLTYKHLKSKGSRAKLILGGWGGGHQLPSLLKGLDRALPQDIIFSCLNPDLGKSPQPDFLEEIARNRSVWAVPWLEGDHQLWHFQPRVNMMREQVKLAAEQNLDGVIAIHWRTEEPRFNFRTFARFASDKGADESVDQLYDRYLTEEFGEEAAKEMTPLLARMDREQIQWNVPSPEFYAYTPEWGLLDENNVRIRQELVSSGESLLKKLRGEKRENLKRFIAMFRFELLLGEVDRAMMPAFILKKKEVQGEKINGSQEYMDAYRLLVSAPVKEMFDTYMERVHSRGELGVLSSLNQRVWREYNDLKIYLENKIKEK

SEQ ID NO: 6017 - protein, 219 aa, B.fragilis
RYKDMKKLIIFDLDGTLLNTIADLAHSTNHALQTLGYPTHEVASYNFMVGNGINKLFERALPEGEKTEENVLRVRKEFLLHYDRHNADESRPYPGIPELLETLQHKGYKLAVASNKYQAATEKLIAHYFPGIRFVAVFGQREGVKVKPDPAVVHDILQIADVSKDEVLYVGDSGVDMQTAINSGVTSCGVTWGFRPRTELESFCPDYIVDKAETILSIV

SEQ ID NO: 6018 - protein, 498 aa, B.fragilis
STKDMNFLSLFVLIPLLMLGGLYLAKSIKAIRGVMVAGSTALLILSVVLTFLYLGERQAGATAEMLFRADTVWYAPLHIAYSVGVDGISVAMLLLSAVIVFTGTFASWKLRPLTKEYFLWFTLLSMGVFGFFISIDLFTMFMFYEIALIPMYLLIGVWGSGRKEYAAMKLTLMLMGGSAFLLIGILGIFFGAGGTTMNILEIAQLHNIPFAQQCIWFPLTFLGFGVLGALFPFHTWSPDGHASAPTAVSMLHAGVLMKLGGYGCFRIAMYLMPEAANELGWIFLILTGISVVYGAFSACVQTDLKYINAYSSVSHCGLVLFAILMMNQTAATGAVLQMLSHGLMTALFFALIGMIYGRTHTRDVRELNGLMKVMPFLSVCYVIAGLANLGLPGLSGFVAEMTIFVGSFQNFDVFHRTLTIIACSSIVITAVYILRLVGKILYGTCTNKHHLALTDATWDERFAVICLIICVAGLGMAPFWVSHMIGESVLPVVSHLIP

SEQ ID NO: 6019 - protein, 531 aa, B.fragilis
NMEEIKYIEPAALHDEMLRLRNEKQMDFLESLTGMDWGVADEGDAPNVTRGLGVVYHLESTVTGERIAIKTSTNNRETPEIPSVSDIWKAADFNEREVFDYYGIVFIGHPDMRRLYLRNDWVGHPMRKDNNPEKDNPLRMDNEETYDTTREIELNPDGTYQTQENVIFDDREYVVNIGPQHPATHGVMRFRVSLEGETIKKLDANCGYIHRGIEKMNESLTYPQTLALTDRLDYLGAHQNRHALCMCIEKAMGIEVSERVKYIRTIMDELQRIDSHLLFYSCLAMDLGALTAFFYGFRDREMILDMFEETCGGRLIMNYNTIGGVQADLHPNFIPRVKKFIPYLRGIIHEYHDVFTGNVIARQRLKGVGVLSREDAISFGCTGGTGRASGWACDVRKRMPYGVYDKVDFKEIVYTEGDSFARYMVRMDEIMESLNIIEQLIDNIPEGPIQEKMKPIIRVPEGSYYTAVEGSRGEFGVFLESHGDKTPYRLHYRSTGLPLVSAVDTICRGAKIADLIAIGGTLDYVVPDIDR

SEQ ID NO: 6020 - protein, 536 aa, B.fragilis
ALLDPLDEKAYDFVSPEQLGDSESAASQLVTGAYNTVITSFIAPGSYLYLTNMDCDYASGASWAFGNVGAGNPQGFWGIDHMWQGSYTLIHRANLGISKISAMSNLSQESKQDALAQLCFLKAWAYFNLVRNYGPVPIFRKSISEGEAMSQPRASVSDVYAHIIELLEQAEGMYSKDDAGFVVGHASNGAAKALLAKVYVTMASGAMSGVPIVVKGGNPNIFEPQPITHIAKTVAGYESFDPAKYYALARDKAWEVINEYTLFDNYMDVWAIGNRNKGEHIWMAQAISGDKDFGNTICQDYVGIFKEDGTMEGNWYGMRDHWYLLFEEQDTRIVDGVIHRYASDGISNGKVIYNYYPRWYANKVDNKEVYDSHGNAFDGTEVYHERQGWTLAKLTKFTFVTYRKQKNSDFHFTLLRLPDIMLIYAEAVNELNGGPDAEAYNQVNRIRTRAHATPFSGMNQDEFRSAVLEERARELAYEADRRYDLFRWGIYLDVMNAIDMDEHNVTKRRLERNLLYPIPTSEVNSNDKIDSNNPGW

SEQ ID NO: 6021 - protein, 336 aa, B.fragilis
NVMELSLYIKDKLVSGKRVAIPIMTHPGIELLEKRVLDAVTNGEIHYHAIRALNECFPQSAACTTIMDLTVEAEAFGARLSMSPNEVPSVCGRLLTGYADVEALQIPSVESGRMPQYLLADRLAAEGIDKPVLAGCIGPYSLAGRLYDMTEIMMAIYTEPDTVLLLLEKCTEFILRYCLAIKETGVAGVIMAEPAAGLLSNEDCQRYSSVYVKRIIDAVQDDSFAVILHNCGNTGHCTAAMLATGAKGYHFGNKADMITALRECPSDVWVMGNLDPVGVFRVLTPEDVFARTEELLTCTGEYANFIISTGCDTPPEVPFDNIQAFYLAVEKYNKGR

SEQ ID NO: 6022 - protein, 485 aa, B.fragilis
KKMDYSQFLYMKEELSLIAVILILFVVDLFTCPDQKGAAPKVNVRSLTLPAVILMTLHTVINLFPGTPAEAFGGMYQYTPMQTIIKAVLNVGTIIVLLMAHEWLRREDTRIKQGEFYVLTLSTLLGMYFMISAGHFLMFFIGLEMASIPMAALVAFDKYRHHSAEAGAKYILTALFSSALLLFGLSMIYGTSGTLYFNDLPGHITGNMLQIMAFVFFFAGMGFKISLVPFHLWTADVYEGAPTAVTSYLSVISKGSAAFVLMTILMKVFAPMVAQWQEVLFWVTIASITIANLFAIRQQNLKRFMAFSAISQAGYIMLGVIGGSEMGMTALVYYVLVYLAANLGVFAVISIVEQRSNKVEIDDYNGLYKTNPKLAFIMTLALFSLAGIPPFAGFFSKFFIFMAAFNSGFHLLVFIALINTVVSLYYYLLIVKAMYINPNEEPIPTFRSDNYTKVSLALCTLGIIALGIASCIYQGIDKFSFGMGM

SEQ ID NO: 6023 - protein, 126 aa, B.fragilis
TYYWIMNFTLLVVVLLTAIAFVGVVIALSNAISPRSYNAQKFEAYECGIPTRGKSWMQFRVGYYLFAILFLMFDVETVFLFPWAVIARDLGPQGLISILFFLAELGLGPCLCLEERSTVMEIMKKP

SEQ ID NO: 6024 - protein, 65 aa, B.fragilis
AEARFRKSYHVVNGVDKILPVDVYIPGCPPRPEAFYYGMMQLQRKVKIEKFFGGVNRKEKKPEGK

SEQ ID NO: 6025 - protein, 518 aa, B.fragilis
ENTRRFSHLPVRQMHCLPDSEIHIGFMQTLDKMEKIKYCFSMIGLLFLFAACQEKVTSPARVDTLPSIFPDYVGVTIPSTIAPLNFRVTDDGVEAVDVVIAGTKGKPVRLNGRLVDIPAKQWHELLESNKGDSIEVKVSVRQGKKWKEYRPFPIYVSPFPIDYGLVYRLLAPGYEVYSKMGIYERELSTFRQTPLFENTQVTAACINCHAFNRTEPTPSSVHVRGGHGATVIDTGDRLEFLDTKADGQLSACVYPYWHPSGEYIAYSVNKTNQAFHLGGKKPIEVFDQASDVVVYHPRSHRILTTPLLSTASFETFPAFSPDGRTLYFCSAEQKEMPVRYKDVKYSLCSIAFHPEDGTFGDRIDTLISARTLDKSISFPKPSFDGKYLMFTLSDYGNFSIWHKEADLWLLDLKTGTYRNLEEVNSDDTESYHNWSSNSHWFVFSSRRGDGLYTRLYISSVDGQGRIGKPFLLPQQDPYTFYDQLIYSYNVPEFVSVPVQWDKREMAKGLMSKERVKVK

SEQ ID NO: 6026 - protein, 251 aa, B.fragilis
CQCSRNNGQEVDKRLLNMPLMNSHIVEECLPFTSLRLDPEDINLSMGAGYVPDAEIQAISDALETEIAGICTPRFLYALFDAEPAGTCEVGVNGISLKTGSVITPYLKDAAGYVLFVATAGYEFEAFQHRIGSQGDILREFLLDAYGSAIAEAVVREVCRKVESRMFPLGYGVSHPYSPGYCGWHVTQQQLLFSCLPEFPCGVRLSDSSLMSPIKSVSGIIAYGPCIVKRKYGCELCGKADCYKNRNKLNR

SEQ ID NO: 6027 - protein, 114 aa, B.fragilis
QQKGKNLNLKTEKETLMGSKKTDLMRISYFVAIVILVCLIGNLKDLWLQSWTDLIIYLIVLFAAAECLFSTFARIRAVGEQKQPRWLTSISLLIYGILFLGTLFFIGDFLINKL

SEQ ID NO: 6028 - protein, 172 aa, B.fragilis
KNMGLTLETVVFYFLAVFIIAMSILTVTTQRIVRSATYLLFVLFGTAGIYFLLGYTFLGSVQIMVYAGGIVVLYVFSILLTSGEGDRAAHLKRSKFLAGLVTTIIGAILVLFITLTHKFVPTSDPEPVEISIKTIGHALLSSGKYGYVLPFEAVSILLLACIVGGLLIARKR

SEQ ID NO: 6029 - protein, 932 aa, B.fragilis
TTFMDNDIERFRQMASMAQLGWWEADFTAGHYVCSEYLCDLLGLEGNTISFTDFRKRVREDYQEQIVREFNASIHREFYEQTFPIHSKEGIVWLHTRLGEREEIPGRGVVSFGIMQRVEAPNDTSERVLERVNDLLYRQNSISHSLLRFLKDDSVDLCIMEILKDILDLFHGGRVYIFEYDEYYRYQDCTYEVVAEGVLPEIDSLQRIPTDSLPWWRQQTLSGKPVILDSLDQLPKHAKAEYAILSRQNIKSLMITPLIAGEHVWGYMGIDLVKNYRNWNNEDFQWLSSLANIISICIELRKAKDEAVRERSFLRNLFRFMPMGYIRMTMVRDAAGLPCDYRIADANDLSSELIGMPLSDYVGCLASELHADFKAKVDYLLDVMEGSVHKETDVYFHRTQRSSHCIVYSPEKDEVVALFLDSTETIRAHRALDRSEKLFKNIFANIPAGVEIYDKDGNLLDLNNWDMETFGVKDKADVMGVNFFENPNVPLEIRERVRNEDLVDFRLNYSFNKASDYYHSDKSNIIELYTKVSKLFDSQGNFNGYVLINIDNTERIDAINRIRDFENFFLLISDYAKVGYAKLNLLSKRGYAIKQWFKNMGETEDIPLSSVVGVYDKMHPEDRQKVFDFYEKVLAGEEKDFRSEMRILKPGATNEWNWVRMNVVVTKFEPEHGEVEIIGINYDITELKETEAMLIEAKEKAENMDRLKSAFLANMSHEIRTPLNAIVGFSGLLVDTEDMEERCEYIKIVQENNDLLLQLISDILDLSKIEAGTFEFTYGETDVNMLCEDIVRSSQIKVPQGVELVFDPHPSDCTVISDRNRLHQVISNFVNNALKFTSSGSIHVGYEKKEEGVEFYVSDTGIGISKEQLTHIFERFVKLNSFIHGTGLGLSICKSIVEQLGGVIGVDSEEGKGSRFWFTIPYINSEQSIVND

SEQ ID NO: 6030 - protein, 185 aa, B.fragilis
IKSIPYEDFIDNESLEKMVKELNEGGANVLVGVLDDLINWGRRNSLGPLTFATSCCGIEFMALGAARYDRARFGFEVARASPRQADMIMVCGTITNKMAPVLKRLYDQMADPKYVIAVGGCAVSGGPVSQILSCGERSRQDSPGRCIYSRMPSPPGSILLRYDATATESEDREILRRSKPEREKT

SEQ ID NO: 6031 - protein, 1071 aa, B.fragilis
TLCITLNKKRMKKISILFMLLLGITTLYAQQLNITGTVIDKKLNEPIIGATVQVKGTNNGSITDMEGKFSLKNVSKGGILTVSYIGYTTQSIPLNGTQTSFRIELSEDSKTLDEVVVVGFGTQKKVNLTGAVTSVDTKALASRPVSQVGQALQGVVPGLNLSTPDLGGQLGQTMNVNIRGTGTIGKGSSASPLILIDGMEGNMNNLNPEDIENISVLKDAASSSIYGSRAAFGVILITTKKGKAGKMQVNYNNSFRYSGPTSLPNQLDSYRFANYFNDAAINQGGSVIFDEETIDRIQKYMAGEITTTTIANGTNWHFHEKANDNVNWWKKHFQWAWSNEHNISLNGGTEKLQYYVSGSYLNQDGNLRYGNDNYKRYNATAKVNTQINKYVDFNINTKFVRFDLDNPVYLEEGGLLYHDIARMWPMMPFKDPNGYYMRNGKLNQLTDGGRAKTHNDNIYLQGQLVIHPLKGWNIYAEAGMRVINQNKQTNLNPIYEHDVNGNPLALAFSGSYSPGSSFARSAYHNSNFYTTSVYTDYTLQIKDHYFKALVGMNTEEYVYRELAAQRPDVISSLIPEISAATGEDKINSSKYNDWSTAGFFGRLNYSYKDRYMAEVNVRYDGSSRFLKDQRWNVFPSFSLGWNLARESFFEPINNIINTLKPRVSWGMLGNQNTDSYYPFYLTQSVTANGGNWLMDGSRPTTAGVPGMVSSTLTWEKIYNTNLGIDLGMFNNRLNMTFEYFIRRTKDMVGPAAEVGAILGTALPNTNNAELKNKGWELQANWRDNIGKVNYNIGFNLSDNRAKVISYPNASKALWDSNGNTLYYNGMTIGEIWGYETEGIAQTDAQMTEWLASNDQSKIGSVWGAGDIMYRDLNGDGIVDKGNSTATDHGDLKKIGNSTPRLRFGLSLGADWKGFDIQMFFQGVMKRDLWLSGPMFWGADGGEWQSVGFDEHLDYFRPENTTSIFGANLNSYYPKAYLGDKGNKNKQTQTRYLQNGAYMRMKNLQIGYTFPKAWMNKAKIEKLRIYVSGENLFTISGIADMFDPEATAGNGFSNGKTYPLSKTISFGLNITL

SEQ ID NO: 6032 - protein, 694 aa, B.fragilis
FIRMKRYFIISLLTLASTVAPLTAVFAQSSFIYEKGKSFKDVNASPMPQTIRLDRTAEPVIYENAVPENATTICYRIQLPSYVRGTFFSRDSRPGDYEWPNNTNRLLPWMFNHLTDLTRDDYPGIPSNARPSTLGDALLLQLTDGSYLFTKAIAGDNSLSWFQVNTDGSLNLYVSTLGTDRLEHKVPVALVQSAGNIYQVFQQAYETLISDRNVSALQKRTEKNYFEALNYLGWCTWEHYHFDIDETKILNDLDAIETSGVPVRYVLIDDGHLANKNRQLTSFTPDPQRFPNGWAPIMAHKNKDKIRWIGLWYALSGYWMGISPDNDFPTHVKNSLYSFNGSLLPGKSTPNIDTFYQYYVHSLKTHGFDFLKVDNQAFTLPLYMGSTEVVRQAKECNLALEKQTHAQQVGLMNCMAQNVLNTDHTLHSGVARVSIDYKKYNENMAKSHLFQSYTNTLLQGQTVWPDHDMFHSSDTICGSLMARSKAISGGPVYLSDSPKEFVKENIFPLIDKEGKIFRPEAPAIPTPESVLTNPLQDGKAYRVFAPTGDEAVSVICYNLNTSPKHRKVTAEIDPKDYLLRETLTGKPTPQQKRVILFDWNNQTATELTGKQTVELDGFTDRLFHLCPIHDGWAVIGIQEKYLSPAAVRILSSTPDKLVLNVLSPGTLKIWTENSGKQELRNIQVKETGKMTIRK

SEQ ID NO: 6033 - protein, 487 aa, B.fragilis
LYSIMKNIIPQALLTMPILSTGLQAQEKQPTPNLVFIMADQYRGDAIGCIGKEPVKTPHLDKLASEGINFTNAISSYPVSSPARGMLMTGMYPIGSKVTGNCNSETAPYGVELSQNARCWSDVLKDQGYNMGYIGKWHLDAPYKPYVDTYNNRGKVAWNEWCPPERRHGFDHWIAYGTYDYHLKPMYWNTTAPRDSFYYVNQWGPEYEASKAIEYINKQKDQKQPFALVVSMNPPHTGYELVPDRYKEIYKDLDVEALCKGRPDIPAKGTEMGDYFRNNIRNYYACITGVDENVGRIIEALKQNNLFDNTIVVFTSDHGICMGAHENAGKDIFYEESMRIPMILSWPDQIKPRKSDPLMIAFADLYPTLLSMMGFSKEIPETVQTFDLSNEVLTGKNKKDLVQPYYFVKFDNHATGYRGLRTDRYTYAVHATDGKIDNVILFDRTNDPHEMNNIASQQLKLTHTFNRQLKTWLEKTNDPFAQYIKLK

SEQ ID NO: 6034 - protein, 128 aa, B.fragilis
EIGMKQNLKYYIIIVLAVLLHSVTMKAANTSYIIEDPDQEECFISQATPASRNILERFHFYCTIMPCEMGHADISHVPTDKSFIRPEMIFHKYRMRNNPFSVHSNHSHTYNPSDPLTYYVYGLRKIII

SEQ ID NO: 6035 - protein, 105 aa, B.fragilis
DDMMIHMEYYLVVSTIMMFAGIYGFFTRRNTLAILISVELMLNATDINFAVFNRFLFPGELEGYFFALFSIAISAAETAIAIAIMINIYRNIRSIQVKNLDELKW

SEQ ID NO: 6036 - protein, 1380 aa, B.fragilis
ISFVCLGFISFFCNKLIINMKKLNLFLLVLFICNCPVVSGYAFFDRDIRLLTMQDGLADNTITSIYKDRDGFMWFGTNNGLSRYDGKLIKNFSSSPAYMYVSEIVEMSDRYLGVIAGNTLYCFARSLEKFIPIVHATDYSSVHVSHLLPIDNNSFWGLSGNKLYLYTQEEVKNEKGEVVQIKLKCEKQYKDLIDSGDNFCAMCYTDNHEMLCLVTQQGNLLLFQPESSEKSKKISLWKNKTWDATSVLYDKGVVWVSTIGHGILRYYVSSGYIDRITYKENNKENSLSHTDVFQVIPINNNRYLAVTWSGYTLLFQDKNDPKRMMTEIYYNTASQLHRNLETRMISAYYDPSGIVWIGTNGGGVIYSDLRSQFYNQFHQERHNEICGIVMDNRKYVWMATFHQGIMKSEQPFEPGRRMNFTRVGTPDIQSKNTVLCAINDNRGSLWFGNRDGTLTSYNEATKQFRLHFLQDRGKVNTVSIWALYWDTNRNLWVGTNDGVWKLNIDSGFCKKIPIEILFKDPTPICIRAIAGTKDGTIWLGTSNAGVCKLKIDSRGEMSLETGYEKKANIKNNSVRSLLVSSDGNVYVGYMDGFAILSPKKDAIREYYTTRNGLCSNFIGCLVEDNRGHIWLGSNSGVSRYSRHQHLFYNYYISGSNRSALLADNTLFFGNNKSLTYFDPDDVGGHLDEDQVLITGLEVDGRPVGIGDKINGQTVLAEGISYTSSITLNNENRDFVLSFNNLSYAEEQQKYNYRLLPYQTHWLVSNDGEKATYMNLPEGDYTFEVKNIYPDGKDGKVTSLQIHILPHWSRTLPFRLFILLLLAGGVAYLIRLVKHRQMRMEREMRMEHELLSVNLEREKERQIRMERENFFTSAAHELRTPLTLILAPLQELLEHIKASDPLYSKLYTMYKNSSSLHTLVDQLLYVQKIEAGMVKLRLSEADIVELVREVAESFRQMAGIKGCTFQVRLPEDPVFLWIDTEKITSSVGNLLSNAFKYTSPNGEVLLTLTRMEQDGKPFCQITVSDTGEGIPDEFQKRIFDSFITGDNSPAFSTKVGIGLRIVKNTMDLHHGQVILDSEPGKGSTFVLLIPEGKSHFTGDLYEIVDYRGHETEPQFQPLSVQEKSEEGVPVTKKTLLIVEDNVDVRQYIRSLFVTKYTVLEAADGEEGVRIATNEIPDLIISDVMMPVKDGFACCREIRERQETAHIPILMLTAKAEDADVLQGSYSGADDYMMKPFNPEVLKAKVENLILQRERLKRIYTKALMLKRESVEDEEADDEFIQKLIHVVEKNLSNENFNVKMLAEQLHMSQPTLYRKVKQRSELSVVDMIRSVRVSKAASLIMENRYSIQEISEKVGFSDARTLRKHFTEQFGVPPSKYMENK

SEQ ID NO: 6037 - protein, 421 aa, B.fragilis
NVNVMNRSRDKVRCALNHQNAGSIPVDFGSTAVTGIHCRIVEALRNYYGLAPRPVKIVDAFQMLGEIDAELAEKIGVDCIGIGGPKDIFDLDTTRMHEQTTPWGQRVLVPEAMDLTPDMRGDVYVYAGGDQNYPPSAVMPKGCYFINAIERQQPIEEDRLDPEDNVEEFGLLTENDLAYYCAEADKAYQTGRAVVASFGGTALGDVAFVPGMGLKQPKGIRSVVEWYMSTAMRQDYLHQVFEKEIDIAIANYEKLWAALGDKIDVVLTCGTDFGSQESQFCSIDTFRELWLPHYRRMNDWIHQHTTWKIFKHSCGAIIPILPGLIEAGFDIINPVQINAKDMESRRLKEEFGSQLTFWGGGVDTQKILPFGTPDEIRRHVMGQCEILGRDGGFVFNAVHNVQANVPVDNVVAMFDALKDIS

SEQ ID NO: 6038 - protein, 384 aa, B.fragilis
SGMVMNTFVTFKIEDAMKTFRYILFVWVMLGCGLFASCEDDEVEYAPLAVTRVSTVLDREQGIDQANLAQYIIVQGTGLNAVNSILVNDVQVDLKDAYITSGEITFPIPRVIPGEINNLITLGSGNSTVTAPISVFIPELEVNGMFNEFTPAGDTMKVVGDYFDLYEITTESGQLFFGGKEVKITKSTGNSLSFVLPEDAVMGSKIKLVSPVCGEVTVPGKYMEKGNMLCDFDPFTGWGGSKYVIDGPVPAPYSGYFSRFKINKGDANDWDWNEVTTIAQCAVEYSPEVIADQNKYLLKFEVNTIKPLTKRQIRFYFSQINYDWEPFASGLALNTNGEWKTVSIDLGEMWKGDIPNDGVLQIMGNSWAEDTDICFDNFRIVPKD

SEQ ID NO: 6039 - protein, 686 aa, B.fragilis
VHKVVSPPPFPLLLIKFPIKKMLLPLSFTKFAFKFARIMKNEPTYSLLNAINYPKDLRQLSVDQLPEVCEELRQDIIKELSCNPGHFAASLGVVELTVALHYVYNTPYDRIVWDVGHQAYGHKILTGRREAFSTNRKLGGIRPFPSPEESEYDTFTCGHASNSISAALGMAVAAERKGEKDRHVVAVIGDGSMSGGLAFEGLNNASSTANNLLIILNDNDMAIDRSVGGMKQYLFNLTTSNRYNQLRFKTSRLLFKMGLLNEERRKALIRLGNSLKSLAAQQQNIFEGMNIRYFGPIDGHDVKNIARILHDIKDMQGPKILHLHTIKGKGFGPAEKQATIWHAPGKFDPVTGKRIVANTDGMPPLFQDVFGHTLVELAEKNKRIMGVTPAMPSGCSMNMLMDRMPDRAFDVGIAEGHAVTFSGGMAKDGLLPFCNIYSSFMQRAYDNIIHDVAIQKLNVVFCLDRAGLVGEDGPTHHGVFDMAYLRPIPNLTISSPMDEHELRRLMYTAQLPDKGPFAIRYPRGRGSLVDWECPLEEIPVGKGRKLKDGNDLAVITIGPIGKLAARAIERAEADTGISVAHYDLRFLKPLDEELLHEVGKKFRHIVTIEDGIIKGGMGCAILEFMADNGYYPEIRRIGVPDQFIEHGSVQQLYHLCGMDEEGIYKVITKNELRMDAPVESCMATHS

SEQ ID NO: 6040 - protein, 512 aa, B.fragilis
SIKLNSSYYWIKSNNVYFWSEIKPENFKSNSMSTLQNAMGKMTNYRWTICAMLFFATTINYLDRQVLSLTWDEFIKPEFHWNESHYGIITAVFSIVYAICMLFAGRFIDWMGTKKGYLWSIGIWSAGACLHAFCGIITEEYVGMHSAAELIAATGDVVVVLATISMYCFLVARCILALGEAGNFPAAIKVTAEYFPKKDRAYATSIFNAGASIGALIAPLSIPLLAKAWGWEMAFVIIGALGFVWMGFWVFMYTAPSKNKFVNSAELEYIEQDKHETYTATVKENEEKKSMTFRQCFTYRQTWAFAFGKFMTDGVWWFFLFWAPSYLNTQFDIKTSEGLGRALIFTLYAITMLSIYGGKLPTIIIHKTGLNPYAARMRAMLIFAFFPLLVLLAQPLGTISPWFPVIMIGIGGAAHQSWSANIFSTVGDMFPKSAIASITGIGGMAGGVGSMILQYSAGELFVHADKTQMVFMGFIGKPAGYFVIFCICSVAYLIGWIVMKALVPKYKPIILN

SEQ ID NO: 6041 - protein, 820 aa, B.fragilis
PDNSETMKMKLICFLMLSVFFIFPVRAKNTFGKKKDKVTRLHFYDLNKNGRMDTYENPSAPVEYRVEHLLSQMTLEEKVGQMLTSLGWPMYERVGEDIRLTPQLEKEIGEYHIGSLWGVMRADPWTQRTLHTGLNPSLAARASNRLQSYVIEHSRLGIPLFLAEECPHGHMAIGATVCPTSIGQASTWNPELIRQMGRVIAIEASAQGAHIGYGPVLDLARDPRWSRVEETYGEDPYLNGVMGTALVRGFQGETLNDGKSVIATLKHFASYGWTEGGHNGGTAHIGERELEEAIFPPFREAVGAGALSVMSSYNEIDGNPCTGSRYLLTDILKDRWQFKGFVVSDLYAVGGLREHGVAGNDYEAAIKAVNAGVDSDLGTNVYAEQLVAAVKRGDVAVATIDKAVRRILSLKFQMGLFDDPFVDEKQAVQLIASSEHTGLAREVARQSIVLLKNKDKLLPLKKDIRTLAVIGPNADNVYNMLGDYTAPQADGTVVTVLDGIRQKVSKETRVLYAKGCAVRDSSRTGFKDAIETARNADAVVMVMGGSSARDFSSEYEETGAAKVTINQISDMESGEGYDRATLHLMGRQLELLEEISRLGKPVVLVLIKGRPLLMEGAIQEAEAIVDAWYPGMQGGNAVADVLFGDYNPAGRLTLSVPRSVGQLPVYYNTRRKGNRSRYIEEPGTPRYPFGYGLSYTTFSYTDMKVQVTEGSDDCRVDVTVTIQNQGTADGDEMAQLYFRDDVSSFTTPAKQLRAFSRIHLKAGESREVTFTLDKKSLALYMQEGEWVVEPGRFTIMVGGSSEDIACRQAFEINRKYTFKM

SEQ ID NO: 6042 - protein, 554 aa, B.fragilis
VLFREINRGPDLPEEFKETIYKTSPIIPPGGHLPIQPKKGYSNLPRIFSVRIETTSPIYTDKGSKTIASTLPGNRAHSFDGWITSTGRISANAPKAGPPRPVVTDGVYRRTEKLNITSVSTESGIVCNIGFDESLMYEAWKNVSLKELPGLPVIKYPEGVAALARHLEEVMRYQTPADYHVFRIQVASETLEETEYPEFINPIGSDGKTYALLKEARTERVVISGQAVDVKVPAGYGISPFLKVSRILEMIFSAYGFTLVENPFATDYQLSKMVVLNNVADTIVTGEIDYRNLMPDCTVNEFLDALFCRTGAKVYVNAGRKAVIRLLKDSIGATASADWTPLKASEPEINYTPAKQLKLSAGTSFKEAEPAADSFEKFLKPYGGIITEFTGDRDVPDELYITYQPSTGRYYKRDIVNKKKKWISSDFFPWDKGTPGVEYLEITGKDECVPMAFKTGLLTPGYLAGAVNINTTLRGAAKEQGEKKQTPLAFCFAMGKTNQIIGAGALVEEYYFGSSLCREPKGEYFQDPGGNVYRYSLVFKGEDGAFNRFFKEYD

SEQ ID NO: 6043 - protein, 71 aa, B.fragilis
TPSVTTGRGGPALGALADIRPVDVIHPSKECARLPGNVDAIVLLPLSVYMGDVVSILTLKIRGRFEYPFFG

SEQ ID NO: 6044 - protein, 177 aa, B.fragilis
VACSTVISGFRPELSSSKTEEDFFWAGTNAATEDQNFVIYSYPYTDKDTFTKEFFIHKRDSVMKANIPGAKEGMYMATDSSTVEVRPIDIHGDYTMEARGLWRIKGDFMGGPFVSHTRLDKASHRIITTEVFIYSPDKMKRDLMRRLEASLYTLQLPTEKAQEQIPMGIEQEEKTNK

SEQ ID NO: 6045 - protein, 81 aa, B.fragilis
LRISKELISCNYEVNINVLLMLTSYSSLIKILLFDNQLLIFWMHSVVKFFSYVQDVRSCLFIKLPLRLSIACLSTYFHILL

SEQ ID NO: 6046 - protein, 384 aa, B.fragilis
ENYSYLCYPKGELRCRRIAEMNERKIIHIDMDAFYASVEQRDHPELRGKPLAVGHAEERGVVAAASYEARRYGVRSAMSSQKAKRLCPQLIFVPGRMEVYKSVSRQVHEIFHEYTDLIEPLSLDEAFLDVTENKQGILLAVDIAKAIKQRIREELSLVASAGVSYNKFLAKIASDFRKPDGLCTIHPDQAIDFIARLPIESFWGVGPVTARKMHLLGIHNGLQLRECSSEMLVRQFGKVGLLYYDFARGVDLRPVEAVRIRKSIGCEHTLEKDIHVRSSVIIELYHVATELVERLQQKEFRGNTLTLKIKFHDFSQITRSMTQAQELTNLERILPLAKQLLKEVEYEQHPIRLIGLSVSNPREEADEHRGVWEQLSFEFSDWGK

SEQ ID NO: 6047 - protein, 62 aa, B.fragilis
RCLSPSRSSSASCSPVDAPDGTDARPIMPDSNTTSTSTVGLPLESRISRPVIFSIFIVSLVF

SEQ ID NO: 6048 - protein, 1110 aa, B.fragilis
IMGFNEFLSSIFGNKSTRDMKEIQPWVDKIKAAYPEVAKLDNDGLRAKTEELKEYIRNSASKERAKADELRAGIENVELEDREEVFAQIDKIEKEILEIYEKALDEVLPVAFSIVKESAKRFSENEEIVVTATDFDRTLAATKDFVRIEGDKAIWQNHWNAGGNDTVWNMVHYDVQLFGGVVLHKGKIAEMATGEGKTLVATLPVFLNALTGNGVHVVTVNDYLAKRDSEWMGPLYMFHGLSVDCIDRHQPNSDARRQAYLADITFGTNNEFGFDYLRDNMAISPKDLVQRQHNYAIVDEVDSVLIDDARTPLIISGPVPKGEDQLFDQLRPLVERLVEAQKVLATKYLSEAKKLINSDDKKEVEEGFLALFRSHKALPKNKALIKFLSEQGIKAGMLKTEEVYMEQNNKRMHEATDPLYFVIDEKLNSVDLTDKGVDLITGNSEDPTLFVLPDIAAQLSELENEHGLSDEQKLEKKDALLTNYAIKSERVHTINQLLKAYTMFEKDDEYVVIDGQVKIVDEQTGRIMEGRRYSDGLHQAIEAKEGVKVEAATQTFATITLQNYFRMYHKLSGMTGTAETEAGELWDIYKLDVVVIPTNRPIARKDMNDRVYKTKREKYKAVIEEIEQLVQAGRPVLVGTTSVEISEMLSKMLTMRKIEHNVLNAKLHQKEADIVAKAGLSGTVTIATNMAGRGTDIKLSPEVKAAGGLAIIGTERHESRRVDRQLRGRAGRQGDPGSSVFFVSLEDDLMRLFSSDRIASVMDKLGFQEGEMIEHKMISNSIERAQKKVEENNFGIRKRLLEYDDVMNKQRTVVYTKRRHALMGERIGMDIVNMIWDRCAAAIENNADYEECKLDLLQTLAMEAPFTEEEFRNEKKDKLADKTFDVAMANFKRKTERLAQIANPVIKQVYENQGHMYENILIPITDGKRMYNISCNLKAAYESESKEVVKSFEKSILLHVIDESWKENLRELDELKHSVQNASYEQKDPLLIYKLESVTLFDNMVNKINNQTVSILMRGQIPVAEPTEEQQEAARRVEVRQAAPEQRQDMSKYREQKQDLNDPNQQAAAQQDTREAVKREPIRAEKTVGRNDPCPCGSGKKYKNCHGRNS

SEQ ID NO: 6049 - protein, 401 aa, B.fragilis
EAESLSFIDNLKLKASYVFLGNNNIGNYPYQSTYALGKAMNYVFGGVYTQGAAVTTYVDPTLKWEKTRTTDVGIETAFWNNKLTFNAAYFYRKTTDILYKPSASYSSIFGLGLSQVNTGSLENKGWEFEIGHQNKIGEFSYHVNGNFSIIKNKVISLGVGDVEQKSGMIGNGSDLFLGYPMNMFYGYKTDGVFLTDDEVKEWHDQSKIAPNSKAGDLRYVDISGDGKVDESDKTYLGSKIPQYTFGLGLGAEYKGFDFNILLQGVAKVKGQLTNYAGYAFFQEGNIQKWQAEETWTNNQSNRYPKYPRLEVMSNAGSNNTLGSDFWILDASYLKVRNIQLGYTLPKRITQKFGSSNLRFYISLDNPFSISGYRKGWDPEINTDGSYYPILSTYTFGLTLKF

SEQ ID NO: 6050 - protein, 349 aa, B.fragilis
TDLLLTYFLLIMEKKTRKSFIWLAILLLGTIWILAQRNKQIPYNSINGLVFGTVYNITYQYDGNLKAEIDAELKKFDGSLSPFNDTSVITRVNRNEEIVTDTFFQTCFNRSMEISAETRGAFDITVAPLANAWGFGFKKGAFPDSIMIDSLLQITGYQKVKLENGKVIKEDPRVMLSCSAVAKGYSVDVVARYLDSKGIKNYMVDIGGELVVKGVNPKEEAWRIGINKPVDDSLSLNQEIQTTLKLTNVGIATSGNYRNFYYKDGKKYAHTIDPRTGYPVQHNILSATVVADDCMTADALATAFMVMGLDEAEAFTKSHPNIGAYFIYSDEKGEVKSYFTKNMKQYLDK

SEQ ID NO: 6051 - protein, 542 aa, B.fragilis
IRLLAIFVSGSDRPYWKLLMNKIDMTNERMKLLNCTLGLVAGVSLPVSALAVPQPAQDQTEKQPNIILIVADDLGYGDLSCYGAHRIQTPGMDRIANEGIRFTQGFCTAATSTPSRYSVMTGKYPWSNVDAKILPGNAALIIDTQKITLPKLMKQAGYTTGSVGKWHIGLGDGHVDWNKEVHPGAAEIGYDYSFIQAATNDRVPCVFLENGRVVGLDPNDPLYVDYRKNFPGEPTGKENPELLRMHPSVGHAGSIVNGVPRIGFQKGGKAAQWKDEEMAGLFLDKARQFVDDNKDKPFFLYYGLHQPHVPRVPNERFVGKSGMGPRGDVILEADWCVDQFLKELDKLGLAENTIVILTSDNGPVLDDGYQDDAVELVGDHKIAGPLRGGKTSMFDGGTRIPFMLRWPAKVKPQVSDVFVCQMDLLASFAFLLGQTYPDKVDSENTLDAFLGKSKKGRKELVIEGMFNYAYRQGDWALIPPYYNPYSKEDGDFIGLGYGYKLYNLKSDIGQQKNLAEKYPKKLGELINRFEYLKAHSDKVTRF

SEQ ID NO: 6052 - protein, 541 aa, B.fragilis
SSMFHSFQTSIAGIELPRLFTYPFHYTPHPLCVMAAGEVQAYINKQTRWKEELDKGKMFGVLIVRTSNGQTGYLAAFSGNLCGSNSHSFFVPPVYDLLKPDGFFKIEEEQISAINHQIGQLQNCDRYLELQQKMERETASSQQALSEARKVLKAAKEKREQRRLHRPNENEQVAMIRESQYQKAEFKRLERYWKEQISEIKTELESFSSQIEALKAERRNRSAALQQKLFQQFNFLNAKGETKNLCAIFEETVQKTPPAGAGECAAPKLLQYAYLSGLSPIAMAEFWWGESPKTEIRHHGYYYPSCRGKCEPILRHMLQGLNVEPAPSERYSLSQNMPEILFEDQWLLVLHKPEGVLSVPGKSEEQSIYSLLRARYPEATGPLVVHRLDMATSGLLLAAKTQEVHRHLQAQFENRSIKKRYIALLDGILPEEEGVIDLPICPDYLDRPRQMVNEELGKTAITRYQVMDRKNGQTRIAFFPLTGRTHQLRVHAAHPLGLNCPIVGDELYGRKAERLYLHAEYLEFIHPVSGQRMVIEKKAEF

SEQ ID NO: 6053 - protein, 166 aa, B.fragilis
FSAFFVIYPFISGTIIIKYSLIRQRILFFLKFIATFAATMIKYIFCILIGIFFVYGAGYTASIEETADLPAEVTATFVSQYAGDHSLFNDETAESKVCDAILPHSSFSRELSSSKILKLKLQTAIRLLNASLFHQSERGDTYPDFNHNFIKYSSGYYVYSLEHILI

SEQ ID NO: 6054 - protein, 307 aa, B.fragilis
ESLPYTQFEYLNIMADNYIERQYEQYEARKAAWEKARKYGKKKTGITHPARTEQPGQTTIEPHHYKRVFVTGGANGIGKAIVEIFCKSGYRVAFCDKDGIAGKRTAEETGAIFHQVDISDKDMLEHCMQSIIEEWDDIDILINNAGISDFSPITETSIEDFDRILSINLRPVFITSRFIAIHRQSQTTSNPYGRIINICSTRYLMSESGSEGYAASKGGIYSLTHALALSLAQFHITVNSIAPGWIQTHDYDRLRPKDHEQHPSRRVGKPEDIARMCRFLCEEGNDFINGENITIDGGMTKKMIYTE

SEQ ID NO: 6055 - protein, 540 aa, B.fragilis
LCALSRKTTMLKRIPHTYTIISSVILLCAVLSWIIPAGEYVRETIDVNGISRTVIVDHSFHRVEQTPQTWQVFSSLLEGFERQAGIIAFLLIMGGAFQIMNSSRAIDTGIFSFLNFTKGLEKHRLIKILGVNNVVISLVIILFSLFGSVFGMSEETLAFVIIIVPLAISMGYDSITGLCMVYVAAHIGFSGAVLNPFTIGIAQGLSDLPLFSGFEYRMFCWLVLTTALIVCVLRYAAVVKKHPEKSPMYHADAYWRKREKESCGEISHVTTRQAWIVYLLLLVSLGLFSIIYPISTFSVGEASVTCYAVPTLSILFAVFGWLGLRKSNQFFILTLLAFTILFLIIGVMGHGWYLPEISAIFLAMGILSGFANSEHADAIIKQFMDGAKDMLSAAIVVGLAGGIIQILQDGHIIDPILHSLASLMGEAGKIVSLGVMYLIQTLINLIIPSGSAKAALTMPIMAPFSDVIGLSRQATVMAYQFGDGFTNMITPTSAVLMGALGIARIPYEIWVKWLWKILLLFIILGMVLLIPTVLFPLNGF

SEQ ID NO: 6056 - protein, 445 aa, B.fragilis
NLDTMKIKTLVAVLFLSAGATTVVAQDDANCNSNSSISHEAVKAGNFKDAYTPWKAVLENCPTLRFYTFTDGYKILKGLLGQIKDRNSAEYKKYFDELMNTHDLRMKYTQEFLGKGVKVSSEDEALGIKAVDYIAFAPKVDVNQAYDWLKKSVDAAKAESAAATLFYFLQMSHDKLKEDPAHKEQFIQDYLAASEYADDAIAAADKESVKKAFGGIKDNLVALFINSGTADCESLQGIYGPKVETNQTDLNYLKKVISIMKMMKCTDSDAYQQASFYVYKIEPSAEAATGCAYQAYKKGDIDGSVKFFDEAINLETDNAKKAEKAYAAASVLTTAKKLSQARSYAQKAISFNENYGAPYILIANLYAMSPNWSDESALNKCTYFAVIDKLQKAKSVDPSVTEEVNKMISRYSAYTPQAKDLFMLGYKAGDRITIGGWIGESTTIR

SEQ ID NO: 6057 - protein, 166 aa, B.fragilis
IISTLDESIRPFRRFVKTLKLMHMKKYLFYLSMALVAVVLFSCKSGKKSVFTPTSSGRAYEVLVVVEKPVWERPAGRALYNVLDTDVPGLPQSERSFRIMSTSPKDFDAILKLVRNIIIVDIQDIYTQPKFKYAKDVYASPQMILTIQAPDEASFEKFVEENKQPI

SEQ ID NO: 6058 - protein, 396 aa, B.fragilis
KPRTVKNCSRLFYIQPKSYFCSFRKVKKQAMTKYPYILFVLLLASFSSCQTVEQLSIDYMLPAEISFPNELKRVAVVNNVSDTPDNTLPPKDNTIKNKNELSRAVAYHEGQPALTTEALAKAIAEQNYFNEVVICDSALRARDFTPRESTLSQEEVQTLAQFLDVDCIISLENLQMKSTRVLSYIPEWNTYYGTLDTKVYPTLKIYLPGRKSPMVTINTHDSIFWEEYGNTEGFVRSRLPDERQMIREASEFAGSVPVNRILPYWKTANRYYFINGSVAMRDAAVYVKENEWEKASKLWEQAFKAAKNDKKKMRAAFNLALYYEMKDSVEEAHKWAVTAQELARKIDKIDTLKRNDIDLSEIPNYYLTSLYVNELKERSNGLGKLKGQMSRFNEDF

SEQ ID NO: 6059 - protein, 673 aa, B.fragilis
LCRTKMKSYMEKLKMESVSIAEDSLNKIAELFPNVVTESMGKDGQLHKAIDFDKLKFLLTANQAEMGVVYDDDERYELTWVGKKQAIREVAHPIRKTLRPCPEESRNWEQTQNLYIEGDNLDAMKLLKKSYAGKVDVIYIDPPYNTGKDFIFNDTFALSQEESDEKQGRYNEEGQRLFQNTEANGKFHSDWCSMMYARLMLARTLLNDNGIIFISIDDHELANLIKIGNEVFNASNFIDVFNWAKTETPENLSKKSKQIIEYIVCYQKKKNDMKFQGLKKESVSSNGLLNQPNSVGILTFPANKVVTSIPDGVIKAGMYGTDAYDVELLEDTTVRGGLFTAPVKLKAKFKWSQANLDKEIQKGTTIKIPTLKLSPSYEKLEYDPEVPPNLINYKVGVETNEQAGNHQLQFFDKKVFNFPKPVSLIQYLCEFIDTKNKDCIVMDFFSGSGTTAEAVMRMNMKPRKNKVKYILVQLPEDVTETIKKAKTPSEKEIMQNAIDFLTENHKALNICELSKERIRRAGDTIEAECNQRKLKDLPDIGFRVFRIADSNMKDVYYSAKEYSQSDLFYFTDNIKEDRTGLDLLYGCLTNLGLSLSLPHDEEDINGYTVYSVDKTELMACFAEQIPEKVFREIAGRQPRRVVFRDASFRDSADRINIDEIFKTLSPGTTIEIL

SEQ ID NO: 6060 - protein, 296 aa, B.fragilis
VNMTITVFTPTFNRATLLPRLYESLVNQTFLDFEWLIVDDGSTDDTFNFIESIKENDKIDIQYYYQNNAGKHAAINWGVELAKGDLFFIVDSDEVMIESGLQTIVDVYKQVSDNDNFAGVTGLKSFFSGKTIGGELNYTYLDCSAIDYNLKYKYGGEMAVAYRTKILQKYPFPIFEGEKYCGEGLIWYKIALHYKLRYFAHPIILTEYYPDGLTALGVNKRMESPKTTLATYSELSKMNVPFNSRIRYIINFWRFFCCDKQRGFACKLKLVNKSTILLFPLGYCLHLIDIFKTKRR

SEQ ID NO: 6061 - protein, 430 aa, B.fragilis
RKETNKFIEPAILFPQKQYLCHMNSKLRHLLLIVFSIFPILTWGTESPSTADSIRISLLTCAPGEEIYSLFGHTAIRYEEPARGIDRVYNYGLFSFNTPNFILRFALGKTDYQLGVEDYRCFAAEYEYFGRSVWQQTLNLTVEEQQQLITLLEENYRPENRIYRYNFFYDNCATRPRDKVEESLQKSGSQLLFSNAHTENGETKSYRDIVHQYTKGHPWAQFGIDFCIGSQADHPINDRQMMFAPFYLMDAFAGARIANTSDNKALVASTKKIIDCEPAVSGSAENDIWNMLTPIRLSLLVFIAIGMATVYGLRKKKSLWGLDIAVFAAAGIAGCIIAFLALFSEHPTVGSNYLLFVFHPGHLLCLPFFINDERKRRKSRYHLLNCTVLTLFIVLFPVIPQNFDLAVLPLALCLLIRSASNLILTYKKAK

SEQ ID NO: 6062 - protein, 133 aa, B.fragilis
SVYFKKQNKLPGQIIGDKMKLIQYISTTYVREELYNPDNRDLINPKSPPEFISSGGPFCHKVELEGFEPSSKRGNHKLSTCLSLPKFFVQEQNQSHQFLPYPLKFHQKRKATSDYPRCNCTTEPECFGATASE

SEQ ID NO: 6063 - protein, 264 aa, B.fragilis
IILFSYFCSRFFKRVMAQFTEEEKTIRRIEKRFNKGMVQYGLIEEGDKVLVGLSGGKDSLALVELLGKRSHIFKPRFSVVAVHVVMKNIPYQSDWDYLREHAEKNGVPLVVYETSFDPSTDTRKSPCFLCSWNRRKALFTVAKEQGCNKIALGHHMDDILETLLMNITYQGAFSTMPPRLVMNKFDMTIIRPMCLVHEADLLELAQIRGYRKQVKNCPYESQSSRSDMKGILRQLEKMNPEARYSLWGSMTNVQEELLPKEVEF

SEQ ID NO: 6064 - protein, 62 aa, B.fragilis
CAYFFAQTADRYQWITPAQKRYIHPEEGSKNEFYYLQTEHSNPYDRVSNCKLYPAFQYSEWQ

SEQ ID NO: 6065 - protein, 388 aa, B.fragilis
LVMAESNFVDYVKIYCRSGKGGRGSTHMRREKYTPNGGPDGGDGGRGGHVILRGNRNYWTLLHLRYDRHAMAGHGESGSKNRSFGKDGADKIIEVPCGTVVYNAETGEYVCDVTEHGQEVILLKGGRGGLGNWHFKTATRQAPRFAQPGEPMQEMTVILELKLLADVGLVGFPNAGKSTLLSAISAAKPKIADYPFTTLEPNLGIVSYRDGQSFVMADIPGIIEGASEGKGLGLRFLRHIERNSLLLFMIPADSDDIRKDYEVLLNELKTFNPEMLDKQRVLAITKSDMLDQELMDEIEPTLPEGIPHVFISSVSGLGISVLKDILWTELNKESNKIEAIVHRPKDVSRLQQELKDMGEDEELDYEYEDDGDEDDLDYEYEEEDWEDK

SEQ ID NO: 6066 - protein, 119 aa, B.fragilis
QYMADVKEKINLLDVIPFRSENITAEKGSDGTVTIAFPRFKYEWMRRFLLPKGMSADIHVRLEDHGTAVWELIDGKRTVRRIIEELAEHFNYEENYESRITAYITQLQKDGFVKLVIEN

SEQ ID NO: 6067 - protein, 431 aa, B.fragilis
YDMAKIQIKSEKLTPFGGIFSIMEKFDSMLSPVIDSTLGQRCSSIFGYQFSEIVRSLMSVYFCGGSCVEDVTSQLMRHLSYHPTLRTCSSDTILRAIKELTQENISYTSDQGKTYDFNTADKLNTLLINALVSTGELKEIEEYDVDFDHQFLETEKYDAKPTYKKFLGYRPGVYVIGDKIVYIENSDGNTNVRFHQADTHKRFFALLESQNIRVNRFRADCGSCSKEIVSEIEKHCKHFYIRANRCSSLYNDIFALRGWKTEEINGIQFELNSILVEKWEGKCYRLVIQRQRRNSGDLDLWEGEYTYRCILTNDYKSSTRDIVEFYNLRGGKERIFDDMNNGFGWSRLPKSFMAENTVFLLLTALIHNFYKTIMSRLDTKAFGLKKTSRIKAFVFRFISVPAKWIMTARQYVLNIYTENRAYAKPFKTEFG

SEQ ID NO: 6068 - protein, 481 aa, B.fragilis
QIHYQYLLIINIHIFSNRSVTLPSYFCTGKQQADVMNNVQQVKTYSQRKISDFLFILWAGGAALLSYSLVYALRKPYTAAGFDGLEAFGMDYKVVVTIAQILGYVLSKFIGIKLISELKRENRMKFILISIILAEASLILFGLLPAPYNIGAMFLNGLSLGCMWGIIFSFIEGRRMTDILASLLGVSMVISSGTAKSAGLYVMDTLNISEFWMPALIGGVALPLLALLGYALNRLPQPTAEDIAMKSKRETLNGKQRWELFKNFMPFLTLLFIANVVLTILRDIKEDFLVKIIDVSQYSSWMFAQVDSVVTLIILIIFGLMVFVRSNLKALSILLGLIIASMVVMAVVSFGYEQLQLNAIVWLFIQSLCLYLAFLTFQTIFFDRFIACFKIRGNVGFFIAMNDFLGYTGTVIVLAVKEFFSPDINWTAFYNLMAGYVGIICFVAFVCSFIYLHQRYRRENYGKTGVFRKKEEEKEVPDFVY

SEQ ID NO: 6069 - protein, 202 aa, B.fragilis
FINYHFNDMTGLEIWLLAIGLAMDCLAVSIASGIILRRIQWRPMLIMAFFFGLFQAIMPLLGWLGASTFSHLIESVDHWIAFAILAFLGGRMIKESFKEEDCCQRFNPASLKVVITMAVATSIDALAVGVSFAFLGIKSCSSILYPAGIIGFVSFFMSLIGLIFGIRFGCGIARKLRAELWGGIILILIGTKILIEHLFFNN

SEQ ID NO: 6070 - protein, 357 aa, B.fragilis
NISYWNFMKLLVTGAAGFIGSHVCKRLLQRGDEVVGLDNINSYYDINLKYGRLSSLGVSQSELSWYKFTRSNVYPRFSFVRMNLEDRQAMQMLFANGNFDVVINLAAQAGVRYSIENPYAYVESNIDGFLNVLEGCRHSQVKHLVYASSSSVYGLNGQVPFSEKDGIAHPVSLYAATKKSNELMAHTYSHLYNIPSTGLRFFTVYGPWGRPDMSPFLFADAILHGRPIKVFNNGNMLRDFTYIDDIVEGVLRVADSIPEGNQCWDAEVADPSMSCAPYKIYNIGNSRPVKLMDFIRAIEMSIGREADKIYLPMQPGDVYQTYADTSSLSREIGFQPNTSLEAGVKETISWYKEFYNL

SEQ ID NO: 6071 - protein, 355 aa, B.fragilis
KKILNYKGFVSGGSSETMSWLFIRKLICLHKGKIKFAYKEEQKLVLILIFPIVIRQSERVSEFSGILSVPELSTGNGELLSVTGMLPTVKTSEQKRPDKKKEKHSLVLVERNKDLCNYLVQILMKEYKIVSVCDAEAAFETVCEQCPDAVLASSVLTRISGEELAVRIKSDDRVAHIPVILLVKPGEDDRYIQRNADLYVWMPFAISSLKTEIAALIANREMIRKRYIRLALGGEASDPIDKEVESSEGDQEFIRQVRSLIEERMTDSGFKIGELSDCMNMSRSSFYNKIKEITGHAPADYVRNVRLNRALVLLMSRKYTVAEVADMTGFSDPKYFGIVFKKYYGGSPTKYINNL

SEQ ID NO: 6072 - protein, 163 aa, B.fragilis
IVAYQLTAIPDALSQFLPAFPVIFAHTILNGINRIFVDKFFQIVNLFVSCTFFAFFTFKFGVIVNTVMIEFGRGAVHANHYIFARFVACSFDSGKNRVKCIFCSFQVGSKTAFITNSCTQTTVFQYFFQSMEYFGTHAQPFFKRTCTYRTDHKLLEGYRSITV

SEQ ID NO: 6073 - protein, 319 aa, B.fragilis
LMYYLIILVLLFLAELFYFRIADKCNIIDKPNERSSHTRITLRGGGIIFYFGELAYFLTNHFEYPWFMLALSLITFISFIDDIRSTSQGLRLVFHFTAMALMFYQWGLFSLPWWTILVALIICTGIINAYNFMDGINGITGGYSLIILIALAYINRIYVPFVEPDLIYTMLCAVLVFNFFNFRKQARCFAGDVGSVSIAFVILFLIGSLIIKTENFGWLILLAVYGVDSVLTIVHRLMLHENIGLPHRKHLYQIMANELRIPHVVVSLVYMIAQIIIIIGYLYCQNYGYWYLLGCILLLSGIYIVFMHKYFHLHLLSKR

SEQ ID NO: 6074 - protein, 256 aa, B.fragilis
ILSLIFAPSNREKVNLIIDIGNTVAKVALFDRTSMVEVVYDSNQSLDSLEAVCNKYDVRKAIVATVIDLNECVLAQLNKLPVPVLWLDSHTPLPVINLYETPETLGYDRMAAVVAAHDQFPGKDILVIDAGTCITYEFVDSLGQYHGGNISPGLWMRLKALHQFTGRLPLVHAEGRMPDMGKDTETAIRAGVKKGIEYEITGYITAMKHKYPELLVFLTGGDDFSFDTKLKSVIFADRFLVLKGLNRILNYNNGRI

SEQ ID NO: 6075 - protein, 223 aa, B.fragilis
FIMYTIIVSKELKEACPVFAGAAIYAEVKNTSYCEGLWEEIQSFTEMLTATTRLEDIKKQPVIAATREAYKRCGKDPGRYRPSAEALRRRLMRGIALYQIDTLVDLINLVSLRTGHSIGGFDADKIAGTGLELGIGKINEPFEGIGRGVLNIEGLPVYRDAVGGIGTPTSDNERTKMGLETTHILAIVNGYNGKEGLQEAAEMIQTLLKKYADSDGGTITYFE

SEQ ID NO: 6076 - protein, 347 aa, B.fragilis
IYVYWTVMMNILVTGIHGFVGSNLVEALKENCIFYGLDIVSPAKEGVVTTFSWLDIEPTSFPFQTLPQFDAIIHLAGKAHDTKNQSAAQSYFDINTGLTQKIFDFFLESSAKKFIFFSSVKAAADSVVGDVLTEDVIPTPVGPYGESKIKAEEYIKNHFMFPTVSISEDRSLRLEKEKGRIPKNKQVYILRPCMIHGPGNKGNLNLLYNVVKKGIPWPLGDFDNRRSFTSIDNLCYVIEGLLNQDVLTGIYHMGDDEALSTNELIGIMCEAMGKKPHIWKMNKRVMEGCAGLGTLMHLPLNTERLRKLTENYVVSNAKIKAALGIDKLPVTAKEGLMKTIRSFEETK

SEQ ID NO: 6077 - protein, 342 aa, B.fragilis
YRDLYSSWIEALAIYVFYDKPIRCGKVTHCLSNGILFYLQYISVYLHSESKWIFMAILERKIIHEIDTSCSHIIYPQFVLPRHKHAEYEIMLFTQGSGKQFVGEGVADFQEGDIALIGSNVPHLHLCNSKLNPVANTVCSAGEALQFLPDIFPVHVENLPDYQEIYRLLRKSQYGVRFYDKGLYDEVKELFQEMDLLKHTNRLITILRILGRLTECRNIKLLSDVAYNGSNRLLEVNEPVNKVYTYLFNHFKEKVLLQEVADYVKQNPSALCRYFKQRTDKSIFQCLAEIRIEHACKLLSYSNLSVSQIAFESGFNSVPYFIKQFQSITEKTPGEYRELIGR

SEQ ID NO: 6078 - protein, 362 aa, B.fragilis
NIYHLKHINMKVLYIGYDKKLVKSGADQIDIRNLELLYDSIPYVKVLPVLETRSFYKRYLFGIDSLLIQKVFAELQTGDYQLVFVSQSLMGRISKHIKCDFPNIKIITFFHNIEKYYALELLRVSGFTHYLFYLAASYFEFQSVKYSDYLIVLNQRESNLLQKIYNKSADLILPTSFKDQCSKIENCNIRKEFVYLFVGAAFFANIQGIKWFISNVLPEVHGKLIIVGKGMDLYREEFASERVEVYGYVQNLSEYYSMASVVISPIFSGGGMKTKVAEAFMYGKVVVGTKEAFTGYVNCSGVMYECNDKYAFVKILNELFVDKTHTVFNSKAREIYLQEYSYESSYSKFSRWISPILKLLNK

SEQ ID NO: 6079 - protein, 466 aa, B.fragilis
IMNQDTICAIATAQGGAIGSIRVSGPEAITITGRIFTPAKSGKLLSEQKPYTLTFGRIYNGEEMIDEVLVSLFRAPHSYTGEDSTEITCHGSSYILQQVMQLLIKNGCRMAQPGEYTQRAFLNGKMDLSQAEAVADLIASSSAATHRLALSQMRGGFSKELTTLREKLLNFTSMIELELDFSEEDVEFADRSALRRLADEIEEVIARLANSFSVGNVIKNGVPVAIIGETNAGKSTLLNVLLNEDKAIVSDIHGTTRDVIEDTVNIGGITFRFIDTAGIRETSDTIESLGIERTFQKLDQAEIVLWMIDSADAISQLTLLSDKILPRCEHKQLILVFNKVELINETQKNELTSQFSEHIGSEIESIFISAKQRLHTDELQQRLVAAAHLPTVTQNDVIVTNVRHYEALTRALDAIHRVQEGLDANISGDFLSQDIRECIFHLSDIAGEVTNDMVLQNIFAHFCIGK

SEQ ID NO: 6080 - protein, 215 aa, B.fragilis
ISRQMNKRGFVSRILQNFRKPEGFFGRMILWGMNTGHASLAQWGMSCLQWQPEWSVLDIGCGGGANLLQILQRCPQGKAYGIDISSESVTFARKKNKKYLGTRCFIEQGGVHRLPYPDYAFDAVTAFETVYFWGNLQHAFTEVARVLKPGGSFLICCEISDPANKAWTGLVEGMEIHSCDELKAILSKSGFTDTAIFRTKKEELCLVSHRQTVRL

SEQ ID NO: 6081 - protein, 522 aa, B.fragilis
KMRQYVLLACLSPVACLMAATGQKGGKAKQKINDRQLPNVVFIYADDLGYGDLECYGAKNVQTPNVNRLAAEGIRFNNAHATAATSTPSRYSMLTGEYAWRRPGTDIAAGNAGMIIRPERYTMADMFKNAGYATAAIGKWHLGLGDKDGEQDWNAPLPTALGDIGFDYSYIMAATADRVPCVFIENGKVANYDPSAPIEVSYRKPIEGEPLGKDHPELLFNLKSSHGHDMAIVNGICRIGYMKGGGKALRKDENIADSITSHAIGFIREHNDEPFFMYLATNDVHVPRFPHDRFRGKNPMGLRGDAIVQFDWSVGQIMETLDKLGLSENTLIILSSDNGPVVDDGYQDRAEELLNGHSPAGPLRGNKYSAFEGGTRIPAIVRWPKGAASSQVSNALVSQIDWFASLASLVGAGLPKGAAPDSFNYLDTWLGKNQSDRSWVIEQASNHTLSVRTKDWKYIEPNDGPAMITWGPKIETGNLSTPQLYHVVDDVAEQKNVASLHPDLVFELQNILRHVRMKNLKP

SEQ ID NO: 6082 - protein, 83 aa, B.fragilis
VPEQQKVAQDFAMSEFSLILVLQKENKQNSNMTWQKYKLNLRNSHLLEEFFQSWRNLTPCFHPLSTQHWVRDAAVSSDISSAR

SEQ ID NO: 6083 - protein, 124 aa, B.fragilis
ASINDVHHWYRQYIRIRTSDVSVKRNIEIVGSSFSYGKRNTQNSVGTQFGFCLCSIQCQHGMINAYLVEGRHTDQMRSNDFIDVLYCFLYTLAAITMFITVAEFKRFVFTGRCTRWNGCTSHNA

SEQ ID NO: 6084 - protein, 183 aa, B.fragilis
RTINETCTMKKLIKLVLFLMVAYPLTGAILSACSEESDCSMTGRPMVYAKMYIINPETKAVLNDTLDSLSVTAFGTDSIIINNQKKVHDIALPLRYTSDSTILVFHYTRLLRDTMVILQTNTPYFQSMDCGYSMKQNIISIHPIDYTETNKKKYHSIDSLYIKSNAANINGTENLKIFYRYNR

SEQ ID NO: 6085 - protein, 81 aa, B.fragilis
ATDKKIDNIAINPKSAGETNLAITMVNIKRNACPDIFSTAFHIKLFNAANFKFLIIIYNHHLQVINNIKALIIQKYNQYLV

SEQ ID NO: 6086 - protein, 321 aa, B.fragilis
FISKMDISVVVPLFNEEESIPELFAWIERVMKANGFSYEVIFVNDGSTDRSWEIIEELQKQSSTVKGIKFRRNYGKSPALYCGFERAEGNVVITMDADLQDSPDEIPELYRMITEDGYDLVSGYKQKRYDPLSKTLPTKLFNATARKVSGIHNLHDFNCGLKAYRKAVVKNIEVYGEMHRYIPYLAKNAGFQKIGEKVVHHQARKFGKTKFGGWNRFFNGYLDLISLWFLSKFGIKPMHFFGLLGSLMFILGFISVVIVGASKLYSMNHGMPYRLVTDSPYFYLSLTAMIIGTQLFLAGFLGELISRNAPERNNYQIEKII

SEQ ID NO: 6087 - protein, 265 aa, B.fragilis
SDCKTISSGEAERNDRNLFIGGRNSRSFNATIYHIVCSVVNNAIKINWIMKKVVLIGASGFVGSAILNEALNRGFHVTAVVRHPEKIKIENENLEVKRADVSSLDEVCKVCKGADAVISAFNPGWNNPDIYKETIEVYLTIIDGVKKAGVNRFLMVGGAGSLFIAPGIRLVDSGEVPEKILPGVRALSDFYLDFLKKEKEVDWVFFSPAADMAPGVRTGRYRLGKDEMIVDMVGNSHISVEDYAAAMIDELEKPEHHQERFTIGY

SEQ ID NO: 6088 - protein, 291 aa, B.fragilis
SDGKIQYRTFNDNNLKNGKVYDVDFEAAQQTQAPTGTLVARYRPIPSLSDPKYYSHFTLSKFRNGTFQLLNYDEGDVDMGGGATWSNLLKNGARLDTGYYMMVTGTRMASGAVLANVTFFTIEEGKTTTVDLVMRESKDQVQVIGNFNSESTYLPIGTSEPQSILQTCGRGYYVVAVLGAGQEPTNHALRDIAALSGEFEKWGRKMVLLFPSEEQYKKFRPSEFPGLPSTITYGIDVDGAIQKQIAESMKLPNSTILPMFIIGDTFNRVVFVSQGYTIGLGEQLMKVIHGL

SEQ ID NO: 6089 - protein, 238 aa, B.fragilis
IKLNYSVAELRITNESYMKPTIKKVQPVKVVAPFLNSQSESPVPLDALTDQEKVSDLYFLKGTVHQIAKPYLSINNCTFKQQIFSECQFKSAQLTDVRFENCDLSNVSFAGTTFYRVEFISCKLLGTGFPEATLNHVLMDHCYGQYINLSMVKMRTARFSHCNFRNGSLNDSKLMPAAFDTCELLEADFSHTSLKGIDLRNSRIAGIQLNIADLKGAIVSSLQAIDLLPLLGVKIEDD

SEQ ID NO: 6090 - protein, 153 aa, B.fragilis
KELKDMKLSQQSQAIIESAIQKAINKYTCGCEQTIVTDIHIQPNQNSGELFIYDDEDEELSSVTIDEWTTYEGDDFYEDAERIFRTVLCRMKENGSFDKLTILKPYSFVLVDEDKETISELLLVDDDTLLVNDELLKGLDKELDDFLKDLLEK

SEQ ID NO: 6091 - protein, 411 aa, B.fragilis
KTINLDSMESIDFGTLFQGFGTMIASGWFLASARMFLIALGFLLIYLGWKGVLEPMVMIPMGLGMVAINCGTLIMPDGTLGNLFLDPMLSDTDALMNTMQIDFLQPVYTLTFSNGLIACFVFMGIGTLLDVGFLLQKPFASIFLALCAELGTFLTVPIASGLGLSLKESASVAMVGGADGPMVLFTSLALAKHLFVPITVVAYLYLGLTYGGYPYLVKLLIPKRLRAIKMVEKKAPKNYDAKVKLAFSAILCAVLCFLFPVASPLFFSLFLGVAVRESGMKHIYDFVSGPLLYGSTFMLGLLLGVLCDAHLLLDPKILKLLVLGMLALLLSGIGGIMGGYIMYFIKKGNYNPVIGIAAVSCVPTTAKVAQKLVSKDNPNSFILGDALGANISGVITSAIITGIYITIIPYL

SEQ ID NO: 6092 - protein, 510 aa, B.fragilis
TKQKSLMKNFWKKYHKWVGLFFSFFILMFCFSGIVLNHRTLFSKAEVSRNWMPESYHYKNWNNGIIKGTLRLPDGKILAYGNAGVWKTDSCFATFADFNRGLAKGIDNRKISNIVRVANNDIWCAGLYSIYLLDHDSWKEYPIAGNDERISDITQRGDTLVILTRSYLYTGVSPYDEFRKTELKTPENYSPKTSLFRTIWLLHSGELFGTPGKLAVDFLGVVLIVLSATGIIYTLLPPFIRRRHRKRLPVKTQAKALKTSLNWHNKLGTWLIGLTLLLSVTGMCLRPPLMIPFVLVNTRPVPGSTLDSDNPWHDKLRSIRWDASRNVWLLSSSMGFYRINDLQLPPVKLKQTPPVSPMGVNVFHPQSPDEWLIGSFSGLFVWNPSTGTVLDYYTGQPPAAVHGRPLGGSLVNGFTDDLVTREVIFEYDNGARNKENNLVLPAMPDLIKQQPMSLWNFCLELHVGRCYSPFLGVFSDLFVFISGLLLTLILISGYIVYKRHHKRSKKIRMH

SEQ ID NO: 6093 - protein, 642 aa, B.fragilis
RYRKIKVENSNSGKMKQKEKEIKTKYMNQKHSLPPLLKRGTGVRPYLTTNCMKTLTRFLIIPMLSVAFFSCSESHFLKDVAYRNQVTQDFEMKKQQLPNGELFAVFNEKLTIPEQEALMFLYAYMPTGDVTDYTGDYYLENVRLSDQARREMPWGKEIPDDVFRHFVLPIRVNNENLDDSRRVFYNELKDRVKNLSLHDAVLEVNHWCHEKVIYTPSDARTSSPLASVKTAYGRCGEESTFTVAALRSVGIPARQVYTPRWAHTDDNHAWVEAWVDGKWYFFGACEPEPVLNLGWFNAPASRGMLMHTKVFGRYTGQEEIMYETPNYTEINVIDNYAPTAKGSVLVTDAEGQPVADATVEFKVYNYAEFYTVATKHTDRSGHASLTAGKGDMLVWASKDGRFGYSKLSFGKDNELKITLDKNAGETYSLPLDIVPPAEGANLPEVTPEQRTENDRRMAQEDSIRNAYVATFITEEQARTFAKENKLDETETVRLLIASRGNHQTLTDFLSDAVKADKAGQAISLLKVVSAKDLRDVSPEVLNDHLNNSGLPASEDFCSNVLNPRVANEMITPYKAFFRKEIPASEAEAFRKNPQALVEWCKKEITIINELNSQRIPMSPLGVWKSPGSKQKNPVPFLCIHGP

SEQ ID NO: 6094 - protein, 431 aa, B.fragilis
RCRKGKNRFCKLTMSIIIYLLITMAFSAFFSGMEIAFVSVDKLRFEMDRKGGVSSRILSLFFRNPNDFISTMLVGNNIALVIYGILMAQIIGDNLLAGWITNHFVMVLVQTVISTLIILVTGEFLPKTLFKINPNLALNVCAVLLFICYVVLYPISKFSSGVSYLFLRLFGMKVNKEASAKAFGKVDLDYFVQSSIDNAESEETLDTEVKIFQNALDFSAVKIRDCIVPRTEVVAVALDTSLEELKGRFVESGISKIIVYDGNIDNVVGYIHSSEMFRSPKDWRDHVKEVPIVPETMAAHKLMKLFMQQKKTIAVVVDEFGGTSGIVSLEDLVEEIFGDIEDEHDNTSYICKQIGEHEYVLSARLEIEKVNETFNLELPESDDYLTVGGLILNQYQSFPKLHELVSVGKYQFKIIKVTATKIELVRLKVME

SEQ ID NO: 6095 - protein, 499 aa, B.fragilis
KKRKKVYFQLICIFELLNNNPRPFMKKKNILFFLLCFLLTSLSAQTLEQARGMYGRGQYAEAKPVFQKYVKSQPANGNYNLWYGVCCLKTGNAAEALKYLETAVKKRIPSGQLYLAQTYNDLYRFQDAVDCYEEYIADLSKRKKPTEEAEQLLEKAKGNLRMLKGVEDVCVIDSFVIDKANFLKAYKISEESGKLFTYNDYFKTKGYHPGTVYETEIGNRIYYSEQGEESLNILSKTKMLDEWSQGKPLPGSINASGNANYPYVLSDGVTIYYASDGDGSMGGYDIFVTRYNTNTDTYLVPENVGMPFNSPYNDYMYVIDEYNNLGWFASDRYQPEDKVCIYVFVPNDSKRTYNYEAMEPEKMIELAQLHSLESTWKDSKIVDDARQRLEAVINHKPAVEQNFDFEFIIDDHSTYHHLTDFKSPKAKQLYLKYEQMEKDYRQQTDKLKSQREGFARSNKDEQSKMAPAIRDLEKRVLQMSEELDKQAIEVRNAEKQNLK

SEQ ID NO: 6096 - protein, 183 aa, B.fragilis
SLLKLFLTNVVLETTDSDKHWYVVLTRTNSERKVRDYFQLQEVDTFLPVQNRVIEREGKRIERERLLLPRMVFVHISRQEMAAVRSTLNVYDFLRDRSTGAPTCIPDAQMADFRYMLDYSQDQVILTGESIPKGTRVVVAKGDLQGLRGELVRYNNKYHILVRIDMFGSAMVTIPASYVRKEK

SEQ ID NO: 6097 - protein, 498 aa, B.fragilis
DTMKANDLLSQFGDHRQRVQSAITSVCEGRGILLVDDENRENEGDLIFSAQSMTETDMAIMIRHCSGIVCLCITEEKARQLNLPLMVEQNTSKYGTAFTISIEAAEGVTTGVSAADRIQTIRTAIAPNATPESLHHPGHIFPLIARSGGIKERSGHTEGSIDLMKLAGLAPCAVLCELTNDDGTMARLPEIIEFGLEHKYPVVTINDLKEYQTAPDFLPKLVGSFSCPAAENPTTAIMEAAFRHHYMHYRYINCEVGPENLAAAIQGAKAMGWRGFNCSLPNKVEIIRYLDELGESAKIIGAVNTVVIGDDQRATGENTDGKGFVKAISEIITIQDKKIALLGAGGAARAIAVEMALAGVKEITILNRNRDKGQALADLLNSQTVATARFVLWDHPYRFSTDIDIVINATSVGLYPNVDQRLDIDTDTLLPHMVVADCIPNPVYTQLLRDAVRRGCCHVLPGMKMLVYQAVIAIKYWSGVDVDPDIMLEKLKEVVKPA

SEQ ID NO: 6098 - protein, 108 aa, B.fragilis
CKMKSLKYIVALALAAGLFQACDLERYPLTDLSEETFWNSESNAELALTSLYRGSLTDGVEYNPSDWWSYHGMIMMEHLSDNAFDRRGENNPFFKISSGNPDCRQCFY

SEQ ID NO: 6099 - protein, 306 aa, B.fragilis
FVVNIFIKLKPFNNMKKYFPSSELIINEDGSVFHLHVKPEWLADKVILVGDPGRVALVASHFENKECEVESREFKTVTGTYKGKRITVVSTGIGCDNIDIVVNELDALANIDFQTREEKEHLRSLELVRIGTCGGLQPNTPVGTFVCSEKSIGFDGLLNFYAGRNAVCDLPFERAFLNHMGWSGNMCAPAPYVIDANAELIDRIAQEDMVRGVTIAAGGFFGPQGRELRVPLADPKQNDKIEKFEYKGYKITNFEMESSALAGLSKLMGHKAMTVCMVIANRLIKEANTGYKNTIDTLIKTVLDRI

SEQ ID NO: 6100 - protein, 386 aa, B.fragilis
DKKKMNIVFVGLSGVPYARRAIDTRLLSFANLFTSSNHDVVILNRYSALKPNWEYDAQFIDDRVSVIELCNLKGIPKCMSKFLLIYTIIIEFWKLIFLNKKKKIDVLHVASGHFIDIFYYVIIARCIGAKVVYHYCEYRSSFKSRNVYHRINGKLINCYAPKFWDGAICISHFLVSKTKEVNKFIKIIQIPPICDYDYFDHIICEKEASPYLLFCGYTSYSEIIYMIIDAYNKSRIKEVASLKMVINGNPVVISEIRRYCPKMEILQNLKYTDLISMFKGALALFIPLRNTIQDIARFPNKICEYTACHGVVVTTRYGEIPYYFEDKINALIADDFNVASIAEQLDWLYDNMDQTARIKKNSYLLGRRVFNLISYKDSVTEFLKEL

SEQ ID NO: 6101 - protein, 69 aa, B.fragilis
KANESAAEAINFITPATKKPMTKVSPIMAKVDNNKLNITQYDFRLKNKMQCIPTAGKYKTHLPGIYRNG

SEQ ID NO: 6102 - protein, 300 aa, B.fragilis
IMIEQPSPKVYDELLSIWEEAVRSTHHFLTEADIQFYKPLIRHEYLAAVRLYIIREDSGTIAAFMGLSNDCIEMLFVRPNAHGHGYGSRLVEFAIRKKRIYKVDVNEQNAAALGFYLHMGFETTGRDALDATGKSFPILHLQIPPIRLRKATLEDIDLLRTLFTQSVQNTCSADYNRLQIQAWTGRGTLQRWHELFQSDLYFLLAEDSRKSQVAGFTSVNSKGYLHSMFVHPDYQRQGIASRLLLKAEEYVRIRQGVSVYSEVSITARPFFEKHGYSIEKEQTVSVGDIEMTNFLMYKRI

SEQ ID NO: 6103 - protein, 63 aa, B.fragilis
EWSECERSFMRLFNRIQASIHDIYWENQCTDHLMTDELRREEGEPLLLSVADVMEILVRKILK

SEQ ID NO: 6104 - protein, 434 aa, B.fragilis
KTRETMKIEKITGREILDSRGNPTVEVDVVLESGIMGRASVPSGASTGEHEALELRDGDKHRYGGKGVQKAVENVNKVIAPHLIGMSALDQIGIDHAMLALDGTKTKAKLGANAILGVSLAVAKAAANYLDIPLYRYIGGTNTYVLPVPMMNIINGGSHSDAPIAFQEFMIRPVGASSFKEGLRMGAEVFHALKKVLKDRGLSTAVGDEGGFAPNLEGTEDALNSILAAIKAAGYEPGKDVMIGMDCASSEFYHDGIYDYTKFEGEKGKKRTADEQIDYLEKLINEYPIDSIEDGMSENDWEGWKKLTQRIGDRCQLVGDDLFVTNVDFLAKGIEKGCANSILIKVNQIGSLTETLNAIEMAHRHGYTTVTSHRSGETEDATIADIAVATNSGQIKTGSLSRSDRMAKYNQLLRIEEELGDRAVYGYKRIVVKG

SEQ ID NO: 6105 - protein, 180 aa, B.fragilis
PVMDTIQIKDKLFTVSIREQEIQKEVIRVANEINRDLAGKNPLFLSVLNGSFMFTADLLKHITIPCEISFVKLASYQGVSSTGSIKEVIGINEDIAGRTIVIVEDIVDTGLTMQRLLETLGTRGPKEIHIASLLVKPDKLKVDLNIEYVAMNIPNDFIVGYGLDYDGFGRNYPDIYTVVD

SEQ ID NO: 6106 - protein, 158 aa, B.fragilis
QTMDVLIIIALIAAAVILFLVELFVIPGISLAGISALVCIIYANYYAFANLGTGAGFITLIISGIACIGSLVWFMRSKTLDKLALKKDITSKIDRSAAEKVKVGDTGITITRLAQIGNAEINGNIIEVKSMDGLLNEKTPIVVNRITDGIIFVEKLKS

SEQ ID NO: 6107 - protein, 175 aa, B.fragilis
KNMDWNKKIMRISLLVFTLVVGISCTVSYKFNGGNINYDKVKTISIADFPIKSDYVYAPLGTKFNEDLKDIFLRQTRLKLVNNNADLEIDGEITGYNQYNQAVSADGYSSETKLTITVNVRFVNNTNHEQDFEQQFSAFRVYDSRELLTAVQDGLIAEMTKEITDQIFNATVANW

SEQ ID NO: 6108 - protein, 355 aa, B.fragilis
NKPEMKKLIILTGLLLSTSAYAQTEVTAGVTRGKDYGVTYALPKTAINIEVKVNKVTYTPGEFSKYADRYLRLTDVSGEPQEYWELVSVKAKSVGIPDSEHTYFVKLKDKTVAPLIELTEDGIVKSINVPLSPKKSAPMQPATTQKKKINPRDFLTEEILMAGSTAKMAELVAKEIYNIRESKNALVRGQADNMPKDGEQLKIMLANLEEQEAAMTEMFSGTLNKDEKIFNIRLTPDKEMDNEVAFRFSKKLGIVANNDLAGEPVYITLKNLKTVNVPEDDGKKKVDGIAYNVPGKAQVTLTEGKKQWFNGELPVTQFGTIEYLAPALFNKKSTVQVTFNPDTGGLIKVDREEGE

SEQ ID NO: 6109 - protein, 1017 aa, B.fragilis
TEKEDTEMKLKFKHQKFQEDAAKAVCDVFGGQPYKTFDYQVETRKKDGQTSFEKFTGFRNHPIVPQLTDEIVLKHIRDIQRAQQIKPSEALEGKYNLTIEMETGVGKTYTYIKTIFELNKRYGWCKFIIVVPSVAIREGVHKSLEIMKEHFASDYSTPLSYFIYDSKQLGELNAFVTDSKIHVMIINSQKFNATNKDARRIYMKLDDFGGNCPIDVIAQMNPILIIDEPQSVEGAKTKEGLKRFNPLFTLRYSATHRELYNLVYRLDAMEAYNLQLVKKIAVKGISISGTTATEGFVYLEGLNLYPDKNPTANIGFEIKRTKAVNQVVRALKINDDLYAKSNHLEEYRNDYVITDINGVEDSVTFRNGIKLYAGDVAGSVNETQLRRIQIRETILSHIEKEQELFEKDIKVLSLFFIDEVAKYRRYNPDGKGEYAEIFEQEYTDIIKHLDPSLFNQPEYIDYLKSTVASKAHEGYFSKDKKGKLIDSKTERGTKESADEDAYDLIMKNKERLLDRKEPIRFIFSHSALREGWDNPNVFQICTLKQSSAEVRKRQEVGRGLRLCVNGQGDRMDANVLGEEVHRVNLLTVIASESYESFAKGLQTEMAEAIADRPQKVTIQLFKDQSLRLANGETIIATEDIAQSIYDSLLENKYIKKGELTDKFYEDRKQGEVIFDDELTDYKASIMTILASIYNPREMQPNDARKSKINLRLSKDKLENSKLQELLKLLCSKSTYTVKFDEKELVERAIESLNEKLRVSQLYLSVITGQMEKIKSKAALISGEAFKVDANQAHYEKIDAMANDQVKYDLLGKLTDATNLTRQAVAQILSRIKPNVFGQFKNNPEDFIIKASELINEEKACLIVKHIEYTPIDQYYDVSVFTRATIQGRLGVNTIKADKHLYDHVRFDSQNEKTFMERLEENDEIEAYVKLPGNFYIPTPMGKYHPDWAIVFKQKLSKYPYFIAETKASDSSLQDRRIEEAKIECAKKHFAKTNGGKLKYNKVSSFEELLKIVTQESV

SEQ ID NO: 6110 - protein, 416 aa, B.fragilis
SGREFSANMTKAEIQQVKLRFGIIGNTEALTRAIDVAIQVAPTDLSVLITGESGVGKESFPQIIHQYSRRKHGQYIAVNCGAIPEGTIDSELFGHEKGAFTGAIGERKGYFGEADGGTIFLDEVGELPLPTQARLLRVLESGEFIKVGSSKVQKTDVRIVAATNVNLTQAIAEGRFREDLYYRLNTVPIQIPPLRERGEDVLLLFRKFASDFAEKYRMPAIQLTEDAKRVLLSYSWPGNVRQLKNITEQISIIETNREINAPILQSYLPAQSTQRLPALFGVKTGKSFESEREILYQVLFDMRQDVTELKKLVHEIMSERGAVTSNVGTFYTPAPVVAPTPSVPAIIHPVKPNCPDDDDIQDTEEYVEESLSLDEVEKEMIRKALEKHHGKRKSAAKDLNISERTLYRKIKEYGLE

SEQ ID NO: 6111 - protein, 469 aa, B.fragilis
FLSLNITMTEQLKNKLSDSKTLRWSVLALVAFTMLCGYFLTDVMSPLKPMLEKELLWDSLDYGFFTSAYGWFNVFLLMLIFGGIILDKMGVRFTGMGACILMVLGCGLKYYAISTTFPEGALIMGFKTQVFLAALGYAIFGVGVEIAGITVSKIIVKWFKGKEMALAMGLEMATARIGTTLAMVLTVPIADYFGYTDESGSFHTNIPMPILLCLIMLCIGTIAFFIYTFYDKKLDASLDAQGEEPEEPFRMKDVMLIVTNKGFWLIALLCVLFYSAVFPFIKYATDLMVQKYNVDPKLAGNIPGLLPIGTIFLTPLFGTLYDRIGKGATLMIIGAVMLIGVHTLFALPILNVWWFATVIMIVLGIAFSLVPSAMWPSVPKIIPEKQLGTAYALIFWVQNWGLMGVPLLIGWVLNTYCKGPVVDGAQTYDYTLPMAIFACFGVLALIVALMLKAEDKKKGYGLQEANIKK

SEQ ID NO: 6112 - protein, 270 aa, B.fragilis
MISLTDDRKMLGYGLLGAYPNISHFVTTRHGGYSEGAYASFNCSPFSGDELERVEKNQTLLFQSLSQAPRHLIIPFQTHGTKILPVDEKFLGASGQQQQEMLNGIDALITTEPGCCICISTADCIPVLLYDRVHHAVAAVHAGWRGTVEYIVGHTLEKMRAVFGTEGQDVIACIGPGISLQSFEVGDEVYEAFRLNGFDMSRISFRHSVTHKYHIDLWEANRQQLLDFGVPGVQIEIADICTYIRHEDFFSARRLGIKSGRILSGIMINS

SEQ ID NO: 6113 - protein, 420 aa, B.fragilis
CEIWVYFCFMYTKKFLVFDKNTIFIILILLFWLFAPFLTIFLVLLLFCKRLSICQYKCMFLVISMSFALLAYTQKSLFYLDTDIIRYYNAYYPFIDQSFDLFSLMFVLENNLTFSFNLINVLLVCTFANVQIISIFWVFCIYYFYFLSLLKLFEHEGISISPINILLVTFISIFGFILFTQVTDTIKNAASFAIFFYAFICFICNENKLKIILLYIIGVGIHSSILMLLPLFLYKKINTQILILLFILAVLISSRINIMSLFSIILPDVGFGSLLLKKAETYSIVGDAQSSIRYIGISCVMLLSAIYLSINKLFNVSNKYMNIIFIYLIIMYLNYNNPDGYIRFANFAHFLFLFEFIQLLRDKKRYSLVIFLFIVVFIVTNFQMTYSRTLSGGYCSSYMNNSIFQILFSNVVEYLSFKAY

SEQ ID NO: 6114 - protein, 396 aa, B.fragilis
CFLCLRSTFYDILDNIFIMIRILITGDYCPRNRIDDLINLGKYQSVFEDIIPIVKGHDYSIVNLECPVVEHDDCAIKKQGPNLSSSLRAVEILKLLDFNLLTLANNHFYDYGDGGVKHTLECCKNLDLDFVGGGESLSAARAIKFKNLFGKRFAFINVCEHEFSIATQTTGGSNPLNPISNYYDIQKARATADYVIIIVHGGHEHYQLPSLRMQETYRFFIDAGADVVVNHHQHCFSGYEIYNNKYIFYGLGNFCFDNPVKRNSIWNEGYMLSLNFSDYGKIDFSLIPYIQCDQLPKVRLLKESEKAVFFDKISSLNKIIQSPDMLKDSFYAFCMTKRRLYLSLFEPYPGRYLKYIYRMGYLPSFLFSKTRLFIQNFMDCESHHDIVKEVIKINRK

SEQ ID NO: 6115 - protein, 60 aa, B.fragilis
EILWGLTDEVYKQFIDRQKTGKGATLPVFILLTNPVDWIERITLIFAIRKENCDAEGLQR

SEQ ID NO: 6116 - protein, 524 aa, B.fragilis
MKGLLTSILTVLTFTGLQAQPLPSTPKLVVGLTIDQLRTDYLEAFSTLYGDRGFRRLWKEGRVFRNAEYTFSGTDRASAIAAIYTGTTPSVNGIIGKRWMDVSTLRTVSCVDDPAFMGNYTNESSSPSHLLTSTIADELKIATRNEGLVYAIAPFRDAAILAAGHAGNGAFWLNNTTGKWCGTTYYSEFPWWVSQYNDRNAIDFRIADMTWTPVHPVQSYSFLPEWRDAAFKYKFDDDRVNKYKRLITSPFINDEINTLTEELLDKSTMGKDHVPDMLALTYYAGNYAHKSVQECAMEMQDTYVRLDRSIASLLDIIDKKVGLQNVVFFITSTGYTDTESPDLGLYRVPTSEFHLNRCAALLNMYLMATYGQGQYVEAYYDQQIYLNHKLIEEKQLNLADIQEKAAEFLIQFSGVNEVYSGKRLLLGSWTPDISMIRNSFHRKRSGDLLIDVLPGWSIVNENTSDHKVVRKAHIPSPLIFMGSGVKPAVINTPVTIDHIAPTVAHILRIRSPNACSATPITDIR

SEQ ID NO: 6117 - protein, 182 aa, B.fragilis
NCSRSNLMNLSFAAIDFETATGYMESACAVGIVTVTDGEITDEYYSLIQPPENEYWRANMLVHGITPGMTESLPGFHAIYPEVKKRLQGNVVVAHNEQFDRNVLKNTMRMYGLDYDELSLPERWECTCRIYRSLGYKPVNLSACCEREGIELKHHEALSDARGCAKLYLNFLEKYRPLSTLW

SEQ ID NO: 6118 - protein, 135 aa, B.fragilis
LLTLNQNNKMYLLLVILMVIAAILMCFIVLIQNSKGGGLASGFSSSNQIMGVRKTTDFLEKATWGLAAFMVVMSIATAYVVPTSSSKTQDVIMEQAQQEEQTNPYNLPVGTTAPKTDAAAPVEAPATETPATPAN

SEQ ID NO: 6119 - protein, 421 aa, B.fragilis
FYPRITERKTFFYYFCITLLTLRDFTNMKRHVFLLVTLFTMSTVAAQQQPIISPKDSIPSVIERVTGKENKGFSAHMNLQLYTSCAASFTENELDEVAFKLNRFKLEIIGNINRKFSYHFRQSFNKYSNPFALDNLSSSVEYAYLTYHLSDRFSITAGKQFLMLGGYEYYVNPIKVREFSEFNNYVNCFLAGVSATWNVTPTQELNFQIVNNRNGGDADTYLHGLPTDVEATKVPLISTINWNSYYLDKAIQLRYAASWGQQAKGRNIMYLTAGNVYEKGPWIAYMDFMYSRQGIDNKGIISALPRIDLENPQTAQHTEYFTTIANVDYRFHPNWNAYLKGIYESGKIYKANGIFEKGTYRRTWCGQVCVEYYPMRNSELLIFLHYQYKRNKLLKPARNLDAIDPNTQRISLGLVYSIPVF

SEQ ID NO: 6120 - protein, 898 aa, B.fragilis
QTNRMKYIIYFMMMLYGSLCHAIVCKHIVERSETNTRKVYQIQRDALGYMWFMNHAGISRFDGTKLKHYKLPAEGRTMDYYMGNCRLLTDNRNGLWVVTRNGYLWMYNPSLDKFECRNHLVIPNDVSLHFLCVDNSSHIWFSVGNRLIAYQILSNTFHRVDHSLAAISCMVEVAPGEYFVGSDEGLFGITIKNYAVDRQTGELSGKRYSRIHEILFHPYTQRLVMFDYSEGLGVWDMKSEQLVGTWNRLLNSRVSGLRIWDDRTVLVATDGEGIFRMDIVNPDITSFIQTDFENDNSIRTNRIADVFVDDQKLIWVADYPEGVSMIDVESPDDYKWYRARSGDSHSLTNNRVNAVLHDSDGDVWFATDHGISCFHPSTGLWNRIVTPLPCQMYTALCEVKPGEICAGNYVHGLFFIRKKSNYSVTPYVRISGVNALCRKDKDGFWIGTDEGVFFYCPENDSIVEVKRLSGLHIHALHQSDDCLYIGTEGNGLMVYHPEHEQMDTVAALGTGNVYAVWSDDSRRLMGSSDGFAFSLDLVQHSYYRFLSKGIRITSGTFLGNGRYILGTYQGAIEYDKQKARPLRKACLGFYLDELRVLDKEVTVETENSPLKKALNCTATLQLEHNENTFSFTATAIRYTEKQDIAYSWKLDHTDWSAPSVDNRIRFSNLPPGEYIFSVRALSIDNGRPFAQRNMHIIIRQPLWKTGGAFLCYGLLALMLGSLAVRSWFVWQDRNLSREQVRLFANTTRNLCLPLTLIKVPLEYLYEKSSSELVSNVLQQIKGVNNLLAELENISRVSAAPGRLSLADYELSIFLKETVARIRDYISEKDIMLRWTEEPAFATVCLDKDKMSAILRNLLMAFTDSMDRGDEILLSTSCNNQKWELRLESEDNGFLKKKF

SEQ ID NO: 6121 - protein, 260 aa, B.fragilis
RNGSKLVIRMISANLQQWIQHPETLNKDTLYELRTLVTRYPYFQSLRLLYLKNLYLLHDISFGAELRKAILHVADRRKLFYLIEGERYILKPRKKNALPETEVLEEEPSLDRTLSLIDAFLATVPEEVSAQTSLDYATDYTTYLLQEDDTPELEETPKLRGHELIDGFIERSEEETSIRLQPADENKAISEEEESETHHEEDEDDSCFTETLAKIYVKQHRYSKALEIIKKLSLKYPKKNAYFADQIRFLEKLIINAKSK

SEQ ID NO: 6122 - protein, 83 aa, B.fragilis
NSGSIFSNSSCCKRANRYLYGVSPIWCMGFSRTVLSICFYLNSFLLDIFKMDAIMDFLYTIISGVILFWIKIIISWSFTYNLF

SEQ ID NO: 6123 - protein, 311 aa, B.fragilis
YCERSDKDKSKMNYKRILKNQTTRLAMLRALSFIPDAIMLRLQYWIKTGHKLNLNKPQRYTEKIQSYKCFYRNPLLKVCSDKYMVRDYVASKGMAKYLNELYGIYDSAEDICFDSLPNEFVIKSTDGGGSNNIIICKNKDELNIFETIKTVNSWLKLNRKVNPGREWGYLGGRPRVIIEKLIKNINSETSLTDYKMYCFCGHVHSLFVLTDRDKGAKINFFDRNWNPLNVKSDSYPTSNQLILKPKNFDRMIEIAEVLSEDFPHVRIDLYNIDGNIIFGEMTFYSGSGYWGFVPDSFDFELGQQFDISSFI

SEQ ID NO: 6124 - protein, 144 aa, B.fragilis
GTMSLHKYSIVLLALLALLCSCHDEDKGDIPQSDERTADFIVKYKDDFGIHTDYKAKVYIYYGIYSMDIVGFHYLPDGVLDHEGKEITPDIRLSADGKEDITLLLDNAEKVTVIVESSYYEGRVGITSYSSGDTPIKGNITFGE

SEQ ID NO: 6125 - protein, 303 aa, B.fragilis
DLMRVSVVIPSYNRAKLLLETIPTYLQEDVIEVIIVDDASVDNTAEVVKKIQEKYPQVKYIRNAVNKKQTYSKNIGIKISKGDYIYLGDDDSILMPNSIRYLKETMYKYNADICGAKALYLPMEYVNKIDEYVQLNDIQLVDKNEIVDIKKIKASFNYSTALPIVVPFCQACALVKKELAIQILFDENFTGNAYREETDFFIRCTLQGAKVMYDSRAVQVNLPRQVATGGAHSRGRIKWYLSTIANNWYFLKKNWKNIQSYYKFSDNIYKRQLMFVLKNICFASKAVVKILMRNLGLLLLYVY

SEQ ID NO: 6126 - protein, 63 aa, B.fragilis
CIRSQHFRSNHFGHHYRHLYNDYTLFINHRVGDKIILGMTIENHSVVIGNPERLKSIVIHVFL

SEQ ID NO: 6127 - protein, 79 aa, B.fragilis
RMRSVMEGISKQAGQFDAGNGGLEGMKHATLLDLNGFLCDDFQEFFEGAYFIIFKLPTVCLRKMFFGTFDLCLFYSPIL

SEQ ID NO: 6128 - protein, 375 aa, B.fragilis
SRRRKLTNNKMEDNKIKIGITQGDINGVGYEVILKTFADPVMLELCTPVIYGSPKVAAYHRKSLDLPTNFSIVNTAAEAAHNRLSVVNCTDDEVKVEFSKPDPEAGKAALGALEKAIEEFREGLIDVIVTAPINKHTIQSEGFAFPGHTEYIEQRLGNGSKSLMILMKEDFRVALVTGHIPVREIASSITKELIQEKLAIFNRSLKQDFGIGAPRIAVLALNPHAGDDGLLGTEEQEIISPAIQEMAAKGILCYGPYPADGFMGSGNFTHFDGVLAMYHDQGLAPFKALAMDEGVNYTAGLPVIRTSPAHGTAYDIAGKGVACEDSFRQAIYVAIDVFRNRQREKEAHANPLRKQYYEKRDDSDKLKLDTVDDDI

SEQ ID NO: 6129 - protein, 172 aa, B.fragilis
MPGRCVLYFPAVGIHCILFFNLKSYCVMFSLLLSTFAMMGLTFVIGFFVAGVIKLIASAADSLAFYSSHQEELARLKRIRKLHQKVATLITESALSDEEYGSDGREDFSRGVTKHPGDNRGFYHGVSPGESERGLMDYFYPEDTRTMFLRKEEQMLQHDKKNNKTSSTNKKQ

SEQ ID NO: 6130 - protein, 123 aa, B.fragilis
NMKGIYAISLLVVSNIFMTFAWYGHLKLQETKIISNWPLYGVVLFSWVIALAEYSCQVPANRLGFSGNGGPFSLMQLKIIQEVITLIIFTVFSTLLFKGESLHWNHVAAFVCLIAAVYFVFMR

SEQ ID NO: 6131 - protein, 440 aa, B.fragilis
SIIMKIAIVGTGYVGLVTGTCFSEMGVDVTCVDVIESKIDNLKKGIIPIYEPGLEDMVHRNYNAGRLKFTTSLASCLDDVEVVFSAVGTPPDEDGSADLKYVLEVARTIGKTMNHYVLVVTKSTVPVGTAQQVKATIRGELDKRGLNLEFDVASNPEFLKEGDAVDDFMKPDRVVVGVESERAKSIMERLYKPFMMNNYRLIFTDIPSAEMIKYAANSMLATRISFMNDIANLCELVGANVNMVRKGIGADSRIGSKFLYPGCGYGGSCFPKDVKALIKTADKNGYSMRVLKAVEEVNNSQKSILFNKLIRYFDGNLSGKRIALWGLSFKPETDDMREAPALVLIDKILSCGGLVKAYDPIAVEECKRRIGDSIEYANDMYDAVLDADALLLVTEWKEFRMPSWGVLKKTMNRALIIDGRNIYDKKELHDMGFEYTCIGQ

SEQ ID NO: 6132 - protein, 699 aa, B.fragilis
GPSIFAVSKTKIMMKVKLALLLTLIGTLPLAAQNVRQEQDTVSYMNDDPFNLEQIVVTATRTEKKIKNTPVITQIITSKQIEERGTGNIQDLLTQEVPGLNFQEVGYGTSIDIQGLGSKHILFLIDGERIAGENGGNIDYSRINLYNIDHIEIVKGASSALYGSQAMGGVINIITRKAKKKFEASAGIRYAGRNQQNYKDTPKDHSQYKYRIHLDKPNLNTNLSLGLNLGKFTMNTDVLYKSFDGYQLFDKKPLVKYFPAYNTTITEELSKTPTSISGYEDVQVAHKMDYRFSKRLKVQLKGSYYMLNKYDFQADNIFEKSEDYTYGGSIDYTISDKSSLVASVHTDHYNRYDKYELKSGRRLEYKNNIIQPRIVYSTTALDKQTITGGLEYYRESLFSDKFETGVKENKSQWYATAFLQDDWSINKQFSVIAGLRCDYHEKYGTNLTPKASVMYKIFPFTVRFNYARGYRSPSIKELYMNWDHLGMFWIYGNSKLKPETNNYISLSGEYVNSWININANVYSNWFRNKIEGMWSNDQTELHYINIGKSRLAGVETMCKIQINRHINVHGAYNYLYTSKDADGVRLSSSSPHSGNIRAEYNTRIPRYATVVNLSGNIMGKKKFDVLDELEIDGKKVEAYYQAKVNPYCLWDLTVSQYIMQNLRITAGITNLFDYTSDRVTFNTSTSPGRNYFIACNYTL

SEQ ID NO: 6133 - protein, 392 aa, B.fragilis
FISIAKEMTIAFVYRNFPSLGGVERVIVILANEMVKQGSKVVIYSLEQGLNAYSLDSSIEIICLPQKKILESKENVNFLITHLCEYKIELLFNHDSVKDSIELCRRVKKKINIPVVTLHHGQIYLPWKSQWAILKDKYSLRVCLKKIFFPFFVLATKVRNNLHHRYNIKVCDVYVFLAECYKDQLGIDKKVMAIPNPLSSSFFFEDDCYQSKCNTVVMVGRISDFHKRIILALRIWKEIENCEQFDSWNFDIAGDGPDFYLIQDTICSLGLKRVRLLGQVNSFDVYKKAKILLLTSAFEGFPLVLNEAKQCACVPIAMDSFESVHELINNGEDGLIISNNDLNTFLEGLKYLMSHNDILREMSKKSVLNTRKYEVSRLCNIWMDLFKSIVNN

SEQ ID NO: 6134 - protein, 262 aa, B.fragilis
TLYISNQMQLTLMEQKISKYSTATIVSLLCLLFSLPLQAQQQRPGARPAVKQKAKEEIKADTIPFYNGTYVGVDLFGLGSKLLGGDFLSSEVNVRVNLKKKFIPTVEIGFGQTDTWSDTGIHYKSAAPYFRVGADYNVVKEYLYVGLRYGFSSFKYDISSTPFSDPIYGGSMANPGLIDGIWGGSVPYHYNGLKSNMQWLELVAGVNVQIYKSFYMGWTLRFKFKTAGSISEHGNPWYVPGFGEYDSSNIGITYTLIYKLPF

SEQ ID NO: 6135 - protein, 344 aa, B.fragilis
NPNIHLKSSTIMNVEPMYLTIFLIAGGIIFLVLFFHYVPFFLWLSAKVSGVNISLVQLFLMRIRNVPPYIIVPGMIEAHKAGLSNITRDELEAHYLAGGHVERVVHALVSASKANIELPFQIATAIDLAGRDVFEAVQMSVNPKVIDTPPVTAVAKDGIQLIAKARVTVRANIRQLVGGAGEDTILARVGEGIVSSIGSSENHKSVLENPDSISKLVLRKGLDAGTAFEILSIDIADIDIGKNIGAALQIDQANADKNIAQAKAEERRAMAVATEQEMKAKAEEARANVIQAEAEVPKAMAEAFRSGNLGIMDYYKMKNIQADTSMRENIAKPIGGATSKPLSD

SEQ ID NO: 6136 - protein, 245 aa, B.fragilis
SADIPLILRRLKTCLCWATKPATASLSVVGLESLQRSDKSMLRQQSNSLLNKSLSITIVFGAIVMLLLFSSCGGRNKAMADAITERDSLPVMDTRGVTTLISDSGVTRYRVNTEEWLIFDKKKPSYWAFEKGIYLEQFDSLFHIDASIKADTAYYYDRDRLWKLIGNVDIKSLKGDHVTTELLYWNEATKKVYTDKFVRMEKPDQIMTGYGFESDDQFMKPVVHNISGIVYIDEDAEKAKTDSVN

SEQ ID NO: 6137 - protein, 248 aa, B.fragilis
ITDIPMKNIFTLLILSVCFLCANISGRAQNKFSDMEVNHVRVATPGLFSKENCVMLDLKSLSRNYSFPLPGGKVISGYGTRGGHSGDDIKTCARDTIRAAFDGVVRMAKPYGAYGNVIVIRHPNGLETVYSHNVKNLVKSGDVVKAGMAIGLTGRTGRATTEHLHFETRINGQHFNPGLIFDMKKGTLRTDYLQCTKKGKGIVVKALKSEKVLPKYKTLSPFLYELPGIKKPVWNIPALARSAAYSGL

SEQ ID NO: 6138 - protein, 67 aa, B.fragilis
SVCIPKSSLYFTIKSAVRSSDCGISPLSSSWQLQSNANNANKTIEYLCKLIVPYNLLVLNMILLPNI

SEQ ID NO: 6139 - protein, 385 aa, B.fragilis
YFIFYLIILMYNLFIVVNVDWFFLSHRKDIALTAQKSGYNVTIVTKDTGKKKDIESLGLKVIDLPMNRSGQNLLEELHTCWFLYHLYRRENPDIVHHVGLKTILWGTLAAKLANIHGIVNAVSGLGIFFSEGNRSIISKLLPKVLRFSHYRNNVAVIFQNDEDKSLFLKHQIIKESQAYKIKGSGVDLKQYNYTPEPEEGKIKVLLTARMIVEKGIFILTDSAIKLRKQYQGKVQFLLCGGLDDNPMAIKESELQAVCDGKYIKWLGYRTDVLDLLKDCHIVAFPSYYKEGLPKSLIEATAIGRPIITTNSIGCKETVIDGYNGYLIPIKDSDMLASRLSFLFENKDVRQSMGRNSRKLAEKDFSIDDVIKKHLDIYRTLVIGTL

SEQ ID NO: 6140 - protein, 473 aa, B.fragilis
WSIFRITLLTVGERTILSLRFRVETLTADNAFIKRYWETSYKRIGYCNRFLVGIQNNSESEKKTRMIAEARFLRATQYFYLASYFKNVPLVENVLTGEEANNVTKTSQADILKWCVTEFTAAAADLPRFSAIPAGEAGRACKQAALAFLGRTCMLQKDWKSGAKAFHDIMELGDNAINANYQELFYPSTGTSNKENIFYIQYLENYLGTGLPQHALSAKDGGWSLVNPAADLYESYEFKDGTPFSYDDPRYDPSNLGKDRDPRLDYTIYYNGAIFMGTEYKMSPDYSAAKKEKLDYTSEASRTGFMMRKYFEESTPINDVQSANGLTPVIRYAEVLLGYLECLVEDNQTITQGILDETINAVRGRASVNMPPVTEVTPAKLREIVRHERRIELAMEGIRYWDIMRWGIAHEVLSQKIWGAPYPGSTQYATTTKEVDPTGNYRWYVGKRAFRNPTDYTWPIPQSEQNINPNLRD

SEQ ID NO: 6141 - protein, 955 aa, B.fragilis
NQLMLKSKYLFLSLICLLTSFRLHAQFMDYGSDPAKFKWNIARLPHYNLVYPQGNDSMAYRYALFLENVYPHMSKTIGKPIKAKFPVILHPGNMQSNGMVSWAPRRMELITTPSSDLNNQSWDKHLVLHESRHVFQTGKVMHGIFKPLYYIIGEQAAGVASFFLPVWFLEGDAVSTETAMSNGGRGRLPEFNMVYRAQMLGGKKNYSFDKWLMGSYKNYTGTYYALGFDMTSYARQRYGADIWDKSTSRYIRNLLFEGSFKHYTGSSFKRLQHDTFDFLRAEWEKQDTCTQSPQYLSPTKETYTSYRYPQPINDSIVITVKSGLKDINSLVIINNGREKHLDYIGSINSRLSYRNGRVYWSELVPGLRWTHQNYSIIKYYDLDKKNIKALTPRQRYLSPAIDEQGQHIAVSRPTVEGKNQLVLIQAEKGNELAAFDVPDNAFIKELTFAGGDTIISIAVADSGIRLLQFNFGNGIWKELLKTASANITSPVWKDGKIFFESGANGINNIYSLNPADGQVRRMTAARFGAFDPSFGSSDGRLFFSDYQADGYRIASLPTDSMLFEKADLNRPASMPFVETLAAQEQFNLDSARLTSVDFNPKRYRKAEHTFKIHSWAPFYYDVAEAMNSGASDLSTIVKPGATLMSQNTLNTAIMQAGWYIDKGYHHGKLSFIYQGWFPVINLSVDYGDKAFNVDWTQNDKGQDITQGHYTQRNLVEAEARVYLPFNLTHNQRIRGIQPALTYYFTNNKYQEYHSRKFHNFQYILPEILFYDYRRKAQRDILPRTGYQLRLQYLKTPFNSENYGSLYAARLTTYWPGIIRNHGLMIRVGYQYQDLDNKALYLPKHLLEKPRGYHFQYQTRQQWAFKTDYALPLLSPDWSIGSLIYIRRLRANLFYDLSRNQASSKSRWSNQSSYGGDLIFDWNVLRMSYPLTTGIRLIQPIDYGKFQVEALFSISF

SEQ ID NO: 6142 - protein, 82 aa, B.fragilis
LFIMNGLYKRSMIDLALSDSTPTTTRSGFMKSSTASPSFRNSGLEATSNSRFKPRLSNSPRIVAFTCCAVPTGTVLFVTTST

SEQ ID NO: 6143 - protein, 506 aa, B.fragilis
KFTMKIFPSSSIKKLDAYTIEHEPIASIDLMERAAQALTKAITERWDITTPVTVFAGPGNNGGDALAVARMLAEKEYKVEAYLFNPKGELSADCQTNKELVETMDNVKFSEVSTQFVPPALTMDHLVVDGLFGSGLNKPLSGGFAAVVKYINASPATVVAIDIPSGLMGEENTFNVKANIIRAQLTLSLQLPKLAFLFAENSEFVGEWKLLDINLSREAIEETESNYALLEAEEIHALIKPRNTFSHKGNFGHALLIAGSYGMAGASILAARACMRSGVGLLTVHAPIRNNDILQISVPEAIIESDASDTYFACPTDTDDYQAVGIGPGIGRSEETEAALLEQLSGCQTPLVLDADALNILANHRHALTTLPKGSILTPHPKELERMVGKCQNSYERLMKACELARTAKVHIILKGAYSAIITPSGKCYFNSTGNPGMATAGSGDVLTGVVLALLAQGYPAEEAAKIGTYVHGLAGDFARKKQGVISMTAGDIISNLPLAWRLVSE

SEQ ID NO: 6144 - protein, 717 aa, B.fragilis
IVLIKMATLQNIRSKGPLLVIVIGLALFAFIAGDAWKVLQPHQSHDVGEVNGETLSAQDYQNMVEEYTEVIKFSSGMSSLNDEQTNQVKDEVWRSYVNNKLIEKEAKKLGITVSKAEIQSIINEGVNPLLQQTPFRNPQTGAFDKDMLKKFLADYSKMDKTKMPSQYVEYYEGMHKLWSFVEKTLIQSRLAEKYQALVTKALFSNPVEAQDAFDARVNQSDVLLAAVPYSSIVDSTITVKESELKDLYNKKKEQFKQYVETRNIKYIDVQVTASAEDRAAIQQEVTDYTNQLATANGDYTTFIRSTGSEYPYVDLYYTKKAFPSDVVARMDSASIGQVYGPYYNAGDNTINSFKVLSKVAAADSVQFRQIQVYTEDAAKTKALADSIYTAIKGGADFTALAKKYGQTGESNWISSANYENAQVDGDNLKFISTINNLGVNELSNVALGQGNIILQVTDKKAVKDKYKVAVIKRAVEFSKETYNKAYNEFSQFIAANPTVDKVAANAEESGYKLLERNDLYSSEHGIGGIRGTKEALKWAFAAKPGEVSGLYECGESDRMLVVGLVSVIEEGYRPLAQVQDQLRAEIIRDKKAEKIMADMKAANATTIAQYTSMANAVSDSVKHVTFAAPAYVAALRSSEPLVGAYASVSDINKLSAPIKGNGGVFVLQVYAKDKLNETFDAQSEEATLENMHARLASRFMNDLYLKGDVKDKRYLFF

SEQ ID NO: 6145 - protein, 427 aa, B.fragilis
TIIMVGYKQTLCALLLTILLPGVAIAQNNTNSPYTRYGYGQLADQSFANSKAMGGIAYGLRDGSHINPLNPASYTAIDSLTFLFDGGFSMQNTNFSSEGTKLNAKNSSFDYIAMQFRLHQRVAMSIGLLPYSSVGYNMAKANNDVASEEARSVTSFAGDGGLHQLYVGLGVKVLKNLSVGANVSYFWGEITRQARITFPYNDNAFAFQHVDYLSVRDYKLDFGAQYTQQLGRKHAVTLGVVFSPKKDLHNEAYVQRSTLTNSNSTQAVTTNTVDTVATFGMPNSFGVGLTYEYDKRLIVGADFNLQKWGDVTYMNQPNAFCDAMKISVGAEYMPSRFSRSYLAHIKYRVGGYYSEPYYKIGGERASREYGVTAGLGLPLPGSRSLINVSAQYIKVHGLKAGMVDENTLRLSIGITFNEGWFFKRKVK

SEQ ID NO: 6146 - protein, 218 aa, B.fragilis
TKTIMNNKNKFRFAILLFGVLSAFITTACSDNNSPDDPAQGENTLPVKQVSLSRKTAYGNDWIYYSLEKGKEVSVSEESHAENTDWDIAFNRYNVRTNSGASGKGKGGALLTNIKDLAACTTVPQGTFTVDAAYTITAPGTGFPPPTMESTANEVLCKAITFAGPPPTYTPSDYVFIVRTASGKYAKLKAKSFYDDEGKSGIYSFEYAIQPDGSTNLN

SEQ ID NO: 6147 - protein, 485 aa, B.fragilis
LYMMIKNLKLAALNSLMWNAVEKMSGQALRFILTIVIARLVSPADFGLIAMLSIFLSVAQSFIDCGFYNALVQKQDRTEVDYSTMFYSNVLISVVVYFFLYWSAPYIASFYSQPELKQITRVMGVSLIISAFRIVQQAKLVIALNFRIQAVFSVIAVVVSGLIGIYMAYHQFGVWALVVQSLVSAFISTVSFWIYSRWMPLWTFSIQSFQELFSFGSKLLLAGVLHTIYSNLYTIVIGRKFSSVDLGFFSRGQTMAYFVPSNMTNIVTMAMYPILCSIQDDYVKLKKTFKVYIRLVCFIFFPIMIILAVLSEPIIKIVLTDKWLPSVFYVQILCIAYMWDPLMRINANILSVVGRTDYSLKSEIIKKVISVIVLFITIPFGIDVMCIGLALYCIIDLLVSTYYVKRIIGLGFWDEMRNIYAFFILSLVIGGVVFVVNIFVESDLLKIFIGTLVGIGLYISMCIIFRIKEVFDFWSIINSYLLQKK

SEQ ID NO: 6148 - protein, 192 aa, B.fragilis
INKMLNIVIFGAPGSGKGTQSERIVEKYGINHISTGDVLRAEIKNGTELGKTAKGYIDQGQLIPDELMVDILASVFDSFKDSKGVIFDGFPRTIPQAEALKVMLKERGQDISVMLDLDVPEEELMTRLIKRGKESGRADDNEETIKKRLVVYNTQTSPLKEYYKGEGKYQHINGLGTMEGIFEDICKAVDTL

SEQ ID NO: 6149 - protein, 157 aa, B.fragilis
FYWILLLFYTNKNRKESTNHNSFLFKMKNSLCNSVSSVVKKLLEYGEDGTPVYVNELTALNQELRNLCADLLLQKGESPEEEAEILVTLFKGYDTMLFNFSSENEQVIQELLDRSMTVLEKLPASVLKCQLLLECFEQTGDEELIREVKFTFESCGI

SEQ ID NO: 6150 - protein, 654 aa, B.fragilis
KLYFIILSLFAYSKTNFMAMAHTLDSFPDTGDLENLKDNYQKITSVLAGHQIAFWEYDIPTGECNFTDEYFHILGLKEAGIIFRDINDFYRFAHPEDVISYQTTFARMLESETKISQIVVRCVGRQGETIWLEDNFIAYKKNKENGSDKIIAYTANITSRCEKEVQIRQLEERNRKIIEALPEFIFIFDDNFFITDVLMAPDTELLHPVEVLTGADGRSIYSSEVSDLFISSIHECLKSGKLKEIEYPVDVEAGRHFFQARIAPFEGNKVLALIHDIGDRMRRSQELLEAKQRAEEADRMKSVFLANMSHEIRTPLNAIVGFSEIIALTEDEKEKEEYLGIIQQNSNLLLQLINDILDLSRIESGKSEMHCQLTEMSGLVDEVDKVHRLKMKKGVKLNVIRPSEEIWISTDRNRVTQVLFNFLSNAIKNTIEGSITFGLVKEEEWVKLYVTDTGCGISKEKLPLIFTRFEKLNDFVQGTGLGLPICKSIVERLGGRIEVESELGQGSTFILYLPNRQVQEVVVGERENAAGNMGVENRQKKILIAEDVESSYLQINAFLKKEYTILWVPNGEEAVKSFIREKPDLILMDIRMPVMNGIQATAKIRAISQEIPIIAITAYAFCPEGERALEAGCNEVIAKPYPLEKLKETIETYL

SEQ ID NO: 6151 - protein, 210 aa, B.fragilis
PDSFINFNRHKFHTKQYYLYLCALFINKMTESRSNLQKYAMHFGTYMGVYWILKFILFPLGLSIPFLLFLFFGLTLGVPFMGYYYARTYRDKVCGGSIRFLQAWVFIVFMYMFAALLTAVAHYIYFRFIDHGFIVNTYMGMFDELTNKEVPGIEGYISQLKEVMEMISRLTPIDITMQLMSQNVFYGSILAVPTALFVMRKPKSPEVQPL

SEQ ID NO: 6152 - protein, 1294 aa, B.fragilis
NFIVKIMKNAIGNCRQRKAVLFALALPLMFSGSPAQAMHRSEIVREVTQQNLKIVSAKKINPTTIEVLFSNNQRMTFDFYGENIFRVFQDNAGGIIRDPEAKPEAQILVNNPRNTVSTLNLNDGSNLISITTGKIKVEIDKNTSLMKVIDLEKNTVAFEEVEPVLFDKGKVTVTLKENPNEYFYGGGVQNGRFSHKGKAINIVNENSWTDGGVASPAPFYWSTNGYGMMWYTFKPGKYDFGADEKGKVKLTHDSPYLDLFYMVSDGAVGVLNDFYQLTGNPVLLPKFGFYQGHLNAYNRDYWKEDEKGILFEDGKRYKESQKDNGGIKESLNGEKNNYQFSARAVIDRYKNHDMPLGWLLPNDGYGAGYGQTETLDGNIQNLKSLGDYARKNGVEIGLWTQSDLHPKEGVSALLQRDIVKEVRDAGVRVLKTDVAWVGWGYSFGLNGVADVGHIMPYYGNDARPFIISLDGWAGTQRYAGIWSGDQTGGVWEYIRFHIPTYIGSGLSGQPNISSDMDGIFGGKNMIVNTRDFQWKTFTPMQLNMDGWGSNEKYPHALGEPATSINRWYLKLKSELLPYTYSFAKEAVTGMPLIRAMFLEYPNAYTLGTATQYQFMYGTDFLVAPIYKATKADAKGNDIRDGIYLPEGEWIDYFTGEKYQGNCVLNNFAAPLWKLPVFVKNGAIIPMTNPNNNVAEINKGLRIYEIYPYKHMMTVEYDDDGISEAYKEGKGTTTFIESNVDSKNNVKISIRPTQGDFDGFVKEKATEFRVNVTAKPKKVSAQIGKGKVKLTEVSSMDDFRKGENVYFYDAAPNLNKFATKGSEFEKKVITKNPQVLVKLAATDITKNQVVMDIEGFQYAPADNYRVTSGSLTAPAARIAAEDIEAYTLKPTWNKVPNADFYEIEFNGMLYTTIKDTELLFDGLAAETDYTFKIRAVNKDGYSDWAEFGAKTKANPLEFALHGIKGETTAKNQEGFDIDRLFDFAELGDMWHTKYGAKALPYDMIIDLRTVNQLDKFEYLPRTDGGNGTILKGTVYYSMDKENWTEAGAIDWKRNGDVKVFTFTERPTARYIKLAVTEGVNNYGSGRELYVFKVPGTESRLQGDINNDGKIDNNDLTSYTNYTGLRKGDSDYEGYISVGDIDQNGLIDAYDISVVATQLEDGVSEEPIEKLDGTIEISTAKRNYSKGDVVEVLVKGVNLRSVNALSFALPYNQQDYEFVGVEPLNLKAMENLTYDRLHTNGTKALYPTFVNLGAKEALEGTNDLFILKLKAKRAVKFDLKAIDGVLVDKNLNTRKF

SEQ ID NO: 6153 - protein, 349 aa, B.fragilis
IFVVNMPKYPLLGMTLTELQSVTKDLGMPAFAAKQIASWLYDKKVTSIDEMTNLSLKHRELLKGEYDLGISAPVDEMRSVDGTVKYLYQVSDNHFVEAVYIPDEDRATLCVSSQVGCKMNCKFCMTGKQGFTASLTANQILNQIAALPERDKLTNVVMMGMGEPIDNLDEVLKALHILTASYGYGWSPKRITLSSVGLRKGLQRFIEESECHLAISLHSPFPSQRSELMPAERAFSIKEMVDLLKNYDFSKQRRLSFEYIVFKGVNDSLIYAKELLKLLRGLDCRVNLIRFHAIPGVDLEGAGMETMTSFRDYLTSHGLFTTIRASRGEDIFAACGMLSTAKQEESNKN

SEQ ID NO: 6154 - protein, 75 aa, B.fragilis
NCAVQQMIPAFASLSFIVYKEREAEQMPRMEDKQQVIGAYRGVFGEKSKESDDASCDTRCRKHCDIQSPKTLFLA

SEQ ID NO: 6155 - protein, 68 aa, B.fragilis
NEEVVTTYVGAKIDNIRHIERKRGWILDILFIPERNTGDYTNFVFSECNKDNQQNLKTTSIHYGQENH

SEQ ID NO: 6156 - protein, 65 aa, B.fragilis
RTKVQIILFGMEFMPVKVNKAIRSEKKHFFFDFKYLKSRSLPVKHAKKYRSPIAGLIKIPTFAPG

SEQ ID NO: 6157 - protein, 60 aa, B.fragilis
FFLFSLFLLFFSLCKFTHLWEAEESLLIGIPFGFLPYKSVSLLLYYKTKKREERFNRLLF

SEQ ID NO: 6158 - protein, 63 aa, B.fragilis
REQFSITGNAGPYKTATHVVMEFLFGTSCRSLLFPILRCFFRSIRFYFRPSANVNPYFGIYRI

SEQ ID NO: 6159 - protein, 65 aa, B.fragilis
EVFFTSAYIAAPAKTGHASFNSFDTIMVYIINQNFIYQLFIIMPDKIRPDFMPNLRAEKKSSCRM

SEQ ID NO: 6160 - protein, 419 aa, B.fragilis
IFYSFRKETQEIILTLYFQNVTKTTNKISKQHLFIMVKKIISICAAGMIVASCSPKKTTAQPTDPSTTDSELTMLVGTYTSGNSKGIYTFRFNEETGESLPLSDAEVANPSYLIPSADGKFVYSVNEFSKDQAAVSAFAFDKEKGTLHLLNTQKTMGADPCYLTTNGKNIVTANYSGGSITVFPIGQDGALLPASDVIEFKGSGPDKERQTMPHLHCVRITPDGKYLLADDLGTDQIHKFNINPNANADNKEKFLTKGTPEAFKVAPGSGPRHLIFNSDGKFAYLINEIGGTVIAFRYADGMLDEIQTVAADTVNAQGSGDIHLSPDGKYLYASNRLKADGVAIFKVDETNGTLTKVGYQLTGIHPRNFIITPNGKYLLVACRDTNVIQIFERDQATGLLTDIKKDIKVDKPVCLKFVD

SEQ ID NO: 6161 - protein, 598 aa, B.fragilis
TMCSKIKHILLTACCFTGAGLMTSCNDGFMDRFPETSITEKVFFSSPADLETYTNGMYGYIGASYSDTPSDNMLYPEDTDIYKMMRGEYRADNIGKWSWSNIRTVNFMLARTGRVEGDRGEIDHYIGLARMFRALVYYSKVKDYSDVPWYSHDLQTTDIDLLYKPQDPRALVVDSIMADLDFAVTHMKTTKSTTRIYRDAALAVQARIALHEGTFRKYHPELKLNDGDRFLKIAVEACQKIMDTKSYSLSTTKESGLPAYQSLFCSTDLTQNPEMILVADYDKALGRLHNAQAQFDYNTGLSRSLMEDYLVVKDGHTEYFHQVEGYKTKTVLEVFENRDPRLEQTFMKPGVLNVGTTEPHRTKLNLGGYPQIKFRPLTFDQIDWGKSYTDLPIIRYAEVLLMYAEAKAELGILTQDDVNQTINLIRQRAGMPDASLDDWLANIDPVQDERYSNVQSAQKGAVLEVRRERRIELACEGFRYGDLMRWGCGKLFEAAPEGAYIPGMGYYDVTGDGQPDVAIVEKKADIDKIPEEDKQKYKLTVYALEGNTIGLTEGTKGYIYLVAQHNKYTFVSPKYYYYPVATKDITVNENLYQNPFWE

SEQ ID NO: 6162 - protein, 131 aa, B.fragilis
YSESAGSCIMPTTGFCPGSPCSPLFPLVPSTPSLPSVPSTPSLPSVPFVPSAPSLPSVPFSPSFPSVPSVPSTPSLPSVPSTPSLPSVPSMPSFPASPSGPVSPFFPLRIVIGALLEKEIVYPAPSASSSI

SEQ ID NO: 6163 - protein, 67 aa, B.fragilis
GIGPSYLVNSFKFASPNYPFLYIRSNIFFKPLRDFTSQCPPYRIDTFCYLSILESYTCWNMFIPKKM

SEQ ID NO: 6164 - protein, 296 aa, B.fragilis
DIGTFLFFYNIHQPMKTLIENLTSDLLPNQIFQTGFSFLIILKGNSLLKLDSNVLIFIMSGTMKVSSAQQELATVRERHIFFWDKEDDYTCEMLSDSQVILFAFGDLIVHDLLTFRPFGAISDSSVSKDVGLKFAEPLNSFLQLLAQYMEMNLYDLSLYIAKQRELFYILNSVYNEQELAILFSSLTEQSSRFKEQILENYLSAKNVGELASLLGYGVTNFRAKFKEQFGVSVYRWLLNRKSQHIIYRITVYGDEFSQIIDDFGFSSPSHFNKFCRSQYGLTPCELRKKLKTNNNS

SEQ ID NO: 6165 - protein, 330 aa, B.fragilis
QEVTSVISPCIIFNNRIGMNKFIYIFVAIVAISFASCTQERAKEKELKVLSWNVWHAGHAKNYPEKGCEGTIGILRKSQADVILMIETYGAAPMVADSLGYDYVLLSDNLCIYSRYPIKKTYLFPDSISTFNFGGVEIDMDGTPVRLFDTWLHYLPDMRLVPTEQSETDILAWDDAGTRDNEIRRILSVLQPMIRQTDSIPMIMGGDFNVHSHLDWTDATKDMYHHGGAVVEWTVSKEMQNAGFKDSFREIHPEPEKNIGTTWIYDNEDKPLRSDRIDFIYYQGKTIRAITSESYNQELTKPLKFMGEEFFYPSDHGFVMTTFKISPLEK

SEQ ID NO: 6166 - protein, 431 aa, B.fragilis; identical to SEQ ID NO: 6067

SEQ ID NO: 6167 - protein, 83 aa, B.fragilis; identical to SEQ ID NO: 6082

SEQ ID NO: 6168 - protein, 179 aa, B.fragilis
RTINAVYMKKHFVWLLLLFPLLLTGCYGEEDKEKDQGDYIWDFINYNIYFSVKDAAGNNLLDPQVASNILGNEITVEYGDKSFPLENSVDTRFNMPRPLGLRKEVLGEAKERVLSFGEFSPEHQYKGETFTIHWGDGTKDVVKFDLYITWKKQNPTIHKRLYLNDKEYSKDSFLIKIVK

SEQ ID NO: 6169 - protein, 92 aa, B.fragilis
NLSNISAFHFITLQNQKLFFIIKISPNHKTRELHYRKIHTFLFSPSPSDRKKEFLHIFKIQNDRIVSDHEKTSCDTYYVRFLLPSGILYQFF

SEQ ID NO: 6170 - protein, 711 aa, B.fragilis
IFYKDMNKFKWRSFLSFFLTERNIRLVRLMSFILFLFVFQGVYAQQTRINLHVKQVPLKQVLKSIESKSEYTFFYNDAEIDMNRKVTVQANNERIDVILSKILPDCKCVVENRKIILVPGAEKQNTPNDNTAKTKEITGTVTDTRGETLIGVNVTVLGTTTGVITNIDGKYSLKVPAGKSLKFSYVGYIAQTVKVGDKSVIDIVLEENSKALDEVVVVGYAVQKKVNLSGSVATVSTKAIEDRPVLNMGQALQGAVANLNVSVGDGEADDSPSYNIRGTTSLNGGSPLVVIDGVVSTSDQLNRMNPVDIANISVLKDAASSAIYGSRAAFGVILVTTKDGSNEKLTVNYNNNFVLRTNTRMPEIITDPYLVATTRNTMAYPWYNLYNEEQLAYAKKCSEDPSTSPYFLNPDGFYTYFGRTNWVDEAYNDVGFSTIHNIDISGKTDRISYYFSGGYNRQNGMFKYGNDIYNRYNLRTKLQFKLTDWWSLNSNVSLTTSDYDYANAMTNTYKQMYRKNPMDMVKNPDGTWTDASVGTLGALAEGGRATDWKTNTNINLSTKIDVIKDVFFVQGTFAFSNTKTRSNWYNLPVTYRNGPELPVLTFNPISTVSDASSSNSDTKHILFDVYGTFQKTFAKKHAVTAVVGFNQEEYKYDYVKANRKELISSSLPTINLATGDMNMSQSITTWALRGAFARLGYIYNDKYIFEFNGRL

SEQ ID NO: 6171 - protein, 511 aa, B.fragilis
LFMKKNLLYLFALICSVSLLVACNDDDPEYIQDGEFDGVYLGTLDVDAAGVIKVDDIPQKVYITKTGENQFKMELKNFSFQTMELGNISVDNIAVIKKGNSCTFSGKANLTLAVGACDVTVSGTIEDNKLDMDIAVVAAGTLNVAVDFEGTKLAADKSSEAKILTFTFANEFVTSQPVIDSENKTITFVVSDQMPEEQLKALIPEFTISEGASVDKKSGVAQDFSQPVTYTVTSEDGIVKMVYTVSVSGKEKYLSFNEWETIKSSTSGSLEQYQNPKGTYGTSNPGVMTINEMFGQVGIPSFEYCVAPVDGRVGKAAQLKTLHTAIVANGIDYNAAFGGLIPYITAGSLFTGTFKTDMFNPLNSTKFGVPFVGEPVTFTGWYKYAPGEIYYDNTNKIVEGQTDKCSIYAVLYEESLDSKGNNIPLTGDYKNKEVYIGSSSRVVMKAELSDGSAKAEWTQFSVPFKPVGDNKYDANKKYYVAVICSSSFEGDYYKGAPGSTLIVDDFSILSK

SEQ ID NO: 6172 - protein, 267 aa, B.fragilis
LLKKQMKKYKFFIAILTFSILHSISVKAQEERNKGIIWSSLRGLEYEVKAGFSIGGTSPLPLPKEIRSIDSYNPNMAIAIEGNATKWFGSDKKWGMLLGLRLENKSMTTKATVKNYNMEIIGDGGEKVSGVWTGGVKTKVKNSYLTIPILAKYKLTKRWNLTVGPYFSYMLEGDFSGNVYEGYLRKTDPTGPKVEFTDGKVATYDFSNDLRKFQWGMQLGGEWKAFKHLNVYADLSWGLNDIFKKDFKTITFAMYPIYLNLGFGYAF

SEQ ID NO: 6173 - protein, 415 aa, B.fragilis
KVYEPMTEWYSFLKLRGSYGSLGNQDVDAYAYLATMGSGKISQILDKQQPVYVGAPGLVAGNLTWEKVTTTNLALDANFFDNRLSITGEVYVRRTKDMLTPGVTLPSVLGTDVPKQNAADLKTEGWELTVGWKDQFKLAGKPFYYDVNFNLADSRAYITKYENPKGLLGDYYVGKEIGEIWGVETLGFFTSEEDIKNHADQSWCTSYPGTRPLAPGDLKFKDENKDGKITDGAWTLEDHGDYKIIGNSRARYTFGLSANAQWNGFDLSLFAQGVGKKDYYPGTGDLYFWGIYAQPWTNITKGNMYDHWTEENPDAYFPRMKAYVAENTDRECGVVQTRYLQNAAYMRLKNLTVGYTLPKVLLNKIGIERLRIFFSGDNLCEFSGLYKHYKVDPESLGDIVYPLQRSYSFGLNVTF

SEQ ID NO: 6174 - protein, 201 aa, B.fragilis
HYKEQMETAENKYITVAYKLYTTEDGKRDLVEETAAEHPFQFISGLGTTLEAFESQIVNLHKGDKFEFTIPFAEAYGEYDEEHVIDLPKNIFEIDGKFDNEHIYPGNIIPLMNSEGQRLNGSVVEVKADTVVMDMNHPLAGEDLTFVGEVTESRPATNEEIQEMIKMMTGEGGCSCGSCGDGCGDDCGDSCGDSCGCGHCH

SEQ ID NO: 6175 - protein, 460 aa, B.fragilis
NHSLIRIGYSLVKWMVYKSIFPTFVQNINLGQMTESERKQIIALIQREVIPAIGCTEPIAVALCVAKATETLGAKPEKIKVLLSANILKNAMGVGIPGTGMIGLPIAMALGALIGKSDYQLEVLKDSTPEAVEEGKKLIDEKRICISLKEDITEKLYIEVTCEAGGEQATAIISGGHTTFVYVAKGDEVLLNKQQTSGEEEEEETLELTLRKVYDFALTAPLDEIRFILETARLNKKAAEQSFQGDYGHALGKMLRGTYEHKIMGDSVFSHILSYTSAACDARMAGAMIPVMSNSGSGNQGISATLPVVVYAEENGKSEEELIRALMMSHLTVIYIKQSLGRLSALCGCVVAATGSSCGITWLMGGSYKQVAFAVQNMIANLTGMICDGAKPSCALKVTTGVSTAVLSAVMAMENRCVTSVEGIIDEDVDQSIRNLTRIGSQGMNETDRVVLDIMTHKGC

SEQ ID NO: 6176 - protein, 354 aa, B.fragilis
IRGLIAVSGLWEHLYSQAWQLVVTVCLLPILAVIFIILSYTIKCIYKMKKISILFIFSLILGLFVSEVSAAGPRLKQRPKHVVLVAFDGLSAVAIRNHPMPNFNRLMKEGASTLNNRSILPSSSAPNWASMFTGVGPELHGYTTWGSKTPEIPPFITNQYGRFPGLYGLLRDTHPKAELGYIYEWDGMKYLVDSLAINHFVHAPQTKDHPKGATQFAVNYLKEKKPMYCAVIFEYPDHTGHTYKWESKEYYEKLDELDGYLGEIVAAIEEADMMDETVIILTADHGGIGTNHGGKTLNEMETPLVFYGKGVKKNYKITESTMVIDVPATEAWLLGVEPHEAWLGNPVTTAFFTK

SEQ ID NO: 6177 - protein, 63 aa, B.fragilis
LVIFNFHSKTEQSNSFISIQTRSILRILCSKFKIKLVIERNRIKKKLIYDSNRANIIYLHHHL

SEQ ID NO: 6178 - protein, 559 aa, B.fragilis
SGSLQSSGEYSNIIITSAYADLTGLDNPWPAVSDELKSAQNNVKTIPTIGYHAGSATLSRWSLYKQIRQANEFIAYAHVIPQNGDVADFIDEKELALLKNEARFLRAYYHYLLFELYGPIPIMTEIADPSAADLDYYRNLVDEVVAFIDKELNECYDLLPEKELNPDGTINNERAAAPTKGAALAILAKLHVYAASPLFNGGYPEAIALKDNQGKQLFPAKDDTKWKTALDALQRFIDYSKGRYSLYQVMKNGEIDPAESLYQLFQVSVNNSEAVWQSSKNSWGGVNGEGRERRCTPRAIFSGFSCVGVLQEAIDDFLMSDGKSIEESGLYKEEGIGEDGIPNMYKNREPRFYQDITYSGKVWQKTDKKIYFYKGMPDDNSKADMSYSGYLLYKGMNRDLLNQGNNPKSKYRAGMLFRLADFYLLYAEALNHVNPGDARIIQYVDSVRYRAGIPLLKDIKPGIIGNRELQEKAIRHERRIELFAEGQRYFDVRRWMCAEEEGYKQGGPVHGMDMNATDLEGFMKRTAFETRIFEKRMYLYPIPLAEIQKSKKLVQNPGW

SEQ ID NO: 6179 - protein, 378 aa, B.fragilis
KRVMNKGFILKALFLLCFLFSQTAQGQSFTPGEIWPDNHQVHINAHGGGILYENGTYYWFGEHKTEGEAGNLANVGVHCYSSDDLYHWKDCGIALSVIENDPGHPISKGCILERPKVIYNPLTKKYVMWFHLEPKGAGYSGALSGIALSDRVTGPYTFLKAVRPNAGSWPINVLPIHKTTRRPSAEEERQCTGGSLPAHPDSLNILGRDMEQGQMARDMNLFVDDDGKAYHIYSSEENSTLHIAELDPTYTGYTGKYIRAFINRFMEAPAMFKKDGNYYLIMSGCSGWNPNAARSAIASSIWGEWKELGNPCIGQDADLTFHSQSTYILPVQGKKNQFIYMGDRWTPQNAIDGRYIWLPIHFEGPKPIIEWKDSWTLD

SEQ ID NO: 6180 - protein, 452 aa, B.fragilis
KQTIILKLKLMLKNHCCMGTGCRRAILFLLFFPLFGTGFAQTETPVKVDKPLKSYSHWYFGAEYGVPFLFGDFTSFSADKNYVGSQFGGFAGYQVNSWIGIEASARTGYTRMGAKSYAGDYLMNADGMTYYTNQDFNTWKYKDVFSKVHFTNIGLQMNLNVNNFFGPNRGNRRWTVLLSPAVYAQHFSTELINKADKSPLSGKKTDKWNIGIGGDVSLRYKISRAFDVQLRTGIIWVNNNKMDGISTLIKSKDHFMTSAGLSLIWKVGKKKEDNVLYASRRAADVEIRYIEERAVSLPTPACCVEDSIEKERMKREIASLNMQLQQAHTVVKEKTGSDPILGFNELPPVYFKRGSAYLNVALYKNELCRIVQTLKKYPELKVILSGHADHTGNPDINQKISLQRAEALAAYLEKKGIDGKRIAVKGECIDMLTSDPNNYSVLARRVIVEIQK

SEQ ID NO: 6181 - protein, 193 aa, B.fragilis
YFKMKENTMYSNLESVEQLFRQYYKVLRVYAFRFVNDWDIAEDVVQDVFVALWNKRTDIEFDGAVKAYLFKAVYNKSLNILSSKKYTEEESVEQFSDQIEALQILENNQENSLFMKELQSEIETFIETLPTQVKKVFILSRSYGLKIKEISVQLDLSPKTVEKYLTRALLELRTHLKNKDLMSLLFLLYLCLK

SEQ ID NO: 6182 - protein, 377 aa, B.fragilis
NPKMKTMIRKKIYLLLLLIPLLHGCKESDFNDLLDRQGDQRKELQELTDLCKKLNEDIYNLQVIVNTDRIGDNITHIEELADGAGYTISFSKSAPITIRNGKKGDTGPDGDAGKDGIDGTDGKDGVDGTDGKDGVDGTDGTDGKDGENGTDGKDGADGTNGTDGKDGVDGTDGKDGVDGTNGNKGEQGDPGQNPVVGIMQDPADSEYYWTIKIGSGEPYYLADNDGNRIKATSTVHDGQTPQLGVKQWETSAGGDDNYYWTQKIGTGPETWIEADGKKIVANAKNAVSVFEKVDLKEPDYVEFTLSGGATRFRLPIGRPVIEVPEGRKLFFFNRGGSQAIAFSCKGISKEQLSVDVPKGWRATVDSEAVASLHRRGC

SEQ ID NO: 6183 - protein, 378 aa, B.fragilis
TKRIINQKQNRMKLKNLIACFFLGFIMVSCIQDEAPNAEAAIDACKGSDDVVLTDINAEAKRISIYVYKTADITKQKLNFVLPQGATINPPSGIENDFTTPQKYTVTSEDGKWSAVYTVEFVKSELPTNYHFETLTESSANKYDIFYEFQEGTSTEPSKIVQWASGNIGYDLTGMAKESNDYPTVQVNDGKIGKCLKLETKNTGSFGAGVNMPIAAGNLFIGKFDVSNALADALKATQFGLPFYKVPQSLKGYYKFKAGDIFTENGKPVEGKKDQCDIYAIFYETDNNHEMLDGYNALTSPKLISVARIEDPKETDQWTEFNLPFIMRPGKTIDQAKLKAGKYKLSIVFSSSIEGDHFRGAVGSTLYIDEVELIFKEN

SEQ ID NO: 6184 - protein, 352 aa, B.fragilis
ISLVLLIEELKMKNEIKDINEVIIRFLDGTATGEEKVFLFNWLKQSEKNRNEFSEVRDLWLLGNTIATDDLETEIALERFKNRIQSTESGLRKNRFVFRKHFVPFLRVAAVFLMLFTVWSVFYYWGSSSVPKQPDVMNRLLTANGSKGRFVLPDSTVVWLNSNSLLEYPETFSSSAREVSLSGEAYFEVRRNEKLPFRVQAGEMKVEVLGTRFIVDNYRRKSGVEAVLVEGSVKIAGCKMNHSVVLTPGQLINYDKKSERTKVQMVNTDDYISWIQNELTFDNDKLADIIINLNKWYGVDIECPSEFAEKVFMSFSVRNGENLDEILKAMTLVAPIRYYWENGILHILPRKR

SEQ ID NO: 6185 - protein, 824 aa, B.fragilis
YDKLINMLKLFISMAALFLGVGSSVFAQIEGKVYIDANGNGICDAGERGLKGVCVQDGLNVVKTTDDGHFILPGHKDTRFVTLTVPDGYQASTSHYLSFDGTGKKYELGICKTSVNTGNGYSFVQITDTETSLYGDWIDNLKEYVKTNPTAFIIHTGDICYEAHQDFHGHYLRSVDLGIPTYYCVGNHDLRAGKYGEELWQSHFGPSWYSFDVGNVHYVVTPMLGGDHAPSYRRSDIIRWLKNDLAQTDKGKRIVLFNHDLWFWGDDLLFKDKNGEQIDFADYNLDAMIYGHWHNHYYKQLKSGLHTYCSSTPDKGGIDHGTSCFRIYNADTKGKLSSATRYTYIDGILTSAYPAEGETVSVPDGKMTVRINAYRTISDAKKVTASVERNGRLVSTVTLMPETDWGWSGAVRVSGGKQRLLVTAEFEDGTRLTKRVDYTVTKQPLSVIATSDVWAGLRGNAAHNQLVNDSVSLPLQTNWIQNVGSNIYMCSPIVAQNKVFIGTIDDDKAKKCYVKAYDATTGHLCWTFVTSNSIKNTIAYEDGRIFASDASGMLYAIDAEKGTACWQTQLPVSLLPLLDEGLAVADGVVYAGHAKGTCAVRAVDGKILWQNKAWDGGEGTTSTFTVGAGVLVASAHWNGLFGHDISNGALLWKKRDSKIRFRDGSATFYDGNFYLASCENLYVINPRSGDILKMAETSYEFNSACAPLVTDKYLIVSTSNKGVVAFDRLTFKEVWNYRTGTSLFYTVPYSHNQECTVEVSPVLVGSTVLFGASDGYLHAVDLNTGAYRGKRALGAPVFSSVAVSGNCLFVADFGGNIYNFKLHN

SEQ ID NO: 6186 - protein, 297 aa, B.fragilis
ENGFKERKQMKRIIIGMIACICAITVMAQVQTHDIKGVVFDRRQQPIVGALVTAKGTNISTITDVDGKFLLQEVPLSVKKVVVTSIGMETREVDLNVPVQLTGKRKKVSFVAHAGLSMSKYTIYGSDFKVGYEFGLGIEVRMSKRWAFQPTLQICNHGAEFNAERYGVKYQETWNPVSLDLPMLFILRCPIARKMNLAFSMGPVFSYGFAGKVKASETGKPDEEYDIYSSEYEYDYSGGKHSLLHPFSFGVAYGIGVEYKKWLAGISGKSMCLGQDDEGFEAKEHNLVLTLGVTNRN

SEQ ID NO: 6187 - protein, 85 aa, B.fragilis
TEKSFCRELWVCLMDGDSARFLIECHKIGAIASLKYFLEGKLCLSVVPLSASDTSQPERKTQESGEKNRTIDLMDKNNRRYLKKK

SEQ ID NO: 6188 - protein, 659 aa, B.fragilis
NGTPYPEQPECLAAGYHGAYHHPTHIHHAIGQPGHSAGRRGDRIHRHPGRVVGTVGNVSGNILLTANRYLTMAHGDHLKYSGKPKAGKKTFLRLISYVACDRRLLIVIGVLIVISIAANLTGSYMLRPIINDYILPGDFQGLVRILLFLAAIYLTGVAATYIEYILLNKIGQRTVTRMREELFGKMERLPVRYFDTHQHGDVMSRYTNDIDRISDALTDSLSDMLSSALTVIGIFCLMIFISPTLTAVTLITVPLMFLSAKGIVKRSRKYFKAQQEALGMMNGYAEEMISGQKVVKVFGHEQKVETDFGILNQSLKDKSLKAQFYSGLMMPVMQNLNTLNYVIITIVGALLAIFRGFDVGGLAAFLQYSRQFGRPINELASLYNSIQAAIAGAERIFEIIDEAPEKADVPEAVTLKNIKGDVALKNVYFGYRPEKTILKGVSLHAPAGKKIALVGATGAGKTTILNLLPRFFDIQSGEITIDNHPIDRIERNSLRRSMAIVLQDTHLFTGTVRENIRFGRLSATDDEVVAAARLTAAHSFIKRLPQGYDTLLENDGANLSQGQRQLLNIARAAVADPAILLLDEATSNIDTRSEILIQRGLDLLMQGRTSLIIAHRLSTIRNADTILVLEHGEIIEQGSHQELLALKGKYYSLNEEQFK

SEQ ID NO: 6189 - protein, 64 aa, B.fragilis
RISAALSVASTSPVATKGFRDQCNHRLNGRPMMEQIVKISFGEANRKKTTAKRPIHNVCCSAYS

SEQ ID NO: 6190 - protein, 574 aa, B.fragilis
MKKYWQILKKYKISLLACPLLVLVSVMCETVQPMYMADIIDNGVMQRDLSVITAVGGKMILISIVGLIFSIANVYVSSHASIGFGTDLRTGLFGKIQQLSFFDIDRFSTASLITRLTSDISRIQQVIMMSMRLMLRSPLMLVMAVFFVVRINLELAGVLLAAIPILGFSVFFILRKGFPFFLKVQQKVDQLNEVVRENLINIRVVKSFVREDFEAHKFKDKSESLRDTVIHASNIIVSIFPVMQLVMNLSIIAILWMGGHKVMTGELKVGELISFVNYLGQVLMSLMMLSMIIMSYARASASSKRILEVLDTQPSLTDTPEGMQSTREIEKGEIAFEKVSFRYGGGETDVLRNISFHIRPGETVAIAGATGSAKSSLVQLIPRLYDVSAGEIRIDGIPVQDYNLRELHARIGMVLQKNELFTGTIAENLRWGKPDATQEELEVAARAAEAHEFICSLPAGYDTLLGRGGINLSGGQKQRICIARALLRKPKILILDDSTSAVDSETELRIRNNLNAWLRDTTVLIITQRIYTMQSANRVILLDDGEIESIGTPEELLERSEMYREIYYSQQIVI

SEQ ID NO: 6191 - protein, 421 aa, B.fragilis
IIANFVSNFNSMIRILHTADWHLGQTFFGYDRTQEHEHFLDWLAGVLTKNKIDVLIVAGDVFDVSNPSAASQRMFYRFIHRVTTENPRLQLVVVAGNHDSAARLESPLPLLQEMRTEIKGIVRKQNGKIDYEHLLVELKNAAGEVEALCLAVPFLRQGDYPVVETEGNPYAEGVKELYARLLKYALKKRTDGQALVAVGHLLATGSEIAEKDHSERIIIGGLESVSPESFPEQIVYTALGHIHKAQRVSGRENIRYAGSPLPMSFAEKHYHHGVVKVTLDEGWAVEIEKLEYTPLVRLLSIPATEAAAPDEVLDELRGLELPEDEPMPYLEVKVKLSEPEPMLRQQVEEILEGKPVRLARIVSFYRQAAEGSVEEETLTAGLQEMNPLQIVKATFENSYQAEMPEELVNLFQEACRTINLE

SEQ ID NO: 6192 - protein, 380 aa, B.fragilis
TKMNKRKLLGLLCLMTLLATSCDNKGDYWGAMESSKATLTLERICDMATLSQDSVELLSNILGMNTEELYRTDVVMIGKVTSEETGFYQYPRFLIAKDREMKEVLTEAYVHRDTEGTFYAFLESNMLPVGETYYCAMVDYNYGYNGRPGLLDHVLGGNTRGERYSEVKPFRLSGLPRLVVHDAHFTGYSFYLSAEVRFKSNGGIIEQGACYSSTKRIPTVDDQKTLARETRNYDYSFLEVEVTDLLPNTHYYIRPYVTTEEGTGYGPVVEFTTEPGTEPIIDYFTMYIDTDRSVNLYATFYIDNYQITHYGYSYGIYSPETGTVTDEQKIEVPLEDNHGQQLSKVITGLRPGILYAFRVYAENGVGVTYSGYQTVKIPVE

SEQ ID NO: 6193 - protein, 996 aa, B.fragilis
SVVKANRITMKILTIRLKNLASIEGTFEIDFQAEPLRSAGIFAISGPTGAGKSTILDALCLALYDKTPRFSASVESLYMSDIGESRVNQADVKNILRRGTGEGFAEVDFLGASGHCYRSRWSVRRTGSRANGALRSQTIQVTDLTANQELQGTRKELLAQLVTLVGLTYEQFTRTVLLAQNDFATFLKSRESAKAELLEKLTGTEIYSRISSEIYLRSKTADAELNQLKSNATLIELLSEEEITLLRTEKESLTNLREQGSKALIDLNAQLSVLHTLKLQQEQRDKKVQDMRLDEEKSKKLREEYTRQSDSLIRFRGQCEAVQPDLSRARELDVQIQSLVSQSKQVEEILQGAEKAANAQANKLQSVQGALHTSCHSLKNLTGEIELPVTEETGLFLESVRNRLKEQEDQLAILQEKNEARVNRLNAFGIEAVTDEQARWMQEQTRLQNARQQMLEWRKAGTEAERLKAQQEEMGHKQEQMRKEITLLTTRLSEKEAELKVLQRLFENARIAMGKDVRTLRLNLRENEPCPVCGGTDHPYRNEEQVVHSLYQNIEQEYQTASAEYQQLNNRNIALKQDLLHLSELSGEITVQLQAFLQEAEQKRPSSEEEQNPDYFEKQLHTVQGKLNLLAEKMHQYHQLYKEWQQHEGQIRTVRSACEALREGVARCHLLMQQVLAAKEQFELLKTAETTAREQFRVVSEQLITLRQERAPLLKGKSVEDAEAAIRKKEKQLNDSVEQVRKEGEEVQSRISGMQGEIRQLNSSIDELMLRKEQIADPEHLPETIARQQATNQETERRLSTVEARLLQQEQNRKKLKQLEQELTEKQETANRWGKLNKLIGSADGTKFKVIAQSYTLNLLLMHANKHLSYLSKRYRLQQVPGTLALQVIDCDMCDEVRTVYSLSGGESFLISLALALGLSSLSSNNLKVESLFIDEGFGSLDADSLRTVMEALEQLQMQGRKIGVISHVQEMSERIAVQVQLHRAANGKSAITLTN

SEQ ID NO: 6194 - protein, 98 aa, B.fragilis
RVNDFNIQQNMITSAEEALDLSILAYNETRQRFIIGKADINSLTLSLNRQQEAQQNYISALQNYWLNYYKIRKLTLHDFATGISLTDKFDYAGGQLVR

SEQ ID NO: 6195 - protein, 363 aa, B.fragilis
RKSLITIMKTQYPSYTLCLALTMLTACSVRKKESASEKGVEPCLPDTKNEVSVMTLKKQIFNHELVSNGKISARGMADLRFESGEVIAHIWVKNGDRVRKGQKLAELDKFKLDNQLSQSEDALKKSELELRDVLISQGYPADDISQVPEETMKLAKVKSGYDQSKSQYEMSKYNAEHATLTAPFDGVVANLFSNPYNLASTSDVFCTVIDMQGMEVDFTVLESELPLIKNGDKVVIKPYSDAATVHEGSISEINPLVDDKGMVKVKARVNGAGKLFSGMNVRVSVHRSLGEQLVIPKSAVVLRSGKQVVFTLKDGKMAQWNYIHTALENADSYSVADGLTEGDTVIVSGNINLAHEAPVTIIE

SEQ ID NO: 6196 - protein, 195 aa, B.fragilis
DMELDDLKKSWNALDEHLKNKEFIEEKEIAQLLGRARNKMNSIDRFNRKLRFASIGILTLAVLFWICADTLTDLFYWIALSLCIPALCWDLYSAHYLSRTRIDEMPLVTVISRINRYHRWMVREWIIGILYLLAMATFFFFHRQVWQYGAAGIIVSLIVWAIGLGICLWVYRRNIRHIKEIKKNLNELKELNHTA

SEQ ID NO: 6197 - protein, 345 aa, B.fragilis
NIRWEAADGLETSKTSPATISTSILFLVRTPASQSRKCSCSCVRSYPKKVCPKCQSAVCSIRIMLLKFETKLAIIQDSNIILFIFAQAKTKIIMKILYYIYQICIALPILLVLTILTAVVTIVGSLLGGAHIWGYYPGKIWSQLICLFLLIPVKVHGREKLHERTSYIFVPNHQGSFDIFLIYGFLGRNFKWMMKKSLRKIPFVGKACESAGHIFVDRSGPKKVLETIRQAKDSLKDGVSLVVFPEGARSFTGHMGYFKKGAFQLADDLQLAVVPVTIDGSFEILPRTGKWIHRHRMILTIHDPIPPKGQGADNMKATMAEAYTAVESALPDKFKGMVKNEDQDR

SEQ ID NO: 6198 - protein, 390 aa, B.fragilis
ENMLQRVLGFLIVILVLPDIYIYRTFIKQLTLSLFWRILYFFPTLFLMAGVVSLAFFANYEYAEQHTLWIGRFAVVFFLFASPKLIFTICSIIGRPFNRWLHWSRKPFVATGLVLATLNAALILYGSMVGKDRFEVKEVTFRSSRLPEAFNGYRIVQLSDIHIGSWQGNAKSLQRMVDLVNAQKPDLIVFTGDLVNNRAAELDGFEEILSQLHATDGVYSILGNHDYGPYYRWKSKRDQVNNLNDLKKRQADMGWILLNNEHTLLHRGNDSIALIGVENEGEPPFSQHGDLPKAQAGTNGLFKLLLSHNPTHWRREVLPQSDIDLMLAGHTHAMQLAIGHHSPASWIYPEWGGMYMEDNRGLYVNVGMGFVGLPFRFGAWPEITVITLDK

SEQ ID NO: 6199 - protein, 180 aa, B.fragilis
PNKSNPKRRSMNLNPAHINEPVQKEFLSVIKEYERVIYKVCYLYTTRNATLGDLYQEVILNLWKAYPKFRKECKISTWIYRIALNTCISFIRKEKNVPEIVALTREADWMTEEKDELTEMLRQLYRMINQLGQLDKSIVLLYLEEKSYEEIAEITGLTVTNVATKLSRIKDKLKKMKKEE

SEQ ID NO: 6200 - protein, 1083 aa, B.fragilis
LCGRTIGAIVLTNIETMDNPSKIKTQTKASSFTLIVAFICVALIGLALIPLLPVKLNPSRTLPGFTVQFSMPGTSSRVVEIEATSKLEAMLARIKGIKNIYSTSDNGSGSITIELDKYADIDAVRFEASTIIRQTWPQLPDGVSYPYIRMKRPDENASRPFMSFTLNAPSTPILIQQYADEHIKTRLAQIQGIYKIDLSGATPMEWVLEYDSEQLRRLGITLSDIQQAVSRYYLKEFLGTYNVESSTGGKEWIRLALMPETKDEGFDASRIRVKSAEGKLISLDELVTVSHMEEAPQSYYRINGLNSIYLSITAEETANQLQLSKQVKEEMEAIQKVLPAGYEIHTSYDATEFIHEELNKIYLRTGLTVLILLFFVLIITLNPRYLFLIVVSLSINIAVAVIFYYLFGLEMQLYSLAGITVSLNLVIDNTIVMTDHILHRRNLKAFMSILAATLTTMGALVIIFFLDEKIRLNLQDFAAVVIINLAVSLFVALFFVPALIEKIGLKKRKRRRTQSRFFLLRASLPRRITVYFTRFYGWMIRKLCRWRVAVCILLILLFGLPVFMLPDKVEGEGRATEWYNKTLGSSTYKEKIKPIVDKALGGSLRLFIQKVYNGSYFTRNEEVVLYVYANLPNGSTLEQMNELIKKMEIYLSQFKEIKQFQTSVYNARRGNINIYFTKEHQNSGFPYTLKANIISKALQLGGGSWGVYGLQDQGFSNDVREGAGSFQVKMYGYNYDELYEWAEKLKAKLLTHRRIKEVIINSYFSYWKDDYQEFYFNLNRERMAQENINANILFSTIRPIYGKNMEIGSVVAENGSEKIKLSSKQSQEYDIWAMQYFPYGTDDKQYKLSELATMEKGQMPQQVAKENQQYRLCLQYEYIGSGEQGNKILKRDLEEFNKELPMGYTAQSERESWGWGKKDNKQYLLLLVVIAIIFFTTSILFNSLKQPLAIIFIIPVSYIGVFLTFYWFKLNFDQGGFASFVLLCGITVNASIYILNEYNAIRRRHPRMSALRAYTKAWNAKILPIFLTVVSTILGFIPFMVGTDKEAFWFPLAAGTIGGLVMSIIGIFFFLPVFVLKKRVGKR

SEQ ID NO: 6201 - protein, 550 aa, B.fragilis
WSIIFTGNMLVTVLYMLVYRTGIKGGRKWLRLKINNPLKEHTLDRFYDKGIDWVFSHKTLSVLFCAISFPLCIFFFYFIDKERMPDIDENELITRIEWNENIHVDENQRRVDELFRELQGASVEQTASIGLQDYILNREQELSSSEAELYFKTETSKEIAPLQEQIYQKLKERYPLAVISFSPPETVFEKLFVTGEADIVAELYARNKDRAPGPGTLRGLEQTFGQKTGIPPTGIAFENQLNLSINQEKLLLYQISYNELYRVLRTAFKENSVAMLHSYQQYLPISIAGDEKTVNQVLQETLIQTQPDSKTGEVNFIPLRELIKVTPAEDLKSITAGRNGEYIPYKFYGVENAEKLMTQVKETSSETGDWDIAFSGSFFSNQKMLDELVVILFISLLLMYFILAAQFESFMQPLLVLMEIPIDVAFALVLLWVCGHTLNLMSAIGLIVTCGIVINDSILKLDAINELRKEGVPLLEAIHEAGRRRLRPIIMTSLTTIFAMVPLLFSFDLGSELQKPLSIAMIGTMTIGTLVSLFIIPLLYWFIYRNKEKR

SEQ ID NO: 6202 - protein, 152 aa, B.fragilis
STPIANTHNDMMQNPDYFERTRSRLHPKKYRFYFFDYLYYCGDRWSKRNSRVWGSGVIFNYWTFCIWGPVAFWTRLNGIHLFSESIDVTIVFAGMLLPFVCTRLRYRKDRVSAIRHHYRRSAWRSIIPPRLVVFGWFIILLLEVIGAKLCEA

SEQ ID NO: 6203 - protein, 486 aa, B.fragilis
HRTIMIKFLIQRPIAVLMAFTACFIVGLVTYFTLPVSLLPDISIPEITVQVSAKNTSARELENTVVKPVRQQLIQVAALKDMTSETRDGAGIIRLSFDFGTNTDLAFIEVNEKIDAAMNYLPKDTDRPKVIKASATDIPVFYLNLTLKTDSAYEETDQQAFLNLCEFSESVIKRRIEQLPEVAMVDVTGLLERQLQIVPDMDKLAMLELSIEDIETALAQNNVEPGSMTVRDGYYEYNIKFSTLLRTAEDVENIYIRKGDRIIQLKEFCRIAIVPVKEKGVSVSNGKRAVTLAIIKQADENMDNMKDALSETMDYFKKIYPDIEFSVSRNQTELLDYTISNLQQNLSLGFVFICIVAVLFLGDVKSPFIIGLSMVESIVISFLFLYLCKMSLNIIYLSGLILALCMMIDSSIIVTDNISQYREKGYSLRRACVAGTSEVVTPMLSSSFTTIDVFVPLVFMSGIAGAIFYDQAFAVRVGLMVYYFHR

SEQ ID NO: 6204 - protein, 430 aa, B.fragilis
RKTIDMKKRYYIVIAALLFGASVAKAQDHIKLDLQKTIQLANDSSLEAFRTQNMYLSGYWEYRTYKANRLPSLTLNMTPAEYNRDITKRYDSEKDLDVYRSQQSFYASGNLAIQQNFDLTGGTFYLQSQLGYMRSFGGNKTTQFTSVPIRLGYSQSLVGYNSFKWERKIEPLKYEKVKKEFVYNVEAVSVQATTYFFNLAMAQAEYNLAKENMVSSDTLYSIGVQRQKIAAISKADLLTLKLDVVNARNTLQNKASALKRAMFSLVSFLNLDKNTVIDIDLPVRPQELVIPVDKALQMAHENNPQLLGLKQNVLEAERNVDKTKKESRFNASVNASIGFNQVADNFGDVYHKPMQQDLVSVSVSIPLVDWGVRKGKYNMARNNLNVVKTSARQDEISLDEEVIMTCERFQYSTEYDHQCRRSTRPLYPGL

SEQ ID NO: 6205 - protein, 161 aa, B.fragilis
QMEVPLVDKDYLLERTPGNGGWTYAPIPEVPQDKKAPFGWVKVKGSIDGVEIKKHHLMPMGNGELGLSVKAEIRKKIKKQAGDYVHVVLYLDEEPSEIPEELQLCLQDEPRALEFFNSLAENERHNYVKWIYSAKTDRAKVARMAKAIDRLASNLKYYDKG

SEQ ID NO: 6206 - protein, 389 aa, B.fragilis
INSSLFMKVLVTGAKGFVGRNLVSQLRNIQSGKAKNYALSGNELIIFEYDVDSDPSELDDYCRQADFIFNLAGVNRPLDQSEFMKGNFGFASTLLASLKRHGNTCPIMISSSTQAALDNPYGASKRAGEQLLFEYSRETGSKVLVYRFPNVFGKWCRPNYNSAIATFCYNIAHDLLIQVNDPNVEMNLVYIDDVVDELISALMGNEHREGAYCKVSAVYTVTLGAIVELLYSFRENRNNLGVPHVGDAFTKKLYSTYLSYLPKDGFGYPLKMNVDARGSFTEIIRSTDRGQFSVNISKPHITKGNHWHHTKNEKFVVVSGQGVIRFRNMYDSSSEILEYFVSGDKLEIIDIPTGYTHNIENLGDTDMVTFMWCNECFDPGRPDTYFEEV

SEQ ID NO: 6207 - protein, 66 aa, B.fragilis
RQISKIYKQSQLHSYHLKKTISPGARHQAHTLKHKIIRKASSLKYHLYLSNNNYYIIFLIQSSWKN

SEQ ID NO: 6208 - protein, 632 aa, B.fragilis
SNGFKDKSCFPKNEYTMMDSHDTNQPLKQGELEEEKKAVEVSEEITETPAEETIVEKPTENASKLSTKEEVLLRLKEVAQDAENANKQELDGLKQTFYKIHNAEIEAAKKTFVENGGAEEEFIAQPSGVEEEFKSLMAAIKEKRSALAAEIEKQKEENLQVKLSIIEELKELVESPDDANKSYNEFKKLQQQWNEVKLVPQAKVNELWKNYQLHVEKFYDILKLNNEFREYDFRKNLEIKTHLCEAAEKLADEQDVVSAFHQLQKLHQEFRDTGPVAKELRDEIWNRFKAASTAVNRRHQQHFEALKETEQHNLDQKTVICEIVEAIEFDQLKTFAAWETKTQEVIALQNKWKTIGFAPQKMNVKIFERFRKACDEFFKKKGEFFKLLKEGMNANLEKKKALCEKAESLKDSTEWKETAEILTKLQKEWKTIGPVSKKYSDAVWKRFITACDYFFEQKGKATSSQRSVEQENLEKKKAIIARLTAIDETTDADEASKEVRELMKEWNGIGHVPFKEKDRLYKQYHGLIDQLFDRFNISASNKKLSNFKSSIGNIQSGGSQSLYREREKLVRTYENMKNELQTYENNLGFLTTSSKKGNSLLTEINRKVEKLKSDLELVLQKIKVIDESIKEE

SEQ ID NO: 6209 - protein, 113 aa, B.fragilis
GGTSMRQGVVYLNKERVGIITELSSNEYKFRYDDEYFNDPSKPSISLTLTKQQQEYTSHYLFPFFANMLSEGHNRIVQARLLQIDEKDDFGILLATAHTDTAGAVTIKPLDYD

SEQ ID NO: 6210 - protein, 343 aa, B.fragilis
SIMSLFKDKSLLITGGTGSFGNAVLRRFLDSDIREIRIFSRDEKKQDDMRHYLQNPKVKFYIGDVRDKRSVDGVMNGVDYIFHAAALKQVPSCEFFPTQAVRTNVLGTENVLDSAIAHGVKNVVVLSTDKAAYPINAMGISKAMMEKVAIAKGRQLGNCGGTTICCTRYGNVMASRGSVIPLWVEQIKKCNPITITDPNMTRFMMTLDDAVDLVIYAFQHGKNGDLFVQKAPAATLDVLADALKSLYHSNADVKVIGTRHGEKLYETLVTREEMSKAEDMGDYYRIPCDTRDLNYDKFFVEGSEEVSKIEDYHSHNTRRLDVEGMKELLLKLDFIREDLGLEK

SEQ ID NO: 6211 - protein, 414 aa, B.fragilis
TKSSGENPDNIEMNILFLTLNRVSDLSERGIYTDLMREFICHGHRVYMVVPAERRFHESTSIKESCGAQMLRVKTLNIQKSNVVEKGIGTLLLEMQYQCAIKRYWKDIRFDLILYSTPPITFNRVISSQKRRCKAKSYLLLKDIFPQNAVDLGMFSKRSLIYRLFRKKEKDLYQISDFIGCMSPANVDYVLTHNPEIKADRVEICPNSIKLLEKSLMASTVRKNILQKLHIPINKTLFIYGGNLGRPQGLIFLLDVIAANEERNDSYFIIVGSGTEYGKIKSWFEANHPDNSMLLSSLPKKEYDDLVKACDVGLIFLDRRFTIPNYPSRLLSYLENRMPVLLATDLNTDIGRIAERNGYGFWTENGNLDTFMEMVDSLSADREKIKVMGEKGYEYLKSNYTVERGYRMIMKHFE

SEQ ID NO: 6212 - protein, 60 aa, B.fragilis
LHLLELQQLQNLVWKPLLLYLNDLDESYPHSFQHKLFYIFPSYIEFIRKNKQEVLVITIY

SEQ ID NO: 6213 - protein, 162 aa, B.fragilis
RISPLSSPQRGGRRAEGGFCLSPDTGIRLQYNDAQLLGTDGHAKEIEHYRHRGSKLHTQAVGLWEEGNDGMETDCQHLLERHRSQRKIPDSGAKQDEKKVAESVSPLFVVDKKANIQAFDQKGIQRNKEVKSVLNELKHSVFKAQDFSRPKLCFNATLKLVL

SEQ ID NO: 6214 - protein, 61 aa, B.fragilis
ECLPKDRNLFSFGNGVNIVSLIDSVKMIFRLNLVLVLPFGKSLLALYELFWGECRCGYQIL

SEQ ID NO: 6215 - protein, 98 aa, B.fragilis
  UNSURE (19): Identity of amino acid sequences at the above locations are unknown.
KAATATASLPLNGIHTRSXRSWYTFILKGIDNVGLLNEITQVISRQLNVNIRKLDMETDDGIFEGKVGLYVHDVEDVKAICNNLRKIPNIKSVTRVEN

SEQ ID NO: 6216 - protein, 387 aa, B.fragilis
NSNTMLKSKYKIYLLLLCLTGCVSEYNAQLPSSDEELLVVTGDIIANTEAIFSLSKSIPLSEDMPEDYRNIYARIAVVGSDGYRSDFGTALGDGKYQVSIGELQDDVSYGIEIEYDGEIYTSSPSTPMVSSEIDSVSWIQPEPEQALSIRVSTHGDPGKTQYYMWNYREDWEIRASYITTCYFDPDMNRIYEDSNYPTFYCWKKEISRNILIGSTEKLKEHLIINNKLLDVPVNEDRFTVLYSIQVQQRALSKEGYEYYLNVQQQNEEMGGIFTPQPSEIQGNISCISQPGRRTIGYVGVYKNISEKRIYIHPNEIKRPPLYSGCEEVSDSEMDEQGYSTYLIRYLVGYRPVGTGTHIDHWALRRCTECEANGGSKNKPSFWPNDHQ

SEQ ID NO: 6217 - protein, 121 aa, B.fragilis
LRNTLQTKRNLCHSKIKSTNSRNQIHNILGISLLIKQILSIFVSNSQYIGNMKQIGIQIRQRRKMLGINQQTLADLAQISINTITKIENGEININFQKLYAILEVLGLELSLKIKNKEGHL

SEQ ID NO: 6218 - protein, 681 aa, B.fragilis
  UNSURE (363),(629): Identity of amino acid sequences at the above locations are unknown.
IMDTENQKEIAEEQMIEQAFQELLNDYLATKHRKRIEIITKAFNFANQAHKGIKRRSGEPYIMHPIAVAKIVCNEIGLGSTSICAALLHDVVEDTDYTVEDIENIFGAKIAQIVDGLTKISGGIFGDRASAQAENFKKLLLTMSDDIRVILIKIADRLHNMRTLGSMLPNKQYKIAGETLYIYAPLANRLGLYKIKTELENLSFKYEHPEEYQEIEEKLNATAAERDKVFNEFTAPIREQLDKMGLKYRILARVKSIYSIWNKMQTKHVPFEEIYDLLAVRIIFEPRNIDEELNDCFDIYVSISKIYKPHPDRLRDWVSHPKANGYQALHVTLMGNNGQWIEVQIRSERMNDVAEQGFAAHWXYKERGGSEDESELEKWLRTIKEILDDPQPDAIDFLDTIKLNLFASEIFVFTPKGELKTMPQNSTALDFAFSLHTDIGSHCIGAKVNHKLVPLSHKLQSGDQVEILTSKSQRVQPQWEVFATTARARAKIAAILRKERKTFQKEGEELLNEFFKKEEIRPEAAVIEKLCKLHNMKNEEEFLVAIGNKTIVLGDADKNELKEKQSSNWMKYLTFSFGNNKDKQQEEKEPQEKEKINTKQILKLTEDALQKKYIMAECCHPIPGDDVLXYMDENDRIIIHKRQCPVAAKLKSSYGNRIIATEWDTHKKLSFLVYIYIKRNR

SEQ ID NO: 6219 - protein, 295 aa, B.fragilis
SKKTNMAIAYDGINYFPVGVNFMEENAMEVIEAKYGIKGSAIVLKLMCKIYKEGYYIRWDEEQCLIFANKAGREVQAEEVQGIIEILFTKGILDRNSYQENGILTSESIQKVWMEATKRRKRELSELPYLMVKPEKENGKADTPPALQEIQQPELFKKEKTPVNPKNVVHHVAVDAKNACNSGQSKVKEKKAEENKEFPPSAPPKGEEEERKGDSAYLPIPGYAFNTMTHNYSGLMDTLKRLSITDTGEVNSILRLSDYGRKGTTVWKLIANTCWSDIGAKGRYLIAALNKTKRR

SEQ ID NO: 6220 - protein, 121 aa, B.fragilis
TTKTNNKKKKKEFKKNKTGNKQISDNRDLKSNRGRKKEKPIQGIVLKHYECLKLLITLYQDGAMGIKKETSQVALARYIDDKKLLGNIRNGIFIPLKFSTILKETNTIWNEMLRDKSIGIK

SEQ ID NO: 6221 - protein, 119 aa, B.fragilis
MNETKVLIEKITEGIQEKKGKNIVIADLTNIDDTICKYFVICQGNSPSQVIAIVDSIKEFTRKGAGTKPSAIDGQRNAEWVAMDFSDVLVHVFLPEARNFYNLEHLWADAKLTTIPDID

SEQ ID NO: 6222 - protein, 74 aa, B.fragilis
NLSTMIELTCCPSTLQKGFSTYSPVALKELFNSQKVNHILPYNGMDNNETEQKEFQDNNKHMSISGAQQNKSSQ

SEQ ID NO: 6223 - protein, 367 aa, B.fragilis
LISAMEHPENNEAYKGLVVNAGIEQPSSVNPYLKRKVKKRQLSVSEFVEGIVKGDVTILSQAVTLVESVRPEHQATAQEVIEKCLPYSGNSIRVGISGVPGAGKSTSIDVFGLHVLEKGGKLAVLAIDPSSERSKGSILGDKTRMEQLSVHPKSFIRPSPSAGSLGGVARKTRETIILCEAAGFDKIFVETVGVGQSETAVHSMVDFFLLIQLAGTGDELQGIKRGIMEMADGIVINKADGSNIDKAKLAAAQFRNALHLFPAPDSGWTPRVLTYSGFYNLGVKEIWDMVYEYIDFVKGNGYFEYRRNEQSKYWMYESINEQLRDSFYHNAKIESMLQEKEQQVLRGNLTSFVAAKSLLDTYFEDLK

SEQ ID NO: 6224 - protein, 401 aa, B.fragilis
LLYANQRNFRINTWYKSIKKMISPKFFIDSLSDRQIDFFSGVPDSLLKNICAYIADNKDAKHNIITANEGAAVGLAVGHYLATREIPVVYMQNSGEGNIINPLASLTDKEVYNIPILLLIGWRGEPGVHDEPQHVKQGKVTIPLLDVMGIKNTVMSKSEVDFTKQLDDALVYMRETNEAFALIIEKDTFESYSLKLKEDSVLQQLSMSRENAIQMVVDSIGKKDVIVSTTGMISRELFEYRTKMNESHQSDFLTVGSMGHASQIALGIALEIPDRKIYCFDGDGAVIMHMGSMAIIGDKGPENLIHVVFNNGSHDSVGGQPTVGLKINIPAIARAVGYKVVYSVDCEEALKTALEKVIKEAGPILLEVKVKKGNRKDLGRPSITPIQNKLSFMTFLNNEKK

SEQ ID NO: 6225 - protein, 419 aa, B.fragilis
KSFYMEQITEKINDLFVSWGFDSSEVGPIMTLVLIIGIAFLADLICRNILLRVVAKLVKKTKATWDDIVFDRKVLIYLSHLVPPIIIYVLIPLAIPNVSALDFIRRICMIYIIAVFLRFISAFLSAVYHVYSEREQFRDRPLKGLLQTAQVILFFIGGIVVISVLIDKSPMVLLTGLGASAAILMLVFKDSIMGFVSGIQLSANNMLKVGDWIAMPKYGADGTVIEVTLNTVKVRNWDNTITTIPPYLLVSDSFQNWRGMQESGGRRVKRSINIDMNSVRFCTPEMLAKYKKIQLLTDYVEQTEQVVKEYNKEHHIDNSILVNGRRQTNLGVFRAYLTNYLKSLPDVNKNLTCMVRYLQPTEQGIPVELYFFSAVKEWVPYEGIQADVFDHLLAIVPEFGLRVFQNPTGEDFREWNRRN

SEQ ID NO: 6226 - protein, 279 aa, B.fragilis
AKFLFFSRRSEDLSLISLPINLDNMGKIIALANQKGGVGKTTTTINLAASLATLEKKVLVVDADPQANASSGLGVDIKQSECTIYECIIDRANVQDAIHDTEIDSLKVISSHINLVGAEIEMLNLKNREKILKEVLTPLKEEYDYILIDCSPSLGLITINALTAADSVIIPVQAEYFALEGISKLLNTIKIIKSKLNPALEIEGFLLTMYDSRLRQANQIYDEVKRHFQELVFKTVIQRNVKLSEAPSYGLPTILYDAESTGAKNHLALAKELISRNSK

SEQ ID NO: 6227 - protein, 204 aa, B.fragilis
VGMYQYVIKRLIDFVVVFFVLIIIWPVLLLVTLWLHFANKGAGTFFLQERPGRHGKIFKVIKFKTMTDERDAEGNLLPDDKRLTKVGKFVRSTSIDELPQLINILKGDMSFIGPRPLLPQYLPLYNKEQARRHEVRPGITGWAQVNGRNAISWVRKFELDVWYVDHCSFFLDLKIFFLTIKKVFVREGISSDTSVTMEPFTGNN

SEQ ID NO: 6228 - protein, 355 aa, B.fragilis
SSMQIFCTLFNVAYLDKAITMYNSLERVSSEFTLYALAMDDRCYEILVDLNFRNLKPIKLSDFEDDDLLKVKSDRTFGEYCWTCSSSLISYVLHEYCEPHCTYIDADIYFFSDPIVLMNEMLHKNASVLIVGHRFNDYNRDLMCRTVGKYCVQYNTFLNDENGNILLEIWRRQCITHCSCDGDGVYWGDQKYMDNWTTDYDFVHETLNVGAGIAPWNISQYKLRLINDSGCVIVSRNKVDCSTVFYHFENINYINDKIVKINVFNTWHIDKELVKAFYIPYLTEVYDIKLMLKERYAVNILLKKHPGVKCDKRTFVQKIIDRLSYLIDKEKQKLYIMSVLPTRLYKKNDVIIIIG

SEQ ID NO: 6229 - protein, 508 aa, B.fragilis
LIVNEMSDNKRIAVNTLIIYARMAVTTIISLIATRYVLLELGQADYGLYNVVGGIVTMLNVVSIGMYMTTQRFINVEMGKGPNGNLNKVFNVCIVLHIGFALSIFIIGLTVGLWYIYNILNVLPEKLSDAVLIYFISTTVSAIGIINIPFQGLMLAFEKFKKMAIIDLLSNFMKVPLVILLMCWSGNKLLFYAIGVCFISLFSFLFYYSYCYRKFGDIVKWHLSREKYIYKEILVFNNYTSIGTIAYLSRTQGASVVINYFFGIIVNGAFAIVFQIENFIMMFVNNLGTASDPQITQSYASGNYRDAFSLVEKISKYSMFIMLLVTFSIGVELEFLLRLWLGTLPEGILVLSRWMLVSLLVRSINSSCGSIIQASGHVKWFQIISSVLLLLGLPISWLLYKWGMPPVTIIITFTVTDFISRMIYLWLMHRIIKFDVLHFSKKVFLPVIKVLCLSGLYLYLYNSIMLQTDFMRVMGIGVSCMFYVCLCLFVGMNRLERNSIFFYIKNKI

SEQ ID NO: 6230 - protein, 345 aa, B.fragilis
HLTKTRPMAISLKDNLTSSYFNAAHKLYSKKARRRIVAYVESYDDVAFWRTLLEEFEDEEHYFQVMLPSATSLAKGKKMVLMNTLNTAELGKSLIACVDSDYDFLLQGATATSRKINRNRYIFQTYAYAIENYHCYADSLHEVCVQATLNDRHLIDFNEFMKRYSQIAYPLFLWSVWFYRRHDTYTFTMSEFNACVRLHDVSLRHPERSLEAVRRSVTSKLSELSTRFPQGIEEVDKLSVELKGLGVLPDTTYLFIQGHHIMDNVVMKVLTPVCTALRREREQEIKKLAEHDEQFHNELTCYQNSQVNVEVMLRKNSAYKDLYLYQWLKEDIKEFLYGTDNRKNK

SEQ ID NO: 6231 - protein, 254 aa, B.fragilis
SQTKAQHFMKNRHYLRHILAITALLFNGEAIYSQTYPIENYLKAAGDYVTIYNGEIELTYSLAQYDNLPYFQGDEFTTGEIIFKGNRYPGLDLHLDLHKDQLCALTPDSHYSMIINNEGIEQVNLHNTTFIYFRPTKKTDLNKGFYELLQDGKRLRLLARKTYSVAQINVEKIAKTRKHQTEYFIYGVKYYLEYNGIYYPVSNNKSFAKIFPEQHKLIKRYARKHKLNFRHDADASLIALTNFCEELIDQKQTR

SEQ ID NO: 6232 - protein, 119 aa, B.fragilis
NHYNMKKLKSPASQSEAMKLRWKKRIVFEKGYTESCAEWMAERLEALLDHMQYGHATVAYRKQNGSFQLVKATLIYYEAEFRKKYDPTKIEGAVVYWNVDEQRWTTFQVENFMEWRPVV

SEQ ID NO: 6233 - protein, 333 aa, B.fragilis
MKNKELGMKKLIKKALKLILPLVLGGFILYWVYRDFDFVKAMEVLQHGTNWWWMAFSLLFGIFAQVFRGWRWRQTLEPLGAFPRRRDCVDAIFISYAASLVVPRVGEVSRCGVLAKYDNVSFAKSLGTVVTERLVDTVTILLITGVTVLLQMPVFVTFLEQTGTKIPSFMHLLTSVWFYIVLFCTIGVIVLLYYLIRTLSFFEKVKGVVLNVCEGIMSLRNVKNLPLFLLYSFLIWLSYFLHFYFTFYCFAFTAHLGLLAALVMFVGGTFAVIVPTPNGAGPWHFAVITMMMLYGVNATDAGIFALIVHGIQTLLVILLGVYGLVTISFLHRK

SEQ ID NO: 6234 - protein, 444 aa, B.fragilis
ILCKMEKCKKVYVGMSADMIHPGHLNIIREASKLGSVTVGVLTDAAIASYKRLPYLDYEQRAEIVKSIKGVDSVIPQETLDYVPNLEKLRPDYVVHGDDWIDGVQSNTRKRVIKCLLEWGGKVVDIAYTKGFSSTAMNERIKEIGTTPEIRQKRLRRLINAKPIVRILESHNGLTGLIAENASVIINGVKHEFDGMWSSSLTDSTSKGKPDIEAVDLTTRLHDLNDTLECTTKPVIFDGDTGGKVEHFVFTVRTLERLGISAIIIEDKIGLKQNSLFGTDAVQTQDSIESFCHKIRSGKNAQVTDSFMIIARIESLIAGKSMEDALERAAAYVKAGADGVMIHSKDKSGMDIKNFCTCFRKIDSTTPIVAVPTTYNQFTESELASWGINVVIYANHMLRSAYPAMLDCAKSILTHERSLEASNDYCMPIKEILELIPGTKALKR

SEQ ID NO: 6235 - protein, 383 aa, B.fragilis
TEILGIMKYYLIVGEASGDLHASHLMAALKEEDPEAEFRFFGGDLMAAVGGTMVKHYKELAYMGFIPVLLHLTTIFANMKRCKEDIVAWSPDVVILVDYPGFNLDIAKFVHAKTKIPVYYYISPKIWAWKEYRIKNIKRDVDELFSILPFEVGFFKGHRYPIHYVGNPTVDEVTAFKASHQESFADFIADSELADKPIIALLAGSRKQEIKDNLPDMIRAASAFPGYQLVLAAAPGISPEYYAKFVKGTELAVIFDRTYRLLQQADVALVTSGTATLETALFRVPQVVCYHTPVGKLVSFLRRHILKVKFISLVNLIAGREVVRELVADTMTVENMRAELECLLFREDYRRKMLDGYEEMARLLGPAGAPRHAAREMVKLLKK

SEQ ID NO: 6236 - protein, 284 aa, B.fragilis
KRNNTLKNNFLQRAITGILFVAIIVGCILYDPLAFGTLFVIVSALTIREFGHLVNQSGEVSINRTITMLGGAYLFLAIMGFCIDAAGSKIFIPYLILIIYLMVSELYLKKKNPVLNWAYSMLSQMYIALPFAMLNVLAFQNDPEASSVSYNPILPLSIFVFLWLNDTGAYCFGSLFGKHRLFERISPKKSWEGSIGGGIVAIASSFVFACYFPIMTWAEWAGLALVVVIFGTWGDLTESLLKRQLQIKDSGSILPGHGGMLDRFDSSLMAIPAGVIYLYALTLV

SEQ ID NO: 6237 - protein, 314 aa, B.fragilis
KKLKKCVIFVANNTILAMNALQSNIIREITPLSDKDCFYIAERYKTEFTYPIHNHAEFELNFTEKAAGVRRIVGDSAEVISDYDLVLITGKDLEHVWEQHDCHSKEIREITIQFSSDLFFKSFINKNQFDSIRDMLEKAQKGLCFPMSAILKIYPLLDTLASEKQGFYAVIKFLTILYELSLFNEEARTLSSSSFAKIGIHSDSRRVQKVQEYINAHYQEEIRLNQLADMVGMTPVSFSRFFKLRTGKNLSDYIIDIRLGFAARLLVDSTMSIAEICYECGFNNLSNFNRIFKKKKECSPKEFRENYRKKKKLV

SEQ ID NO: 6238 - protein, 107 aa, B.fragilis
LKQKEAIMKRIFTLYLFILFCLILQAQEELYERVYVHTDKTCYLAGEEVWLKFYTIDTHFRPSSFSKVGYIEISNTERPKAQLKLALDNGSGSGKVKIPTDAPSGIL

SEQ ID NO: 6239 - protein, 288 aa, B.fragilis
MAKKTKIYPLYIALLLCFFQVAGIDVYAQEPVKVSQDSISPVREAPKARARRHREPVVSTPATDSVKVEKAVVLPPIDSLENLKPAIVTADSLEEVNRQNLERIETPVMPSVVKADSLPPVMPKKLFVPNPTKATWYAIVFPGGGQIYNRKYWKLPIIYGGFAGCAYALSWNGKMYKDYAQAYMDIMDNNPNTNSFQDLLPPNHNYTDTQLKDLLRKRKDTYRRYRDLSIFAVIGVYLISIIDAYVDAELSNFDISPDLSMRVEPTIINNNPLQPGSKSVGVQCSLRF

SEQ ID NO: 6240 - protein, 401 aa, B.fragilis
LYMKLLYIGAFCEPSTDFLIRKRTKGHITVSATTFQKALLSGFENLEKKLDYIINIPDIGSFPLRCNNPFFSRTNFQFAFMKGVNGSFLNITYLKKYSIYQSVINEAKRWLNLHRDEEVTIIVYSLMYPYLKAAIDLKKHYSNMKVCCIVLDLPEYFGDNSSILHRVLEARNTNKIYSLVQEIDSFILLTEFMKDKLRVGIRPWYLLEGIYSPVEVALQKKRRKTILYTGKLDARFGIRDLIESFIKIDDREFSLWICGFGTDRAFVETAAKNDCRITYWGLVDQKRVFEMQQQATLLINPRKGDAEYTKYSFPSKTMEYMASGTPTIMYKLPGLPANYLNHLILIPDHSRETLTTLLKEWGNKGQDELDDFGKHARQFILDNKNSENQARRLLEFLVNKT

SEQ ID NO: 6241 - protein, 342 aa, B.fragilis
DMKKKKILFYSSVRSLELLNTQKFYQIDIALLRNLGYDVCLSNRIVDSLKFWEYDILFSYFYRYSFFASFFAKCLGKRTYFTGGIDNLDENYASTRNYKIQVLFFKLCYWVSSSCIIVSQSDLKNIAKVFHFRRRLSYSEHVVDTAQFMSDVPKEKLFTTVVWMGEEGNVRRKGVDKALRIFAELKKITSFSDYRFIIMGKKGEGTALVQSLINEYDLEKFVELVGEVSEEEKIAFLKRSKYYFQLSLYEGFGLAALEALCANNILIHSGRGGLANPIYTDQLLFDIDNDFDKEFSILTKKLASFTSLIPNDEVLSYYDIQRRKEDFKAIITDNNRNYKLNN

SEQ ID NO: 6242 - protein, 124 aa, B.fragilis
LLNLKSIFMKIKKLFTILTVLCFSALAGVVFLKFVDNKKNARDIALANVESLANAEGDGIGNEDNPSTTIKKCVSSSEFTKDDSTGEYYLVCNSGTTESVIYRCPSGTTEGHKDWIYSFLYCTR

SEQ ID NO: 6243 - protein, 326 aa, B.fragilis
TNIENSNDKLVTFASVFNKGNIFGMEIDKNLKGHALAFTANMMWGLMSPIGKSALAEFSALSVTTFRMVGAAAAFWILSAFCKQEQVGHRDMVKIFFASLFALVFNQGIFIFGLSLTSPIDASIVTTTSPIITMIVAAIYLKEPVTNKKVLGIFIGAMGALILILSSQAVSAGGGSIWGDLLCMIAQLSFSIYLTVFKGLSQRYSAITINKWMFIYASICYIPFSYQDIASIKWDSISTAAIYQVLYVVLCGSFIAYICIMTAQKLMRPTVVSMYNYVQPIVASIAAILMGIGSFGWEKGVAIALVFLGVYFVTQSKSKADLEGVS

SEQ ID NO: 6244 - protein, 251 aa, B.fragilis
LKKEMKKIKLLWMAMLTLMLPALQSCDDNDGYSLGDIAVDWATVRVVGGDTYSLNADRWGTLWPAATAIPFYKPIDGQRVITYFNPLYDNYEGYDHAVKVEHNYNVLTKQVEDLTAENESEFGNDPVWVNKDMMWIGGGYLNVIFRQNLPVKEKHLVSLVRDKWATAAEGEDDGYIHLEFRYNTYDDVTARQANGAVSFNLNSLDLTGKKGIKVKLNSVKDGETEVVFNLKGQSMPEEAKQVTLSDEVQIK

SEQ ID NO: 6245 - protein, 300 aa, B.fragilis
INEDMATQRRNALGRGLDALLSMEEVKTEGSSSINEIELSKISVNPNQPRREFDETALEELADSIREIGIIQPITLRKVSDDEYQIIAGERRYRASQKAGLDTIPAYIRTADDENVMEMALIENIQREDLNSVEIALAYQHLIEQYDLTQERLSERVGKKRTTIANYLRLLKLPAPIQMALQNKQIDMGHARALITLGDPKLQVKIFEEILEHGYSVRKVEEIVKSLSEGEAVKSGTKKITPKRAKLPEEFNMLKQHLSGFFNTKVQLTCSEKGKGKISIPFSNEEELERIMEIFDSLKK

SEQ ID NO: 6246 - protein, 269 aa, B.fragilis
TIYCHTMAWTIMKRNKKNFRITTNTCLYPELNKISPANEHLTMQIASQVYNIPTAANGLCFFQNDEPAYITRRFDIAPNGRKFRKEDFASLAGISKGNKGPNYKYDVLSYEEMADIIKQYVSASSVEVLKFFRLVIFNFLFSNGDAHAKNFSLLETPSGDFILAPAYDLLNTRLHIFDDHVFALQRGLFKENTLNGNDGAVTGKEFIEFGIRIGIPPKRVHKELISFCQKAEQVQDLVEKSFLPNQLKKQYLLHYQMRKDSYLSVGILT

SEQ ID NO: 6247 - protein, 480 aa, B.fragilis
QWERFGQSKDSYRRSFGNFMIWTESTRYMRNEGEKVFFRNPIAVINTSRVSDSDPIELADSAEIYPKGKPGTTENIHIKTSRSNYNTRQLVELTINRLPDEVSDLTVSVSRNDSLVTLPPLEESTWSKQVTATPGTFSGKWIPEYEGHIICGQIESPTGETLKQVQNEPISADIAFVGKDIRYVQGQVESGGNTLFYTSHVYGTNDVVAAAWNINGEPFRMNILSPFSEKLPQNLPSLKLYRNKKRLLERSIGIQLQQVTVLDSLDHAIPLQSCYGLQPYLNYNLDEYTRFNTMTETFVEFVRSVIIRKVNGKRRLRVLKEGEKRFNIGNTLVLLDGVPIHDHEDILKYNPRLVKKIEIYNGRYGFGGEVFECMISLTTQRGDLPSIQLSDDSRLTVYECPQLPVTFKMPEYKDATDKKSRRPDFRHTLYWNPSVETEAGIDTTLSFYTSDLEGEFKVVVEGFTLKGELIRGEVNFHVKK

SEQ ID NO: 6248 - protein, 316 aa, B.fragilis
PCHSYKRHNRTIEKCSGNNKLNNYLSMNEGLTKEYRVKLLETFAAFDRFCKANGIKYYAAYGTLIGAVRHKGLIPWDDDIDVYMLREDYDKFCSLKGKVMDHYDIMDINDDGYWLLSLAKFVDTNTTLWEFKNRPLILGVYIDVFPLDECNMEQVITLKNRYDKYSLLVAQSMMRYSLGDILHSLFRLKLKCLLLQISCVFYKRHKYAYYKQKYLSCVEDIKKSKGNFLVSYDGPYGMGEVLDKKLFSESVLVPFESMSIEVPIGYEECLKSIYGDYMKLPPKEKRISHHSRYYLNLNHRLSFSEISREISLRGKI

SEQ ID NO: 6249 - protein, 925 aa, B.fragilis
RIDRPKTNTMKKSTYLWMLPLLFAWPQQMTAQHPLSLPADSITIDSLLETVEKNTPYRIFSTISAPFKVLVKGKASPLQQLKEALEPTPYKLSVSGNNLFVLKEQELITLLPAKLTGEPEKGESYYGDVYTYLSGEPEKASSENKVYNVGDVRIKQPPRKAVLKGQVTNFKTGEPMIGINLILKDPWIATTTDVKGNFTLELPTGHKQIDIKGLNIKDTRRQIMLYSDGTLDIELEETTHMLDEVTITSGRIQNVKSTQLGAETLRPTQLKNIPMALGEVDILKMVQALPGVKTVGEASSGFNVRGGATDQNLILLNDGTIYNPNHLFGFFAAFNSDMVKEAEIYKSSIPAQYGGRISSILDITGKEANKEKFTGSAGIGLVTSKLNLEIPIIKDRTSVLLSGRTTYSDWIMKQLPEKSEYKNGTAGFYDLAAIVAHKFNDKHSLNVYGYYSHDRFAFNSNEKYGYNNLNASARWRAVFNEKLIGYFSAGYDHYDYNNRETVNASTAYKLSFDINQYFVKADFTNILADKHTLNFGFKSMLYHINSGTYEPEGSESFVKKDVLQKDKALETAFYLGDEWEITPKLSVNAGIRYSLFSALGPRSYYQYASGMLPHESTITDTITAGAGKFMKTYHGPEFRLSARYAFTDNFSVKAGFNSMRQYIHKLSNTVIMSPTDTWKLSDVNIKPQRGWQAAAGLYLNSPSGIWEYSVEGYYKRMSDYLDYRGGAKLLMNHHIETDVINTQGHAYGVELQVKKQVGKLNGWMSYTYSRTFLRQNDKRIEKPVNNGDWYPTEYDKPHDFKFVGNYKFTHRYSMSINVDYSTGRPTTIPAGQYYDESTQSMRVYYTERNSYRIPDYFRTDISFNIEPSHHLTLLTHSSISIGVYNVTGRKNVYSIYYMPEEGQIKGYQISIFGVPIPFITYNIKF

SEQ ID NO: 6250 - protein, 338 aa, B.fragilis
QWCRNILSDLFRRYACFVSEFSDFQENPILEEVNNGCNFFEKSKSDIIIACGGGSVLDMAKLIRFKAAYDGDLVDSVFEKKKELTPLIALPTTAGTGCEATPFAVCYKNSIKYSVAHNDMLPDYAVIFPQFTYNNSSYLTACTGFDALSQSIEAYWNVNATAESDEYAKRAISVLWDNLPKVVNSPSNEIRDLMSVAAYWSGCAIAITKTTAPHAFSYAFTTHCGYPHGHAVALSFPFFMALNLLEKQDFAFQPRINIDEYYKKTAWLQSQLGFSDEINIQSEMQSYLNNIGLCNNGYGDNDLTIMLNQVNIQRLVNNPVIVTKDIIERLKNVLGTIN

SEQ ID NO: 6251 - protein, 418 aa, B.fragilis
LLCGVTSVLIPVGRILILKKFNSIMEIKLDYSDIKFRYDGKLRLLIIVGTRPEIIRLAAVINKCRRYFDCILAHTGQNYDYNLNGVFFHDLSLQAPDVYMDAVGDDLGSTMGNILNASYKLMSHLRPDAVLVLGDTNSCLSVISAKRLHIPIFHMEAGNRCFDECLPEETNRRIVDIISDMNLCYSEHARRYLNASGVAKERTYVTGSPMAEVLSENLSAIESSDIHARLGLRKGQYILLSAHREENIDTDKNFASLFEGINAMAEKYDMPVLYSCHPRSRNRLESSGFKLDSRVIRHAPLGFHDYNCLQMHAYAVVSDSGTLPEESSFFTSVGHSFPAVCIRTSTERPEALDKGCFILAGIDKASLLQAVDTAVEMNRNGDNGVPVPDYMDRNVSTKVVKLIQSYTGIVNKIVWRKS

SEQ ID NO: 6252 - protein, 141 aa, B.fragilis
IECGMDMQDVKVLDLPKILDKRGNLSIIQEVENIPFKIKRIYWIYDVPGGERRGGHAYKKNQEFIVALSGSFDVVLDDGNCEKVFSLNRSYYGIYVPQGIWRKMQNFSTNALALVLSSTNYDPDDYILEYIDFVQSKKNSL

SEQ ID NO: 6253 - protein, 197 aa, B.fragilis
LLMGNLTENDFQRVADLLGIEVAVVKAVQAVETSGHGGFVAPGRPMILFEGHIFWRELKKRGLDPERYVAGNENILYPKWEKGHYYGGMKEYERLEKAWQIHKEAADASTSWGMFQVMGFNYAMCGYGSVEEMVKDMCVGEDKQLEAFARFVKLAKLQSYLEQKDWVGFAKRYNGPGYARNQYDKKLEGAYRKFTKE

SEQ ID NO: 6254 - protein, 166 aa, B.fragilis
FKFIMTLSEEVASLQRAAHDLMYLGMDGSPIYSDDLSRRNNEVYRLTTTLYNSGVQGSTVEEQASVCLALLMGYNASFIDHGEKREHVQKILDRCWDILDTLPASLLKLRLLTACYGEVFDEPLADEARSIIASWDSVSLTTEQQEAINEFQTVVDNPYPWEYVEE

SEQ ID NO: 6255 - protein, 296 aa, B.fragilis
VLIMKGIVLAGGSGTRLYPITKGVSKQLLPIFDKPMIYYPISVLMLAGIREILIISTPYDLPGFQRLLGDGSDYGVRFEYAEQPSPDGLAQAFIIGEKFIGDDSVCLVLGDNIFYGDGLIEMVQAAVKKADLENKATVFGYWVSDPKRYGVVEFDKEGSVLSLEEKPRDPKSNYAVIGLYFYPNVVIELAKNVIPSSRGELEITSINQEFLYKKMLTVQLLGRGFAWLDTGTHDSLAEASTFIEVIEKRQGLKIACLEDIAFGQRWITIDKLRKLAEKMKNNQYGKYLLKIVEGLN

SEQ ID NO: 6256 - protein, 265 aa, B.fragilis
KCVMAKLYPIGIQNFEKIRREGYLYIDKTALVCRLVKTGSYYFLSRPRRFGKSLLISTLEAYFQGKKDLFRGLAMEELEKDWIKYPILHLDLNTEKYDTPESLDRILNDTLAKWEMVYGTAPSETSIPLRFKGIVQRACEQSGQRVVILIDEYDKPMLQAIGNEELGEKYRDTLKGFYSVLKTMDGYIRFALLTGVTKFGKVSVFSDLNNLNDISMDEPYVELCGITEKEIHHYLEPEIRQLAKYQKMSYEDACRLHHRAGRILE

SEQ ID NO: 6257 - protein, 295 aa, B.fragilis
LSSMENEETFAFLFGSVVDTSSFCYFCAFRKHKITDKVDCMENKRPLILVSNDDGIMAKGISELIKFLRPLGEIVVMAPDAPRSGSGCALTVTQPVHYQLLKKDVGLTVYKCSGTPTDCIKLARNQILDRKPDLVVGGINHGDNSATNVHYSGTMGIVIEGCLNGIPSIGFSICDHAPGADFDAAGPYVRRIAAMVLEKGLPPLTCLNVNFPNTQEIKGVRICEQAKGHWSGEWQACPRRDDANFYWLTGEFIDHEPENEKNDHWALANGYVAITPTVVDMTAYHFMDELKSWEL

SEQ ID NO: 6258 - protein, 182 aa, B.fragilis
NNRIMEVEKETEIWFAMRATYRRETDAMRLLAKENLGCFVPMQYKISIKKGKKVRVLVPIIHNLIFIHACPSEVKRVKSMVAYLQYITDTRSGKKIIIPDNEMQRFIAVAGTYSDHLLYFQPDELNLSKGTKVRITGGDFEGQEGVFLKVKGARDRRVVIAIQGVIAVAMATIHPDLIEVIK

SEQ ID NO: 6259 - protein, 680 aa, B.fragilis
SISMDNNSKKPNNKVNMPKFNLNWMYMIIALMLLGLYFANGSSSVSKNISYDEFQQYVRDGYVSKVIGYDDNSVEIYIKPQYVGTVFKQDSTRVGRNPMITTEAPSRENLDNFLQKEKEETHFDGSVSYDKKKDYFSAILWNVLPIVFLIALWIFFMRRMGSGASGGAGGVFNVGKSKAQLFEKGGSIKVTFKDVAGLAEAKQEVEEIVEFLKEPQKYTDLGGKIPKGALLVGPPGTGKTLLAKAVAGEANVPFFSLAGSDFVEMFVGVGASRVRDLFKQAKEKAPCIVFIDEIDAVGRARGKNPAMGGNDERENTLNQLLTEMDGFGSNSGVIILAATNRVDVLDKALLRAGRFDRQIHVDLPDLNERKEVFGVHLRPIKIDDTVDVDLLARQTPGFSGADIANVCNEAALIAARHGKKFVGKQDFLDAVDRIIGGLEKKTKITTEAERRSIALHEAGHASISWLLEYANPLIKVTIVPRGRALGAAWYLPEERQITTKEQMLDEMCATLGGRAAEDLFIGRVSSGAANDLERVTKQAYGMIAYLGMSEKLPNLCYYNNDEYSFQRPYSEKTAELIDEEVKRMVNEQYERAKQILSEHKEQHNELAQLLIDKEVIFAEDVERIFGKRPWASRSEEIMAANNKQENAVHPADGEDVDTTTPQATESQEGNTQQESAASQN

SEQ ID NO: 6260 - protein, 140 aa, B.fragilis
KEFIMTVFDCSIIEFPKIEDRSGNITPVHSEENVPFDIKRVFYSYDIPGGGARGAHAHKECHQCLIAASGSFEVVLDDGVNRKTVLLNRPYYGLHIPPGVWASEQGFSSGAICLVLASHVYDENDYVRNYQNFLNNKEIL

SEQ ID NO: 6261 - protein, 198 aa, B.fragilis
SVTIMFLYGASGHAKVIIDILRAGHESIEALFDDNVEVTSLLGHPVLRPSEVRGPLIVSIGNNRIRKRIVDTLSVEFGCAIHPLSIVSEFADIGEGSVVMQGSIIQVCAQVGRHCIINTGASVDHECVIEDYVHISPHSTLCGNVLVGEGSWIGAGTTIIPGVKIGKWSVIGAGSVVTKDIPDHVLAVGNKCKIIKSI

SEQ ID NO: 6262 - protein, 205 aa, B.fragilis
ILKIIDCTLRVKMIRFGLMTFPGLVNEVLMGKLGILSLMFCTIVLLSCGKKKNVYPELEAFIGKEIIFSDKNFNTVGNKAFKDQFLLISYVDSGNCTPCSLEKMQYMKTNKRRLLDTHTGVLMIVHEKDTFTVNEVFRQMHVSYPIFFDSLGCFKKENGIFDNPLYQDFVIDRSNKVVWLGNPLRNKQSWQQYEKAISMLMDSGK

SEQ ID NO: 6263 - protein, 298 aa, B.fragilis
VIEIYVILLLINMVSVIIPLYNKYLAIGRTIESVIVQTYKDWELLIIDDGSNDGSGQVAEQYTFDERIHYIYKSNGGVSSARNMGIQMAKGEWLLYIDADDYLLPNALETLLNLAEKFEVSIAASNFYVEFEGKKRRCLYNVSEGVVLNNFRSLFFNSFDIRAGATLYKSSLIKQYKFDETLIRYEDAKLEFDILRNHKVAITPQFTMVYTKDYAGLSKPASDFSKDYISCMSFEGKPFWEKMKLGSLANYGLDIYPNNRSEIKAIYSNDLKWIYLSAKIGFFVYLFNKCCNLLHKLK

SEQ ID NO: 6264 - protein, 498 aa, B.fragilis
PVEIDLKPINNSFMSTILDLAPQNVWKHFYSLTQIPRPSGHMEKITEFLVNFGNSLGLKTFVDDAGNVIIRKPATPGMENRKGVILQAHMDMVPQKNNDTVHDFEKDPIETYIDGEWVKAKGTTLGADNGLGVAAIMAVLEDQNLKHGPLEALITKDEETGMYGAFGLKPGTVNGEILLNLDSEDEGELYIGCAGGMDVTASLEYKEVAPEEGDIAIRVNLKGLRGGHSGLEINQGRANANKLLVRFIREAVATYEARLASWEGGNMRNAIPREAHAVVTIPAENEEELLALVKYCEDLFNEEFKAIETPICFTAERVELPAGEVPEEIQDNLIDAIFACQNGVMRMIPTIPDTVETSSNLAIINIGEGKASFKILARSSSDSMKECLTTSLECCFSMAGMKVEMTGGYSGWQPDINSPILHAMKESYKKQFGTEPAVKVIHAGLECGIIGAIIPGLDMISFGPTLRSPHSPDERALIPTVQKFYDFLIATLEQTPMK

SEQ ID NO: 6265 - protein, 1927 aa, B.fragilis
YMRIKLICIIVLLSMGMMSWTHAQSYDRLWKQVEQAQQKSLPQTVVRLTGEIYQKAKAEKNSPQMLKAYIWQMKFREEITPDSFYVSLNGLEQWAVTTDKPLDRAILHSLIGSMYADYASQNRWKLNQRTDLEEEAPSVDIREWSKNQFVTKVMTEIAVTFQDSLLLLDTSSRSYIPFVELGVTSDYYHHDMYHLLASRAITSLENLSGFGHDSLINVRIEEIYQHMMNSYHRTDNHDALLLTTLDYLQWKRRTDIDFRPYRAPEGKLGLTQDPYLAALDKLIAENKSHDVCAEVYLLKAQAAMDAGVPASALQLCEEAISRYPDYRRINALKELKQEILRPDLTVQSPSTVYPGEEFDLKVSFKNLKDFTVELYAINLPARPNTVEAPNDAFLKKHGRLLSSEHYVLFPSDDYKVKDSIYHIKAPETGLYALRVIPGVKVRSNVSKFLYSTCFKVLTRSLPSNLSEVAILDAMSGKPLQGVVLSFFDRQNKQLLTATTNTEGKVQFASSEKYRYLTAAKGNDTAMPQMYLWGGDYNFADHSKPVSVVTLLTDRSVYRPGQTVYVKGIAYEQYPDSAHVIAGQEYTLTLSDANGQEISAKKLRTNDFGSFTAEFILPSVCLNGTFSLNTQNGFRSIRVEDYKRPTFDITFEPVTESYRLGDRVELKGSVKTFSGVPLQDIPVTYTITRSLYTWRMWGMNPVILASDTVRLGVDGNFEIPVDLKPDTSNPDLGDGDNTSLYYDYKVQLSVTNVAGETQTSETSLRAGKTSLLLFADISGLICKDDSMKATFRVNNLDRKPVSVEGSYRLFLISDYQKSKPLKEQDVSDQPALSGSFRSNEEILLSDWKKLPSGAYKLVASVKDDQGRKVDAEKVVILFASDDKRPPVSMPLWCYEVNTRFDAAHPALFYFGTSEKDTYVLMDVFCGNKHLESKLLHLSDSLVRFEYPYREAYGNGLGITFVFVRKGVVYEQEVSLIKRLPDHNLNMRWDVFRDKLRPGQEEEWKLTIRNPQKSPVLAEMLATMYDASLDKIWKTNQSLQLHYQLSVPIARWRRDYVGSNYFYFGFRRTDLKVPPFSYDHFDLPPVLYAVAEMLSVTNDAAPTTRYARLRGMGAAKPQMKSAAVADVVFESEMVPVTEESGMAMSMDNADMGRTTDIELRTDFAETAFFYSQLHTNVQGEVSFSFRMPQSLTTWNFRGYAHTQDMMTGQMDATAVTSKEFMLTPNLPRFVRVGDHTSMAASVSNLTGKNLSGTVKLVLFDPMTDQVISTQQKKFNAGAGQSVGVSFLFTVTDKYEILGCRMIAEGGNFSDGEQHLLPVLSDKENLTETLPMPVRGEQTRTFSLADLFNHHSKTATNRRLTVEFTSNPAWYAVQALPALSQPRNDDAISWATSWYANTMASYIMNAQPRIQAIFDSWKLQGGTKESFLSNLQKNQEVKNILLSESPWVMEATSESEQKERIATLFDLNNIRNSNTAALLKLKELQLPDGSWSWYKGMDGSLFVTDFIVEQNARIALLTGKPLEGGALDMQQVAFGYLHKEALQEYRSIREAEKVGNKSEGISRSALKYLYLIAVSGEKVPASAKEGYDYFLSKVAPSLSQQSVTEKAWSAIVLQKAGKVKEAQEFMASLKEYLTQTDEQGMFFDRTDSPYAWNNLKVPAHVDVMEAFEMVGSNATIVEEMKMWLLKQKQTQQWDSPVATADAVYALLYRGTNLLDNQGDVRIVLGNEVLETISPAKTTVPGLGYIKKTFTDKKTVNTDEIIVEKRDPGIAWGAVYAQFEENLDKVVRQGSGLNVDKKLYVETIVNNNRRLQPVIGKTQLKVGDKVVVRLTVRLDRTMDFVQLKDQRAACLEPVEVLSGYRNVGDVGCYVAVKDASTDFFFDTLNKGTYVLEYSYRVDRAGSYEAGIATIQSAYAPEYAAHSASARYEVSQ

SEQ ID NO: 6266 - protein, 362 aa, B.fragilis
HRVILFSSNDSCVIVIVYIFLIFVSTVIFISHIYVKSEKVNKITAFLWVIMMTLFVGSQDGIGNDHANYIAQIKSPWATPQEPFTLFIFYIIRSCDLSVYVFFYIYAFLTYYFLYKVILLSDKSIRFIIVMMILQSLLFFQSFNLIRQILACAIFLYGISLILNNKKGYWFLLLACLVHYSAFFGLLIVWIASKIRVSTVMLIVYIMSVALLYTGGFIGDFISKYEFLIRMTYYGYYLDSSLINDDVAANFGVVYKITFILCLVVYTKRKFFKSNGQILLFNLFFVGQILYNLSSANITIQRATYFPYFSMILVIPLLAKCFSPYWNSRLALVLYSLYFLFISASLASQDCPYVPYKNIIWN

SEQ ID NO: 6267 - protein, 281 aa, B.fragilis
RAAIRAASLHTLAMSAPENPGVWRASKSTSTVSSILMGRKCTPNTSLRSFRSGKSTWICRSKRPARSNALSSTSTRLVAARIITPLFEPKPSISVSNWFNVFSRSSFPPIAGFLPRARPTASISSMKTIQGAFSLACLKRSRTRDAPTPTNISTKSEPAKEKKGTLASPATAFASNVLPVPGGPTNRAPLGILPPRSVYFWGSFKNSTISSTSCLASASPATSLKVTLMEPPFSKSWAFDFPTLNTPPAPPLAPLPMRRMKNIHKAIRKTIGSTFQSIALK

SEQ ID NO: 6268 - protein, 440 aa, B.fragilis
PMKIEQIRMKKLANYCPLILLFLFATPKVNAQSVDVVIRDNGKERQESIELPKSMTYPLDSLLNDWKAKNYIDLGKDCSTAEINPLFSDSVYIDRLSRMPTVMEMPYNEIVRKFIDMYAGRLRNQVSFMLSACNFYMPIFEEALDAYNLPLELKYLPIIESALNPSAVSRAGAGGLWQFMIGTGKMYGLESNSLVDDRRDPIKATWAAARYLKDLYDIYHDWNLVIAAYNCGPGTINKAIRRSGGETDYWSIYNYLPKETRGYVPAFIAANYVMTYYCDHNICPMETNIPESTDTIQVNKNLHFQQIADLCNVPMDQIRSLNPQYKKEIIPGESKSYTLRLPQNAVSSFIDRQDTIYAHRAGELFKNRRTVAIRDDSSASKRRGSSAKAGSGTPTYYKIKNGDTLGAIAAKYGVRVKDLQNWNGLRGTNISAGKRLKIYK

SEQ ID NO: 6269 - protein, 379 aa, B.fragilis
LIHVRMMVLKNKWKNRFILILFMVGFVFFACKEETDLYFNGDITVIKSFDNDTLLSPVKVELEDIYDGSVLAYDSLLFFTSHKYSDCWMYVFSVNSGKHIASLCPKGQGPNDYLSCKNSQQFIRENGELKLWVRDNAKSARLLNITKSIETGATVCDAIIPMDWNKYFVYPATTLFFLKDGYILGQNQCEEQYSKGKEYIPRKFYLYKDSLGNKVKEYKLFNRPVILKDDKYDVLSGMFYANHSYIHPDQTKVAIAMQRVAQITILDVKSGKQVGYRMDDTLDFSDIEQNLECIRYYYTSAAVNSRYIFALYIDQAEMGGKYPFKSKTVHVFDWEGRPVYKIQLDKEISWITLDPQNNRLYAQGEDDSIWAYDVSWLSK

SEQ ID NO: 6270 - protein, 272 aa, B.fragilis
MKLVKPKKFLGQHFLKDLKVAQDIADTVDTFPDLPILEVGPGMGVLTQFLVKKERLVKVVEVDYESVAYLREAYPSLEDNIIEDDFLKMNLQRLFDGHPFVLTGNYPYNISSQIFFKMLDNKDLIPCCTGMIQKEVAERIAAGPGSKTYGILSVLIQAWYRVEYLFTVNEQVFNPPPKVKSAVIRMTRNETQELGCDPKLFKQIVKTTFNQRRKTLRNSIKPILGKDCPLTEDALFNKRPEQLSVQEFIHLTNQVEQALKVPIEPVSQIENP

SEQ ID NO: 6271 - protein, 471 aa, B.fragilis
TNKVGNVIYKTCLPYYYRKLSKAVIMNEEYIDNVKELIEEKDADKVKELLIDLHPADIAELCNELNPEEARFVYRLLDNETAADVLVEMDEDVRKEFLDILPSETIAKRFVDYMDTDDAVDLMRELDEDKQEEILSHIEDIEQAGDIVDLLKYDENTAGGLMGTEMVTVNENWSMPECLKEMRQQAEELDDIYYVYVIDDDERLRGIFPLKKMITSPSVSKVKHVMQKDPISVHVDTPIDEVAQIIEKYDLVAIPVLDSIGRLVGQITVDDVMDEVREQSERDYQLASGLSQDVETDDNVLRQTTARLPWLLIGMIGGIGNSMILGNFDSTFAAHPEMALYIPLIGGTGGNVGTQSSALVVQGLANSSLDAKNTFKQVSKEAVVALINATIISLLVYTYNFIRFGATATVTYSVSISLFSVVMFASIFGTLVPMTLEKMKIDPAIATGPFIAITNDIIGMMMYMGITVLLS

SEQ ID NO: 6272 - protein, 367 aa, B.fragilis
NMEVRVWNYLKEYASSKEEILKAVEDVFESGQLILGAKGKHFEQAYAEYCGVSHGVGCDNGTNAISLALLAVGVKPGDEVITVPNTAIPTVSAIVTVGATPVFVDIDPLTYLMDVTKVESHITEKTKCILPVHLYGQCVDMDELIALAWKYKLSIIEDCAQAQGAEYKGYKAGSMSNASTTSFYPTKILGAYGDGGMIITNDAEVEGKLRRLRFYGAEKMYYAIEHGYNSRLDEVQAAILLTKLPHLDQYIKRRREIAYLYNELLKDTNLILPKEADYGKHAYYLYVVRHSNRDEIMAALKENNIFVNISYPWPIHTMTGYQFLGYKEGDFPETESAAKEIFSLPMYPTLTDEEVHYVSDILHKILK

SEQ ID NO: 6273 - protein, 379 aa, B.fragilis
KPLFLYSKQLIIIKQRRMKRSLLFIFTLLTITLSAVAQPRISSNKETHHFGQIEWKRPVSVEYTITNTGDKPLVLTNVTTSCACSVANWTKTPIAPGEKGTVSATFDAKALGHFNKSIGIYSNAQPSLVYLNFDGEVVQEIKDFTKTHPYAIGQIRIDRTDIDFPDAHSGEKPVITLGVVNLSDRPYEPVLMHLPPYLKMETNPTVLLKGKKGTITLTLDTKQLMDLGLTQSSVYLARFAGDKVGEENEIPVSAVLLPDFSGMTEQDKAVAPVIRLSESKIDLSQVLAKKNKARRDIVITNTGKSPLQISKLQVFNPAVGVALKKTVLQPGESTRLRVTVLKKNLGKKKRHLRILMITNDPVQPKVEIDVKATNNESHN

SEQ ID NO: 6274 - protein, 402 aa, B.fragilis
LRIFRIMFWRWETNVKLLRVYKIILLMNKRIWLSLAHMGGREQDFIKEAFDTNWVVPLGPNVDAFEQSLVEYLHEDRYVVALSAGTAALHLGLILLDVKPGDEVICQSFTFAASANPISYLEAKPVFVDSEKDTWNMDPVLLEEAIKDRLRKTGRLPKAIIPVHLYGMPAKMDEIMDIAGRYGISVLEDAAEALGSELNGRKCGTFGELAALSFNGNKMITTSGGGALICRTEEEARQTKFYATQARDAAPHYQHTHIGYNYRMSNICAGIGRGQMFVLDEHIARRRAIHSLYVDLLKDVAGITVMENPDSRFASNFWLTCILVDPKLAGKSREDIRLRLDSENIETRPLWKPMHLQPVFTDAPFYGNGTSERLFDIGLCLPSGPTLTDEDIRRVVDTIRAI

SEQ ID NO: 6275 - protein, 279 aa, B.fragilis
MQPFMELSANYIKRIEIDGLWDRFNIVWDLRPDVNILSGINGVGKTTILNRSVGYLEQLSGEVKSDEKNGVHIFFDNPEATYIPYDVIRSYDRPLIMGDFTARMADKNVKSELDWQLYLLQRRYLDYQVNIGNKMIELLSSNNEEERSKAATLSIAKRRFQDMVDELFSYTRKKIDRRRNDIAFYQDGELLFPYKLSSGEKQMLVILLTVLVQDNAHCVLFMDEPEASLHIEWQQKLISMIRELNPNVQIILTTHSPAVIMEGWLDAVTEVSDIATSYK

SEQ ID NO: 6276 - protein, 100 aa, B.fragilis
VSHSQEIKKRVSFSGHPLPYASASHTLLLFDFPYYTRLGTNTIKDSHFYTRYGIKVGASQESIPIWVYCYSFYLITSMTFLIFSLEPTFSYLLHFFSTPS

SEQ ID NO: 6277 - protein, 77 aa, B.fragilis
ESRKCNGQTVRESKGTYLTEEYVWENKLDIERTAWQYDPYTHEWVDMPLVSKGKKQSEELPEPEYGDKQQCKCLSER

SEQ ID NO: 6278 - protein, 519 aa, B.fragilis
TCLWYRKAKNNLKNFQSLSMVTNNNVSVSQKGKYGSVRTSLTHVYNKGQYPNQKLNKITYSVSGDMKWKKFSFDGGLTYNKRFYPNDMGAGYGGSGFLYNLLVWSGAEYDIRDYKNYWIKQDEQQNWMDTKWYDNPYFIANEIVRSSDYDLINGYLSANYDFTPWLNLSLRSGLDSYSQKKEWRNAVSAVGGWHKQGYYGLQRLGGYSLNNDLILSADHKFGDFNVDGFIGGNVYYWKSDNILGETQNGLKIPGYYSLKSSIDPVKTTSGITKKLVTSVYAKASVSWKSTLFLDVTGRNDWSSSLPSETRSYFYPSVAGSVVLSQFIPMPEVIDFWKVRGAWTQTKSDLGVYDTNNTYSVSTDLWNGESAAYYPTSIRGVAVKPSATRSYEIGTAIHMFKNRLKLDFTYYNKLYYNLTRSAGISNSSGFTSTLINIDEEYVGRGVELTLSGDIIRTRDLKWESSFNWSRDRWYYTKIDPVYSTQKPWVAVGKRWDWYGIYDWERDSQGSLHHGGGRSNV

SEQ ID NO: 6279 - protein, 274 aa, B.fragilis
QTRFATERICGATGPFPDPDRAGPNIPFSIRRTPFRHPVSVGYSNIYSFCRDFVSTPRFLGAFPWLELAGTIAPLLAAYNANASALSLHIESPQAYWDAAEDRIREICKRKGVPYSARMLEEFKDEAMEKFASGVTGRENVGKYMHTTRFWDADANDFQGWTITPIDKKIRDYIESQIKIANKADAAATSGFGLDPVLSNLIMDNKLSSGSEKLYSIKVYNASETAIPDMILCKPLMHYIRANYPGSRTQVGLYRSVVESEQSVSPANRMKENI

SEQ ID NO: 6280 - protein, 158 aa, B.fragilis
IRNAMNEDLIKQEFVRENIERDIRAIFEAQYLIATERVYTSAIYPTQVGQGRSLVREQGYGRLVRGTTGRLLSALHNPVYSVGFSGRGVVATSNIPLYIRFLDMKKHGNYGIYNRQVWGILWNNSLQTIKYGYGKEVRDRIYAGLQEAFQRMEIRTDS

SEQ ID NO: 6281 - protein, 151 aa, B.fragilis
NCSAMVDLQQYEEYWSGITERIPQIKKVVPVTFDPDMGALVQGLKADELPALLLIIPSAKGKSPDVDNLLELNLCVAFLMDKTDPQRKGTYQVLKELQPVMEKMKAQMIDDKAAGCHLLSRLDLSSLSTIPEAGFYSVFAGWSLGFEFETP

SEQ ID NO: 6282 - protein, 133 aa, B.fragilis
EAMKYFTIKELSHSDTAVARGIDNTPTGEVVHNLTELVENVLDPLREKYGKPIRVSSGYRSAVLNRSVNGATSSQHLLGQAADITVGSKEGNRRLFEIIRKELPFDQLIDEKDFSWVHVSFRTGKNRKQVLKL

SEQ ID NO: 6283 - protein, 948 aa, B.fragilis
  UNSURE (908): Identity of amino acid sequences at the above locations are unknown.
ESVNDLELMQAAVRAKDFRIPLEDLGKYLQFARLKAQQTGQSVDYLTDSIITGLGRKSLLILDNLGLSAAEVNEEMAKTGDLMAAVAAIVDRQLAQAGENYVSAADKAAQKAAELQNRQMEIGRLLLPLQEKWSGLFQSLKLGFSDVALRVLEHKKSIITLISVVTGFILVYKTVILLQKTWNGLLMLGKAVGLAYASVVAMQRGNILRSAAAMKMYNASVASNNILVKACTASTYLFAAAKAVLTGNINKARIAMQAFYAITKISPLAIVATVVAALTYKLVSYRRELTATEKAERSLHRVRAQAADTVATETRELNTLLGIARNEKISKEQRMEAIKRLNALSEEYLGGLRLETINTREATAAVKDYTDNLLSMARIRSANSRLEEIQKEKRALEEQRKDIHANRNLWDSFKLGLAKGFNSLSVAVKGYSDAWSEGVIHDYFAREFDQIQALNREEKKLTQEITASQQDIIKVDTQSEAKTKDLIQAKKEEIAQAEREVASTPALLAAKNRKLQQLNEELKALQQLGTIRETPDGFASQTDKVLSALNERHEKELLKIRENKERQQQTQAQYDKAVLAEDIRFHTQRLVILEGLEKKTARTKLRQLADIRAKMTESSAKILELQRKLDENEVALLQEQRDKKLAIQEDTYKATRAQIELNYANLHITQQQRDMLLLSLEESNSRERLGILKEYRKDVEALELQTGDVKIQAVKLSGQKVLEAELANAKDRAAQQKAIETMLSSFKKEFNLFNLPDETDLQLKVLEASYRARLELIRNALKNELVTKDQAARQEKELEEAYSTAKLNITRGAEERRNGILEKYGLLGFQQRYAMQMAALKREKEQGLIGAEAYAKAEKMLKIQFWKEAFDYYSNLFSGAVSALQNAEIANMEAKYDAEIAAAQGNAXEVERLKTEKAQKKLEIEKKYADVQFAVKATRSLPDTAWPS

SEQ ID NO: 6284 - protein, 316 aa, B.fragilis
YTNMKLIFDKDSNGTQELVDALGLIDVRTDFSKWKPYIPLSIRRLTAIIGQEVYDKVLDFYQSASVDPDGKLTRLLGMVQQSVALFTWLKIIPTLDAQHGNTGRQKRLGEHEKGLTALQEYKDEANILSQAYESVDALIAYLEQEKFDFWIQSPKRKAVSELLLNSKEAFDFYYVTGSHRLFLTLAPIIREVQQRHIIPIITYGRYEKLVAGQQVAEGFRDAVCRPLALLSMSKAVERLPVEVLPDGVVQVQLAGSVREKLRAEAEARKTVAKSLEQDGMRDLAALEDLVAALDAAPDEPDLYVPSITLQSKGITF

SEQ ID NO: 6285 - protein, 215 aa, B.fragilis
NTDMARRSATVFMPDYRKLSKEWKYVRIPKDTLSFCPGDGPPIFVLKNNVMGKLQPDYITWTLLVNADGLQKEMLKVRNNTKELKAENVRLKSSMENLAMQGKLQSKEYKELNAQLKANNRTISENGEKLRLLESRLNNADKSYAQLSKQARQLRRELDNTVKSLQPQEYARLEAELAKTKEAMEQLRPKTRGGERVIFQPYQDEIRGSPVFSPV

SEQ ID NO: 6286 - protein, 264 aa, B.fragilis
IMEIRRTGNTGFIDTGEGQLISFAMGKGWSPSSISFSRPESWQTRKIRVAGVNIVPMGANNDLPGDVQRLLDNFYGGEGIMGKIQGLQWGEGPRFFEEAIDSENNRFYRKWILDDVIQADLESWDYRDYMLRCLVDLVHMQGFWVKFIRNRGPRIGEDGRIIRLEHIPYRKCRFEYPDDRHDLPQNVYVGRLGPSPIPTGLGQISRFQSGGPRSGIRYRSAIPTYTPFAGTLSARPVSWGLSRGWNWRAPSPPCWQPIMPTRRH

SEQ ID NO: 6287 - protein, 285 aa, B.fragilis
TGSVCTLDHPSIKRHNILTMKEITYNNQKKEIPDSLEELSPKEYYRYLELVLMMNAGEISPFQMRCKLLSCLLGMKHSLLLCLGEIQEELLAQLPALDGFFDITSQEGMMVYDARLKTGRNLLPAYKEWKGPGDMLSGITFGQFIECMGVMAEMERAREQGNEEDIGELISSIGRLLYKKQGPQETGTPPFPVCFHAYIFFLAVWELIYSVPISTNGKDIDFSILFEKSGRGNAGDNTGWVGISYDVAASGVFGDFRQVNDTPFWDVMLYIYKCRFEMLHNNKKQ

SEQ ID NO: 6288 - protein, 168 aa, B.fragilis
KGESKTLKIGKKTMGQLDKTDVEILQVLQKDAKVNTKELSEKLHISKTPIYERIKRLENDGYIKGYVALVDNKKVGLPLIVFCNVSLAVHDDEHIKRFQEEIKEIDEIMECYSTGGIYDFFIKVVLKDLDAYNRFVFEKLTKVHGIVKMQSSFVLSEIKHTTVLNIDR

SEQ ID NO: 6289 - protein, 215 aa, B.fragilis
QLLLARQEVEKSTVMKLCARFYDPTKGRILFGGVPVREIEPEKLMSRISMVFQDVYLFQDSIRNNIRFGKSDATDEEIVAAAKKACCHDFIMHLPHGYDTMVGEGGCTLSGGEKQRLSIARAMLKDAQIVLLDEATASLDPENEVEIQKAIDTLIKGRTVIVIAHRLKTIMGADHIVVLSDGKVEEQGTHSELMCRDGLYRKLWNIQESTLGWTL

SEQ ID NO: 6290 - protein, 140 aa, B.fragilis
IIYPKGINIMIQTIQVQGTEKRLYQLIAPLVMNPDVLSANNNYPFKTTEQYVWFIAIDKKSVVGFMPVEHRRSGCVINNYYVSGDNRETLSLLISSVLEAIGKEVRLFAVVMVNHQAVFEEHGFIMEKAWKRYVKMQKDE

SEQ ID NO: 6291 - protein, 608 aa, B.fragilis
INRLIMVNKKKEGLSRLFEIAGQKKSLLLLAGLLSAGSAVCMLIPYWAIYRILYELLNHSRELSSIDETNMIRWGWIAFGGLIGGLLLLYASLMSSHVAAYRILYGLRIRLTEHIGRLPLGYLNGTSTGAIKKTMEQNVEKIENFIAHTIPDLVNVMATVVVMFLIFFSLDGWLAGVCLAVIVLSIFLQFSNFMGKKAREFTRIYYNAQEQMSASAVQYVRGMPVVKIFGQSVRSFRQFNAEIEAYKTYALKVCDTYESGMTYFTVLLNSIVTFILPVGILLMQNDSRSLTLAAVWLFFIILGPGVASPVYKLMYLGSSTREINEGVSRIDRILENQPVSEPACPKIPATYDIEFRHVSFSYENKEQATRTEALHDLCFTAPQGKITAFVGPSGSGKSTVANLIPRFWDVEQGEILIGNVNVKDIATEQLMDLVSFVFQDTFLFYDTLYENIAVGSSKATRDTVIAAARAAQCHEFIEKLPNGYETRIGDKGVFLSGGEAQRVCVARAILKNAPILVLDEATAFADPENEYKMQQALKSLIKDKTVIIIAHRLSSIVSSDRIIVLKDGRAVQCGRHEELSSQEGVYKKMWNAYTSAFRWQLNVKQEKE

SEQ ID NO: 6292 - protein, 185 aa, B.fragilis
KHIAMSIKKSPVYNVIAVPVEKVQANDYNPNVVAPPEMRLLELSIWEDGFTMPCVCYYDKEKDVYILVDGFHRYSVLKTSKRIFQRENGMLPIVVIEKDLSNRMSSTIRHNRARGTHNIELMCHIVAELDKAGMSDQWIMKNIGMDRDELLRLKQISGLADLFANRDFSVPEDDQPGNVDKKPTR

SEQ ID NO: 6293 - protein, 337 aa, B.fragilis
RMSAIRNITIGRTERLYKPVGYTMLANLVNIVPFCLSIEAIRIIFRAFNGGGQSLDTTRLWCIFGCMTGYIAVMVLAERAAYRANFRGAYEMSASGRISLAEHLRKLSLGFLGKRDPGDLSSMLITDFTMAETGISHYLPQLMGALVMPVLAFVSLLWIDWRMAVAMFVALPFAMGILWLSTSVQERLSGRQIKAKVNAGNRLEEYLQGIRVMKAYNLLGDRFVRLRDAFAELRRACIRLEALLGPFVLLAITLVRAGLTLMVLCGTYLLLGGQLSILTFVMFLVVGSRVFDPLTSALTNFTEFRHFSISGGRILSLMNEPEMKGTKEAPEDGNIIF

SEQ ID NO: 6294 - protein, 117 aa, B.fragilis
  UNSURE (94),(95): Identity of amino acid sequences at the above locations are unknown.
SWRYPLDLGAVKLSAQQMIVLTPVLRYTEGEEQQLLAPVVIAGPRRYRVLKRSLAFGTDNFEMFPMLVENRKSGTPQTVNIHFGLPYHEWMRRXXLIIRERCPVVPIVLSVRMTIPL

SEQ ID NO: 6295 - protein, 156 aa, B.fragilis
IPLQVQKYIEYMETKILSNATHKCVLVIDNAQPTGIVANIASVLSMTLGCRVSNIVSHDVYDKQGERHLGITQLPIPILGASQEKIKELRNYFHSLEIEDLVLVDFSTIAQQSRTYDEYEREMYSANEDDLHYVGIGICAEKKAINKATGSLSLIR

SEQ ID NO: 6296 - protein, 60 aa, B.fragilis
LIRQLYLPLLANIRISPHVKNRLQALNVGTTYRMLLRDYYPPTRSNVYTIFNVARAFNVV

SEQ ID NO: 6297 - protein, 434 aa, B.fragilis
MMTKTTTVPKNVYELAQERLRIVFNEFDNVYLSFSGGKDSGVLLSLCIDYIRRNNLKIKLGVFHMDYEIQYKMTIDYIARMLEDNKDILEVYRVCVPFRVATCTSMYQSFWRPWEDSKKDLWVRPLPENAMTKEDFPFYNTQMWDYEFQMRFASWLHEKKDAVRTCCLIGIRTQESFNRWRCIYLNRKYQMYHRYRWTSKVGNDIFNAYPIYDWKTTDVWTANGKFKWDYNKLYDYYYWAGVNLERQRVASPFIGEAQESLALYRAIDPNTWGKMIGRVNGVNFTSMYGGTHAMGWQSIKLPEGYTWREFMYFLLSTLPDRARNGYLRKLQVSVQFWRNKGGCLSDETIRRLNEAKVPIIVMDNSNYKTTKKPVRMEYQDDIDIPEFREIPTYKRMCICILKNDHACKYMGFSPTKEEMSKRNQVIEQYKNILQ

SEQ ID NO: 6298 - protein, 96 aa, B.fragilis
SGINNVSATMFSNSCFCFILYFYDVSVRVALKNERYSKSFTKKEENLRKDSLLNFNPVNGDLYFCLLLLILSAKPSNLEFQTIYTHARYTPFPCYR

SEQ ID NO: 6299 - protein, 108 aa, B.fragilis
NMEKIEIVLRREQNNRNGIYLNYINGYWYTYEWSAFLLCMLHPEVEVRKCIGVQPDENYAIARVNKKIIKKLERKYQTSMMDDSIKILLPPFNEDENIFLNWKALLPP

SEQ ID NO: 6300 - protein, 307 aa, B.fragilis
VQRKKNGKMKDSKLKTAGMRKLHWGKAVMSIVVTLAAMPLTHSLARVLKEGTTGVEQFYAGMGMGAFGLFMVIAGVFVKGHIRQTLLGLFGGMFYWMGAVDFLFMYFANRFGTQAQLDPVTGEVVSRPEYLLLPATFGFWVMVMILYLFCTRNGCNFLNWWQKLFFGKHKKEIVVRAMTRHTSIVAFMEVITMLWTCYLVLMFCYDERFFGDHHPVTLLVGMLGLIGSIFMFAKLLRHASWDMSLRFGFATVIIFWIAVEVFDRIHLFPGLWENPGGHKQELLLIAASIIFTGWWLGYNNLLVLKNK

SEQ ID NO: 6301 - protein, 317 aa, B.fragilis
NGGCLIKRNFFCPLQYLRHIKLWNERKMADNVKANKMNSQADDDIGFGIYTDIADLPMTGCPSYIEEGIGGVCESGTATIVVFDVPFQIVPNVVITLMPWQLVFIKEISEDFRITFFKISKDMFSETLSTLWRPASGFLLYMRKHIVSIPDGELIGRFLAYCNLLVYRMKHTPQNCRQESIMQLLRVYFWDVYTVYINDPQAEKSLKFTRKDEYVYQFVRLIIEDHSPDKDVAYFAQKLGISPKRLTNLIRSISGQSAREWIVYYTILEIKSLLRESSLDIKSIAARVNFPDQTTLSRYFRHYTGVTPSQYRKNIYF

SEQ ID NO: 6302 - protein, 214 aa, B.fragilis
FYVRKQNAVRHMQTLKSDIRNRILSAAKEQFVQRGYLKTSMREIADAVDVGVGNLYNYFENKDELFCVILRPVSDALERMLQEHHGAKGADIMLICSEEYLKSAVDEYISLINKHGELMKILLFHSQGSSLETFREDYTNRSTEMVKTWFAEMKEKHPEINVVVSDFMIHLQAVWMFTLFEEMLKHAIDSKEMEYIVHEYILFEIQGWRALLRV

SEQ ID NO: 6303 - protein, 288 aa, B.fragilis
TRNSLTMKLLHIERHTTCLNYVSDYNICFIHQRLFSGGDFKIDNHHHSCILFLLKGEILTSCSEFHDQHIVEGHMVLFPQNDPNQSKSMTETEFILLFFDNQVNLHSKMSIELSAIHLESEKSCFYSLSICPPLRHVLDSICFYLKQKVQCSHMHELKQKEIFMVFGTFYNRTDMAHFLMPITGRDPNFKSFVLENYLQIRNIKQFAQLYHCSERSFNRKFKSCFHDTPYNWILNQKTRHIKGQLANRNIPISEIARTFHFASPSHFTTYCKKRLGITPSEFREKIAK

SEQ ID NO: 6304 - protein, 200 aa, B.fragilis
KVPGCADRLVSQDDHTVITSVFGEQFAPRTELSIVTPPVDPLKQRSETHTAYLNFEVDKYVMSRNYKNNANVLADVDRIVNEIQNDSNLTVTEFRVTGYASPEGDYSRNMELSENRALAFVGYLQNLGGVDESLLTVDWKGEDWSGMRREVAASSMIDKAAILAVIGEHTDFATRKKSVAGVECRNYLQDVTEGLLSAYT

SEQ ID NO: 6305 - protein, 197 aa, B.fragilis
SVYIIEETSMKKLILFGAAISISVAVSAQHVALKNNLLYDATTTPNLALEVGLGKKTTLDLYGGYNPFTFGNHKRFKHWLAQPEFRYWTCERFNGTFWGVHLHGGEFSVAGISLPFKIFPSLKDHRYEGYFYGGGVSVGHQWLLSKHWSLEASVGVGYAHWVYDKYRCVNCSPKIKSGHKNYVGPTKAAVSLVYFIR

SEQ ID NO: 6306 - protein, 119 aa, B.fragilis
QVRILIIIKKITIMKKVLVAVALVMGLGSSVAFAQEVENSTAVETQAQAPQDEFTKIDAQKLPDAVMNALAKSYEGASIKEVYSADKETGKIYKVILTTKDSQEVTVLLDEKGEEIKEA

SEQ ID NO: 6307 - protein, 275 aa, B.fragilis
KYRMKQKHEFENIVAETLLIPLYMRAKENRRKNPILCDKLAEQLVENIEYDYSRFDGAKLSEVGCVIRGWYFDHAIRRFIDTHTCPVVVNVGCGLDTRYQRVGNDGKAVFYELDLPEVIAIRRRLIPEPENDCYLSASLLETDWMDRIRLLHPNGDFIFVVEGVLMYFREEQVRTFLHNITMRFEGGELWFDVCGTMMSRRGVKPDSLREHKAQIRSGIDDGHMVELWEPGLHLLEQANYMKFFRSRWGFFFGQILGRMTKLCYKFSSMLGYKIG

SEQ ID NO: 6308 - protein, 61 aa, B.fragilis
RTQISGLMGPGSKTDIKQPIAEPIKEEVRCSGQKHLFSSIRHSPDVKFAFHFIHINYNNPL

SEQ ID NO: 6309 - protein, 238 aa, B.fragilis
ILMVIIGVFAQGDTRQTLWGFFGGLLFWTGWVEFLFMYFANRFGTQPELDPVTGEIVTRPEYLILPASFGFWMMVMVMYLFSTKNGCNFINWWQRLLLRGRKADIAARPMTRHVSIITFMELMMILWTSYLVLMFCYDDVFLGEHHPVTLLVGLGCLVGAFFIFVKQLRIASWGANIRMAIATVVVFWTPVEILGRMNLFSEIWIDPMNHVMEMGIILAVFIILTVYLWYMSAKKKKR

SEQ ID NO: 6310 - protein, 511 aa, B.fragilis
MSNSSIKSKTALLRNGETQKGNGYPEANDYSARILETMQTGVIFFNTEQIISGINNLACEDLQIPRDPSGHKITDIISIIHQEKDIFPELIARLKSSETDMEKLPIDTLIRSLETKVQFFASGCIMQLETGRYLLAFRNTMDEVTHEHLLSMILARTKIFPWFFDLKRNKMLIDAHWFSYLGIPAEDCEITIEKFFSRVHPNERDMLADALQKQLSEKEIPDSFSYRLQRGDGSWEWFSEQSMYLSKTNDGSPYRIVGVCHSIQEHKNTEDKLRAARNKAQESDRLKSAFLANMSHEIRTPLNAIVGFSNLIAGGIVDLDTEEARDYSALISKNCNYLLTLVSDVLDLSCIESDTMTFKFTVYPLTRLLTEIYQKYENRIPQEVQFNLLLPTDNVEIETDAVRLRQVIEHLLDNAAKFTVKGHIDIGYALSDHGEKIYVFVADTGCGIPSDQYKKVFERFYKIDSFVQGAGLGLSVCKTIVEGLGGTINVYSQLKEGSRFSVILPLNRLHK

SEQ ID NO: 6311 - protein, 484 aa, B.fragilis
SNFPHTFIWGEAQGEALITSGTSADGMGMLYGDIKLQNLIEDHTEGIKKFGDIFGRLTNLNLFIARVTDATYMDDVKKGYYLGQAYGLRAFYYFDLYRTYGGVPLRLTADVVEGVIDPNKLYMARATPKEVMDQIKKDLDKSMESFGDNNSFDPNNRGNKKGYWSKAATECLMGEVYLWISKVSTGDDAANEANLEIAKTHLQNVINNYGLKMLDDFSSVFDAKNGKGNSEIIFAVRYMEGEAGNNNNLFTYAMATGSTKDNYLANGEKFLDALNIANTGSQQLEYKHEIYNSFDVADTRREATFIASYSKNTETKELTLRGTHVRKNIGYVNAQGSRIYCGDYIIYRLPLVYLMLAEIENMQGGDVAKYINLVRERAYSTNWDKAIYGYTNADFTTNELAILHEKDKEFIQEGQRWWDIRRMTLTKGGKHLVFVKEGSIGTDMPTLDEATEAHKVLWPVDKDLLGNDPLIYQTPGYATYKKAE

SEQ ID NO: 6312 - protein, 1089 aa, B.fragilis
LKKAILMKKTIFLILCILCSLGAMAQKKSITGVVMDASGESIIGASVVEVGTTNGVITDISGKFTLMVDPNGKIKVSYIGYQPQVLDVKGRNSFNIKLKEDSEMLDEVVVTGYGGKQLRTKVTNSISKVSEESLKVGVFSNPAQALSGAVSGLKVTQSSGNPGSTPTIVLRGGTEWDGSGSPLVMVDGQLRDGLNDINPEDIESMEVLKDAGATALYGARASNGVILITTKTGKVGKAEINLKAKVGMNYINNPYDFLGAKDFITAIRTAYDTTPWASKSSLDGASAYGTGNKYGSDLVWNLLVKDSGNEFLLNKGWQQMQDPLNSSITLLYKDIKPSDYNLNNPSLTQDYNVNMSGGNDKGTYYAGLGYNKSEGLPISSFYERYSFIFNGSYKLADWITANSNFNYNRANWRSMPGSQDNEGNYFGRIMSLPPTVRYEDEDGNPVLGPNHSDGNQSYQPEKWLVDNQTDKFTMIQSLEIRPMKNLVIKGTANWYYSEGVYESFTKDFETAPGKFNTTRASSAKFERDFSQTYNVVLNYNNTFAQNHNIDVMLGSEYYDKKTKGFSASGSGAPTDDFADLNLTDNGEGKRTIDSWHSQYRILSYFGRLNYDYQGKYLLSGVFRYDGYSSLLGDNRWGFFPGVSAGWIFGKEDFIKNAVPDLSFGKLRFSYGVNGNATGIGAYTLQGSYNSQKYNGNVGYLIGALPNPGLKWEKTRTTEVGLDLSFFDNRLNANFTYYNRLTMDKYADLSLPTTTGFSSVKNNNGDFRNSGIEMELSGTILKIKDWTWKMGGNISYNKNKVVTLPDNGQPKNRIGGQQIYTGRKVLDEAGNQVDEVIFVGGKQERQEPGILVGYKAEGLYKSWDDIPENLIVKTGNYQGKYQYGPKAYAALSDAEKAKALQIAPGDVKWKDINNDGTIDAFDQVVMGNTTPHWFGGFNTTLTWKGLTLYGRFDFALDYWIYDNTTPWFLGCMQGGYNTTTDVFNTWSEENPNAKYPRYVWADQLGTANYYRTSTMFAYKGNYLAIREISLSYSLPQNIARKFYCQKLDVSVTGQNLGYITSANVASPEVSTAGSGYALPRTLLFGVNVTF

SEQ ID NO: 6313 - protein, 542 aa, B.fragilis
KEKYMKRIKSTILYGLLVASSGLLVTSCADKLDLSPIDYYGSGSYWKTEAQATAYIDGIHKHLRDAAWQHTITFGELRGGRFITGASSDGMGVSNGDIILQNFDETHTGVSKFGDLFGRITNLNLFIARVTDATYLSDEMKNFYLGEVYGLRAFYYFDLYRIYGGVPLRLTADVVEGVIDPNKLYMARSTPKEVMTQIKSDLNKSMEYFGNMNDFDPYKRGKKVYWSKAATECLMGEVYLWTSKVTTGDDVANPADLTIAKTHLESVLNNYNLKMLDDFSQVFNAKNKANDEIIFAIRFLEGEATNSNGTFTYNVGTGSTKNRYQANGEVFGDALDIQNTGNQTYEYNKAVYQNFDDADTRKEATFIASYNKDGKTGELSLYGTHVRKNIGYVNAQGARVYCGDYIFYRLPWVYLTLAEIANMEGDNAAVAKYINLVRKRAYGNAWDEILYAYPETADFTTNELAILHEKDKEFIQEGQRWWDLRRMTLTKGGTPLVFCKEGSLLGDAPILNKSTEAHKLLWPIEKTMLDKDPALEQTPGYK

SEQ ID NO: 6314 - protein, 420 aa, B.fragilis
NLNQMKNIFLIIGISLFFNGSLYAQSDDWSPKNHNLIKSVREDGRFSSSYGVVHAMLRNTEPRYAFHREFSPKEFRKWQKGLRHAMEEIMKFPQIKNSPAPVCIKREQREGYRLEKWEFYPLPECVSTFLVLIPDNINKPVPAILCIPGSGGNKEGLAGEPGIAPKLNDRYKDPKLTQALNFVKEGYIAVAVDNPAAGEASDLERYTLGSNYDYDVVSRYLLELGWSYLGYASYLDMQVLNWMKTQKHIRKDRIVVSGFSLGTEPMMVLGTLDTSIYAFVYNDFLCQTQERAEVMTMPDKNGRRPFPNSIRHLIPDFWKNFNFPDIVAALAPRPIILTEGGLDRDLDLVRKAYAIAGTPDNVKIYHYKKFSDPDTRKNVEYLPEGLDRNEYFRMVNVDGPNHYFKSELVVPWLRKLLEER

SEQ ID NO: 6315 - protein, 543 aa, B.fragilis
NTRNMKTIKSIIISGMLLVVSGGIMTSCSDLLDLSPIDFYGSGSYWTTEAQVTGYMDGLHKHLRDVAEQHIFTFGELRGGIYRSGNASDGNALNYGSIILQNFDRNNTGVTGFGGHYGRLANINLFIDRVSKADYIDDAKKKFYLGQAYGLRAFIYFELYRIYGGVPLRLDVEVIDGVLDPNKLYMARATPKEVMTQIKKDLDLSMEHFGNVTAFDPYNRGKKVYWSKAATECLMGEVYLWTSKVTTGDNEANIADLAIAKQHLQSVIDNYGLSMMDNFSDVFEAKSHKGNNEIIFAIRYLEGEATNRNVNYTYMNQGEIDKGGFREDGTPWNDPLGLKKSGAQWCEYIPELFQLFDVEDTRRDATFLASYKKDKDGNLSLWGTHVQKNIGYINSEGNRVFCGDYAFYRLPWVYLSLAEIANMESDHSGIEKYINLVRKRAYASNWDENKHGYKSGDFTQNELAILHEKDKEFVQEGQRWWDVLRMTLTKGGKHLVFCKEANLKNDGVPILNEATESHKVLWPIEQNMLDKDPSIKQTPGYDK

SEQ ID NO: 6316 - protein, 71 aa, B.fragilis
AKNGEKRKFCEYFQTSKNQAFILFLVLVFSLHKGLKMNLLEGDKSSIKIRLIHLLKNELMIFFQNPTEVRC

SEQ ID NO: 6317 - protein, 443 aa, B.fragilis
TKDMKFYNRENELAELQRIQELSFEENSRLTVVTGRRRIGKTSLIMRAFEKTPTIYLFVGRKNEASLCREFITLVSQALDIYVPEEISTFKSLFRYIMEVATRQSFNLVIDEFQEFYNINKSIYSDIQDIWDQYRQKTHMNFVVSGSIYSLMEKIFHNEKEPLFGRADNIIKLSAFSLNVLKKIIKDYHPQYTNDDLLALYSFSGGVPKYVELFCDNRVLTVDGMIDFMVRDNSPFTDEGKNLLIEEFGKNYGTYFSILSAISGGYNTQTEIEALLGEKSLGGYLKRLIEDYNIVVRQRPVFSKEGSQTVRYGICDNFIHFWFNYFDRNRSLIEIKNFVGLRKLIKADYPTYSGKILEQYFKQKYAESYEFRLIGSWWEPKGNQNEIDIVAIYLDNKSAIVAEVKRQKKNFKPELFQKKVEHLENKVLAKYQINTVCLSLEDM

SEQ ID NO: 6318 - protein, 70 aa, B.fragilis
CPCIVLIKGVTGTVIEKTKSEPFHKIKGKVKLSFYYQIECFYLFTTYSYLGKFQKRNIITYFFFLNFIVR

SEQ ID NO: 6319 - protein, 1100 aa, B.fragilis
TSLLLTQKAILMKKTIFLILCILCSLGAMAQKKSITGVVTDASGESVIGASVVEVGTTNGVITDIDGKFTLSVDPNGKIRVSYIGYQPQVLDVKGKNSFNIKLKEDSEMLEEVVVTGYGGKQLRTKVTNSIAKVKDEALKVGLFSNPAQALSGAVAGLKVTQASGSPGAAPKVTLRGGTNFDGSGDPLVIVDGQLRDGMQDINPEDIESMEVLKDAGATAIYGARASNGVILITTKTGKEGRREINFKAKMGLSYVNNPYDFLGAKDYINVLRTGYSKSGFTTSDGEYVSIAPLGNLTSASPFGTGNTLNDKTIWNIMNKTADNAYLLQKGWQEMPDPLDPSKTILYKDTNPADYNLNNPAISQDYNINMSGGNDKGTYYAGLGYNRQEGLPIKTFYERYSFVLNASYKITDWLTSSSNFNYNRANWKNMPGSQTSEGNYFGRIMSTPPTVRFQDEDGNPTLGPVAGDGNQNYQPDKWWNFNQSDKFTMVQAFQIDILKNLSVKGTANWYYSESLAESFTRDYENTPGQFVRTRSSSASFSRDFSQTYNVVLNYNQTFAKDHNVAVMLGMEYFDRYSRSFSASGSGAPTDDFADLSLTDNGEGKRSIDSGHSDYRILSYFGRLNYDYKGRYLLSAVFRQDGYSSLLGDNRWGFFPGVSAGWIFGQENFVKNALPFLSFGKLRASYGVNGNATGIGAYDLQGSYNSQKYNGNVGFLIGALPNPGLKWEKTRTAEVGIDMSFFENRLNANFTYYNRLTSDKYANLSLPSTTGFSSIKNNNGKFRNSGVEIELSGKILKTKDWSWDLGGNISFNKNKIVSLPDNGLIRNQQDAAQIYSGRQLSDGTYEKIWVGGNQEGYEPGVLIAYKADGLYRSWDEIPGDLVVTSGNYFGKKMYGPEAWKKLSSAEQKNALPIQPGDVKWRDINGDGMIDNYDQVVVGNTNPHWIGGFNTTLRWKNFQLYGRFDFAFDYWIYDNTTPWFLGCMQGTYNTTKDVFNTWSEENPNAKYPRFVYADQLMNANYYRTSTLFAYKGNYLAIREISLSYSLPKAWANKAYCQKVDVSITGQNLGYITSANVASPEVSSAGSGYALPRTLLFGLNVTF

SEQ ID NO: 6320 - protein, 329 aa, B.fragilis
QPMQIVLDRKKWGGLPEKYNGISDACILTDEKNGTIYVAGLWMYGVLDPRSGKWVEGMTQDSTRWIHQWHAKGSQPGLGAKETCQFLITKSVDDGLTWSDPVNITAQTKKPEWWLYAPAPGHGITLKDGTLIFPTQGRDKDGIPFSNITYSKDGGKTWIASKPAYHNTTECMAVELQDGSVMLNMRDNRNHGNKKVNGRRICVTSDLGSTWTEHSTSRKALIEPTCMASIHRHTYQENGRQKTLLLFCNPESYDSRDHMTLKCSLDDGNTWDSGRKIMLDELGSFGYSCITSVNDSTIGVFYESSQAQMVFQQIQLKELIGKGKSYKER

SEQ ID NO: 6321 - protein, 248 aa, B.fragilis
LEWSPLSFHNCNKLRMNFKEGEVLYFNKPLGWTSFKVVGHARYHMCRRMKVKKLKVGHAGTLDPLATGVMIVCTGKATKRIEEFQYHTKEYVATIQLGATTPSYDLEHEIDATYPTEHITRELVEKTLKTFVGEIQQIPPAFSACKVDGARAYDLARKGQEVELKPKLLVIDEIELLECNLPEIKIRVVCSKGTYIRALARDIGEALQSGAHLTGLIRTRVGDVKLEQCLDPAKFAEWIDQQDVEISD

SEQ ID NO: 6322 - protein, 142 aa, B.fragilis
VICPLFTVYCLPFVIIMANTLCKAERLNSKILIEKMFAGGSKSFSIFPLRVVYMPVENQDVQASILLSVSKKRFKRAVKRNRVKRQLREAYRMHKHQLLQILTDKQQQLAIAFIYLSDELTSSAEIEEKMKILLARISEKLV

SEQ ID NO: 6323 - protein, 73 aa, B.fragilis
INNTGSYTKKFVVIIPFPVFKKRNEETLNFWYNFLLIVSRYKNMFDYRQNDSFPTYHKPCSNVLLRQNTYGSK

SEQ ID NO: 6324 - protein, 381 aa, B.fragilis
IEMTKNKLLSCVIGVIILSLLVGAYFYQRNKVAVHQQAERLFVQMLQEEIERKERNLNLFHLFSESSSDTLPLKICIITEEGKKEYEVDSLKSKKNISQNLRNRSIHSILCEKSHLLPDSLNEHWQSMLKKDHIDTESTIHVRMENLQGKIISSSSHDGVWDTSSGIITSYIGNRCEIEVIGLLAFSWKTILWYHWQPFGWIVICLLLMLLFICFYYKKVNRPPELKEVPYEVVVEKEVVVEKEVIREIIVEKETSPEKKAPLIKQICKVEGQLYGLRYGVVFDAQNRVLNCNGKKMSLSPQQCQILKLFLDAPDYTVTDEDIIKFIWKGQSNVQINTFCSAGNKLGKRLEQAGCGVCFRRFGSDRYRMLFIDDLVDNDLT

SEQ ID NO: 6325 - protein, 254 aa, B.fragilis
IFRTLKIKKVLVSQPKPASEKSPYYDIAEKYGVKIDFRPFIKVESVSAKEFRQQKVSILDHTAVIFTSRHAIDHFFHLCTELRVTIPETMKYFCVTEAVALYIQKYVQYRKRKIFFGATGKIEDLIPSIVKHKTEKYLVPMSDVHNDDVRDLLDKNNIQHTECVMYRTVSNDFMEGEEFDYDMLVFFSPAGVSSLKKNFPDFDQKDIKIGTFGSTTAQAVRDAGLRLDLEAPNVKAPSMTAALDLFIKENNKGK

SEQ ID NO: 6326 - protein, 280 aa, B.fragilis
VCRYMIFVQDSLGAQEADTVQHVISAAGAPQDTLGSRVDLQAVSKTVTGAEGMPIPYSPRTDDGLAMILLGCFFVSAYVLARSKKFLLQQVKDFMLHRERTSIFASSTAADMRYLLLLIVQTCVLGGVCIFNYFNDIRPALMERVSPHILLGVYVAVCLLYLLFKWILYSFLGWVFFDKSKTDIWLESYSTLIYYLGFALFPFVLFLVYFDLNVTFLVSIGCVLVIFTKILMFYKWLKLFSCNIYGVFLLILYFCALEIVPCLIVYQGMIQLNNVLIINF

SEQ ID NO: 6327 - protein, 304 aa, B.fragilis
FDDLCIQKETLMKSKSRNNAVSYFDMQFITSSISTTLVLLLLGLVVFFVLAANNLSVYVRENINFSVLISDDMKETDILKLQKRLNNEPFVKETEYISKKQALKEQTEAMGTDPQEFLGYNPFTASIEIKLHSDYANSDSIAKIEKLIKRNTNIQDVLYQKDLIDAVNENIRNISLVLLALAVMLTFISFALINNTIRLAIYSKRFLIHTMKLVGASWGFIRRPFLKRNIWSGVLAAFIADTILMGAAYWLVSYEPELIRVITPEVMLLVSGAVLVFGVVITFLCAYLSINKYLRMKASTLYYV

SEQ ID NO: 6328 - protein, 76 aa, B.fragilis
NVYLMKMKNYLKVTVFWVAVLSVWCLKPTKKSQDTLLLQNVEALASGEEPSQIHCYWRGSVDCPVSHDKVEVVYEY

SEQ ID NO: 6329 - protein, 437 aa, B.fragilis
FIIHNFIMGYLFTSESVSEGHPDKVADQISDAVLDKLLAYDPSSKVACETLVTTGQVVLAGEVKTGAYVDLQLIAREVIQKIGYTKGEYMFESNSCGVLSAIHEQSADINRGVEREDPMNQGAGDQGMMFGYATNETENYMPLSLDLAHRILLVLADIRREGKEMTYLRPDAKSQVTIEYDDNGTPVRIDTIVVSTQHDEFILPADDSAAAQLKADEEMLAVIRKDVIEVLMPRVIASINHPKVLALFNDHIIYHVNPTGKFVIGGPHGDTGLTGRKIIVDTYGGKGAHGGGAFSGKDPSKVDRSAAYAARHIAKNLVAAGVADEMLVQVSYAIGVARPINIYVNTYGRSNVKMSDGEIAKKIDELFDLRPKAIEDRLKLRYPIYSETAAYGHMGREPQMVTKHFQSRYEGDRTMEVELFTWEKLDYVDKVKAAFGL

SEQ ID NO: 6330 - protein, 439 aa, B.fragilis
LNFKTYYHSMNFVEELRWRGMVHDMMPGTEELLAKEQVTAYVGIDPTADSLHIGHLCGVMILRHFQRCGHKPLALIGGATGMIGDPSGKSAERNLLDEETLRHNQACIKKQLAKFLDFESDAPNRAELVNNYDWMKEFTFLDFAREVGKHITVNYMMAKESVKKRLNGEARDGLSFTEFTYQLLQGYDFLHLYETKGCKLQMGGSDQWGNITTGTELIRRTNGGEAYALTCPLITKADGGKFGKTESGNIWLDPRYTSPYKFYQFWLNVSDADAERYIKIFTSLDKAEIDGLVAEHNEAPHLRVLQKRLAKEVTVMVHSEEDYNAAVDASNILFGNATSDALKKLDEDTLLAVFEGVPQFEISRDALVEGVKAVDLFVDNAAVFASKGEMRKLVQGGGVSLNKEKLAAFDQVITTADLLDEKYLLVQRGKKNYYLIIAK

SEQ ID NO: 6331 - protein, 298 aa, B.fragilis
PLFNQILFQMKNLILVLGCFFFLISCQQTEKEKLEELVKNWNGKEVLFPTNPSFTLYGKTPVDFKIPVSDYKIVTYVDSLGCSSCKLQLPKWKEFMKYADSIVGYQIPVLFFLHPANVREMRSVLKQNRFDYPVCMDTEDTFNKVNKFPSQLNFQTFLLDKNNHVIAIGNPVHNYDVRELYIHLISGGIDGDSLSNMRTVIKIEEDMVDLGSFDWRREQHITFEIHNIGNNNLVVYDNKTSCGCTSVEYSKEPVQPGKSLAVKVTYKADHPEHFNKTIILYCNASASPLELKITGNAK

SEQ ID NO: 6332 - protein, 60 aa, B.fragilis
YFLNFQRPKNLLSKHYLAESYLDTLSDKVRFQGHKSIKLKGKPHKYYRKKALTTCKTSIF

SEQ ID NO: 6333 - protein, 89 aa, B.fragilis
IMSKKIFAALIVAVVATFAGYNIYQSQKTEKIVSDLVIANVEALAGDTEGGATITCSRTCSDGVGRCYKVYDKWGNCHFDGSQTYSCTC

SEQ ID NO: 6334 - protein, 676 aa, B.fragilis
LLIKGSVMLRGEKSYMNMKIMKYIGLGLLLLVCSCGGRDRQVEEALSLSGNNRNELEAVLKHYEGDGRKLEAARFLIGNMPGSYGANPIVEQDCSAFYEAYDSLGQKYDYRVGTEWGKQVDSLWKDFSNRHRVRQELNYDITRMKAEDLIREIDLAFRAWVENVHSRNCSFEDFCEYILPYRRQNGLLIDNARREFNKRHQGKYFVKEGKDWQQEIDSLLYEYKYLTHSGFWGTKIPIWNAVTLEKMRHGLCAQRCWYNSLLLSSLGIPVAIDFVPAWGNRNNSHTWNVVLINGESHAFEAFWDNDRWKYKRIYNNRDDDELWGRFRLPKVYRYTYSNHIEGPLADVEVDKADIPELFRSVKKVDVSSEYFETADVTVELTGEAPQGVKYAYLAVFGYQDWHPVQWAKIENGRAVFREMGKDMVYLPVYYKRGGLLPAAEPFRLRNDGTMEKLSGNEGTEEVAVRMVTGAPAYDQNREYLGCMKGSRIVGLLDGKSEEELCRWTDSLALQSVVRKVSARLPYRFVRLLLPSDSIALGELSFYTEEGRIGNMRIITPMRATGRNEVPGMITDGLGATGYRGRVAERLVDIDLGKEYMVSHIGMTSYLKTQLFCPDEFELRYWDNGWKTVERKQADHKGYLVFERVPRGALLMLKNCRWKGKTAERIFTYEKGDVKWE

SEQ ID NO: 6335 - protein, 93 aa, B.fragilis
VFKNIISMVNFSLEGKVAWVTGASYGIGFALATAFSEAGAKIVFNDISRELVDKGLAAYKELGIEARGYVCDVTSEEQVNALVAQILFTAGLQ

SEQ ID NO: 6336 - protein, 268 aa, B.fragilis
NRMEWFEALILGLIQGLTEYLPVSSSGHLAIGSALFGIEGEENLAFTIVVHVATVFSTLVILWKEIDWIFRGLFKFEMNSETRYVINILISMIPIGIVGVFFKDEVEAIFGSGLLIVGCMLLLTAALLSFSYYAKPRQKENISMKDAFIIGLAQACAVLPGLSRSGSTIATGLLLGDNKAKLAQFSFLMVMPPILGEALLDGMKMIKGEAIAGDIPTLSLIVGFIAAFVSGCLACKWMINIVKKGKLIYFAIYCAIVGVVTIVVSQLQ

SEQ ID NO: 6337 - protein, 81 aa, B.fragilis
IIFWIYCYFCFVLTDYLMKNKLKTAFTLLVYIAVTVGIYALICHLNHQPFDDLRILYAVLIGCVAYLPRHLMVRKSRKSQK

SEQ ID NO: 6338 - protein, 85 aa, B.fragilis
GECCQLSYLSLIVAVVATFAGYNIYQSQRVESIMSDLTMANVEALAGSEINDEDCVSASNRYCSVLIVTPNGNYLETYFDQKTKY

SEQ ID NO: 6339 - protein, 527 aa, B.fragilis
SMKRRDFLKCSLAVGAGLAASPSTYAFNGESKETGNDSSKLSKAPATKGGKPHIIFIMSDQHRGDALHCMGNKAVISPNIDKLAQEGSLFVCGYSSAPSSTPARAGLLTGMSPWHHGMLGYGKVASKYKYEMPQMLRDLGYYTFGIGKMHWFPQKALHGFHATLVDESGRSETRDFISDYREWFQLQAPGKNPDLTGIGWNNHNAGTYKLEERLHPTAWTGQTACELIRNYDSDQPLFLKVSFARPHSPYDPPKRYLDMYEKVDIPVPFVGDWCGKYAERKDPERVSKDAAFANLGEEYAVNSRRHYYANVTFIDDQIGQIIQILKEKGMYENAIICYTADHGDMLGDHYHWRKTYAYEGSAKIPYIIKWPSAMTTQAIRGKRIEQPVELRDFLPTFIELAGGTVPDDMDGKSLVALASGNKNGWRKYIDLEHATCYSADNYWCALTDGKMKYIWFIHTGEEQLFDLSSDPGEQKNLSGNSRYADRLVEMRKAMVDHLQERGTEFVKDGKLAVRDQTLLYSPNYPKD

SEQ ID NO: 6340 - protein, 90 aa, B.fragilis
NDRSHTLQRLHKYGRVTQHQALEPPDNQWTGMQAKSQKDAFVHLYIYVNTLLRKSSNYKKDNPLTWWKVDWQLSRTVNNSPGYCTYQRIL

SEQ ID NO: 6341 - protein, 692 aa, B.fragilis
RPCGSFQPRGEDQVTAFNTGWQFKKGPFATDPMRAASQWDGKWETVEIPHTWNAMDMQVQSGSFYEGAGYYRKTQFFPHDLEGKRVFLRFEGVGACAEVYVNGKLAGTHKGGYSAFACEIGTALKLGAENEIIVKADNKARPDVIPVNQNLFGVYGGIYRPVWLIVTEQNNITVTDCASPGVYITQKDVSKKSADITVKVKLDNAGLQPAAVTLENTIYTQEGRKVGTHSRSFDLSPQGTQTYLSTFKLKNPHLWQGRKDPYLYKVVCRLMADGKVIDEVVQPLGVRKYEIVAGKGFFLNGEKYPMYGVTRHQDWWGLGSALKNEHHDFDLAAIMDVGATTVRFAHYQQSDYLYSRCDTLGLIIWAEIPCVNRVTGYETENAQSQLRELIRQSFNHPSIYVWGLHNEVYQPHEYTAALTRSLHDLAKTEDPDRYTVSVNGYGHMDHPVNLNADIQGMNRYFGWYEKKIQDIKPWVEQLEKDYPYQKLMLTEYGADANLAHQTEYLGDALNWGKPFYPETFQTKTHEYQWSIIKDHPYIIASYLWNMFDFAVPMWTRGGVPARNMKGLITFDRKTKKDSYFWYKANWSEEPVLYLTQRRNADREKRTTAVTVYSNIGIPKVYLNGQELSGIRNGYTDVHYVFDNVSLADGKNILKAVVSTKGKEYTDEIEWNYSGEKNREIDSYENKNEHSGF

SEQ ID NO: 6342 - protein, 79 aa, B.fragilis
ITMGDKQKFAFDKTNFILLAIGMAVVILGFILMTGPSSSETVFQADIFSVRRIKVAPVVCFLGFIFMIYGVMRKPKTKE

SEQ ID NO: 6343 - protein, 67 aa, B.fragilis
GVTGLLDMYIFCFSNFSLCRDGTDKREEALLFSGNNRDEFETVLNAIYLGGILELVDSYKSSCLRVK

SEQ ID NO: 6344 - protein, 354 aa, B.fragilis
FIIMNKIVSFFILILVCSCSDRKEHIANILSMNSIDIKTNRINKDEVIARGAFPFEMIDSLFFLFNGDPSSGALVLCESNASELGHFLQKGNGFGECITPGYIGHCNDTIYVSERSRTRRMTYLLSNHNDSLQYKCLEDVSPKMNSEFYYQICRLQSGLFVGARLFGKEHLFTLLDESLDTLTTFARVPIDIEENANNKLAPFIGHLCIDDNTVYYASNDFSYMAAYDILSEKEIKPVFERMYISPIIQKSANGISLDKYKHLLGFGDIRVYQNYIFATYIGKPDITMDQENDISALVPTHLLVFNKDGVPIVKFKFPFKIRSFVFTKSKMYLLDVDCNIESVDLVELWKHLPD

SEQ ID NO: 6345 - protein, 357 aa, B.fragilis
THIIIMKLSQFKFKLPEEKIALHPTKYRDESRLMVLHKRTGEIEHKMFKDILNYFDDKDVFVFNDTKVFPARLYGNKEKTGARIEVFLLRELNEELRLWDVLVDPARKIRIGNKLYFGDDDSMVAEVIDNTTSRGRTLRFLYDGPHDEFKKALYALGETPLPHTILNRPVEEEDAERFQSIFAKNEGAVTAPTASLHFSRELMKRMEIKGIDFAYITLHAGLGNFRDIDVEDLTKHKMDSEQMFVTEEAVKIVNRAKDLGKNVCAVGTTVMRAIESTVSTDGHLKEYEGWTNKFIFPPYDFTVANAMVSNFHMPLSTLLMIVAAFGGYDQVMDAYHIALKEGYRFGTYGDAMLILDK

SEQ ID NO: 6346 - protein, 283 aa, B.fragilis
IRNMKTNYEIRYAAHPEDARSYDTKRIRRDFLIEKVFSADEVNMVYSMYDRMVVGGAMPVKEVLKLEAIDPLKAPYFLTRREMGIFNVGGSGIVRAGDAIFQLDYKEALYLGAGDRDVTFESTDAAHPAKFYFNSLAAHRNYPDKKVTKADAVVAEMGTLEGSNHRNINKMLVNQVLPTCQLQMGMTELAPGSVWNTMPAHVHSRRMEAYFYFEVPEEHAVCHFMGEVDETRHVWMKGDQAVLSPEWSIHSAAATHNYTFIWGMGGENLDYGDQDFSLITDLK

SEQ ID NO: 6347 - protein, 212 aa, B.fragilis
SMDILDIHTHRMPVELGQAIQNCQPAEFDPLAGAYYSVGIHPWYLTRENLDRQWEMLLAAIQCPQVLAIGEAGLDKLVRTDYMLQQEVFEKQAMLAHEMKYPLVIHAVRSANEIICLRKKMKPSNPWIIHGFRGKKELALQYIREGIYVSLGEKYQEEVLWGIPLEYLFLETDESMIDIHCLYERAALLLEIPLCKLMQQVRQNINNVFFRQ

SEQ ID NO: 6348 - protein, 76 aa, B.fragilis
ETGMKGLLSYILLLPIYFYRACISPMTPPSCRFTPTCSQYAIEAIKKHGPFKGLYLAVRRILRCHPWGGSGYDPVP

SEQ ID NO: 6349 - protein, 201 aa, B.fragilis
TKPMQEMNQITSVCVYCASSTKIDQTYFDAAIKLGHLLANRHIRLINGAGNIGLMRSVADAVLQNGGEVTGVIPHFMVDQGWHHTGLTELIEVESMHERKRLMAEKSDAVIALPGGCGTLEELLEIITWKQLGLYLNPIVILNTNGFFDPLLEMLENAIEGNFMRKQHGDIWHVAHTPEEAVELVYSIPVWDGSIRKFAAI

SEQ ID NO: 6350 - protein, 375 aa, B.fragilis
TDFLVRVLRVCLIYFKNEIYVSCLKITKMKQKYILFLSLCFVLFSCRKNDVGSVYSFDTVCKIVDYNLICSDENAPWGAIMNMEIVDSILILQHAMDEYAFSFINVNNGELLSQWGRTGEGPEEFIDFGSGFEIVDSRIVFLDRMKKERISVLLSDILSKKEHPDITREAYPYNVDFRVLEINAVGNKKIVTGGFKKGYWGALDSQNHIIPNVAELPFDAGEVSGLEKGIVFGGILKANSKQSKFVLSIRASDIFEIYRVSDDGINRVYVSPFKHIPKTWKKGGGYAIDYNQSIGGIKNIAVSDDLICFSLFLQNYNEAAKTDFASNELFCFDWDGNKVKKYVLPFPIGNFCIDGTHIYGVRNFEDKIIIYRFNM

SEQ ID NO: 6351 - protein, 1098 aa, B.fragilis
SKQINSVSMRKLFVCIALGLTTLTGNATSPLWMRDVQISPDGTEIAFCYKGDIYKVSAGGGTAIQLTTQPSYECTPIWSPDSKQIAFASDRNGNFDIFVMPATGGTAQRLTTHSSSELPSAFTPDGKYILFSASIQDPSQSALFPTTAMTELYKVPVNGGRTEQVLGTPAEAICYAPSGEFFLYQDRKGFEDEWRKHHTSSITRDIWLYDTKTGKHTNLTNHAGEDRNPVLSPDGKSVYLLSERKGSFNVYSFPLDNAQDLKAVTSFKTHPVRFLSMSHGGTLCYAYDGEIYTQKDNATPQKINIDIVRDDQDKIADLTFTNGATSGTVSPDGKQIAFIVRGEVFVTSTDYATTKQITHTPAREAGLTFAPDNRTLAYASERNGNWQLFLAKIARKEEANFPNATIIEEEVLLPSATVERAYPQFSPDGKELAFIEERNRLMVINLDTKKVRQITDGSTWFSTDGNFDYQWSPDGKWFTLEFIGNRHDPYSDIGLVSAKGDSPITNLTNSGYMSGSPRWVLDGNAILFTTERYGMRAHASWGSQNDAMLVFLNQDAFDKFRLSKEDYELQKELEKEQQKDKEKASIDPKKDKKKDPQTDTEKKDEIKNILVELNGLEDRIIRLTPNSSNLGSTIISKDGETLYYLSAFEGGFDLWKMDLRKKETKLLHKMNAGWASMDMDKDGKSLFVLGGNAMQKMDLSGETLKPINYKAEMKMDLAAEREYMFDHVYKQQQKRFYNTNMHGVNWDTMSAAYRKFLPHINNNYDFAELLSEWLGELNVSHTGGRFSPSIPGDATASLGVLTDWNYKGKGASIMEVIEKGPFDHARSKVKAGTIIEKINGQEITPETDYHTLLNDKANKKTLVSLYNPQSGERWEEVVIPIGNGILNNLLYKRWVKQRAADVDKWSDGRLGYVHIQSMGDDSFRSVYSDILGKYNNREGIVIDTRFNGGGRLHEDIEVLFSGKKYFTQVVRGREACDMPSRRWNKPSIMLTCEANYSNAHGTPWVYSHQKLGKLVGMPVPGTMTSVSWERLQDPSLVFGIPVIGYRLPDGSYLENTQLEPDIKVANSPETIVKGEDTQLKTAVEELLKELPAGKGKKH

SEQ ID NO: 6352 - protein, 590 aa, B.fragilis
EHKIKIYLAIIMKSILTFLLIILMDIQFNYACPCSPTNTLIEMNESFASQFQTATIIPMFLWQPSWSYPIEGLAIGLLISLIVYYRMVYSTKLFPHEKLRLILNITHKTQTPLTLIHHLLEEIISDSLSESTSQKVKRILRYTSHIMSCYQNIAVFDDKENELHPGSSPIEFELYTFITSIVNQCRAYADTRQIKLNINKDFSYISCRVDEITMTAALQCLLNKMIEATPCKGCINMDVSHSIKHWNLQITNGPECRQSHKKMLSFISTFMLIHYCGSLQIIKKIIRLHGGKLIGSYHGRSITLRVTVPINGYCNTIQCPEVVPPVMKDDKIIRPDKKQHHILLVMADTELSNYLHKAFSILFRITILENPEQILHFSGDRLPDIIVIDETVNGIRGKEICSKIKSNTSMVHIPVILLISNNDNGSYLAHADCGVDKLEPRAINICRLKMDIQILINKHERIMKLLEKNLSDNLPSPTAKSEEDALFINKVNKLLEKNLSTESYTVDMLSADMGMCRTKFYTKIKEITDKTPTEYMHYFKMNKAKILLVTQQYTVTEIATFLGFCNAKYFGKRFKKFYKVPPTQYIKEVF

SEQ ID NO: 6353 - protein, 376 aa, B.fragilis
CNKIMKNILLTLLLFILFSCRSTGDKTDCEVLHVDLVERPVPTEELFSKISVIPLETNDSSFLVRPVKVIIKDNRYYIVDEGVPAVFSFDEEGHLLHKIGKKGQGPGEYREIYDAVIKEKENTVYMLSPFGSLYVYSLDGKFIKEIKLPTRSNYQLIEELDSKYFVTWTLPASENENCISVISKESFNNVKEFWHVPPVLTTLNSKPFYNYEHKVYFSNPYQNEVYEVRTDSLRVAYRWDFGKDNLDLKEYGFTLLEDQKVEEYKLMLQCLRDSTVPYLLRHQFQNKKYYYTMLTFGFRHRINLFYRKDDGKSFFFEKTAEGVLLHPLAFNEDFLTCIVFNEDFPNYEKVLPSEEYKKLEERLEDDNPCLIKFYFK

SEQ ID NO: 6354 - protein, 355 aa, B.fragilis
LYRINMNNMRFNLVVLFVILLSFYSCGREEKTVYDFPLEQSLKSDKEVSLNKELLAPYLMCSYDSTLCLIDWTANPMVHVYNMNTGKEMVAFGNKGMGPDDFLSISQMYVDMGKRSLVLYDQSLQTISSFQIDSLAQGSLSKIDCVSAPKLGMNRVYAYSDSIFYGSGTFESGLIAKCNQKEILNQYLPFPHTEQAVNRDVNYLLFQGDLIMKPDKKRFAYLAYECDLLSIQKVVNDTCLESVVHLNTYTPLFENQSTNEVSSVNVSTDSPKGFLRGVATENYVYALYSGQIGKNKAIANEIYVFDWEGRAVKKVILDRWGVCISVDSNDERLCLMTKETDGGEERYHYYCYQLN

SEQ ID NO: 6355 - protein, 359 aa, B.fragilis
IKKIMGKYISILILIETILLGCHSTKEKIEFSNRVICSDSISRELVVLNDTFLFSYPLQIECIDSMLLVLDNVNNNFFHLFTLKGVPIKSFGEKGQGPIDFINVESFNLSEDRKIMYAYDTSLRKIVKYDVSSFLKDSLKSEVIQVNYDSLPQTEVPTIIYDMLSLKDSNFLVKANHKGLRFGLLKDGKVTQLYNSFSDCVNTNDDEEVWSVFCSNTKTKLRPDRTKMLNATYLGGVLELFDLDDNCSLSLAKILYIYEPKYGIAEGAIPKYVVFNETTQIGFEDIYVTNNSIYTLLHSIGSETLPSEITVFDWAGIPITKIKTGCSLSNIAVDGKDNTIYVIAENEQNAYELSCLSLN

SEQ ID NO: 6356 - protein, 81 aa, B.fragilis
HLYFEAMKNYMKLIFGLIVLIGYWPTTKIPKRVNSLFLQNVEALAGSEHVTNLGCLGDGSVDCPINHIKVEHVVQGFSLGE

SEQ ID NO: 6357 - protein, 83 aa, B.fragilis
HLYFETMKNYMKLIFGLGLIALVGYWPAAKTPKRVNSLFLQNVEALAGSEHVTNLGCLGDGSVDCPINHIKVEYVVQGFSLGE

SEQ ID NO: 6358 - protein, 409 aa, B.fragilis
DNIVKYYICLQKQTVMKRSRLFLWIFGILMQAFLISMHFYQRNMEAMYAETEYLLKEVLNEELHRKQQELNLFYISKVTIDTIPLKIRVTTSKGVKTFTVDAKKSKKNISQSMAERSWHSAACMKSRLSTDTLNLLWNRRLKSQQIFAKTDVHITTTHLDNTISYCKCKNCKDYCFGTHKFTFYVGNRCEIEVIAFCSYLRWAVYQYHSIPFEVIWSVTAVLIIILCSWYLIKKYISKIRNDKKHLANDRDRERKVRIQLEKDQKRLEVKQKEYEKRIKDFSAKGEEYEEERKSMEKILKEYENQIQKLKELRESGKEPLLYRLSPKVTFDSYAKVLICSDQTISLTSQACQLLDAFLNASEYILTYEELLRYLWEDGTGDMIRLRVAISRLRVALSIDPENFYFSEGY

SEQ ID NO: 6359 - protein, 376 aa, B.fragilis
SNKVMKNISLILLLFILFSCKSTGDKTDCEVLHVDLVERPVPTEELFSKISVIPLETNDSSFLVGPVKVIIKDNRYYIVDEGVPAVFSFDEEGHLLHKIGKKGQGPGEYREIYDAVIKEKENAVYMLSPFGSLYVYSLDGKFIKEIKLPTRANYQLIEELESKYFVTWTLPASENDNCISVISKESSKNVKEFWHVPPVLTTLNSKPFYNYEHKIYFSNPYQNEVYEVRTDSLRVAYRWDFGKDNLDLKEYGFTLLEDKKVEEYKLMLQYLRDSTVPYFLCDQYQNDKFYYIMLVFGLKHSKNLFYRKEDSKSFFFEKTTEGIHFEPLAFNEDFLTCIVFNEDFPNYEKVLPPEEYKKLEERLEDDNPCLIKFYFK

SEQ ID NO: 6360 - protein, 65 aa, B.fragilis
PAKVATTATIRAAKIFLLIIYFYDVNYFSPMSLFRGATSSVKKVNATFTHSNYFFAIFVPGNLLF

SEQ ID NO: 6361 - protein, 154 aa, B.fragilis
VMKVYLGLGTNLGDKELNLRVALQKIEERIGKIISLSAFYATAPWGFQSENNFLNAAVGVETVLSPVGILESTQRIEQEIGRLHKSRDGVYSDRLIDIDLLLYGDKILQDERLIVPHPLMTDRKFVLEPLAEIAQDVVHPVFHKTIKELFLALS

SEQ ID NO: 6362 - protein, 311 aa, B.fragilis
RFGVHLNMQIKPMNKLTINACPLCGGAHLKRAMTCTDFYASGEQFDLYTCEDCGFTFTQGVPVEAEIGRYYETPDYISHSDTKKGAMNAIYHHVRQYMLGRKARLVMKESHRKTGRILDIGTGTGYFAHTMQNRGWEVEAVEKSGQARNFAREHFGLNVRPEAALKELVPGTFDVITLWHVMEHLEHLDETWELLRELLTEKGVLIVAVPNCSSYDAMKYGKYWAAYDVPRHLWHFTPATIQQFGSKHGFILAARHPMPFDAFYVSMLTEKHKGSAYSFVKGMWTGTVAWLSAQAKKERSSSMIYVFRKKR

SEQ ID NO: 6363 - protein, 77 aa, B.fragilis
WVMSVFCLQETCFLQTKDYMDNSSKQNIHREKHLVFSFTHRYILNITFGRHPLGSTVIPDTLKAYTDIMSAIQTRHI

SEQ ID NO: 6364 - protein, 110 aa, B.fragilis
NKNTMYTIQANPSGTRSMEISEENLVTIEKYSLFQHLIDSNGIVDEAVLEKLKLNIRSLIASQEEDSKDLLDLCIDVIYHNNMKAFGLQQLIKLYLTWLSKQEAEEEEEA

SEQ ID NO: 6365 - protein, 150 aa, B.fragilis
SFVAYYMNQFYIIMKAKMFFLVVAMLLCRGVAYAYSPSANDPISKSGGIEQDIPPPHIPPPPLPSQIFLHVGEISETPYPMIGAMVWECDNPPVGIEQEESYIFGTMIILRIKGVAAGRYQVDMKWYNPLNPGQPPLGRQTIEVIVQPWP

SEQ ID NO: 6366 - protein, 149 aa, B.fragilis
GVALPCGWLHPISVPSQTTGQPDRQSTDLFNYFKFITQNQRKSLSLPKIFSIYSHKTFGIMAKRRELKKNVNYIAGELFSECLINSKFIPGTDKKKADELMVEIMKMQDEFISRISHTEPGNVKGFYKKFRSDFNAKVNEIIDAIAKLN

SEQ ID NO: 6367 - protein, 746 aa, B.fragilis
ICSNIHNNTIMKKHLSLILVLLPVLFLALPALAQERKKVGVVLSGGGAKGVAHIQALKVIEEAGIPIDYIVGTSMGSIIGGLYSIGYTPQQLDSMVRKQDWMFLLSDRVKRSAMSLNEREKSEKYVFSFPFTKSPKDAVSGGIIKGQNLANLFTELTVGYHDSVDFNKLPIPFACVSQNIVNGEQIVFHNGILATAMRASMAIPGVFTPVRKDSMILIDGGMINNYPVDVARSMGADIIIGVDVQNNLKGIDKLNSAPDILSQIIDLTTKNNHQSNVGLTDTYIKVNVEGYSSASFTPAAIDSLMHRGEVAARKQWASLLALKKKIGIADTFVPQSHGPYTMFSKDRTLHVKEITFSDVEENDKKWLMKKCKLQENSRISMRQIEQALFILRGNQSYSNASYTLTDTPEGYKLNFLLEKKYEKTINVGIRFDSEEIASLLINATAQLKTHIPSKVSVTGRLGKRYMARVDYTLEPMQQRNVNFSYMFQYNDINIYDHGDRAYNTTYKYHSGEFGFSDVWYKNFRFGFGARIEYFKYKDFLFKKPEFTMNVNSEYFISYFAQLRYNTFDKGYFPSKGSNFSGAYSLYTDNFARYNGHAPFSALSASWESVFSISNRLTLIPALYGRVLIGQEIPYAYENALGGDVFGRYLPQQLPFAGIYNIELTHNSVAVASLKLRQRMGSKHYITLAGNFALSDDNFFKILKGNRIYGCSIGYGLDSMFGPLEASLGYSNQSKDVGFYVNLGFSF

SEQ ID NO: 6368 - protein, 1023 aa, B.fragilis
LPEKSIGSRYPQIENAVYRINGQLATSSANDLSAIAGFSFISSTFAPDNHSTEHMKKLCIFLLLLFAATGILFAQEIEKSVKERLSNYFETYTPASANTGSCKLKSVDIDFEGRKLSIYASESFAYQPFVPETVDEIYHQIEELLPGPVRFFRTTIYANNQPIEELIPNFFRGKKKKDKSRLSNAEYKGAPWVINTSRPYEITKGLQNRHISLWQSHGKYYKNDKGEWGWQRPRLFCTTEDLFTQSFILPYVIPMLENAGANVYTPRERDTQKNEVIVDNDTRNGSIYLEMKSRKARWEKTDGYGFAQRKPVYEDGENPFLTGSARFTRTEKKKNKAFAEWIPTIPETGSYAVYVSYQTLPNSVSDAKYLVFHKGGVTEFKVNQRIGGGTWVYLGTFEFDKGSNDYGMVVLSNESSENGVICADAVRFGGGMGNISRGTVSGLPRYLEGARYSAQWAGMPYDVYGGKQGTNDYADDINARSNTINYLSGGSVFNPGQKGLGVPFEMNVALHSDAGYSKTNDIVGSLSIYTTDFNNGLLNSGNSRYASRDLADLLLTQIQKDIRAKFNIQWTRRSMWDRNYSETRLPAAPSTIVELLSHQNFADMKLGHDPNFKFTVGRAIYKAVLQFISSQHNKEYVVQPLPVSNFAIEFGKKRNTLELSWQGENDPLEPTARPREYMVYTRIGYGGFDNGVRVNKPSYTLKIEPGLVYSFKVTAVNHGGESFPSEILSAYKAKQEHARVLIINGFNRLSGPAVIDTPDEAGFDLEQDPGVAYQYNISLCGAQTGFDRSQAGKEGKGSLGYSGNELEGMKIAGNTFDYPFVHGKAIQAAGNYSFVSCSDEAVENGRIQPEHYPIVDFILGLEKDDILSNPARKTYYKTFSSPMQRILTAYCQSGGNLLVSGSYIGSDMSNSQGNREFTEKILKYGFQGSLKDTRSGQITGLGRTLQIPRLPNEKAYAVTAPDCIVPVDSAFPVFVYQPGQYSAGIAYKGNYRVFAMGFPFESIESETDRAIVMAAILKFFGEK

SEQ ID NO: 6369 - protein, 1025 aa, B.fragilis
FKRNSSSLSLGEGRGETLLNMKVSFFIDRPVFSIVISILIVIIGIIGLTMLPVDQYPQITPPVVKISASYPGASALTVSQAVATPIEQEINGTPGMLYMESNSSNSGGFSATVTFDVSADPDLAAVEIQNRVKLAESRLPAEVIQNGISVEKQAPSQLMTLTLMSSDPKFDEIYLSNFATINVLDVIRRIPGVGRVSNIGSRYYAMQIWAEPDKLANFGLTVQDLQNALKDQNRESAAGVLGQQPVKGLDVTIPITTQGRLSTVEQFENIVIRANTNGSIIRLRDVARVSLEASSYSTESGINGKNAAVLGIYMLPGANAMEVAKSVKEAMDEISKNFPEGLSYEVPFDMTTYISESIHEVYKTLFEALILVVLVVYLSLQSWRATLIPIVAVPISLIGTFGFMLIFGFSLNILTLLGLILAIGIVVDDAIVVVENVERIMEEEKLPPYEATKKAMNGLAGALIATSLVLCAVFVPVSFLSGITGQLYRQFTITIAVSVLISTVVALTLSPVMCSLILKPDNGKKKNIVFRKINHWLNVGNHKYVIAIRRVIGNPRRVLAGFGVVLIGILLIHRLIPTSFLPVEDQGYFKIELELPEGATLERTREVTDRAITYLEKNPYIAYVQNVTGSSPRVGSNQARSELTVILKPWEDRKDTSIDEIMSNVRHDLSEYPECKVYLSTPPVIPGLGTSGGFEMQLEARGEATFENLVQAADTLMYYASQRKELTGLSSSLQSDIPQLYFDVDRDKVKMLGVPLADVFSTMKAYTGSVYVNDFNMFTRIYKVYIQAEAPYRDHKDNINLLFVKASNGAMIPLTSLGNASYTTGPGSIKRFNMFTTAVFRGEAAQGYSSGQAMEIMEQIARYHLPDNIGLEWSGLSYQEKKAGGQTGLVLALVFLFVFLFLAAQYESWTVPIAVLLSLPVAALGAYLGVWVCGLENDVYFQIGLVMLVGLAAKNAILIVEFAKVQVDRGGDLIQSAIHAAQLRFRPILMTSLAFVLGMLPMVLATGPGSASRAAIGTGVFFGMI

SEQ ID NO: 6370 - protein, 258 aa, B.fragilis
LFMKISIVQTDIIWENKQENLRLLREKLSPLRGTTEIVVLPEMFTTGFSMNSRLLAEPVSGTTLRSLKNYAIEFHLSLAGSFICEEQGSYYNRAFLITPDGQEFYYDKRHLFRMGHEAEHFSAGSRKVIIPYNGWNICLQVCYDLRFPVWSRNVNNEYDLLIYVASWPTPRIQAWNTLLCARAIENQCYVCGVNRIGQDGNGLCYPGYSALYGPKGENLAGTPDSEEKIQTIELSLEALTTFRHKFPCWKDADPFLLY

SEQ ID NO: 6371 - protein, 112 aa, B.fragilis
TINEERGTINARRMGNILKDKSMAFAIQIVNLHKYPNKRKAYSLSDQILISGTAIGVLQKETECAESNADFIHNIASPQKNVMKPFSGLNCYLKQNIYPKQNIQACLQTQMN

SEQ ID NO: 6372 - protein, 125 aa, B.fragilis
WRTDDFTVYYFMSEIQNQIKKWPVTAIKKIKSTFGSAEKFYATVYLIARNEHHCQMMGVAGAEQRLKTIHAYQGMIRFMLDEEGLNGKEILDTIAGEYLEDFVNYREQDFGMTNEEFIAIIKRIG

SEQ ID NO: 6373 - protein, 409 aa, B.fragilis
LIKDKLILIIQTSMRLFFTRKELKLRRKRTIAGIVCLALVAGIYWILTRPHKVEPEVPTVIVEPAERDNVEIFGEYVGRIRAQQFVEVRARVEGYLESMLFAEGTYVNKNQVLFVINQDQYRAKADKARAQLKKDEAQALKAKRDLERIKPLYAQNAASQLDLDNAEAAYESAVATVAMSEADLAQAELELGYTLVRSPLSGHISERNVDLGTLVGPGGKSLLATVVKSDTVLVDFSMTALDYLKSKERNINIGQQDSSRSWQPNITITLADNTVYPYKGYVDFAEPQVDPQTGTFSVRAEMPNPKQVLLPGQFTKVKLLLDVREGAIVVPHKAVTIEKGGAYIYVMRRDSTAEKRFIELGPEFGNKLVVERGLGAGEEVVVEGYHKLTPGMKVRATLPQPSAENKETE

SEQ ID NO: 6374 - protein, 981 aa, B.fragilis
NCTWVSGWIRVSLRMYCIVTGLNTWIMYTNRGQYAVRGSIIDVFSFSSEYPYRIDFFGNDVESIRTFEVDSQLSKEKKESIVIVPDLAVTGKVTTSFLDFIPKDTTLAMRDFLWLRERIQVVHDESLTPQALASQEAEENGGITLEGKLIDGSEFTVRALDFRRMEFGNKPTGTPDATLTFHTTAQPIFHKNFDLVAESFKEYLNRGYALYICSDSTKQTDRIKAIFEDRGDRIQFTAVERTLHEGFADDTLKLCLFTDHQLFDRFHKYNLKSDKARSGKVALSLKELNQFTPGDYVVHTDHGVGRFSGLVRIPNGDTTQEVMNLVYQNEDVVFVSIHSLHKVSKYKGKEGEAPRLNKLGTGAWEKLKERTKPKIKDIARDLIKLYSQRREEKGFAYSPDSFLQRELEASFIYEDTPDQSKATADVKQDMERDMPMDRLVCGDVGFGKTEVAIRAAFKAVADNKQVAVLVPTTVLAYQHFQTFRDRLKGLPCRVEYLSRARTAAQAKAVIKGLEAGDVNILIGTHRILGKDVKFKDLGLLIIDEEQKFGVSVKEKLRQMKVNVDTLTMTATPIPRTLQFSLMGARDLSVISTPPPNRYPIQTEVHTFSEEVIADAINFEMSRNGQVFLVNNRIANLPELKAMILRHIPDCRIAIGHGQMEPAELEQIIFGFVNYDYDVLIATTIIESGIDIPNANTIIINQAQNFGLSDLHQMRGRVGRSNKKAFCYLLAPPLSSLTPEAKRRLQAIENFSDLGSGIHIAMQDLDIRGAGNMLGAEQSGFIADLGYETYQKILSEAVHELKTDEFAELYADELKGEGVISGEEFVEECQVESDLELLLPANYVTGSSERMLLYRELDGLTLDRDVDAFRSRLEDRFGPIPPETEELLRIVPLRRLAARLGVEKVFLKGGRMTLFFVNNAESPYYQSAAFGKMIDYMMKYTRRCDLREQNGRRSMLVKDIPNVETAVSVLLEIVALPVKEKE

SEQ ID NO: 6375 - protein, 113 aa, B.fragilis
RPARPLYRCDLSQQYESIRVAATHQALSHLVVKAGSRRRGGGMITVDTCGMTNYSPLIPAIKAMCNANPGDKMEIVTDQVAAFQDLKEYLSEQGIGFREIYDGERMTLQFTIL

SEQ ID NO: 6376 - protein, 392 aa, B.fragilis
LITRMLTQLINARILTPQGWMKDGSVLIRDNKILEVTNCDLAVIGAELIDVKGMYVVPGGVEIHVHGGGGRDFMECTEDAFRAAVHTHMKHGTTSIFPTLSSSTVPMIQQAAETCTKLMEEKNSPILGLHLEGHYLNMKMAGGQIPENIKNPDPNEYIPIVEQYHCIKRWDAAPELPGAMQFGKYIAAKGILPSVAHTQAEFEDIRTAYEAGYTHATHFYNAMPGFHKRREYKYEGTVESIYLLDDMTVEVVADGIHVPPTILRLVYKIKGVERTCLITDALACADSDSKEAFDPRVIIEDGVCKLADHSALAGSVATMDRLIRTVVQKAEIPLEDAVRMASETPARIMGVYDRKGSLQKGKDADILVLDEDLNVRAVWAMGKLVPETNTLF

SEQ ID NO: 6377 - protein, 196 aa, B.fragilis
NHRRYRETELRMKKAIYSFIYYHLLGWKTNVTVPNYDKCVICAAPHTTNMDLFIGKLFYGAIGRKTSFMMKKEWFFFPLGILFKAVGGIPVNRGRKSSLVEQMAEVFAKRPKFHLAITPEGTRKRNPNWKKGFYYIALKAQVPIVLIGIDYNTKTVTSTKAIMPSGDIEKDMREIKLYFKDFKGKHPENFSIGDVE

SEQ ID NO: 6378 - protein, 460 aa, B.fragilis
DMKRTLIQNATIVNEGRSVRGSVVIEGEKIAEVLEKGQKPAIPCEETINANGCYLIPGVIDDHVHFRDPGLTHKADISTESRAAAAGGVTSIMDMPNTNPQTTTLDALNAKFDLLAEKCSVNYSCYFGATNNNYTEFDKLDKNRVCGIKLFMGSSTGNMLVDKMNSLLNIFNGTDLLIAAHCENHETIKKNTEKYVKEYIEKYPHQYYHVHHETLPMGYHAKIRSIAACYESSELAVRLARIADARLHILHISTARELSLFDNDIPLEEKRITAEACVSHLLFDSSDYPELGARIKCNPSIKTKTNRDALRQAVNSNLIDVIATDHAPHLLKEKEGGPLKAMSGMPMIQFSLVSMLELVNEGIFTIEKVVEKMCHAPAQIYNIHNRGFIRPGYQADLVLVRPDALWTVSADQILSKCGWSPLEGRTFEWKVEKTFANGHLLYTDGQVDETYRGQEIYFER

SEQ ID NO: 6379 - protein, 262 aa, B.fragilis
RRVRSLELFTLLLFKQKRYKLYMKQEKFFRLLPIEGAYNIRDLGGYPTSDHKHVKWKTFIRSGDLDKLTESDLDYLTSLHIRTDIDFRSMQEKKAAADKIPSTVTQYIPLSIEAGDMTDMAHFNLNNIPGILEQAYVYIIQNAQDTYREFFRIVSEERNTPLLFHCSAGKDRTGIAAALLLGALGVDREVIMEDYMLSAEYIKGKYDAIVQAHPGFAPLTTVRKEYLEAAFQTIDTDYQGMDNYLKNQLGVDTHRLRMLYTE

SEQ ID NO: 6380 - protein, 161 aa, B.fragilis
VERMDIFLIILGSICLLVGLAGCIVPMLPGPPVSYLALVFLHFTDKVSFTIPQLFFWLFIVVLIQILDYFIPMFGVKRLGGTPWGKWGCIIGTFAGIFLFAPWGVFIGPFVGAVVGELLGGKETKYALKAGFGAFAGFLLGTVLKVAVCGWFIFCFIRALV

SEQ ID NO: 6381 - protein, 263 aa, B.fragilis
RKSITFVFKFRHNMQTSDSIVIIPTYNERENIENIIRAVFGLEKTFHILIIEDGSPDGTAAIVKTLQQEFPDRLFMIERKGKLGLGTAYITGFKWALEHSYEYIFEMDADFSHNPNDLPRLYEACAVQGGDVAIGSRYVSGVNVVNWPMGRVLMSYFASKYVRIVTGLPIHDTTAGFKCYRRQVLETIDLDHIRFKGYAFQIEMKFTAYKCGFKIIEVPVIFINRELGTSKMNSSIFGEAVFGVIKLKVNSWFHTFPQKTKMN

SEQ ID NO: 6382 - protein, 689 aa, B.fragilis
LIVFIYICSEFPITTKTQSNLINNKLMKTNLSSQITLNRVSPRYYRPENAFERSVLTRLEKIPTDIYESVEEGANHIACEIAQVIRDKQKAGRFCVLALPGGNSPRSVYAELIRMHKEEGLSFRNVIVFNMYEYYPLSQDAINSNFNALKEMFLDHVDIDKQNIFTPDGTIAKDTIFEYCRLYEQRIESFGGIDIALLGIGRVGNIAFNEPGSRLNSTTRLILLDSGSRNEASKIFGTIDNTPISSITMGVATILAAKKIYLLAWGEEKAHMVKECVEGNVTDTIPASYLQTHNNAHVAIDLSAASNLTRIQRPWLVTSCEWNDKLIRSAIVWLCQLTGKPILKLTNKDYNENGLSELLALFGSAYNVNIKIFNDLQHTITGWPGGKPKADDTYRPERAKPYPKRVVVFSPHPDDDVISMGGTIRRLVEQKHEVHVAYQTSGNIAVGDEEVVRFMHFINGFNQIFINSEDQVISEKYAEIRKFLKDKKDGDMDTRDILTIKGLIRRGEARTACTYNNIPLERCHFLDLPFYETGKIQKNPISEADVEIVRNLLREVKPHQIFVAGDLADPHGTHRVCTDAVFAAVDLEKEEGAEWLKDCRIWMYRGAWAEWEIENIEMAVPISPEELRAKRNSILKHQSQMESAPFLGNDERLFWQRSEDRNRGTAALYDSLGLASYEAMEAFVEYIPL

SEQ ID NO: 6383 - protein, 204 aa, B.fragilis
WAKIAFMTITELQHQYAGHPNVEALNKLLGEPAVRHIYCGGLYASAASLFASALVEKSPCPFVFILGDLEEAGYFYHDLTQVLGTERILFFPSSFRRSVKYGQKDAANEILRTEVLSRLQKGEEGLCIVTYPDALAEKVVSRQELSENTLKLHVGERVDTGFITDVLHSYGFEYVDYVYEPGPVCRSWKYYRRVFIFVRVSLSY

SEQ ID NO: 6384 - protein, 65 aa, B.fragilis
LYKIGSCSTLQMIIRAQIIRLEDSIMKLEKYYRTKTAGLEGQPNKKKNKRMADIVAVNVKYVLFG

SEQ ID NO: 6385 - protein, 642 aa, B.fragilis
LYAVGSSSALSVPSYSEIIRIFVPMKEYRLTDWLPTTKKEVELRGWDELDVILFSGDAYVDHPSFGAAVIGRILEAEGLRVAIVPQPNWRDDLRDFRKLGRPRLFFGISAGCMDSMVNKYTANKRLRSDDAYTPDGRPDMRPEYPSIVYTQILKKLYPDVPVVLGGIEASMRRLSHYDYWQDRLKKSILCESGADMLIYGMGEKPICELVRRLTALCDNQDGVISSSDIHSPALSSIPQTAYLTRKYESDENDITLYSHEECLADKKKQATNFRHIEEESNKYAAARIVQAVDGKTVVVNPPYPPMTEKELDRSFDLPYTRLPHPKYKGKRIPAYDMIKFSVNIHRGCFGGCAFCTISAHQGKFIVSRSKESILKEVKEVVQLPDFKGNLSDLGGPSANMYKMGGKDLSLCKRCKRPSCIHPKVCPNLNTDHRPLLDIYYAVDSLPEIKRSFIGSGVRYDLLLHQSKDATVNKITAEYTRELIARHVSGRLKVAPEHTSDRVLSIMRKPAFSQFGEFKKIFDRINRELGLRQQLIPYFISSHPGCKEEDMAELAVITKQLDFHLEQVQDFTPTPMTVATEAWYTGFHPYTLEPVFSAKTQREKLAQRQFFFWYKPEERRNIINELRRIGRADLIDKLYGKRK

SEQ ID NO: 6386 - protein, 226 aa, B.fragilis
LPVLKQSNMEKHNPSSFTVDSSSPAHRSSFAVHDLTPYINWIYFFHAWGFQPRYAAIANIHGCDSCRAIWLTTFPEEERSKASEAMQLYKEANRMLNELDRNFEVKTIFKLCPANADGDNLIINGITFPLLRQQVKKKENEPFLCLSDFVRPLSSGITDVVGAFASSIDADMEGLYEKDPYKHLLVQTLSDRLAEAATEKMHEYVRKEAWGYAKDENLSIPDVFNT

SEQ ID NO: 6387 - protein, 135 aa, B.fragilis
AVGSRRQCLPVSKVTLHRYIHFAFIEDAALRTITEEQHAVGGNSNAYHRINVGILIVDSFHSQTFSDYITTGIDDGDIFRMRHYMIKVTDTYLIEQDAENKYSRRQYVIKYKYGSPGEGMCYQNRQADDSKMENT

SEQ ID NO: 6388 - protein, 263 aa, B.fragilis
SLPSLRNNKKNKKIGRMVSANPYNRYICFQIRRLRYMETMFDTLLQLPLFQGLCHEDFTNILEKVKLHFTRHKPGEPLIKSGEVCDQLLFLLKGRLSSVTVSEDDTLTVIEYFEAPAVLEPYSMFGMNTRYISSYIPHNEEAQMVSISKSFVMGELFKYDIFRLNYMNIVSNRAQNLYTRLWDKAPKDIEDKIIRFILGHIERMTGEKLFKVKMDDLARMLDDTRLNVSKALNGLQELNLLELHRKEIRIPDLSLLTEWNEKR

SEQ ID NO: 6389 - protein, 417 aa, B.fragilis
LIWFHYETDELYICRLNLKIEPYMKYNFDEVIERRGTDSVKYDAVSERWGRSDLLPMWVADMDFRTPPFVIEAIRRRLDHEVLGYTFACEAWYTSIINWQKERHGWNVTREMLTFTPGIVRGLAFALQCFTAPGDKVMVMPPVYHPFFLVTEHNHREVVYSPLLLKDGQYQIDFERFRADVKGCKMLILSNPHNPGGRVWTREELAEIAEICFDNQVLVISDEIHADLTLPGYTHPTFALVSEKARRNSLVFMSPSKAFNMPGLASSYCIIEDEAIRHRFQTYMEASEFSEGHLFAYLGVAAAYSNGTEWLDQALEYIQENIDFTDEYLKTHIPAIRMIRPQASYLIFLDCRGMGVSQKELVDFFVDGAHLALNDGAMFGKEGEGFMRLNVACPRSVLRQALDQIKEAYELKHDTIA

SEQ ID NO: 6390 - protein, 862 aa, B.fragilis
SPITLDFLSFITNFVITINLTTSAIMKKGFKITAIVIGVILILMFLLPFAFRGKIEGIVKSEGNKMLNGHFDFSSLDISLFRNFPKASVTLNDFWLKGTGEFENDTLVKAGEVTAAINLFSLFGDDGYDVSKVSVENTRLHAIVLPDGKANWDIMKPDSSTASETQESGESSTFRIKLQRFVIKNMNVVYDDRQSAMYADIHNFNALCSGDLGSDQTLLSLEAETEALTYKMNGIPFLSQANVYAKMDVDADLAHNKFTLKKNEFRLNAIKAGIDGWIELKDPAIDMDLKLNTSEIGFKEILSLIPAIYSKEFKNLKTDGTATLEATAKGILQGDTVPQFDVRLAVKNAMFRYPSLPAGVDQINIDAQVRNPGGNIDLTEISIHPFSFRLAENPFSLTADIKTPVSDPDFTAEAKGVLNLGMIKQVYPLDDMELNGTVRADMTMAGHLSYIEKEQYDRFSASGTIALSDMNLKMKEMPDIEIKKSLFTFTPKYLQLSETTVAIGKNDLTADCRFENYMGYALKGGTLKGTLNVRSNHLNLNDFMTATTDSAAQTSQASSTEETASMIEVPQNIDFQMDAGLKEVLFDKMTFTNMNGKLIVKDGKVDMTNLSMNTMGGSVVMNGYYSTADPKKPEMNAGFRMENIGFAQAYKALDMVQQMAPIFENLKGNFSGNMHIRTLLDNQMSPVMDTMQGNGSLSTQDLSLSGVKVIDQIAEAVKKPELKEMKVKDMALDFTIKDGRVSTKPFDIKLGDYVMNLSGSTGLDQTIDYSGKIKLPASAGDIAKLTTLDLKIGGTFSSPKVSLDTKSMTNQAVEAVTDKAISEIGKKLGLDSATTANKDSVKEKVKEKAVEKALDFLKKKIK

SEQ ID NO: 6391 - protein, 368 aa, B.fragilis
MEKTKRDSRHIDPLKDEEKFFQWLKFKSVRMNQEHLSKDDYERLRQRIHVSLRMLRRKRTVRRVAYYGVSVCVIIALGIVAYLNHYERVEPVPSVVEKKAEIVWQPLKSEDIRLVSGDSITSFRQNVQLLLSKDGSAMVYHPNSGQKRIRMEQDEVNELVVPYGKRSKVKLEDGTEIWLNSGSVLKFPTHFSGEKREVSLKGEMYAEVTADSKKPFIVHTAHFDIQVYGTRFNISAYEDEPTPSCVLVDGIVGFRPESGPEIRMKTNEKVLYDGKRFEKRKVSASRYTCWKEGYLELDDANIMDVLNRIGRYYNLSFSFGDKKRLTGRKCSGKIYLSDNIDNVLTTISLLYSTDYRKEERTIFISENP

SEQ ID NO: 6392 - protein, 313 aa, B.fragilis
YSMTKPAPTPLYNEFTFFLKKYFPYKVQKISLNAGFTCPNRDGTKGLGGCTYCNNQTFNPEYCKTEKSVTRQLEEGKQFFAHKYPDMKYLAYFQAYTNTYAELEGLKGKYEEALSVDGVVGLVIGTRPDCMPDPLLRYLEELNKHTFLLVEYGIETTRDVTLKRINRGHTYADTVETVNRTAACGILTGGHVILGLPGETHDEIIAQAAELSRLPLTTLKMHQLQLIRGTKMAREFECRPEDFHLFSVDEYIDLVIDYVEHLRPDLILERFVSQSPKELLIAPDWGLKNYEFTARVQKRMKERGAYQGKAYLV

SEQ ID NO: 6393 - protein, 292 aa, B.fragilis
KQYYMGNDKRVRKPEWLKISIGANERYTETKRIVESHCLHTICSSGRCPNMGECWGKGTATFMIAGDICTRSCKFCNTQTGRPLPLDPDEPAHVAESIALMKLSHAVITSVDRDDLPDLGAAHWAQTIREIKRLNPETTTEVLIPDFQGRKELIDQVIKACPEIISHNMETVKRISPQVRSAANYHTSLEVIRQIAESGITAKSGIMVGLGETPAEVEELMDDLISVGCKILTIGQYLQPTHKHFPVAAYITPEQFAVYKETGLKKGFEQVESAPLVRSSYHAEKHIRFNNK

SEQ ID NO: 6394 - protein, 149 aa, B.fragilis
QLEQSMKRERIVRTENIDRQRIKYRVLFGFIFIMCCNGAALPSEDGKMPDWKFSFSLKRIPMIRIFDEIEQKSDFVFAWSCDIDNEIHEEISICVTEEPIQKVMEKVLKGSGLVYQRLDRQIVVYRLLGHNACRVDSVRVMTNMEQNDR

SEQ ID NO: 6395 - protein, 364 aa, B.fragilis
VCVQWLLTKRGWTNIKTKTVISFTVKVMKIRKDDILLILLSLLFADCRVGKAEPVADPMEEEGISVVRYDKLLDEYVRFNSFSALQKMNLEYALPTKLLIEDVLAIGQVSDDHIFQRLKTFYSDTTLVRLIEDVEAKYPELESVEKNLTKGFGKLQKEIPDIMIPMIYTQISAFNESIVLSDSVLGISLDKYMGEDYPLYKRFYYNYQRRTMRPDRIVPDCLVFYLMSQYPFPMDYSRTLLDVMMHYGKINYVVQHLLDYSSSEEALGYSDLEREWCKENQQQMWRYILEQDHLHATDPMVVRQYTRPAPFTNTLGENAPSMVGTWIGTKIITSYMKHHKKTTLRQLLEMSDYERMFTESRFNP

SEQ ID NO: 6396 - protein, 85 aa, B.fragilis
YRHKNKEEDRPEELLAYPLLFISLTRKSVEELIFQTVFDPFHCFLTFFSSLLRTFFYVFGCIFGCIFDFLKCIFGAFFHVISYFL

SEQ ID NO: 6397 - protein, 904 aa, B.fragilis
CMTKKINLFPSLIRFRETNRLKMAIAASIMLWCMAPQQAVADTYEKHEVASIQQQKVKANGTVVDQTGEPLIGVSVKVKDAPNGTITNLDGKFSIDVAKGATLEISYVGYKTVIVKAESTPMHIVLKEDSEMIDEVVVVGYGSQKKVNVTGAVGMVNSEVLEARPVQNVSQALQGVVPGLNLSVNNGGGSLDSEMSINIRGTGTIGDGSGSSPLVLIDGIEGSLNTVNPNDIESVSVLKDAASASIYGARAAFGVVLVKTKSGQSGKPRVTYSGNVRFSDATNIPEMLDSYTFAQYFNRAAANDNGGTVFSKEQLERIKAYQDGTLKSSATFNEQSRRWNYYTGSNANTDWFKEVYEDWVPSMDHNLSISGGTDKTQYIVSGSFLDQKGLIRHGKDTFQRYTLNGRITSNITDWFTLGYSTKWTREDYDRPSYLTGLFFHNVARRWPTVPVYDDNGYLTEPSELIQLEDGGRQINQKDLFTQQLQLTFEPIKNWKIYVEGSLRVTANNQHWEVLPVYQHDVDGNPVGMTWDAGVGSYPVGGSKVSEYAYKENYYSTNIYSDYFKQLDNGHYFKAMVGFNAELYKDRSVSADKSTLITPSVPTINTAVGEPSVAGGYRHTSVAGFFARLNWNYKDRYMLEANGRYDGSSRFIGDKRWGFFPSFSGGWNIAREAFFEETANKLKIGTLKLRASWGQLGNTNTNEAWYPFYQTLPQGQNYGWLVNGVRQNYASNPGIVSSEKTWETIETWDAGLDWGLFNNRLTGSFDYFVRYTYDMIATAPELPSILGTGVPKINNADMKSYGFELEIGWRDRIKNFSYGVKFVLSDAQQKILKYNNPDKSLSNPYYEGQKLGEIWGYKTIGIAQSDEEMNLHLANAKQPMGQKWAAGDIMYADLDNSGSVDQGVF

SEQ ID NO: 6398 - protein, 243 aa, B.fragilis
YMEKKEFSSPARRYGKFFIAFIFITAGVLLLARNLGWISYTLFGILVSWQMLLILLGIYLILRRQILRGGILLAIGAYLISPYLEWMPAGVHVTLFPIVLIVIGLAFLFRPKRARHERSHRGNFASSQYNSTDGVLHSENTFSGIRQVVLDEVFKGGTIQNSFGGTVIDLRRTTLPEGETFLDIDCTFGGIEIYVPSDWKVVFRCTTCLGGCQDKRFGGGMIDQNRILVIRGDLTFGGIDIKS

SEQ ID NO: 6399 - protein, 274 aa, B.fragilis
KQSNMRLIIQPDYQSVSQWAAHYVAAKIKAANPTPEKPFVLGCPTGSSPLGMYKALIDLNKKGIVSFQNVVTFNMDEYVGLPKEHPESYYSFMWNNFFSHIDIKPENTNILNGNAADLDAECARYEEKIKSYGGIDLFMGGIGPDGHIAFNEPGSSLSSRTRQKTLTTDTIIANSRFFDNDINKVPKTSLTVGVGTVLSAREVMIIVNGHNKARALYHAVEGAITQMWTISALQMHEKGIIVCDDAATAELKVGTYRYFKDIEADHLDPQSLLK

SEQ ID NO: 6400 - protein, 320 aa, B.fragilis
SNSLYFLWFSSFLCTLFVLLCRKSISLQPNLTLKGMSYNLLKGKRGIIFGALNEQSIAWKVAERAVEEGAVITLSNTPVAVRMGQVSALSEKLNCEVIAADATNVEDLENVFKRSMEVLGGQIDFVLHSIGMSPNVRKKRTYDDLDYNMLNTTLDVSAVSFHKMIQAAKKQNAIAEYGSIVALSYVAAQRTFYGYNDMADAKALLESIARSFGYIYGREHNVRVNTISQSPTFTTAGSGVKGMDKLYDFANRMSPLGNASADECADYCIVMFSDLTRKVTMQNLFHDGGFSSVGMSLRAMATYEKGLDEYKDENGNIIYG

SEQ ID NO: 6401 - protein, 157 aa, B.fragilis
LAALRTCGLMRFTVSMLWEMISGQAFITWSISSLRPWKSGISTSVVVSGFSRLISRIVCAQWAAPKSGRSSRSTDVITACESFIRAIDSATWAGSSGSKGRGRPVWVLQNLQLRVQMSPAIMNVAVPFPQHSPMLGQRPLLQMVCRQCDSTMRLVSV

SEQ ID NO: 6402 - protein, 369 aa, B.fragilis
HNLWNLYKKTFRMKKNSFETQILHTPFEKEDAYHSLSMPVYHTAAYEFETAEEMEAAFCGQKAGHAYSRITNPTVQYFEQRVQRVTGALSVTALNSGMAAISNALITLASAGANVVTSKHLFGNTYSFLKSTLEAFGVEVRFCDLTCPEEVKQQIDGDTCALFLEVITNPQLEVADLKALADIAHKAGVPLLADTTAIPFHVFHATDFGVDIEIVSSTKYISGGATCIGGLIIDYGTFDWEHSAKLAALSADTGKEAFTVKLRKEVHRNLGAYMTPQVAYMQTLGLETMEVRFARQAETCLKLAQCLQELPEIESVNYTGLESNPFYELSTRQFGSLPGAMLTFDLPSREICFRFINRLRFIRKGNDFI

SEQ ID NO: 6403 - protein, 66 aa, B.fragilis
SVALEGIFAMADQTFLIEKASTDNILSFICATTDAKIVIHGRNPIFIHFLKPVGICIRSRIVVPSA

SEQ ID NO: 6404 - protein, 374 aa, B.fragilis
KHMGNKGVLSSAFNMSLGFIPVIVSILLCEFITQDISIYIGTGIGLIYSYRSLSRKGARIPNFILYISTGILTLLTLASFIPGDFVPEGALPLTLEVSILIPMVILFLHRRKFISHYLRQNAQCNRRLFAQGAESAIVSARVVLILGILHFAVISLTVLVAHPLTRTSILVLYHVLPPTIFILSILLNQIGIRYFNHVMAHTEYVPIVNTRGDVIGKSLAVEAINYKNAYINPVIRIAVSTHGMLFLCNRPQSCILDKGKVDIPMECYLRYGETLTAGANRLLSNAFPKASDLKPTFTISYHFENEQTNRLVYLFIVDMEDDSILCDPRFKGGKLWTFQQIEHNLGTHFFSECFELEYEHLKQVIGIREKYKVS

SEQ ID NO: 6405 - protein, 673 aa, B.fragilis
NISGSSDVEFTIDTGNKEFQDALNLIQYTRQSVFLTGKAGTGKSTFLKYICKNTKKKHIVLAPTGIAAINAGGSTLHSFFKLPFHPLLPDDPNLSLQRGRIHEFFKYTKPHRKLLEQVELVIIDEISMVRADMIDAVDRILRVYSRNLRDPFGGKQVLLVGDVFQLEPVIKGDEREIINRFYPTPYFFSARVFNEIELVSIELQKVYRQSDAVFVSVLDHIRSGAAGAADLQLLNTRYGAQIDASEEDLYITLATRRDTVETINERKLTELPGDPVVFEGEINGDFPESSLPTSKELTLKPGAQIIFIKNDFERRWVNGTIGVVSGIDNDGIIYVITDDGKECDVHRESWRNIRYKYNEEKKEIEEEELGTFTQYPIRLAWAITVHKSQGLTFSRVVIDFTGGVFAGGQAYVALSRCTSLEGIQLKKPISRADIFVRPEIVSFSGRFNNRQAIDKALKQAQADVQYAAAARAFDKGDFETCLEQFFLAIHSRYDIEKPAARRLIRRKLGVVNLLREQKRKLQAQMEAQKKSLQKYAREYLLMGNECITQAHDVRAALANYDKAIELYPEYIDAWIRKGITLFNEKEFFDAENCLNRAVSLRPSEFKALYNRGKLRLQTENIEGALSDLDKATSLKPEHPGAHELFGDTLLKVGKETEAAIQWRIAEELRKKKK

SEQ ID NO: 6406 - protein, 207 aa, B.fragilis
QTIMILKLYEKNNNPQDLQRIVDLLNDGGLIIYPTDTMYAIGCHGLKERAIERICRIKEIDPKKNNLSIICYDLSSISEYAKVDNNIFKLMKRNLPGPFTFILNGTNRLPKIFRNRKEVGIRMPDNSIIREIARLLDAPIMTTTLPHDEHEDIEYVTDPELIDEKLGDVVDLVIDGGIGGIEPSTVVNCTEGEAAIVRQGKGELEEA

SEQ ID NO: 6407 - protein, 144 aa, B.fragilis
HLIMKKVLFFALVLTIATACSQTKDSYLEGFKLFIESVQKNAQDYTKADWEKADEQFTKLKDSYNNFSKQMTSDEKGEVIKLESTYAALKLKKIGDDVKESTKDAFEKVKDTAKDAAKDVKEGAQKAAKKGEKAMEGIKDGLKD

SEQ ID NO: 6408 - protein, 745 aa, B.fragilis
KQPIKSSKPMKRKFIFLFFCLCCLAGFAQGGKALDLKEINSGKFSPENIYGVVPMPDGEHYTQRNAEGTQIVKYSFRTGEPVEVVFDVTKARECPFKKFDSYQFSPDGSKILIATETKPIYRHSYTAVHYLYPVKRNDKGVTTNNIVEKLSDGGPQQAPVFSPDGNLVAFVRDNNIFLVKLLYGNSESQVTEDGKLNSVLNGIPDWVYEEEFGFNRALEFNADNTMLAYVRFDESEVPSYTFPLFAGEAPRYDALQDYPGEYTYKYPKAGYPNSKVSVHTFDIKSKVTRQVKLPIDADGYIPRIRFTQDPNKLAIMTLNRHQNRFDMYFADPRSTVCKLALRDESPYYINENVFDNIQFYPEYFSFVSDKSGYPHLYWYSMNGNLIKQVTSGNYEVKNFIGWNPDTNEFYYTSNEESPMRQAVYKIDRKGKKMKLSNQPGTNSPIFSSSMKYFMNKFTSLDTPMLITLNDNTGKVLKTLVTNDKLKQKLAEYAIPQKEFFTFKTTEGVDLNGWMMKPVNFDPAKRYPVLMFQYSGPGSQQVLDKWGISWETYMASLGYVVACVDGRGTGGRGSEFQKCTYLNLGVKEAKDQVEAAKYLGGLPYVDKGRIGIWGWSFGGYMTIMSMSEGTPVFKAGVAVAAPTDWKYYDTVYTERFMRTPKENAEGYKAASAFSRADNLHGNLLLVHGMADDNVHFQNCTEYAEHLVQLGKQFDMQVYTNRNHSIYGGNTRNHLYTKLTNFFRNNL

SEQ ID NO: 6409 - protein, 281 aa, B.fragilis
NMDIHPIQESSRRWMTALILAVVAAGIQTTLLWGYAGADTLPAAIDGILSVGLLCLLAYLAWYVIGLVSILQTDLLIAALALLFWLAGGFAVQYVLEQNMGQVYAPFGETLPFRILFGALAWGVMMLWYRLQSLNTVQEEILEEAVSREEALREELRQIECREDKALPEEAECIDRITVKDGTHIHLIRTDELLYIQACGDYVTLVTPSGQYVKEQTMKYFDAHLPSAGFVRVHRSTIVNVTQISRVELFGKENYQLSLKNGVRLKVSNSGYKLLKERLEL

SEQ ID NO: 6410 - protein, 402 aa, B.fragilis
KKRMEQKTRIKGNVHYVGVNDRNKHLFEGMWPLPYGVSYNSYLIDDEMVALIDTVDICYFEVYLRKIRNIIGDRPINYLIINHMEPDHSGSIRLIKQHYPDIVIVGNKQTFGMIEGFYGVTGEQYLIKDGDFLALGRHKLRFYLTPMVHWPETMMTFDETDGILFSGDGFGCFGTLDGGFVDTRMNIDHYWGEMVRYYSNIVGKYGSPVQKALQKLGGLPISAICSTHGPVWTENITKVVGIYDKLSRYDADEGVVIAYGSMYGNTEQMAEAIAAELSAQGIKNIVMHNVSKSNPSYILADIFRYKGLIIGSPTYSNQIFPEVESLLSKILVRELKGRYLGYFGSFTWAGAAVKRMAEFAEKSKFELVGDPVEMKQAMKEITYQQCENLARAMAGRLKKDRV

SEQ ID NO: 6411 - protein, 292 aa, B.fragilis
QTAVKIYHHCGIQLLYIRLFQYICAPLKKRRMIKALFFDIDGTLVSFNTHEIPSSTLAAIAEAKAKGIKIFIATGRPKAIINNLTALQERELIDGYITMNGGYCFVGDEVIYKHSIPVQDVKALAALSDERNFPCIFVAEHTVAVCNTNKLVNEIFHDFLHVDILPIQTTAEATQPEIFQMTPFITTEEEKTVLPLLPNCESGRWFPAFTDIVAKGIRKQKGIDEIIRHFGIGQEETMAFGDGGNDISMLRHAAIGVAMGNANDDVKETADYITTSVDEDGIQKALKHFGII

SEQ ID NO: 6412 - protein, 204 aa, B.fragilis
KAKFIIYKLYTMLPKKKNLEEERAKHTVDSLYKDYVDDLFSYALGFGFDKQTAMDAIHDVFCRVCIREREVQEIQNPKFYLLRALRNQLIDTYKLKRNYSEVLTGEITDELPYKIKITVEDEIIAAEEQAEVSQKVDEILSILTERQREIIYLRYMQECSYEEIAEIMQISVPACRKLLYRTLLKLKHNNTLVLFYLLLSINVG

SEQ ID NO: 6413 - protein, 245 aa, B.fragilis
SVKFQLLNTLFMDTALYLLPVTLGDTPIESVLPSYNKEIIQGIKHFIVEDVRSARRFLKKVDREIDIDSLTFYPLNKHTSPEDISGYLKPLAGGLSMGVISEAGCPAVADPGADVVAIAQRKNLKVVPLVGPSSIILSVMGSGFNGQSFAFHGYLPIEPGERAKKIKALEQRVYAEHQTQLFIETPYRNNKMVEDILHNCRPQTRLCIAANITCEGEYIRTKTIKEWQGKVPDLTKIPCIFLLYQ

SEQ ID NO: 6414 - protein, 458 aa, B.fragilis
NGCSVPGLGIYHSKFPDAERVEIWQKQLTEEGYDIILGVRSSVFLPFRNLGLVIVDEEHENTYKQQDPAPRYHARNAAIVLASMYGAKTLLGTATPSVETWQNATTGKFGWVELKERYKEIQLPEIIPVDIKELHRKKRMTGQFSPLLLQYVREALDNKQQVILFQNRRGFAPMIECRTCGWVPKCKNCDVSLTYHKGINQLTCHYCGYTYQLPRSCPACEGVELMHRGFGTEKIEDDVKLIFPEASVARMDLDTTRTRSAYEKIIADFEQGKTDILIGTQMVSKGLDFDHVSVVGILNADTMLNYPDFRSYERAFQLMAQVAGRAGRKNKRGRVVLQTKSIDHPIIRQVMTNDYEDMVAGQLAERQMFHYPPYYRMVYVYLKNRNETLLDVMAHTMAEKLRALFGNRILGPDKPPVARIQTLFIRKIVVKIEQNAPMSRARELVFTTGLEGSARSVH

SEQ ID NO: 6415 - protein, 510 aa, B.fragilis
ITNSIKTNAMLRKIRLTCGIICLTLITLLFLDFTGTLHGWFGWLAKIQFLPAVLALNVGVVVLLIILTGVFGRIYCSVICPLGVFQDVAAWIGKKRKKLPYSYSPALSLLRYGALAIFIITLVAGVSFIATLFAPYSAYGRIANNLFQPIWLWGNNLFAHLAERAGNYAFYEVDIWIKSLPTFIVAAATFVILILLAWRNGRTYCNTICPVGTVLGFLSRYSLFRITIDTEKCNKCGLCARHCKAACINAKEHTIDYSRCVVCMDCLGKCKQKALSYQLRTTKARPAKAEENALAASSKEVNEARRNFLTVTAMAATASALKAQEKKVDGGLAAIEDKKIPNRQTPITPPGSLSARNMAAHCTACQLCVSACSNQVLRPSTNLMNLMQPEISYERGYCRPECNDCSQVCPTGAIHPITAADKSSTQIGHAVWIKANCVSLTDGVKCDNCARHCPTGAIQMIVAEPEKEASPQIPAINTERCIGCGACENLCPARPFSAIYVEGHERHRII

SEQ ID NO: 6416 - protein, 265 aa, B.fragilis
KSVPGIFTSNIVAVMKVLIVEDETAAYENLTDILTEITPDIRIMANTESVTQTVGWLQSNPAPDLIFMDIHLSDGSAFAIFDRIELETPIIFTTAYDRYAIEAFKVNSIDYLLKPVKVEDVEHALEKYSKLTRQDLLQYLSQLTLLKPAPRYKDKLLIAHKDKLLPVNIKNISYFYATGKNTYVCLKDGNRYPYSKTLEQIASSLNPEDFIRANKQFIVARDSVTDITIWFDSRLLITLDTEVPERIYVSKNKASEFKTWLVNDK

SEQ ID NO: 6417 - protein, 280 aa, B.fragilis
ITMFYDYLCKGKSLYLSTQCLLITISFPDMDIVDKLNKEFLTQPFCKNEQLPEELNEYKRIAYNYARIENSIAVLSDMHTNISYIYYGGTAETLGIARKGDNQNLESIWEKEVFKYIHPDDLAEKYVQELRFYHFLKQIPHKKRADYFLMSKLRMRDPSGKYIPILHRMFYVATHSNDSMWLALCLYNLSVDPTMSCRVINSTNGQVIELEKQDCSKLLSDREKTILQLIDMGKTSHEIARELFISKNTVSRHRQNILEKLQVKNSIEACRIAKELKLLF

SEQ ID NO: 6418 - protein, 195 aa, B.fragilis
TQVTPCRRLHVWEELILTFNYYIIIMETTSIKLYSLNYNDTKTYLTTLLFVVGNMALPQLFHLIPQGGITWLPIYFFTLIGAYKYGWKVGLLTALLSPVLNSLLFGMPQPVILPAILLKSTLLAIAAGYAAHRYKRISIPILLLVVLSYQVVGTLGEWILVNDFFSAVQDFRIGLPGMALQIFGGYLFISRLIYK

SEQ ID NO: 6419 - protein, 87 aa, B.fragilis
NQPTILYILTSFYYLSSIKSINMDSIGKRMYRNLGDDTKAKISQSLRGRSKSASHIQAISQGMTNYWKTIPVKTDDNPSDKTKKEGQ

SEQ ID NO: 6420 - protein, 212 aa, B.fragilis
TSNTMKKVVIFARVSSTNGTQDYERQINDLQTLASANNWTVEAVFAEKVSGAKKNTERIELMNMINYINSHNIHKVLVTELSRLGRDTLQVLQAIEILNQNKVSVFIQNYNIETLTPEGEINPMSQFLITILAEVARMERKTIRERVASGYQNFRSNGGKVGRKVGYTKSDEVMREEYAEELRLLKRGYSLRNTSKLTGTSINTLRKLTQLT

SEQ ID NO: 6421 - protein, 447 aa, B.fragilis
FTGTTHRRILFYFNNYFSYEQSLNTGNGRFIRSQYPVSEQCAQFLGHGVCHHIKQRLVPVFQIDIHHPVIRRIMKHLPLSQLSRHHIFIIVRHHLTDDGMVYTFGLQHYPAPFIFSSGTSGNLRHQLEGTFVRTEIGIIQHRVRIEYPHHADVVKVESFGYHLGTDQYIGLSLFKVCNNFFVCRPRTCSIEIHTCYGSFRKNQLHIIFYLFRTKSSVHQLDPFASRTRTGQLVSIPAIVASQLIDTFMIGQADITVLALWHPSARAALYHRSKSPAILKQNHLLFIIECLADILQQQRRELPRHPLLAVQLLYIYRNNLRQLNFLIAFFQFHPPEFAGSGILPSLHRRSGSTQQRLCPIHRSQHDGSIPGMIARCGILLLIRIFVFLVHNDQSEIPKREEHRRAYPQNDVVTLLRQLLLPDLYSLGVGELGVIDSQPGNRTPVSAVR

SEQ ID NO: 6422 - protein, 65 aa, B.fragilis
LKTTTGRVNQYTIFPTMRELNVGGFAACLSVYPEKARHKKNKFKTACNQIRSAMNRTETYNSTTQ

SEQ ID NO: 6423 - protein, 63 aa, B.fragilis
KISTTKSPCSINTDTLILKVRKSILICLDQDIEKAQRTVDEKQAAVDGLNATLKKLLDAYAAE

SEQ ID NO: 6424 - protein, 419 aa, B.fragilis
PNRAIGIITNMNKLLMPFMTLVCLLFTACNKDDILPGGPMLWTYEILTPESVEYEGGTVGWIPKECFKANGNEGYIVMTCKNFDMLNPISGGSYTYDCGWATLKVEANQLKIHFPRQVSEAPDAYEEITISTNDGKRTASTIICLSRTFKDEGQPDPEPKPLPEEAKFKMKKAYFTPFMHLDTQFPAPLDLVTFRITDINDNYTPLGFPEFTQYYDSIVWSAEGFPHTFRVYESNTTEGGMETHLATEWSSHFFKSGTIKNYLKGYRKGKVEYETSLAVRLYERDFLGIEWGTIVLQSPQNLTTYCLLDTDYEYQVYDIVAKDYNPFSKIIPVNHKQLSDSDFPAAAQKAIKTLMENNIGEGQNAGGKENLFKCLPEEGVKAELYWENKTTRILMLHQLSTDPDDLTQEKYYLHVEPKQ

SEQ ID NO: 6425 - protein, 431 aa, B.fragilis; identical to SEQ ID NO: 6067

SEQ ID NO: 6426 - protein, 165 aa, B.fragilis
LNSYKMKKNVFILFVVLLTTSVFMSCSSDDDNDNGKVENTIIINGKEYLNDESASVSYNSYSQSISFEAGFSNPESLMDISYFTIASNDAASVDKLTNGMELNAKVKEFVKNTDLGSSYTYTTVGGKVVVDNVTSESITLRYDDFKFTKNGGEYTIKGRVLYHKN

SEQ ID NO: 6427 - protein, 65 aa, B.fragilis
PTDYQTIYIFHFCHFTPLFCYLVHFEFSFSFAPLQYRKTKENQLFSVITRLWYLNRDKTSSVWQR

SEQ ID NO: 6428 - protein, 64 aa, B.fragilis
KKCYVSKSMFSLADDGLASILCNTSIYSYFVGNPKQTIEGCKWRFAKRNSSKRESLFIIRYKKE

SEQ ID NO: 6429 - protein, 66 aa, B.fragilis
SLLYPSIFLPIFLEYSDFGCDFGYSTYNSGWSCFVISKYGKQYIAEKDKCMNGPFNLFKVLELPQH

SEQ ID NO: 6430 - protein, 192 aa, B.fragilis
FISYSEFIMVNELNKEMDVDKYKIRSWSKDDFSTLAKYLNNKKIWDNCRDSLPYPYSENDAQQFILSVSSQNEQNNYCIEVNQEAAGNISFARGIDVERYNAELGYWLAEPYWGKGIMTQMLALAISSYFHHTDVMRICANVYAGNIASMRVLEKIGFRKCGIHRNACFKNGVFTDCHYFELLKEEFRNLVK

SEQ ID NO: 6431 - protein, 235 aa, B.fragilis
LLAYNTLLLKWFYISLCVERDIFQFIMNGFFLLKRPFIWLARFRHRCGYGVHSPFAFDLITNVIYERTPYYAYSSLEAEQKKMSANSGRKWKHESKKVNRLLFRLVNYIQPDTIVDAGTLSASSLYLQAGHAKADYVGASDLSELFLEKDTPVDFLYLHHYRNEEFVEQVFDLCASRTTGRGLFVIEGIRYTKKMKALWKKIQQDDRTGITFDLYDLGIVFFDRTKIKQHYLVNF

SEQ ID NO: 6432 - protein, 67 aa, B.fragilis
LILYSDKGNSFQDIREKKKRYVYLVGENVGNFQTDVRDSIVVLTHIAWTVLVTSASKVSYELHLDVA

SEQ ID NO: 6433 - protein, 240 aa, B.fragilis
YYLYSLITHSTAIEGSTLTELDTQLLFDEGVTAKGKPLVHHLMNEDLKQAYELAKTESSSLVQITPALLQRLNATLMRTTSSVHSVMGGSFDSSKGDFRLCGVTAGVGGHSYMNYLKVPAKVDELCAILQVKQKTVGTLREQYELSFNAHLNLVTIHPWVDGNGRMARLLMNYIQFCYHLFPTKIFKEDREEYILSLRQCQDEETNQVFLDFMVRQLKKSLSLEIECFNASQKRGFSFMF

SEQ ID NO: 6434 - protein, 91 aa, B.fragilis
LQRYHPCGSRKRQLPQKHFTGTAGSTQERNPRGSLLPRTYRSYHNGCRSRRYSISVFASQELNPQKSRVLLILGLTKTNDWKQIQQYFNEY

SEQ ID NO: 6435 - protein, 459 aa, B.fragilis
LAYHLPIQRQFIQLSLPKIKKKDMILQLAFVLTAIIIGARLGGIGLGVMGGVGLGILTFAFGLQPTAPPIDVMLMIAAVISAASCMQAAGGLDYMVKLAEKLLRKNPSHVTILSPIVTYLFTFVAGTGHVAYSVLPVIAEVATETKIRPERPLGIAVIASQQAITASPISAATVALLGLLAGFDITLFDILKITIPATIIGVLVGALFSMKVGKELVDDPEYQKRLAEGYFNSKKIEIKDVHNRRNAMISVLIFILATAFIVFFGSFDGMRPTFLIDGETVTLGMSAIIEIVMLSAAALILLITKTDGIKATQGSVFPAGMQAVIAIFGIAWMGDTFLQGNMGQLTESIEGLVRQMPWLFGIALFIMSILLYSQAATVRALMPLGIALGISPYMLIAMFPAVNGYFFIPNYPTVVAAINFDRTGTTKIGKYVLNHSFMMPGLISTVVAIALGLLFIQIF

SEQ ID NO: 6436 - protein, 327 aa, B.fragilis
LKTQTWRFMKKLMLLTLLSTFIFYSCSDDDSCTTCKEDNGSLVTPDLSVTLSDTQSPMTGVLEAYPCQAGGAIYYGNYIEGKLTSFPGMYYLQNGEIYGDKNREISLPVGTYNMIYWGTPKYEELIYSNPVVVAPQITIGGDLSQQYFGLRKVSADTTYYPVFDLVYTVKPAHIGTEELSAAMQRVVAGLKVIVKNKNNGILSSSIAGMEVHVGGIAEKLNMYTAAPVNQTKTVSFPLVLSADGTQMSNATVMLFPSSAKPMFKLIIKLKNGNTKVYQQPLNAPLKANNKLTLTLTLGDIFSEETSGGFTIDNWQEENETIDIPTLE

SEQ ID NO: 6437 - protein, 83 aa, B.fragilis; identical to SEQ ID NO: 6082

SEQ ID NO: 6438 - protein, 224 aa, B.fragilis
NKHNQKVEMKKVCLSLLMGLMVQMTFGQTLEKMQWFNEPEQWEIKNNVLSMSVTPQSDYWRISHYGFTVDDAPFYYATYGGEFEAKVKVVGEYKERFDQAGLMLRIDHENYIKAGIEFVDGKFNLSTVVTHKTSDWSVITLDKTVPYIWIKAVRRLDAVEIFYSFDDKTYTLMRNAWLQDHIPVKVGLMAACPDGSGFNAKFEYFQVKHLPDQRRVEWLKKNAE

SEQ ID NO: 6439 - protein, 229 aa, B.fragilis
ILNKSRILRKSPRSALGYAWGDFFITHSRMIKKMKGIWPEVFPAVFEEGGLYPCHPKRELPLKRDGANPKLKGRTINLQNAVKKCNRLCPLRYDSITVSEGRFMFNGKVTAPQVRELFIQETDSDRFPVTLPVVLDPGEINAKIGDIVLVEGSGLNEEMMQTLMALDEFRGRDFTGKEINEIKEAFGGFVLEQIVKHAGSPVGNYLYEAYQNKLNEKQQAEARKTLGIG

SEQ ID NO: 6440 - protein, 123 aa, B.fragilis
LINKGVMKNYQKKSVAQDARVELHDSLALTGAEVSINHLPAGAGVPFVHSHKQNEEIYGILSGKGFITIDGEKIELQAGDWLRIAPDGKRQISAASDSPIGFICIQVKAGSLEGYTMTDGVVQ

SEQ ID NO: 6441 - protein, 314 aa, B.fragilis
NKNKMKEKDLIRFMDRMIEERKAEYALGTAHIYQASRNALSAFLKAHDIPFKRVRPELLKQFERFLRRRGNSWNTVSTYMRVLRAVYNRAVDRRLAPHVPHLFKAVYTGTQADIKRALKAEEMGQLLDTKCTRKQSELLQKTHHLFVLMFLLRGLPFVDLAYIQKKDLNGNILTYHRRKTGRQITITVTKDAMNIIREYMDTTTESPYLFPILSAEGGEDTIYREYQQALRIFNYQLTKLGELLGLTTELTSYTARHTWATLAYYLEVHPGIIREAMGHSSIKVTETYLKPFNIKKLDETNLSIISYAKRSFEG

SEQ ID NO: 6442 - protein, 76 aa, B.fragilis
NMHNMDNKQERTVVHVEYNGQHYYFGSLSAIYTKFSPKDLGIALGTLRNYGLKEEKPYQNSLCTIRKGFLITMPKK

SEQ ID NO: 6443 - protein, 91 aa, B.fragilis
PVCKDKPFPLLSQMITIEKMNEQQLFIKIGDKIKEIRLEKGISQQDLAAKCNFEKANMSRIEAGRTNLTIKNAYKISLALGVRLKDLLDVE

SEQ ID NO: 6444 - protein, 60 aa, B.fragilis
TDLNKKTLGRREFLIGCCLYRKEPIKPTNIMKEFMLIASLVLSFCILILCRDYIVFMLKK

SEQ ID NO: 6445 - protein, 153 aa, B.fragilis
RMAKIENKTKENPKLEQNKLSDGRISLYLEYYLGREEKPVLDANGNQVYYEDGKMQGKPKFSVKHNRRKENLNLYLMDKPRTPAKRQQNKETLELATKIRAEREQEFKESMLGYRLKKDCTINFLDYFQAYIDSYTKKDCAWCKLHLAVSKTS

SEQ ID NO: 6446 - protein, 63 aa, B.fragilis
SIQNHSQSHYILGKWEGRCWDIEDFIISLNYQSKLQLTIYPQQYLAQSEREVQLQTNSNNNTN

SEQ ID NO: 6447 - protein, 848 aa, B.fragilis
TNRKMKNAIVSLLLLLMVTQYVTAQKKVIKIACIGNSITYGVGTRNPAKDSYPAVLGQMLGDGYEVRNFGVSARTMLMKGDHPYMKEERYRQALAYNPDIVTIKLGTNDTKPQNWRYKSDFKKDMETMIRTIRALPSKPEIYLCYPIPAYAVQWGINDSTIVHGVMPVIDQLAAKYRLKVIDLHTPLIGMKECFADHVHPNEKAAACIARVIYRQLTGKEAPEHVSQPFPGHKSKWQGFDQYTFTYQDRQAIVVCPERAAAGNPWIWRPAFFGAFASVDEALLKRGFHVAYYDLTHLYGSPRARKSGTDFYWNMVQMYGLSPRVTLEGFSRGGLFAYNWAADHPDKVACIYVDAPVCDVFSWPGRSSGNAGLWKGMLDEWGLTEARMNTFPGNPIDRLKPLADARIPVICVCGDSDRVVPFSENSAVVRQRYTAMGAPFELILKPGVDHHPHSLENPTPVVDFIVRHQAGYEAGQCYTLRGNYQNSYRKFEKERVGTVAFLGGSITEMKGWRDMICEDLKQRFPYTKFTFVAAGIPSTGSTPGAFRLTDDVLSKGKVDLLFVEAAVNDDTNGFSAIEQVRGMEGIVRHALVSNPSMDIMMLHFIYDPFIPKLDKGQMPDVILNHERVANHYLLPSVNLASEIAARMRSGEFTWEQFGGTHPNPLGHAYYAATINKVLDEMYAPCATAKDAAKPHALPAVPLDAYSYTNGRLVDIRQAHIGKGWQLVAPWTPRLAAETRPGFVDVPMLETNRPGAKLTLDFEGTAVGIFCVSGPAAGILEYSVDGAPFKKLDTFTAWSGGLYIPWVYMFDTELPMGKHRLTLRMSKDHHPQSKGTSCQIRQFVVNDSCE

SEQ ID NO: 6448 - protein, 73 aa, B.fragilis
RRTLELWDRDVERWINSERVPVYSPITYFLYDLPRWDGKDYIRALARYVRTFRRIGYKRTEALCFVHSDQQSQ

SEQ ID NO: 6449 - protein, 397 aa, B.fragilis
TLMKKLMAMLLLAGSIQGVYAQKTEKKEMFLENKSLYEELTNVQKKTDKFNLYLNMQGSFDANFRDGFDEGVFKMRQLRIEAKGNLNSWLSYRYRQRLNRSNEGGGMIDNIPTSIDYAGIGVKLNDQFSFFAGKQCTAYGGFEFDLNPIDIYQYSDMIENMSNFMTGLNIGYNITPTQQLNLQILNSRNSSFDKTYGITEDSEGKLPDLKSGKMPLVYTLNWNGNFNEVFKTRWSASVMSEAKGKNLYYYAVGNELNLDKFNMFVDFMYSQEGIDRNGTITGIVGNAGGHNAFNAGYLSVVTKLNYRFLPKWNAFVKGMYETASVTKAADGIEKGNYRTSWGYLAGVEFYPMKTNLHFFLTYVGRSYDFTHRAKVLGQENYSTNRLSLGFIYQLPMF

SEQ ID NO: 6450 - protein, 62 aa, B.fragilis
VTRKNNIGRNILSSQEISDSYERKNIKYRDRPSMQLLPGLQNTPSAGKCNRPVKERSGTANY

SEQ ID NO: 6451 - protein, 178 aa, B.fragilis
TERKKNMENVIQIQYYQSPCGELILGAYREKLCLCDWKIEERRIIIDRRIQKELQASYKEGISEVITRTIGQLDEYFAGRRTTFDIPLLLVGTDFQKTVWNELLNIPYGKTISYAGLSQKLGNPKAIRAIASANGANPISILVPCHRVIGSDRKLVGYGGGLPAKKILLDLESSDRLF

SEQ ID NO: 6452 - protein, 200 aa, B.fragilis
CVNLDRNNKHTIIMKKSLVYTKTGDKGTTGLIGGTRVPKTHIRLEAYGTVDELNSNLGLLATYLMDEHDLNFVQSVQDKLFAIGSHLATDQEKVQLNDVSIITPAEVEAIEREIDAADEILPPLHSFIIPGGSRGSAVCHVCRTVCRRAERRILALSESCTISADLLAYINRLSDYLFVLSRKMNFNEGKDEIFWNNSCK

SEQ ID NO: 6453 - protein, 78 aa, B.fragilis
EINDHLTYHIPAIYALHSKCTEFPDETSRRVTKITFYFLFLPKDLTTAKNINIRIFSTAIDFHYIQSLQSLTFRSHTP

SEQ ID NO: 6454 - protein, 92 aa, B.fragilis
RRADPRTLPELLIEKHDILIEKIGTRLKTHATETDIARLFIALVEYRFMRKCPIKTFRNACTTSLMNKKSFMKEVFRKHTKISFRHLETAKS

SEQ ID NO: 6455 - protein, 172 aa, B.fragilis
ILLELDQGERVMNDRKILVAYFSCSGVTKAVAEKLAAITGADLYEIKPEVPYTEADLDWNDKKSRSSVEMRDALSRPAISGTLFHPEEYEVLFVGFPVWWYIAPTIINTFLESYDFAGKIVVPFATSGGSGIGNCEKNLHKAYPDIVWKDGKLLNGRITRDLVTEWFEKIRL

SEQ ID NO: 6456 - protein, 448 aa, B.fragilis
NVADFRSLHFLRRQNHFMINESPALASGIFCIFVLTMKKYVDVILPLPLPRCFTYSLPDEGAEEVQIGCRVVVPFGRKKYYTAIVRNVHHYAPTEYEVKEISTVLDTSPILLPGQFRFWEWLADYYLCTQGDVYKAALPSGLKLESETIVEYNPDFEADAPLSEREQLVLDLLAKEPEQCVTKLEKESGLKNILTVIKSLLDKEALFVKEELRRTYKPKTEARVRLAADASGEENLRRIFDELERAPKQLALLMKYVELSGVLGDGASKEVSKKELLQRASASPAIFNGLVEKQIFEVYYQEIGRLNRLVGKTVELNVLNEHQQRAYHEFMQSFQEKNVCLLHGVTSSGKTEVYIHLIEETLRQGRQVLYLLPEIALTTQITERLKRVFGSRVGNLSLQVPRRRESRDLAKAVDGGGLRHHSGGTLFGVPPVSESRTGHCGRGTRKYV

SEQ ID NO: 6457 - protein, 328 aa, B.fragilis
KTKEEYSMIKKLCIILLSVCTVAPVMAQQYSSSDDASFAPKKGQWQVSMVMGSSQMFNNNTENYLLPTYWNGQNFSFPNVGLGNNTSGNQSSDPATYLQLGDLNSNNLVNIIGIQGKYFLTDRWDVNLMFSMNIGVTPKKDYIEGDKTVTDMQIPALQYLEGRIKNNWSVNIGSNYYFNTKNERINLYVGGLLGWQMGRIETTLPYTGIMVSDKDMNTDGTDTDLQPTPDENGQDNGPVVDDNDVTGTPLEVYIPNSRAGQIFGLRAATVAGIEYSIGKGLILGFEVQPVAYRYDMIQIIPKGTPVYKVGHHNINLFALPNLKLGFRF

SEQ ID NO: 6458 - protein, 323 aa, B.fragilis
VMKELKRLSFVVVTLLLSTMMAFAQKPNIHILATGGTIAGTGGSATSTNYTAGQVAISTLLDAVPELKDIANVTGEQIVRIASQDMSDEVWLILAKKINQLLKRPDIDGIVITHGTDTMEETAYFLNLTVKSNKPVVLVGAMRPSTALSADGPLNLYNAVVTAGAKESIGKGVLIAMNGLILGAESAIKMNTIDVQTFQAPNSGALGYIFNGKVFYNQAPLKKHTTQSVFDVTNLNSLPKVGIVYSYSNIDPDMVTPLLHHDYKGIIHAGVGNGNFHKNILPVLLEARKKGILVVRSSRVPTGPTTMDAEVDDTQYQFLLLRN

SEQ ID NO: 6459 - protein, 392 aa, B.fragilis
KKGEKKNKRSHKHFYFQRINRILAETFKTVNIMTSKDNYCVIMGGGIGSRFWPFSRKTMPKQFLDFFGTGRSLLQQTFDRFNKIIPTENILIVTNAIYADLVKEQLPELDPKQILLEPARRNTAPCIAWASYHIRALNPNANIVVAPSDHLILKEGEFLAAIEKGLDFVSKSDKLLTLGIKPNRPETGYGYIQIAEQEGDNFYKVKTFTEKPELELAKVFVESGEFYWNSGLFMWNVNTIIKAGETLLPELASKLAPGREIYGTPEEKDFIEENFPACPNVSIDFGIMEKADNVYVSLGDFGWSDLGTWGSLYDLSPKDEQRNVTLKCDSLIYNSNDNIVVLPKGKLAVIEGLEGFLVAESDNVLLICKKDEEHAIRKYVNDAQMKLGEDYI

SEQ ID NO: 6460 - protein, 197 aa, B.fragilis
LFMESEKEKMGTGRLYDANYDTELIAERQACKELCYTLNHLPPSQIAEREAIIRRLFCKTKERFLLEQPFYCDYGYNIEIGENFYANMNCVILDEAKVTFGDNVFIAPSCGFYTAGHPLDVEQRNRGLEYARPIRVGNNVWIGAQVCVLPGVTIGDNTVIGAGSVVNRDIPANVIAAGNPCRVIREITEEDKTKYLL

SEQ ID NO: 6461 - protein, 462 aa, B.fragilis
RHMEKQNNHIDRRGFLKIVGISAATTTAALYGCGSGTKSSQGRNASSPVPTDQMTYRSVGGIKDKVSLLGYGCMRWPTVPSPEGKGDLINQEAVNELVDYAIAHGVNYFDTSPVYVQGWSEKATGIALKRHPREKLYIATKLSNFSNFSRENSLAMYHQSFKDMQVEYFDYYLLHAIGGGGMKVFNERYIDNGMLDFLLKEREAGRIRHLGWSFHGDVEVFDQVLAMHDTAKWDFVQIQLNYVDWRHATGNNVNAEYLYGELAKRNIAAVIMEPLLGGRLSNVPEHIVGRLKQRRPEDSVASWAFRFAGSPELVLTVLSGMTYMEHLQDNIRTYSPLVPLTDDDKEYLEETAQLMMQYPTIPCNDCKYCMPCPYGIDIPAILVHYNKCVNEGNIPQSQSSENYKEARRAFLVGYDRSVPKLRQASHCIGCNQCTPHCPQSIHIPEELHRIDRFVEQLKQGTL

SEQ ID NO: 6462 - protein, 61 aa, B.fragilis
KAMEQGVWQEIEQLYQKFQKLGINEAVDYDSTTCILLLPIPQPLKAQRLRNLIRSFFSTRE

SEQ ID NO: 6463 - protein, 66 aa, B.fragilis
LVICAQEPDNLQKTLTMLIEERYKDEDTGSGGVNSLPKLELSYSAGVCFFLLKQAKRTIINLKIKK

SEQ ID NO: 6464 - protein, 385 aa, B.fragilis
KDSRFIFGYPLRWLRVRGGKKAVNQALPVIDMNEDYPEKEIVLQDIADISYIPLETNDEFLFDGSVEVVTDQYVITKGHRGNDVCFFSRQGKALNRIHRVGNGPGEYKDIGSMDVNPANGELYLKEMNRQQIHVYSLDGKFKHSFTFPEGKRMSRMCLFSPDYLIAEQESKVPDDQDANFYPYLLVSTRDGHLDSLDYVQKRNILVKLIVNAENHSYAYLLEPSLIRNGSRFYIGNPDSDTLFAMNPDRTLEPLLVRTPSHSEEGNKYGLFLRGAAGAYFFLTKQPMEVPMNSIESLDLKSEEWLYDCRTQEVCRYLLKNKDDASKRVDGIMFFCYPEDCGLAVLKSEDLMDAYEAGQLSGELKEIAAGLKADDNPVLMLIHFKK

SEQ ID NO: 6465 - protein, 77 aa, B.fragilis
IRKLMYWTLELASKLEDAPWPATKDELIDYAMRSGAPLEVIENLQEMEDEGEIYESIEDIWPDYPSKEDFFFNEEEY

SEQ ID NO: 6466 - protein, 261 aa, B.fragilis
SKISFFTSRMDSSGESRDTCFFVNYKRGLTLPKTELDSMSKRKLTTKFEEEPLNFGTGMWNVGLTPNVCRCTLLLPTSCMTCLVGTGRTTSGRWPATYVPFDESAISELKRYASFIATSNHSDLLSDPSGSRRFICINITGRIRNGAAINYLQPYAQAVQELREGECFYFSPEEEAVLMENNQEFELQTPVGHLFQQYFRSADEGEKCETLLAVDILGRIQKKNGFKLSATKIVHLGRILRKLGVPCKKMKNGNFYCVVEL

SEQ ID NO: 6467 - protein, 284 aa, B.fragilis
LLPSLHRQLYKERLRMVQIALSRFKDFLKEQYPLYECNIKPKFITKDMIVQFVDYLQSRSVGEGAKSIYQRFKKVIRYAIEHDVILKDPCKEVICKVDDPMLRKDVLSLEEIQSLINCHYENENPMVRRAFIFCLYFGLRFCDVKDLTYKNVDYSNKLLKFEQNKTKGHSSASGVVIPLNDGLLSIIGEAPANGNKDVLIFDLPTYESCSKSLRRWVKRAGIDKHISWHCARHSFAVNILNNGANIKTIAGLLGHSGLKHTKKYTRAVDKLKEEAINSLPELKL

SEQ ID NO: 6468 - protein, 808 aa, B.fragilis
IATSQSLHRMQPMYPALSAIHPHTGRTASHRSFCRTAQAGDTMMEKIIDLLHSGGYSCVIGNGTEIRTFTQRGVADLYDLFRQDPSFMKGAGIADKVIGKAAASLMVLGGIRQVYADVISQPALALLCNANIEVSYVRLVPFIENRDKSGWCPLETACYGIESIQEIFRIIENFLSKIRIKKNLLGILLVCAFLSSSLQAQVRKDTTQAGHNYEIDGVVVTGTRNETDIRHLPMTISVVNRETIGQRSEPSLLPTLTEQVPGLFTTSRGVMGYGVSNGAAGGISLRGIGGSPTTGLLVLIDGHPQYMGLMGHPIADAYQSMLAEKVEVVRGPASVLYGSNAMGGVINIVTRRQREDGVRTGVRLGYGSYDTWMTEATNQVKKGRFNSIITGSYNRTNGHRPDMEFEQYGGYTRLGYELDHSWNVSADLNLTHFNASNPGTVSTPVFDNDSRITRGMTSFALENRYERTSGALKFFYNWGKHHINDGYGTGEEPLDYRFNSKDRMMGISWYQSASLFSGNRLTAGIDYMQFGGEAWNRFIADKHKEGISDKSENEIAGYLDFRQAIGSYLTMDAGLRIDHHTVTGTEWIPQVGLSVQLPQDASLKAMASKGFRNPTIRELYMFRPANPDLLPERLWNYELSYSQRLLKGTFYYGVNLFYINGDNMIQTIRTDGRPLNVNTGKVENWGAEADIAYHIHPMWRLTANYSWLHMEHPLIAAPEHKLYTGIDFTQKKWSFSTGIQYVTGLYTAVDPQEKKENFLLWNLRGSYRICSIADLFVKGENLLAQRYEINAGYPMPKATCMGGININF

SEQ ID NO: 6469 - protein, 166 aa, B.fragilis
HKRSIIYTLNLNNKKMNKVIVTFLLLIGIVASSCTTSKSVISQKADLSRYEYASIINNDTYHIPAQLMEYEIQLFDAIESSRLKLVNDIRIDELSPNQQSKLLMVKYGVDILEEESVVTVNFIDYLTGRPIASCRGAYTTLGFSVSADIRGAIKRVAKQIAETFPK

SEQ ID NO: 6470 - protein, 716 aa, B.fragilis
SNYGMNTKSKHPLLSFPKPQFTTGMIRLSITLLFSTLCIGSFGQKKSPITVETLLEEMTSYDEMTRYPTLPYRSMQQSSYDRRSVSPDRPGWFANDDGEGFIRLEEHNGRKEKVLFEDEGPGAITRIWLTTFGSIHTILRFYFDGKDEPGWVVPSYDLQKFGVRGLKKGLIEPDDKWIRGSLIYLPVTYADGCKVTMEELTPERTNRHFLFNYRKYPTGTPVETFSRKVAERIPQSVEKTSATLYRNIDKGVDPQARYGKGALIHRQNLSLNKGEKQQLNLHKGKRAISLLQFNVKTDPDLKPGTDDFARLMRSLIISISFDGQQTVWAPLSDFAGSGMGAFASRSFFFYSDGKGIVCSKWLMPYRQNCEISVLNLSPYKTDVHIDIVSQPYKWDNRSLYFHTAWKQERRLPVVTWMEHEKCMDWNFTTISGRGVYRGDLLSLFNHTTEWYGEGDEKITVDHEAFPSHFGTGTEDYYSFDGYFKSQTPFAGQPRQDMKDFYGYNSFFRVRCLDGIPFNQQLKFDFELLGWENGTVDYSSTVFWYGDLNSQAAGFSGIEEIEAGLLPTPTQSPVCSIANAIDFCQIQPTSKSERLRYDRQRLSGHPGKWNLKDHLVCHGGKKGDYIEFEFSGFEDREYSLNLFCTKAADYGNIKFYVNRQENGKQLDCYSQEVEATGAINLGMHKPIDGKFILRIELTGQNALSTGTLFGLDCIRIE

SEQ ID NO: 6471 - protein, 92 aa, B.fragilis
HDYGFCKISGRSLNNRPFDKFPIEECTYGTPHYITLEEKDKIFNADLSATPQLAIQRDIFIFQTLIGCRVSDLYRMTQSRPTHATRTSDRKA

SEQ ID NO: 6472 - protein, 480 aa, B.fragilis
RYIMKEELSKATRTESDLIGEREVPETALYGVQTLRGIENFRISKYHLCEYPLFINALAITKMGAAMANFELGLLTEEQANAILRACKEILEGKHHDQFPVDMIQGGAGTTTNMNANEVIANRALELMGHKRGEYQYCSPNDHVNRSQSTNDAYPTAIHIGMYYTHLKLVKHFKEVIDAFRRKGEEFAHVIKMGRTQLEDAVPMTLGQTFNGFASILQDEVKNLDFAAQDFLTVNMGATAIGTGITAEPEYASKCIAALRKITGLDIRLADDLIGATSDTSCLVGYSSAMRRIAVKMNKICNDLRLLASGPRCGLGEINLPAMQPGSSIMPGKVNPVIPEVMNQIDYKVIGNDLCVAMSGEAAQMELNAMEPVMAQCCFESADLLMNGFDTLRTLCIDGITANEEKCRKDVHNSIGVVTALNPVIGYKNSTKIAKEAQETGKGVYELVLEHDILSKEDLDTILKPENMIHPVKLDIKPNH

SEQ ID NO: 6473 - protein, 355 aa, B.fragilis
GIIILLFFAVRKKSIMDSFDKYISRNLPLVSLISAVFIIYPNIACTPWELNSLEPSEYLGFFSYFIYRFLFFWGMIGFLINYNLRQIPTALFRKRLTHNFLFALTGYLFFASVSYTISSHGFHTDFLGSTLISQFFTLCFLCTLVGYISMLYTRQREKEQEIERLRFENLQSRCDALANQVNPHFFFNSLNGISSLIRKKNDENTLTYVNQLSDIFRYILQSDRKGVVTLREELEFIQSFRYVMEVRFANKLSFTIDVDEAQKDVLTLPVLSLLPLVDNVTVHNRIDSEHKMDISIRLNEQYELVVSNPIYPKLSPPDTNGTGLSNLENRFNLLMNKQIRIETDEKVFRVYLPLI

SEQ ID NO: 6474 - protein, 301 aa, B.fragilis
VTPMKERILNIETVHQCNCCLGCKTLHPLVSVIDLSKSDLEQQIIKFDFYTILMMEGEIDDILYGRKYYDYSNASLVFLTPGESIKINKSKALPSKGWLLAFHPDLISQTSLGEHIKDYSFFFYNPEEALHLSQREKAKAVECICNIEEELRHAIDCHSQILISRYIELLLDHCNRFYERQFITRCEANKKIMKKTDVLLKDYILSGKLKYNTSPSLGYCAKILQLSSHYFNDLLKFESGKNIDEYFESKRLEMAKSMLLDSNNTVSVVTEKLGYPNIRYFSRLFKRITGVAPNNYRLSQN

SEQ ID NO: 6475 - protein, 587 aa, B.fragilis
KMYIEKINSPKDIKELSVEQLSVLAEEVRTALIRKLSEHGGHIGPNLGMVETTIALHYVFNSPIDKIVFDVSHQSYVHKMLTGRMAAFLDPAKYDDVTGYTNPDESEHDFFTIGHTSTSVSLAMGLAKGRDLTGGKENIIAVIGDGSLSGGEALEGLNNAAMLGSNMIIIVNDNDQSIAENHGGLYKGLKELRDTNGESPDNIFKAMGLEYYYLGDGHDVSALIKLFTPVKDIDRAVVLHIHTIKGKGLKYAEENKEYWHAGGPFHIEDGSPKGPGWPVNETVRESVLDLIEKRSDVVAITAGTPSVIGFTEDYRKRAGKQFVDVGIAEEHAVAMASGIARNGGTPIFGVFSPFLQRTYDQLSSDLCLNNNPAVIMVFMASVYGMNSNTHLGIYDIPMISHIPNLVYLAPTSKEEYLAMFKYATTQKAHPIAIRIPMMMPETGIEDTTDYSLLNKYQVVRKGSGVAIIALGDFFELGVQIADKYKILTGNDVTLINPKFITGIDEELLECLKTDHELVLTLEDGIVEGGFGQTIASFYGLSDMKVKNYGIKKSFPTDFRPEELMRENGLSVEQIVEDIKSVCREHVM

SEQ ID NO: 6476 - protein, 221 aa, B.fragilis
NYIFVPNFKHNLVMKKIISALMMAVCIGMAMPAQAQLIKFGVKGGVNLAKADLNTSDFKTDNFTGFFIGPMAEVTIPLIGLGVDASLLFSQRGVKVSSRDFIDPLADSDPIIGNRTIRQNGLDIPINLKYTIGLGSSLGIYVAAGPDFYFNFSGDKVYENYGRLNKKNAQIGINVGAGVKLLRHLQVGANYNIPLNKTAEWKEADFSYKTKMWQISAAYIF

SEQ ID NO: 6477 - protein, 401 aa, B.fragilis
KNVMFQHQFIDSLTGLLCFFGNLGRVFISDNRIQCSHHTDTVVNIFPAFFLIGRDAVYTQGTQRIETIHQQIGRFETALGHDRFHRIQFHLGRFTTHSYTKVVTYYFIVNLIHHFGNNRIDLTRHNGRTGLHGRQIDFAQPATRAGCQKAQVITYLIHFYSYTAHSRRVTYQTRSVGSSSYQIIGQTDIQSGNLPESRYAFACIFRLGGDSGSDGSSSHIDGQEVLSSKVQVLDFILKDTGKTIERLSERHRHRIFQLGAPHLDHVCKFFALSSESIDHLLKMFHQFEVRIIHTDMDSGRISVIGRLRTVNMIIGRTILIFPTFMSHQLECAVGYHLVGIHVGGSSGSTLDHVYRELVMMFPFQNFFTCTKNGICLLFGQQSKFKVSHSGSHLGNGQCIDK

SEQ ID NO: 6478 - protein, 806 aa, B.fragilis
FTYITFFLLTLKNRGMRKWTYLVAALLVGGATTTFTGCIDNDEPAGIEQLRGAKAEFIKAKAAYEDALTQIQLVKVEREKVKLEKDQVNLELKKCSLEVEQAKTAEQKAFWEAEAQKRTEEFKAKILDLQTLTAQAEYNNKKALMDIEVALLTMKDDAYTAEINKYRAALVGYTFKSESTTNGETTITTNSSYGALADLAEAKSSLMKAEVARINFLSKNKYYPEELQLERTHAAKTLEIQMALMEEYKALDATGTDSKALADKLKGYKTDLQALDAKEDEAYTKIEEMRKPIFPINQQIIEEKIKLDATSSAYTLAKADVDPALVNGLYSALSTGEDEEKLVEDLDKIFVQDSWNAELLNYQYTMKKDVVINDLSLNNKATKIGAIADAIKAYYQGENSEAFDASGKLLDAYKTKFENELKRLEIDKKPAYDQFKSDSTAWINAYVAYVAALKAYNNYKGTNTYQAITKEVTTYNSLKAEDKKLETANALRTSILGYLGKRKAVDGFNAEFATTYKDALTDANLATFNEAIATAVSDGISSLIGNETLATSFNDKVEGSTLFAFLEANQALFGGSELNLEKSIEPKEISANKYDMPKNVSQLIDNPENNSGSFVKYTYLAQESNYLVNLDKWQALYAKIKAEADPVLAEVDAINEKIATLESQIKDENAALWQAELACYLIKGDKSKRQNEIFSESNPYKNYYTSNEQEPLLGNVVTEYSKLEAEIALVQRAMEDGYFYYTYYDANSHTYKVSEKSLNLTSLLETQEEAITDAKKTVEDIDNKIALFDKYGYTNIEGQEEYLDLS

SEQ ID NO: 6479 - protein, 523 aa, B.fragilis
KTRIMNVIIYCRVSSDEQTLGASLDVQEERLRKYCNQMGYNIINNIPYREDESAKTFEKRPVIQGIMSYIRKNKGKVNKLLFLRWDRYSRDIISASENLKELLKLGVEPNAIEAPLDFNSDTWPLLLGVHIGSAQCDNIKRSKATMDGIHGTLAKGKCANKAPRGYKNVRISKHETHVEIDTNTAPFIQAMFKEVAKGIETPCYIRRKFARKGYNIPESSFLEMLRNKFYIGKIRVPAYKGEPEYYVNGEHEAIIDEETFYKVQEILDGKRKKTPKLSKAINPDLYLRKFLICPVCGCALTGATSSGNGGKYTYYFCCNNQKHIRMRAENVNEEFARYTAQLKPNKTVLNLYNEILKDLQNERKGESKKEVVALQNELSTVQKRINSIEDKYLDGDLTKEEYNRMLERYTKEASTIQQQVEMRENPNRSNIEPKLNYSINLINNIDSYIRNASVGVKIKLISSMFPEKIEFDGKTYRTNSYNKVLDLIYQQTNELRGVEKKSGESFSTFSASVPRPGVEPGWK

SEQ ID NO: 6480 - protein, 339 aa, B.fragilis
KNNFNFLMKSQYEKKRLITFDRIKIKSNYKYLLNTKVKFNEMFHSRSGEKIGIFYSSKDDINIPYNLYIAVSYIKQTLTLEFSSKILKEKYPDLISRDTIKECLTNINQLHICDIDVDSILSNGAITSVDVTYDANLILSDNLLNILNSQVTNYRRFKWAHYDKEGITFTKDVKSKDCTETITLYNKEKEICTSHNKDFLNSLSQPQSVIDYFKGKTRFEITLNTVKKIMNYLNLTDTKIFSVLNSDTNPILTQFDKVFGNSTANMPNTTFDDYENWAMKIILERYNGDLKLLEQDIRSKFNSRSGASKRMKKFETVYHAMTSASTSENPIEKIRNLLL

SEQ ID NO: 6481 - protein, 87 aa, B.fragilis
MMSVLLLPLRWRLLSAKSMPPTKFFHLYILLLFREGVVALRFATFAVPFAGGPNAGFLHYPKAVQSQPIYWPISTVYRIIYLSCPVK

SEQ ID NO: 6482 - protein, 206 aa, B.fragilis
ERSLVFARILITFVRNHYQLSNGKKDEVWQVVSSKYLFRRPWLTVRCDDMLLPNGNHIPEYYILEYPDWVNTIAITKEGKFVFVRQFRPGIGKQLYELCAGVCEKEDASPLVSAQRELLEETGYGKGNWKEYMVISANPSTHTNLTHCFLATDVEQIDTQHLEDTEALTVHLLSLEEVKELLENGQIMQSLHAAPLWKYMAEHKQI

SEQ ID NO: 6483 - protein, 63 aa, B.fragilis
RVISSYEVISSKRVSTVIGDFFCPNEPMHRVEKSKVMLNLIIPVVNWGFGNDSKGCFDFVFMP

SEQ ID NO: 6484 - protein, 197 aa, B.fragilis
IMELQVIQNKIYEVRGQKVMLDFDLAELYGSETKRLKEAVRRNLKRFPSDFMFELTKEEFESLRSQIASSNKRGGTRYMPFAFTEQGVAMLSSVLNSESAIEINISIMRAFVTVRQYLSSLNSTTKEIEELKQRMKMLEEGNEDIIAAVNDLSEDTRKELDDIYLALSQLAEKQKHVNKQTERRPIGFAHYKENNKK

SEQ ID NO: 6485 - protein, 812 aa, B.fragilis
LSPSPNKETPTMKEDLYDDLYEEKEEKIDFHALLFRYVIRWPWFVASVIICLAGAWLHLRQTTPVYNISASVIIKDDKKGGNSGGNLAALEGLGLVNSVSNIDNEIEILRSKTLVKHVVSELNLYTTYSVKGSFNEVELYKSSPVLVGLTPQEADRLPGPAVFELTLSPGNRLDVKATVGETSYNKKFSKLPGLLVTPAGTFTFTLAGDSAGVSEPQTLTAVVSNPMQTAKRYAAALSVEPTSKTTSIVIVSLKNTNKRRGEDFINRLIEVYNRNTNNDKNEVAEKTEEFIAGRIRIINDELFSTEKELETFKRDAGLTDLASDAQLAVSENSAYEKQRVENGTQLNLVRYLAEYISAPDKINAVLPVNVGLTDQSLSSLIGQYNEMVLQRNRLLRNSSESNPVIVNLDSGIRAMRENILTTIHSVQKGLLITKADLDRQANKFNRRISNAPAQERQFVSISRQQEIKAGLYLMLLQKREENSIALAATANNAKIVDEAMADNGPVSPKTKTIYMIALVMGMGIPVAIIYVMGLLQFRIEGRADVEKLTSAPIIGDIPLAEEGNGKAGGIAVRENENSLMAETFRGIRTNLQFMLGEENKVILVTSTISGEGKTFVATNLAISLSLLGKRVVIVGLDIRKPGLNKVFNLSQKEKGITQFLAGPQTTDLMSMVQPSGISRTLSILPGGTVPPNPTELLARQALVEAIDILKKHFDYIVLDTAPIGMVTDTQIIARVADLSVYVCRADYTHKADYTLLEDLRLGNKLPNLCTVINGLDMKKRKYGYYYGYGKYGRYYGYGKKYGYGYGYGQKHN

SEQ ID NO: 6486 - protein, 101 aa, B.fragilis
DYVSLCGELHEEVHTCYNGGYRRQLAGDRMLIPKASLSSDRSLQPDFVKLDSLVIAHQPRRGGIRSRALYTPPVKPWEPGVPEVRNRKDRPRVKLVTGAKS

SEQ ID NO: 6487 - protein, 588 aa, B.fragilis
LRAFIIMTDMTDIKNEEAGEKKSLNFIEQAVENDLKAGKNGGKVQTRFPPEPNGYLHIGHAKAICLDFGIAAAHGGVCNLRFDDTNPTKEDMEYVEAIQEDIRWLGFQWGNVYYASDYFQQLWDFAVTLIKEGKAYVDEQTSEQIAQQKGTPTQPGVESPYRNRPIEESLALFEKMNSDEAKEGSMVLRAKIDMASPNMHFRDPIMYRILHVAHHRTGTQWKAYPMYDFAHGQSDYFEGVTHSLCTLEFVPHRPLYDLFIDWLKEGKDLDDNRPRQTEFNKLNLNYTLMSKRNLLILVKEGLVNDWDDPRMPTLCGFRRRGYSPESIRKFIDKIGYTTYDALNDFALLESAVREDLNARATRVSAVLNPVKLIITNYPEGQVEELEAINNPEDPTAGSHTIEFSRELWMERDDFMEDAPKKYFRMTPGQEVRLKNAYIVKCTGCKKDENGTVTEVYCEYDPNTRSGMPDANRKVKGTLHWLSCNHCLPAEVRLYDRLWKVENPRDEMAAIREAKGCDALEAMKEMINPDSLTVLPHCYIEKYVADMPALSYLQFQRIGYFNIDKDSTPGHLVFNRTVGLKDTWGKINK

SEQ ID NO: 6488 - protein, 224 aa, B.fragilis
ALQLFDEKAIYVTNLMFKKMKKDFNLTKLFYSFAIAFSVVTLSSCNNDDNSPLPPPSTNDVAGTYNGKVLITQVTPATVKENAGEAPQGQDVNATVKNDTVFFDKLPVTELITSIVGDKDKAEAIVKAIGDVKYKVGYKPALNTEKDSIYLAFDPKPLTLQLPAAVEGQEGQTVTVTISSPDKGSFAYKKNQLKLKLSADKVELAGVAVPVPQTLFNFDMTKKK

SEQ ID NO: 6489 - protein, 172 aa, B.fragilis
NLELSIMATTNFKGQPVKLIGEFIQVGKVAPDFELVKSDLSSFALKDLKGKNIVLNIFPSLDTGVCATSVRKFNKMAAGMKDTVVLAISKDLPFAQGRFCTTEGIENVIPLSDFRFSDFDESYGVRMADGPLAGLLARAVVVIGKDGKVAYTELVPEITQEPDYEKALAAVK

SEQ ID NO: 6490 - protein, 379 aa, B.fragilis
MINTPRKNGYSFKYGTLFYVPFFSCHLGISETFIRLYIYAIDFLLISSIFSNLSLKIFFIINRVLEHTKKNKKMEIEKFIKSLARKAKLGGRYSTANTYLYTLHSFQKFAGKASLTFEEITPESIKEYEQYLILNGKRYNTISLYMRMLRSICNQASEQNIASLNTRELFENVFIGNEPTAKRAISPVLISRLLEADFSKNSRLDFARDLFLLSFYLRGIPFVDLVHLRKTDVQGNMLVYFRQKTGQQLTVIIENCAKVILRKYASLCKESVYLLPVISAAGEEGHKQYRSALRVYNKRLNQISGILKLKTPLTSYVARHSWATTALQKGVPVSVISAGMGHASEKVTYIYLASFDNKTLSNANKKVIAAVRFKKEEEE

SEQ ID NO: 6491 - protein, 155 aa, B.fragilis
KESTIMSKEVTYSVVARKNMLKKDDPAKYYAQAQASGDVGLDEISTRVEKACTVHSADVVAVLKALEDEMVDGLSRGEIVRLGNIGTFQVGLRSRGAEKAEDFKAANISKARVNFRPGPVLADAMKTLNFSKVSTRAAQKGDGGGDGDIVDDPTA

SEQ ID NO: 6492 - protein, 104 aa, B.fragilis
KHTAFRIFFRTFTVCNNQIIKAMNQRKEEDTTEADFIIRSYTKAELAQLYCPGLDPVLALQKLYRWMRKNTALTQALSEVNYNKYRHSFLKREVRLIVYYLGEP

SEQ ID NO: 6493 - protein, 212 aa, B.fragilis
TIGARTLFTMDNNLKNKIDMKTLFDEMEHAVKNWWLSLILGILYIIVALCLLFAPGSSYIALSVIFSISMLISGIIEIIFSISNRRGISSWGWYLAGGIIDLILGIYLVAYPLLSMEVIPFIVAFWMMFRGFSATGYSMDLKRYGTREWGWYMGFGILAIICSLIILWQPAVGALYVIYMLAFTFLIIGFFRVMLSFELKSLHKRSTVMNGK

SEQ ID NO: 6494 - protein, 482 aa, B.fragilis
LLIKLGRKNSPSERERELQNLIAQYEAVKAKNESLYLDGDQLADIADLYASERKFKEAQEVITYGLGLHPGHTDLMVEQAYLFLDLNQPQKAKEVAELITDTYSSNVKLLLAELLLNEGKLDAADQMLDSIEEEEKNDLGILVDIVYLYTDLGYPEKGVQWLKRGAEMYKDDEDFLAATADCYGAAGAEYIEQAIVVFNKLIDKNPYNPAYWVGLAKCQFATKDFDKAIESCDFAIAADEEFGEAHIIKAHSLFHLENIEGAIVEYRKALKYKTLSPEFTYMFIGLAYTQQENWAEANESYSMALRAIEENGNGSSPLLSDIYSNKALCASRQGDSEEAHRLCRLAKELAPQDAEPYLLEGRIYMEEDNFDLARAEWALALRYAPEADTWMEIGNYSLEFRMLENARFCFEQVLEEDPEYPKICEQLAAVCLVLQDHEGFKKYNAMSGDSINLDSLRDTILEMGVDGEQMLRELDDFLKDEK

SEQ ID NO: 6495 - protein, 254 aa, B.fragilis
HRCKLKMSLMKRSPTGKSWGVKISRSGVFRLEDITHYYSEEELGEAYENAGEKIMELIQKTPGIVAFIPQKFVVRPDAVHFIKDNTISVKEVFAGAEWFPTATPAPLFGFLPLITGTLWVSLFAILIALPFGLSVSIYMSEVADSKVRSWLKPVIELLSGIPSVVYGFFGLIVIVPLIQKVFDLPVGESGLAGSIVLAIMALPTIITVTEDAMRNCPRAMREASLALGASQWQTIYKVVIRLHHGAGRIRRLDL

SEQ ID NO: 6496 - protein, 424 aa, B.fragilis
NHRDAFLIMLLSVAVAITVLLSVSVIAAVFSVSIVIAVFPLFHVQAVDYGTQVGELVAQAEIFEQGIVGFVGIVGAADINREVGHPCDDLCVGHHSDGSGVEHDIVEVLFEDIDGFHQCLACQQFGRVGRYGSAGEDAQGAGYPGGLHHRHQVGGLRAGQELGDSFFFLREVEDLVESRLADVEPYDDYSFAQQREADGEVGGYKCFSFAADGRGDQDDFILFAQHKLQVGADAPEGFRHQAVFVFADSDASRFPVTLFGQGDVSDDGGGGQLFHIGPSFYPELEQPHDVDDGYGDAHPHDEGYHIDRFGLGRNGTVVRHGLVYDLGVVGSGGQCDGVFFPFLQQHQVESGFDLLLPGDADELAFLRGRIADAAVELVGLTVEVGLGDQQSFLNAVDGGQDVFAHGTDAAIQVHDHRVAFRGVA

SEQ ID NO: 6497 - protein, 62 aa, B.fragilis
EMRWKEKKKLIKIKKMNKRNYTTEEHRVSQRIFFPHHTKDENPVKLCVLCGEPPHSNILKLR

SEQ ID NO: 6498 - protein, 153 aa, B.fragilis
RHPCHARKHPDHHPQRSERIADHQGRPRPSGQQVQPPHQQCARAGTPVRQHLPAAGDQSRTLPDAVAETGRKLHRTGRHCQQRQDRRRGHGGQRSRFSQDQNDLYDSPRHGDGHPRSHHLRHGAAPVPDRRTGRCGKADLRPHHRRHPPGRRG

SEQ ID NO: 6499 - protein, 262 aa, B.fragilis
MTKRLLFFTLTCILLASCQSYKKVPYLQDPGEAQRAVAEAKLYDARILPKDLLTIVVSCSDPELAEPFNLTVSTPVSNTQKSLTSQPALQQYLVDNRGNIDFPVLGTLHIGGLTKGEAESLIREKLKGYIKENTIVTVRMANYKISVIGEVNRPGTFTISNEKVNLFEALAMAGDMTVYGLRDNVRLIREDADGHQHIITLNMNRADIIQSPYYYLQQNDILYVTPNKTKAKTADISASTTIWFSVVGTLVSLASLIITIAK

SEQ ID NO: 6500 - protein, 149 aa, B.fragilis
KSKGMKKVFERIIEGILTCSGFVTSITILLIVLFLFTEAFGLFSSKVIEEGYVLALNKDNKVSELTPMQIKDVFDEEITNWKELGGEDLPIRGVPSGRHHALLLGRRTGRSLRECRGKDYGADSENTRYRCFYSSEVCGTAGCGTFHKG

SEQ ID NO: 6501 - protein, 470 aa, B.fragilis
KYSMKQVLRFNKVIKRIVFTGDLILLNGTFLSLYTLLGSKFFADPFIHSLPQVLVLLNLCYLVSNMSSGIILHRRVVRPEQIVWRALRNSAGHALFFSCALTFGNFGILSARFFLLFYIAFTLLLVCYRLLFRKILKSYRKHGGNSRSIILVGSNSNIIELYHQMTDDVTSGFRVIGYFDDQPGSRFPEKVNYLGKPGKIVDRLKQGGVEQVYCCLPSARSEEILPIIDYCENHLIRFFSVPNVRSYLKRRMYFELLGNVPVLCIRQEPLSFAENRFRKRVFDIAFSLLFLCTLFPIIYVIVGLTIKITSPGPIFFKQKRSGEDGREFWCYKFRSMKVNTQSDTLQATLHDPRKTRFGNFLRKSSIDELPQFINVLMGDMSVVGPRPHMLKHTEQYSQLINKYMVRHFVKPGVTGWAQVTGFRGETHELWQMEGRVQRDIWYIEHWTFMLDLYIIYKTVRNALEGEKEAY

SEQ ID NO: 6502 - protein, 198 aa, B.fragilis
IMVIAYLRVSTEKQFLANQKEEIMRFAEKNGLSIDKWYTETVSGSVSTKDRKLSELLKRMHPGDTLIVTEISRLSRTLLEIMTILNFCIKKQVVLYSTKEGYVFQDDINSKVLGFAFGLMAEIERNLISMRTKEALARRKQEGMTLGRKKGDTPKIKLLRANKRVLTKELDKGTTYSELAEKMGVSRTTLFRFMKTMY

SEQ ID NO: 6503 - protein, 216 aa, B.fragilis
IKQMESVAFIQWCLDHLNYWTITLLMTIESSFIPFPSEVVVPPAAYKAAVNEELNIYLVVLFATLGANLGAIINYYLARWLGRPIVYKFANSRFGHMCLIDEAKVQHAEEYFDKHGALSTFIGRLIPAVRQLISIPAGLARMKLHTFLIYTTLGAGLWNTILAAIGYYLSTVPGIESEEQLLAKVTEYSHELGYCFIVIGVFIVGFLVYKGMKKKK

SEQ ID NO: 6504 - protein, 163 aa, B.fragilis
CFSVGGMSKNEGGSMRKIDLIVIHCSATREDRCFTEFDLDVCHRRRGFNGPGYHFYIRKDGRIVSTRPVEKIGAHAKGHNATSIGICYEGGLDARGRPKDTRTEWQVHSMRVLVKTLLKQYPGSRVCGHRDLSPDLNANGEIEPEEWIKQCPCFNVIEDKKLH

SEQ ID NO: 6505 - protein, 285 aa, B.fragilis
NSGVLCGESNSKLNHMKIRTILFGRLSLAALHANAQRIKGSDTVLPVAQQTAERFMNREPDARVTVTGGGTGVGISALMDNTTDIAMASRPIKFSEKMKAKAAKRDIDEVIVAYDALAVVVHPSDPVKKLTRRQLEDIFRGKITNWKQVGGDDRKIVVYSRETSSGTYEFFKESVLKNKNYMSSSLSMPATGAIIQSVSQTKGAIGYVGLAYVSPRIKTLSISYDGEHYATPTVENATNKTYPIVRPLYYYYDAKNKTQIAPLLEFILSPEGQDIIKKSGYIPVK

SEQ ID NO: 6506 - protein, 147 aa, B.fragilis
LMMFLIFKYYTIMKTMIISIIAVLASVAVSGQSLTLTVKDVEHVEGTLYVAIYSSKENFMKKPLFGFRVAVKDRTMTIPCKGIPAGTYAISLFQDENGNGKLDTGSFGRPLEKFGFSNDAEGIMGAPSYEKCCFEFKRDTTVVIHLK

SEQ ID NO: 6507 - protein, 681 aa, B.fragilis
LLITKGCSSSHVRCCLSHIRAVRPGYFFALCQSFMFADENVSKQITMKGFYVPAALSLMLLSLPIAAQSVATDTILLATFNDSISLDEVVIKAHKTPRANSRWSDLQPVDLVTVGGSNGDLYRALQTLPGAQLQGESGRLLVRGGNSNETQTYIDGMHVLNPYTTTGTDTPARGRYSTFMFSGVNLASGGQSQEYGEALSAVLPLETKDYSTVNKFGMNVSTVGMGGGGTRAFNRSSLSLNLDYQNLAPYDRVYPSRTDFKRPYRMLSGATQFRYTPNEKILFKFYAGYDRTDFSNYTDIDRHLFGLGENNIYLNTTFRKRTASDWNWFIGTAYSFYDRKVKGAVKDRDVWNERQQEFHLKAKFSKLFTSRLRLDMGVETFVRSYRNDYQLETLRDTHQMYPTIYAGFLSSAFYLSENLKTEISLRPEYTSLNRTMNWSPRAAVSYTWNHLLVSVVAGQYTQLPENDYLIRNISLPSNVCRQVLFSLQYEQGGRFYKAEFYYKNYKKLELSVPDGITPDGYGYSKGIDLYFCDNVLWKNFEYRLSYSYNLSKRKYREYTELTVPQYATRHHASLVLKYSVPRLRTIFSVTDGVASGRPYHNPELSGLMNDEVKSYHSLDLGITVLAGKKVIVHASATNLLGRKNEYGRIDGEAVRTSSDHFFYLGVYITLGKKVAYDVSNF

SEQ ID NO: 6508 - protein, 399 aa, B.fragilis
NEHFKIKTIVMIDLGSWMNKILIGWGVDPKIANTFDETIIAILMIFIAVGLDYLCQAIFVGGMKRLARKTSYKWDTLMVKHKVIHHLIHILPGILMYMLLPMAFVHGKTLLLVSQKICVIYMIFALLLALNSSLLMLLDILSAKEKLKDRPMKGFIQVLQVLVFFIGGIVIVAIIVDKSPATLFAGLGASAAILMLVFKDSILGFVAGIQLSANDMIRPGDWVTIPSTNANGIVEEITLNTVKIQNFDNTISTVPPYSLVNGSFQNWRGMTESGGRRVMKSIFLDLTTLKFCTPEMLDTFRKEIPLLADYQPEEGVIPTNSQVFRVYVERYLCSLPVVNQDLDLIISQKEATEYGVPIQIYFFSRNKIWKEYERIQSDIFDHFFAMIPKFELKVYQYSD

SEQ ID NO: 6509 - protein, 620 aa, B.fragilis
NTNQSISPQKHNNTFMKKLILSTALLAAICTAGQAQETNDYYVKHVEFPQGATLEQKVDMAARLVPTPQQLEWQQMELTAFLHFGINTFTGREWGDGKENPALFNPTDFDAEQWVRSLKEAGFKMAILTAKHHDGFCLWPTKTTGHSVAASPWKDGKGDVVRELRDACDKYGIKFGVYLSPWDRNASCYGDSPKYNEFFIEQLTELLTNYGEVHEVWFDGANGEGPNGKKQEYDWTAILSTIRRLQPRAVTAIMGDDVRWVGNERGLGRETEWSATVLTPGTYARCEEQNKALGVKATSKDLGGRDMLVNAKELFWYPSEVDVSIRPGWFYHQQEDNQVKSLKHLTDIYFKSVGYNSVLLLNIPPDQRGRISDADVNRLKEFADYRKEIFADNRVKGGLKAWTARPGDTRVYQLKPKSEINVVMLREDISKGQRMEAFTVEALTADGWKEIAKGTTVGYKRLIRIPAVEARQLRVKVDACRLAANISEVAAYYARPLEESAAKENWNDLPRTAWKQVTAAPLVIDLGKAVDMTGFVYAPANAEAKPTMAFRYKFYISTNGRDWKEVPTTGEFSNIMHNPVPQTVSFGNKVSARYIKLDATTPDTTPARVDLKEIGIRLQK

SEQ ID NO: 6510 - protein, 322 aa, B.fragilis
SPCLSYLSDILYYFAGKANKIQYMGSHWGEKIRRYLQSLYPVAYQRWKVVLISSLVVFLILLVLQPFGISGIRQHKFWILVGFMGVTAVSLSIPMYVFGKLFPKFYKEETWTVWKQIVNLLQILFFIAIGNWIYSTLVFGWGLRWDVFCAFALFTLVIGLFPTVLFILLNQNRLLAIHLKEATEMNLHLQRSVLLAESVETTQDSPFLLFQGGIRESLELDSKDLLYVESNGNYIRVNYQKAGKNVQCLLRATMKQAEEVTAVCPLVLKCHRAFLVNVRKVVKVNGNSQGYRLLLEGCPEEIPVSRGYSKQVKELIEGISGD

SEQ ID NO: 6511 - protein, 91 aa, B.fragilis
SVQKSIFAPTKLIEMLYTILITLLIVAICLGLLGIKVFFTKGGKFPNGHVSGNKALRERGISCAQSQDREAQKKRRFSIDEIEKALNDSMN

SEQ ID NO: 6512 - protein, 209 aa, B.fragilis
LIKKLYFTSMKRMNYLINGFAALAFLFLFSQCAGKADNAAPAASGNANGTSGLKIAYVEVDTLLSQYNFCKDLNADMISKEENSRMVLNQKANELRKSQQEFQKKYESNAFISQERAQQEYTRLAKLEQDLQALQNKLATEMASENAKNSQILRDSINAFLKEYNKTKGYNLIISNTSFDNLLYADSTLNITKEIVDGLNARYTPVAKK

SEQ ID NO: 6513 - protein, 288 aa, B.fragilis
QIIESILLIYKSLLFMMRIRIIITLLIALFVESRQEAFGQTVDTLSLSDKVIRTASFATGFRGEVWRNPALYYYYTPYTWTRLDVNGAYHDKGKASLKQEGDKDTHIGVDVHSFVILSGRDRVFGSAGYRSEKQENVLWNENIDWKLIAPYVTGDSIGGFLKGETYYFNGGYASESGSWTWGITGGYRASHNYRDKDPRPRNTASDLSFALGAGYRLGAYRLGVSTDFRLYQQKSEISFLADKGSTSVYHMLGLGMDYVRFAGNQTGTKHQGTSSPRGWMGSALCTLA

SEQ ID NO: 6514 - protein, 356 aa, B.fragilis
TSTEQHLKGIQSMLRLFFILLISLSSLFLSAQNRPPFRVVFWNTENFFDTRHDSLKNDMEFLPHSMRHWNHRRYKKKLDNVARTLTAIGEWNFPALIGLCEVENDTVMRDLTLYSPLKEAGYRYVMTHCSDLRGIDVALLYQRDRFKLLSYSALSVGNFKGHRPTRDILHVSGLLLTGDTLDIMVAHLPSRSGGVRQSEPYRLYAAQKLKDAADSLINVRPSAKLIIMGDFNDYPTDKSVVQVLQALSPEVSTHHDRLYHLLARKAKDRNFGSYKYQGEWGLLDHLIVSGTLLDISGTLFTEEKKANVARLPFLLTKDEKYGGMQPFRTYVGMKYQEGYSDHLPVYVDFETNQSEY

SEQ ID NO: 6515 - protein, 408 aa, B.fragilis
NKIEMKMKKNQLTMAILFATMLGFTACSDDDKVNISTVSITTTVDTTIEGLQLTGGTYTFENINTSVKTDVAYPLQSIELADGLYNVTFIGKGTYSQNGTSVEVDVQGVQQNVTVSGGSCKLELTVHVLNTGEPGFVIAEIFIPGTYNEAGKQYNGDQYVRIYNNSDKVLYADGLIFMESQFQTTQKYQSVDPDIMNEAIAVGSVVAVPGSGTDHPVQPGESFILCDNAINHKEANPNSIDLSKANFEWYIESKQDVDNPAVPNLDIYYCYSKTIWVLNKQGNRAYAIGRLPQGMTKEKYISDYAYNYTYIMQNGTASKPQSKYKFPNEWIIDAVNVGASNEWQWNVTSTGLDMGHTYVGVNNTIAENIGKCVMRKVAYKDGEREVLQDTNNSTVDFTPAATPSLFNK

SEQ ID NO: 6516 - protein, 114 aa, B.fragilis
VISFIFATGINEKIMGKLITIWEFIGRHKYWITVVAFGVIIGFLDENSMIRRIGYAREISRLQGEIDKYRAEYEENTERLNELSTNPEAIEQIAREKYLMKKPNEDIYVFDEEE

SEQ ID NO: 6517 - protein, 939 aa, B.fragilis
IDTLLYLIFGIASAADILYFCELIESKMIRKIAYTFFSFLICCNVSLAWGQTFAFRGTVLDEQTHKALDYATIQLFVEKQFAYGGITDANGHFELLHIHPGTYRIIISYLGYDSTEKEIKVVGNTSDIFYLKPSNMALNEVVVTASESKRATSASIVDRTAMKHLQPSSFSDLMELVPGGKSADPQMGQANLIRIRETGKTEDISSLGVGFYIDGIFQNTDANLQYMPSSTSAVNATSTMSKGVDMRTIPTDNIEKVEIIRGIPSVAYGNVANGAVIIQRKTSESPLSARFKADKTSKLFSVGKGFRLDGNGRYVLNTDLSYLDSKIDPRNSVKNYTRLTASARLDGKWLWNERNIHWNLSTDYTGSFDDAKRDKDATVKEDSYKSDFSSFKMAGKWNLKFSNHSWIREIHAATSVSWQWEKMRETKSVSLNRPAAIATQTETGESDGIYLPYNYVAQMEIDGKPLYVTVSARTHLAFPLGGLQNRMNLGVEWNYQKNLGKGQVFDVTRPISEGLSTRPRRFKDIPGLQPFAFYAEEVLNLPVKRHKLAFTAGIRLQSLLGLDRKYEMQGKIYPDLRLDLQWSLPTSNGWNIAFSGGLGWISRMPTTAQLYPDFKYVDLIQLNYYHNHPDYRRINMMTYKWDNTNYQLEPARNMKWEVRADIGYKGNRLSATYFRERMNNAFDDLTYYKSLAYKLYDPASIDGSALTAPPELSQLTYANEYNLDVYSTQGNGMKVHKEGVEFQFASRRIESLKTRVTVYGAWIKTVYSSDSPKYKASSILLDNKQLKYVGLYQGENGTESQAFNTNFMFDTYIQRLGLTFSTSAQCTWYTNRRNLWNNGVPVSYIDQSGETHLFREEDKNNIQLQHLVEKYSATYFERTTVPFYMDINLKASKRIGKYLNLAFYVNRLLGIYPDYTLRGVLQRRTSESPYFGMEMNLTF

SEQ ID NO: 6518 - protein, 566 aa, B.fragilis
QHTWIVHIACMNVRKIILPSLSGHWATKPGNGINFERTYDWLKSVEKSRPVQYERAEQNYNTDIYCRMYRSVDEIKAYLAQKDIYRPFILCEYVHAMGNSVGGLKEYWDVFENNPMAQGGCVWDWVDQSFREIDSNGRWYWSYGGDYGPKGIPSFGNFCCNGLVSADRVPHPHLLEVKKIYQNIKCTLINKNNLTVRVKNWFDFSNLNEYILHWQVVGDNGKLLAEGNKEVNCAPHATADVTLGKVALPANVREGYLNLSWTRKEASPMVGTDWEVAYDQFVLPGTKGSTAYLPAKAGQTAFTVDKETGALNSLTLDGQELLATPVTLSLFRPATDNDNRDRNGAYLWRKAGLNQLTQKVVSLKDGKKAATAKVEILNAKGMKVGDADFAYSLNSAGALKTKVTFRPDTAVVKSMARLGLTFEMNDTYGNVAYLGRGDNETYSDRMQSGKIALYQTTAERMFHYYVTPQSTGNRTDVRWMKLTDETGQGIFVDSNRPFQFSVIPFADDVLEKARHINDLERNGHVTVHLDAEQAGVGTATCGPGVQPQYRVPVTEQSFEFTLRTVK

SEQ ID NO: 6519 - protein, 641 aa, B.fragilis
NLFRFLFYPCTFLRTFAQTQKIEIIRNMENYIVSARKYRPSTFESVVGQRALTTTLKNAIATQKLAHAYLFCGPRGVGKTTCARIFAKTINCMNLTADGEACNECESCVAFNEQRSYNIHELDAASNNSVDDIRQLVEQVRIPPQIGKYKVYIIDEVHMLSASAFNAFLKTLEEPPRHAIFILATTEKHKILPTILSRCQIYDFNRISVDDTVNHLTYVASKEGITAEPEALNVIALKADGGMRDALSIFDQVVSFTGGNITYKSVIENLNVLDYEYYFRLTDCFLENKVSDALLLFNDVLNKGFDGSHFITGLSSHFRDLLVSKDAATLQLLEVGAGIRQRYQEQAQKCALPFLYRAMKLCNDCDMNYRASKNKRLLVELTLIQVAQLTVEGDDGSGGRGPKQAIKPVFTQPAAAQQPQVAPIASPSQSMNAATPVAPQAVSQQVGSSPAVNVRPGGAISPSGAMPDAVRMAQFKEEKKIPVMKKSSLGLSIKHPQKEEEQRGAGVVHTAQMSTQQIEEDFIFNERDLNYYWQEYAGRMPIEQKAIAMRMQNMRLSLLNDTTFEVVVDNEIVAKDFTALIPGIQAYLRGSLKNRKVTMTVRVSEATENVRAVSRVEKFQMMAQKNNALLQLKEEFGLELY

SEQ ID NO: 6520 - protein, 492 aa, B.fragilis
KEKRMEKSELKPAGVFHFFNEICQVPRPSKKEEKMIAYLKAFGEKHNLETKVDEAGNVLIKKPATPGKENLKTVILQSHVDMVCEKNNDTDHDFLTDPIETEIDGEWMKAKGTTLGADNGIGVATELAILADDSIEHGPIECLFTVDEETGLTGAFALKEGFMSGEILLNLDSEDEGELYIGCAGGIDTVAEFQYENEMTPISHLCFRITVKGLKGGHSGGDIHLGRGNANKILNRFLYQMMTTYQEDFHLYEFNGGNLRNAIPREASAVFSVPEHYKHDIRTALNVFTAEIENELHRVEPDLNILLETEPHRDWSIDSSTSYRLITSLYGCPHGVYAMSQDIPGLVETSTNLASVKMKPENTIRIETSQRSSILSSRDDIATTVRAVFRLAGAQVNWGEGYPGWKPNPDSEILKVAEESYKRLFGVDAKVKAIHAGLECGLFLDKYPALDMISFGPTLTGVHSPDERMHIPSVDKFWKHLLDVLAHIPAKN

SEQ ID NO: 6521 - protein, 222 aa, B.fragilis
TLVGMKFFIDTANLDQIREAHDLGVLDGVTTNPSLMAKEGIKGVENQRRHYVEICNIVQGDVSAEVIATDYEGMVREGKELAALNPHIVVKVPCIADGIKAIKHFSGKGIRTNCTLVFSTGQALLAAKAGATYVSPFVGRLDDICEDGVGLVANIVRMYRFYNYPTQVLAASIRSSKHIMECVEAGADVATCPLSAIKGLMNHPLTDAGLKKFLEDYKKVNE

SEQ ID NO: 6522 - protein, 332 aa, B.fragilis
SKNIIDMKAICNKGICVFLFLSLLMSATMVNAQRVITASGKYITKNIKVTRFDQIYLKGSPTIEYTQSPGASEVQIAGSDNLVDLVECRVEGSTLIVNMKSRTNISYGKEGRLKILVSSPMLKSASLQGSGDIHLGSLKVEGLDVSLIGSGDIVAENITCNGDFSALLQGSGDIDVKGQLRAKSVNLNLQGSGDLKVAGVTGSEISAMLQGSGDLKVGSTNITSTVTAKLSGSGDMDVLDIRANSVSGQLDGSGDMTLSGSACNATLVLNRSGELSARKLDAENVTAHVNGSGEISCTATKTLETNIQGSGEISYKGNPSIRSTGKNHLNRL

SEQ ID NO: 6523 - protein, 502 aa, B.fragilis
LTVLKWSGSFQPRGEDYEQSPYYLNLNGKWKFHWVKNPDLRPKDFYKPSFYTGGWADINVPGNWERQGYGTAIYVNETYEFDDKMFNFKKNPPLVPYKENEVGSYRRTFTVPAGWKGRRVVLCCEGVISFYYVWVNGHFLGYNQGSKTAAEWDITDQLEEGENTIALEVYRWSSGSYLECQDMWRLSGIERDVYLYSTPKQYIADYKVNATLEKERYKDGIFGLDVTVGGPADGVASVSYTLNDPLGRPVLSGEMPVKSRGLSNFITFGEQRLKDVKRWNAEHPNLYTLVLELKNAGGQVTEVTGCEVGFRTSEIKDGRFCINGVPVLVKGTNRHEHSQLGRTVSKELMEQDIRLMKLYNINTVRNSHYPTDPYWYRLCDRYGLYMIDEANIESHGMGYGPASLAKDSTWLTAHMDRTHRMYERSKNHPAIVIWSLGNEARKRNQFRAYLRLAEIGREKPSRPVRTCRAELQYRYLLSNVSQCRRNQGLSGPERYLPSVHSL

SEQ ID NO: 6524 - protein, 117 aa, B.fragilis
RGRMKQLIPALFAVGAVMALIGAAVFITGWVYAPYIYTIGAGFVALAQVNTPLRAKSKTLRRLRIQQIFGALALILTGAFMFTTRGNEWIACLTIAAILELYTAFRIPQEEEKELSK

SEQ ID NO: 6525 - protein, 355 aa, B.fragilis
  UNSURE (77): Identity of amino acid sequences at the above locations are unknown.
AFRTWWPFIRMKRESVLFQAARKHHLNLLFPLFRANTSASYPVSRFISRPITVLSKGFAKGFFCIKKETVDKIQQFXFDKWAIEERRYHQLLSILLPGLKNGNLASVEQYLGAKHIEAYAAVPYVADRWELDDASLPQGAVVVLTCEGVLYSWETYRLERYISAAIANDRISGVVLFVNGPGGMITRVDVLEKLIRQSPKPIVAYITGVCASAHFWFVSACARRFVSSPMDEIGSCGVVYTFQSFKEYYAQMGIEIEDIYPDSADLKNRAYRDKEEKQDDTLIKENLSFYHHLFAQTIARNLGVKYDAQDPLFRGQTFFADTALAKGYVDAYGSLEDAILWVSAQKTVKRANKMI

SEQ ID NO: 6526 - protein, 157 aa, B.fragilis
RKNAEYLKINKLYNMKTIKRPYTPVCDLELVPVECISDFAVILPRAFIAVRDGSYRIPVIPGSFTPGVESEQADSGTIYYNVGHTFEVALTGPDSQELLSAMSLQDLVAIYTNEAGERIVSGSPQTPLKLTFSIVSGKYQCKLSGKQVYIEAYHSPF

SEQ ID NO: 6527 - protein, 274 aa, B.fragilis
  UNSURE (251): Identity of amino acid sequences at the above locations are unknown.
QDDLILTIKVNLFMKNYFASFIPAVKAILGIEAWSKDADKKDALLEEQKQKLKALNFNDTFINGFCEALKDGFPEDSSRKDGESGTKGSGPDPNTSNAVIQGLLADMTAKLVTAQEEIAVLTKEKGELSQEVSAKQTEITGLQTKIQTLSGLAEQDGGKGFQHARLEPDAKDIVMNWDDEKQLGGLSGEMFAMGPPYNQRLRAKMLYRKGLTRQVPTASSIDYSRLKEDLGAFYRIPWQERLQSFLTLLPXIESIFPAEFGISGPGRAYKHLGW

SEQ ID NO: 6528 - protein, 168 aa, B.fragilis
KKHQLMITTKITVEPHLAQYCYAKYSSDPEGSMPVRFADHLDVYHLVYNLLEKRPVNCPRDNGNLEIVLPDRRQGDVPGGKSPERFNYLGQRSQGIINKKLKLMMRAELHDFIDENKHRFGIDQLQSVHCFMKKYCIDSLSEDALLKDYQRWRDRVRRSSLKRPYKKK

SEQ ID NO: 6529 - protein, 205 aa, B.fragilis
KKMEVELVKTTLHAVLSPSQLQKPCVRKKELTPLQISLKTGSTASQLVDEWGGTIAQLNMGAPLYDVAANGEIPTLADVGVVFGNSTSVRIITSHLESVLKYAGVELSREQMAETALAILSGYWFLNLAELCIFFTRLKNGSCGQLVWGKSLNNQAVMVALSDFCKERREVIIRKETERMGPGLWKKAFPERRILPPVLCWAYRV

SEQ ID NO: 6530 - protein, 293 aa, B.fragilis
KSRRNLPRLCVRLRTPYLICLLCNIYRDKGYYIEWDEDLPFVVADTIGTTEGAVEEVVKKAVQVGFFDKSLFDQYRILTSNGIQNRFKSAVSRREGFEYIPEYLVSVCNNPIQSNFCIQKPSSTEFLYAETQPNRVSACKSTQSKVKERISPPPHAREGGISGIRLFSDKSLTECYGELKANIPWMEQFCMNIRLDYPDFTPELFYGFLDRFFRKLQNEGEIVKSPKDAMSHFANWLNIELEKLKKDGSRTSKNHPACGSEPVSVTETLCPKEGADASPDLVKNWIDGLSIGG

SEQ ID NO: 6531 - protein, 268 aa, B.fragilis
KNNIPMIVAWFSCGVTSAVACKIALSLYDDVQLYYIETGSGHPDNARFLSDCERWYDQPIHIIRSDKYTCVADVLRKGFINGAHGAACTLELKKKVRYKLEKELGSWDGQVWGFDYEPKEINRAIRLKQQYPDTKPLFPLIEKQITKPDAMGILWKAGIEIPAMYKMGYNNNNCIGCVKGGMGYWNKIRKDFPEVFAQMAQIERDVGATCLKDKDGRIFLDELPTWRGDPVEEIIPDCSLICQIEFQEIIDRQVKRVLKGEISINDVA

SEQ ID NO: 6532 - protein, 62 aa, B.fragilis
TMKVVIYWQKKSTVHHRRRIRDRFRLPDGMTINGETPADVRPEDMKELQTLEEMGYIKLRNK

SEQ ID NO: 6533 - protein, 115 aa, B.fragilis
SDHSQRDRADGPGAVEKGFSRTEDFAAGIVLGVQGIAVKRERAKADFNAFLEFFPCLPSGYDPIALWKAWGGDPDAINLLFGNNPPGVEAAAESVGRYLCDYNVYQARVKAKASL

SEQ ID NO: 6534 - protein, 63 aa, B.fragilis
ETSSHFNTFSGDSTVRPHPQNNNTQTGQNNNKPFSLFLSNKLKEALIINILFFYHHIPPTESL

SEQ ID NO: 6535 - protein, 80 aa, B.fragilis
IKQSIKVFYHQATTYLNKITDCNNSFPAYFPCISPLFHIPLSKIKVLKHPDVIYQNTRMFYIRTSGCYLLKHPDVFRHNL

SEQ ID NO: 6536 - protein, 64 aa, B.fragilis
QFLPCLKLNFPPSLSKKCRKLASSKNNEYSQFKKQRYEKFKLQKRFNWSSGRATSLCIQTNNRP

SEQ ID NO: 6537 - protein, 488 aa, B.fragilis
VYNTKGNKIGFYMATTDFIAAIELGSSKIAGIAGKKNSDGSIQVLAYAREDSSSFIRKGVIYNLDKTAQSLTSIINKLEGALNNSIAKIYVGIGGQSLRTVRNVVSRDLEEETIISQELVDSICDENLEIPLIDMDILDVAPQEYKIGNNLQADPVGVAGSHIEGRFLNIVARASLKKNLERCFEQAKIEIADLLISPLVTADAVLTESERRSGCALIDFGADTSTISIYKNNILRFLTVLPLGGNSITHDLVSLQMEEEEAERLKIRYGNAFYEEEEGEEPATCQLEDGNRTIELGKLNNIIEARTEEIIANVWNQIQLSGYDDKLLAGLIITGGAANLKDLDEVLRKRSKIEKVRNARFVRNTIHADEDVVKKDGTQNTLFGLLIAGNENCCLLETPAPQPHIQPQPQPEPVNMFEEDESLKEQEAAARAAKKKKEEEEKKRKEEEKQRKLEEKKRREEERRNKPNWFKSTFDKLSNEIFSDEDMK

SEQ ID NO: 6538 - protein, 489 aa, B.fragilis
KHCTPGFTGFCCRYCKRSYKISATIMNIETIQSVYFVGAGGIGMSALVRYFLSKGKVVAGYDRTPSELTQHLIEEGAQIHYEENIDLIPEACKDKATTLVVLTPAVPQEHAELTYFRDNGFEIQKRAQVLGTITRSSKGLCVAGTHGKTTTSTMTAHLFHQSHVGCTAFLGGISKNYGTNLLLSSTSPYTVIEADEFDRSFHWLSPYMSVITATDPDHLDIYGTEQAYLESFEHYTTLIQPGGALIIRKGISLQPKVKEGVKMYTYSRDEGDFHAENIRIGNGEIFIDFVGPDIRIDNIQLGVPVSINIENGVAAMALAHLNGVTPEEIKQGMASFRGVDRRFDFKIKNNRIVFLSDYAHHPSEIKQSVMSMRELYRDKKITAVFQPHLYTRTRDFYKDFADSLSLLDEVILVDIYPAREQPIPGVSSRLIYDNLRPGIEKSMCKKEEILDVLKAKHIEVLITLGAGDIDNYVPGICDLLSRRMVPSDN

SEQ ID NO: 6539 - protein, 254 aa, B.fragilis
IVKTINFLMIKRILLTIVMLLLIAYLVAAVTVFNDKPAHQVCRDMELVIKDTLNAGFVTKNEVAAILQKKGIYPVGKKMDRVHTKTLEKELDKHPLINEAQCYKTPNGKICVEVTQRVPILHIMSSNGENYYLDNKGKMMPPDAKCVAHRAIVTGNVEKSFAMKDLYKFGVFLQNNPFWEAQIVQINVLPGKEIELVPRVGNHIIYLGKLEHFEDKLKRLKTFYEKGLNQVGWNKYSRISLEFGNQIICTKKKQ

SEQ ID NO: 6540 - protein, 669 aa, B.fragilis
LRYFHYICSVIIIRNQIMSEEQNPTNNGSYSADSIQVLEGLEAVRKRPAMYIGDISVKGLHHLVYEIVDNSIDEALAGYCDHIEVTINEDNSITVQDNGRGIPVDFHEKEQKSALEVAMTVLHAGGKFDKGSYKVSGGLHGVGMSCVNALSTHMTTQVFRNGKIYQQEYEIGKPLYPVKEVGIADHTGTKQQFWPDDSIFTETIYDYKILASRLRELAYLNAGLRISLTDRRVVNEDGSFKHETFYSEEGLREFVRFIESSREHLINDVIYLNTEKQNIPIEVAIMYNTGFSENIHSYVNNINTIEGGTHLAGFRRALTRTLKKYAEDSKMLEKVKVEISGDDFREGLTAVISVKVAEPQFEGQTKTKLGNNEVMGAVDQAVGEVLNYYLEEHPKEAKAIVDKVILAATARHAARKAREMVQRKSPMSGGGLPGKLADCSDKDPQKCELFLVEGDSAGGTAKQGRNRAFQAILPLRGKILNVEKAMYHKALESEEIRNIYTALGVTIGTEEDSKAANIDKLRYHKIIIMTDADVDGSHIDTLIMTFFFRYMPQIIQNGYLYIATPPLYLCKKGKIEEYCWTDAQRQKFIDTYGGGSENAIHTQRYKGLGEMNAQQLWETTMDPENRMLKQVNIDNAAEADYIFSMLMGEDVGPRREFIEENATYANIDA

SEQ ID NO: 6541 - protein, 435 aa, B.fragilis
KLKAVDLLKNIFKGDKVIWIIFLCLCLISIIEVFSAASTLTYKSGDHWGPITQHSIILMVGAVVVVLMHNIPYKWFQVFPVFLYPISVVLLAFVTLMGVITGDRVNGAARWMSFMGLQFQPSELAKMAVIIAVSFILSKKQDDEGANPKAFKYIMILTGLVCMLIAPENLSTAMLLFGVVVLMMFIGRVAFKKLAMLLGGLALVGCLGAVFLLAIPKDTDIPFLHRFDTWKSRITNFTEKEEVPAAKFDIDKDAQIAHARIAIATSNVIGKAPGNSIQRDFLSQAFSDFIFAIIIEELGLVGGAFVVILYIWLLVRTGRIAQKCERTFPAFLVMGIALMLVSQAILNMMVAVGLFPVTGQPLPLISKGGTSTLINCAYIGMILSVSRYTAYLEEKKENPAPLLTQSEGNEAIASEAQTAAEPTAEVLNSDAKFEE

SEQ ID NO: 6542 - protein, 135 aa, B.fragilis
KRLARVRGIDFIHDSKAPNVNSCWYALQSMTTKTVLILGGKDKGNDYTEIEELVREKCSALVYLGLHNEKLHEFFDRLGLPVAEVQTGMKDAVEAAYKLAKKGETVLLSPCCASFDLFKSYEDRGEQFKKYVREL

SEQ ID NO: 6543 - protein, 66 aa, B.fragilis
VGHLHQQACLRNKIYNRLYIILEAGLFSSAFYAFNYPVGFIFNSSFFTLHSSLTQIFSLYLLCYYN

SEQ ID NO: 6544 - protein, 181 aa, B.fragilis
QWSYHILIKVKYRIINPDLPIVNRKSLNHNNIMDLFERVSEDIKNAMKAKDKVALETLRNVKKFFLEAKTAPGANDTLTDADALKIVQKLVKQGKDAAEIYIGQGRQDLADAELAQVQVMETYLPKQMSAEELEAALKEIIAEVGATSGKDMGKVMGVASKKLAGLAEGRAISAKVKELLG

SEQ ID NO: 6545 - protein, 67 aa, B.fragilis
RTSYTRYFKAMCQSVVNKNTARKGKNLGFVLKPSERGGEDKAVIVPLKLRTVFLTLFVKLFHAETLS

SEQ ID NO: 6546 - protein, 343 aa, B.fragilis
DRNLGERTCGETLYGTRSIRSSLGRDYERRTENNEQRAKMKEEETTYHVPVLLKESVDAMNISPDGTYVDVTFGGGGHSREILSRLGDGGRLLGFDQDEDAERNIVNDPHFTFVRSNFRYLHNFLRYHDIGEVDAILADLGVSSHHFDDSERGFSFRFDGKLDMRMNKRAGITAADVVNTYEEERLADIFYLYGELKNSRKLASVIVKARTGQKIETIGEFLEIIKPLFGREREKKELAKVFQALRIEVNQEMEALKEMLMAATEALKPGGRLVVITYHSLEDRMVKNIMKTGNVEGKATQDFFGNLQTPFRLVNNKVIVPDEDEITRNPRSRSAKLRIAEKK

SEQ ID NO: 6547 - protein, 180 aa, B.fragilis
SQNLIIINGFGKDTVIGPELLFGSCVVRYSYFFNGIKRFTDFIFLLIDFTVAEYLGSHVCRQCIHTGHTYTVKTSGYFVRTFIELTSGMQYGHGNFEGRFLLFFVEIYRNTTSIILYGDRVVFVDSYFDMVAITGQCFVDRVVDNFIYQVMKSLYADVTNVHRRAFSNCFKSFQYLDTIC

SEQ ID NO: 6548 - protein, 442 aa, B.fragilis
FIIQYNMDEIVQFDFPTDSPKIIKVIGVGGGGGNAVNHMYREGIHDVTFVLCNTDNQALAESPVPVKLQLGRSITQGLGAGNRPERARDAAEESIEDIKTLLNDGTKMVFITAGMGGGTGTGAAPVIARIAKEMDILTVGIVTIPFIFEGEKKIIQALDGVERIAQHVDALLVINNERLREIYSDLTFMNAFGKADDTLSIAAKSIAEIITMRGTVNLDFADVKTILKDGGVAIMSTGFGEGENRVTKAIDDALHSPLLNNNDIFNAKKVMLNVSFCPASELMMEEMNEVHEFMSKFREGVEVIWGVAMDNSLDTKVKITVLATGFGVEDVPGMDDLHEKRSQEEEERQLQLEEEKEKNKERIRKAYGESASGIGTRNLRKRRHIYLFNAEDLDNDDIIAMVEDSPTYLRDKTTLGKIKAKAALEEEIATEEAIDDSGVITF

SEQ ID NO: 6549 - protein, 171 aa, B.fragilis
KFIKMKTKNYLSIISILFFSFLFVSCSKEDEGDTIKPVIDLLEPEEGAILRIGSSHGVHFEMNLHDNEAIASYKINIHNNFDGHSHTRASEAGVTKPFTFERTYTDKAGQKDAHVHNHDIKIPADATPGNYHLMVYCLDQSGNETYVVRNIVLSVEGGEEGEHHHDEHHHD

SEQ ID NO: 6550 - protein, 328 aa, B.fragilis
RLDNRSDEQQAMSYKCLPLITKYEPKTCSIKKKIYRRIDKFRLINRNLKIMKRIVVLGAGESGAGAAVLAKVKGFDTFVSDMSAIKDKYKTLLDGHGIAWEEGRHTEEQILNADEVVKSPGIPNDAPLILKLREQGTPIISEIEFAGRYTDAKMICITGSNGKTTTTSLIYHIFKSAGLNVGLAGNIGKSLALQVAEEKHDYYVIELSSFQLDNMYNFRADIAVLMNITPDHLDRYDHCMQNYINAKFRITQNQTSEDAFIFWNDDPIIKRELDKHGIRAHLYPFLGIKEERSIAYVEDHEVVITDPIAINMEQEQVALTGQHNLITL

SEQ ID NO: 6551 - protein, 452 aa, B.fragilis
IMCKYQIVKIMMDWKRLISAKRFGMEEFHEERQENRSEFQRDYDRLVFSAPFRRLQNKTQVFPLPGSIFVHNRLTHSLEVSCVGRSLGNDVSKAILARQPELQDSFLPEIGSIVSAACLAHDLGNPPFGHSGEKAISTFFSEGKGVQLQEKLSPMEWNDLTHFEGNANAFRLLTHQFEGRRKGGFVLTYSTLASIVKYPFSSSLAGNKSKFGFFTTEEEGFRRIATELGLIQLSDRPLKYARHPLVYLVEAADDICYQMMDIEDAHKLKILTTEETKELLLAYFADERQTHIRKTFDIVKDTNEQIAYLRSSVIGLLIKECTQVFLNNETEILSGTFEGALIKHISERPGKAYKHCSEVSFSKIYRSRDVLDIELAGFRVINTLLELMIDAVTSPEKAYSQLLINRVSGQYNIKAPALYERVQAVLDYISGMTDVFALDLYRKINGNSLPAV

SEQ ID NO: 6552 - protein, 61 aa, B.fragilis
FQKKPYLCTRNRETTIQNESKVKQKEQKCSKQDGPFVYRLGRKIFILERGVRFPHGLQLKK

SEQ ID NO: 6553 - protein, 208 aa, B.fragilis
MKKKYLVIVLLFLVANTCYIYHQHVGLKKVHSFLSELRQDTGERLGILEMQKEDRVYEIQFNGQLIDKELTVIDTDGKQKKIGDLIIDNPKLVFRFSELNCDKCIDAQIRNLNEYVDSIELQNIILLTDFQSLEYMRSFQKSNKVKFAIYNMEAEIDSVLVNIDLPYFFVLTPQEERIQCMYIPHKEIPFLTEVYLSSVKRKFFTDLE

SEQ ID NO: 6554 - protein, 140 aa, B.fragilis
GWCLYYELCIDICIRCILFNELAAWTYVFTHQHGEDIVGFCCVVDINLFQHTVFRIHSRFPQLLGIHLTQTFVALCMDCIFRTATISVDKLLALRICPAILFYFSFFAKVERGSGNVQIAILDDLWHIAEEKSHDQCVDV

SEQ ID NO: 6555 - protein, 113 aa, B.fragilis
MGVKRNTRHRIWLAWMLLMTFMPLSVVKVFHNHSEETSITCTDAHSGKSHHTCETCPICQFMLSPFIETPSTLLTYTPLYVKWESGTFQDKKLSIAFYPHYLRGPPPVFYHIV

SEQ ID NO: 6556 - protein, 880 aa, B.fragilis
HTVDPSSPVVKTHNLSLEEVAVYAYRNKAGKANWEVTRASADTIPADTASTDFNSEIDIRNIELKHANLVFDDRNTDIYSRIDDANLKLRLSLTKGISTLGLKFDNKNILFWQQGELLVNKIATSLRTDIMVDRQTAVWKLKDTELDVNGIRLDVNGAFRRDTVAKTIGMDLEYGLHAPSMETVLRMIPKSYVKDTKVSAKGEVTVSGRVRGVYGDKKLPAVSLKIGIKEASAQYKGLPYGIDEVTADFDAYVDLMRHQPSYLNLKIFHFKGAHTEVLADAKVDDLLDDPLITFHTKSTVDLDALAKTFPLQESVTITGKLDADMGMKCRLSALKKQDIGRMKLGGKLELKDFELKDTAKDFDFLGNATFRFRDNETLQAQMDVRKLVLRSRFLSSDIERLVANVSSTNPQDTNRIVSLQCDMEVSKLRASMGDSIKLYSARAKAQAALGPQGVDVTKPAIDFSLRADSLFFSAAGTRMAMNVAGIKMKADKLNDSLWMPKGIVGFNRLRFRTPEFGLPIRMSKTAVTVDGPKITLKNASVRIGRSNMTATGDMMGVYRAMTKGEKLTAHLSLTSDLIDCNQLINSLSFPEDTTEVLTDSVPSEMKLFVIPRNIDFELQTDLKKVIFEKMLFENVHGAVDIKNQAIHLEDLSMRALDADMKAVMVYKAGSPRGGYAGFDFKIRNINIAKLVDFVPALDTIVPMLRSFKGRVMFDVAADARLDSAMNIRIPTLRSAIHIKGDSLVLMDGETFAEISKMLMFKNKKENVFDSISVNVTVHDGNVTVYPFLVEIDRYKAAVGGEQGLDMNFNYHISILKSPLPFKAGVNISGNLDKMKFRIGKAKYKDAVTPAAVHRVDSTRMNMGNEIVNRFRRVVLGRQPR

SEQ ID NO: 6557 - protein, 217 aa, B.fragilis
KQSLNYNWTLFMRFQVRSILLFVLLLIIFLQQTIAMNVLRNWLYLFPISLLMILLFSCNQIKEYDAKERTSRNTRVQHLIEKDITWLVGKKLNSVDSILPNELLHEKVLFLFNYHDCGTCIKTGFAVVNSIDRQKGKEYVKVIGSMISDLTSVQRFNEYHGYIYVDTKDLIRRELKYAPTPMLLRVDTDNRILEALIPTTEMDNQTIKMFIASCLKR

SEQ ID NO: 6558 - protein, 347 aa, B.fragilis
QIKEQLLTKYMEEVIEPVSKELIIAELTEDKRLRMTNKSNNQIYIITYQDSPNIMREIGRLREIAFRAAGGGTGLSMDIDEYDTMENPYKQLIVWNPEAEEILGGYRYILGTDVRFDEHGAPVLATSHMFNFSDRFVKEFLPTTIELGRSFVTLEYQSTRAGSKGLFALDNLWDGLGALTVVMPNVKYFFGKVTMYPSYHRQGRDMILYFLKKHFGDKDGLITPMKPLEMETDEAELARIFCKDSFKDDYRILNGEIRKLGFNIPPLVNAYMSLSPTMRMFGTAINYGFGDVEETGILIAVDEILEEKRMRHIESFVKNDPEDCQITSGVNKVFTPKVVTPQEDCSR

SEQ ID NO: 6559 - protein, 486 aa, B.fragilis
GMKLKEILTSIQPVKITGNQDIEITGVDIDSRQVESGHLFMAMRGTQTDGHAYIPAAVEKGATAILCEELPAELVEGVTYIQVADSEDAVGKAATTFYGNPSSKLELVGVTGTNGKTTIATLLYNTFRYFGYKVGLISTVCNYIDDEAIPTEHTTPDPITLNRLLGRMADEGCKYVFMEVSSHSIAQKRISGLKFAGGIFTNLTRDHLDYHKTVENYLKAKKKFFDDMPKNSFSLTNLDDKNGLVMTQNTKSKVYTYSLRSLSDFKGRVLESHFEGMLLDFNNHELAVQFIGKFNASNLLAVFGAAVLLGKKEEDVLVALSTLHPVAGRFDAIRSPQGYTAIVDYAHTPDALVNVLNAIHGVLEGKGKVITVVGAGGNRDKGKRPIMAKEAARASDRVIITSDNPRFEEPQDIINDMLAGLDTEDKKKTLSIADRKEAIRTACMLAEKGDVILVAGKGHENYQDIKGVKHHFDDKEVLKEIFSLTV

SEQ ID NO: 6560 - protein, 82 aa, B.fragilis
KPSCNWHHFYYKAGKRKGVKQRLFKRAPIHDHFRTSMSLVEPGCSVKFTKPDQLFHESKITVRFWIVTIVLAAITIITLKIR

SEQ ID NO: 6561 - protein, 595 aa, B.fragilis
MFGRINNCSKMKINKLLFGMLLLLLASCGSSRKVEKQSEQVAVQEINLTPEQQRKYDYFFLEASRLKVKKEYTAAFDLLQHCLAINPTGSAALYEIAQYYLFLKQVPQGQEALEKAVAYAPDNYWYSQALAGLYQQQDQKEKAIGILEKMATRFPAKQDPLFNLLDLYNQKEDYGKVISTLNRIEEKTGKNEQITMEKFRIYLQMKDNKKAFEEIESLVNEYPMDYRYQVILGDVYMQNGKKQEAYDTYKKVLAAEPDNPMALFSLASYYEQTGQKELFEQQMDTLLLNRKVPSDTKVNVMRQFIVQSEQEGKDSTQVIGLFDRMMQMDMDDVQIPMLYAQYLLSKGMEAQSIPVLEQVVQIDPTNKAARMTLLGSAIRKNDYEQVIKICEPGIEATPDALEFYFYLVIAYNQAEHWDDVLEVSRKALEHVTPESDKQMVSDFYTIIGDVYHTKKLMKEAYVAYDSALVYNPSNIGALNNYAYYLSVERRDLDKAEEMSYKTVKAAPNNATYLDTYAWILFEKGNYAEARIYIDDAIKNTKPEEESSVVFEHCGDIYFMTGDVEGALKYWKKALELGTESKTLKQKIEKKKYIAE

SEQ ID NO: 6562 - protein, 389 aa, B.fragilis
TVMLNLKSNMNKENNKEGQGDALRVIISGGGTGGHIFPAVSIANAIKELRPDAQILFVGAEGRMEMQRVPDAGYQIIGLPVAGFDRKHLWKNVAVLLKLVRSQWKARNIIRQFRPQVAVGVGGYASGPTLKMAGMMGVPTLIQEQNSYAGVTNKLLAQKARRICVAYDGMEKFFPANKIIMTGNPVRQNLLAEKPEREQAIRSFGLNPEKKTILILGGSLGARTINNTLIAGLQLIRRTTDVQFIWQTGKIYHQQVTEAVKAAGEILNLFVTDFIKDMAAAYAAADLVISRAGAGSISEFCLLNKPVILVPSPNVAEDHQTKNALALVNKQAAIYVKDAEAENKLLPVALETIANAEKLSELSENIAHLALPDSAVVIAKEVIKLAQQS

SEQ ID NO: 6563 - protein, 206 aa, B.fragilis
TENRKKEIHCRMKGSKLKQTVIKQSYLLPLLLMVVLLAGCKTSKVVKTTPVEPAYLSSKLQLTVPNKNGSMTVSGSMKMKSGERIQLSVLMPVFRSEVMRMEVTPDEVLLIDRMNKRYVRATRDELKGILPENADFDRLEKLLFKASLPGEKKELTGRELGIPSLEKAKVRLSDFSTAEFELIPTEVSSRYTQVALEDLLKMLIQL

SEQ ID NO: 6564 - protein, 150 aa, B.fragilis
IVNRLNMNIQVINKSKHPLPAYATELSAGMDIRANISEPISLAPMQRCLVPTGLFIALPQGFEAQIRPRSGLALKKGITVLNSPGTIDADYRGEICIILVNLSAETFVIEDGERIAQMVIARHEQAVWKEVEVLDETERGAGGFGHTGRG

SEQ ID NO: 6565 - protein, 723 aa, B.fragilis
DDLSMRIGFFSGMLGGLCLISTLHAQEPDSLKAVSLSEVVVTESYQHLKNKNSTWRMEVVGKEFLREHFTGNLIQTLGTLPGVHSMDIGSGFSKPMIRGMGFNRISVVENGIKQEGQQWGADHGLELDAFNAGQVSIRKGPASLLYGSDAMGGAIELVPLPLPAGNRLFGEASLLGKSVNGTLGGSLMLGIKKDAWYTWARYSEQHFGDYRIPTDTIVYLTQRMPVYHRRLKNTAGFERDVSWAAGFRKERYVSSYWVSNVFQKTGFFPGAHGIPDVSRLQDDGDSRNIELPYSQVNHLKVSTRQSLLYDKWALTWDIGFQKNHREEWSRFHTHYDAQPVPDKDPDKELAFTLNTYSSAVKLKLFASAVWQHTAGWDVQYQRNTIAGYSFLLPAYRRFTTGAFWMTTYRPGPTLSFSGGLRYDYGKIDASAYTDPYLAIYLREQGYGDEFIRKYEWRSYPVRRHFGDYSGSLGLVWSPSGGHLLQVNVGHSFRLPGANELASNGVHHGTFRHEQGDAALASERGWQFDASYTYENGPLSVSLSPFVSWFSNYIFLRPTGEWSILPHAGQIYRYTGAEALFAGGEAAVGIDFLRHFNYRVSGEYVYTYNCDEHIPLSFSPPASLRNTLTWRYKEFSIYGEVQHIAAQHRVARNEDPTPGAQLLNAGVSANLRIGGIWAEVTLSARNLSGAKYFNHLSFYRKVEIPEPGRNFQILIKVPFKSLLK

SEQ ID NO: 6566 - protein, 118 aa, B.fragilis
NKRSEMEDKEAKKKKSNSLKSILGGDILATDFFRRQTKLLVLIMVLIIFYIHNRYASQQQQIEIDKLKKELIDIKYDALTRSSELMEKSRQSRIEDYISTKESDLQTSTHPPYLISTK

SEQ ID NO: 6567 - protein, 198 aa, B.fragilis
SLIFPRHCLKNAVNLHHRKTTNIHNLKSNVMKSLSFRKDLIGVQEELLRFAYKLTTDREEANDLLQETSLKALDNEDKYTPDTNFKGWMYTIMRNIFINNYRKVVRDQTFVDQTDNLYHLSLPQESGLDSTESRYDLKEMHRIVNSLPKEYKVPFSMHVSGFKYREIAEKLDLPLGTVKSRIFFTRQRLQEELKDFRQ

SEQ ID NO: 6568 - protein, 168 aa, B.fragilis
IIFFSPSKMKGMVTIPTVRMSISLAIRAMTGAAPVPVPPPIPAVINTILVPSFSRVLMSSMLSSAASRARSGRFPAPSPCVMERPSCSLTGTGDSANAWLSVLQRTNVTSCMPSRYMWLTALPPPPPTPITLMIFGESVGKSNCTISSILYCIMNYHFISYLRQKKFH

SEQ ID NO: 6569 - protein, 122 aa, B.fragilis
YKSISLFIMKRKIFSLIVVLVVTISFINVWISVGSTNAKVKLRLAAIDAMAMIEAETPGDTELSLSGSCKITFTCYDSWTGAADGSITCWGAEYCKRGIKKEGIVIITETRWVECDGKRTEC

SEQ ID NO: 6570 - protein, 414 aa, B.fragilis
GNHMTKAIDFRYECKIIVINEKQIMKIVNIFVALFCLTACSLSNDLKDRLILKPQSILIDPDKVKDFIDLTPLLRDSVEIIPLETKDECLLSEIERIEFYKDRIFVLDRTRKGVYMFDQSGRFIGKIGCQGSGPGEFTSVGFFCVTGDSVLISDQHQSKWVVYNLQDKRTTEFSCGEFTYLNGFLMGRNLYLVSNYNKSQSDRFNLYKFDVSTRKIEEALIPFEEKMDKYSTTAFTIYASQYQDTAFLIYPFNDTIYEVSSKGAQPFYTIDFTQRNLPDDIEPINNSFRLAVAKGNFVKGLSYMQMSGNYILGRYADKGYFRYLSVDRSTLKSTVGNSFVVRDLGYLPVTSFYTIGDALVSVYSASALMQMLDVILSPDSPIKEKYRTKFESLKQITNCEGNPVLLKFQFESAE

SEQ ID NO: 6571 - protein, 265 aa, B.fragilis
DSSIRLSISSFFVALLPERKVRAMLQKTVGIVLHVLKYNDTSNIVEMYTELSGRASFLVTVPRSKKATVKSVLFQPLALIEFEADYRPNTSLFRIKEAKSFSPFTSIPYDPFKSAIALFLAEFLYRAIREEAENRPLFAYLQHSILWLDTCKISFANFHLVFLMRLSRFLGLYPNLDDYHAGDYFDMLNATFTSVRPQLHSSYIQPDEAGRLLQLMRMNYETMHLFGMNRTERARCLAIINEYYRLHLPDFPILKSLDVLKELFD

SEQ ID NO: 6572 - protein, 171 aa, B.fragilis
KPKILMSINYAVTKKVDKSKGIAKERYYATTRALQKKPVNSVQIANQLAERSSLQNGDVLSALTQLSDIIAAHLKEGRTVSIDGLGNFYPSITSEAVDKPEECTANKVWVSRICFKAAPAFLNNVRKTDFVSLQLKYGRKSTKSQNGSDKETTDVIPHQQSISEDSSLSDE

SEQ ID NO: 6573 - protein, 352 aa, B.fragilis
KNRMLIMSASFNLLDRKRLKGLLLFCPVWVLLFWGCGRTVESPEKVLKCELVSYIKSYPDSSFFSQVGTMQYQDGKIYLLDEARRDVAVMDLEFSDFSLIGKPGDGPGELVRPVGFYVEKDTVYILDGGTVNVKRYFDSEFISSFSVPAANDYRFFMNKDTIFLSAVTDSTFYTKSAESWQRGDLFTLVLAGNVHDFGNARRNMVLNQRHLVKDSTSLYGITSSSSLLGKYDLSSNKQVATFDLSSVSLIKDNLTYEGSQPYDPKSYYTFISDAYAMNGYLYLLCSELKDRDKGGFRVNKILCLKTEPELQLDVIYALPGEIYTSFCVTPDYIFATNYSNERIEKLALPVSD

SEQ ID NO: 6574 - protein, 160 aa, B.fragilis
GEMIRFLGNIEAKADAKGRVFIPAQFRRQLQSGSEDKLIMRKDVFQDCLVLYPEEVWNEELDELRQRLNKWNANHQLIFRQFVSDVEIITMDGNGRILIPKRYLQITGIQSDVRFIGVDNKIEIWAKERAEKLFMEPEAFGAALEEIMKEERRTTNNELK

SEQ ID NO: 6575 - protein, 708 aa, B.fragilis
KMAVNKKNIMTRYFFVILLMGLIGVAIVVKAGITMFAERQYWQDVADRFVKENVTVKPNRGNIISSDGKLMASSLPEYRIYMDFKAGGVKKDTMLMNHLDEICEGLHKIFPDKSASEFKTHLKKGRKQGSRNYLIYPKRISYIQYKEAKRLPVFNLNKYKGGFHELAYNQRKKPFGSLAARTLGDLYADTAQGAKNGIELAFDSILKGHDGITHRQKVMNKYLNIVDIPPVDGCDLLSTIDVGMQDICEKALTDKLKELNASVGVAVLMEVATGEVKAIVNMTKAGDGNYYEMRNNAISDMLEPGSTFKTASIMVALEDGKITPEDGIDTGNGIKMMHGRPMKDWNWYKGGYGYLTVTQILEVSSNIGTSSIIEKYYGSNPQKFVDGLKRMSIDQPLQLQIAGEGKPNIKGPKERYFAKTTLPWMSIGYETQVPPMNILTFYNAIANNGVMVRPKFVKAAIKNGEIVKEYPTEIINPKICSERTLKQIQEILYKVVHEGLAAPAGSKQFAVSGKTGTAQISQGAAGYKSGRVNYLVSFCGYFPSEAPKYSCIVSIQKPGLPASGGLMAGSVFSKIAERVYAKDLRLDIRNAIDTNTVVIPDVKAGEMIEARQVLEGLNIQTQAEFKAKKNKEVWGHAQAAPKAVILQGKEQLRNFVPSVIGMGAKDAVYLLESKGLKVTLSGVGKVKSQSLPQGTTIKKGQTISIHLN

SEQ ID NO: 6576 - protein, 376 aa, B.fragilis
APDVIQSKSVNRLTVNKVMLYYLFEWLHKLNFPGAGMFGYTSFRALMAIILALLISSIWGDKFINLLKRKQITETQRDAKIDPFGVNKVGVPSMGGVIIIVAILIPCLLLGKLHNIYMILMLITTVWLGSLGFADDYIKIFKKDKEGLHGKFKIIGQVGLGLIVGLTLYLSPDVVIRENIEVQKSENEIEVIHGTHDLKSTQTTIPVFKSNNLEYADLVGFMGEHAQTAGWILFVIITIFVVTAVSNGANLNDGMDGMAAGNSAIIGLTLGILAYVSSHIEFAGYLNIMYIPGSEELVIFICAFIGALIGFLWYNAYPAQVFMGDTGSLTIGGIIAVFAIIIHKELLIPILCGIFLVENRHAIGITSIIKPEKERV

SEQ ID NO: 6577 - protein, 89 aa, B.fragilis
NRLVEMANHKSSIKRIRQEETRRLRNRYYGKTMRNAVRKLRSTTDKAEATAMYPGIVKMVDKLAKTNVIHKNKANNLKSKLAIYINKLA

SEQ ID NO: 6578 - protein, 286 aa, B.fragilis
KRTVNFAQSFHLKRMADDSLFLIDIDKILQTKAPKHYKYIPKFVVSYLKRIVHQEELNVFLRDSKDKVGVDFLGACLEFLDAKLEVKGLENIPKDGLYTFVSNHPLGGQDGVSLGYILGRHFDGKVKYLVNDLLMNLHGLAPLCIPINKTGKQAKDFPKMVEAGFKSDDQLIMFPAGLCSRRQNGVIRDLDWKKTFIVKSVQFQRDVIPVHFEGRNSDFFYNLANLCKALGIKFNIAMLYLADEMLKNRHKTFTVTFGKPIPWQTFDKSKTPAEWAQYVKDIVYKL

SEQ ID NO: 6579 - protein, 71 aa, B.fragilis
CFHSSGPVFVLRLFSVLLVPLPVRVTFPGVTLLLSREAELSLWDTPLLTSSLRPELERMVTDPKSERRCVL

SEQ ID NO: 6580 - protein, 115 aa, B.fragilis
GSGSFSPVVKTAELDSTTVVRFNQMQFHPYLKAEKKKQQWHFTAAVDKPWFPADQLFGSLPKGLFSNLEGIKTSGELAYHFFLDANFALLNSLKMEIEPEGKEFPHGKLRGHKSG

SEQ ID NO: 6581 - protein, 281 aa, B.fragilis
RVKSPVPLLNPGGYQTNRVGLLFLLHNKITYKISALMKMALSDFALRKKGIYGILHVIILLLSLFLVISISIDTFKGIPFYTQSVYMKVQLWICVLFLFDFILELFLSKNKWHYLSTHFIFLLVAIPYQNIISYMGWTFSPEVTYMIRFVPLVRGGYAMAIVVGWLTYNKASGLFVSYLTMLLATVYFSSLAFFVLEHKVNPLVTGYGDALWWAFMDVTTVGSNIIAVTVTGRVLSVLLAALGMMMFPIFTVYVTSLIQKKNKEKEEYYKQLEAADESKPK

SEQ ID NO: 6582 - protein, 325 aa, B.fragilis
QLLPLDWEIRCKDRFLPVGCNASCIFLLSSFRLIAILFVLLHPKIRRMNHVTTYIRQALHDIYPPGELRSLTKIICCDLLGQDAIDYYLGKDITLSANEQCDLESIVERLKKNEPIQYIQGETCFYGSMFRVAPGVLIPRPETEELVDLVVKEAATGTRLLDIGTGSGCIAISLAKHIPQAVVTAWDVSEEALAIAGENNRELKAGVHFEKMDVLSAEPVGDDQYDMIVSNPPYVTESEKNEMEPNVLDWEPRLALFVPDNDPLRFYRRIASLGRKMLRLHGRLYFEINRAYGEEVLQMLHEQGYEELRLIKDISGNDRIVTAKR

SEQ ID NO: 6583 - protein, 191 aa, B.fragilis
SLNTKIDMDDQIKQIAERLRGLRDVLELTAEDIARDCEISAEEYRLAETGDYDISVSMLQKIARKYGIALDALMFGEEPKMSSYFLTRAGKGTSIERTKAYKYQSLAAGFMNRNADPFIVTVEPKPDIEPIHYNSHSGQEFNLVLEGRMMISIDGKDLILNEGDSLYFNSKLPHGMKALDGKTVRFLAVIM

SEQ ID NO: 6584 - protein, 62 aa, B.fragilis
  UNSURE (56),(57),(58): Identity of amino acid sequences at the above locations are unknown.
YGVTVVPTKYGADDSINLVLKDRTTTNEMSYKEQIDLNRIPKHVVVTAECNACSIXXXPASP

SEQ ID NO: 6585 - protein, 308 aa, B.fragilis
QADAAICFSAANHSYVCFLFIFAVNRMKIMSIELGKFNQLEVVKQVDFGMYLDGGEEGEILLPTRYVPEDCKLGDWLNVFLYLDNEERLIATTLTPLVQVGEFACLEVSWVNQFGAFLNWGLMKDLFVPFSEQKMKMQVGNKYVIHAHIDDESFRIVASAKVDRYLSKEKASYQPGEEVNILIWQKTDLGFKAIIENMYSGLLYDSEIFQTLHTGDVLKAYVKQVREDGKIDLILQKPGFEKIDDFSKTLHRYITEHGGWIGLTDKSPAEEIYDTFGVSKKTFKKAVGDLYKKRLILLHEDGIELVRP

SEQ ID NO: 6586 - protein, 70 aa, B.fragilis
SCPAADYPHRCRVIFTWNGKQYAAYTFVFHSHFDRCGFQEAFDTCYFPWTAREHFNLRNLSAYYHLLLIV

SEQ ID NO: 6587 - protein, 457 aa, B.fragilis
YVIYDTILIAMAQKLWEKSVEVNKDIERFTVGRDREMDLYLAKHDVLGSMAHITMLESIGLLTKEELAQLLTELKDIYASAERGEFVIEEGVEDVHSQVELMLTRRLGDVGKKIHSGRSRNDQVLLDLKLFTRTQIREVAEAVEQLFHVLIRQSERYKNVLMPGYTHLQIAMPSSFGLWFGAYAESLVDDMLFLQAAFKMCNKNPLGSAAGYGSSFPLNRTMTTELLGFDSLNYNVVYAQMGRGKMERNVAFALATLAGTISKLAFDACMFNSQNFGFVKLPDECTTGSSIMPHKKNPDVFELTRAKCNKLQSLPQQIMMIANNLPSGYFRDLQIIKEVFLPAFQELKDCLQMTTYIMNEIKVNEHILDDDKYLFIFSVEEVNRLAREGMPFRDAYKKVGLDIEAGHFSHDKQVHHTHEGSIGNLCNDEISALMQRTIEGFNFQGMEQAEKTLLGRK

SEQ ID NO: 6588 - protein, 161 aa, B.fragilis
SNCNRQTMNTITEEEALNRMAAYCSAAEHCKAEVNEKLQKWGLPYEVINRIIDRLVVEKFIDEERYCRAFVNDKFRFAKWGKMKITQALYMKKIPREVTYRYLNDIDREEYLAILGDLIAAKRKSIHAKDEFELNGKLIRFAMSRGFEMDDIRRCVQVEEE

SEQ ID NO: 6589 - protein, 415 aa, B.fragilis
KKNKKEITFKIYSTMEQKKKVVVAFSGGLDTSFTVMYLAKEKGYEVYAACANTGGFSEEQLKQNEENAYKLGAVKYVTLDVTQEYYEKSLKYMIFGNVLRNGTYPISVSSERIFQALAIARYAKEIGAEAIAHGSTGAGNDQIRFDMTFLVMTPGVEIITLTRDMALSRQEEIDYLNKNGFEADFTKLKYSYNVGLWGTSICGGEILDSAQGLPETAYLKQVTKEGSELLRLEFKNGELHAVNGEVFEDKIAAIQKVEEIGAAYGIGRDMHVGDTIIGIKGRVGFEAAAPMLIIGAHRFLEKYTLSKWQQYWKDQVANWYGMFLHESQYLEPVMRDIEAMLQESQRNVNGTAILELRPLSFSTVGVESQDDLVKTKFGEYGEMQKGWTAEDAKGFIKVTSTPLRVYYANHKDEEV

SEQ ID NO: 6590 - protein, 166 aa, B.fragilis
GFSKGIYQYDERIGIECFCDGARIRFAPDLLLENMKTLIKTAGTNFLIIDGHHCTEKTAVIETVNSMMLQTVEGVIYLFPCWTQTPAAFTRLRAKGAFLVSADYDGTSVGGLKIFSEKGGICRLSNPWRGRKLRVTENGKPVSVKEQNNVCSFITRKGSTYTIVGL

SEQ ID NO: 6591 - protein, 533 aa, B.fragilis
LMANIKQAVKLGVFTLAIMNVTAVVSLRGLPAEAVYGMSSAFYYLFAAIVFLIPTSLVAAELAAMFQDKQGGVFRWVGEAYGKKLGFLAIWVQWIESTIWYPTVLTFGAVSIAFIGMNDTHDMTLASNKYYTLAVVLIIYWLATFISLKGMGWVGKVAKIGGMVGTIIPAALLIILGIVYLASGGHSNLDFHSSFFPDLTNFDNVVLAASIFLFYAGMEMGGIHVKDMQNPSKNYPKAVFIGALITVIIFVLGTFSLGIIIPAKDISLTQSLLVGFDNYFRYIHASWLSPIIAIALAFGVLAGVLTWVAGPSKGIFAVGKAGYMPPFFQKTNKLGVQKNILFVQGGAVTVLSLLFVVMPSVQSFYQILSQLTVILYLVMYLLMFSGAIYLRYNMKKANRPFRIGKKGNGLMWIVGGLGFLGSLLAFILSFIPPSQISTGSNTVWFSVLIIGALVVVIAPFIIYAAKKPSWADPNSTFEPFHWETQAKPQVAPATTTTAGPATSSATTIGSTTSAPSTGSGSVSSDKDTPQKQS

SEQ ID NO: 6592 - protein, 188 aa, B.fragilis
MQSEDGAFYFHRGFLPEAMRKALYQDLKVKRFARGGSTITMQLVKSVFLSRNKNIARKLEEALIVWLIETERLTSKERMYEVYLNIVEWGPLVYGVQEAATYYFKKRPSQLTAEESIFLASIIPKPKHFRNSFNNDMQLKESLEGYYRLITERLVKKGIISEVAADSIRPEINVTGEAKKDLQRDSIQ

SEQ ID NO: 6593 - protein, 221 aa, B.fragilis
KLNDMRKVIITLCFLFVAFVAQAGRISGINIQSSGEAILVFVDGEQICTPTETCFIANYSGRHRIEVYAVRYIPRTGQSVKGDLLFQEWVSNPGMNIRDIRVGYNDRPDFCPDRPVRPGYDVVMNRTEFDRFLRSVKDKHFDSDRNKLIETTLVSTGFTSDQCLQLVNLFSFDSEKIKLMQAMYPRIVDKPNFYLVIESLTFQSDKNKMNEFVRKYHNQRN

SEQ ID NO: 6594 - protein, 347 aa, B.fragilis
KMKEEKYMRRCIQLAKNGLCNVSPNPMVGAVIVCEGQIIGEGYHIRCGEAHAEVNAIRSVKDLSLLKHSTIYVSLEPCSHHGKTPPCADLIIEKQIPRIVIGCQDPFSKVAGKGIQKLRDAGCEVIVGVLETECRELIRKFITFHTLHRPYIVLKWAESADGFIDLERTEGQPVILSTPLTSMLVHKKRAESDAIMVGTRTALLDNPALTVRNWHGHNPVRIVMDRNHSLPQTSHLSDNSVSTLVFTEHPRAGKENLEYITLNYQTDILPQILSALYQRNLQSLMIEGGRILLESFIRSGIWDEVIIEKSDKLLYSGVKAPEISDKISYSEEKHFCTTFRHYLKRNT

SEQ ID NO: 6595 - protein, 252 aa, B.fragilis
DMKRILIFFLVIGITAISSVSMAAMSNSRIRKETRFLTDKMAYELNLSTGQYNDVYEINYDFIYSIRYLMDDVIRGEEWALDKYYRTLDIRNDDLRWVLTASQYRRFIGVDYFYRPVYASGGSWSFRIYIRYTNHNHFYFGKPYHYNSYCGGHYRTHYHNSYYRGRYRHDFYSGSHSIRDHRNYNTHRRSDFGSVTIRSNSGRRDEVRRGVSQRESSASRDNNRVTPGNVTRTGRGTRSTENNRRTNTGPEE

SEQ ID NO: 6596 - protein, 163 aa, B.fragilis
LKYRKKSHSDRICSDCSSFFFISKINKMTKFESSVKVIPYSQERVYEKLADLSNLEAIKDRLPEDKVKNMSFDTDTLSFNVDPVGQLTLRIIEREPSKCIKFETTNSPLPFNMWIQLVAVSEEECKLKVTIGLEINPFMKAMVQKPLNEGLEKMADMLSMIQY

SEQ ID NO: 6597 - protein, 326 aa, B.fragilis
GRRGMIKAGIIGGAGYTAGELIRLLINHPETEIVFINSTSNAGNKITDVHEGLYGECDLAFTDELPLEDIDVLFFCTAHGDTKKFMESHNIPEELKIIDLSMDYRIASPDHDFIYGLPELNRRATCTAKHVANPGCFATCIQLGLLPLAKHLMLNEDVMVNAITGSTGAGVKPGATSHFSWRNNNMSVYKAFEHQHVPEIKQSLKQLQNSFDAEIDFIPYRGDFPRGIFATLVVKTKVALEEIVRMYEEYYAKDSFVHIVDKNIDLKQVVNTNKCLIHLEKHGDKLLIISCIDNLLKGASGQAVHNMNLMFNLEETVGLRLKPSAF

SEQ ID NO: 6598 - protein, 228 aa, B.fragilis
LKPIRIMKKIHVSAILILLVVMSSCAGLILNFKNSQLMSIQKGMTQQEVKAILGKPNYRRFDGAMEEWEYRGYLSKAGHSVICVNFIDNRVVGLDSFRDGAPTAPPAPSFSLGIGGTVTASDIAPACDYRAMRNDEFARFLNDVKSKTFDSDRTDFIEKATRSTGFTSEQCCRLIKLYSFDDDRTKVLKILYPSVVDKDNFSAAIDGLDFLSNQDTVKNFVRNYNRIK

SEQ ID NO: 6599 - protein, 260 aa, B.fragilis
LYNMKVAIIGAGNMGGSIACGLAKGKLIPASDIIVSNPSIGKLEALKKEFPSIAITRNNAEAATGADIVILAVKPWLIRGVLREMKLRSKQILVSVAAGISFEQLAHDVVEPEMPMFRIVPNTAISELQSMTLIASRNAGQELETLMVNLFSEMGMAMILPEDKLEAATALTSCGIAYVLKYIQAAMQAGIEMGIRPSDAMDMIAQSVKGAAELILNNDTHPSVEIDKVTTPGGITIKGINELEHNGFTSAIIKAMKASR

SEQ ID NO: 6600 - protein, 230 aa, B.fragilis
SRSISVFLHPVIIIVSLVMKNLERLFAEKLLKIKAIKLQPANPFTWASGWKSPFYCDNRKTLSYPSLRSFVKFEITRLVLERFGQVDAIAGVATGAIPQGALVADALNLPFVYVRSTPKDHGLENLIEGELRPGMKVVVVEDLISTGGSSLKAVEAIRRDGCEVIGMVAAYTYGFPVAEQAFKDAKVPLVTLTNYEAVLDVALRTGYIEEEDIATLNEWRKDPAHWETGK

SEQ ID NO: 6601 - protein, 458 aa, B.fragilis
INTIFQMRIKFLSVIVSFFLVSFAVTSCLDTEEIEYSPDATIHAFALDTIHGVNYKFTIDQLGPDGVGLIYNQDSLPVGSDTIIDRILIKTLTTTSGIITAKNAEGQDTLFNYSDSIDFRGTMQKPMRIKVWAADMQYTKEYTISVRVHQQDPDSMNWTKMTDNFANYSGYQKSVTLNEDLLIYTSNTTAYQSSGDVISKGRSWTPVSITGLPDNIKLSSIISFGGKLYATNGESAYVSSDGALWNVATDLNKNGKVEMLIAPFPKNEGNLLGISGIAGIINNGDQSTFAITNPEATAWNIGSETVGADFPLENLSATSYLTATGIQTIAVMGNNRNANDTTSIAWTSQDGLLWIPLKTSSSTAYCPKLDNPSFFYYDNAFLAFGGNFETIYTSEAGIAWYKANKKIFLPAEFKDRGNNYSTVVDKNNFIWVIWSNGGANEVWRGRLNKFGFERQNNN

SEQ ID NO: 6602 - protein, 203 aa, B.fragilis
LTTIILYTKSTMDTQQIDVMVADASHEVYVDTILETIRNAAKVRGTGIAERTHEYVATKMKEGKAIIALCGDVFAGFTYIESWGNKQYVATSGLIVHPDFRGLGLAKRIKQASFQLARLRWPRAKIFSLTSGAAVMKMNTELGYVPVTFNELTDDEAFWKGCEGCINHEILMAKDRKFCICTAMLYDPTDPHNIKKEQERNNI

SEQ ID NO: 6603 - protein, 377 aa, B.fragilis
EETMNLFDVYPLFDINIIKGKGCHVWDENGTEYLDLYGGHAVISIGHAHPHYVDMISKQVATLGFYSNSVINKLQQQVAERLGKISGYEDYSLFLINSGAEANENALKLASFHNGRTKVISFGKAFHGRTSLAVEATDNPKIIAPINANGHITYLPLNDIEAAKTELAKEDICAVIIEGIQGVGGIKIPTPEFLQELRKACTEHGTILILDEIQSGYGRSGKFFAHQYAGIKPDIITVAKGIGNGFPMAGVLISPMFTPVYGMLGTTFGGNHLACSAALAVMDVIEQENLVENAANIGSYLLEELKKFKEIKEVRGCGLMIGMEFDQPVKEIRSRLIHEQKVFTGASGTNVIRLLPPLCLSKEEADEFLARLRKVLG

SEQ ID NO: 6604 - protein, 413 aa, B.fragilis
KYMMIYIIFSVFIIIILFICARYWYLWRKISVQKNEWVAQTKESDTILRSMNACFILINSDLVVIRTNYYDLSGISEEPESSGRVGDLLNCKNAVRSGGGCGAHKNCENCMIRHTIENAFCHKKGFHKLEASMRLLSSDHQQIIPCDVSVSGTYLNNEGHEQMLLTVYDITELKNMQRLLNIEKENAVSAEKLKSAFIANMSHEIRTPLNAIVGFSGLLASADDDTEKKMYLDIVAENNDRLLQIVTDVLDLSKIESGSLDFHYSEFDVNDLLCALHGILNIRLKDKPEIKLICKAGTDEWIIYSEQHRIVQIITNLVHNAMKFTHSGEICFGCRPQGEDEIYFYVSDTGIGIPAGEQDKIFDRFTKLDHEVPGTGLGLTLSQTIVQNLGGEMGVESEVTKGSTFWFTLPLKS

SEQ ID NO: 6605 - protein, 659 aa, B.fragilis
LSVICITEKYNRLLNTHALNMKLKFLFLFLSYSLSIHSQNNLLYADSSKDSLFFEQKKALLTATWHKPFSYSSIQSNHAPLGPYMGNGDVGVVAFTSDNSQTLKISKVDFVTDGWTDWAGSGPAALPIGGVNITVNSPVYSGFVTVNRADPSGFSYQMDQLNSELRMTTATAQQVKMVTWMGVNENMIITELTTSSKTPVPISVDTYADNQSASYTTTAQVNGQIAQVTRQTKTDAVRWISCAGISTKIVGVMSKPECLSESMVRSNFQLTASDTLLVVVYVSGGGKGNDPQLPTAYNKLLTLNKADVTQLKMAKKAWWKDMWTRSYVETNDELLNRHYLSSIYLLASAYNEHSPVSGGMYGVWNMDDKMMYHGDIHLNYNSQAGFYSAFSSNRPEIALPFYKTIELLIPEGKRRAKEEMGIMHPSWEGKSCRGILFPVGALGIGVFYNYYWQQTMNAPFNVPLFSWYYEYTGDLNFLRYRAYPYIRLCGDFYEDYMQKETYGKSYRYTITTGGHEDSWDLNPPSDLAFVKQTFGLLVRYSKLLGVDQKRRKKWDDILSHLPEYKVIMPTKTPNQGLPVYAKNEAGWDLPSHAIQLHAAYPCEILNLHSDSTALQIARNTLYYYEVSQKGFTNTMNELGLSAFVMGPVSDLLPISYWKI

SEQ ID NO: 6606 - protein, 160 aa, B.fragilis
LYKMKKKANRLDAIKMIISSKEVGSQEELLQELGQEGFELTQATLSRDLKQLKVAKAASMNGRYVYVLPNDIMYKRVGDQSASEMLMNNGFISLQFSGNIAVIKTRPGYASSMAYDIDNRESDTILGTIAGDDTIMLVLREGATPTAVRHFLSLIIPNIN

SEQ ID NO: 6607 - protein, 554 aa, B.fragilis
INKMIDRFLSQTSFNSQEDFVKNLKIHVPDNFNFGYDIVDAWAAEQPDKPALLWTNDKGEHHQFSFADMKQYTDRTASYFQSLGIGHGDMVMLILKRRYEFWFSIIALHKLGAVVIPATHLLTKKDIVYRCNAADIKMIVAAGEEVVTKHIIDAMPDSPTVKHLVSVGPEIPEGFDDFHQGIEHAAPFVKPEHPNTNDDISLMYFTSGTTGEPKMVAHDFTYPLGHIVTGSFWHNLKENSLHLTIADTGWGKAVWGKLYGQWIAGANVFVYDHEKFTPADILEKIQNYHVTSLCAPPTIFRFLIHEDLTKYDLSSLEYCTIAGEALNPAVFDTFKKLTGIKLMEGFGQTETTLTVATFPWMEPKPGSMGVPNPQYNVDLIDYEGRSVEAGEQGQIVIRTDKGKPLGLFKEYYRDASRTHEAWHDGIYYTGDVAWKDEDGYLWFVGRADDVIKSSGYRIGPFEVESALMTHPAVVECAITGVPDEIRGQVVKATIVLAKEYRERKGEDLVKELQNHVKKVTAPYKYPRVIEFVDELPKTISGKIRRVEIRKNDEK

SEQ ID NO: 6608 - protein, 334 aa, B.fragilis
IMEFLTNEKLTIVGAAGMIGSNMAQTALMMKLTPNICLYDPYAPALEGVAEELYHCAFEGVNLTYTSDIKEALSGAKYIVSSGGAARKAGMTREDLLKGNAEIAAQFGKDIRQYCPDVKHVVVVFNPADITGLIVLLYAGLKPSQVSTLAALDSTRLQNELVKYLHIPASEIVNCRTYGGHGEQMAVFASTTKVQGEALTKIIDTPRMPMQDWEDLKVRVIQGGKHIIDLRGRSSFQSPAYLSIEMIAAAMGGQPFRWPAGTYVSDKKFDHILMAMETSITKEGVSYKEIQGTPEEQKEMEESYAHLCKLRDEVIAMGILPEINKWHELNKHIN

SEQ ID NO: 6609 - protein, 760 aa, B.fragilis
MNNSKIINVRLMKKVLVLVLSFLSVTAFAQNITVKGIVKDGTGEPIIGGSVLVKGSSIGTVTDVDGNYTLSNVPADGVLEFSYIGMKKQDVKVSGKTVINVVLQEDTQILDEVVVTALGLKREQKALGYAVTEVKGDDLKAANTISPVAALQGKVAGVEIRQSDGGMFGATKIQIRGASTLKGNNQPIYVIDGVILDNSTSGNTTMDWDAGNNNANDYGNELKNLNPDDFETVSVLKGAAATALYGSRGLNGAVVITTKSGKGFKGFGVSVSQTFGIDHAYRTPDIQTEYGVGLMPGWKDTDNNGSVWDPFQFKLDDKGDRTLIGAGSYGWGPKYDGQPIRNYDGTWTNYSPHKNNMLDLYQLGLNSNTNVAIRGGNDKTSYYTSLSYKKARSTSEKNTFERYSFLLKGSHKISDRVEVSAAMSFTNSNPKNSPRTVGERFVNPNGTIMTPMLDVNYFRDKYLGEHGGLASTSYGDKYGSVPGRDLFFMIDKYDYSQKETVVRPQMEVNVQILDWLRFKADANMNYYYTKFEEKQLGSGYANEGGKYTMGQTTKEQATFGGTFTVNKQIQDFSVGGFARYEYYTSRSEAYKVYTDGGMVVPGQWFVDNSKNPKKSEASISNTKRMMSAVFALNLGWKNQVYLDVTGRNDWSSSLVYQNGMGTYSYFYPSVSGSWLLNETFDLPHWITFAKVRGSWAQVGNDTDPYYVNSVYGFETKEMYDGNIYVNTLDKTMKSLKLKPERKNAWEVGLDLRLFDSSLTL

SEQ ID NO: 6610 - protein, 114 aa, B.fragilis
ICISVPQLIACCGLDCENCDARIATVRDDNELREKTAQKWSIMNNAPEITPATINCMGCRTDGAKFAYCNDYCPIRKCVNEKGYNTCGDCKELDDCQIVGAIFQHAPDAKENLL

SEQ ID NO: 6611 - protein, 321 aa, B.fragilis
IVTSLKLEDRLMKDPFKLNVKSIMALYELFPTEEACIKHLEAINWHDKPVSPFDKTSRVYKLKSGKYRCKNTGKNFTVRTGTMFEKTKISLRKWFIAIWLVTNHKIGLSSYQLANDIEVTQKTAWYMLHKIRHAMRLANENILEEAVEIDETVVGGKNGNRHKDKKVPHSQGRSHKDKFPVVGMIQRENLMNARATPDTKSDTLSAFIKEYIHPDAIIYTDEYNAYDQIGFSYTRFYVDHSKKLYSYDHITTNRIEGAWTHFKRMVKGTYRTLLKKYLQKYVDEFVYRYNLRDISNSDRLNCFLCCADTRYTYKQIRKSAA

SEQ ID NO: 6612 - protein, 60 aa, B.fragilis
RTQSFKKTKRTNHAIAKSMRFYSIPIFQAGKNRFSAFSKYKMTNRLLIRYSTHDFQCCIQ

SEQ ID NO: 6613 - protein, 138 aa, B.fragilis
PTRSHTMKLRKPFRILRNLILFFFISSIGAVIFYRFVPVYVTPLMIIRSVQQLVSGEKVVCKHTWVPFDKISPSLPMAVIASEDNRFASHNGFDMIEIKKAMKENETRKKETGCQYHQPADSEKRLSLATIFVDTKRI

SEQ ID NO: 6614 - protein, 333 aa, B.fragilis
ESPSTPCSCLSRRSTRNMYCKPHRPGNTPQVPDNKGKCTRLVDYLSKESQVERPYYDNFFSQQKDYVIPLTVKNHIDNNHRTLKSNDDKFYMLSINPSGDEQRHLIERVTGRKVGEFSELTPGEQESVLAQMKKFTRECMDEYARNFYREKIKSGDDLVWYGRVETERHYKNDDPEVKAGRAKAGDKKPGLQLHVHVIVSRMDRTQTVSLSPLSKSRGNRQVLEGREVVVGFDRSQWSSRCASRFNQLYDYFPNYYSRDESLRKYSENWQAKNELKNEAVSKLKQEVLKGELKEERRLYANTFRIYRFVVNPRKAIIQELKRLGTDLLSGRDL

SEQ ID NO: 6615 - protein, 322 aa, B.fragilis
TATPYKNKDWQWDVAMTYTKNKNTIISLHENVADYIALSGYANDYDYHIGSVAKVGGDYGLLMSDILPAKNEKGETLLEWDDSWRGAYEARSGKVQEVGKMTPDFLGSLSTTLSWKNLSLHIATDMRFGGLVASYSNLYGTQAGWIKSSLKWRDPEHGGLSWTSQYGDSKGISYGDGVIPDGVFKNGTFATLVDGTKMDVSGMSYKQLVAEGKLEPTHAGTYHVNRAAWGQNTIFDTWVHELNYIALREITLSYRFPKSVASKFGAQGLGLSFSARNLGYLYNSLPNHLNPESVRGNTASEFRIRGYEPYTANYMMTINVDF

SEQ ID NO: 6616 - protein, 288 aa, B.fragilis
ELYPDIMNRIEKNKTQTDQAWNKLHNRLETDGLLPTVTERRFATRPTVWIGIAAIAAIISLCVYLPTVLRTDRHLSGGELLVKANKEESILVTTLEDGSVVYLSEQTSLEYPKHFSKKRREVSLKGNALFDIAGNRARPFFIETGKVQIEVIGTAFHVRNSGNSPFELAVQRGEVKVTQKQNGQEIHVKAGETATLLGDEWQLTVTENSEQFTRYMQNMRFKDEQLDHILHAINLRQTEIHLQSSPELGKHVLTVSFSEDSPEKMAELIGLALNLKCTRNQNIITLSE

SEQ ID NO: 6617 - protein, 148 aa, B.fragilis
ALFPLAPSLPLAPSFPAAPSLPLIPSFPLAPSFPLAPSLPLMPSLPLAPSLPYARIPVSFPLIYQFPLVPIITSGDLPSLPIAAFPVSFPLITQFPFSPIVTVGVVPATPSSPLEGFPVSTPSINQLPLSPIVTTGGTASSPFCPSLP

SEQ ID NO: 6618 - protein, 96 aa, B.fragilis
YGPFEGLLRPGEHRAEWFPVFGQLLFDATVVNSTEYAHVKGYGVRHNPCCSQVRLIIFHEYMVYRANVNVPVIPELFETAKRSIIVLGGAGVVQLP

SEQ ID NO: 6619 - protein, 466 aa, B.fragilis
GLQPEESRIFATHFLLNNIMQGIKNLTQGPINKQLFNLAMPIMATSFIQMAYSLTDMAWVGRLGSEAVAAVGSVGILTWMSGSISLLNKVGSEVSVGQSIGAQNHEDARNFASHNITIALIISLCWGGLLFLLARPIIGIYELEAHITENAIAYLRIISTGLPFIFLSAAFTGIYNAAGRSKIPFYISGTGLVLNILLDPLFIFGFGLGTNGAAYATWISQAAVFGIFIYQLRCRDALLGRFYFFTRLKKKYTHRILKLGLPVATLNTLFAFVNMFLCRTASEQGGHIGLMTFTTGGQIEAITWNTSQGFSTALSAFIAQNYAAGRTDRVIKSWHMTLLMTSIFGTLCTLLFVFFGNEIFALFVPEQAAYEAGGVFLRIDGYSQLFMMLEITTQGVFYGIGRTIPPAIISITCNYMRIPLAILFVRMGMGVEGIWWAVCVTTVAKGLILAGWFALIKRKVLSRPIL

SEQ ID NO: 6620 - protein, 78 aa, B.fragilis
LPSTTHDIDTHMITATMEGNAAAQDFLSHLPLKATLPFIPRGVALQFSAFLTPTHLSSEKFVAVVLMTNSFVTVCEWQ

SEQ ID NO: 6621 - protein, 401 aa, B.fragilis
SMATVKAKFRPSTVKDRPGTIVYVVIHRRTVRQITTGYKVFPHEWDEERSKPVLADNVRRTTVMQSITRKLQSDMKRLYKIIERFDKQCRSYSSDDVVAEFRHSEEGDSFFNFMEGVIERLRQLNHSGTAKNYNAALGSFKQFRDNRDIYIGSIDHILMEDYQAYLTATGIVPNSISFYMRILRAVYNRGVEQELTEDRKPFRTVFTGTEKTLKRAISINDIRRIRNLDLSLKPGLEFARDLFLFLFLCRGMSFIDAAFLKKADIQNGVLTYRRHKTGQLLHIKVIKQIEEIVDRHSDKESPYLFPVITRPGENERKQYETALHHVNKSLKIIAGMIKLPVALTTYTTRHAWATIAKSKNVPVNVISDALGHDSITTTQIYLASIDVSVIDKANELIIKDL

SEQ ID NO: 6622 - protein, 193 aa, B.fragilis
RTLTPDISPNMLNDVFILTQIKEGNIKAFETLFRQYYTPLRLYAASITGEPDVAEEIVEELFYVFWKDREKLEIFHSVKNYLYRSVRNRSIQYCEHQDVRRRYQDAILSVPVNIASPDPQEQIEYKELQQIINRTLEKLPERRLHIFRLHHTEGKKYSEIASLLSLSVKTVEKEMTRALRTLRKEIENYIQIS

SEQ ID NO: 6623 - protein, 93 aa, B.fragilis
RKATPYTIDTDGGSRCLFISEKVMEVFDDGFDYREVANHKELTDLTVALFAGMISAQPPRTAAMEVPVACLREDARTGTNGNGHAVAPVKRKG

SEQ ID NO: 6624 - protein, 296 aa, B.fragilis
IAETMEIFSLKEHVSCYNYAKCIREGFSYYESSKTETDEGPHETDCILFVMEGELELSCNGERIKLPAGNMICCSRESMYRVFSQGKMSIVIAQFDNAVQSCEKVSFSQLNSLNSSGEKGIYPLEIRDRLQLFLKLLIGYLGDGASCVHFHETKLKELFWNIRFYYTRTEQASFFRPILGNDHEFKKKVLDNYRNARTVKELAQMCESSLSTFKRKFFKEFREPASEWLQKQMNSIIKYKLADEDIPIRNIADELHFSSQPQFCRYCKRNFGYTPGEWRKLLKNRDKTPRRPSGRV

SEQ ID NO: 6625 - protein, 123 aa, B.fragilis
PYRTRQSLQQIECRLMIKCDPLCGNSTISKVSGGICKTTKVNFPVYGLSENKRTRYPMIAALIDRFNRKFLAIHMLPYLILTIEYIARREILIDSHLVLYILIGCLAVEADMGAVIPYVDSGG

SEQ ID NO: 6626 - protein, 162 aa, B.fragilis
IIMTSKDFIEAEAGNNGSIILYREGLFWKAYEKSAYAVCTQIKPLKAIKRRLKSLGGGEIVSVGFPCKHEQKYIGSLEHMETMPDRLVLRTLKPIDGQRFEEWKQELSSEHSVVGRRDACVQNLSRSNIPHGELIMRIRMFNLAESTPMDCMLFVNELKKML

SEQ ID NO: 6627 - protein, 63 aa, B.fragilis
AVIAFCKIETIIKISYLQVTGEEVYRSLSTYPHGLVGLVDEPNWIQKFRDFCCLYNYKNHAIF

SEQ ID NO: 6628 - protein, 428 aa, B.fragilis
CFVAFMRFLQPFSYKQLIYIIICNSFIVMATVKTVLVKGRCNSRGAYPLAVQVLHKRKKKVFYTGYSIEPCQFDSISGRVIFNGMYTMETIRRMNRVCRKISKVLDKAIDILEKGDSEYTTCDISRIYETLTGKVGFYSYFQERIRVLFDTGHEGTAKAYESTLHSMQRHLCESDFPFPHLSSRLVIKYRDALQEAGVGKNTIGFYLHNMKAVYRRGCLELNLVFPSPFSDIRIRSEKTVKQSLPMNQVRSLARLSLSAGTPECLARDIFIFSIYTRGMSFVDIALLKKSDVFPGVIRYRRHKTGQLLEIGINRQIQSLLDRYGDTAGNYLFPLVDESETPYSGYKKAYNKMRYALKKVSKSIGMNPPLRLHAARHCWATMARENGTPLHTISECLGHSSEKMTRIYLKELDRSVLDEVNNHIADNIC

SEQ ID NO: 6629 - protein, 523 aa, B.fragilis
TDTAMEIRKQYFKEKQYMWHKVRELQLKGLNKTQIGIYLGVNRKTVRRYLNMTMEEFVKKQSSHRKYRLKLENYEQYVRANLEEYPYISAARIHDWLKECYPDFPRVCNRTVSGFVERVRKKYGIGKKVETHKRNYEKQPDTPYGEYAQADFGEKWMRTENGKSIKVYFFAIVLSRSRYKFIYFSRRPFDTGLAVYAHELAFEYFGGRPQKIIYDQDKVLIARANMGDLILTGKFQAFVKEQHFHPVFCHKADPESKGKVENVVKYVKTNFLTARIFQNVDRLNEEARLWLERTGNGKEHGTTHRIPLEEFAQEREYLVPYHGTPHSPGGEMKEYHVRKDNTVQYRGNYYSLPCGTYRGGETTVWLHETDGCLELYNKETGKLVCRHDLCELKGKTIYGEGHRRQRNIGAQKLAERILIYVSYNREVALWLENLQRRKERYYRENLEVILRIIPGYDKAILTEAVSVCLDKGIYNGESVKSLCGHIWKKKMGESDVGKNPASRTQSTGLVKTYNEIFRNNGKV

SEQ ID NO: 6630 - protein, 478 aa, B.fragilis
QTDAPLSTLIFKTFITMNQTVTENHRLRDTIIIGAGLTGLTTAYCLTRKGCDIEVIEQSPCVGGQIRTYHENGFTFESGPNTGVISHPEVAELLAELSPTCRLETAREASRQRLIWKGDRFHSLPSGLFSAITTPLFSTKDKFNILGEPFRAKGNNPDETIGELVQRRLGISYLHYAVDPFISGVYAGDPMRLVTRHALPKLYQLEQTYGSFILGGIAKSFSHRSEHDRLATRKVFSTYGGLSNLTKALEQAIGIKRFSLGATSTSLMPCEQGWVVSFTDSCGIVNRIHCRKVITTTPAFVLPSLLPFVPDKQMNRISNLTYAPVMQVSVGLRNTYGKEFHAFGGLVPSCEQKPVLGILFPSACFDNRSPEGGALYSYFLGGTRHPELLEKSDDEIIRLITTGLNEMLDYPAGIVPDLIRIFRHKKAIPQYESSSTDRFAAINELQKQYPGLVVAGNLKGGIGMADRIKQAVEIARER

SEQ ID NO: 6631 - protein, 157 aa, B.fragilis
GTSAIPTDLTVSFVALTHVIHTSKSENQRLKMKRRKEPTEFRLGTIIVPYIEMFDEAVAIRTDGVRLIIDTYFNDLSIDDIPQQYVFTWNWLGKGYKFTVINHLYKSSKAKTKRGFKKLLAEALPLLIDPKNGLIKKPELSPADLNRFNTVLKTCSK

SEQ ID NO: 6632 - protein, 88 aa, B.fragilis
ELFYRDIYLLLTSCQLINQNPFTYELLVPILHQDTFVQMVLRGITYLPLLILVMVVMDGLLCIIGLLPFADRNKGIGHEYDCNELFGR

SEQ ID NO: 6633 - protein, 62 aa, B.fragilis
NLLYGFTQLFFRRNYIEIFPKAFVVYKWNFRKDGMYGQPLIMVETADIIRFYLAGDHFKPCM

SEQ ID NO: 6634 - protein, 67 aa, B.fragilis
NYNLQGQRAQDVEAVFGNLKTTNNPRRFYLRRVEKVDIEFGLLAIAYNLAKVASSTTFCAPKDILKG

SEQ ID NO: 6635 - protein, 527 aa, B.fragilis
SRNQNPKTMKASKSLCLQCLFTCLLLFIAARVKADDSGILDRIIRLPKSEMTVYKLLSKITEETGYLFIYDSKLVDNERTVKLKGGKQTVRQAIYSIIGNDNLKLRSVDKHIIIYRPETALSISKEEGLCRDSTLSFTLEGTLIDQLSREPIPYATVGAEGSSIGSVTNQNGSFRLHLPDSLRNGRIRFSHLGYVPQTTDASLLAGRNGTFALEPKVIPLQEVIVRIVNPVRLLREMLQFRKKNYSKVPVYLTSFYREGIEQKNRFVSLTEGIFKIYKASSSTPEKTDQVKLLKMRRITNQAVKDTLIAKMKSGIHASIELDLIKSLPDFLLPDSKECVYVYTSSDLAIIDNRLAHVVSFEQRPSIKYPYYCGELYIDSENSALLRARFELTPRYIHKAANMLVEKRSRNIRIIPQKVVYTVSYKPWKQTYYIHHVRGDLHFKIKQKNKWLNNTILHTWFEMVTCKIETDNVSRFDHNERLSVHTIFAEIPFVYDKSFWEDFNVIPPEKELSEAIEKISSKIEETEN

SEQ ID NO: 6636 - protein, 187 aa, B.fragilis
KIKHLITMIVQDLNFDQTVAMAKAKAESMIQNGLYSRFGLSEKERLDKALLGCIGELAFQKHLKNLGIPFELDQTDFQSHHSDEFDVKVNGAKIDIKVAKKTTANPPTDNWTYGYPQEQHPETKDYVVVGWVDFNRKEVGFYGWIRGKQIVEFKVVTQNSYAKYPYLTPNHEFKWGCLTKDLNEILK

SEQ ID NO: 6637 - protein, 434 aa, B.fragilis
ITMHMFKKLLILLLSLLDCIPVFCGGDTLHYRFYFRVGASSLDLSYRDNGLRLDSLLSVIHSRQAHAVLRRVSLYSSASPEGGSALNKRLSDRRLASLRTVIQHRLAIPDSILISFSLGEDWDGLSSLVEGSDIPYRGEVLRILRDTPVWVIRNGIVVDSRKRQLMNLRGGRVWRYMHEHFFPELRNSSVIECEFEPFVAENDDVPAPSQKGVCPPDTVILRDTVERAIMMRDTVEVPVPIANIPKPFYMGLKTNLLYDALLVPNIGVEFYLGKGWSLGGNWMYAWWNNDRRHRYWRVYGGEIGLRKYFAPRAAYTPFIGHHVGLYGQMLTYDFEFGGKGYMGGRPGGSLWEKSNYGFGLEYGYSLAIGRRLNLDFSLGVGYLGGTYYEYAPMDGHYVWEATKNRRWFGPTKAEVSLVWLLGRGNYNDKKGGRR

SEQ ID NO: 6638 - protein, 324 aa, B.fragilis
RHMQYVGIQTQQSRNNLRSGILLILFPCLVAVLTYLFCYLLITFTVEDDYGQYNTLAMTNQMFINLIPYIIGGVLVWFIIAYFTNSSIIKAATGARPLERKENKRIYNLVENLCMSQGMKMPKINIIDDDSLNAYASGINEQTYTVTLSKGIIEKLNDEELEGVIAHELTHIRNHDVRLLIISIVFVGIFSMLAQIALRSVYYSSWTRSRNDKNNGAILILVLAMIVAAIGYFFATLMRFAISRKREYMADAGAAEMTKNPLALASALRKISADPDIEAVEREDVAQLFIQHPGKQAKSALSGLSGLFATHPPIEKRIAILEQF

SEQ ID NO: 6639 - protein, 133 aa, B.fragilis
QEQQNLFPENQGSKGTVWLYLESKRGIPHLHGTFCRIDERGNVNNDHDIHLRAQRAAGRVALKRGWMTAAEVRETNIGHVNRDCMEPLQSMKSRSWDEYAAGLQSMGYKFWEPRDNKKILHGYVLKKGNAIYY

SEQ ID NO: 6640 - protein, 322 aa, B.fragilis
ERRQTMNRILTTNHILHVVSVFTILLLTSCEHKDLCYDHSDATEIQVVFDWTNAPDATPETMRLYLFPVGGGTPHTYEFPDYRGGRINVPAGRYKALCINSDTESILYRNIDSFDSFEAYAADGVLNVRSSSSPRAEGTADERIARSPDRFYSARLDDVTIELSKENRTVTLYPEPSVCRCRVTITNVSNLKYISSDGISGALSGMCGGLLVGRNEATSDPVTVPFGVVSDGASTLTADFLVFGQIGPSGYPAHKLVIYAIMSDGSKNYYTFDVTRQVDEAADSHDIHITLDGLPFPKPIVNGGGFHPAVDEWQNVDVDVSM

SEQ ID NO: 6641 - protein, 242 aa, B.fragilis
ERRHEMKKVYTVMEYVPLLAGMLMLLSSCGHKDLCFDHDVHAPKSEVRIEARYEKEWQYTHEGSTDWKSHSTWPESFGMEYDALRPGIPDGLRVQVYNADGSDEIINTAPEGDVVYMRPGEHSLLFYNNYTEYIVFHEMQSFASAKATTRTRTRSSYLGNSYMETASENTVNQPDMLYRSYMESYCGGTLDRNRRDTRHHAPDGVHLSGTLRVQPRGGIRVSGTRCLGWYGAGGMVEQRTHV

SEQ ID NO: 6642 - protein, 67 aa, B.fragilis
LWVNFSVFIFAAVNKQTTKPDLRNTVSITLKTLEFCFPFFPIHAGTTTFQKESIWVLSKQVIPLSVA

SEQ ID NO: 6643 - protein, 216 aa, B.fragilis
CFPNRHKDIILLYDDTSLKIGVYFLMICLTGHGTKKIGRRNHDGKSGIYFLSHGINDIQYITGESRNKKQETRNKKHPELIFHIIKDNLLPSGLDATGIWDFMRLTQEKSKKVKNSVIHIEVSRAPEHTKDFTIDDWRRLWDDFMGEFDNIELLDKNSKTYSPKTKAARARCGCIWNPREAFPIFTARSAVSTNGEMSTTTMTYTCEHSGQPGVWP

SEQ ID NO: 6644 - protein, 431 aa, B.fragilis
SKDNMHMRGLIVSAFLLLGCIQAFGQENRKEVCIGFPVGNSTLDTAYGNNAARLSEVVSFLESVKKDSTLELTGVSFCGSASPEGGFTVNRMLAEKRRNSLERYVRERVSLPDGIISRPEGFIAWERLAELVEVSDMPHKEEAVDVLRNVPEFTYGNKGVLVDSRKKHLMELQYGRTWHYMHKHFFDRIRNASVILVTVRQKPLIEEKTVVKEEPVVPTPADDTTTVVEKADTVVAVSSETSKPFYMALKTDMLYDVLAVPNIGVEFYLGKNWSISGNWMYGWWKKNSNHRYWRVYGGDLAVRYWLGKKAHEKPLTGHHIGIYGQAFTYDFEWGGKGYMGGEPGGMLWDKTNYAAGVEYGYSLPIANRLNIDFTLGVGYWGGKYYEYVPLDSHYVWQATKNRHWFGPTKAEISLVWLLGRGNSNNKKGGMK

SEQ ID NO: 6645 - protein, 197 aa, B.fragilis
YQCKNRKEINMTIREFKEHVKTRKLLDTEEIHQFMDIMSNEARRITFQLNTTYHTPNEVRELLSELFGYRVPSSFRVFPPFYTDFGKNITIGEDVFINACCHFQDHGGITIGDGCQIGHNVVFATLNHGLLPEERKSTQPAPIVLGKNVWVGSNATILQGVSIGNNAIVAAGAVVTKDVPSDTVVGGVPAKFIKTIR

SEQ ID NO: 6646 - protein, 88 aa, B.fragilis
IKNKKINGMNMNKKMYILPGDERIAASDAKEFVHELRTGSWMDSNCTDEQYMCNFAERYVIQAGVRIATDTPENFLADLIRTGYAKEM

SEQ ID NO: 6647 - protein, 690 aa, B.fragilis
NMIKRLFFLLPFSTIVSANEPDTIQVKRIDLDEVTIVAFKQNTPNREPLSISTLDNRFLKENEISGAKDLSSLLPNFYMPDYGSKQNSPVYIRGIGAKKDAPSVGFYVDGIPYFETSAFDIDLSDISSIEVLRGPQGTLYGRNSIGGTINVYTHSPLDYQGTYFRLGYGSYNDMRLIASNYTKVNEQLGLSFSGNYHHNDGFFTNLHTHKKADKLDNGAGRIGLTWKPAAHWTTRFITSYEYSNQGGYPYGLYNADKGTTEAVNYNNEGLYRRNLLTSGINIRYNGPHISFNSQTSYQYIQDKMGIDQDFSPRNIFYGQNKIRQHMYCQEFTIKSVNKSRYHWITGAFVFRQTINRKVDLSRFTDTTRHLTNSGIPTQGIAFYHQSTLDLLQGLSCSVGLRYDYEHARCDFSKVQQPLNGNGETKSLEQFNRSLHFGQFTPRFSMQYLSSHNQLFYASVSKGYKAGGFNVSFLNNDDYLYSPEYNWNYEIGTKLSFLNNRLSADLSLFYIDWRNQQITNTIPTVGNVIRNAGRSRNKGIEASFQARPTKSWMMYMNYGYTDARFVHYQKEERGILKDYEGNYLPMVPRHTFSLTTGYSFYDICSWIDRLTLNAGVSVTGPIYWYEDNHPSQSPYALVNLRISINKGCFTWEAWSKNLTNTDYLSYYFVTSKAYAQKGKPITLGTSVSISL

SEQ ID NO: 6648 - protein, 83 aa, B.fragilis
YPTNTYIYIKKNTIYMYQTISEYESLQPVTYQIDTNRFEKNQIKDSAKEQYKSVTNLYLPRNDKNCICTSVPNVNTQEAKPGR

SEQ ID NO: 6649 - protein, 231 aa, B.fragilis
LYKKSLIMKKIKFMALFLSMALVFGSCGSMNNTAKGGVIGGGSGAALGAIIGGIAGKGKGAAIGAAVGTAVGAGAGVLIGRKMDKKAAEAAKIKDAQVEQVTDNNGLAAVKVTFPSGILFAFNSSALSAASKQSLAEFANILKEDPTVDVAIIGHTDKVGSYEANQKVSANRAYAVENYLQACGVKPYQFKKVEGVGYSQYNESETPEQNRRVEIFMYASEQMIKNAEAGK

SEQ ID NO: 6650 - protein, 424 aa, B.fragilis
TLKKMKTQWIRSIGCILAVLILSGIMPLAAQDNAERYTTISGVVKDKLNKKKLEYVNVSIPGSSVGTVTNADGEFTLKIPESVQAKDIEASHVGYLNSRIPLKEENPTERIVWLTPYANLLSEILVRARDPRSIVEEALRKIPANYSPQSNMLTGFYRELAQKGRRYINISEAVIDIYKTPYNETAEHDRVQIYRGRRLLSQKQSDTLAVKLLGGPNMAIYMDIVKNPDCLLAQEDLLFYEFRMEDPTSIDDRSQYVISFRPRVKLSYPLCYGTLYIDKERLSFTRAEFNLSMDDKNKATQAILRKKPFGLRFKPVEVSYLISYKNLEGITYLSYIRNNIRFKCDWKRKLFSTNYTILSEMVVTDRKENNITAIPYKAAFKQNHVFSDKVDNFTSDNFWGGYNIIEPTESLEHAVNKLKKQQKQ

SEQ ID NO: 6651 - protein, 316 aa, B.fragilis
QVMNETIRRILAESGTKTSKIRKLLLTGLSHREIADLVTRGNRGFVWNVYKRMRDEGLLPASQTATVLRPEPDYTFNRCFGVEIEAYNCPRQTLTDALRETGIPVEIGSRNAETNSNWKLTTDGSLEGSHTFELVSPILCGEQGLEVLERVCWVLDAYNVKINSSCGVHVHFNAGDFNLTTWQNLILSYKHAETEIDKFMPASRRGNRNTYCRSLRAFSDEDIRSAESIESLQRLFGSRYMKVNLEAYSRHRTVEFRQHSGTINFTKIENWVRFLGRLIIFASTSSLPAGIRLEDFPFLEEKQKLYYKLRTKKLME

SEQ ID NO: 6652 - protein, 401 aa, B.fragilis
NNMNFNEIKNRLLIGALAITVFPFYVHAQNDKMEGQTAHRTKAWEIGVGGALINWDRVTFSNFRQVDGNYLYRMNIDHLFGGIQLYAARELNPWFYLDLQGTLGLARKQVETGGRKFDFMYMAGPGLQFRLTPLFKSKYVEPYLRVGVNYLHHDFYAINAGKFENDPIGEAEWTSSNPWNKEKIGSKQSYFPLSFGAGVQAWLNDHWGVGLQGEYIMPVDKKQTRFVQASMRIMFRLGGSTKRPMPVVQYIDRPVDRIVERIVEKRIEVPAVVESHVCDLFDNIHFAFDKDVITSESEITLDKIADLLKSYPDNNFLITGYTDARGSDNYNIDLSKRRAKAVYSALLKRQVPQHMLKWRGVGYHASSVPASGPDKVRMGDRKVSIERVTNSDYWGWLTNEE

SEQ ID NO: 6653 - protein, 301 aa, B.fragilis
KNMKTTQRTAGWYHVMAAVTVMIWGTTFVATKVLIKYGLSPVDILFYRFLLAYICIWFFSPRVLLAKSWQDELRFVGLGLCGGSLYFVAENTALGMTLASNVSLIICTTPILTALLAPFFYKGDKLKARLIGGSLMALIGVGLVVFNGSFILQLSPAGDILTLIAALMWAFYCLLLRRMNTHYPTLFITRKVFFYGLVTLLPLFLVYPLQTDIHILFRPVVALNLLFLGVIASMLCYIMWNTAVKQLGVVCATSYIYVVPLITLLTSAIVIDETITIVALLGSALILSGVYIAERGVNLKK

SEQ ID NO: 6654 - protein, 77 aa, B.fragilis
LTMNKVVYVHLVFEKKDYFFGSIAAIYDYLSADQIGAGYNTLRNVRWKETSVYVTPKAIIKIGKLLRAGSCKKQPIK

SEQ ID NO: 6655 - protein, 186 aa, B.fragilis
SVTKMNTNKEFLTKMIRVSPSVKKRMEIFQGGDSANSCIDRMITFFEITGFNPRYASRNPTALVEKRIEDVVRIIKSQERDILKPVLEKLSAINNTPQESPDYARLMNELRDLKDENRKLKERLQADDLHTQDAAVYQDKLKRLGGLLKYQLDPEKFPRIKYSDDVRVPVNTLQLLIKKINEEYVL

SEQ ID NO: 6656 - protein, 152 aa, B.fragilis
RKTKPGKKKRGASTISQQTAKNVFLWPQSSWIRKGFEVYFTFLIETCWSKERIMEVYLNSIEMGKGIYGAQATAKYKFKTTAAKLTRGQCALIAATLPNPIRFDSAHPSPYIKRRQGQILRLMNLVPKFPPVDKEKAKGQDTKKQKNKKKKK

SEQ ID NO: 6657 - protein, 204 aa, B.fragilis
LIKNTIDSPNNDRSIMYKIIFVFLAIMGIATASCAQQKQGANRKQPNNKVLIAYFSATGTTAGAAEKLSKVTGGELYEITPAQPYTNADLNWNNKQSRSSLEMNDPKSRPAIRKSSIDIADYDVIFVGYPIWWNLAPRIINTFIESYHLKNKTIILFATSGSSSITNSMATLKKSYPELIWKEGKLLNGMNENDIREWISKLDY

SEQ ID NO: 6658 - protein, 92 aa, B.fragilis
LSWNNSNSAWPLLYKKEHQRPITAKYTGLHCIKSKQPTIYKNELYKSVQSIVKKSFETLSFILCEICSDKHEIILNHLYALYILSLPIVIFM

SEQ ID NO: 6659 - protein, 105 aa, B.fragilis
IPNLLGVGMGFIQVYNGNLKYVATKDRKEVNMAGKNIHVVHNGDQWKVKQENAQRSSGNFRTQQEAFERAREIAIKNGQEVAIHGLDGRIREKHSYGNDPYPPEG

SEQ ID NO: 6660 - protein, 206 aa, B.fragilis
IETESHTFGSSLITLRIKRIMNLLIILGIIIILVIIIASMYNSLVKLRNNRENAFADIDVQLKQRHDLIPQLVDTVKGYAAHEKETLERVIQARNGAVSARTIDEKITAENQLSSALAGLKITLEAYPDLKANQNFLQLQEEISDVENKLAAVRRYFNSATKELNNAVQTFPSNLIANMFGFHKEMMFDLGTEQRANLEEAPKIKF

SEQ ID NO: 6661 - protein, 436 aa, B.fragilis
VRAESGSTLEERKNQVVRFRRDRPGGGATAGRCHRGEGHRDFRRRGYGRRLRLRRGCGRLGRLRGHRTSSLICIESYQNIFIHNLIFNQMKKIFLIGLAATAMLASCSNDETVEMAQSKAIGFSNAFVNNGTRSIVDPSFTSTSLEDFAVYGFTRAGQIFKGDKVYKESLESTPQWSYDVLQYWVPDNTYTFGAIAPYSVATNVFDVALPENATKVEMKVAFTNTDADQVDLLHAAPTQIAGTEVTETYATPVSMTFDHQLSKVKFSFENAVGEGYNVKVSNVRITDAYTKGTLTVTAAGNIWSAQADNNLILNFGNVVANDATADEAAVIANATTSESYNEKLMIPMAATATYTVTFTAELYHGDVLLGSYNHEVTIKNVEFKLGYCYDFKATLTSSNITDKPLNPIKFEVDNITDWNKTDIDKDLAVPTTQSGN

SEQ ID NO: 6662 - protein, 73 aa, B.fragilis
GQQDNFFLYTFVYAKYKMYTYNRLIINAMRRFMFPCAGTPLALPYQEFTKGPPALSPGRFREARNIRQGHGCW

SEQ ID NO: 6663 - protein, 887 aa, B.fragilis
NNILMRPSHFTLHSCRDAFSHFLLFTLVSGSICLSSCEDDMDRPSPSSHVSFTTEISSSRTPSTRSTTDTDTPQGTVTALQGGSTPLYLHTLYTDSIALPPSDSRPDRGVLTRATPIKDANMYESFGVSAYSYTGSWSEDKTPNYFYNATASKSDGGYTLSSTYYWPGSSYKMKFFAYAPTANTQYVLSGRTHAGSPTISVTIPGDVNDQKDLLVAKTDELAGNTNTAVALSFNHALTAIRFVCGDDMQVGTVKSVSLKNVYSKGTYHMGTQSWSNVGTPATFPQTLNKSITGTPDEPLTVDAQTFMMVPQTLPDGAQLEVVFTDNSSMDHTLTADLKGTVWPVGKTVTYKISSSSINWTYTLAVTSPADFTYEGGTQQYNVTSYRQNTKGVKEAVAWTAQYSEDGGASWSNTRPGWLDAFTVSGNGGDTPQSYNATVIAQTGVEANPQHTAALQNASVKGTETVPYNLANQTNGGTVDENTANCYVVSGSGYYCFPLVYGNAIKGGTTNTSAYTSTAPSGTTILSPFINHAGNAITAPYIRNNADCTPAKAELVWQDAPNLVTDIKYNNTGNGNISFTVDKNTIRQGNAIIAIKDAGDNVLWSWHIWVTDEDINNVIEITNFQGKKYKLMSVNLGWCDGSTTNYAERSCKVKFTAGGESQTITIRQASKSIVVGGNNPYYQWGRKDPFLPSNGLRDINKTWYDKDGNAHTGSPKTEDFSIGAPCITNYILKPDVMQSQDYGDNTYANLWSADNNVYTANDENVIKTIYDPSPVGFKVPPSNAFTGFTTTGNNTSTSSEINGTWDSSLKGWNFYTDSSKNKTIFFPASGFRDYSYGGALIVGSYGYCWSAVPSIQYYARNLNFNSSFVNPLNNSSRACGFGVRSSQE

SEQ ID NO: 6664 - protein, 87 aa, B.fragilis
RGVLPPCKAVTVPCGVSVSVVERVDGVREELISVVKETCEEGEGRSMSSSQEERQILPETSVKSRKCEKASLQECNVKWEGLISILF

SEQ ID NO: 6665 - protein, 67 aa, B.fragilis
ATLWETIMQPSAFLRDKVENSKNRLSEALTKLDGTVSSLHEASTISVSAKAKRTLEQGREATCQKKG

SEQ ID NO: 6666 - protein, 61 aa, B.fragilis
ENGRANRPCTEPEVHTQSKHNHPLRVIPESKPKNNESLEKSLPTMPVHLSAIIHSSPGKGG

SEQ ID NO: 6667 - protein, 171 aa, B.fragilis
KPQRMKSLSFRKDLIGVQEELLRFAYKLTANREEANDLLQETSLKALDNEDKFMPDTNFKGWMYTIMRNIFINNYRKIVRDQTYVDQTDNLFHLNLPQDSGFESTEGAYDLKEMHRVVNALPKEYKVPFSMHVSGFKYREIAEKLELPLGTVKSRIFFTRQRLQQELKDFV

SEQ ID NO: 6668 - protein, 744 aa, B.fragilis
DRFSIVYSGIIIHGIDDLPTGCKGLNVPLHSLTAVQANKYKTEEMKVHKKNPSWMAGGMATMLLCTLLFSCNNEDFLESGNPEKAGDNICFGISSDKNMQTRGYAGSDDEGYTADRFVLRSDDSADTLCVRAIVSDGINVSGFEGEQALTRGTLVGKDNFYNKFHVLAYWSKNGASIDQFYMNTNASNAAASVGTGAIWSTEQIYYWPGADHSFQFYAWAPTDAGGLITPSDPSSKELKYTVPADAADQKDIVVATTNEIPGNNNAAVPLNFKHICTAVRFAVGSQMQPGSIKSVALKGVKNAGTYDMVAGTWTLGDATVDFSQELNKETTGSEANGAEITSAEGTFMMLPQTLPADAMVEVVFTNANASGVDRTLTASIGNTEWKTGTTVTYILSITPEYELEFVSQPETQDAHYVIYPIAIKADKFPEGGWTLTSNDKENVTFVEKFADDGIKNLVDQGYWLKDYCGASTLTGSSFGEVPIYVFLKENISEKDREIVLSLAPANDPNAKPKTFTFKQHCPAWNNGIGVERIQGKDYPWGFNWSSDMKITYSMPSGLWSGIIHVLFEIFGDHSYVESSGLAVLGTWKVIVNFAKVPSLTIAISPTDGITNTWELYNFDGINEASIIMSQLESWGGVPDKELPVNPSEFVAWACAKKNRFGVERKSNSGETIYVPTLEQTDMVWYLPAQEEALYMKDDLSENYWTSTAITDPGTTAYTYTAESGSTSGMDRNEVIHVRAVRKKP

SEQ ID NO: 6669 - protein, 497 aa, B.fragilis
RGGSRIDRLPRSFYFRSYIGFHIIDLYILFLQKRISTHSFLTYMYTEIINKYNVPVPRYTSYPPANYFEPFTNARYLEAVQQSNQASERALSFYLHIPFCRHLCHYCGCNSYPMARPEIIESYVVALHQEIDLILPLLDKDRPIAQIHYGGGSPTAIPVALIKELNAHLLSSFPAIDRPEIAIECHPGYLSEKDWLQLTECGFNRLSIGVQDFNIEVLKTVNRRPSLLPMEDIFILLREKGISINLDFLYGLPKQTVENFTRNIKQAILLSPDRLVMFSYAHVPWINKRQLLLEKSGLPDNHEKQTMFDTAAGLLHKSGYQSIGMDHFVLPNDELSIAMQTKKLHRNFQGYCTRRTTAQVYGLGVTAISQLESAYAQNTKDIPHYIKTISKGELSITKGYALSPTEQLTREVIETLMCNGCIDWRDLSKRLHVSVSTLKAATAYDEKKLSGFADDGLIYYTDDYLEMTTAGSAFVRNVAASLDKLMLHSPHSYSKPL

SEQ ID NO: 6670 - protein, 71 aa, B.fragilis
RQIRPSKSSHKRYVIYHIVTKVKEQGGGPSLTPSFAQLKNYTKSLPKINLFINEKYLIKQSPSVPVAISDG

SEQ ID NO: 6671 - protein, 426 aa, B.fragilis
IMKRGKRLILPLLGTLILTSLFSCGVDRWPEYYPETGRDIWIDSVMRQEYLWYRDMSSPAAPDYFQKPEAFLKKAVASMDNGFSKIDSLLDEPIPSYGFDYTLYKVLDNDTAYNALISYVVPGSPAEEAGLQRGHWIMMMNGDYITKKVESELLQGSTRQLQIGVYKEVVGEDGEVTGGVVPIGETTMPASRSLVDKPVHRFEIIPWNGKKVGYLMYNEFKAGPTTDSQAYNDDLRRAFRDFQTGGVNEFVLDLRYNTGGSLDCAQLLCTMLAPADKMNQLLALLRYSDKRVEANQDLTFNPELIQSGANLNLSTVYVLTTNATRGAAEMVINCLNPYMKVVLIGTKTAGEYVATKPFVHPTDRFILNLVVCNVYNAEEKSDYATGFKPTYEYNEDSYLSTYLPFGNTNETLLNAALKIMSGITDK

SEQ ID NO: 6672 - protein, 203 aa, B.fragilis
ITILILKSMKKNFITVTPDSGTSGSSNTISVAAEPNILLKERSEILNFNASGGVSKSVQVIQNSMPYFPIRFPFVLNMNKFIGNLKVDSSGVLQGAYSISEIKSIDPSAYDSSLGEGWGMGSTQKMLIYDPFSNVTEIVAHIIDSSGTYDANFISSNANMGRIWGDPGLLYQKLLKIISEDYTKGGYEIRINSVLAMKFVFVE

SEQ ID NO: 6673 - protein, 388 aa, B.fragilis
SNIIIFMKKNLLFTAIAVAVLASCSNDDVVDVNNGSGISFRASLDKAITRSNVTNLQNLAAFNVTAIGNGANFFTDLSVTSTDNGTNWTTASTYYWPNYALSFFAYAPQTPGGTVSIDNTAKKITGFSPAQSVADQKDLVISYNTGTKGSNENAGVAMNFKHALSQIVVNAKCSNDKIKIEVLGVKLVNAAAKADFAFPEAVTNTGYTLPQGQWSNLSEKDDPSKAYMIRGDAPLTLTADAQSIMFGDNNLMLIPQQLTAWNGTVATAGAYLSVLCRIYSLDGGNETLLYPEPTSTDDKSGKYAFSAIGINTNWEPGKKYTYTLNFCGDGGGGGKIDPTPTDPTKPTDPTVDPTPIDGGSGGDPILGKPIKFTVTVDDWTDQPVDVPM

SEQ ID NO: 6674 - protein, 291 aa, B.fragilis
NDVMKLLYFKEHLSCINYQINVNTGFVYYNLEKDSVSKIDNSASPCILFLLDGEVSIDSGEYQNVHIEKDKMVLIPQHVDNKIEVIYDAKCLLLFWNKDIRVCDKVYMNSLSSYKERKKEMCVLPIRDPLQAVLNSVVAYLYAKMQCKHMHLIKQQEVLLVLRGYYTKKELFTFFSSILGNTGHFEDFVMNNYRKVKSVKEFAGLYCTSERSFNRKFQNCFKESPYQWMQKKKAELIREKISESDTPFQEIAMDFDFNSQAHFTSYCKRLFGMTPSKLRTESKKVAPDLEY

SEQ ID NO: 6675 - protein, 415 aa, B.fragilis
SNDMNHMRINKLSPLSRKALNLSTFFCLYIAQAIPMSFFSTAIQVLMRQADYSLSSIALLQLIKLPWILKFLWAPLVDRHCITLKDYKRCIITSEIVYALLILMVGLLDIQTDLYLIIGLVFLSLIASATQDIATDTLAVLSFGKSDKSLVNSMQSMGSFGGTLIGTGILLLVLQHYGWHVVIPCLCIFVLLAIIPLLKNKHMKIIPKEPSKRAQFTDFIWFFARRNIWKQIGFLLLYYASIIGILSVLRSYLVDLGYSMKEIGIMIGIGGTGAAFASSFLAGLLVRKIGRYHSRILFAIFILLTTLYFMCISWTVPSFSMLCLGIVLLWSAYGMATIVVYTTSMDCVRKGCEGTDFTIQTVLTHLSGLLIAFLSGVVAGLTGYHGLFIFEVILASISLIYIFYFFRKESQPIHS

SEQ ID NO: 6676 - protein, 283 aa, B.fragilis
KHIMKSLETMARYKKELTECARNLKLPFLAEHLDEILHEAQEKQQTYSEFLSTCLMRELRDKERRSYLTRLKFAGLPARYDLDLYDFSRTEGIDQRQMRELRELVWIRRTYNLLLVGDSGTGKTFIASGLIHEAVKAGYKAYLLTLEELLVCLKAKEISRPAMKTYKRIMKAQLLAIDDVTLFPLKGEDVLLLFKLVNCVQGKTSLIIAASRDLTGWLEMAGDEVCAAALLDRLLYCCEIIRLLGKSYRMENRKTIFSNQQIGTAPQKGLMKVKKRTKESGYC

SEQ ID NO: 6677 - protein, 594 aa, B.fragilis
LTAMKKEIKFSLVYRDMWQSSGKYQPRVDQLVRIAPLIIEMGCFARVETNGGAFEQVNLLYGENPNKAVRAFTKPFNDAGIQTHMLDRGLNGLRMYPVPADVRRLMYKVKHAQGVDITRIFCGLNEVRNIIPSIHYALEGGMIPQATLCITFSPVHTVEYYTAIADKLIEAGAPEICLKDMAGVGRPAMLGQLTKAIKERHPEVLIQYHGHSGPGLSMASILEVCENGADIIDVAMEPMSWGKVHPDVISVQAMLKDAGFRVPEINMKAYMKARAMTQEFIDDFLGYFMDPTNKHMSSLLLKCGLPGGMMGSMMADLKGVHAGINMILKSNNQPELSIDDLLVMLFDEVEYVWPKLGYPPLVTPFSQYVKNVALMNVMARVKGEERWSMIDNNTWGMILGKSGRLPGPLDPEIVALAKEKGYEFTDEDPQKNYPDQLDEYRKEMQENGWESGPDDEELFELAMHDRQYRDYKSGVAKKRFEEDLQRAKDAALAKQGFSEEDVKRMKRAKAEPITAMEKGRIIWEIDVESPSMPPEVGHKYEPDDVFCYIATPWNTYDRVLANFSGRIIEVCAKQGALVNKGDALAYVERCEEPA

SEQ ID NO: 6678 - protein, 152 aa, B.fragilis
MSQIGYKSSETSVVYIITKTMPYFNGQLHFFTFTLHIQYQSLKLLNMKLDENILKTCQGLVMNCNCKVLILNVLGEHRVFLVNDVHLKTRECRYNEVRDAQDITTLVLNIGHNFANGMTEQTLLERTQSIHKEDFKFGTDNYLWITKVDLNR

SEQ ID NO: 6679 - protein, 772 aa, B.fragilis
YNKMNNAKLLHLMVYILTIILGQSCTEVDITMPKGPKGDRGMSAYEFWKENVENGVISWPKKETEITDFFKYLKGKDGLDGKSAFELWKEEVATGALDNPHRPGSMWPVSQNNLRDFWYYLTGASGENGQTPHIGNNMNWWIGNKDTGIRAQGRDGQNGEDAVPPVVTIGDNGNWLIDGVDTGKPSRGEEGVAGTTPTVTIGENGNWVINGKDTGKAAIGKDGRSPEVIIGTNGNWYINGKDTGIRAYGKDGANGKDGINGKDGANGKDGANGKDGINGKDGAAGKDGANGKDGANGKSAYELWVESVEAGCNNTGPKVKNPHNPSLDWDCGKTTLSDFWEFLRGADGKDGADGKDGKPGVPGKPGAEVTIIKGVPNVIALYSQQEFGEYVRTTDGGVAYRVYDESGNKAPKAVVKGIPGLDPAKTYTANEEGEFIIPKEDLPQIDDIDARWGKVKEVTINKVTKESAENTYVPNRMQIRMIYIATSPYLDYEHNLQFRVERKTDPSAEWKTLPSYLPNVNAVFTAYQVTNPEDPTSLDKTKKIESTTPNMSSTSMSINPNRYVKENPAGIKNGITDFWDGKDNYFSIVKDTPYYGETIYWNGVCKMAPYQIPPTLKTLALTKASAESGDDVFLNKAQGEFDFSTIDFNIICKHELVKTVKPNGIDYIEPEYYAPEEAKELLLCYVKFTYTSPLGVQTATSELNMSSYKKPEYAALSPYLGATIYSVGASSTFIYSSNVSLGVLKKKADNGTYYVENTYKDMPEISVTYKEK

SEQ ID NO: 6680 - protein, 182 aa, B.fragilis
TSPICFTAVTWSHTVAERSTETDVIPVTMHPMVFTYLVRYEFSHGVEYVSLARGALAGMAQAVWLNSGHTSDEAATVLYDCTVEDFGTQALVRSFGIPDFPNEHYGTRAERKYGLNLEVRLKNGKIKSFDFDVTDQVVAQPQGGVIVVKGIEISDEEGTEGGSGFDVDVDDWGDYEDIELPL

SEQ ID NO: 6681 - protein, 86 aa, B.fragilis
RYEIFIIVSILQKAMTAYDLKNIASAGGNIVVNAEDFSAYDLKNIAENGVATKAKLTIKNAGGLSGYDCKNIASANPGNVTFDFSE

SEQ ID NO: 6682 - protein, 234 aa, B.fragilis
TLWIIKGSALILEESPIQQKVQTRHSGQPISSGLFICVFVQAFGDAFEFTQVAVHFLCNNVISHWLSEKNSKNFAIMKKYFVLSVFIMLIGAFTNVQGQNSATPDKGVLVHGNVRLCNYERGCLITDNDMKHWTQKLEISYDGSDKTYGIYINVRGDIINLGVKYKSSGTESYTYEGTDRVTGRKVVVVTKQKLSWYLNNNGVDSHTEVESPKGIIVTVPATYTVFSVVPIKNK

SEQ ID NO: 6683 - protein, 282 aa, B.fragilis
NNHFIITYIIMNKVFLFLLFSFLTITSMAQEKIKQTAGRDQLGDFAPKFAELNDDVLFGEIWSRTDKLSLRDRSLVTITSLISQGITDNSLTFHLQSAKNNGISRTEISEIITHIGFYAGWPKAWAAFRLAKEVWAKDTTGVDAKAAFQREMIFPIGEPNTAYAQYFTGNSYLAPISHEQVNISNVTFEPGCRNNWHVHHAKKGGGQMLIGIAGRGWYQEEGKPAVEILPGTVIHIPANVKHWHGATAESWFAHLAFEIPGEDSSNEWLEPVTNKEYNRLPQ

SEQ ID NO: 6684 - protein, 61 aa, B.fragilis
INTVPSSLLTLTARKNGQHDTECKKTCRTAERFLEHGTVYEPGIGHTGADESRQKKNELFH

SEQ ID NO: 6685 - protein, 74 aa, B.fragilis
YLYVAPDHIKLNLQFKNGFYHLKKQDDGWLTTEINLVPFLSVKFLTALLFIQKLFYFQELILSNGCKALKTQSN

SEQ ID NO: 6686 - protein, 636 aa, B.fragilis
TFNVIFSMKQMMKKYLYMAAVAVVGTGFLMSSCKDEFAGQNTNPSTVSKPNVRYLFTQCAMSFQPADYLQWFAGFDAMSTWVQATASGGGNSSKLNMVTQTGCGYQVNEVLRYTNEIKHQISLMSDDEKAKYEYIAYLCNPMLVYLGLEDSDMYGSRQYSEAEMARYGGTLTPKYDTQEELFELWLKQLDETINYLRENNPQDVLGAQDFIYRGKLDKWAKLANSLKLRIAARLINKDKARAIAIVNEAAQNPAGLILTLDDDFVFNKGKRDNNWNNDISVGAGTKQLIDFMVSNRDPRLFYFFQKNDYNSNVVQGFFDQKRALPSYVEANVNYTVDADGKKHFESWKAPGEPWVRYYGVPCQVDINKKEEYKDYFDPNNELFYLLSKDGAKKTYTPIAYRNTENIKGLLIYTFPDVPDVAPVQDKEEYGWYGLYFSAGETNLLLAEFKLLGANLPMTAQQYLSAGVEMSVRGYDFVSAKNHIPYYDKTYTGDVHDKTISLKEGMIDEMLSHDAYHLTGDLSKDLEKVYIQQYIHYLMLPMDMFVTARRSGVPMKNSTLLPYQDFDPLLGDQYVIPRRFPVSKPLDSDLLRDITIAAYQAQGYTYEGEMSNSPVTLSKERVWYDKEAPAFGTGPQQ

SEQ ID NO: 6687 - protein, 124 aa, B.fragilis
EVAVYDNLPVYKAAYDLLRSVYEKTGKIPRDVKYTLVEVLKKDLTEIMVMIYRANATTGKLPYIERARDLVVGVKVRLRLLQDMRHISVKQYAAFAQQVELLSKQLSAWHDYARRQDAKSQEKI

SEQ ID NO: 6688 - protein, 584 aa, B.fragilis
  UNSURE (1),(584): Identity of amino acid sequences at the above locations are unknown.
XTLFIILFSLGYSGIYSQEQQVKKDSVYQLQEIVVSSQQILGSKFKARNRTGSAYYISPEEIRRLGYTDINRMLKAVPGVNMYEEDGFGLRPNISLRGTKAERSERISIMEDGVLAAPAPYSAPAAYYFPNVARMEAIEVLKGSSQVQYGPFTTGGAINLVSTPIPNSFSGKANISYGSKNTFKSHTSVGSSWKHFGYMVEYLRYQSDGFKKYEDHAAKGFKRNDIIAKIRVKTDHVKGVNHALELKFGYADENSDETYVGLSADDFKKTPFLRYAGSQMDKLKTDHRQWVATYLLTFSNKLKITTNAYYNYFHRNWYKLNDVRAGITSKEKRSIADVLVDPETNIRYFDILTGKTDREGEALLVRANNRTYRSRGIQTRAEYRFNLNEFFFDLEFGLRYHADEEDRFQWDDSYSMKNKKMVLFMEGIHGTNANRVTSANALAGYLLAKLRYDAWTVTAGLRYEDVDLLKKDYTKEDLARSGKVRIETPNHARVLIPGVGLHYQLMPAASVFFGIHKGFAPPSAELYQKPESSVNMELGTRVAIGNFRAELIGFYNNYSNMLGSDLAASGGGLHHGAARSRAVX

SEQ ID NO: 6689 - protein, 61 aa, B.fragilis
CRHACPSGRGGPGDGVCPALGTGSGGDYPGGGTGGCDGGGEDLFCCRFSGVGRREWKGGLE

SEQ ID NO: 6690 - protein, 383 aa, B.fragilis
VLAYQDILREKDLCGTLCYSVVKHPFNHKIFPTMSDKFQTFCFSHSGSWFLPFLWLSLLAGLSACSWTGDDRSDCPSGFRIRLQPALHAQIQPDSGTGVITDEIDTLSLYVFDAQGQFVCLHTENRQSLTENDYIITLPLEYKDGDVYELVFWAGGDNRHYRMPQLTPGSSTRDELTLRLERDGDGRQDDELGHLWYGHLRLSRIQPSELTSVSVPMLKDSNRFVITLHDTSGQGLDADDYDFTLLADNGRMNADNEVMTGDRVTYAAYHTESASETEPAATRTGEVSLARARLNTLRLLADQEARLVVTDRVSGQKVVDVDLTRYLLMTRPLFEESNGVELSDQDYLDYEDRFNVIFYLTPMGKLEALNINGWIIRLNDAQL

SEQ ID NO: 6691 - protein, 292 aa, B.fragilis
RKKEMKKLKYMSMMGLAALLLTTWAACSDDTDASGGENPEEARAYTTVTIAVPNGVAETRASDPTADTDDTNMDIGLTDEYKVTKANLYLFPGGTGSSFGSAKLTEIISISQFTQTTTTTTDQKTIVWTSKKTALTPGDYRIYIVVNGTVNGVGDSDKGTLTEAAFLAKTTAAATSVIAAVPSDGLVMASRSPNSNNSNTLPYIAQEITKDPEQTIAATVERVMGKITVTAGGTSASSAATVNKYTSFSTTVAQINNIKDITLKTHYVVHAGKEGYYFRHVDKESSATNPLT

SEQ ID NO: 6692 - protein, 250 aa, B.fragilis
QIRERMIKLILPPPVLANSYGNWYLQGSSAFGLSSFGTFSGTYTDMPGYSSGAVETKVAAYCYENTMLKDKQKNGYTTGIVFKAEIAPSKMMKKRSSGGGVEETTTIGSIGEIFYHSGIFYKDIEALKEAGVLLADGTTSSSASGVPADLKKNDVQCFKKGNTDGKFFCYYPYWIKHLPSDTAEDVMEFGIVRNNVYQVTVASIQGVGKDGVTENIITDTETDDPTTVLLNVKLSIKPWVVRANSAVLGR

SEQ ID NO: 6693 - protein, 495 aa, B.fragilis
ISGSEQEKFSGADPCGHQSDLYVKIKSLMKEKIRSTRLRMCFRKMPPAVCFLTLFALCFGALSVRAADPSGRVALSAVRMQRAGGQVYVSFAVKIAPRAVRARHRWVITPCLGNASDSVLLGPFVVTGRIMAREENQRRLLAGLPDRDVNHRWTARNGDTFLYTDTLRYAPWMENGLNLRLDIDREGCCRVQTVGSIVSSGAFPVALPYRPSVSELTPRVSRTVAEHADDYPFLCEAGSRPLHESGIGIRFRAASAVVDTLYSANAGNLRRITEAIGLLRADSCAFLQGISISGYASPEGTTGLNRKLSAKRAEALRHALSVRMNLPVSLFELNAGGVDWDRLAELVNGSDMTYKEEVLAILRSHPEEERNDRLKALAGGRPYRSVLDVLYPQLRDACYIRVQYANRPDSVADTVNRAIEAIRGRKYEEAFRLLKTVEADERSWNVRGVCHLLCGDDKEAGLWLHRAVKAGNREAEENLKKMNAERRAATIGITQ

SEQ ID NO: 6694 - protein, 112 aa, B.fragilis
APLLPLSSHSTDTFLGVHAGGGESNLSRVHLLFVSRWVSSRYEGWALMPGFSSGYSWVLGKRWNLEATIGAGWVHAQYKRFNCPVCGEYRGANKKNFLAPTRAGISLIYMLK

SEQ ID NO: 6695 - protein, 344 aa, B.fragilis
RTASPFSPSGTASVNGRSMKSSEDSKRSVRSMQYKCRPFFVFMGKTEEFCCPEIQTHILHDKMIMKKEKTYSRAPLPFVGQKRMFVSEFKKILKHFDDKTIFVDLFGGSGLLSHITKRERPDAVVIYNDHDNYRERLENIDRTNTLLRDLRKIVGIYPRHQKITGKMREAFLERIRLEETTGFVDYLTLSTSLLFSGKYAQNMEELEGLYFYNKIRQSDYRCDGYLDGLEVVCYDYKELADTYGVFPGVVFLVDPPYMGTDISTYKMDWKLADYLDVLLVLKGHPFVYFTSGKSPILDFCRWMEEHPGIGNPFKGAGRSTLTARMNYNSSYTDIMLYKDLPRAA

SEQ ID NO: 6696 - protein, 87 aa, B.fragilis
ARGTTTYIQFITLSAHSMVRATTVAPSLLFKVIPVQAPAGICGTLHKTDINNADNFVFILSILMVVYGSVTHSIPERLITIESNYSF

SEQ ID NO: 6697 - protein, 145 aa, B.fragilis
NLKTHKEVTSNKSKTLDFVISKTMKIFRYILLASLTCTLFSCGPDELIPESVPPVVNPGDKDEPGEEPEEPEEPEKIQLAITASLQNMQQTRGIIEAFAPGHEMGVFVGTSQTDEAAGIKNASYLFDGKVWNAGQDVPVEADAGL

SEQ ID NO: 6698 - protein, 116 aa, B.fragilis
HTDAHHRTTGGKYPCRGMRFYLYMNDWLCKDKKIFAMTLFEILNFNRELLERLTRMGFKPDDYKYIDLYKEYEQMRRQGDKVTYCVAVLSIRHGVCERKIYEIVGRFKKECTLHAV

SEQ ID NO: 6699 - protein, 366 aa, B.fragilis
TTIKIESMNTKLSALLMSVLCSVPQIPAGACTGITLKSKDGATVVARTIEWAESVMNCMYVVVPRAQELQSLTPSGMDGLKFRAKHGFVGLAVEQKEFVVEGMNEKGLSAGLYYFPNYGRYPVYDAAQRDKSLADFQLVSYVLAECSTVDEVKEALSQVRVINIDPRSSTVHWRFTEASGRQVVLEIVNEMMNFYDNPLGVLTNSPGLEWHWTNLNNYINLQPGTLPEHNFGPLEPKSFGHGSGLLGLPGDFTPPSRFVRATFFQLTAPQQPDAKGSVFQAFHILNNFDIPTGSEQPWGKASANVPSATQFTVACDIRDQKVYYRTMYNSNIRCIDLKTINFDNVKYQADPLDETKEQPVEMKVIK

SEQ ID NO: 6700 - protein, 62 aa, B.fragilis
KVTKLNQIALLYIPTLCGLYTSFVAFVVLQHSQSANHRTVYMANGKENVKRNRMKGSDKTKY

SEQ ID NO: 6701 - protein, 141 aa, B.fragilis
LNKKKLSFLFLKVIITEAIKQLFSSHTFQTLSLESRTLLDEYNFTKSMIANLLDKQEKLYLVPSTKKENELLAGIILNDEIIYLLKFSKASDNIYTLYNETNEPICDVKYDFEKQNIVIISNYGNDAIPPTTQVGTVLFVI

SEQ ID NO: 6702 - protein, 271 aa, B.fragilis
SRRCKRMKTITTACVNHKGGVAKTTSLLNLAAGIARMYKKRVCIIDADPQANTTMAAFGEEMASLPREVLLESALQDCMQDTPPELKPQKWLEKVDILPASLDLAATEVIMYTTPGREFLFREIVKGLEEKYDHILIDCPPSLGIITQNALMASDYVIIPTDGNYFAMKGIEKIHYIIGLLKRKLGAEVRILGYFMTKYNARRKLDMDIRESLVRSLGDGVFETVIRSNVALGEAQYKAQSIFDYAPSSNGADDYRELVKEFLGRIKKINK

SEQ ID NO: 6703 - protein, 97 aa, B.fragilis
KKGRIMKDFTSKGISLENMVGETPGKEKGMTGKTSPKTNQTVALTEDLKWELRTFASDHRCRGVKTLLETMIECFVREDGTLDRDKLEGFWREYVEK

SEQ ID NO: 6704 - protein, 522 aa, B.fragilis
LYTMKKISILIAALTLSISLKPLAAQNKKVFIIDKQTVYQEIDNFSASDAWRCAFIGKNWPQEKKEKIADLLFKREFDEKGNPIGMALTNWRVNIGAGSYENREAKEVDNSWNRTECFLSPDGKYDFTKQAGQQWFMKAARERGMNNFLFFTNSAPYFMTRSASTVSTDQDCINLQNDKFDDFARFLVKSAQHFREQGFHVNYISPNNEPNGQWHANSFQEGSFATKADLYRMVEELDKAISEAQIDTKILIPEVGDMKYLFEIDSIAKIPDDIIHSMFYKDGQYSVLKFKNLFNCVAAHDYWSAYPATLLVDIRNRIHKELSANGHNTKFWASEYCILEKNEEITMPASPERSINLGLYVARIIHNDLTLANASAWQWWTAVSLGEDVPIQLLPLEGSNGLSLQYDGEISTTKMLWTTANYSFFVRPGMKRIAVKPTYKVSDLEAATSLMISSYTDGKEVVTVAINYSKENQVISLNCDHAQKGKVYLTTIDKNLRYMGEQPLKKLQLPARSVATIVVEDN

SEQ ID NO: 6705 - protein, 73 aa, B.fragilis
SVFVASMKRQGVEVHFRHMEQSNKLQDIVFTMDSYHFNGSKVGRRFSYSKFGTTLFSWAVPPLFASGSLCCRI

SEQ ID NO: 6706 - protein, 422 aa, B.fragilis
KTKVRFLRAWRYYMMVTAYGDIPLVTEVVPSLEDAKLPANPETDVVEFILDELNDITKDGALDVSPKQKGRITRGAALALKVRLCLFYKKYDEVIDAANEINSLGVYNLYQEGEVPYSELFKEANEDNCEIILAVKKVMNDYKNQTIIEFCNVIDGGWSAFVPIQSLIDAYEMKDGLTIEEAQAKGEYNPEHPYKDRDPRFYATILYSGADWMDNKGRKRIYNTLDRNINGEPNKDHRLDSRNASQTSYSICKYMKPLTQYSDINNTGLDMIVFRYAEILLSKAEAMIEKNTDLSGATDLIDLIRERAGMPKVDRAKYNTQAKLRELLRRERRVEFAFEGLRRDDIIRWDIAKDVLNGPIYASNQGTVDMDTSIPQEERATIFQGEKNQVVLEIRKFRNRYMPIPQAELDKNPNLKQTNFKI

SEQ ID NO: 6707 - protein, 81 aa, B.fragilis
PVLSLHLCIYYSFSYSKYHSVFPKDTNHIKIPDSRHGHRGGINKWTYLFIKSSTRPMAYQPDGDRGQNLNPILNVGAASTL

SEQ ID NO: 6708 - protein, 152 aa, B.fragilis
INKSIYLYLPGVRDGCRGFLCDWYLWERLNGIWNMKKSNIYIGEVIKQVIAEKQVTKAELARRLGVKPQSVDYLLTRKSIDTDTLYSLSLALDYDFAVLYSIKKEHALATDEESPFKVGNAKISLEIELRPDEMLKLNLKQKIADLLEGKGK

SEQ ID NO: 6709 - protein, 749 aa, B.fragilis
RRYLPPAINFVSNCITIDTKLLSEADTGSQLHGKRTNITARHPMTVIRCRIFFVHQFGPGNASFSPGLIQEIDNRGTQRKMLVHRPVDTSEGFPASVEIVSIFNVGIRLAEVAEAGPDSEIIRDVIAGIQFDKHFRNLRHNIPCGIDLPHRTVFKGHTRFILLVSRTLISEEEVEVEALKRLDHCIRRPADGLDVITQRGGENLSLVIRINQVQCRVVIRLRDIREQRGQTDPIGVIIDPGTSQGNRDFIGIGHSGRCKVRQAGTLCVVSEIGGKTKFTGQLISSGGSKGHVHPVVVEKTGSDPDSFIGHSSQVIIRKTAYGIPFGIVYSRIFTFQVLPFQTGAIIHVPLGRNIPIVSGINSQFVFMSFIIFRSILIEIVIYTICIPFTYQTFGILLYRMIVHGSIRSIIHLIVPFVHSDSPGRITIGTGEFGGSEKLIDFSPVKARHAALHISFIRFQCTVYRFQVVTGRGIFLFHGHWSLVDIRAQGMIILQIDLPVQAIIPGVRVEQGQLVSFIQSGIIKIGLLQFTRTHVTVGHFARCRQIGTCSEAESRYFFHATVAYIDERGGSHFVAWPTAVAVVIDSRQLSASFIIILGQGCFIDLSTVLIRCKTQFETARIKILVNASTVEPSFPHTTADISIELLLAKVIGTIIDDSTKLFCSQLGKRVYSITDIAGSNGGFGDFEQPDVPETAVSTPVRIYIMRIRGIDYGESVFEYIYVSTWQADRDFAGTIGARSVQHNITIAFFL

SEQ ID NO: 6710 - protein, 136 aa, B.fragilis
VKTEYNDALAAVSGDNATAYANLLTAMDNAVKARVETLIAYYKADHNYSVQNTLAYTLQTIADGLADYDQLILVQKQAIAAADENIANAASVVSKEQAIANQEKTIADLENSLAVNEPIYNDYLAQIKALVGDSAE

SEQ ID NO: 6711 - protein, 261 aa, B.fragilis
KKYRMKIKRLLVLAVLPMLCLAVNAQNSSKDNTPKKGDFTVAATVGYNSYTSVTAPSGLLTDYEVRALSTNWADKKLMVGFEGGWFFKDQWKLNLGGGVSFTNNPGYPAVPGTIDDSNKNNSADENMGEIPNYRAVADAQSFAYNVSAGVDRYFNIKRVPNLMWYTGIRVRFAYGENEMKYDEETSMGKSIAESWNLRGALTIGVDYFVFPALYIGAQIDPFAYTYNKTTYNPQAGLGDLSADSHNYSVLAAPTFKIGFKF

SEQ ID NO: 6712 - protein, 265 aa, B.fragilis
KYHVIMKTTFMNVSRGVIGALAFSLGISSCQSSQSKMTFEQEGDSLTVIHITNPTQYLLLPVEEKTPEAQVCIASDSVPVDMDVRLSREKVDYFVPFALPKGEKEVAVRIRHLPKEALCWKELKLSDTFDTTNTDQYRPLYHHTPLYGWMNDANGLVYKDGEYHLFYQYNPYGSMWGNMHWGHSVSKDLVHWEHLEPALARDTLGHIFSGSSVVDDANTAGYGAGAIVAFYTSASDKNGQIQCMAYSTDNGRTFTKYEKNPSSPR

SEQ ID NO: 6713 - protein, 790 aa, B.fragilis
NKSFSWEMGFRVPLRHQNNLNQLKNLSTMMKNQKRAVCLLACLLIAGFTAAQEKKESAQTASGSKEEGNRNVMLNASSANGPREISIGLPGGDVNVLENGLPVVYTSNPHNVNTHWRGDSSLGHVGLLKISETAITTGNIGYAVNSFTQLGTEKFRGIVNYSTNHFGKQQFDANISGGMGKGWFYSGSVYQNFDPGSFKLRFTSNQDRTQIYKAALTKNYNEGRGQLSAIYHYSNSRWPSNEVTSAPFIYVGDGSVKEIPGFSLGTSSYLPTTGEMAYRDMRTGELKETNLYDATLNKGNQLTLLNTYTWDNGLNWKINLKYDHALGSYVYQTPMAMEQKDASAGYYLKAVDGTLKPYEGYVQSRMSCLNRGKIDEFFATSELSRSYRNTTWRIGVNEWHYKVDYASNTTMYDHTVEEYPERLVREGNTDGVYYDFNKNASEYYKGHENKLAVYATHDWDISPKWNVYYGARLEWQHLEGENAAVYDAEGNAVGRFPDYYLGAVSDKGVRITPRLFDYDWMNMAFTAAATYKLTREFGFTADFTYNTQRPGLSNFAPATMPNTDKISVPLGRAGIYYNTDWISLTSLFSYISKTNNNSTLNLINPNDQTEILAAPLSYDIQTIGWTTDAVIKPFKGFNFHFLFTYQSPTYKKYETSVTFKDGTVGEIDATGNIVTEIPKVLVELDPSYNITNDLRVWASFRYFSKTYANIKNAYYFNGRWETFGGINWTVNKHLALSATVINFLNQTGAKGSIAGTELVDKKDAASYNGHWMAGSYIRPFTVELAASIRF

SEQ ID NO: 6714 - protein, 127 aa, B.fragilis
IRSTPKAISSQYLYQIFRYDLLLVKRRESWPHFPCSYYFPVVVNLPDFDFKHQLPSLNYYPLNPLGGKILLKCSTSRLFRSSFARNINPLLEKSRCQQTPTVKTLFYRTALTIRLAPGSWNNPYTLC

SEQ ID NO: 6715 - protein, 400 aa, B.fragilis; identical to SEQ ID NO: 5316

SEQ ID NO: 6716 - protein, 73 aa, B.fragilis
RPRENNRSMGNGAMTPSFLLKVGRIEISGKGIVKKSPWGCCGSILSNMYQIRDFNGALLTMVVFLETVDGRYS

SEQ ID NO: 6717 - protein, 417 aa, B.fragilis
PLIFIMKNSKIYPWIVVALLWGVALLNYMDRQMLSTMKDAMQVDIVELQSATNFGRLMAVFLWIYGLMSPISGMIADRLNRKWLIVGSLFVWSFVTYLMGIAETFNQVFWLRALMGVSEALYIPAGLSLIADYHTEKSRSLAVGIHMTGLYTGQAIGGFGATVAAAFSWHTTFHWFGIIGIAYALVLVLFLKDKKEHVKTERLKPSSKNGEKAGLFKGLSLLFSNIAFWVILLYFAAPSLPGWATKNWLPTLFAENLDIPMSQAGPMSTITIALSSFIGVILGGTLSDKWVQKNIRGRVYTGAIGLGLTIPSLLLLGFGHSFVAVVGAGLLFGIGYGIFDANNMPILCQFVSSKYRATAYGIMNMTGVFAGAFITDLLGKWTDGGNLGLGFAMLAIIVFIALAVQLYFLRPKTDNME

SEQ ID NO: 6718 - protein, 149 aa, B.fragilis
TVVIPSFAEIKYTFESMYEYNQCRMYKGGKFDMLHGQDKTILPCLAMGGPQGGIGGTANYNGVNLVGIIEAWKAGDLEKARELQNFSQEVINVICHFRENIVGGKRIMKLIGLDLGKNRTPFQNMTDDEEVRMKPEPQAIHFFDRCNKF

SEQ ID NO: 6719 - protein, 150 aa, B.fragilis
KEMIVSNLQNSQRVEGLHPLFKTLFDYVKTHDLFHAELGRIEIDGDNLFINNVNPECVARDKQVLELHRDYIDVHILLEGTETIGWKAIEDLKDEVKPYEANGDCALYSDAPTTFVDLLPGQFMIVYPEDPHAPLIGQGKIRKLIAKVKL

SEQ ID NO: 6720 - protein, 698 aa, B.fragilis
  UNSURE (668): Identity of amino acid sequences at the above locations are unknown.
TSLLLTQKAILMKKTIFLILCILCSLGAMAQKKSITGVVTDASGESVIGASVVEVGTTNGVITDIDGKFTLSVDPNGKIRVSYIGYQPQVLDVKGKNSFNIKLKEDSEMLEEVVVTGYGGKQLRTKVTNSIAKVKDEALKVGLFSNPAQALSGAVAGLKVTQASGSPGAAPKVTLRGGTNFDGSGDPLVIVDGQLRDGMQDINPEDIESMEVLKDAGATAIYGARASNGVILITTKTGKEGRREINFKAKMGLSYVNNPYDFLGAKDYINVLRTGYSKSGFTTSDGEYVSIAPLGNLTSASPFGTGNTLNDKTIWNIMNKTADNAYLLQKGWQEMPDPLDPSKTILYKDTNPADYNLNNPAISQDYNINMSGGNDKGTYYAGLGYNRQEGLPIKTFYERYSFVLNASYKITDWLTSSSNFNYNRANWKNMPGSQTSEGNYFGRIMSTPPTVRFQDEDGNPTLGPVAGDGNQNYQPDKWWNFNQSDKFTMVQAFQIDILKNLSVKGTANWYYSESLAESFTRDYENTPGQFVRTRSSSASFSRDFSQTYNVVLNYNQTFAKDHNVAVMLGMEYFDRYSRSFSASGSGAPTDDFADLSLTDNGEGKRSIDSGHSDYRILSYFGRLNYDYKGRYLLSAVFRQDGYSSLLGDNRWGFFPGVSAGWIFGQENXVKNALPFLSFGKLRASYGVNGNSTGIGASS

SEQ ID NO: 6721 - protein, 73 aa, B.fragilis
SLRSIGLKPRPLSFETNGTLVLKVFSRWYNTIYQHIVSETFAKAGSSVRILITDKKNYKPTSERCVETLFTTE

SEQ ID NO: 6722 - protein, 329 aa, B.fragilis
RKNKKMGLFIKKPFEALLAEANASGSKSLKRVLGPWSLVALGVGVIIGAGLFSITGTVAAGYTGPAITLSFAIAALGCCFAGLCYAEFASMIPVAGSAYTYSYATMGELIAWIIGWDLVLEYTVAATTVSISWSRYLVVFLEGLDIHLPQALTACPWDGGIVNIPAFLIVVLMSIFLIRGTEGSSIFNGIIVFLKVSVIAIFVVLRWKYINADNYTPYIPANTGTLGEYGLSGVLRGAAIVFFAFLGFDAVSTAAQETKNSETEYADRYSGITLGMYRTLYACCPRNDRSSPLIPNFNGQKGIAPVAIAIRTHGTCRCNRASFTRIIPW

SEQ ID NO: 6723 - protein, 116 aa, B.fragilis
KWIEEARALGDTPEEKELYEWNARVQITTWGNRNAADYGGLRDYAHKEWNGLLKDFYYMRWKLYFDFLSQRIEGKTPAEIDFYAIEEPWTKAANPYSAEAEGDCIEVAKQVMQAVE

SEQ ID NO: 6724 - protein, 202 aa, B.fragilis
AMTDYFPPFFSHINEKFRTPARSNLLFMLIVGLLAAFVPARLAGEMTSIGTLMAFTLVCAAVLVVRKTMPNVPRSFKTPFVPLVPILGILTCLCMMLFLPADTWIRLVLWMLIGLDIYVGYGMKHSKLEHGVKNRRGQSALNMIGIALSLLCVITGLWHQQTVGWNESKILLIISFVFAFTHCAYYMMRIWKGTTKQTNDNG

SEQ ID NO: 6725 - protein, 432 aa, B.fragilis
TLCCAPFAMQAQQPQIYTLKSCLEYGLQNNYSLQIVRNEEQVSRNNATPGNAGYLPTLDFTAGYKGTVDNTNTKVRATGESVKENGVFDQTLNVGLNLNWTIFDGFNITANYQKLKELQLQGETNTRIAIEDLIANLAAEYYNYVQQKIRLQNFRYAVSLSKERLRIVEERYHIGNFSRLDYQQAKVDFNADSAKYMKQQELLHTSRIQLNELMANEDVDQPLVIEDSIIKVNAGLRFEELWNATLLTNASLLKAEQNNTLAMLDYKKVNSRNYPYLKMNTGYGYTFNKYDIAANSQRGNLGANFGVTVGFNIFDGNRRREKNNARIAIKNARLQREQLEQGLKADLSNLWQAYQNNLQMLKLERQNLVAAKENHEIAMERYMLGNLSGIEMREAQKSLLDAEERILSAEYDTKLCEISLLQISGKITKYLE

SEQ ID NO: 6726 - protein, 446 aa, B.fragilis
RPVWRNVLDKLGYTKTEINEFISGPGFFAWWVMNNLGGWGGPNPDSWYTRQIALQKKILKRMREYGIEPVLPGYCGMVPHNAKEKLGLNVSDPGTWCGYRRPAFLQPSDPRFEEISSLYYKELEKLYGKANFYSMDPFHEGGNTAGVDLDAAGKAVMKAMKKANPKAVWVAQAWQANPRPKMIENLKAGDLLILDLTSECRPQWGDSTSEWYRKNGYGQHDWIYCMLLNYGGNVGLHGKMDNVIDNFYLAKADPHASATLKGVGMTPEGIENNPVMYELVMELPWRPDRFTKEEWLKEYVKARYGVDDPVVQAAWTNLANSIYNSPKNLTQQGTHESVFCARPAEDVYQVSSWSEMKDYYRPQEVIEAARLMVSVADRFKGNNNFEYDLVDIVRQALAEKGRLMQKAVTAAYRAGDKQLFALASGKFLDLILLQDKLLGTRPEFRV

SEQ ID NO: 6727 - protein, 301 aa, B.fragilis
KCISMKPYHINKKQILIMGCLGMFPLFSSAQDILSTSGTSRWDYSNSRVEREPGRDALDITFSVFPLAGLGSQEVAYLFPVYVSADGRDSVRLEPVCVAGKRRYKVIKRRKALGNLKPGNPGSGEVRSAKVLESSGLTVKRSVPFERWMADGRLVVREVSYGCAECGTNESEDIAFQAGIPLFGEKDYAYSFIEPEKVMIKCYKDSFDCKVVFPVARHDLQEDFAGNAQELDSLKKFLSENMNIQGTSLKEVHIKGYASPEGSFDYNRSLAQRRTQTLSDYISRQYPALSSPRGWKNPRWR

SEQ ID NO: 6728 - protein, 72 aa, B.fragilis
LTGPDRERYQLKFFSSRLDDGRRLSTPKEAFTTDNFTIPGCFCKSRLGARGGIIQEKKGTPYLANLSYTVFN

SEQ ID NO: 6729 - protein, 999 aa, B.fragilis
FMNTLQKTAGAILSLSLLCGMQVYAFPDYPSLRGQIIEQSDICQGVVKDANGESIIGASVLVKGTTNGSITGLDGDFSLRNVKKGDIIVVSYVGYQSQEIAWTGEPLNIVLKEDAEVLDEVVVIGYGAVRKADMAGSVAVLDNKNFKDQPITQVADALQGRVSGVHVENSGVPGGSVKIRIRGANSISKSNDPLYVVDGIVRESGLDGINPEDIRSMQVLKDASSTAIYGSRGSNGVVLITTKIGKAGVREIMFDASVGVSNVYKRYDILGAYDYALALKEVKGIDFSNEEMQSYQNGTGGIDWQDEIFRTGITQNYKLALSNGSEKTQYYISANYMSQEGVVIESKNERYQAKANLSSQLTDWLHITADINASHGVRRGGSFASGKDNPIWIALNYSPTMTMMAENGNYNTDTYNSIASNPVGILKLQSGETMTNVFNGRVDLRLDIMKGLTFTTTNGVDYYDGKSYSFSSKRVGTKSGMGNNDTYRLMLQSSNNLTYTGSWNDHHLTATAVYEVTSSETRTMGITGNNLLTEGVGWWNVGMASSRDANNGYEQWALMSGVARVMYNFKDRYMLTGTFRADGSSRFAKKKWGYFPSIAAAWTLSNEDFMKDVSSVQDIKLRASYGIVGSQAISPYATMGLMSATAYNFGTNSNFTGYWANDIATPELTWEKTKQFDLGLEFSLFDRRLNFSVDYFYKRTTDALLKRSIPGYVGGNSFWVNDGEISNRGIDLSVTARIMQNDRFQWTSTLNGTYLKNRVERLSGGENDFINGSSPAAGMVDYATIIKPGEAIGTFWGYEWTGLDENGHDTYTDVDGNQMIDGGDRKVIGKANPDFTLGWNNSLSYKNWDLNLFFNGSFGAKRLNLVRYTMASAEGNSRFVTLADAYLKGFDKIGSSATYPSLTEGGNNLQPVSTKWLENADFLRLENISLSYTFPKKTTGFADLRLTFSCQNLFTITGYKGMDPAGTTFSNSSVDVDAGIDMGAYPSPRTFTFGLRMNF

SEQ ID NO: 6730 - protein, 68 aa, B.fragilis
RPGTFTGHDHFPEFLYVRGETYGMYAAFFEYLVQRHTPGTVTQALHEDRIHETRSMTENNHSTGGADK

SEQ ID NO: 6731 - protein, 287 aa, B.fragilis
ATKTETMELFYLNEHTSCYNYSKSMQEGFRYYKFDEGLNHEEELVKDCILFVLKGSLQFSCNGFQFTVSSGEMVFFCRDSLFNTQSLEKCEVVAALFEGGVWPCQRASFSELYHLREIVEYRMEPLEIRDRLCKFLELLVCYLEDGANCIHFHEIKLKELFWNIRFYYSRQELANFFYMIIGRSQDFKNKVLNNYKSCRTVKELASACDISLSAFKRQFSAEFGEAPAEWMQKQLLGEIKYKLSVTDLPLGTIANELEFSSLAHFSRFCKRCLGCSPRELRQQIKGG

SEQ ID NO: 6732 - protein, 207 aa, B.fragilis
SNETMNNSMMKPFFLLVFLLCSAGAFSQKVALKNNLAYDALKTPNLSLEFSMGRKWTLDTQVGMNFFFYTRDATSSRYKAKKFSHWLVQPELRYWTCDVFNGWFFGLHAHGGQMNIGGVDVPFVLQKGDGNMKDHRYEGYFWGGGLSAGYQWVLSNRFNIEASLGIGYVHARYDKYKCTTCGQKLGKGDADYIGPTRAAISIIYMLK

SEQ ID NO: 6733 - protein, 96 aa, B.fragilis
KSDAFSVRSLSHPTNINPAKSNTTLHNVNLLFIFIFTTIIDKNNISINLAKKNINHLRQTNYLINNNIFIEYNTQPIIYCAKKKQDKILLIIILAL

SEQ ID NO: 6734 - protein, 467 aa, B.fragilis
KKSYTYKTYRSLTDGSGTDFPSFVQFSRLVTELFWSFSDLMHISLCFLSRKQGSVKCLTNKKLMATVKTVLVKGRSNRSGKFPLVVQVLHKRRKKVVYTGFSIPDTLFDPVKGRVIDGGENTPESIRRINNRCESISRVLLKCISMIEKKSREYEIEDVFRTYGVLTREAGFYFYFSRKIRELRESGHEGTARAYASSLRSMQRYLGKKDFPFIKLSSRIISDYQGKLLASGICDNTIGFYLHNIKALFRKGCREMGLELPCPFRDISIKTEKTLKRSLDPVVIKTLSAIELEKDSPLSLARDIFMFSFYTRGMSFVDIALLKKRHVFPGEICYRRHKTDQLMRVGINKEISRILERYKNVPGEYIFPLFPAERDPYAGYRSAYHRIRYSLGKISRVIGLEFPLRLHAARHSWATIAKVNGASVHVIGECLGHTSEKTTRIYLKELDHSALDAVNNQVADFILAVDD

SEQ ID NO: 6735 - protein, 486 aa, B.fragilis
NRLQIISTFGQARVCCRRANLVESLQIGVCQSYKAGIPFGRSHRISYKIQTFGSERSVEEQVQIPVFIRQGVIPSQGEIGIGLADDLAVATVYHLISIYIRVSVMSVFIQAGPFISPKSTDGLTRLDNGGIINHTGSRTGAVDEIILTTGKAFHAVLQISTVQGGGPLEPVILHNPGGHAQINTTITDFAVIHPKRVTADISGDTSFKQRICSTLIEIVHTEIQPPVEQGELQTQVELLGLLPRKLGSRYVICPITGKITVGSKIVCSSTHKAHGRVRTDGLATHNTITGAKFNVLNRGNILHEILIAQRPSCGNRRKVPPFLFGKARRTVGTKCSGKHITILKIVHDTGHSRHQRPLLVTIVCITRGSHTHIPPAHTLGQQVVTGYTHCPGFGGGHLIYSRGCQMMVIPGTCICQIVGALQHQTISIVIAHTTLGPHSFGAETITFPVIIVHAIGCGECQPLHYIKAQINTSVENIGHCLSRLQL

SEQ ID NO: 6736 - protein, 342 aa, B.fragilis
IKRKMRTIACKTVWALLIGVSLVLSLNSCSKDPVIPEDETKNKLHEDPAKMTVRLVECHLHADWNEIQKAGGPHQNPESPARYMKRVQEITYELKTGSGWTLAEGSQGKFYVQKNGEYKNGNNFTPAPVYLMFIYYYNSKGELMNGQFVENGQENIHQHFFTPENVRPTFDGKPEADDNDPEALVDYLYVDTTPWDKTKHDNEAEITGSTNPVGLKGVIRFLKDRKEFDLKLRLYHGYNSKKNPQTNGFDPFYKPSGVLIQRGTWDINLSIPVVVFWSREEFVDVDPEADVNLIGEDSLDEDSNRTLHSIMKTFSLTWKEALEEFISYTYQAGDVEAGSIWL

SEQ ID NO: 6737 - protein, 65 aa, B.fragilis
CHGNDLHTPFPYQLKSHVQVTYPSFRKHMTGKAGAENTEKTIQNLVHDIKKLYIENQRSDPPINW

SEQ ID NO: 6738 - protein, 260 aa, B.fragilis
RGEDAARPRATSARRRAPAPTHDADRSTRAPRTTGRAPPARTGTPQPTTPDRAARRARGARERGRKRRRKTRKKKEEKKKKTKKKKKKKKKKKKKKKKKKKKKKKKKKKKKKKKKKKNKKKKKKRKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKTPMN

SEQ ID NO: 6739 - protein, 109 aa, B.fragilis
QTHRGCTEEMREKNDDDICFPGDKIPYRPASRNIIVYKNPCLDKRGERKETDGTIFRRIVTGVSLFVMGYARMFPVNMKSFHEEKGHQCQQQHTCYDSPLSLSFFRTIH

SEQ ID NO: 6740 - protein, 259 aa, B.fragilis
GAARTPRDRAQQARADEPRRPRTTRTGAHEHRARQAGPRPREQARRNPQPQTARRAAHGEQGREGGRDGGKREKKRKKKKKKPRKKKKKKKKKKRKKKKKKKKKKKKKKKKKKKKKKKTKKKKKKGKKKKKKKKKKKKKKKKKKKKKRKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKHQ

SEQ ID NO: 6741 - protein, 512 aa, B.fragilis
FLNGRSQPKLTPENFFSTQDELNMSIYALYQKVNLSQVYTNMQLSQWQGDDITTNPGSNKQSAAEMDKFAAANNNKGVKDAWNMHYAIVKAANLIIQGASKTPTTQDEINIGLGQAKFWRAYAYFTLVRLWGPLPMNLDNVNDDYTKPLSPVEEVYGHIVQDLTEAEAVLPTGYSGSPRFLNGVNVYVTRQAAKSTLAAVYMAMAGWPMNKTEYYAKAAEKAKEVIEGVNRGEYEYKLDKDYKDVYAMSNNYNNETVLGINYSPFVDWAQDSELTSCNQYESLGGWGDAWGEIRFWKEFPDGPRKDATYDPKIRLKDGTLVDWWELKEDGTPVVPEHHPMFSIFSVNWDPASKVNTSAPYDYTKPASQNMCNDHRHRIIRYSEVLLWYAEAKARTGQTDELAFKCLNDVRERAGLEPLTGLSADDLAEAAYKEHGWEVAGYWVALVTRRADQFRMNRLKDTFKERAENTAVEVADGILVKESVEYTNRTWSDNLMYLPYPDMDSQKNPNLVR

SEQ ID NO: 6742 - protein, 278 aa, B.fragilis
ARRGRRATARNKRAPTSPGAHARRGQEHTSTAHDRQGPARANRHAATHNPRPRGAPRTGSKGEREEETEENAKKKGRKKKKNQEKKKKKKKKKKEKKKKKKKKKKKKKKKKKKKKKKKQKKKKKKEKKKKKKKKKKKKKKKKKKKKKEKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKNTNELTCPKITLQLLSISLIIL

SEQ ID NO: 6743 - protein, 430 aa, B.fragilis
RRWGMMRRMDVHEAANRRLKIIFDYFDYVYVSFSGGKDSGILLHLCMDYIRMHAPGRKLGVFHMDYEVQYRQSTEYVERMFSNNRDILEVFHCCVPFKVPTCTSMYQQYWRPWQEGYQNIWVRQMPGTALTVKDFDFWNDSLWDYDFQSLFPSWIRRKKGCKRVCCLVGIRTQESFNRWRAIHSDKNYRKLANYKWTHRVGYYTYNAYPMYDWKTTDVWTGYARYGWDYNRLYDLYYQAGIPLSRQRVASPFISQAVSTLHLYKVIDPDTWGRMVSRVNGVSFAGMYGNTVAMGWRSISCPDGFTWKEYMYFLLDTLPRATRENYLEKLRVSQKFWREKGGCLGEETIGKLRAAGVPFTVEECTTYRTDKRPVRMEYIDEIDIPEFREIPTYKRMCVCILKNDHTCKYMGFTQTKREREMKERVLKRYKL

SEQ ID NO: 6744 - protein, 176 aa, B.fragilis
LIFFLARFIDILFLSIIVVNINMKSKFTLWSVVLLLAGFIFVGCDNERTENASDFQTGIHKIVIQQSGDTDSFEVSVSIGGADKGGPAKLYNDKGEYIGDSYSAQIRTATMSCCTNGNAFFMTCAGSVSSISEAGKRLHITVIGYIDDKEVNRLEKEYITDGNTLIETFSVSTKEI

SEQ ID NO: 6745 - protein, 785 aa, B.fragilis
PVYIFSSMTFHAYLQYVCLLVVCLCTLPSPMEARVQADRQSTGTRDTLLVIDQESGLPIEGAYILTRERLLVSSPRGMIVFGHGTCFMDTVLVQCLGYGSRRVPLNEVFKESSIHTVCLSPDIQKLGEVVVTGERAGASPNVVSRRLSSPEIRNALGTSLATLLERVSGVSSISTGTTVSKPVIQGMYGNRILIIHNGARQTGQQWGADHAPEVDMNGSSSVSVIKGSDAVRYGSDALGGIIVMEQSPLPFRKRSLQGGISALYGSNGRRYVATGQLEGAFPGDFAWRLQGTWSNSGDRSTAHYLLNNTGTREYHASASLGYDRGRLRVEGFYSRFYSRTGVMLSAQMGSEDLLAERIRLGRPLHTDPFSRGIRAPCQEVTHQITFGRMRLGMKKGGSIHWQSTWQKDDRQENRVRRLDSNIPAVSLHLNSFQHLLRWKRDYRSWQVEAGGQVMFIENHSRAGTGFVPVIPNYTETQAGIYGIGKYHLARGGVEAGLRLDMQETRASGYDWTGSPYGGTRKFNNVSYSLGGHYQLSRRWRLTSNFGLAWRAPHVYELYSNGNELGSGMFVRGDSAMHSERSYKWISSLRYGDGMFSVCLDGYLQWVDGYIYDGPEKETVTVISGAYPVFQYRQTPAFFRGMDFDLRFTPGGSWDYHAVVSFIRANERTKGNYLPYIPSFRFSHELAWIHETKSHLRLRLNIRHRFTAKQRRFDPDTDLIPYTPPAYHLLGFDAALELPVKRGHQVRFMLSADNLLNREYKEYTNRSRYYAHDMGRDVRCGVNWIF

SEQ ID NO: 6746 - protein, 138 aa, B.fragilis
RIGIMNILKLQGLDGRLFDLVAPLVMNPAVLRQNNNYPFKTTRNHVWYIAMDEQRVLGFMPVKMTLTNNCIDNYYISGDNSSVIEVLLDRIIHDFSSDGSLVAVVHERHVEDFSMKNFIPCVEWKKYVKMRYHEGGGA

SEQ ID NO: 6747 - protein, 177 aa, B.fragilis
IVIVMSSFKSPAYNVKAVPVEKIVANSYNPNVVAPPEMKLLELSIWEDGYTMPLVCYYREEEDIYELVDGYHRYLVMKTSVRIYKRENGLLPVTVINKDISNRMASTIRHNRARGMHSLELMTGIVAELSKSGMSDSWIMRNIGMDKNELLRFKQISGLAELFRDRSFGLSDDWLEE

SEQ ID NO: 6748 - protein, 92 aa, B.fragilis
SSCVGWNSLFINLQAAGGAAFFVLCNEKIPSAMLNPRGLLGDVLGHALPSHPVPFFMFGKLKKILYIQDVPFPYRRVWNRLPVFRAIFPLGY

SEQ ID NO: 6749 - protein, 501 aa, B.fragilis
NLPLATKPPLPSIAFAHLSIAAYFCFYKIKRSTSMTNVNRITLITVCLAAILPGNGLWAQQTEATGTSQTADSVSMPAQWDLQSCIDYALQQNISIRRNRINAQSTQVDVKTAKAALFPSLSFSSSQNLVNRPYQESSSIISGSEVLKSSNKTTYNGNYGLNAQWTVYNGSKRLKTIEQEKLNNRVADLDVATSENDIEQSIAQVYIQILYAAESVKVNENTLQVSEAQRDRGKQLLDAGSIARSDYAQLEAQVSTDRYQLVTAQATLQDYKLQLKQLLELDGEQEMQVYLPALGDENVLSPLPTKTDVFRSAVALRPEIEASKLSVEASELGIGIAKSGYLPSVSLTAGIGTNHTSGSDFTFGEQVKNGWNNSIGLSISVPIFNNRQTKSAVEKAKLQYQTSQLTLLDEQKTLYKTIEGLWLDANSAQQRYAAAIEKLHSTQTSYELVSEQFNAGMKNTVELLTEKNNLLQAQQELLQSKYMAILNTQLLKFYQGDKITL

SEQ ID NO: 6750 - protein, 61 aa, B.fragilis
KKRPTFTGRTFFVLFEYVIYIQQLNSMIIKITTQQNGIRENHFGRIGLSHLNVTYVIIMTN

SEQ ID NO: 6751 - protein, 518 aa, B.fragilis
GKNPAFNLKRGSLYPISGVFSQACDEIGMLFWAENAFWGIGGHKGDDYWNASAYPVNESDRAEFENSVKAQLKELIRIHRNHPSIIVWSMSNEPFFTAPETIDPMRKLLEETVKLSKQLDPTRPAAVGGAQRPLGEKRIDKLGDIAGYNGDGSYIPEFQQPGMPTVVSEYGSTTADRPGEYDPGWGDLAKNNAQNGFPWRSGQAIWCAFDHGSIAGSALGKMGIIDYFRIPKRAWYWYRNAYKGITPPEWPQEGTPARISLVADRTDNIKADGTDDVMLSITILDANGKPVSNSPAVKLDILSGPGEFPTGTSILFEKESDIRILDGKAAIEFRSYYAGETVIRATSPGLEPAEVKIRFTGSTPYTEAFKVKERPYTRFETPTKTDNLQTFGPNNPTFCSSSANGHSSAFAADGDESTYWQASENDPERSWTLDTEKGLSIRHIRIAFPDLAPYQYKVEVSMDREHWSLIPDQTNNKQNENIRMIQVVPGIQGRFVRISFTGEKAAITDVQVIGTVID

SEQ ID NO: 6752 - protein, 496 aa, B.fragilis
IHITIMATQNKTDIGLIGLAVMGENLALNMESRGWSVSVYNRTVPGVEEGVVERFINGRAKGKHIEGFTDIEAFVESIALPRKIMMMVRAGSPVDELMEQLFPYLSPGDILIDGGNSNYEDTNRRVKLAESKGFLFVGAGVSGGEEGALNGASIMPGGSEKAWEEVKPILQSIAAQAPDGTPCCQWVGPAGSGHFVKMIHNGIEYGDMQLIAEAYWVMKELLDMTNEEMASVFTRWNEGKLRSYLIEITGNILRHKDKTGVYLIDKILDAAGQKGTGKWSVINAMELGMPLGLIATAVFERSLSARKELREAAARQYQCRHSMAVYNKQDTEKEIFSALYASKLVSYAQGFAVLQRASDTFGWNLDLASIARMWRGGCIIRSVFLNDIAAAFEAKEKPKHLLLAPYFEEEIKGLLSGWKNLVAQAMREELPVPAFSSALNYFYSLVSADLPANLVQAQRDYFGAHTFERKDELRGVFFHENWTGHGGDTKSGTYNV

SEQ ID NO: 6753 - protein, 136 aa, B.fragilis
SGSTQVWHVHCITIFRCLVIVSRSRTIKFSRIMKKVLVALVIVMGLGFSVAKADEPLKKKSPKVEQRDSREDFTPIEVNNLPEAVIDELSCEGALIKEAFIAYSRSEGKLYKVIILSSDFHEQAVFLNERGNILNR

SEQ ID NO: 6754 - protein, 74 aa, B.fragilis
KACTQGHGVDQEEEVSPNQVAALRCLFTPEYTRPAAIGTTRALLQGVEFQKVSAIGGAINGGSGSGDIVDDPTA

SEQ ID NO: 6755 - protein, 383 aa, B.fragilis
TMGTYIFLQQYWWLVVSLLGAILVFLLFVQGGNSLLFCLGKTEEHRKMMVNSTGRKWEFTFTTLVTFGGAFFASFPLFYSTSFGGAYWLWMIILFSFVLQAVSYEFQSKAGNLLGKKTYQTFLVINGVVGPLLLGGAVATFFTGSDFYINKGNMVNEVMPVISHWGNGWHGLDALTNIWNVILGLAVFFLARALGALYFINNIADKELVAKCRRSLIANTVLFLVFFLAFVVRTLLADGYAVNPETKEIYMEPYKYFNNFIEMPVVLIVFLVGVVLVLFGIGKTLLKKTFDKGIWFVGIGTVLTVLALLLTAGYNNTAYYPSNTDIQSSLTLANSCSSQFTLKTMAYVSILVPFVIAYIFYAWRSIDNRKIDAKEMDEGGHAY

SEQ ID NO: 6756 - protein, 62 aa, B.fragilis
ITRFPSNYILDFIFISSKIMLIYNHFMIVSYFKTTDKIIYFFTFLFNLFWVSMPLASNVFIV

SEQ ID NO: 6757 - protein, 236 aa, B.fragilis
SSIAVKLRCAIVDDEPLALSLLESYVNKTPFLELAGKYSSAVQAMKELPGNQIDLLFLDIQMPELNGLEFSKMVAPRTRIVFTTAFGQYAIDGYRVNALDYLLKPISYVDFLQAANKALQWFELVQKPEEVDSIFVKSDYKLVQVELKKILYIEGLKDYIKIYTEDAPKPILSLMSMKSMEELLPPARFMRVHRSFIVQKNKIRIIDRGRIVFDKTYIPVSDSYKQTFQTFLDERS

SEQ ID NO: 6758 - protein, 450 aa, B.fragilis
PNTAAVTSCCATDKSRKTALTRTFFPQPKHWPLCRYKKNNRQIIMNGTNLFKIALRALNNNKLRAFLTMLGIIIGVASVITMLAIGQGSKKSIQAQISEMGSNMIMIHPGADMRGGVRQDPSAMQTLKLTDYETLRDETSFLAAVSPNVSSSGQLIAGNNNYPSSVNGVGTEYLEIRQLSIDNGEMFSEADIQSSAKVCVIGKTIVDNLFPDGEDPVGRIVRFSKIPFRVVGVLKSKGYNSMGMDQDDIVLAPYTTVMKRLLAQTYLQGIYASALSEDMTDNATEEITELLRRNHKLKEADDDDFTIRSQQELSSMLNSTTDLMTTLLACIAGISLVVGGIGIMNIMYVSVTERTREIGLRMSVGARGVDILSQFLIEAILISITGGLIGVIIGCGASWVVKSVAHWPIFIQPWSVFLSFAVCTVTGVFFGWYPAKKAADLDPIEAIRYE

SEQ ID NO: 6759 - protein, 84 aa, B.fragilis
VVNLRKNKSKMEYKFDEQSVKELMEWAQTAQLPQELELSKAERIFDVKLCIESDLSCIRAHYPDAFYNPAITRLYRIREKLEEK

SEQ ID NO: 6760 - protein, 429 aa, B.fragilis
QIYYKYMQPLAERLRPKTLDDYIGQKHLVGPGAILRKMIDAGRISSFILWGPPGVGKTTLAQIIANKLETPFYTLSAVTSGVKDVREVIDRAKSNKFFTQSSPILFIDEIHRFSKSQQDSLLGAVEHGTVTLIGATTENPSFEVIRPLLSRCQLYTLKSLEKEDLLELLQRAITTDVVLKERKIELKETGAMLRFSGGDARKLLNILELVVESETEETVIITDDLVTERLQQNPLAYDKDGEMHYDIISAFIKSIRGSDPDGAIYWLARMVEGGEDPAFIARRLVISAAEDIGLANPNALLLANACFDTLMKIGWPEGRIPLAETTIYLATSPKSNSAYNAINDALALVRETGNLPVPLHLRNAPTKLMKQLGYGQEYKYAHNYEGNFVKQQFLPDEIKAKQLWQPQHNPAEQKHAERMKQLWGNEKNY

SEQ ID NO: 6761 - protein, 525 aa, B.fragilis
RLTLTTNDMIESIDTSLIDWSRAQFALTAMYHWIFVPLTLGLAVVMAIMETLYYKTGNEFWKRTAKFWMKLFGINFAVGVATGLILEFEFGTNWSNYSWFVGDIFGAPLAIEGILAFFMEATFIAVMFFGWDKVSKRFHLISTWLTGLGATISAWWILVANAWMQHPVGMQFNPDTVRNEMVDFMAVAFSPVAVNKFFHTVLSSWVLGAVFVIGISCWFLLKKRDKEFAVASIKIGAVFGLVASLLTVWTGDGSGYAIAQTQPMKLAAVEGYYEGQNGAGLVAVGLLNPEKKTYDDGQDPFLFRIEIPKMLSLLAERKVDAFVPGIKNIIEGGYELKDGTKALSAAEKIEKGKKAIAALATYRTAKKEGDEAAAKEAYTTLQENVPYFGYGYIKDVNQLVPNVPLNFYAFRVMVILGGYFILFFILVLFFAYKKDLSKIRWMQYVALWTIPLAYIAGQAGWVVAECGRQPWAIRDMLPTSVSISKLDVGSVQTTFFIFLVLFTVMLIAEIGIMVREIKKGPTVNH

SEQ ID NO: 6762 - protein, 142 aa, B.fragilis
VNMYMKTLFLKRLMFIFLLFVACYSSAQSLRSLPFQKRDSTLIRIAKETLKKKAPEYLIENGAPIISKHRVRYLTPAEEKEVPEFSTFYGAKSGQVYYIVEFPQDESIESFDAGFVAQVYIWEDTSRPFSIALGNSLIMDLK

SEQ ID NO: 6763 - protein, 446 aa, B.fragilis
IYRLGNSDLYHQKEQEKKIMFGLMDCNNFYASCERVFNPALNGKPIVVLSNNDGCVIARSNEAKALGIKMGVPAYQIKDDIQKYGISVFSSNYTLYGDMSGRVMSILAEQVPEMEVYSIDEAFLNLEGIRDIQSLGTDIINKVIRGTGIPVSLGIAPTKTLAKVANKFAKKYPAYNRLCIIDTEEKRTKALQLTEIGDIWGIGHRQVAKLEKQGVKTAYDFTELPESWVRKNMTVVGERTWKELQGISCIDMETTPPAKKQICTSRSFGKMVEDIDTMSEAIATHASTCAKKLRQQKGYAMSLMVFIHTNNFRKDSPQYWRNTVVHLPIPTNDTLEIVHYALAGLKTIFMQGYQYKKAGVIITEITDSTQLGLFDSVDREKRERLQQTIDKINGKHSRLVKLAIQGTGRNWKLKQKQLSGHYTTDINQIISINCTYPTACQRKQYS

SEQ ID NO: 6764 - protein, 287 aa, B.fragilis
KQLHMYKNILILGRGIGQVMFQNNALSGGLMLLGIAFNSWQLAVLSVLGTVVSTLTASLSGYDKEDICNGLYGFNGTLVGIAIGVFMEINVTSILLLISGSAFSTWVARCFRYQNRVSGLTAPFIFVVWLLLVGCHYLYPSLLLSSSLEKPELTMDIFRSFCLNIGQVMFQGNILSGLFFLLGILINSRMNALYTLTGAILPLFMILYPHTDLAAWNLGLLGYNGVLCAIALGDKTGIGVVKAIFSIILSIVLQLTGMHMGIVTLTAPFVFSVWITGGLFSVFRSKS

SEQ ID NO: 6765 - protein, 359 aa, B.fragilis
LNRHTMKRVFVFQDFKSQKFWSIDVRGTDVIVNYGKLGTDGQTQVKNFSSAGEAEKAAGKLIAEKTKKGYVETLEEVAKEMKVEAKKYALSYDEAEEGVNLMDKILKDKKLPSLKQITIGCWGYEGEDCSDIADGIVENKEKFAHFEGLFWGDIDFEEQEISWIEQVDLSPVLDAMPLLNNLKIKGTNNLSIGKKPRPNLKSLEIISGGLPDSVVEDILGSDLPNLEKLVLYVGVEDYGFDGDMNVFRPLFSKDRFPNLKWLGIVDAEEQNAVVEMFLESDILPQLETMDISAGVLTDEGARLLLDHVDKIKHLKFINMKYNYLSDEMKKELQKSLPMKIDVSDSQEYDDDYSYPMITE

SEQ ID NO: 6766 - protein, 258 aa, B.fragilis
PSGQQEERKISMNKTVIELQNIKRNFQVGDETVHALRGVSFTITEGEFVTIMGTSGSGKSTLLNTLGCLDTPTSGEYLLDGISVRTMSKPQRAILRNRKIGFVFQSYNLLPKTTAVENVELPLMYNSGVSASERRRRAIEALQAVGLGERLEHKSNQMSGGQMQRVAIARALVNNPAVILADEATGNLDTRTSFEILVLFQKLHAEGRTIIFVTHNPEIAQYSSRNIVLRDGQVKEDSTNPDILSAAEALAALPVQEE

SEQ ID NO: 6767 - protein, 105 aa, B.fragilis
SNYKEIMANLFITIVSTKKMLNGKHKVRIAVSHNLATRYIPTNIIIDAENEFKNGKVVKRPDKDILNARLKKIYDMYYERCMKIEYANTLTCTQLIKYCIFAESR

SEQ ID NO: 6768 - protein, 505 aa, B.fragilis
CISKKRNMSKFVMTIFGASGDLTKRKLMPALYSLYVAKRLPEEFEILGVGRTVYEDADYRTYIYNEMEKFVKSEEQNKEKMDAFVGHLHYLAIDPALESGYGQLRLRIEELSGDSRPDDLLFYLATPPSLYGVIPLHLKSVHLNKGRARIIVEKPFGYDLESAEKLNKIYASVFDEHQIYRIDHFLGKETAQNLLAFRFANGIFEPLWNRNYIDYVEVTAVENLGIEQRGGFYDTTGALRDMVQNHLIQLVALTAMEPPAVFNADNFRNEVVKVYESLTPLTETDLSEHIVRGQYTAGGNKRGYREEKNISPDSRTETYIAMKLGISNWRWSGVPFYIRTGKQMPTKVTEIVVHFRETPHQMFHCAGGNCPRANKLILRLQPNEGIVLKFGMKVPGPGFEVKQVTMDFSYDQLGGVPGGDAYARLIEDCILGDQTLFTRSDAVEASWHFFDPILRYWNEHPEAPLYGYPAGTWGPLESEAMMHEHGAEWTNPCKNLTNTDQYCEL

SEQ ID NO: 6769 - protein, 79 aa, B.fragilis
LELNVSRLLPAFYKFARNVFSLVLIGGLAAQKVGEEKQAENEEHDKEFHKYNEPQGTSPGSCFESLLHRNSRCGAVYSS

SEQ ID NO: 6770 - protein, 690 aa, B.fragilis
SIMKQIQPVFLAMKFSFLIFFFFSLPVGAQSIFQKYGRFLTEPRSYVCYRTDGKLKIDGKLDEVSWQKAKPTAPFVDISGEGFPTPKYETTAKMLWDDEYLYIGAMLQEDDIKARLTQRDTIIYYDNDFEVFIDPDWDGHNYFEIETNARGVIFDLMLDRPYRSSGNFMVQWDCPGLKLAIHREGTLNKSKDKDKYWSVEMAIPHKALTMNFNNPLKAGNCWRINFSRVQWLKAGGPEENWVWTPTGKVDMHMPDRWGYLFFAAEKVGTPEHTFALPYNASVYKLLWAMFYVQQERYAKEKNYLRTEQDFFLTDAELKGLPQGAQISVEATWNTYQIAITVPGEGRRYIINNEGRFWTEKVAPRQVKNWVWTRINKSKSETDYRQWFALLKECGISGVMFEGYDENLYRMCKEAGLEAHFWKWTMNRAELLNVHPDWFAVNRKGESTHDKPAYVDYYRFLCPNHEGVAQYLADDYVKIAHLPYVDGVHLDYVRFPDVVLPVSLWKNYGIEQTSEHPEYDYCYCDVCRTKFKEQTGRDPLELKYPMEDQSWINFRLDAISRVVDQITKAVKADGKAISAAVFPGPSMAKKMVRQDWGNWSLDAYFPMIYNGFYYEGPEWIGRSVQESVKTVDGRAKVYAGLMFPDIKNDFEKALDEAFDNGASGVSFFDGPSDEYLHRFKAYLDKKGLKTE

SEQ ID NO: 6771 - protein, 297 aa, B.fragilis
  UNSURE (260): Identity of amino acid sequences at the above locations are unknown.
DHADRPGFDYSEWEKIGLAHSFSTPYFMSKDFYVGYGWYRKAFPVKKEILGKKSFLEFDGVFQEAEIFVNGHLAGTHKGGYTGFSIDISAYLKEGKNLVAVRVNNCWRPDLAPRAGEHVFSGGIYRNVRLVIKPPTYIDWYGTWVTTPDLAENKGKSGSVHIRTDVCNASGKTDTYRLLTTVVDAQGKEVSSVSTSQVLPDNATYTFKQQTKEIQAPQLWHPNHPALYKVISSLYHGQELIDRYETTFGFRWFEWTADRXFFLNGEHLYFKGANVHLDHAGWGDAVTQNRNAKKNLR

SEQ ID NO: 6772 - protein, 341 aa, B.fragilis
LRSERMRILVASNSTSKRTDYFIKAGRSLGADTCFVTYDELSAVLPDCRDTVVKLEPPVFREADFRKYNLLCEEYRSLLSRLADMDKSESVHFLNEPAAILCALDKVYTQRKLTGAGLKTTPLLSDALSTFDDLAAILCRQKRGGFLKPRYGSGAGGIMAVRYNHRRDEWVAYTTMSWEGGRVCNAKRICRLTNRKEIATLAEEVIRCGAVLEEWMAKEKLEGENYDLRVVCRGDEVDYVVVRCSDDAITNLHLNNKARLFEELSLAPSVREELFCRSITAMKALGLRYAGIDVLIARNTDTPYIIEVNGQGDHIYQDMYTENKIYANQIKTIESLFNGNR

SEQ ID NO: 6773 - protein, 411 aa, B.fragilis
RYNDMKKKKIILIAVSLAILAGGGVWLFGGSTAKHKVTYATATVSKGEISESVTATGTIEPVTEVEVGTQVSGIIDKIYVDYNAAVTKGQLIAEMDRVTLQSELASQRATYSGAKAEYEYQKKNYERNKGLHEKGLISDTDYEQSLYNYEKAKSSFESSQASLAKAERNLSYATITSPIDGVVISRDVEEGQTVASGFETPTLFTIAADLTQMQVVADVDEADIGGVEEGQRATFTVDAYPNDVFEGIVTQIRLGDASSTSTSSSSTTVVTYEVVISAHNPDLKLKPRLTANVTIYTLDRKDVLSVPARALRFTPEKPLIGDNDIVKDCEGEHKIWTREGNTFTAHPVQIGITNGINTEITQGASEGMVVVTEATIGNMPGGNVSPEGGQEGGGEQSPFMPSHPGSKKKGK

SEQ ID NO: 6774 - protein, 206 aa, B.fragilis
NPARREAEKSRTEAELKNLRNQLNPHFLLNTLNNIYALIAFDSDKAQQAVQELSKLLRYVLYDNQQNYVPLCKEVDFIRNYIELMRIRLSGNVEVITQFDIQPDSRTEIAPLIFISLIENAFKHGISPTELSFIHILISENKEEIRCEIRNSYHPKTNTDKSGSGIGLEQVRKRLELSYPGRYQWDKAISPDGKEYISKLLIFNHP

SEQ ID NO: 6775 - protein, 259 aa, B.fragilis
AWCRMDQSMQELNKHRSILRAMKPYIFPSSIETARALILHLVKLMLDEPDRTFCIAFSGGSTPALMFDLWANEYTDITPWERLKVFWVDERCVPPENSDSNYGMMRSLLLSIVPIPYENVFRIQGEKNPKKEAARYSKLVMKEVPVENEFPLFDVVLLGAGNDGHTSSIFPGQEELLSTDHIYEANFNPNNGQKRIALTGLPILNARRIIFLITGRVKSPVVEDIFYSGDTGPAAYIAHHADNVELFMDNAAAEKVIRG

SEQ ID NO: 6776 - protein, 426 aa, B.fragilis
YQALVLRFVVLINNLFYMRIKRLLYAIATILPFLFLCSCYEEQEPQQEKQDKEKWTMQVAGNQLNEFLNINPDLRNLYAYPDWDAAQIIRERSDTVSYYVPVVDITADTCSYLIIARASNDVYLYMVRLPEEYSGFDSFLEEHLKILRIIDGARRVPVGYLHNFPDDVLTRTRSSGSLFNHDRETNTEILENNTFVKDDLFGAGFSLPEVTVIGRRPTSSEDPFKWPFGDMPSESPKALPGLDDFFSPQGGGSSSLSSPQQSGSLPKPEEVIKDATVKKALEEAWSDMLKRSTKDQRQEVGFWIYYDPVKKQYYIGKKRYGIAVKNDGKARGNISLGDKSPSVNGVPATAKVVASFHTHTPMTEIKGMKRKVGPSKEDKGNADKNRIPIIVYDYIGTKDPRTNDYYVIGGHKVSDPKKMYIYQPKK

SEQ ID NO: 6777 - protein, 419 aa, B.fragilis
KQLSMKMILNFSECIISFFSLCLLCVVFSCDEMDIDQGPPTSVTRNLMTSDGPGFKIDTVTYDKIPAEYARKILSLEEPTSVVTDKSKRSFRVNELFQIRKANDQLLSITSYSAKTVYDLILEVYVEGGSQYVPIAYLDSIPGFSQFEFKPSLINGNFIYKKDNGVDTLSLSSLNEKRMKFRLLSDDKHFEMLSKIDAEWNISFSNYDWKPGYESGSWRELSAIYAREWVVIITNYAYMMTTPEYAFIMRNFSKIFGGELYDNNRVKFTPEKYLSEEKRFKQPHNFVCGRSKPSVGGLGGGNVWGVTHWNYYGHYASFSGWESITHEFMHCMGYGHSSNMTYASGGVGWTEFMWQLHTYLRGNDWLPYTDRNLLGFHKPENAKYRDGGIDPDKLNDNKILQFYNKSKVTQYFLANPLSK

SEQ ID NO: 6778 - protein, 158 aa, B.fragilis
TKIIIFVPMKQSLTSARRPLEILIHIISWGIVFGFPFFFIDRTGDSINWHAYLRHSAVPLSFVTVFYLNYFLLVPHLLFQEQKNKYIIYNILLVCLIGLLLHIWQSLNAPAPTLKKPHMPPGWDFFRKRHSKPHLHHRTECRHPHECPVGDKLKPRPS

SEQ ID NO: 6779 - protein, 515 aa, B.fragilis
CPNMYIPDPNRMMSSLSTVRSIYYRGSLEHCNYTCSYCPFGRKSVSADTTEDQEALDRFISRIGGWKYGSLRILIIPYGEAMIHRYYREGIMRLAAMPHVIGVSCQTNLSFSVSRFLDEAEAEQADVSKFRFWASYHPEMVGVGEFASKVEMLRAAGIGVCAGAVGDPSAKEQIRKLRQLLDPSVYLFVNAMQGLRKPLSEEDIRFFGEIDNLFDYDRRNAKACLDGCVGGRETLFIDRKGDMYACPRSGIRMGNFYDDPTSDFQPFCLRKVCDWYIALSNLCDTPLRRMMGDGAMWRILERKKVEAVFFDVDGTLTDAQGRIPDRTVSVLEYMAKRLPLYLSTALPVSHAKKRLGNVFGLFSGGVFADGGLLCYGETIECVPIANPVTAGFPGCRVTRYTREGKVFKYAVLAPNTREAVRWLTELDEEAYQLYQEGRLLTVVDSKAGKKNGLITLCARLGISLREVLVVGNTMHDWPMMSVAGYSCAVMDAEEKLRKLSGYVLNPDSIPVFFDI

SEQ ID NO: 6780 - protein, 395 aa, B.fragilis
NLVMKKIHIGLLPRIIIAIILGIAIGNFLPTPLVRLFVTFNSIFGEFLNFSIPLIILGLVTIAIADIGKGAGRMLLVTALIAYGATLFSGFLSYFTGAAIFPSLITPGAPLDEVSEAQGILPYFSVAIPPLMNVMTALVLAFTLGLGLASLHSDALKNVARDFQEIIVRMISAVILPLLPIYIFGIFLNMTHSGQVFSILMVFIKIIGVIFILHIFLLVFQYCIAALFVRKNPFRLLGRMLPAYFTALGTQSSAATIPVTLEQTKKNGVSADIAGFVIPLCATIHLSGSTLKIVACALALMMMQGMPFDFSLFAGFIFMLGITMIAAPGVPGGAIMASLGILQSMLGFDESAQALMIALYIAMDSFGTACNVTGDGAIALIIDKIMGKRKTPESL

SEQ ID NO: 6781 - protein, 149 aa, B.fragilis
NRMMKRKLEIHKIDVSSSLPIPYADEGIRAGFPSPAQDYMEQAIDLNKELIKHPASTFFGRVVGDSMRDEGIEEGDILVIDKSLELQDDDLAVCFIDGDFTVKRVRIEPNAVWLIPANPKYSLIKVTKENEFIVWGIVTYTIKKNRRKR

SEQ ID NO: 6782 - protein, 319 aa, B.fragilis
FMKIVVLDGYAANPGDLNWDELRTLGECEIYDRTAPDEVLERSKDAEAILTNKVVITAEHMASLPNLKYIGVIATGYNIIDVAAAKERGITVTNIPAYSTPSVGQMVFAHILNITQRVQHYADEVRQGRWTQSQDFCYWDTPLIELLGKKIGLIGLGQTGYNTARIAIGFGMKVWAYTSKSRLQLPPEIRKAELDQIFRECDIVSLHCPLTESTRDLVNTRRLELMKPNAILINTSRGPLVNEHDLAEALNNYKIYAAGLDVLSTEPPRADNPLLTARNCFITPHIAWATSAARERLMAILVDNLKAYIGGKPVNNVAK

SEQ ID NO: 6783 - protein, 267 aa, B.fragilis
NIRVAMIKKSDKKNVKKCIRTNFNFYLCPNLYAMLVPTMTTEEVCKEIKNDYPAFYEKMLDNKASNYRKFIKAVLFPVIHQFSWKSSSGNMWNVIMLARYRNERKCPGIVPYLKYENWGMGIIYPKNIYSNLSIIDFKPHFWKRYRERQLIPNGLEGISFDEQIKYFFLNSGLFTFDFREGSNKGHEGFVGYTKTGIFFGVVIKELDYLCVKTYVSANMLFDNQIESLDSADELREKILSHPDYFQKRGKLFHIMNDSSFWMDETIR

SEQ ID NO: 6784 - protein, 287 aa, B.fragilis
NHFSMEIDELPSGTQDQKPDIDMNEIVGTHDILMLCFDTLRYDVSVAEEASGGTPVLNSCGNGWEKRHAPGNFTYPSHFAIFAGFLPSPAEPHMLRNRKWLFFPFQAGTGRIPPEGSYAFKEATFVQSLAQVGYETICIGGVNFFSKRNDIGRVFPGYFNKSYWLPTFGCTDKNSAANQVDFAVDKLEKYPADRKVFMYINFSAIHYPNCHYVEGKKKDDKESHAAALRYVDSQLPRLFEAFRRRSDTLVIALSDHGTCYGEDGYEYHCISHEKVYTVPYKHFILRK

SEQ ID NO: 6785 - protein, 432 aa, B.fragilis
TLYSQKMNEQQQISRYVSYMYSYPHKTAYRTLTPPVSLSPYLERLEGREASLYFHIPFCAHKCGYCNLFSQQCCDAERISLYLHTMRRQAEQLSVAAQGLKFTSFAVGGGTPLILDEGQLEELFCLAELFGVHPSRVFTSVETSPEYTQKSVLRQLRARGVERLSMGVQSFNETELKKLKRRPGLGTVVGALENIVEAGFPQFNLDLIYGIEGQTVESFMRSLNTALTYRPNELFIYPLYVRPGTRIDVRSTDDIGYAIYKSARELLVGQGFVQTSMRRFVRRETTETEFSCGDEVMLSCGAGGRSYLGNLHYATPYAVRQQAIADEIDHYIRTTDFMTAANGFLLSTEEMQIRFIIKNLMYHRGVDLAEYEKRFGEKPDRNLFREFTDRGWIEETGRIVRLTEEGMAYSDYIGQAFISPAVRKLMSEYVYP

SEQ ID NO: 6786 - protein, 535 aa, B.fragilis
VMNTKTKLLYVGFRALNTCCLYAAFLMITSCGDNVVNPDSPEPDGEDMIPVTVSRVEDGSYMESHVDTPDTTGGRTLVDEWVPVKEPPASRAIPAAVPYEGPSAVRMTLREEPQVTTRAATLGNDIYFRLIAFRKVGSNYVFQSAADFTTNGASAPTLRQGNLLTRAGTVRVIGYSFNSTAAMGTIPSSYTYNSTSVTIPDMNSDFMVYDSGDIANVSTISHNLSVSFTQKLCKLTVKLSLSQFGSNTFTNCTGVYVSQGGNASAWTIGPSTNNVSANTGNTPTFNIANNSTATVRLVPFSGSRAITVHIGTLKLSNYFNANNRNITSSQNVQLLPGKSYTITLKFELGIQLAASDINLTQNGCTASDKNDLAKLRWATGNLKSTGNVNYVWASSQTEGGHFYSFNKLYDGSTGDPCSKLNTAYYGTSWRTPTKNELEKLVRCTDRVYNGGMWFMNNRLGLFLKAAGMRPETGPGLEGTGSGTSGVYLTSTLGNRKNTCYALDFGTTYIVVTDTGAWNALQINGYSVRCVKGTKQ

SEQ ID NO: 6787 - protein, 474 aa, B.fragilis
PCINNHTSYNYYKFRIKMNRENKPLFLYTFITVFGGLIVGLNMAGISGAVPFLQEQFMLDDMALGLVVSILTVGCLCGALLGGGFSDRYGRQKVMFSSAVFFIVSSLGCALSGNLVSLLVFRLICGLGIGVISAVAPIYISEISPARLRGTLVSYNQLAIVIGILIAYIVDYILLDYERNWRLMLGFPFFFSVAYLLLLGILPESPRWLSARGKAGRARQVASKLNLEAGEMTVSDTNTQEGRDRIKVTELFKGNLAKVVFIGSILAALQQITGINVIINYAPSIFEMTGVAGDIALVQSILVGVVNLLFTLIAVWLVDKVGRKILLLCGSLGMGISLLYLVYTFVVPAANGIGALIAVLCYIGFFAASLAPLMWVVTSEIYPSRIRGTAMSLSTGISWLCTFLTVQFFPWILNNLGGSVAFGIFAIFSIAAFAFILFCVPETKGKSLEAIEKELGVDKEAEENVKEEHAFSKI

SEQ ID NO: 6788 - protein, 184 aa, B.fragilis
GECERRTCFLENIINTKLDISMKQSKRNVWWSVCAGLLFCSWGCSSRVSDKPVTLETLLDEMVSVEEQALYPVPSYTCRQESSYDRASVSPDSAGWFANSDGFGIKRVDTVAGRIEKVMFDEVGPGAITRIWITTIDKRGTWRFYFDGSDQPGWIIPAHDLLRINVPGLGKVMLHGTHHLYALW

SEQ ID NO: 6789 - protein, 61 aa, B.fragilis
CNKDKTLFSSVQIFIHYSNNQLFISSSYIQCTEPKQCFKKGTSFETQESFYLSNLHKLTAK

SEQ ID NO: 6790 - protein, 503 aa, B.fragilis
YMNRTFIMRECLGKALWLCFCLSIAGCAEDDRMTPLSADSGDTADELIPIHISLTGDNDYHSSSFNNASTRSHSPLIAEWVGVKAFSPTRTGEQPDYDGPRIASMELTEDTLPRVSTRATVPAGVYFRLIVFRKSGNNYVFQSVADYASNGTGTPVLKQGKLLTRSGTIRMVGYSFNTATAADLGTMLSTYAYNSSTVSIPNMSKDFMTFDSGDITNVNSLSHNLPVSFNQKLCKLTITISPTGFPSNTITNCTGVYVKQGGNSTSWKIGPSTNVVATNTNNTAAFSPSTALSTTIRMVPFAGARTITVHFNTLTVGGRIVNNNTEITSTQSVQLKEGKSYTLKIQFKKGPGINVLESDINLTGNGCTAQDKKDLAKLIWADGNLKSTGNSNYVWTTSTDRGYYYTWYSTYTGNTSQNNTDPCSKLNVSTYGTGWRTPSRNELTKLSRCTNKAKVNNGMWFMNSSKGLFLPLAGHTPSASGANTGGNAIMNGNRHGNYWCTKE

SEQ ID NO: 6791 - protein, 70 aa, B.fragilis
PPLFILFSFLPRIVRIFFPNTMHIGIVLFTKPMPFILYSAVVLIYISNYISLFYRLYLNSLAPTPLINSG

SEQ ID NO: 6792 - protein, 109 aa, B.fragilis
LFPSFNCTLWVDVISVLLFTIRPPTVSVLKCTVIVLAPANGTMRMVVLRAVLGLNAAVLFVLVATTLVEGPIFHDVEFPPCFTYTPVQLVIVLLGNPVGLMVIVSLHNF

SEQ ID NO: 6793 - protein, 205 aa, B.fragilis
IKETMLLPWLNEELIEAGCDEAGRGCLAGAVYAAAVILPKDFENELLNDSKQLSEKQRYALREVIERDAVAWAIGIVSPEEIDKINILNASFLAMHRAVDRLKTRPQHLLIDGNRFKKYPDIPHTTVIKGDGKYLSIAAASILAKTYRDDYMNRLHQEFPCYDWEHNKGYPTKKHRAAIAGHGTTPYHRMTFNLLGDGQLELFSK

SEQ ID NO: 6794 - protein, 311 aa, B.fragilis
NIMSKKALLMILDGWGLGDHGKDDVIFNTATPYWDYLMETYPHSQLQASGENVGLPDGQMGNSEVGHLNIGAGRVVYQDLVKINLSCRDNSILKNPEIVSAFSYAKENGKNVHFMGLTSDGGVHSSLDHLFKLCDIAKEYNIENTFVHCFMDGRDTDPKSGKGFIEQLEAHCAKSAGKVASIIGRYYAMDRDKRWERVKEAYDLLVNGIGKKATDMVQAMQESYDEGVTDQFIKPIVNAGVDGTIKEGDVVIFFNYRNDRAKELTVVLTNKICLEPACPQYRGLQYYCFDSGPELWFKGWAYFGSIMENVG

SEQ ID NO: 6795 - protein, 315 aa, B.fragilis
QTKGGNKMRTYLYCEAGFVEKAQWLHNSWVNVVCPDSSDFKFLTETLKVPESFLNDIADTDERPRTETEGNWLLTILRIPVQNAQSSIPYTTVPIGIITNNEIIVSVCYHQTDMIPDFIEHTRRKGIEVRNKLDLIFRLIYSSAVWFLKYLKQINIDITAAEKELERSIRNEDLLRLMKLQKTLVYFNTSIRGNEVMIGKLKTIFQDTDYLDEELVEDVIIELKQAFNTVNIYSDILTGTMDAFASIISNNVNAIMKRMTSLSITLMIPTLIASFYGMNVDIHLEEMPHAFLLIILVSVFLSALSFVIFRKIKWF

SEQ ID NO: 6796 - protein, 62 aa, B.fragilis
LRLGRRYLAFLNGKKKQLLFFVANHGEIVRTRNMLFFFNVGGVLKFALCGITKYAGLLFVFR

SEQ ID NO: 6797 - protein, 192 aa, B.fragilis
PEKTEAPARANPFFGWHPEHSFSPITTTDFAKAARVELEHRGDGATGWSMGWKLNQWARLQDGNHAYKLFGNLLKNGTLDNLWDTHPPFQIDGNFGGTAGITEMLLQSHMGFIQLLPALPDAWKDGSISGICAKGNFEVDLSWKNGQLAEATIFSKAGEPCTVRYGDKTLSFKTSKGKVYKLALDADRLVIK

SEQ ID NO: 6798 - protein, 89 aa, B.fragilis
RKRTNQKVRSYIKADLSLFSKFRENLITFGQTNLINKSAWFRKEQEKNDIHTVTSNNYAYEVEKTNPLQTLFRKQNKIRNPKTNYQINV

SEQ ID NO: 6799 - protein, 62 aa, B.fragilis
PFANRERLIFLPPSSEAARFIHYLLLFNKIVVQRAVIKKIIIINSCILLKVIASLPRDIVIL

SEQ ID NO: 6800 - protein, 95 aa, B.fragilis
FYQIKISPEEKYFFRGYFCFITQSSLHPEKYIHHTEISKPNVTAIRILLLTFYYLYCKIQKVSYLTFWYFSTPTFLNINTIKQNRIENRNEKTKP

SEQ ID NO: 6801 - protein, 387 aa, B.fragilis
DHTSRSLEKSLLYDFTNSQKTVYMKIGILTFHDAHNYGAMLQCYALQQFLFKKGYNVEVIDYRPAFYQKQYHRHSLCPWIGKNPVRTMKSIYYNYYLFNKRCAAFSDFHNRHLYMSIPATRTNIPQSYDAYIVGSDQIWNPQLTNGFHDVYFCDFCFPKGKSRFIAYAPSMEISRLSTQEAEYLTRVLNCFDALSVRESSLIPILQPLVSQPIQQVLDPTLLLDATAWNPLIGKCPENRPYVVLYQVRENPAVRMKAFEIAQSIGGIVVELTARIDCHYSTKYQTASPADFVTYIRYATYVVTTSFHGTAFSLIFNRPFYTFSLGDNFDSRSASLLESVNLTERLVCPDEQFEISLIDFKQANKRLKHLRKQSCDFLRQSLHERQEQ

SEQ ID NO: 6802 - protein, 799 aa, B.fragilis
IYLFPVYHSYRMKRCLLYILCCFGVVQLSAQPADNIRNSFVKAETFYKSGDIDEACRILEENLSSFQGTMHTEACRLAALCCLALDRFPEAEKYVSLLLKDEPYYYISLQDPERFADMVRKHRETKVTLVTASQQVETPEEAPVPVTLITEEMIRAIHARCLRDVLIAYVPGISGLSSNEEMNLAMRGVYSPEQENILIMQDGQRLNSYITNAVSPDYGISLAKVKQIEVLRGPASSLYGSVALTAVINIVTKDGVDVRNGSISVSAGNRGQLAADLLLGKHDMNMDFMAWFSLYRATGESVFVPAEKQYALYPRDGFIRLDNYSGFPAMDGGIKLQRGNLLFSFSMNYAKKRQPYSMWLFSSPYSYERFRTFDGSGPGYSRWSAREQAVYSRTWQRITFSTAFYTDWNKNVHYETSGDTLQDYPIFPNYDYQPIIYPTRGAFQYIRWMDFNVGFNGRVNYAYDWGKLGKGNMLGGVEWNRYTLYDSEYLEGMNFKEIVRTWIEKRLYTGHEMNTDAFLQIKHNLHKNWIVNAGIRYDYKRRSNKRTLQAFSPRLSLIYLRNGLNIKASYSRAFVDAPYYYRNNEMDTYSGGENLQAEYLSSYQVTCAYHHSPSHIDVECNLFYNRASHFLFTQPETRVYENAGSLDMGGVEVVARYKADRLSLDGNLCFQKVLNYTNFFVTDGSVNNVPGFSMNLVANYFLLKKKVQSWSAHLKLNCSSHCYTQISVLEDGLNGDATNYTVRLPGYAVFSFTTRYKYKRIEGSLGIENLFNNRYECGGATVPIRQKGRWISASILYNF

SEQ ID NO: 6803 - protein, 67 aa, B.fragilis
LQFPSPEGKEDSVPLPIPGYAFNTMAHNYPGLADILKRLGINEVNEVNAILRLPDYERKGTVQPLFS

SEQ ID NO: 6804 - protein, 954 aa, B.fragilis
ILLPKNVSAMKKIVFLIMCLCSVYANSQEGIPFFVNYPASVYQAHNRNFDVVCDSCGNVYFANFEGILHYDYNRWETIYTPGFSRVTRLFRDSEGRIWVGGYNVFGRIERDGRGCITLRTLLSDLDTDSLGELEDMAEIDKRIYLKATSGRYYTVQSDSILTPVQVLPAQLQEKWRNQSSVSMNRAFSLPGGETISINSAHGLIMDDSGKKERFSVTERNGLCSNAVSGIAADGRGNLWGATDNGVFHVFIPSLFSRYTSGEGLKGEVISAVSYKGMIYTGTLQGLYVLKQNTFVPVQGISQACWRLCLSPQGELYAASGDGVYVIRDYNHSEKLTDMAAYSLAFIGHTNLLMGTMDGIYQYSADEERIKKISDVEKVVRLEVKKDRSVWAKTLYGEIYLREEGESSFVLQDRESEEVMTEYTDNDGCHWQTNLKGKEVQVHHSQIDTEKFNQCLYAIRNYVVRVIYIEEDRAAWFGGDFGLIRMDLEKARTFTPVAPRIYLREICLNRDSVYWGGDLPEESGGADWQINSTAPRLGNDVRSIRFSFATDAPCFTGSNEYRYRLVGYDPEWSSWDPGTVKEYANLSSGTYTFCVRARDIYGTESEMNQFRFSLLPPFYLQWYCLILYAVAFGMLLFLLFKWRMRSLLKEKERLEALVGQRTKQLVHQKNEIEEKSLKLEKALKELGQAQDELVRQEKMATVGKLTQGLIDRILNPLNYINNFSHLTSGLLKDLYQNLESVKELLDEDTYLDSVDVINMMRDNLEKIEEHGSNTTRVLKAMEEILRDRNRQLEKTELIGLCRKDMELLSSYYQKEITAMHIAVRTSLPDNPLFIDGNAEQLGKTIMSLLNNGMYAIAKKYGKKAYPAEIGLALESKDGQAVIRLYDNGVGIEQSILDKIFDPFFTTKTTGEAAGIGLYLSKEIILNHHGQIAVRSEKDELTEFTITLPLWEEKSV

SEQ ID NO: 6805 - protein, 343 aa, B.fragilis
SMIPKVSVIVPIYNVEKYLDQCVQALLAQTLSDIEIILIDDESPDNCPKICDDYAAQYPNIKVIHKKNAGLGMACNSGLDVATGEYVAFCDSDDYVDSDMYMTMYNVAQKYTCDAVFTGLKRITMAGIPTGTVTHQKEFKLYKNKNEIHTLLKDLIASDPYAREERAIQVSAKVVLYRRNLIEKKHLRFVSERILPSEDLIFNVDVLANSNIVCVLPQTFYNYRTNPISISHTIKKDKFSLFKQLYIEITDRCHRLGVEDNVQLRIQRMFLGYTRNYICNILNSSITNIEKKQITSSICKDGIWKPIWKTYPLSVMPLPHRIFTFAMRHNFYSLLLVLAKIKK

SEQ ID NO: 6806 - protein, 76 aa, B.fragilis
KKEPEAFIQINYADSYLRFSLICYGPGNKGQQNIAKQNSNRSARIKTEKRSAPLPLRQTRSLPRYCWPCNIAIHDF

SEQ ID NO: 6807 - protein, 143 aa, B.fragilis
AMTLLQFRPVDGRLDEILSMLMHSREVASHPSLSYAIRLVSEEIIVNILNYAYPQQAEGYLTLCLWDEDGEITLEFIDGGIPFNPLDKADPDISLPLEQREIGGLGIFLVREMMDDVAYTYVNKENRLTIKKKYLQPTDEPVS

SEQ ID NO: 6808 - protein, 516 aa, B.fragilis
YHMPSDSQNNKRIAQNTLLLYFRMLFLMLVSLYTSRVNLNALGIEDFGIYNVVGGLVAMFSIISGSLVSSISRFITFELGTENKEKLKKVFSTAVSIQFFLVIIVVILAETIGLWFLNNKMVIPEERILAANIIYQFSIISFALSLMSIPYTGTIVAHEKMSAFAYISIFDVIGKLAVALTISIAPIDKLIWFAGFIVFNSTIIQSIYIFYCKRHFEECTYHFIFDKSLLKNMFGFAGWNFIGSIAAILRDQGGNIVINMFCGPAVNAARGVAMQVNNAVSGFVSNFQTALNPQITKSYASGNYDYMMQLIFQGARLSYYILLILALPIISNTHFILQLWLGQVPKHTVLFVQLVLFFTMSESLANPLINAMLATGKIKKFQIIVGGLNLVNLPLSYICLRLGCIPESVVIIAIIISMICEMARVIMLRNMIHFPARSFLKKVYFNVIFVTITASILPLYLHFILEENIYTFTLISVVSFSCTLLSILYIGCSSEERVMVFSKVKVIVNKVSKRYK

SEQ ID NO: 6809 - protein, 150 aa, B.fragilis
SQFTHTNHMTIAVDFDGTIVEHRYPKIGEEIPFATETLKILAQERHKLILWTVREGELLEEAIEWCRQRGVFFYSVNKDYPEEEKSHNGFSRKLKADLFIDDRNLGGLPDWGTIYQMIHEQKPYEPVLCDRQKPTGDLSWIEKLLGKRNK

SEQ ID NO: 6810 - protein, 354 aa, B.fragilis
RKRLTMNNHVVIMAGGIGSRFWPMSTPECPKQFIDILGCGKTLIQLTVERFGNVCPQENMWVVTSEKYIDTIREQLPGIPESNILAEPCPRNTAPCIAYACWKIKKKYPEANIVVTPSDQVVIDTTEFRRVIEKALLFTDKSSAIITLGIKPARPETGYGYIAAGEPITRDKEIFHVEAFKEKPDKETAEKYLAAGNYFWNAGIFVWNVRTITAVMRVYAPGIAQIFDRIYPDFYTEREEESVKKLFPTAESISIDYAVMEKAEEIYVLPAQMGWSDLGTWGALHTLLPKDKEGNATVGPDIRMYESQNCMVHASQEKRVVIQGLNDYIIAEKDNILLICQLSEEQRIKDFSKE

SEQ ID NO: 6811 - protein, 369 aa, B.fragilis
YNTTMTNILGLKQNRWIVGAVLLLTTCNLQAQEQPNAREKFERGNWFVSGALNGEWLTKTIGNVYAGGKISGGVYLTPLSGFRATAEIGKNWIGNDTEATQLSANLDYMLTLIGNNGFKRFNLAAILGAGFNYYDFGDNDPKYTRVNTISGNFSIQASYNVNRKFSIFIEPGLKVLPKYYSKELNNKIYMQSNLTIGLAYTFRDKYRKSVDNSIHPLYLPEADLLEIKEKIGMLCEEVMQMKQELKERRKITDGQNLMIVPQKDALSIDIMFDEFSSFVSEEQGQKIDGIGEWMKNNNASIRIIAFSDNLTDKKADQELRKRRSEAIRKILIEKYHISPERISESTPEAMGYENKTGCNAMIVYIPENK

SEQ ID NO: 6812 - protein, 583 aa, B.fragilis
RRETTYKLKETTFKYMKKSILFTFVLCLLSQWSVAQDPKWVEKAKRSVFSIVTYDKDDKIQNTGNGFFVTEDGVALSDYSLFKGAQRAVIINSEGEKMPVECILGANDMYDIIKFRVGITVKKVPALQVAALAPAVGAEVYLLPYSTQKGGNVTRGKVKKVDNIGGDKYHYYTLDMVLKDKMVSCPVTTADGKVFGVAQKSSGQDTASISYAAGAAFAMSQNISALALSDPALNAIGIKKGLPEDEDQALVYLFIASTQSTPEAYAIALDDFIKTFPNSADGYLRRAGNYVFADKDENHMDKAAADLEHALKVAQKKDDTYYNIAKLIYNYQLSKPETVYKDWTYDKALENVRSAIAIQSLPVYQQLEGDILFAKQDYAGAFASYDKVNQTELASPASFFSAAKAKELSKAAPEEVIALLDSCIARCQTPITSDLAPYLLERAQMYMNVEKYRLALADYDAYFNAVKGSVNDLFYYYREQAAFKAKQFQRALDDIAKAIELNPEDLTYRAEQAVVNLRVGRYEEAEKVLKDALAIDPKYAEGYRLLGICQIQLKQEKAACASFAKAKELGDPNVDELIKKHCK

SEQ ID NO: 6813 - protein, 105 aa, B.fragilis
NKRTMEKYEIHFVGSVLDSNTSGDEQAKIVALIEQGHSVALDLSGCSYVSSAGLRVMLYAFKLAKAKSRDVCLVGVSQEVKDVMHMTGFDKFFRFYQTLDELSQP

SEQ ID NO: 6814 - protein, 647 aa, B.fragilis
CIFAPPKTKTVKQMKQNFFHRYLSAKVLPIWTILLIDIFIIVASCLLAYSLRYDFRSIFLDSSTIDKTILWTVVANLIFFRVFRTYSNVLRFSSFVDIMRIFVSLTVSYGVLMILSLLLDAYLGIRIGAISVLFMAYVINFAMMACSRIVVKMFFEVLNFDGSHTTNVFIYGAKEAGVNIAKSLRVNLRNHYRLRGFIADEPELIGKVMMGAKVFPNDEALIENMNDRDVHTIIVSPAKMEKLKKSDMIDTLLSNNVKLLTAPPLSEWGGQALNKTQLKEIQIEDLLQREPIEVDIHKIASHLEGKRVMITGAAGSIGSEIMRQVASFNPYKLILIDQAETPLHDIRLELQDRWRDIDAETIVADISNATRMEAIFREYKPQYIFHAAAYKHVPMMEDNVSESIQINVSGTRTLADLAVKFGSEKFVMISTDKAVNPTNVMGCSKRICEIYVQSLAKKLQKEGTRSVQFITTRFGNVLGSNGSVIPRFRDQIQRGGPVTVTHPEIIRYFMTIPEACRLVLEAGSMGNGGEIYIFDMGKPVKIVDLAKRMISLSGRTDVKIEFTGLRHGEKLYEELLNVKELTKPTYHEKIMIATVREYDYDEVKERIQKLIDVSYTYDQMKIVAAMKDIVPEFVSKNSCFEALDKKD

SEQ ID NO: 6815 - protein, 383 aa, B.fragilis
TLHATSTSFFYYTNQSVTLVFLQDAFDTLLGKKQTLHDGPCALNIPFNLKALIFMSSPKISIIIPVYMAESYLHRCVDSIITQTFTDWELLLVDDGSPDHSGELCEKYASAYKSRIKAFHKPNGGVASAREFGMQQARGEYSIHVDPDDWIDSNTLEELYQQAVKEQADMVICDFMMEYPNRQIHNCQKPQLLDSSSFMHQLLQQERHGSLCNKLIRTELYHKYQLHFPEKMICWEDLYICCSILLHGCKLAYVPHALYHYDFYTNDNSMVRHTDMRGLQAQIDFCRLMQAKISPEYLPELNELKGITLITAFRNQLLNEQAIRSLFPEINDWYVTRYGHDYEKSNYYGLTLVLRGYNFKTARRRMFVAKFLVQIKNKITRML

SEQ ID NO: 6816 - protein, 549 aa, B.fragilis
TTNAMKLRTIVKIAVISSVVLLCTGFAMFSFFRLSAAEGRKDFNLYTLVPGSATVVLETDDLAGMIQGINELSCSKDRHFLYVSKLFSYLKLHLYTLLEDTPHGLSKQMNKVLLSFHEPDNDRNQVLYCSLGNGDYELVEKFIRKYCSSSFPSKLFDYKGEEIRIYPMPDDSFLACYFTSDFLVVSYQKKLIEQVIDARLSKKSLLTDASFAKVHEDKRARVAATIYARMQPLSMGKATDGIRSCTQLGGWTEFDMKMNGDAIYFSGVSHDTDTCLTFMNVLRQQQPVEDFPGDILPASTFFFNKRSVTDMQAMLDFTARQEYTTSTYSDYIRDRDGELLAYLKENAGGEIVTCLFHSTDTLSNPCAVMSIPLRDGQQAERVLQGMLRTAPKEVDGPPKPRTTFCKTPLRAYTLYVLPRNTLFTQLTGITESALYIYACFYEGRLVLAPDVESLTAYLRHLDKKEILDDTPGYEEAVVNLSPSYNFMMVADLGETFSQPENYVRLIPAFFFRNQEFFRHFILSAQFTCTDGIVYPNVVLIYKGESDDIS

SEQ ID NO: 6817 - protein, 67 aa, B.fragilis
IFHFKVEIGDLDEIVFKEIFGLDLESQVVEYGHKKCSSDHAWPEEHTQTKQIKAVTIRIGTPLHPVL

SEQ ID NO: 6818 - protein, 490 aa, B.fragilis
  UNSURE (49): Identity of amino acid sequences at the above locations are unknown.
KKHYRLVISMFLSGGRTLSWRVRGQKSKGHSMLSEEGESEEDMEDVLFXNPEQFRRVAPYFPEEVFEHLPDLLAQGVKAAGNYRERDMLLMAMITNISACLPEVRVLYDQVYYSPHLYYMVIAHAGGGKGVVSLAGLLPGEIHRYYEKQNEEMRLVYDKAFFEWELELKKAQAEKRSPDFSLRPKEPVRKLLTLSPNVSKSMLISALEESGKLGCCINATELDMVSGAIRNDYGKHDDVFRAAFQHEVVSADFKVNGRQVVAHNPHLALCLAGTPNQLVRFIPSLENGLYSRFLVYTGQSDWCWRSAAPREGGEDHRAMFARLSGRLLELHQFLLQSPTEVTFTAAQWEEHTSRFSSHLSEVVNERDDSPGAIVLRHGLMASRIAGVLTALRKGECAWAMPQYVCSDEDFHTAMLMTDVLLEHSLLLSTSVRKSESKSGPLKPYFRLRPVLQTFSGTFTLYDAMDRAVEMGISVPTFNCLFMRTIELKNN

SEQ ID NO: 6819 - protein, 459 aa, B.fragilis
NMNYQETLDYLYNSVPMFQQVGSSAYKEGLENTYALDEYLGHPHTAFQSIHIAGTNGKGSCSHTLAAILQSAGYRVGLYTSPHLVDFRERIRINGEPIPQEYVIRFVEDHRLFFEPLHPSFFELTTAMAFRYFADQHIDVAVIEVGLGGRLDCTNIIRPDLSIITNISFDHMQFLGNTLAQIATEKAGIIKRGIPVVVGETTEETKPVFYRKAQEMEAPVTFAEEEQRLKGATKFKTRADRKPGQYTDHQPNTAAEKDTEYITGWIYENDVYPGLEGVLGGSYQLKNTNTLLSALPVLKSLGYKIEDHDVRNGFLQVDKMTGLQGRWQKLSDSPTVICDTGHNVAGISYIVEQLKQMKYNCLHMVIGMVNDKDVSGILSILPENAVYYFTKASVKRALPEAQLQQIGASAGLQGKAYPDVQSAVKAAQEKSLPEDLIFVGGSSFIVADLLSCRDALDLD

SEQ ID NO: 6820 - protein, 88 aa, B.fragilis
NTSLRNKMIIASGEQASQFVHHSFLIHSSLLIQILLRWFKGYNCPTKISGKPLLIFYHIDSAHKQDHYNVWQTLPSLWLAKRKAFRIV

SEQ ID NO: 6821 - protein, 354 aa, B.fragilis
TKYQNAINNMSLVNNFTVKKVRSSNLESLRLLSMFFVLVVHADFQALGMPDRTEMTILPLFSVFRIIIEAFAIVCVNSFVLLSGWFGINFHIKSLCNLLFQCAFFLIGIYTFTILIGIEPLSISGIKRCLMLTNNVWFVKCYLGMFIMAPILNAFVEKTDKRTFSTVLLSFFIFQTIYGWFSNGAPYFEKGYSAFSFMGLYLLARYVRIYQPSYTQWSKSKNLLMYISLSTFTALMLIITCYFDKVGYFCMFWTYTSPLVIAGALYLLLFFNRFAFQNKGINWIAASCFAVYLFHFFIWEYFMKPHIQQLAVTYNGISCLLVITGLLLTFFTAAILIDKIRLYIWNHFVSKYIS

SEQ ID NO: 6822 - protein, 421 aa, B.fragilis
MCLNPLSCMKKQLTIIIGLLLSSSITVHAQVAQKLRELGMENIRTIETGGTTVAAFEDNVYRGTYRGVGKAIIAGMEGMGNGNLELVALDGNGIPQLSISLPDTLIAGYKSGGISLKEVYERMEMSYDTDRPMGLLKGSAGVINRSAWKADIVLYPEVSLENSTFDKLYSYRVNLSPAVEMDLWKGAKATAQVVFPIATNMKGEYKKIRPGVMTISQEIRFRNNFLARIVAGNFTDHRIGAQAEVKYRTGNGRVELGAQIGTTGYSAITDDGWYIGTRQRINAAVKGSLYVPQFNTQLDLQAGRYLYGDYGLRGDCTRHFGEYAVGVYAMYVEGEVNGGFHFAIPLPGKKWNRNHAVRMKPAEFFAAEYSMVSWGEYADRKMGYTYQTRPAENRSNGFFQPEYIRHFLIKSIEKERNKKQF

SEQ ID NO: 6823 - protein, 250 aa, B.fragilis
RTYNYPFHLRNMLKLKTVSLLKHRSDLSILPEGKLLINTINAHSYNTALKDAGFAEALLKGGALIPDGASMVLAFRWLRKESIERTAGWDLFEYEMERLNRKGGICYFLGSSKNTLKLIKEKAKTVYPNIRIETYSPPYKPEFTEEENQMMIDAINAVKPDLLWIGMTAPKQEKWAYTHLDALEVTGHIGTIGAVFDFFAGTVERAPVRWQEHGLEWLYRLIKEPRRMWRRYIIGNALFLWNITKEKFSI

SEQ ID NO: 6824 - protein, 270 aa, B.fragilis
IKNNWNMKTIKLGYEGEEALLLCRELKRNGYSVKESRTFTQEMKEAVIDFQQKNKLDADGIVGYRTWEVLFFTGHPITERLTEEDFILVARLLDVEVAALKAVQQVETGGRGGFFAPGKPAILFEGHIFWNQLKKRNINPESHVKGNENILYPKWEKGHYKGGMGEYDRLEQARKINHEAADASASWGMFQIMGFNYAACGEKSVDSFVKAMCMSECRQLVLSARFIKQSGMLSALQAKDWAEFAKRYNGPAYEQNQYDKKLAAAYQKFS

SEQ ID NO: 6825 - protein, 64 aa, B.fragilis
RRILVLVEEQNPLSPRGRGIAVTDAPFYGNGTSERLFNIGLCLPSGPTLTDEDIRRVVDTIRKM

SEQ ID NO: 6826 - protein, 251 aa, B.fragilis
NADNYMIDKSEMIFGVRAVIEAIQAGKEIDKILVKKDIQSDLSKELFTALKGTLIPVQRVPVERINRITRKNHQGVVAFISSVTYQKTEDLVPFLFEEGKNPFFVMLDGITDVRNFGAIARTCECAGVDAVIIPAKGSVTVNADAMKTSAGALHTLPVCREQNLKTTLQYLKDSGFRIVAATEKGDYDYTKADYTGPMCIIMGAEDTGVSYDNLALCDEWVKIPMLGSIESLNVSVAAGILIYEGVKQRTN

SEQ ID NO: 6827 - protein, 276 aa, B.fragilis
NLKNHIMAQLSSVIGSILRDIVSAQHEANLYSLSLGDSYGKDGKAKDFQLPNVMVSDMELDLKYGVKSASESQQQFNIKYDKFRQFLKELCEQVARVAISSAVTTVMTSDIERNEGEKHFFERLKKENKLHQEFCTFLSRNMRNSFRNNLYDAVDSSNGSVNNDVVISRLTDVVRKKFLYDTDLDDLFAGEDGEKLRDTAEKNIIKAMEAIVKKLSVDANFKSLHSFPQLDVAITADELMNMPEEAIHSFKIKFSPRNYSVSQTDDDSLLEDFVMR

SEQ ID NO: 6828 - protein, 178 aa, B.fragilis
NQKNGLTTMKLSKFLSSRTGKRFYNLCYCWGACLVILGAVFKIAHMPYDNLFLMIGLFTEVFIFFISGFDEPAREYKWERVFPLLNDKNANINPHTGVSDTLMTEKYIQQLKRLENNVCKLNETYEAQIKGMTEHAKSLNEMNSEELKKETEKMAAYIELLNKQYSQMLNAMNVKTGK

SEQ ID NO: 6829 - protein, 63 aa, B.fragilis
LWKKNDKFKSPNELLKELSGQVFALVRELPKPLSREEMRELKRLCRFLNNTVKDQERKQEVRK

SEQ ID NO: 6830 - protein, 80 aa, B.fragilis
KTRKRLRRFPRNIQVFSSKLLSLFGKGLRVCHTIIGWSGVFEGQKSKGKLYESVSGKPRGVMIYISPSLSIIFKLYSPHE

SEQ ID NO: 6831 - protein, 201 aa, B.fragilis
RVGKNNKKYIMDEKLLPYFENVNDGGEQGKYLKEFGNEETQGGICLHLSITWLYLWHNSTNKAPNTIWQEMKTPTLIQQIASNQRSYQQYYPNIADNVSLATRNSLHVTGTNAGEIYQITTNALVKSNMLLYVINLEKDHKPVGRHAIAAIATRGRFYLYDPNVGVMSVPMPNMKELIEKIPYIYGKHSLNISQTSVYNIS

SEQ ID NO: 6832 - protein, 114 aa, B.fragilis
KSMNPILNKMGANANEQKKLLMECVSMLEKYVNRFPAEKGCASFSGEDMKLWKEVYFPKLVQTDILLDGKFFCGTSSGNSGIGTDGYFTGYEFFQFIYRAYKALYELEKASQMR

SEQ ID NO: 6833 - protein, 323 aa, B.fragilis
YSMKKREFKISFFLHVWERKAEEISLEEFHNDLRGARWKVLAESYRRWMRTGMTEEGKRLKGALNAVVVAGKCRGGHAANQVTELNGLALFDFDHCLEMLAGMKEKAGALPYVVGAFVSISGEGLKLIVRIDAENAGQYAVAYPVVARELERVLGHPCDMSCRDLGRACYASYDPEAYYNPGAGVFPWREQVDGLLQAEGECSAQSVGKACPAGVASEAGDGFMQVFLNDFDARNPFVAGGRHAFVLKLGRVARYKGFSPEEMRLLQKAVVEKYAQADFGSGEIEKTLSSGYQYVSVRRADAVMASQGPKVQGPLYALRGGGE

SEQ ID NO: 6834 - protein, 81 aa, B.fragilis
IKMKRITDRTNFSVINTVVNYSEAPYAVCPQCNIRTACRRFPSSIHSVRHLYPDRSTTQKHKYDKDKIQKKAVMIPIFTHI

SEQ ID NO: 6835 - protein, 449 aa, B.fragilis
KVSKKRETKNSFNIFLMTKMIMKKSDLFKIGVLLMATTLGTTGCSFGEDEKKPEIVVDPAEKTIEYYIAGKVTEGTTALSGVEVKAGEVTATTDAEGAYKLTVDSKKVYTVTFSKEGYMSIDNATATIADNAANRSMVSLSVKLSKKAPEKEVKADAEEEVVVTDKGDSNISQAEAAVIIPPKAIETTTTVSVTPYEEPAAVTTTVTPGNNVETPVAIANIEVETAQEVTLAKPVTLAIINKASEHTTFENVEVYNQKTTTRAGENWNKVADAIYDSETNSYKFTLPAGASLSGKYSMRVKSSKTTGKERIGETNKEEKKSNEGNMTAIPEYKINFEATAGWEYTVSPEKALMNAGVDAADAQGMGTTINSAIEAQEGTTGTYKVAHELIAGISGNHILYYLNQAKYCEKTYTFKISGGRTVTITLKFYTGMQITYTNVEASQHSGGKI

SEQ ID NO: 6836 - protein, 403 aa, B.fragilis
  UNSURE (84): Identity of amino acid sequences at the above locations are unknown.
VNRKIIMLNGKKIILGITGSIAAYKACYIIRGLIKQGAEVQVVITPAGKEFITPITLSALTGKPVISEFFAQRDGTWNSHVDLXLWADAMLIAPATASTIGKMANGIADNMLITTYLSAKAPVFVAPAMDLDMFAHPSTQKNLDTLRSYGNHIIEPASGELASHLVGKGRMEEPENIIRVLDEFFSSTGELAGKKVLITAGPTYEKIDPVRFIGNYSSGKMGFALAEECARRGADVVLIAGPVQQKTYHSHITRIDVESAQDMYEAAMAQYPLVDAGILCAAVADFTPDAVADKKIKREGDELLLHLKPTHDIAAALGKIKTPGQKLIGFALETNDEQRNAEGKLIRKNFDFIVLNSLNDAGAGFRYDTNKISILSCRGRTDYPLKSKTEVARDIIDRMIKEM

SEQ ID NO: 6837 - protein, 455 aa, B.fragilis
SDAECHECKNREIRRRDMAKYTLPPRQKMINLLYVVLIAMLAINISSDVLEGYGQMNNDYLPQIKKLEEYNRTLLERINSRNDKAALSAQNIDAAAGKLMDTLEELKEDIARKADKEKYEAGKLKAKDDLNAVPEVFLSVTGGKGKALRLSLDTFKEDALSLIKNDAHRQLVGTYLNTESPGTGISWEKETFSYLPAIGGVTFINKMQEEVLLCVNEVYRSLLYEEAEDGKGGAFVFINEDQMIVNKDGTVDLPVVQITPALTSILYTDYENPLNILTAGIPFNEVTFRMTNGKILKRGNHCIAVPDEKAQTATVTATQIKNGVARQLAEYRYTVKALPDPTPYILCTDENGRTVQYRGNVPINKRLVSNMTQLGASISDGPKANYEISSFEMVLIKGSSKAVTSIPNTGNKFSARQMELIRQLEKGDKFYITSIVVTGPGNKKKQIASINVVLI

SEQ ID NO: 6838 - protein, 418 aa, B.fragilis
CINEDRMMNGIFEKLYDMTAFSNIVAEPQFLVMYVIAFVLLYLGIKKQYEPLLLVPIAFGVLLANFPGGGMGVIQADENGMILVNGVMKNIWEMPLHDIAHELGLMNFVYYMLIKTGFLPPIIFMGVGALTDFGPMLRNLRLSIFGAAAQLGIFTVLLVAILMGFTPSEAASLGIIGGADGPTAIFTTIKLAPHLLGPIAIAAYSYMALVPVIIPLVVRLLCTKKELSINMKEQEKKYPSKTEIKNLRVLKIIFPIVVTTVVALFVPSAVPLIGMLMFGNLVKEIGANTFRLFDAASNSIMNAATIFLGLSVGATMTSEAFLNWTTIGIVVGGFLAFALSIAGGIFFVKLVNLFTKKKINPLIGATGLSAVPMASRVANDIALKYDPKNHVLQYCMASNISGVIGSAVAAGVLISFLS

SEQ ID NO: 6839 - protein, 398 aa, B.fragilis
EVCETNKRIIMNLDLDFILLNLLLLYTFWKAGRNISQSMDYWHNAGLCVILFSIVQGCRFARGNDYFAYSRIFREGSLHVENPFFSVINELLRIVGINEYSCFMVYAFTFALCAMIFMKDYRTYARYMFPLFLIGFMNFEESMIRQAFSYSFFFLYLKYLFKLKFNKPKDILHNHKKLIYCIIFAILTLAIHTGNIISLFVITTLYIFWRKPFQPQFAIPIYVACVYILPHIFNFNWLEPILSFAADTNERAAEYVKNADYWFSEKGENDQYDKNFIVEIIQVIGSSALMYFGYRLIIEKLPKHYALITMLNTFIIGLCIESIFVKLEILHRIGQTLDIVGYFALAIVVSYKTIKLKPIQKVAYVCLLWFVYYYVKYLFFSGRTMFIWDTHYPFFKFI

SEQ ID NO: 6840 - protein, 393 aa, B.fragilis
ITIDMAVKILSVDDELDLEVLLTQYFRRQIRKGEYEFAFAHNGLEALQKLLETPDFDIILSDINMPEMDGLTLLAKVNELKNPAMKCIMVSAYGDMDNIRSAMNKGAFDFATKPIDLDDLSRTIEKAIEQVRYIRESQQEHNQLESIKNDLAIAGEIQQTILPRSFPPFPELTEVVDIYASMTPAKDVGGDFYDFFQIDDERIGLVIADVSGKGVPASLFMAVSRTLLRATALRGVSSAECLTYANKLLCKESLDSMFVTVFYGIYHYKTGMMDYTNAGHNPPYLLRGGRTVECLPVASNFVVGVFDDIEFESNTLTFGIGDTLLLYTDGVTEAFNDKREQFSESNLQDILASMHESSSAKEVVTSVLQSVKTFSGDYPQSDDITLLSLQRIK

SEQ ID NO: 6841 - protein, 159 aa, B.fragilis
KSKENMSMHTWFECKIRYEKLMENGMNKKVTEPYLVDALSFTEAEARIIEEMTPFITGEFTVSDIKRANYSELFPSEEEAADRWFKCKLIFITLDEKSGAEKKTSTQVLVQAADLRDAVKKLDEGMKGTMADYQIGSVAETAIMDVYPYSSEPNDKPEV

SEQ ID NO: 6842 - protein, 134 aa, B.fragilis
FMKENSIKPYCYCGESESSLVDNAIFVYFGDEYRRVLLDEILWLEASGSYCVLCMENGAEITVSYPLDRIFNNDLPRGKFQRIHRSYAINVFKVTGFAGNYVHIGKKMLPVSESHKKNFLACFHKIYSKRALGK

SEQ ID NO: 6843 - protein, 206 aa, B.fragilis
YNMDNKKVRSTSSQVMELQQLIAGPLIATIEADSLSSQRYLDYLMKIAFESYDPVTGRTGKIRMLTFNYQSQDAGGGRTQSVSIPILTLVPLPLLQVQEADFDFDIKILDALSETAEEKFSLEEGKSVNEPQSGGGFKLRASLAPKQGEGSSTSNVQQSLSANMKVKVKMRQADMPAGLSNLLHLTASNMQVEETEAEEITEGGNK

SEQ ID NO: 6844 - protein, 193 aa, B.fragilis
RIAESSECAGEFGEKKQVQRLNGRGMKLTFFKRMGEKIRHPFRKEIPKTIPVVETAPQPVADNTTEATAEDSSVIRSADQCGEQARYFLLRNNKPVGKPFSYYHPEIRIVHVGSFVNAFLFFLRMCDQRLLTYRQTGEYLHCTAVFPDESGNLYFTNKVTCRNKENTVAVLKIDYVGLKPKITEIRFELNIKK

SEQ ID NO: 6845 - protein, 190 aa, B.fragilis
RIRERPSLPFLKPYSQSDMKSWLAAYVRLYHEKKTRDRLTAMGIESFLPVQEEIHQWSDRRKKIERVVIPMMIFVHVDPAERAEVLTLSSVSRYMVLRGQSTPAVIPDEQMERFRFMLDYSEEAIEVCSSPLAPGEQVRVIKGPLAGLEGELVTIDGKSKVAVRLDMLGCAHVDMPVGFVERVGKMEAVR

SEQ ID NO: 6846 - protein, 549 aa, B.fragilis
RNILMEKLHIRKIASLGLMLCFFTGVGAQTPVKVEKRKEHKSNTVIPVVKGNVTDTLSLVSFNDFHGAFACDKGVPGAGQLVQTVLTQKEKNKNTIVLSVGDNFSGSYFSRITRGNPLPEMFQEMDVKMSAVGNHEFDWGLPYLTDTAKVYMNFVAANIITDRGDTLEWAKPYRIVTLNLKNGGTVRVAFVGLTTTDTAHKTSPENIKGLAFVHPVYAARVETACRLKKEGKVDMVVLLMHIGTNMKNRDIIEEENAKLLPFLKGVDAIISGHSHEVVLSKVNDVPIIQAGVNGTHIGKLDFRVVKEEGGNRISYIGGDTIRTEGPSNAHIDSLVDKVLAVYGLSEKLILAKDALIHDRTINKWEYTPVGAYVTAAYVRSFLENEKVPAELKVLPVIGVNHFGGLRASIPAGEVTRLRAGNVLPFGGNVVAYEFTGERLKQLLDDGRRNKNGFLQTSYLKLHLNSKGNVETITDCRTNKIIRDDDKCIVVLDAFITSGGDGYDSKLFSGYEIGDFNSQNLETTVAFIDYLKSLKGFVSSEAAPIPIVQK

SEQ ID NO: 6847 - protein, 75 aa, B.fragilis
SHTLFFLQAYPMPISILCHTLPTYDFTAPWSYVQPLSRSHANAPRFLADLNPADKFMELNLPHVGHLSHGSLLTT

SEQ ID NO: 6848 - protein, 258 aa, B.fragilis
TMKLNLKNPIVFFDLETTGTNINSDRIVEICYLKVYPNGNEESKTLRINPEMPIPAESSAVHGIYDADVADCPTFKEVAKSIANDIEGCDLAGFNSNRFDIPVLAEEFLRAGVDIDMSKRKFVDVQVIFHKMEQRTLTAAYKFYCGRNLEDAHTAEADTRATYEVLMAQLDRYPEELQNDMSFLADYSSYNKNVDFAGRMVYDDNGVEVFNFGKYKGQSVSEVLKKDPGYYSWILNSDFTLNTKAMLTKIRLRELTGK

SEQ ID NO: 6849 - protein, 368 aa, B.fragilis
RHSWWDTSKSIKIQRNKYTIKPLLSMPKVLVVATSRKTKGGITSVVKAHETGEQWKKFHCKWIETHRDGNSVRKLWYLATALIEYICLLPFYDIVHIHVGLRTSVNRKLIFARIALLFRKKIIVHFHPATEKHLFDPMFSGNIKHLFELSNKLLVLSPKWIEWINEAYRGNKYNIQVLYNPCPSVKRSIQRENYILYAGILSDRKGYNRLIEAFSKIAAKYPDWKIKFAGNGEIEKGKSLAVKFGIEQQTEFLGWIAGNTKESIFQHASIYCLPSWGEGFPMGVIDAIAYGIPVITTPVGGLEKVFHDGIDAMIYETYDLKMLADKLEQLIKSETYRNSIVNEADKLVCSDFNIITICNKIEKIYENM

SEQ ID NO: 6850 - protein, 378 aa, B.fragilis
CHHRSQCCCNKRRTKQLYSSGCTCKNYKENMIYLICQDWSNTSNNHAGIKYLCNQIQEMYPESYKTFVIPAFWNDRSKSPIRIIASLQYHFARYKHRLYTKKLYNHIISKLRKGDKIILMEYMEKFFPMLHFAQKVKRYKFNIPLYAMVHLVPSRLEKGFSDKKTFDEWTICIDKFLTLGHSLTQFLITKGLPEDKVVTTFHYVDEYYHNKRPVRLHKNIRVIAMGNQMRNLKLLKTIVDNNPNVNFTICQGVNDLSSYFLKNTNVELIPFVEESELRQHMANADISLNVMEDTVGSNVIVTSLAMGLAMICSNVGSIKDYCDDSNTIFCNNSNVEDFSQAITALQTDRIRLNTMQQSAANMGLQFTIEKFVRQISAL

SEQ ID NO: 6851 - protein, 298 aa, B.fragilis
VGDRMESTYIELKDIAQEISDQGEGIEFNPLRLEEVNDGLNLIYSLEQKHRVQTVEELIALSEQYATRLAAITSYDDRIVKLTERRDAQYNKVKKQAAVLTKARTEIAREVEQQMAARLIPLGIPNVRFQVEMGLKKEPGPQGADTVNFLFSANKNGTLQSVSSVASGGEIARVMLSIKAMIAGAVKLPTIVFDEIDTGVSGEIADRMADIMQEMGEQNRQVISITHLPQIAARGRAHYKVYKRDNDTETNSHIRRLTDEERVEELAHMLSGATLTEAALSNARALLEPSLKERKIIK

SEQ ID NO: 6852 - protein, 263 aa, B.fragilis
FMLRSLYIQNYALIEKLDIRFETGFSVITGETGPGQSIILGAIGLLLGQRADVKAIRQGASKCVIEARFDISAYHMEAFFEENELEYEPECILRREVQSSGKSRAFINDTPASLTQMKELGEQLIDVHSQHQNLLLNKEGFQLNVLDILSHNEEALDVYHHLYQDWKKLCKELDELIVLAEQSKTDEDYIRFQLEQLEEAHLTAGEQEELEQEAETLAHAEDIKAGLYRVGQTLASDEGGLLACIERKSWRFEWAAESISTCR

SEQ ID NO: 6853 - protein, 151 aa, B.fragilis
IVRRSYNFLGISDEYSPVFSSLLLCCLNLFCNFVLCKNIKFKITDYMKFIVSSTALFSHLQAVSRVINSKNALPILDCFLFQLEDGTLSVTVSDSETTMVTSVEVNESDSNGKFAVAAKTLLDALKEIPEHPLTLISKPDTYEITGTVPEW

SEQ ID NO: 6854 - protein, 192 aa, B.fragilis
IMKLNNIKTGLLLAGLLLLFGNVKAQDNPFKPEWFVSGGINGITALNGSANNILGGKVSGGVWLNKIIGLRVDAEAGNVWLKGGYNAVTVGAGADILVNLMKNYTDEDRKFRLNAIFGLGYNYYSFGDDYPRLSKTNTMSGNFSLQAAFRLNSHLSIFAEPGIKISTKFYDIENKDDVFAGGMMTVGVIYKF

SEQ ID NO: 6855 - protein, 228 aa, B.fragilis
TQNSIKMNVTDNLKQVLAELPSGVRLVAVSKFHPNEAIEEAYRAGQRIFGESKVQEMTGKYESLPKDIEWHFIGHLQTNKIKYMAPYVSMIHGIDSYKLLAEVNKQAIKAERVIRCLLQIHIAQEETKFGFSFDECKEMLNAAEWKALANIQICGLMGMATNTDSKEQIEREFRSLNCFFHEVKKQYFANEPTFCELSMGMSHDYHLAIKEGSTLVRVGSKIFGERVY

SEQ ID NO: 6856 - protein, 347 aa, B.fragilis
QKSRNNHMYKAPPRDISIDILKCIAAIMITNSHMDILYGDYSYLATGGAIGDALFFFCSGYTLFLGRDMDFFNWYKRRINRIYPTVFTWALIAAVFFDQRYDMPEILIKGGGWFVSCIMIYYVVLWFIRKFLKKHLKWVFFMAATITLLWYFVLGFGEKSGNNMYGWNYFKWCYYFLFMLLGSMMGLKRNLNKKTYPFFEGLYDKHIHIIPIFLKLLICIVLFFGLCWFKCQTGIGWELLQISSLIPLLGTTYYFWRLSNTKLLTQAYHHHLTGPIIRFISGLCLEIYLVQYNLFTDKLNNIFPLNLLVIFSTILVTAYLLRCLSRIWSQTFKDGDYDWRDVTKLYS

SEQ ID NO: 6857 - protein, 316 aa, B.fragilis
CVCGLFPGVCFVDELRGLIGSGRVTSPYLHIGGGSNLLFTKDYEGTILHSRIGGVEVVAETDDDIVVRVGAGVVWDDFVDYCVQRHWYGVENLSLIPGEVGASAVQNIGAYGVEVKDLIVRVETLNIEGKEHVYDVTECGYSYRDSIFKRPENKSVFVTYVSFRLSKREHYTLDYGTIRRELEKYPGVTLDVVRRVIIAIREEKLPDPRVMGNAGSFFMNPIVGREQFEALQAEYPQMPFYEIDTDRVKIPAGWMIDLCGWKGKALGPAAVHDKQALVLVNRGGAKGADVIALSDAVRASVRAKFGIDIHPEVNFI

SEQ ID NO: 6858 - protein, 300 aa, B.fragilis
SRFMQTENFTLGKKELLILLGLTLVLPFPINWALIELNPLTLMAGADDVPTWIGFGGSYIGGIIGGIISIMILNKTLQQTGVLHHDLKLLQLDTIIYTQQQDWFTGFKQELAENLKSIDLYVLNTVVSSISMKNYAYAKEVLTEINKGLEYQMVAASFSFTSTHLSSEEKKYMNLVRRVQTEYSSFIKDILYYIPLAETISSRKKLNYDQLMDYTLSQYDYLQGQEGESTASGAIIPRVMEIDPSDDIRKELERIMEERLTGRTYLYHLKSDLAEATHQLIIYEENRINSILHKPEREMN

SEQ ID NO: 6859 - protein, 133 aa, B.fragilis
ILIINESNKMKKVICSEKAPGAIGPYSQAIEANGMVFVSGQLPIDAATGVMPDGVEAQARQSLENIKHILEAAGLTMADIVKTTVFLQDMSLFAGMNGVYATYFDGAFPARSAVAVKALPKDALVEIECIAAR

SEQ ID NO: 6860 - protein, 294 aa, B.fragilis
KTIIMAVDKTPSQVATSALQAIPFGSIIGGPLKACVEAQALAAKTTWEFIQNVGINVNPETGEKTAVNVSFSFIQGGRLVQLNIPLLTIVPIPYIAIREVDINFKANISASSSTTAETNESVSKDAALKASASMRFGCFKMNADMNASYSSKKDSKATSDSKYSVEYTMDVAVKAGQDSMPAGLSKILELLGNSLDVSDPAGTLEVNSNLLLIENGKETVRLIATYKDGSGLLAPDKLTITGTGANAADFKVSGDSKIIDLPEGTYTIKAEGSKKEVIVEVKKDTATPQEEVTE

SEQ ID NO: 6861 - protein, 88 aa, B.fragilis
FNYMENLETALLLMVVGMATVFAILLIVIYLGKLLISLVNKYAPEEQLPAKQGTQSPVPIPGNIVATITAAVNVVTQGKGKVAKIEKI

SEQ ID NO: 6862 - protein, 392 aa, B.fragilis
QKNIQMKIGIITICKVNNYGAELQAFATQKKLEQMGHNAEIINYLYYKDWHFKDTPLSQPFVPLDMKGKLSYWIKYRLMSWVVNKVLPIFNGNMRRRLHNYQSFIDSERFSAQYKSMDELYKTYPKYDIYMVGSDQVWNPSASSSIEPYFLTFAPKNAPKVTYASSFGVASIAPNLSKRYAKLLNNLDTIAVREQSGVELVKQLTGREAKLVVDPTLLLSKADWEPYMKPLAKISTQYILIYQLFPSQTVIDVALKIGKEKNLPVYNICKRAYGMKKIVGINNILDAGPSEFLWLIANATCMVTNSFHGTAFSVNFATPFCCVLNRKRKNNGRMISFLDKVDMSNRILYEDSIAELNVMTACSEVTNNHLRLLVNNSIDYLKSIIENKEQKC

SEQ ID NO: 6863 - protein, 191 aa, B.fragilis
HKNIMIQSKKDLKYYLSEDLKRFNNHKPNIKDWLLHNEIWYIFHYIRHLRYVEYYKNTNKNKILFFYHFFRYKRLGFKLKITIYPNTIGAGLRIYHVGDFIHIGAQCHIGHNCTLLPGVVFGNKYEKATDTQIIAGNNCYFGLGAKIFGSIIIGNNVTIGANAVVTKDIPDNAIVGGIPAKVLRFKEINIL

SEQ ID NO: 6864 - protein, 194 aa, B.fragilis
RRCIRIKRITNMKKIKTAFALPLFWLLFKVSKDMHKIQVDGQAWCQWQHKNFTLWNMCSLFIGFKEFRNLFYYRIGYLHHLIEWIFPRMTNLYITTPRSDVDSGLIIQHGFATIISAKQIGKNCKIYQQVTIGYDHTLQAPIIGDNVEICCGAKVIGGVTIGNNVIIGANAVVIKDVPNNCIVAGVPAKIIKKI

SEQ ID NO: 6865 - protein, 536 aa, B.fragilis
TCIMIKLNENIIRWIIAVPCILLTVCLVLYRAYRHSASDRERLALSLEEFRDKEKKSVLIQRVSQQMEEIAYQQKDISEKRRQEAVAQTQKANRMQQQAELARERALAAQLEAEKAYRMADEQKNLAMERQLQAEQSKRVADTLAFLALGRSLGTLSVTQYRSGNMELASLLAYTAWWFTKRYDGDVYHPAVFNALSLSCRQDQLWFGHKGAVTGIKLLSEGEEKARAGRNPLPGLVTVGKYGEMIRWKSENGQTYTSELLLNDPCYDFRDVLLRSDSQMYALSYCGQLISTDSAGIVTRFLPKGEYRQLISIASNLVLAVSTTGIYSFDCVNHEIQPYFQPEHSITCVGQMEGYLYVFFKNGTVALLSSDGTFLRFIDSLPENSVVTAFCPLTNERYAIGCREGVILICDKNGNIRQKLIGHQAAVTAISRKGNKLFSSSYDCTLRLWDLRKGKTESAVIVTSPGWIHTFCFHPDGTSVFIGDEQGRLYRVPVSPDHMATVVRQGLQRDFTREEWEYYIGKQIPFESYYLKTYQP

SEQ ID NO: 6866 - protein, 225 aa, B.fragilis
LFLINGKVLMRFILFIIFSLCLPLVMQGQEQNVWTQNDSLKLKKILVGQAEIRINREALRELDRAFSSPRRLFKSQSRSAILLIKDFLLYRPNVFTGKYHISTFKVNELNIRQDSLFMNVHMLGNKQLFVKSQLDIGDPRVLIKRKTDIQFKFTDHLAYRVYGGYTIDKNRTIILPTTATPYYVGTGFSYSLNKKLQLKTGIEYQYNVIYKRWEWVWNSGIRFNF

SEQ ID NO: 6867 - protein, 813 aa, B.fragilis
IKLIMKTNIQENLSRSLSTWGDKPAVVAKDGTVSYQMLERYSANIAQSIRQRLSVTDPSGLRNICIGVCMERNKTLVPAILAIFRLGATYLPIDPSLPDNRKRYMAENADMVLLLTDSSNEVGGIPSVRQLYLNGEQLSEPVVGDYTEVLPDDCAYIIYTSGTTGNPKGVRISYRNLDTFTRNLIDKKLYHLSDPANRYLAFASISFDASILELMMCIPAGGTLILAGEDERRDISLLDELIRREKVNIAFFPPSLLGMFADLDFPSFKTLLFGAEAIGEKLFNRLKQQPYRLMNVYGPTENTVLSTIRIVGKDTSYDDIGYPLKGTVCYVLSENLQQTTLGATGELCLGGPQVSLGYIGSVQLNEKSFISYDGERLYRTGDLVQQQPDGSIRFIGRKDTQVKIRGFRIELTEIAERLNRDPDVERAHVVVVERNGRQLLGAYLQPSVSGNFHPEEVKERLRAELPYYMIPNLWQVVDHFQRTINDKIDVRVLPAFTSLELKYVPPVHPGEVILCGILKEMLGLPQVSVEADLIDDLGLTSLDMLRLVTEANKKGCPINVSAVYTARNLRRLLLVPRHEPIYWYRQQNLKKPVIILVCGSAYFNHLYFNLADRLYPKYDFLVVDAIYDHFNKVATDIPELLEYYVRTVQPMIRERTVYALTGFCMGAELAVGLAEMLHRSMGIMPKVFALDGQAWQNPALCQNYPLLVFPGDTDEMVRERNEIINIYFRTTPNLIYQGEVIVLLSGLFHQQAGLSPEESWTEESYRIFRTEYDNCERLWNKYYPNAPVLRLPTDHWHFLEGESLEQLITVFLK

SEQ ID NO: 6868 - protein, 237 aa, B.fragilis
HQSMRLKEAVLTVCVMMITSGIKAQYTMGTTGMMNIPTAEMQQTGTFMIGGNYLPEELNPFKYNSGNYFVNITFFSFLELNYRCILLKSDYMAKKPKFNQQDRSLSVRLRPLKEGKYWPAIVIGSNDPFKDKGYNYFASVYGVATKSFMIGEHRLAATAGYYYPLSKDKYTLQDGIFGGLSYTPSFCKPLSIMAEYDSDGFNVGAAAKLWKHLSLNVFTREFKCISGGIRYECVLIH

SEQ ID NO: 6869 - protein, 206 aa, B.fragilis
GSTIKEKKKQGNIRRISLKNCNFAAQFKIIAMEFTGKIIAILQPRGGVSKTSGNEWKAQEYVIENHDQYPKKMCFDIFGADKIEQFNIQMGEELTVSFDIEARQWQDRWFNSIRAWKVERVGAGAPMGSGSSGSSSGTLFGHPNLLPVTQKTICLSKQTSFGKRHKTPKVLQDLSGFYTFYGVRKCHQTHLCKSIPHWDIQFRPYK

SEQ ID NO: 6870 - protein, 409 aa, B.fragilis
RTKMLSILINAYACSPNMGSEPGMAWNWCINLARHCELYIITEGEFRDKIEAVLPTLPQGKHMHFYYNPVSEEVRKMCWNQGDWRFYKHYKKWQWKTYEMAQEIIVKQHIDIVHQLNMIGFREPGYLWKLDKPFVWGPVDAKEKFPTAYLRDAGIKANLFIRLKNHITGLQLRYSQRVKKAVKKASVVTSASSESQKSFKKYFHIDAPLLNETGCYPKTTIINSTKEKGDLNLLWVGKLDFRKQLPLAIKAIARLANPHIKLHIVGGNNNSYQKLAMELNISHQCIWHGVISHNEVQELMQKVDIFFFTSIAEGTPHVVLEAINNNLPVICFDICGHGDSINEQVGIKIPLSTPQQSINDFAEKITYLFNHRDVLKQMSENCRVRQEELSWDNKAKQMVSLYKKVLSQE

SEQ ID NO: 6871 - protein, 255 aa, B.fragilis
LKEMKIRILGSGTSTGVPEIGCTCAVCTSKDPRDCRLRTSALVYTDDTTILLDCGPDFREQMLRVPFGKIDAVLISHEHYDHVGGLDDLRPFCRFGEVPIYAETYTAERLRSRMPYCFVEHSYPGVPNIPLREIEPNRPFLVNHTEVLPLRVMHGKLPILGYRIGKLGYITDMLTMPDESFEQLQGIEVLVMNALRIAPHNTHQSLSEALEAVKRIGAKENLLIHMSHHIGLQADVEKQLPPHVHFAFDGLELEC

SEQ ID NO: 6872 - protein, 620 aa, B.fragilis
SYRIIPKTEMKREVKFSLVFRDMWQSAGKYVPRVDQLVKVAPAIVEMGCFARVETNGGGFEQVNLLFGENPNKSVRAWTKPFHEAGIQTHMLDRALNGLRMSPVPADVRKLFYKVKKAQGTDITRTFCGLNDVRNIAPSITYAKDAGMISQCSLCITHSPIHTVEYYTNMALELIKLGADEICIKDMAGIGRPVSLGKIVANIKAVHPDIPIQYHSHAGPGFNMASILEVCEAGCDYVDVGMEPLSWGTGHADLLSVQAMLKDAGFQVPEINMEAYMKVRALIQEFMDDFLGLYISPKNRLMNSLLIAPGLPGGMMGSLMADLETNLESINKYKAKHNLPFMTQDQLLIKLFNEVAYVWPRVGYPPLVTPFSQYVKNLSMMNVIAMEKGKERWGMIADDIWDMILGKAGRLPGKLAPEIIEKAEREGRKFFEGNPQDNYPDDLEKYRKLMKEKKWETGEDDEELFEYAMHPAQYEAYKSGKAKEDVLADVAKRRAEKEQVPTEEAKPKTLTVQVDGQAYRVTVAYGDTELPVAPASQPSAAAGEGKEVLSPLEGKFFLVKNAQETPLKVGDAVKEGDVLCYVEAMKTYNAIRAEFGGTVTAISANPGDTVSEDDVLMKIG

SEQ ID NO: 6873 - protein, 265 aa, B.fragilis
WDRMPINSPQSATLGDNAVRVEMEAQILLGGINRSVFATADDELRPVMNGIYFDITTEDITMVASDGHKLVRCKTLAARGNERAAFILPKKPATLLKNLLPKESGMVVIEFDERNAVFTLESYRMVCRLIEGRYPNYNSVIPQNNPHKVTVDRMQLMGALRRVSIFSSQASSLIKLRMQENQIVVSAQDIDFSTSAEETQVCQYAGAAMSIGFKSTFLIDILNNISADEVVIELADPSRAGVIIPVEQEENEDLLMLLMPMMLND

SEQ ID NO: 6874 - protein, 282 aa, B.fragilis
NRLIMEKNISQEKRIEELEARLKEQEKLGSLGLLSAGIAHEIQNPLNFVINFSKLSGQLLADLADRVDEAKARIPEAELEDIKDILSGLRENVDKIKEHGDRAISIIRGILLYSRGKEDEFMPTQIQKLTKEYVWLAYHAMRANYKNFNIAIREDYAKDIPSIRLIPQDFSRAVLNVMNNACYAVWKKWQNAPEGYSPEIMVTLEKLDKRVVLSIRDNGEGMSPEVKRKLFDSFFTTKPVGQGTGLGMAIVRDIIENKHHGKVLFDSVLHEYTCFRFIIPIA

SEQ ID NO: 6875 - protein, 440 aa, B.fragilis
TKQINWYVATLISSLFAIKLKKYMRTCSPRLAKEKYCTGCMACSDACTHDAIKIVEKNCMPFVKVDTHKCMNCHLCEKACPIITPVKKNRAEKMNVYGGWANDEQTRIDAASGGGFSGLAQSFFHLHKEDKVAVIGATLANNRVYHQLIEQEKDIVLLTNSKYIQSDTQGIYKEVIERLKTGYWILFSGCPCQIAGLYGFLGKKRDSERLITIEVVCHGIASYEALDLHLKYYNSSRIYRFRDKRHGTQDWKQSQCTTIEQNGEEIKLKRKDDMFYAIYAGWMLDRKSCSNCQFAEINRVADITIADFWGLQVPDYYKQGVSLIIANNNKADTMIKAADAIYTFKESLRTAINGNPHLFTGYKLIQFHPIVMWPDFFRKILPKRIRFKTLTNRMPYKLFWALYKLGTIYLVKYQKKQLISKFQKDDNLLKLLNNANRGGG

SEQ ID NO: 6876 - protein, 332 aa, B.fragilis
PPKMNNTNPLVSIIVPVYKVERYIHRSIDSLLRQTYNNLEIILVDDGSPDNCPFICDKYAMQDNRIRVIHKSNGGLSDARNAALNVMTGQYVTFVDSDDYIADNMIEKFIETVKLYQCNMVVAGMNIIDKNNQIYDYRRTLTSTLSTGIDITRKLLKDVFPFNFVCAKIFESSLFEEIRFPVGRHYEDTATTYKLTHKCERIYCIADCLYFYELEREGNITSELNTSKAIKSYIDGCLNSQEQIFFCQKHKDFSDLLPVLTKRLQLWALLAIQSAISLGYKEYMFYYHQIRIYIRSLSYTQRMTHLQIALTFPIIYYSLYPLLSRLKKMYKN

SEQ ID NO: 6877 - protein, 78 aa, B.fragilis
MNNVAEHAREQKAGMKCPQCGAFIETSIFELLTSNALQCPSCHLRLNIDRMKSKAAFDALRKVQNAQENLERKSKFNG

SEQ ID NO: 6878 - protein, 405 aa, B.fragilis
IRYVSIYGTILYLNISVNVITLTSKYDCCGCTACTSACNRGAIIMQEDEQGFLYPHINTTQCIDCGLCNKVCPVFRYDVISNKKNVNPHILALHHHNEKTWISSSSGGVFASLTDYALRQAGVIFGAIYDDNFVVVHRRAETQEDTLKFRGSKYVQSNLTGIYQQVKFYLQEQRFVLFSGTPCQVEGLKGYLQRSYDNLLTVDILCHGVPSPRVFHDYLNFIRQNSDFHFTGIFMKDKTFGWGYQNSRLFFGKNASQFNTVLSRLWNDIFYSHLTTRPSCHACRFTNYLRPGDITIGDFWGIEKHHPQFTDSRGISLIMLNNTKAEIVWNHIKDDFNYLESNIKECIQPNLKYPVPEPVNKATFWQDYASMPFFQIMNKYYRITHQDLLKNRFYMILLTLKKRFT

SEQ ID NO: 6879 - protein, 307 aa, B.fragilis
LSVVRDLLTVPLKNAKLEAAGAGAIVLKSLFEEQIMMEADRLRNPSYYPEGSDYLAEYIRNHKLTEYLELIKESKKICTIPVIASINCYTDAEWVDFAKQIEEAGADALEINILALQSDIQYKYGSFEQRHIDILSHIKKTIRIPVIMKLGSNFTNPVALIDQLYANGAAAVVLFNRFYQPDIDVEKMEHTSGDVFSNASDLSTTLRWIGISSSLVSKIDYAASGGIHKPDGIVKAILAGASAIEICSAIYQNTNLFVGEMNRFLSAWMERKGFKHISQFKGKLNAKDVEGINMFERTQFLKYFSEK

SEQ ID NO: 6880 - protein, 61 aa, B.fragilis
NRPVYQCFYEITYTCKVILNDVKYYGVRRDKSKFHVLNYNIWLLVYLLYESKEMQYMIDYS

SEQ ID NO: 6881 - protein, 120 aa, B.fragilis
NLKVLYMGKNRNHYSFFLYFVFIIFVLLGCRPVRVQMPDGMYGRWKSSAGRPDITLGTDSIGSFAIVHHRIYDGKICPVRYPLHLNSPTKGYIRAEGCILFYYDSLKCVLYFSPGGDYTQ

SEQ ID NO: 6882 - protein, 64 aa, B.fragilis
INEVTDSLKKPLTIITMADLKTTFAGLTLKNPVIISSSGLTNSAAKKRKAGSCRCRSHCPEITI

SEQ ID NO: 6883 - protein, 371 aa, B.fragilis
ASIFPKDIFLVMKVSIIVPCYSVASKLPRCVHNLLAQTFTDWELILIDDGSTDNTWDICNSFTKNNAHIHAVHKENGGVSSARNTGIEIAKGEFITFIDSDDYVKPDYLQKLVEGQEADLVLCGFRSSTGIDFTPEPQYLIGDDLSKNIQAIVENDYLLYSPWCKLFRRDIIQKHQHRFDPEIRLGEDTIFCYKYLLYCSSIKVVASNSYFYDGVWGGYKKYVLTRQEVEYLDKAEITTLHDINQHFNCRIDLTYRGYHVAMLKGLYEKFRDYDTFEMYTRTHDVLPPEHFFANHKLSYIFWGIVELETLYVDKEYCAGKLFMQRLHHFFTIPTNQLLSYSYKMRLIHYLVKSKHYTMAHVLLIFLSILKH

SEQ ID NO: 6884 - protein, 465 aa, B.fragilis
LQQFITVVVNWLFDCKYQHLNLRIMGTKKNFVLDTNVILHDYNCLKNFQENDIYLPIVVLEELDKFKKGNEQINYNAREFVRELDLITDDSLFTHGAPLGEGLGKLFIVTGDSEAPKVHESFPARKPDHQILAVAEYLARKYPKMKNILVTKDVNLRMKARSIGILCEDYITDKVVNVDIFEKSNEVFENIEPDLIDRIYSSREGLDISEFDFKDIIRPNECFILKSDRSSVLARYNPFTHTVCRVNKTKNYGIEPRNAEQSFAFEILNDPDIKLVALTGKAGTGKTLLALAAALGKLTEYKQILLARPIVALSNKDLGFLPGDATEKVAPYMQPLFDNLNVIKRQFASNSTEVKRLEDMQKSEQLVIEALAFIRGRSLSETYCIIDEAQNLTPHEIKTIITRAGEGTKMVFTGDIQQIDQPYLDSQSNGLVYMIDRMKDQNLFAHVNLVKGERSELSELASNLM

SEQ ID NO: 6885 - protein, 70 aa, B.fragilis
PQFSDPAKPQFYKPPLIHQPRVKGQPYFLRSSRQTLTTCYLGPINNNLSSDNRCWHLSHNWKTTFPKPLG

SEQ ID NO: 6886 - protein, 168 aa, B.fragilis
SWLSSPQSPYSVSSFGYSPFNLTDSDMKTTDHFKRTIQMYLEQRAAEDALFAKNYRNPAKNIDDCVTYILNYVQKSGCNGFTDGEIYGQAVHYYDENEIEVGKPIQCQIAVNHVVELTAEEKAEARQNAIRQYQDGLMREMQNRNKPRTATKATVQEVQQPSLFDLGL

SEQ ID NO: 6887 - protein, 214 aa, B.fragilis
VETSNMGKQKFYVVWDGVTPGIYTSWTECQLQVKGYDSAKYKSFDNREEAERAFAASPYAYIGKNAKKKITGPSTEMLPAAVIENSLAVDAACSGNPGPMEYRGVHVASRQEIFHFGPMKGTNNIGEFLALVHGLALLKQKGFDMPIYSDSANAISWVKQKKCKTKLSRTAETEALFVLIERAEKWLKENKYTTPILKWETREWGEIPADFGRK

SEQ ID NO: 6888 - protein, 211 aa, B.fragilis
KNQSNKERSIFMKKSFEEALKHRRTYYSITNQSPVSDEEIERIVNLAVTHVPSAFNSQSTRVVLLLGENHKKLWHIVKETLRKIVPPEVFKTTEAKIDNSFASGYGTVLFFEDQSVVKGLQEAFSSYKDNFPGWSLQTSAMHQLAVWTMLEDVGFGASLQHYNPLIDEEVRHTWHLPEEWHLIAEMPFGLPVQGPGDKDFKDLDTRVKVFK

SEQ ID NO: 6889 - protein, 406 aa, B.fragilis
DCVSMNVSGATALWTRLSVKTEFGTKDYVVDVKKDLKNISSDFNERSLHSVVCMEKQLSADTLNRIWADSLRMRHIVAKTSVQVVSADSSKCIRSEGSCDNNCFVSPIWIAYVGNECEVEVAGFLSSTCWSVIRYSSSSFVLIVGVTFILFAFFYYVYKVKKHLSDSEVEEELLKERLEKERERYQDLEEKRRQYEQQLNLLQQEEKMRIRELSDLREKHKQKEAQIEVLSVEKKRSKEQQSILEKECQEGMLQITMLSDKLEKEKIDRGELQQKLAACELQIAELRKIKEMLGEELVIYKLCSGLTFDPRNHILDCAGNRIKLDAQGSRLLLLFLEASENKLSYEELLEMMWADRRKDKNRLWTAVSRLRKALAPTRVIIKVKNEGGYQLVLPKESDDFSQRELF

SEQ ID NO: 6890 - protein, 714 aa, B.fragilis
HPVSTTKSKVTIHKKVISMKTIIAEKPSVAREIARIVGATKREEGYFEGGDCAVTWAFGHLVQLAMPDGYGIRGFVRDNLPVIPETFTLIPRQEKTEKGYKPDSGVVSQIKIIARLFKESEQIIVATDAGREGELIFRYLYHYIGCTTPFVRLWISSLTDKAIREGLRNLEAGSKYDNLYLTAKARSESDWLVGINGTQALSIAAGHGTYSVGRVQTPTLAMVCVRYWENRRFTVEPFWQLHIATDGGNGEVVKFSSSEKWKEKEPATELYNKVKEAGTATVTKAERKEKTEDTPLLYDLTTLQKEANAKHGFTAEQTLEIAQKLYEKKLITYPRTGSRYIPEDVFVEIPKLLAFIGSLPEWKGKVNPKAMPTRRSVDGGKVTDHHALLVTGEKPLFLSKEDNTVYQMIAGRMIEAFSEKCVKDTATVTAECAGAEFVAKGSIIKQAGWRAVYGEEEKEETIIPGWQEGDTLTLKAASITEGKTKPKPLHTEATLLSAMETAGKEIEDDALRQALKDCGIGTPATRAAIIETLFKRGYMERCKKSLVPTEKGLALYSVVKTMRIADVAMTGEWEKELARIERGELPADTFRKEIEAYTQEITSELLSCDKLFARRDSGCKCPKCGTGSMQFYGKVVRCDNAECGLPVFRLKANRTLTDDEIKDLLTDGHTKLLKGFKSKQGKSFDAVVAFDGDYNTTFVFPERKTTKKFSGRKK

SEQ ID NO: 6891 - protein, 159 aa, B.fragilis
FTNPLNSKVMNNKKKNEGQTDFSYYGLYLLDYLRTNKFEQATDEAFIRERADRAAGTYEWAMLEGYPADGAQELAMRTLLEGLHYSKYAILREVVENEFSDDVPEAKRESFTRKLLPLVGNVFSIYDLSDDNFALSPDYDLLYTELTGAVVLYIEEYGV

SEQ ID NO: 6892 - protein, 110 aa, B.fragilis
SGDPPPVDKVSGMAPCRSQFHQPVFAVPGVQREGLPYEDGRRCRAEADTYPLVDADHVKDDEQDEESQQTSAEDEEVLSLQTLELDRTADTLVYRVFSHTLFIKGRMSAG

SEQ ID NO: 6893 - protein, 300 aa, B.fragilis
NMMFFKRTFKKTYQNQRMMKLVRMTGGLGNQMFIYAFYIQMKTIFPELRIDMSEMKKYKLHNGYELEDVFSIRPQTISAHKWLKRVIVYAFFSIIREKSEEELSIHKYTQHKRWTLVYYKGFFQSELFFKESSDTIRDIFSFNTENANFRTKEWAKIIKEQRSSVSIHIRRGDYTSAKNKIKYGNICTKEYYQKAISIILKKEPKAFFHIFSDDVEWTKAHLKIHHLPHQYISWNRGPDSWQDMMLMSLCRHNIIANSSFSWWGAWLNAYKDKTVIAPSRWSNVKKTPHILPESWISIDI

SEQ ID NO: 6894 - protein, 300 aa, B.fragilis
LNNPHTTMKVSIIILNYNTSRLTLNCINSIHKYLPNGTYEIIVVDNASQETDYQHLTENLSGQEITIIRNKINSGFGAGNMVGANIAQGKYLCFLNNDTELLEDCISPLCSYLKENPQTGCITPQQYNKHLKAVPSFNHPIGILYEILGNDIPERLCPARYPKRKKKVYQFPIHASWINGAFMMFPSEVFFKIKGFDTNIFLYYEEYDICTRLSYHNYQSTVLPTYRFLHLQGESTKVYALAYKERFISKLYVYKKHSNFLFYIIYKWIIIIKLCFHFRRWYILPTIILGKGLSQSMRHK

SEQ ID NO: 6895 - protein, 168 aa, B.fragilis
KALPEPSLESSVDCTLLFCTLPNERKKTMGKVQILAVLTMDGCHSSELYGKAYEDLRLDRCDIDKIRENALYHVTPDYSISMLDEWRKDNTNICYLAEATPDNSDYINGLLRMRVVDEIILYTVPFISGTGRHFFKSALPEARWTLSSQKSYSNGVYRSIYTRMETMK

SEQ ID NO: 6896 - protein, 1022 aa, B.fragilis
SSKPDRMKEALTTNQVVIVLVEHPVLGLLLVPYTVGRALDNTLEVIEQAFHASPDALKKMNEAEQKAIDIASHYTEKYLMGVYSREKTVPKFLRKLTEDSNKLKQQIRPFIEKKLLEMLELICNGQLPFYQKPSGSKQLYEHHAYRVHPHNLKTHFSFKVTEEHFSYQLQCYDDDTPVSLMEQKPVVVLTSNPATLLLGMDLYTFSHIEASRLLPFTKKERISADASLTEKYIDNIIIPLARYHDISIQGLKVVREKRPCNAYLYLEDTIYNDTLLRLDFRYGEQSFSPQPSDETRKFVFREQEEEEIVIHYFQRNSTAERKAVHLLQKAGLQCISDSHFKLSSAAPEKNITEWISHHRQMLLEEFVLSSDTQNKPYYLPEIRIEQSCEDGPDWFDLHITVVIGNQRIPFSRFRKNILEGNREYILPDGRIVLLPEEWFSKYTNLLEAGKESDKTIRLKRPFIGVIESILEKDRQSTSIKTLLSKEIPVPIGLKANLRSYQQKGFSWLANLYLEGFGGCLADDMGLGKTLQTLALLQYVYKPGNTTEAIRETIDLEKAESTSDCLPQKQVFFDEKGQFSLFPMQSKEEENSRIAPQVPQIPEPVQKQNRISPLHGTLIVVPTSLLHNWKREASRFTNLSMMEYNGSSPNEITRLKKYFDRYHLIFTTYGTMRNNIATLSQYTFECIVLDESQNIKNSESLTFRSAIQLRSKHRLILTGTPIENSLKDLWAQFHFLQPELLGNETTFSKHFINAIRQGDERMKDRLRQLITPFILRRSKQEVTPELPSLTEEVVYCDMTERQNELYQHEKNSLRNILLEQTAEKGQQSFTVLNGILRLRQLSCHPQLVLPDFIGDSGKLYQIIETFETLRSEGHKVLIFSSFVKHLELVAGEFRKRKWDYAFLTGSSTNRPEEIARFNRDPKIQAFLISLKAGGVGLNLTQADYVFIIDPWWNPAAESQAIARAHRIGQNNQVIAYRFITQGSIEEKIIQLQEEKRKLAETFITDTEQLPALTNREWARLLGS

SEQ ID NO: 6897 - protein, 388 aa, B.fragilis
KPDTRSCFIRTEIENNNNQRLTKTTTKFYLPLKSKVMRKVIIMFALAMDIVTANAQENVTVGTDNGSEPTNEARAEASSLDYASQGGGRQSQQPTLTKEVYPQKKADGDLYHGLTKKLTFDRMVPPHGLEVTYDKTVHVIFPSEVRYVDLGSPDLIAGKADGAENVIRVKATVRNFPNETNMSVITEDGSFYTFNVKYAAEPLLLNVEMCDFIHDGEKVNCPNNAQEIYLKELGSESPMLVRLIMKSIHKQNKREVKHIGCKRFGIQYLLKGIYTHNGLLYFHTEIKNQSNVPFDVDYITWKIVDKKVAKRTAVQEQIILPLRAQNYATLVPGKKSERTVFTMAKFTIPDDKCLVVELNEKNGGRHQSFVIENEDLVRANTINELQVR

SEQ ID NO: 6898 - protein, 416 aa, B.fragilis
YAVTIDMTKKWQYLCRCLLVLVFIGGVIPAKAQLVERVCRTDYKISPERKGELLLELDNISFFKDNEFAGTVIKGYSLPGLWIQPKFVYYPLKNIKLEGGVHMLWFSGAYRYPSVSYQDIALWKGEQYQKGAHLLPFFRAQISMKSVDLILGNIYGGSNHGLIAPLYNPELNLTADPETGFQVLAGAPWIDLDAWIDWQSFIFRDDTHQEAFTVGLSTRFKLNAPSSTFHCYIPLQILAQHRGGEIDTIRESSVQTLMNGAVGAGVTWNIDRRILKRVNVELDAAGYYQQKGELWPYHKGIGVYSSAFVDLGNFRVKMGHWICNDFITMFGIPYFGTVSTKKEGITYDKPQTLLCSIEYSRMFGKHYALGLKADAYQFFPGTMRSANGELTSPGSTTSFSVGVYFRINPSFLLKNF

SEQ ID NO: 6899 - protein, 427 aa, B.fragilis
NCGTFKRNAGKMVAKISVGNSLYGALAYNGEKINEAKGRLLTTNRIYNDGTGTMEIHRAMEDFLALMPVRSKVEKPVVHISLNPHPDDILTDTELQNIAREYLEKMGFGNQPYLVFKHEDIDRHHLHIVTVRVDENGRSIDTRNNFYRSKQITRELERKYGLHDAERKNRRLDTPLHKVDASAGDVKKQAGNIVKAISGQYRFQTMGEYRALLSLYNMTVEEAHGNVRGREYHGLVYSVTDDKGNKVGNPFKSSLFGKSVGYEAVQKKFARSKQEIKDRKLADMTKRTVLSVLEGTYDKEKFVATLKGKGIDTVLRYTEEGRIYGATFIDHRTGCVLNGSRMGKELSANALQEHFTLPYAGQPPIPISVPVEEPENRQGYSGGEYESHSSGMNLFAPEGSAVDAEEEAFIRAMQRKKKKKKRKGLGT

SEQ ID NO: 6900 - protein, 837 aa, B.fragilis
NDQTIMETLKEKFEALAHRIQSSGKPAAAWFPQFTPVTLLNAENWWEALAVCEYALDTHEDEALTAGFFELIFSAYDCNVEVDLNEEEYAYWWEKVISVCDRVAVFNGAGWSQKGAQYSEARYGKRDLSLLFPCYEKAAEMGSPEAEATVAYWRYMGFYCEQDRAEGERRFAALSSPEALLWGKYYRAYAEQHTGSKEKALLMRKELLDELPESHRLRAHVYAAMGDALDIEEGSVAEEAACYEKSLELVPNLYSLKNLATLYFRYPELGKQKELAFELWEKAWHAGVWSAANFLGYNYQEEEWLDMPKAIEWLEKGMLYCESYCAYELALIYLYNDEYKNVERGLMCLQRCVDDNYVEAIETLANVYFNGELVEENISYACQLLERAIELGSGSAAYRIGWMYERGLLSEEPDYQKAMEYYEKAVSMDNADGYARAALYLANGYSGVTDAGKSKAYYEKAAELGSCFAMVELAFLYENGEVVEQSYEKAFDLLQKAAGQEYPYAMYRVGLYLDRGVIGEPRPEEAFAWYAKAAERGDGDAIFALGRCYKNGIGTEENPDKALEWFTKGAENNEPRCLTEMGLAYEYGSGIEENPHQAVEYMTKAAEQNYGYAQFKMGDYFFFGYGACPEDNKQAVEWYEKAVANDIPLAMLRMGEYYLYDYDKLNESEKAFSYFKKAAEAECYNEGLGICYEMGIGVEDNETEAFKYYTLAAGSGNVMSMYRTGLCYYNGVGVKQNYTEAYRWFNDAAGNDNVASYYYLGKMLMYGEGCVPDAEAGLQWLMKAAEHNSDKAQFELGNAYLMGNGVEENDEIAMEWFEKAAENGNAKALKITGRRQR

SEQ ID NO: 6901 - protein, 103 aa, B.fragilis
HKTARRFERKSGKLTLRRRLRDAYAMPTHSVHSRTLRKRLYQSRRLKVVWIARYFFAPCPTKGKRLWVKFRFLPSSRWTGVILQNYMAKRMRIYALTAAILTK

SEQ ID NO: 6902 - protein, 280 aa, B.fragilis
FTDADMYVTASVQEQENNSSTIKSNRTMSNEIFVAFATQKGGIGKSTVTALAASYLHNVQGHNVAVIDCDAPQHSIHGLRERETKLIDESLYFKALACDHFRKIKKNAYPVIASDALNALDDAERMLAEEDAKPDIVFFDMPGTLKSNGVVKTLSQMDYIFAPMSADRFVVESTLQFAVMFRDNLMTTGQAKTKGLYLFWTMVDGREKNGLYDLYEDVIAEMGLSVLSTRLPDSKKFRRDLSEERKSVFRSTIFPMDVSLLKGSGIREFSEEISRIIKPQ

SEQ ID NO: 6903 - protein, 1951 aa, B.fragilis
RNMAFNRKQRLRDNIEAIRTAFVLDREQRTPTARERLLLERYCGFGGLKCILNPAKELTDAVHWAKSDLELFAPTVELHKLLRENTKDDTEYKQCMDAMKQSVLTAFYTPPEITGTIADVLHEHGIRPDRVLEPSAGVGAFVDAVLENKPDADIMAFEKDLMTGKILRHLHPDQKVRIQGYEKIEKPFMNHFDLAISNIPFGDVAVFDPEFTNSHDPARHSAARTIHNYFFLKSLDAVREGGIVAFITSQGVLDAPTNEPIREYMMNHANLVGVARLPNNLFTENAGTEVGSDLIILQKNSGKNGELYYNEKLFVQTEQTPIGTSVNGYVWSIGSLSHTDLTKSTDPYGKPAYKLMHRGDTVQLAEDLREHLKIELHQLDRELYEKHSLHSAQVESTDKSTPEEVQPSPKVEAVTSTANVFITEAEKPKVQPIDEKPEIEPRQTNHSNAVQLTLLDLWGMPIEEPAKKKKATKKENKAKSVPSKPKPQVTAAPPIESVKPATESKEAKPENAGRQSDPEDIYATLDWETNPPINGFYETMMSLTPERRKALRLEAERHRQEQLKKSGVKDTLNPAFVPSSGNQAEQKEAAKQPKAQPEATPVPVTDNSQSEKATTSLFPEFETGKPKEEVPDLTSRPYHRTPEMHLREGSLVANRARDIGYLKDITPYGATFQPLGLTGYQKEKALLYVSLRDAYERLYRYESNRHEANVPWREHLNTCYDEFVMRYGNLNAKQNVKLVMMDAGGRDILSLERAENGKFVKADIFERPVSFSVESHANVGSPEEALSASLNKFGTVDLDYMREITDSTAEDLLTALQGRIYYNPLVTGYEIKDRFIAGNVIEKAERIEAWMGENPESERMPEVKQALEALKDAEPPRIAFEDLDFNFGERWIPTGVYAAYMSRLFDTEVKIAYSASMDEFSVACGYRTMKITDEFLVKGYYRNYDGMHLLKHALHNTCPDMMKSIGRDEHGNDIKVRDSEGIQLANAKIDEIRNGFSEWLEEQSPQFKERLTTMYNRKFNCFVRPKYDGSHQTFPDLNLKGLASRGIRSVYPSQMDCVWMLKQNGGGICDHEVGTGKTLIMCIAAHEMKRLNLAHKPMIIGLKANVAEIAATYQAAYPNARILYASEKDFSTANRVRFFNNIKNNDYDCVIMSHDQFGKIPQSPELQQRILQAELDTVEENLEVLRQQGKNVSRAMLKGLEKRKHNLEAKLEKVEHAIKSRTDDVVDFKQMGIDHIFIDESHQFKNLTFNTRHDRVAGLGNSEGSQKALNMLFAIRTIQERTGKDLGATFLSGTTISNSLTELYLLFKYLRPKELERQDIRCFDAWSAIFAKKTTDFEFNVTNNVVQKERFRYFIKVPELAAFYNEITDYRTAEDVGVDRPNKNEILHHIPPTPEQEDFIQKLMQFAKTGDATLLGRLPLSETEEKAKMLIATDYARKMALDMRMIDPHYEDHPDNKASHCAKIIAEYYQKYDAQKGTQFVFSDLGTYQPGDGWNVYSEIKRKLTEDYGIPPSEVRFIQECKTDKARKAVIDAMNAGTVRVLFGSTSMLGTGVNAQKRCVAIHHLDTPWRPSDLQQRDGRGVRAGNEIAKHFAGNNVDVIIYAVEKSLDSYKFNLLHCKQTFISQLKSGAMEARTIDEGAMDEKSGMNFSEYMALLSGNTDLLDKAKLEKRIASLEGERKSFNKGKRDSEFKLESKTRELGNNTAFIDAMTEDWNRFLSVVQTDKEGNHLNIIKVDGVDSADEKVIGKRLQEIAKNATTGGLYTQVGEFYGFPIKVVSERILKEGLEFTDNRFVVEGNYKYTYNNGHLALADPLAAARNFLNAIERIPSIIDQYKAKNEVLEREIPQLQEIAGKVWKKEEELKQLKSELAALDRKIQLELAPPTPEITEKEHEGQQVKPEAKGVRNGIRQYPEDTSPQIRNPSESIIANHTITGHPGLYAKEETRSKGLKI

SEQ ID NO: 6904 - protein, 450 aa, B.fragilis
  UNSURE (399): Identity of amino acid sequences at the above locations are unknown.
YDMAKIQIKSEKLTPFGGIFSIMEKFDSMLSPVIDSTLGQRCSSIFGYQFSEIVRSLMSVYFCGGSCVEDVTSQLMRHLSYHPTLRTCSSDTILRAIKELTQENISYTSDQGKTYDFNTADKLNTLLINALVSTGELKEIEEYDVDFDHQFLETEKYDAKPTYKKFLGYRPGVYVIGDKIVYIENSDGNTNVRFHQADTHKRFFALLESQNIRVNRFRADCGSCSKEIVSEIEKHCKHFYIRANRCSSLYNDIFALRGWKTEEINGIQFELNSILVEKWEGKCYRLVIQRQRRNSGDLDLWEGEYTYRCILTNDYKSSTRDIVEFYNLRGGKERIFDDMNNGFGWSRLPKSFMAENTVFLLLTALIHNFYKTIMSRLDTKAFGLKKTSRIKAFVFRFIXVPAKWIMTARQYVLNIYTENRAYAKPFKTEFRLESFLFRLNLRITSSRIVG

SEQ ID NO: 6905 - protein, 478 aa, B.fragilis
YLIYMEQTKNEPKNENKAAPDNGKPKNRRQAESHQACLNGQGAKEEGKAKERKPLTEAQRLKRQKMIVLPAMVLVFIGAMWLIFAPSSDKEQQPGTGGYNIEMPDADKANRQIIGDKAKAYEQGAMEERQENRSRAMQELGDMFDREVAETDGGRDFDLANPGNAEEATSTSSAPKTIQSSAAAYRDLNATLGNFYEQPKNDNTEMDELLERIASLESELESEKGKASAMDDQVALMEKSYELAAKYMGGQNNGKPEPVQAAEPYLVQKTGKNTAAPVRQVTHQVVSSLSQPMSNAEFVASFSQERNRSFNTAVGGTTVSDKNTISACIYGAQSVTDGQAVKLRLLEPMAVVDRIIPRNAVVVGTAKIQGERLDIGITSLEYDGTIIPVELSVYDTDGQPGIFIPNSMEMNAVREVAANMGGSLGSSINISTNAGAQLASDLGKGLIQGTSQYITKKMRTVKVHLKAGYKVMLYQDRD

SEQ ID NO: 6906 - protein, 335 aa, B.fragilis
PMNFDNLHQILRSLYEQMMPLCGDMAGVAKGIAGLGALFYVAYRVWQSLARAEPIDVFPMLRPFAIGLCIMFFPTVVLGTINSIMSPVVQGTAKMLETETLDMNRYREQKDKLEYEAMMRNPETAYLVSNEEFDKQLEELGWSPGDMVTMAGMYIERGMYNMKKGIRDFFREILELMFQAAALVIDTIRTFFLVVLAILGPIAFAISVWDGFQSTLTQWICRYIQVYLWLPVSDMFSTILAKIQVLMLQSDIERMQADPNFSLDSSDGVYIVFMIIGIIGYFTIPTVAGWIIQAGGMGSYGRNVNQTAGRAGSMAGSVAGATAGNVVGRAGKLLK

SEQ ID NO: 6907 - protein, 375 aa, B.fragilis
IELYLLTELQEWEIMNYIAIVCWMLFGSVLRLCAQTCGATYITEFQYDLKKRTNWCNLLRLDAYVPIGTKGILEFASIHVYKTRPERIINDLQTFSNIEEDNLPCAIAVLGYTRLIGNITLFAGIRNLNEDYFTTPCMSLFTNSSCGIFPTLSANYPIANYPLAALCLDYKMTLGRFGIESSLYNGKGYNGWSKGKHPFTFNPRKDGVFSITEINYQTEYGKCFGGFSLHTNGDMPDVAGEWKTREREKKVSPKMMFAWWGYAERKLWSRVRQEVNLLVQYTRTSSVFSECRNYMGAGVTWIYVPGGQKRHEAGLFLSAAQFKSCNEVAGEVTYRYSFNRDTYIQPAIHLIKNGGGLHEVFLIRMGYILNGGRVR

SEQ ID NO: 6908 - protein, 427 aa, B.fragilis
RRILHRLILNLKKLRTMKSTFSVIYYLKRQVVKKDGTVPVMGRITVDGSQTQFSCKLTVDPKLWDTKGGRVTGRSTAALETNRMLDKMRVRINKHYQEIMERDNFVTAEKVKNAFLGLEHRYHTLLQVFRQHNEDYAKQVEAGMKAKGTFDKYKIVYKHLQEFLTIRYHVKDIALKELTPAFISDFEMFLRTDKHCCTNTVWLYVCPLRTMVFIAINNEWLTRDPFREYEIKKEETTRSFLTKDEIRLLMEGKLKNAKQELYRDLYLFCAFTGLSFADMRNLTEENIRTYFDEHEWININRQKTGVVSNIRMLDIAKRIIDKYRGLCENGRIFPVPHYNTCLAGIRAVAKRCGITKHITWHQSRHTAATTVFLSNGVPIETVSSMLGHKSIKTTQIYAKITKEKLNQDMEHLAARLNQIEEFAGCTI

SEQ ID NO: 6909 - protein, 61 aa, B.fragilis
TSGYRSEIGIVTRPENDSFGRSADNSGTHVADIVKLDDASVTVSPTVYFRKFLYWIGLTGK

SEQ ID NO: 6910 - protein, 84 aa, B.fragilis
GCSLKYENTANTKMAKQPIAFKNFFIYSVVLVTHNKYRRFFLSIKKTFLTKTYKLKINKMPPYKNLHQKSSLCEKSSLSLGSTN

SEQ ID NO: 6911 - protein, 114 aa, B.fragilis
NPPLHHFIDGILGCLPCLVSGLDEEEAYHLVLLAGRDNGEVFVLAENALSGAQRFQLHTAMGAGTSANGVRKVVVALPRMSALGTDIRAVRPLDCVMLEAMTESVCLLRGGQSR

SEQ ID NO: 6912 - protein, 66 aa, B.fragilis
LRDLTGKQGQASCFREKSPALRVVFFPKNLAFPNPYLFKHPKRKRPMRQKDALKKMSDKREADKIV

SEQ ID NO: 6913 - protein, 532 aa, B.fragilis
NIFQMAKKKSEKDVLIVRDEKTGEISVVAGLDADGSPKRTPAKAENAQSFLQFDRHGDVLDNFFKNFFRQCKEPSRFGFYRVAADQADKLMEVMKDLLKDPEANKELLAPHKVDTSGYEKQVKEEQTAGKTEQTEQKQEEQPKENQKQEEMEKKQESPQQTQGRQGYQPIDESKINWQELEEKWGVKHDDLEKSGDLQKMLNYGKSDLVKVSPKFGGEAFELDARLSFKKDGEGNVSLVPHFIRKEQKLDEYKEHKFSDEDRKNLRETGNLGRVVDIVDRETGEIIPSFISIDRKTNEITDIPANKVRIPDRIGKTEITKQEQDMLRAGLPVRDKLIERNDGRKFVTTLQVNVEQRGVEFVPGTGRSPRTAQTQEAKNNPTQGQAQGMENSAAPQKEQRRNTWTNADGSIRPISKWSGVNFTDQQKADYAAGKAIKLENVTDKQGFHATMYIKFNPEKGRPYRYDTNPDNAQKVAPSNESRTQVAVNSEGKTNEATKNLKEPLQKGQTAPKDDKQQKLQEKPQKKIIKGMKM

SEQ ID NO: 6914 - protein, 785 aa, B.fragilis
TFIHVPKINVIKIMERSGNFYKAIQLGYILISILIGCMAYNSLYEWQEIEALELGNKKIDELRKEINNINIQMIKFSLLGETILEWNDKDIEHYHARRMAMDSMLCRFKATYPAERIDSVRSLLEDKERQMFQIVRLMDEQQSINKKIANQIPVIVQKSVQEQSKKPKRKGFLGIFGKKEGTKPTTTTTTLRSSNRNMVNEQKAQSRRLSEQADSLAARNAELNRQLQGLICQIEKKVQSDLQNRESEITAMRKKSFMQIGGLMGFVLLLLVISYIIIHRDAKNIKRYKRKTTDLIEQLEQSVQQNEVLITSRKKAVHTITHELRTPLTAITGYTELLRKECNSGNNGQYIRNILQSSDRMRDMLNTLLDFFRLDNGKEQPRLSPCRISAITHTLETEFIPVAVNKGLSLSVKTGHDAIVLTDKERIIQIGNNLLSNAVKFTEEGGVSLITEYDNGVLTLVVEDTGTGMTEEEQKQAFGAFERLSNAAAKEGFGLGLAIMRNIVSMLGGTIRLDSKKGKGSRFTVEISMQEAEEQLGYTSNTPVYHNNKFHDVVAIDNDEVLLLMLKEMYSQEGIHCDTCTDAAELMEMIRQKEYSLLLTDLNMPGINGFELLELLRSSNVGNSPTIPVVVATASGSCNKGELLAKGFAGCLFKPFSISELMEVSDRCAIKETPDGKPDFSALLSYGNEAVMLEKLMTETEKEMQTIREAATEKDLQKLDSLTHHLRSSWEVLRADQPLNVLYRLLHGDVLPDGEALSHAVTAVLDKGAEIIRLAEEERRKYEDG

SEQ ID NO: 6915 - protein, 138 aa, B.fragilis
KQIHQLKKKMRMSISRTKMLQVSKCLIGLAVMMLQSCDVADNRRDLLCGNWESVEGKPDVLIYKEGEAYKVTVFKRSGLRRKLKPETYLLQEENGNLFMNTGFRIDVSYNEATDILTFSPNGDYVRVNPKPDHPIGEQ

SEQ ID NO: 6916 - protein, 133 aa, B.fragilis
FETQLPQLLNPHKKIKIKNRTDMGTTMATKFVAWEVPTLEALKGSKVYILREKLNNGGQMNREEKDWLTRNVNSNTYFKSAVPLQGWRFDFSDVLRTFIVCQYGHWTEYKATDKTGLRRYLYGRIDNIVELEK

SEQ ID NO: 6917 - protein, 174 aa, B.fragilis
LKNQMTMNILNNKNKRISIFKALALCLFAAVSLTLVSCDDDMDIQQSYPFTVEIMPVPNKVTKGQTVEIRCELKKTGDYANTLYTIRYFQFEGEGTLKMDNGITFLPNDRYLLENEKFRLYYTAAGEEAHNFIVVVEDNFDNSYELEFDFNNRNVKDDGAISVVPIGNFKPLTR

SEQ ID NO: 6918 - protein, 150 aa, B.fragilis
GLKHLSIYGSGNTTFTNGIKSHDELQMSIYGSGNISGNSFSCTKLAARIYGSGNVNLKRISTSDTQVNISGSGNVLLDGKSTEAEYHIAGSGDINATELKVENVNARISGSGSIRCYATENLTGGVSGSGNVAYKGNPQINFSKRGLQKL

SEQ ID NO: 6919 - protein, 433 aa, B.fragilis
FLMQQNNSEKWNFLSNKKLFWGTIIVILFLFLLSAWLFFWNRERHFFNDNYVLDNALWGTLGDFVGGFIGSILAFIGVIVTCQIFIEQRQQTIDLNEEQKRITSNSQKSQINQSEIQRFNSLFFELIDLHRTQVDYLMKMPLVGFEAENSKETNFFDRFMEELHSNSNVNSSYARAFIVAKRKYLQLYLSNSTILAPYFRVLYRLFELIDKANIEEKEKVRYAKIARAQLSESELFILRYNSANLYGDNFIEYINKFRLLKHLPLLSLLEFKNIRNVIAEGDSLYQYSINMLFFSVWKRIYNITVGHEDRTNDFVQLYDERKRYKFELKMPKKHRTALYLTIDTSRPNRDPLLKCFRNFNESDFGKLLTNFLLEIYKYSNFSRYNKDENIEYHKKVFHDGSVTKIVCWILNTENKLLRVSHPSRDKFYGISED

SEQ ID NO: 6920 - protein, 386 aa, B.fragilis
PNMQETNSKINKYDYLIVGAGLFGSVFAHEAHKRNKRCLVLEKRPWTGGNIYCENINEIHVHKYGAHIFHTDKKKIWDYVNSLVEFNQFINSPLASSGGKLYNLPFNMNTFYQLWGVQTPMEAEIKLEEQRHPYRIITNPQNLEEQALKICGSDIYYRLIKGYTEKQWGRAATKLPAFIVKRIPFRFTFDNNYFNDPYQGIPIGGYNRLINALLEGIEVKTNINYLENRNKWDSIAEKVLFTGCIDEYFNFCYGKLEYRSLRFETHCLNDISNYQGNAVINYCDSNIPYTRVIEHKHFEFGTQNSTIITYEFPEELSIGKEPYYPINDEKNTTIFRKYQTLAETNKKVLLGGRLAQYTYADMDDTVEAALSLWNKELQNSSQTKLI

SEQ ID NO: 6921 - protein, 246 aa, B.fragilis
KRTHMNGTISMTDILLAVSVGCNLWFLFLLLYDRIMETRFVRFLKGIAGLWRSLDGMAAKQETVREASPAETSDIIGKSRFRMASTRTTAAIPTQEAATSEKGIELSEEEATFDDGNTETVSHPAQVPEEKLDETFTSIPPSELEFGEDEPEDGTPDTPRATGSSFDEIDDAVRAAKNPEATTAERERAAKVFSDMEGTELYEKLMSGSTELSIRIKGLIEVRLKKPKKEFTVPDNIDEFNIRDYV

SEQ ID NO: 6922 - protein, 83 aa, B.fragilis; identical to SEQ ID NO: 6082

SEQ ID NO: 6923 - protein, 452 aa, B.fragilis
SGWQKRKGENTKMDKTTIIVVEDNIVYCEFVCNMLAREGYRTVKAYHLSTAKKHLQQATDNDIVVADLRLPDGNGIDLLRWMRKEGKMQPFIIMTDYAEVNTAVESMKLGSIDYIPKQLVEDKLVPLIRSILKERQAGQRRMPVFARDGSAFQKIMHRIRLVAATDMSVMIFGENGTGKEHIAHHLHDKSKRAVKPFVAVDCGSLTKELAPSAFFGHVKGAFTGADCAKKGYFHEAEGGTLFLDEVGNLALETQQMLLRAIQERRYRPVGDKADRSFNVRIIAATNEDLEAAVSEKRFRQDLLYRLHDFGITVPPLRDCQEDIMPLAEFFREAANKELECDVIGFDGEARKTLLTHVWPGNVRELRQKIMGAVLQAQTGLVTKEHLELAVTKPTSPVSFALRNDAEDKERILRALKQANGNRKVAAELLGIGRTTLYSKLEEYGLKYKFRQS

SEQ ID NO: 6924 - protein, 433 aa, B.fragilis
FLFNICYMRSLFLIFFFCYVTGKAQDRACVVSEKDSIPLSNVYICLKDRRVIAISDEKGVFSLEKYDSLSLNDTLYFSHINYLHKKLSYGDLIKNRCTVFLIENNRVLEEVSIFSNRHLNRFLHYEILSPLKRGVYSFASVLVDGQIYIVGGSTSCGPFQSNIRSTLFWEKYSNMMYRYDIKQDKWETIRHKFRERAYHTAGYYDGKIFILGGKRLSETRIVDYLDNAIEIYDIKRDTVWTDYTNPHQATLLGSVVYKDNMIVLGGVKKVLQNNEGVYSDEMHLWNLKSGYWYELGKMPIRQAPETILVDHCIYLIGNRNGGGWSIECYNLLTGAWTNAGHLLYRLGWPSLAYHNDIIYIFEQGVVQTFNIKSRQVRSYMIDLKLKSPALYYFDGKLYILGGFYMGDPSRNVYSVDLKEFDKTEVDYYYNNVR

SEQ ID NO: 6925 - protein, 85 aa, B.fragilis
HRVKTCSLDVNKKFFKCKRLVICAQEPANLQKTLTMLIEERYKDEDTGSDDVNSLPKLELSYSADVCFFLLKQAKRTIINLKIKK

SEQ ID NO: 6926 - protein, 77 aa, B.fragilis
HFYNVVKWVYTKYVLLYPLKCSKFHLCAKVQILFYILLISIYRYLYGSIDNIQLSMTVIADWVTGFFATFFVRHHAH

SEQ ID NO: 6927 - protein, 941 aa, B.fragilis
IPDKQGYRPSGRVQGSEGSVPLHLLRRSAGSLRPVRHPLHGRHRPVDMYRLRRGIVFRPRMADLRAERPVRRIRADEIGSGKEPSPIPYQPAADHPIIQTATKGRNDMRNTSKMTTLENKFPLLAVEHGCIISKDADITVAFEVELPELYTVTDAEYEAIHGCWCKAIKVLPDFCVVHKQDWFIKEKYKPELQKDDMSFLSRSFERHFNERPYLKHTCYLYLTKTTKERNRMQSNFSTLCRGHIIPKELDKETAGKFMEAAEQFERIMNDSGFVRLRRLSTDEIVGTEKSTGLIERYFSLMPEGDTTLQDIDLSAKEMRIGDNRLCLHTLSDAEDMPGKVATDIRYEKLSTDRSDCRLSFASPVGLLLSCNHIYNQYVIIDNSEENLQKFEKSARNMQSLSRYSRSNSINREWIDQYLNEAHSYGLTSVRAHFNVMAWSDDAEELKHIKNDVGSQLASMECVPRHNTIDCPTLYWAAMPGNAADFPAEESFHTFIEQAVCLFTEETNYRSSLSPFGIKMVDRLTGKPLHLDISDLPMKRGITTNRNKFVLGPSGSGKSFFMNHLVRQYYEQGTHVVLVDTGNSYQGLCEMIRRKTNGADGVYFTYTEEKPISFNPFYTDDYVFDVEKKDSIKTLLLTLWKSEDDKVTKTESGELGSAVNAYIERIRADRSIVPSFNTFYEYMRDDYRCELAEREIKVEKSDFNIDNMLTTMRQYYRGGRYDFLLNSTENIDLLGKRFIVFEIDSIKENRELFPVVTIIIMEAFINKMRRLKGVRKQLIVEEAWKALSSANMAEYLRYMYKTVRKYYGEAIVVTQEVDDIISSPVVKESIINNSDCKILLDQRKYMNKFDAIQSLLGLTEKEKSQILSINMANNPSRLYKEVWIGLGGTQSAVYATEVSAEEYLAYTTEETEKVEVYRLAEQLGGDIEAAIRQLAERRRKKE

SEQ ID NO: 6928 - protein, 146 aa, B.fragilis
IQSNMSEKRRNKGGRNPKLDPAVFRYTVRFSEEEHNRFLSMFEKSGVYAKSVFLKAHFFGQPFKVLKVDKTLVDYYTKLSDFHAQFRAIGTNYNQVVKELRLHFSEKKAMALLYKLEQQTVELVKLSRKIVELSREMQEKWSQKSV

SEQ ID NO: 6929 - protein, 94 aa, B.fragilis
KCIKIMGKKIFATLIVAVVATFAGYNIYQSQRAKNTMSELAMANVEALADINETDSSGQTLYCCGNEDTCAKGEDEDTGEEFIIHGVLSSKKCK

SEQ ID NO: 6930 - protein, 313 aa, B.fragilis
RLIKLYSPMIHIACNIDSNFTVHCAVTLVSLFENNRESEFCIHIVASTLPSEDKEVLKTIAGRYGNEVRFYFPPEDLLHNFSIKKFGKRISMATYYRCMFSAILPEEVDKVLYLDCDIVILGDISEYWNTDMSNYSVACVEDIGSNEDERYDILKYDKSFSYFNAGVLLINLRYWREHKIDEQCEQYFLRYPERIRFNDQDLLNAVLHESKLFVPLKWNMQDGFYRYGADKGVKDKKQLHQQLLHPVILHYTNKKPWNYDSMHPLKGEYFKYLDMTPWKGKRPLSTFKARLSWWLKSLPYALRLRKPKYVNLI

SEQ ID NO: 6931 - protein, 198 aa, B.fragilis
WLANERLLPYVVSVTKNSVTMNRLILLVESRIRGDVYVRFGGELPKTHRSNTAGRWMLSLPLKSVNNLVKDARKVQQTILMVGDITDTYVTSFQRMMRDDNFTVEELGAIAFGYTKLLEESNDVLTELKNVVNITTLSMTDKERMDVVERCYSKMKRYRNLVSYYTNKNISVSYLRAKKKNDLDRIMGLYGNMNERYW

SEQ ID NO: 6932 - protein, 269 aa, B.fragilis
KHKNMKTRALRSYLCFTLLATAFLLGLAGCDKEESEPLRIGDDSFNNIENGVWTAYYPNTNQTSITIYGGVKPYTVSSNSDILKVNMDKLSDAFNYETLGVGDAEVTITDAKGESVGLKVKIDYRSDKMKIVKLDAYVKGDKMTVAAQKELKEKALASIPVKAGGGYQFIYTKDQGGIVYVYPDKYGEKYKEGTFTRSSLAVGNSSYRKYEIKLDGMERTYIVQRYYPSKTRSVAMVPYGFYEDLLDQFTDDYPEVESVYTMQVVSAVF

SEQ ID NO: 6933 - protein, 80 aa, B.fragilis
YMKKYIYAFFFASLIIVALGLKAKIKSDTEFSELTLSNIEALGMEETDGAKDYWCCGNEDVCAEGPHYKIKGKLKENPCK

SEQ ID NO: 6934 - protein, 299 aa, B.fragilis
SSRNTLNKVVLRNKIDKIRLLFCKDRESYSCFYRILGFYPRNIRLYEQALLHKSTAVRSEKGRPLNNERLEFLGDAILDAIVGDIVYQHFEGKREGFLTNTRSKIVQRETLNKLAVEIGLDKLIKYSTRSSSHNSYMYGNAFEAFIGAIYLDRGYECCKQFMERRIIEPYIDLDKLSRKEVNFKSKLIEWSQKNKMEVSFELIEQSLDKENNPVFQTEVRIEGILGGSGTGYSKKESQQNAAQMTLKKIKGDPEFMASVQEAKTQNNVPAEDTTPESEMSLTAENQQIDEIISTEEISV

SEQ ID NO: 6935 - protein, 101 aa, B.fragilis
NVLNMEIVSIEKKTFEMMVASFNALSEKVAALRRKSDGGRLERWLTGEEVCGQLRISPRTLQTLRDKRLIGYSQINRRFYYKPEEVRRLIPLIGTLYPGGR

SEQ ID NO: 6936 - protein, 637 aa, B.fragilis
KQLNNRKMRKWRIEDSEELYNITGWGTSYFGINDKGHVVVTPRKDGVAVDLKELVDELQLRDVAAPMLVRFPDILDNRIEKTAYCFKQASEEYGYKAQNFIIYPIKVNQMRPVVEEIISHGKKFNLGLEAGSKPELHAVIAVNTDSDSLIICNGYKDESYIELALLAQKMGKRIFLVVEKMNELKLIARMAKQLNVQPNIGIRIKLASSGSGKWEESGGDASKFGLTSSELLEALDFLESKGMKDCLKLIHFHIGSQVTKIRRIKTALREASQFYVQLHAMGFNVEFVDIGGGLGVDYDGTRSSSSESSVNYSIQEYVNDSISTLVDASDKNGIPHPNIITESGRALTAHHSVLIFEVLETATLPQWDDEEEIAPDAHELVQELYGIWDTLNQNKMLEAWHDAQQIREEALDLFSHGIVDLKTRAQIERLYWSITREINQIAGGLKHAPDEFRGLSKLLADKYFCNFSLFQSLPDSWAIDQIFPIMPIQRLDEKPDRSATLQDITCDSDGKIANFISTRNVAHYMPVHSLKQKEPYYVAVFLVGAYQEILGDMHNLFGDTNAVHVSVNEKGYNIEQIIDGETVAEVLDYVQYSPKKLVRTLETWVTKSVKEGKISVEEGKEFLSNYRSGLYGYTYLE

SEQ ID NO: 6937 - protein, 488 aa, B.fragilis
LIMKKLFYWILSSIVLFSCSETELLDNSIDDQLITTRASGDGLYDVLGYGYDITKEYLHPMSVCNPVLDIEKYKQDYGERLVTGTPSFGGDQMYYGYSAFDYLKDMTKETKASLQVSDTAKQAAYSGSIAGGTYFKSAYSYSSKYSFASIDAVRKLKYIRINDEKSRLMNYLSSSFKEDLNRLPAEKLVKRYGTHVLTNFTIGGRYKLLFRSVITNTTENSVKRKTIASGLKALVGDIGIGVNFDRNVETSETLTRENKHRMLYVLFYGGTGTSLVYDLEKGLPTRIDIQHWESTVNLTNANLTDINWEETYPIYEFIQDPQKRAEVKNAVDQYIAGQQIKVLELRPMYRMHSKRQKNTFYVFTKSDADYISKKWGDESNGIDGYICVNPEPNTKPMYSLFSKRSENTFYVYDKAEVDYIVHKWGDTFYGLDGYMLTKPEDNTKPVYCLHSNRAKNTFFVFDKGEADRIVREFGDTYKGLVGYFYDAD

SEQ ID NO: 6938 - protein, 350 aa, B.fragilis
PIMKVIVDNKIPYIREAIEQIADEVIYAPGKDFTPELVQDADALIIRTRTRCDRSLLAGSKVKFIATATIGFDHIDTAYCREAGITWTNAPGCNSASVAQYIQSALFILQQTRGMKLNQMTIGIVGVGNVGSKVADVARKLGIQVMLNDLPREEREESTMFASLKSIAEKCDIITFHVPLYKEGKYKTYHLADKHFFHSLKKGAVIMNTSRGEVIETEALLEALRSGILSDAVIDVWEHEPDIDLELLEKVIIGTPHIAGYSADGKANATRMSLEALCRFFLIETDYRITPPEPKNKLISTATYEEASLMIYDPRRDSDALKSHPGLFEQLRGDYPLRREEGAYRIVITK

SEQ ID NO: 6939 - protein, 207 aa, B.fragilis
QDMNYFLLAETDFFRRINEAGDCNMEKAYTVFATQVIELCIGSPDTNRTIIALAYIEIELQHHPVHNLPEEKKEIANYVSKALSFVRKMQKFLAAPQVPPLIPIQTSTDNTNDNTASPLQWTGNAIDLVELIYGINEMGCINNGNMPLKQLAPLLYKIFGVESKDCYRFYIDIKRRKNESRTYFLDKMQEKLNEKMLRDEEMERMRR

SEQ ID NO: 6940 - protein, 263 aa, B.fragilis
FVMKEKMKEKLTVIKVGGKIVEEEATLNQLLNDFAAIEGHKVLVHGGGRSATKIAAQLGIDSKMVNGRRITDAETLKVVTMVYGGLVNKNIVAGLQARGVNALGLTGADMNVIRSMKRPVKEVDYGFVGDVERVDSTLLSDLIHKGVVPVMAPLTHDGQGNMLNTNADTIAGETAKALSAIFDVTLVYCFEKKGVLRDENDDESVIPQINHAEFQRYIAEGVIQGGMIPKLENSFEAINAGVSEVVITLASAIHTDGGTRIKK

SEQ ID NO: 6941 - protein, 505 aa, B.fragilis
RAMNITKIISKVFDSRLKAIDLYDTQAGEIQHRVLTRLVKQAENTEWGKKYDYKSIRNYEDFKNRLPIQTYEEVKPYVERLRAGEQNLLWPSEIRWFAKSSGTTNDKSKFLPVSKEALEDIHYRGGKDAAAIYFRMNPESRFFSGKGLILGGSHSPNLNSNHSLVGDLSAILIQNVSPLINLIRVPSKQIALMDEWEAKIEAIANSTIPVDVTNLSGVPSWMLVLIKRILEKTGKQTLEEVWPNLEVFFHGGVAFTPYREQYRQVIHSSKMHYVETYNASEGYFGTQNDLSDPSMLLMIDYGVFYEFIPLEDVEKENPRTYCLEEVELNKNYAMVISTSCGLWRYMIGDTVKFTRKNPYKFVITGRTKHFINAFGEELIVDNAEKGLAKACAETGAQVSEYSAAPVFMDANAKCRHQWLIEFAKMPDSIEKFAMILDATLKEVNSDYEAKRWKDIALQPLEVIVARKGLFHDWLAKKGKLGGQHKVPRLSNTRDYIEEMIALNER

SEQ ID NO: 6942 - protein, 173 aa, B.fragilis
RLMNMDYKYIEQLLERYWQCETSLEEESELRSFFSEEEVPAHLLRYKELFVYQTVQQEAGLGKDFDARILAQVEAPVVKAKHLTMVGRFMPLFKAAAVVALILSLGNVAQHTFFAEEALDYNYDAYKDTYDDPEVAYKQVSSALMMLSEGINKSQDQVVRDSVKVEPVRVMKE

SEQ ID NO: 6943 - protein, 136 aa, B.fragilis
TKSKNLRVAPSKKREAMKRDIIIIEDKAVSVTGNEIWMTAGEIAGLFHTGVPTVNAAIKAILKADVLSDYEVCRYIQLENGLYADVYSLEIIIPIAFRLNTYCTHVFRTWLVGKALSKEKRQAYVMFIQNGKAGYC

SEQ ID NO: 6944 - protein, 599 aa, B.fragilis
HPQNKSMDIQLSAQQQAVVDCNEPRIVVKACPGSGKTFSVAARMAKLLQENNLSRHQGIAAISFTNTACEVIQKELKETFGCRNIDYPSFIGTIDSFINTYIFLPYAHLVMGCNYRPEIVGTTFNKWFDYDPTQTRYIRGKLGERIITSRDANYYFDLISFGLNDQLLRLAPYQAYHFGKADWDNPNKKDGSPKKVISELKEMKWKHFNAGKVNQADAIYFTFRILDKYPSIAQNIVRRFPILIIDEAQDTTELQMAIIDKLSQCGAESIMLIGDPDQAIFEWNTANPHLFMEKYNSPDWHSLDLSENRRSSEKICQLANHFSGNEMCSIASDKDYTDEPCIKGHLDTPESVNQITNHFIEKCNEMGLDESEYAVVFRGQKFGETNFGLVNNDNSSKQNSPWINGHYGVRDIVYGKYLIDHGKYTDGLSLIEKGCYKITKRVRYVSSSTMRREIAEVGFRRHRAEMFDFIQKLPSTNDTLSNWITKLQQMGINLTVDLGKANVRIESLFRTVNHQFRQERPYLKTIHSVKGMTLEAILVFLSKKAVHTNYTTILNNPAKYSVDNNEELRIVYVACTRPKKLLWIAVPSDDIDCWRNKLF

SEQ ID NO: 6945 - protein, 489 aa, B.fragilis
IKFDGMTKPLVSVVIPVYNMEEFLEETLDSVLSSDYPNFEVIVMDDGSKDRSLEIAESYKSRYENVRVYTQVNSGVATARNHAISKAGGVYILPVDADNRISKELIHSAVDILESEPEVKVVCPRAEFFGDRSGEWVLPPFSLSLLARKNMMDTCAVYRKSEWERIGGYCAEIVAREDWEFWISMLKDGGKVVKLPEIGLFYRVREQSKRVTDRLLKKHVIDVLNRRHPDFFERELGGPLRYQRSWSRLINRISRIIHPRRVFVGDDFQDLSSFVRVLPVHFENGGTLIYEGRNKLKEFEIHGRKLIVKSYQLPHLINRVVYNSFRASKARRSYQYAQMLRKAGIGSPAPVGFYSTGTWLLFGRSYFVSLKSECPYTYRNLLEETFTGDKEKVLRAIARTTAALHENGFLHKDYSGGNILFRETDKGIEVEIIDLNRMRFGKVDIETGCKNFERLPGTHEMFVILADEYAKVRGFDADRCLELIEKSHL

SEQ ID NO: 6946 - protein, 343 aa, B.fragilis
LFNDMNDSLLYKLSSGKPPKFIYFISNTLNMLIPNAFYRYKLKSTLAQLQYRSDKDYIEERVNYYNKLSSPSSLPEKSFIKNEFRYLIFLGTLADNKKSLFHTAYFFDTREYTRWFKQSLRWGYCPGDVYFTPEFPSIVKSRLLTDSNDNSVVMKLDKFRHFMFVNDTMPFSSKKDMVIFRGKIRRSRTRKLFLEMYMDHPMCDCGVVGKDEGVPDAWMTPKKTIRQHLDYKFIMALEGNDVASNLKWVMSSNSIAVMPRPTCETWFMEGKLIPNYHYIEIKPDFTDLEERLKHYIEHPEEAQQIIEHAHEYVAQFRNPRREKLISLLVLDKYFRMTGQNIED

SEQ ID NO: 6947 - protein, 658 aa, B.fragilis
KVRFDNASIVVYYCLIQMNIINLGILAHIDAGKTSVTENLLFASGATEKCGRVDNGDTITDSMDIEKRRGITVRASTTSIIWNGVKCNIIDTPGHMDFIAEVERTFKMLDGAVLILSAKEGIQAQTKLLFNTLQKLQIPTIIFINKIDRDGVNLERLYLDIKTNLSQDVLFMQTVVDGLVYPICSQTYIKEEYKEFVCNHDDNILERYLADSEISPADYWNTIIDLVAKAKVYPVLHGSAMFNIGINELLDAISSFILPPESVSNRLSAYLYKIEHDPKGHKRSFLKIIDGSLRLRDIVRINDSEKFIKIKNLKTIYQGREINVDEVGANDIAIVEDMEDFRIGDYLGTKPCLIQGLSHQHPALKSSVRPDRSEERSKVISALNTLWIEDPSLSFSINSYSDELEISLYGLTQKEIIQTLLEERFSVKVHFDEIKTIYKERPVKKVNKIIQIEVPPNPYWATIGLTLEPLPLGTGLQIESDISYGYLNHSFQNAVFEGIRMSCQSGLHGWEVTDLKVTFTQAEYYSPVSTPADFRQLTPYVFRLALQQSGVDILEPMLYFELQIPQAASSKAITDLQKMMSEIEDISCNNEWCHIKGKVPLNTSKDYASEVSSYTKGLGVFMVKPCGYQITKGDYSDNIRMNEKDKLLFMFQKSMSSK

SEQ ID NO: 6948 - protein, 703 aa, B.fragilis
RGSLHPGDAAQEEKEEAQGLGDVIRSINNQKNQCMSQQEDDLRALAKIMDFLRAVSIILVVMNVYWFCYEAIRLWGVDIGVVDRILMNFNRTAGLFRSILYTKLFAVLLLALSCLGTKGVKGEKITWGRIWTALAVGFVLFFLNWWILALPLPIEAVTGLYILTVGAGYVCLLMGGLWMSRLLKHNLMDDVFNNENESFMQETRLIESEYSVNLPTRFYYKKRWNNGWINVVNPFRASIVLGTPGSGKSYAVVNNFIKQQIEKGFSMYVYDFKFSDLSTIAYNHLLNHPEGYKVKPKFYVINFDDPRRSHRCNPIHPDFMEDITDAYESAYTIMLNLNKSWVQKQGDFFVESPIILFAAIIWYLKIFRNGKYCTFPHAIEFLNRRYEDIFPILTSYPELENYLSPFMDAWLGGAAEQLMGQIASAKIPLSRMISPQLYWVMSDSEFTLDINNPEEPKILCVGNNPDRQNIYGAALGLYNSRIVKLINKKGMLKSSVIIDELPTIYFKGLDNLIATARSNKVAVCLGFQDFSQLVRDYGDKEAKVVMNTVGNIFSGQVVGETAKTLSERFGKVLQKRQSISINRQDVSTSINTQMDALIPPSKISGLTQGMFVGSVSDNFNERIEQKIFHCEIVVDAEKVKREEKAYKKIPVITDFTDENGNDRMKETVQENYRRIKEEVKQIVQEELERIANDENLKHLLQQK

SEQ ID NO: 6949 - protein, 249 aa, B.fragilis
AVGEDYKTRILRNGYSLRTYYHRLSVEYTKMREYAKAKECIDKMLAEKMDDLTCEACELNFMLDYYLETGQFEEAYNRAQPLITRQVSCYEANLRAYMKLAYYACKAGKPEIAADMCARAEEALVGREKDEYLLLYLGLFIAYYFMTHPDRGWEYAERCIPWSLNTNMQKKYRFSCDMVEALSYESHEEVSLSLPEEFPLYRADGIYSVAALRDYFYKQATQLASLYDTRNGNNGYQERLFNVNLIGNL

SEQ ID NO: 6950 - protein, 233 aa, B.fragilis
FLLDILSMRILYVLFFLLTLNSCQKVKEKEVVRLMKEWNRKEVLFPDDLLFTVLEKDTLKEIPKSDYTIITYVDSIGCTSCKLKLQNWLLLERKLRSITNKRVSCLFVIHPKSKKEVNYILQENHFDCPVCIDDSDIFNKLNKFPANIMYQTFLLDAGNKVVAIGNPIHNDRIKKLYLDIISGNKMTSKKGSMQTEITVSETLFDFGKISFKESQKCIFMLQSYYKKVECGRM

SEQ ID NO: 6951 - protein, 599 aa, B.fragilis
KLLEEDNDKNRMEKEGNNLFQVNLKGMIALLSEHIYSNPNTFVRELLQNSVDAITALHNIDENYSGRIDVFLNGDGSMVFQDNGIGLKEEEVYRFLTVIGESSKRDTPDADDFIGRFGIGLLSCFVVTNEIRVESRSAMGGNPVCWCGKVDGTYQTTFPDEEWEIGSRVVLRPKNEWAHLFEYEVFKKILVNYGEVLPYPVYLHRGEEEELVNTPSPVWLDPKATRKELLDYGTKVFQSSALDAFPIRTEHGRIEGVLYVLPFRTQFSVRNSHKVYLKRMLLSEDDCNLLPSWAFFIRCLVNADGLLSTASRESFVSNDSLKDARKEIGVAIKEYLRALVQNNRSVFNKILDVHHFHIKAIASEDNELLRLFMDYLPFETNKGIRSFGSIRSSNNTIYYTRNLEDFRQVRRIAGAQGRLVVNAAYTFDETLLKKYIRLNQELSLEEISPARLLEEFAEVEGNKEHRSFETKASELLKRFGCICRLKHFTPVDTPVIFVAEEKEENSKVANNPLAAVLGSVNAKKRLPPTLTFNADNEMVQTLLRIQGDNKLFQHVVHILYVQSLLQGKYPVNSEEMELFNHSLSELMTAKMNDFINFLN

SEQ ID NO: 6952 - protein, 209 aa, B.fragilis
ITMEFKSLKNIESSFRQIRLFGIVFLSLCAVITVWSVWSSYRFAERQREKIYVLDNGKSLMLALSQDLSQNRPAEAREHVRRFHELFFTLSPEKSAIEHNVKRALLLADKSVYNYYSDFAEKGYYNRIIAGNINQVLKVDSVVCDFNGYPYRAVTYATQKIIRQSNVTERSLVTTCRLLNSSRSDDNPNGFTIEGFTIIENKDLQTIKR

SEQ ID NO: 6953 - protein, 612 aa, B.fragilis
VMKEFFQLMKRFVPPYKKYVIWALVLNLLSAILNIFSFSLIAPILQILFKVDKDVYEFIPWDTVTISTKDLLINNFYYYVSAMIQANGASFTLMILGLFLVVMTFFKTFCYFASSAVMIPLRTGVVRDIRVMVYDKVLRLPLGFFSEERKGDIIARMSGDVGEIENSVTSSLDMLVKNPILIIAYFTTLLVISWQLTLFTLLVVPLMGWVMGTVGKKLKRQSLEAQAKWSDTMSQLEETLGGLRIIKAFIAENKMINRFLKCSNEFRDATNKVATRQALAHPMSEFLGTTMIVIVLWFGGSLILSSHSSIDASTFMVYLTILYSVINPLKEFSKAGYNIPKGLASMERVDKILKAENKIVEIPNPKPLNGLEEQVEFKDISFSYDGKKEVLQHINLTVPKGKTIALVGQSGSGKSTLVDLLPRYHDVQEGTITIDGVNIKDVRISDLRSLIGNVNQEAILFNDTFFNNIAFGVENATMEQVIEAAKIANAHDFIMEKEDGYHTNIGDRGSKLSGGQRQRISIARAILKNPPILILDEATSALDTESERLVQEALERLMKTRTTIAIAHRLSTIKNADEICVLYEGEIVERGKHEELLAKNGYYKRLNDMQSL

SEQ ID NO: 6954 - protein, 135 aa, B.fragilis
ILRDFRRLNRFMNLFHSRISTKSIQSYLNFRNYLGFCGDSIYVQMIAFLRYLGYIQQRKLRLSPFEQHGMAFTLVVAESDILPINVPVTRLQFPDQRAFGYFPVPQQTVWTDIVGERGKEQTIFPELPEHCAELS

SEQ ID NO: 6955 - protein, 119 aa, B.fragilis
FYKLSQLNESMKYTLEIQKLLLQAQNDNLHPREKANLLREAIRIADENEDVQWAVEMRLDLIYELNLLSADAEEIAVFSKILDSYENHKDQINEDDILWKYKWIWSCTFDLPSIPMEQV

SEQ ID NO: 6956 - protein, 474 aa, B.fragilis
RVVCHVDGEYLRLLFLRKPQQGLYGIKLVHVLPLVKEYLAVGVIDDALLDHGRGNDVVHLLRHHDCLPVILAHGFVHIAQVLSHVRRRESLPSLFHYQLFPYAFQSAHLVDEGFHDNDGHDREKLAIFLYRINLEDDEPLAEQVDVLRGVEQEVVASAPVILPHGGEHIVDVEIGLLHLYLTFRQFAAVVVAHILIEGVERGDDAPVSPDTLDVCVHRTAQFAALRFRNFVVLRLPECQQQRLDAVLFLHVEHVIIGVKRIERNRFLLRVGEVHAVRPVCLAPDHLAQALIGVSRIHQYHVRTLLVVLPHEVVHKEGFAAARRTQHELVAVGRDAPLHRQVADVEVQRFSRKPVHHLDTEGRERTAVVGFLREKAHRLLDEGMETLFRREVRRVAGHRRPVERRAVDGVVARHALHACQLAAYIVLYMLQFLRVIAPRHDVEVRPYRGQPVGMGFVQVLVYPFAVDAVAPAVSG

SEQ ID NO: 6957 - protein, 117 aa, B.fragilis
RMELLTRNNFESWMQKLMERLDRQDELLLSLQPSGKAPNPIERIRMFDNQDLCMLLQISKRTLQRYRSIGALPYKTLGKKTYYSEEDVLTFLSGHVKDFKKEDIAFYKARIHNFFQK

SEQ ID NO: 6958 - protein, 409 aa, B.fragilis
DWSCKNRHFIVCFLYKIRQLKKYDYLCTIIYQGMETVNRILQEKITARIAPNKAVLIFGARRVGKTVMMRKIVDNYSGRTMMLNGEDYDTLALLENRSIANYRHLLDGIDLLAIDEAQNIPQIGSILKLIVDEIPGISVLASGSSSFDLLNKTGEPLVGRSTQFLLTPFSQREIAQIETPFETRQNLEARLIYGSYPEVVMMENYERKTDYLRDIVGAYLLKDILAIDGLKNSSKMRDLLRLIAFQLGSEVSYDELGKQLGMSKTTVEKYLDLLEKVFVIYRLGAYSRNLRKEVTKAGKWYFYDNGIRNAIIGAFSPLAIRQDVGALWENYIIGERRKANFNEGLHKEFYFWRTYDKQEIDLIEECADSLTALEFKWGNKMPNAPKVFQEAYPHAEFHVVNRENYLEFV

SEQ ID NO: 6959 - protein, 296 aa, B.fragilis
LTHCMERTEIDAMRQIPLADFLARLGHEPVRRSGNELWYRAPYRNERTPSFRVNVAKQLWYDFGTGKGGDIFTLAGEFIGSNDFMEQVKFIAETANMPMPVPEVSKPTFLPKPSEPAFEGVEAVPLLRSPLTDYLAERGISYDIASRYCCRLNYGVRGKRYFAVGFPNVTGGYEIRSRFFKGCVPPKDVSLVKAEGSPADVCSVFEGFMDFLSAATLGLEKGDCLVLNSVANVEKAMKHLDGYGCIDCYLDHDEAGRRTLKTLKGHYGERIYDRSALYDGCKDLNEYLQLTTQKEQ

SEQ ID NO: 6960 - protein, 177 aa, B.fragilis
RCPREHISFPAERLYVAPSVRVTEPFPIKILRETRSELLRPLLFIAEFCRRNQKKGLNMKVITMESSAFTVLTEQIAEIAAHVRAVSGERKEKFADRLLNTREAAHLLNVSTRTLQRMRSEHRIGYVVLRGKCRYRQSEIDRLLADCTIVEDAATPTELKRNHTLRTGGSKPKGRRT

SEQ ID NO: 6961 - protein, 266 aa, B.fragilis
RCHRPCPFRSRTKAVLPRSHGKRACAHCGMAHDTTTRCRFFGQAHVLTVRGSPQGVSASWRRFPSVPCSALVNDKLDAHAPLRMKLPRVATPQATLPEIGKQGDTVSHVKLHIERQRTAVDEGIPVMEHGAVMQYLFAPVHRFISGKSRSTCIDEYDFTGIGEYLEVVSALRRELRHGYLPVLVRVVLQQVFAAKHPFVPLFRVGGKSRPETVPAVVAAGIEAVRHVRPDLDALHLRQASLGVRLPRTQGKRRDDYCDVLSHGQRT

SEQ ID NO: 6962 - protein, 68 aa, B.fragilis
RPCRIFCFLVAIFANTIHVRIPKTECKISKLTGHELFFIGGNRFLPPDKRSRGLQYGKSIHGFRHPSD

SEQ ID NO: 6963 - protein, 807 aa, B.fragilis
FRRRLFLFPFLRRREFHHFAVATVSGNMELPERFHREAAVLPIAYAHHRQRGRLHPSDGICAVSGSDGECLRAVDAHKPVGFAPCFGSKIEVVILASRFKVAQSLADSLVGERAYPQAYERRSTSDIMVEVSEDKLTFASCIGRHDDLLAFLEKTGDDFYLRHHAAVGFVTLLRFFLTGNEREGFGDDGQVVTDEAAYAVAVGHSKLDKVSECPCHGTVASLEISFLSLCRAHDAGDLTCHGWLFCNDCLHADYFFMNCYFGFSGGHGMLHLHALDDFLLRLLLQLLLFVVFRSGLPFLQRLFQVLGRLVGLSFAVHRHLCAALVGRGDLLRVVGVGVVAVRTSLLRVELDVHRGVETLLVGHVLQFDSFACRVIGFLLVGEVHAAPFTDGADAAVGVRPRVAALLFLWGCGIFHALSLSLRGIVLGFLRLGGTRRPAGSRYELHASLLDVHLKCGDELPAVVAFDELVAHGQPGTQHILLLLGDFRLSDAIRYAHLVCRNVRDFIRLAVYADERGDDFTRFPVHDVHDPAEVARFAQVLTVFVRKLVFLVFIEFLLLADEVRHEADIAFTVLLEGKAGIQFKSLAAELGRHFHQIGLAVVEHLLKVTGLFKVVMFHAPFLFQLLPVDFALVDGLVALSALRLLRAFLLLFHFFLFLVFFGLLFLLLFRLLRLSGGLFFLHLLFVAGSVHLVGRKQFLVGFGVFQQVFHHLHQFVGLVCCDTVETEAAGFLALPEEVFEEVVQHIAVAVELQETLRVLRFRGGTLGGTVGIQPGYHADFARLLVTDYQHVLFAFFLCHLKNVLMGYF

SEQ ID NO: 6964 - protein, 74 aa, B.fragilis
SKISFLTSRMDSSGESRDTSFFVNYKRGLTLPKTELDSMSKRKLTTKFEEEPQKIISIFHLTPSVFQAILRIPY

SEQ ID NO: 6965 - protein, 653 aa, B.fragilis
ARNRLDRRVCRQFDGFGVQMGKQDAQCSESVSRSISPCRVPCCKQGELFGVCIKTKKYRNMYLSSLHIRQFRVFDDITLYFKNGINILIGENNSGKTAIIDALRICLGCGKPDNYIYIQESDLHVNSTVPTENNTTIQFDLTFEFGDALIERECFYDFISQDKEDPAKQTIQLHLKFIQENNGKKKYFKRMIWGGDNEGQQVPYESLQEIFYTYLSPLRDAVSCLRPYSYDNKTSQLFNQLTKYNKGEEEIELNEERKDLLAKNLYHVFEDDASDWKHILTTGKSKVNAHLEGTGITRKHPNIEMRYVGRKFSDVVRGVELKCPVYKTIEDGQEQKYFELYQNGLGENNLIFTSVVLGDLINRCEDNALEIYNALLVEEPEAHLHPQYQNTFFEYLNELQSKGLQVFVTSHSPTITAKSDVNNISVLQRKQNIVQSFSFGKLTESDYPAESKRHLRKFLDTTKAQLFFANGVLLVEGVAEAIIIPILAKKFLSEKIDLCKSGIELVNIGGVAFNHFGLLFNNDDESKRLLSKCAIITDSDPEEDKDKSDRAQKAKDLEGQNLKVCLAPHTLEYDLFEQSEHNKSIMRDVYRKMHAQTNDLRGDFNASTLMKKLKSNKDKAEFALQLCDRLETEVAFDVPDYIKDAILFVAPSE

SEQ ID NO: 6966 - protein, 180 aa, B.fragilis
LFTSSSVNLIEMQEISFRDDILPLKDKLFRLALRITFDRAEAEDVVQDTMIRVWNKREEWTQFGSIEAYCLTVAKNLAIDRSQKKEAQNVELTPEMEEESEISGPYDQLVNNERMSIIHRLINELPEKQRLIMQLRDIEGESYKEIAKILNLTEEQVKVNLFRARQKVKQRYLEIDEYGL

SEQ ID NO: 6967 - protein, 99 aa, B.fragilis
VLVRNVFLIDRKNRLYLLCVTKTTEYMKKFLKAIGCFAIFVLAVFSYFREQPYKLDSLSLQNVEALAEGEEYTHISCIGVGSLDCPVNHSGVKYIFKGY

SEQ ID NO: 6968 - protein, 198 aa, B.fragilis
RTSSALTMRKYIAIIIASLALCTGQAHAQRCLPKMQGIEVRANMADGFNPGGNDGGYSFGAALSTYTKKGNKWMFGGEYLLKNNPYKDGKIPVAQFTAEGGYYFKILSDARKIVFVYAGASALAGYESVNWGEKVLHDGSMLHDRDAFIYGGALTLDVEFYVADRIALLANLRERCLWGGDTRKFHTQWGVGIKFIIN

SEQ ID NO: 6969 - protein, 272 aa, B.fragilis
EIKSRKDWLYGKYCIDLPGNAHYDKFELRQFIFIMKCIHIITPVKDSIELTLQTAEAILKSDFTVPFHYTIYNDFSTDENTKQLKEASLKMGFELVNLSEITSHPSPNYLLVLQMAQEKAIAAEAGLLIVESDVIVKKHTLQSLFDGAQARKDCGIAAAVTVDEHEAINYPYLYAKGKENQVFPEKKHLSFCCSLLTTDFLRAFDFHSLNPEKNWFDVTISHQALEKGFVNYLFTTLTVWHRPHSSRPWKQLKYTNPLKYYWLKFTKGLDKI

SEQ ID NO: 6970 - protein, 116 aa, B.fragilis
IRKRIRKTGSPHHDGGSMLAQVQASVEILSPVPVSGKCGEKDYDGLFIREPEVKAREGKMAYVRPEYHDRIMRITRVIGHDRLSLSAYIDHVLTHHFNQCEEAIKSLYARNYDAVF

SEQ ID NO: 6971 - protein, 627 aa, B.fragilis
AGESPVHGEGKQLIILMQITENVRDIMRSPEYVLNSLTEHSENLNYKFERLYRIFFNEEMYYVAYQRIYAKPGNMTAGADGKTIDQMSLNRIEQLITSLKDESYQPQPSKRMYIPKKNGKMRPLGVPAFNDKLLQEVVRMILEAIYERQFEKTSHGFRPLRSCHTALSDIQKTFSGVKWFVEGDIKGFFDNINHEILIGILKERIADERFIRLIRKFLNAGYIEDWNFHNSYSGTPQGGIVSPILANIYLDKLDKFMKEYTGKFDKGKERKRTKQVVSLEGKRHRILKKLKVVKDKSERSELIRQYKAYQKEGLQYSDGDEMDMNYRKLKYVRYADDFLIGIIGSKQDAIIIKEDIKNFLYEKLALTLSDEKTLITHAENAAKFLGYEIFVRKSNDTKRSKYGVLRRVFNKRIQLALGKDTFKKKLLEYRVLEIKIHNGKEYWKAKSRPKLSNNNDFEILDRYNKEIKGIYNYYCLANNCSSLSKLGYIMKYSMYKTFAQKYRTTMSQIRKKYTKNGLFSVRYYLKNGTAKDLTFYHGGFKKKNPMNIKDLDNLPKFTYHPTNTSLIDRLKAEKCELCGAVDKLVMHHVRKLKNLQGKTTCEKQMMARKRKTIAICGKCYKKLSNNE

SEQ ID NO: 6972 - protein, 160 aa, B.fragilis
VLGRNQPYHQTSMSMGSRKVNTEGIDEELLIASIGRRKQDGTLYRAQEPPVPAPEEESVPETEPPPTASPSREKVQKDTARRKRQEDDYSGLFLRRNEIKTRQCVYISRDVHSKILKIVNDIAGREISVGGYVDTVLRQHLEQHKEKINELYKNQREDLI

SEQ ID NO: 6973 - protein, 439 aa, B.fragilis
KFLGCFPFGEHESRVVVPVKGNHGIEALALLALEAFEQFRVSVGEQVFDLVIGEGTVCLQAEHGQPALRVVAADDLAVKLHTSRSALGTLAAGIPAGEQLVAREQFGGNFLRVRLYLLAEGIGRQFPALNACQLLFPFARHGNVGDAHRLHDRVEGKPLFGRYKRLLAAFHVSPFEKRFDNRCTGSRRANAAVLQSLTQRIVLNLLACRFHSGQQGGFGMQRFRLGLALCDGGSFQCQRVAFLPAGDDGFLFLFLAIDGTPPGLFDDAAFCHELRSGTLRRNSGGVFDAFFRESLNHASGNHLIDGIIFFGEEQRFLARDEQGVVVRYLATVHAAACRHGFRIDFAFPFGQAADEGEQLGYFHEHVFWDVAASCSWIGDEFLLVELLCDFKRLFCREAVLGVGFLLERGQVVQKRSVLRLLLAFCFRDSGCACFLYLIV

SEQ ID NO: 6974 - protein, 179 aa, B.fragilis
PRNGDAEQSFVSTFLTIKSNDYGNTNDHQRSKYLHESRDREIREVPNGYRQTQADTCAIRLPPHGRGIILLCETHVGRVPNRTGQVADGKKRKGGQAMNESGYQTLIVKFSKPITELDGIFDDAEAWGVETLKGWVEDYESSRFTAIDTHTAVITSEYNMECVKTWLERNTPIAEKTEF

SEQ ID NO: 6975 - protein, 152 aa, B.fragilis
HPHGSHNERVQYGVCENMVGKEHPHSRENRILNIRAVSAPPEHSTQRRMNMIAKTILEQIGGRRFAAMTGSKDFIDMGNGLRMSLARNKTSANRLDIIYDAGADLYNMRFYRRTFSKKTFECKTKDIETHERIYCDMLEEMFTMVTGLYTRF

SEQ ID NO: 6976 - protein, 430 aa, B.fragilis
FRLMKPRTQIQQEVAHLSKRLPRLTATQKAYAFRHCFKHYAIKRADGTNICTECGHSWKSDHDLADTICGCTCPHCGMQLEALRTRKSVFSENEYFSIVTTSKQYQVIRFFFVKSRYKAGQAAEYSIYEVVQRWISPDGKTTTVARLRGMSMLYYDQWSEYSDMEVRKNNGLHAYDITPMCTYPRQRFIPELKRNGFKGDYHNTLPYDLFTAILSDSRTETLLKAGQYAMLRHYIRSSFDMGRYWASVKICIRNGYTISDGSVWCDTIDLLRHFGKDTNSPKYVCPANLKAEHDKLVAKRNLQRERERTEQQRQKAIEDEKNYLKAKGIFFGLVFSDSLICIKVIESVKEMEEEGRIMHHCVGGYHNKANSLILSATIDGKRIETIEVSLKTLKVVQSRGVCNSNTEYHDRIIRLVEDNAGLIRQRMNAA

SEQ ID NO: 6977 - protein, 93 aa, B.fragilis
YQPIIKNNMDVRFESMVCLWDDKIPTMFLEFMNLLTFCQSEEQLRAGVKDFSEKHELDKFFLYGFGSHHFYLHQRYTSNPEMVMQNRVLSVHF

SEQ ID NO: 6978 - protein, 232 aa, B.fragilis
KRLFMYSILIIEDEQRVADLLRAGLEENGYNCLVAYDGAMGLRMFRANTFDLVISDIVLPKMDGFELCKEIRAANPAIPILMLTALGSTDDKLDGFDAGADDYMVKPFDFRELYARIRVLLKRKLAVVTDVEEELNYADLSVNLLDKSVKRAGRDIKLSPKEYNLLVYMIENAEKVVSRMDIADKVWNTHFDTGTNFIDVYINYLRKKIDRDFDTKLIHTKTGMGFILTDKL

SEQ ID NO: 6979 - protein, 367 aa, B.fragilis
FCGMMEKNKRVLLGMSGGTDSSVAAMLLLEAGYEVTGVTFRFYEFNGSTEYLEDARALAARLGIGHITYDARKVFQEQIIDYFIDEYMSGHTPVPCTLCNNQLKWPLLAKIADEMGIFYLATGHYVRKQWVDGNYYIAPAEDVDKDQSFFLWGLKQEILQRMLLPMGGMTKSEARAYAAGRGFEKISKKKDSIGVCFCPLDYRSFLKKCLCDESGDKNRNIYRKVERGRFLDESGNFIAWHEGYPFYTIGQRRGLGIQLNRAVFVKEIHPETNEVVLASLKSLEKSEMWLKDWNIVDESRLLGCDDVIVKIRYRKQENHCSVTITPEGLLHIRLHEPLSAIAEGQAAAFYKDGLLLGGGIITMSDQR

SEQ ID NO: 6980 - protein, 190 aa, B.fragilis
ISIFVRKCRLLMIRIFLTGYMGAGKTTLGKALARELHIPFIDLDWYIEERFHKTVGELFSERGEASFRELEKNMLHEVGEFEDVVISTGGGAPCFFDNMEYMNRVGTTVFLDVDPKVLFSRLRVAKQQRPILQGKKDDELLDFIVQALEKRAPFYRQANYIYCADKLEDRSQIETSVQQLRKLLNLHIAS

SEQ ID NO: 6981 - protein, 425 aa, B.fragilis
FDFISMELKRVVVTGLGAITPVGNNVPEFWENLVNGVSGAGPITHFDASQFKTQFACEVKGFDATQYIDRKEARKMDLYTQYAVAVAKEAVADSGLDIENEDLNRIGVIFGAGIGGIRTFEEETSNYALHKENGPKYNPFFIPKMISDIAAGQISIMYGFHGPNYATCSACATSTNAIADAFNLIRLGKANVIVSGGSEAAIAAAGVGGFNAMHALSTRNDEPQSASRPFSASRDGFVMGEGGGCLILEELEHAKARGAKIYAEVAGVGMSADAHHLTASHPEGLGAKLVMKNALEDAEMSPEEVDYINVHGTSTPVGDISEAKAIKEVFGEHAFELNISSTKSMTGHLLGAAGAVESIASILAIKNGIVPPTINHAEGDNDENIDYNLNFTFNKAQKREINVALSNTFGFGGHNACVIFKKYAE

SEQ ID NO: 6982 - protein, 89 aa, B.fragilis
HTFISNKIHSFRNFTLQNTGKALLVIDDVNTSCGCTSVQYSKEPVKPGESLRITVIYKADHPEHFRKTITIYCNVPTSPLQLKITGNAE

SEQ ID NO: 6983 - protein, 311 aa, B.fragilis
FNLIDLIMNVDCVIVTYNRLSLLKECITAVKGQSYPARKIYVIDNNSTDGTLEFLEKFSQDSQVKVINLTENIGGAGGFSRGIKEAVMAGADWVWVMDDDTIPYSDALEKMLKTIDLTKNVGYVCSKVLWTDETPHRMNMPGYSIGTQKGVLYNAFSNRDTPAFLIHHASFVSLLVNAKAVKSAGLPISEFFIWGDDIEYTMRISSLGYIGFYVDNSIVLHKTPTNYQPYPDTAPTNTAWKFYYQARNTAYLKRRKTKNRLCFLLSIINKYRVYIHRINKRKTNDKLIFKKYVRKGCWDGLTFNPQIEYLP

SEQ ID NO: 6984 - protein, 63 aa, B.fragilis
ILSFLQVSVGWQLHFFSFWAALIKIYSYFRLYTFMSIYVKNPADLVYVLSVTICKTIFDPQRG

SEQ ID NO: 6985 - protein, 162 aa, B.fragilis
RNKIMKSVLLMCWMALLSVAVSAQDFDSRFMAEHQADSNLTCVTISPKMMEEIMKSDAEKDKEVLDMISNLKSMQVLTSDVEGKKYFNAALKVVEKNSGRFESFLSFKDKSENCQIMVRKKKSTIVELVMLMHEKNHFAVVNFTGNMSPEFIAQIKRHFHLL

SEQ ID NO: 6986 - protein, 456 aa, B.fragilis
VMKIRSILTIKYAGITATIFLVFMATIYCVNEHLRSDSFYRSLRSEAITKAHLFLNNQVDVETMQSIYLNNRQFIDEVEVAVYTPDFRILYHDALHNDIIKETPGMIDEIVRKKEIDFRTGDYQGIGILYEFGGKNYVVTAAAYDRYGHINQVIMTRLLLLLSIGGLSVLVIVGYMLAKSSLAPIRSIVRKAEGITVTQIDERLPVKNEHDELGELALAFNALLDRVEKTFNDQRMFVSNVSHELRTPMAALSAELDLALQKERTVTQYQNSIHNALQDSQRVIELIDGLLNLAKADYYPEQIKKEEIRLDELLLDANELVLKAHPDYHIELIFEQEADDDRVLTVIGNPYLLTTAFVNLIENNCKYSDNRTSFIQISFCDQWTIVSLSDNGAGMSETDKENLFKLFYRGENKNQAQGHGIGMTLTKKILTLHKSEISVYSHQGEGTTFVVRFHHL

SEQ ID NO: 6987 - protein, 887 aa, B.fragilis
SAKIMIWRKKEKKKAQYQFNSERVFLVATQPAKTAYSYFQTSSVGLSEEEIGQRQSAYGKNEISREQKKNPLVLFIRTFINPFIGVLTALAVISLVIDVVMARPEDREWTAVLIIISMVVCSAILRFWQEWKASEATDSLMKMVKNTCFVKRFSGSEEVDITELVPGDVVCLAAGDMIPADIRIIESKDLFVSQASLTGESDPVEKFPEINGRRHSHGSVIELDNICYMGSTVISGSAKGIVFGTGNDTYLGTIARSLVGERATTAFDKGISKVSFLLIRFMLVMVPFVFFVNGFTKGDWFEAFIFALSVAVGLTPEMLPMIVTANLSKGAVSMSKKKTVVKNLNAIQNFGAMNILCTDKTGTLTCDKIVLEKYINADGSDDHSRRILRHAFLNSYFQTGLKNLMDKAILAHVREENLEHLTEGYTKIDEIPFDFSRRRMSVVIEDQQGKRQIITKGAVEEMLNICSHAEFNGQVYELTDKLRSKAKRISDDMNRNGMRVLAIAQKSFISKARDFAVTDEDEMVLIGYLAFLDPPKPSSAEAIRQLREYGIEVKILSGDNDVIVSAIARQIGIDTCHSVTGVELEGKDGEELREIVGQATLFSRLTPLQKSEIIMILQQNGNTVGFLGDGVNDAGALRQSDIGISVDSAVDIAKESADIILLDKDLSVLKEGVLEGRKTFGNITKYIKMTASSNFGNMFSVMFASAFLPFLPMLPIHLLIQNLLYDISQTTIPFDRMDAEFLKQPQKWDASDLSRFMIYIGPISSVFDIATYCLMWYVFACNSPEHQTLFQSGWFVEGLLSQTLIVHMIRTRKIPFFQSRATWPVLGLTFLIMAMGIAIPFTSFGLSIGLEPLPLSYFPWLVLILVSYCVLTQFMKSWYIRRFSKWL

SEQ ID NO: 6988 - protein, 62 aa, B.fragilis
LAHVRSKSFCTMVCRRIKPLLRKNLYEIEKIREIHIKISRFIVTFAYEEFFEGYAMRRRIMQ

SEQ ID NO: 6989 - protein, 64 aa, B.fragilis
FIFFKDFANICYSNQKHKQLYNLIKNGLIHYNYLRIYYILSFKEINCIIIERNAYLCNERDTSK

SEQ ID NO: 6990 - protein, 438 aa, B.fragilis
LYGVFHLLQFRFKVMLALLQTFQHRPRYVLSLLAQHFEVFLHRVKLRLQDALLQLRRLRYLAELVVRHNDTIVVVVLDVVEETHAVGGRKVFLRSVQNPRVGICRLIGGGNLRNIGFQPDNHRLVRQVQTLHFMRGDAHYQRLAGSNLVVTNSAAVLFQHPDAIHLRGIDAPDAPACQPFQIEVGKSLMRAVILRAHETVELAVIHRRQPLLELWRLLFEPFGEAVSYLVNLGVGELYSLAVAHLDVVAMLVPADGLHHVGTGVVQGVFQKVHAVIVTVIPLHQKLVRDFHGAVAARHRKLVHACRVGDFHLRVEQPAHVGGIDTRRNPAFPEIEIKVFKSDARRFGIFQSLQRLLHLRHTFTFGVFAHPSLYAFRFLYHVSGNKAVLNLVTGYERIVIDAPLQGCEQILRRTVGYLPHIVEIDSAELVERRGQCFFG

SEQ ID NO: 6991 - protein, 126 aa, B.fragilis
SNQVSTARKRTIHPFNGTKQEQFMNKNIRQKLIISAALMIAATASAFAQGNGLAGINEATSMVSSYFDPGTKLIYAIGAVVGLIGGVKVYGKFSSGDPDTSKTAASWFGACIFLIVAATILRSFFL

SEQ ID NO: 6992 - protein, 82 aa, B.fragilis
KLKVMSEIASRVKAIIVDKLGVEESEVTETASFTNDLGADSLDTVELIMEFEKEFGISIPDDQAEKIGTVQDAVAYIEEHAK

SEQ ID NO: 6993 - protein, 351 aa, B.fragilis
LFSFKYVIFNKKRAAMKIGILTSGGDCPGINATIRGVCKTAINHYGMEVVGIHSGFQGLLTKEVESFTEKSLSGLLNLGGTMLGTSREKPFRKQGIISDVDKPALIQRNIAELGLDCVVCIGGNGTQKTAAKFAAMGINIVSVPKTIDNDIWGTDISFGFDSAVSIATDAIDRLHSTASSHKRVMVIEVMGHKAGWIALYSGMAGGGDVILVPEIPYNIKNIGDTILNRLKKGKPYSIVVVAEGIQTDGRKRAAEYIAQEIEYETGIETRETVLGYIQRGGSPTPFDRNLSTRMGGHATELIANGQFGRMIALKGDEISSVALEEVAGKLKLVTEEHDLVVQGRRMGICFG

SEQ ID NO: 6994 - protein, 391 aa, B.fragilis
YSLFYLILVMVKKILVDKYDLFVLSSLIHYLINLLYMCEIRFLLFILFMGCLCACGRVDLKSPKTLFSSVSEISEVEWSIEADSLARVEGIQCNDSVLLVFDFYSGKSYSLFDIYSGKMISRLGSIGQGRDEIPLGVFGYIENNRFYIYYDQTGYIGKFNLDSCSVILDCPPVCLAKYKIPGAQISKIAVVNDSLFLGAGTYNAEYQYLLFDNKSNVIDSAVTIYNSNEANLNIYHKFLSNQGRLRKRPGKSQFVYSINNSSNIDFFEIKNNKINLIKSLRFNNPEYTPTQDGDYSRVLFSDNNVIGYIDIGVTDKYVYTLYTNKKICDNNTYNDLSSTTVLVFDWNGNPVKQYELSKEAYYITIDKTLQRMYAVVRKPDMGWTIVCYAID

SEQ ID NO: 6995 - protein, 207 aa, B.fragilis
MQSFAHFSLFCALKGLIMGKNIAIFASGSGTNAENIIRYFEKNASVRVRLVLSNRKDAYVLERACRLGVPYRAFPKSDWEAAESILDLLRKYQIDFIVLAGFLLRIPDALLHAYPDKIINIHPALLPKFGGKGMYGDRVHEAVVMAGESESGITIHYIDEHYDEGSTVFQAKCPVLPGDTPADVAKKVHALEYEWFPKIIERVVNSL

SEQ ID NO: 6996 - protein, 80 aa, B.fragilis
PVLSFQFACYLLAPVKIVPGVYAPAILVHPDRHNMQMVAVDVLVLENEIRLVAEAHLLQILPCDILKLRVRQNIVGMRIE

SEQ ID NO: 6997 - protein, 111 aa, B.fragilis
SYYSPTESKVMMNENNDVFTLENEPLATVVQNMRKGSKWLSTFLESYRPPLDGERYLTDREVAELLRVSRRTLQEYRNNRVLPFILLGGKVLYPESGLRELLEANYRKPLE

SEQ ID NO: 6998 - protein, 68 aa, B.fragilis
IDTTAVASTPRGEHGFCGGFTTFSTLANDSLSLLKGGFYGIFTFYVFISILLGLLAVLAGGYLGEQFK

SEQ ID NO: 6999 - protein, 217 aa, B.fragilis
HPGIGSGKIGFLVEGNCHEKKKLANILNPGQPNRLVLQYIFCLKDMKPEEINGHQVGTHSILVRKWEASAWSCHPETKTQQCDLDLWEGENTYRCILTNDYKSSTRDIVEFYNLRGGKERIFDDMNNGFGWSRLPKSFMAENTVFLLLTALIHNFYKTIMSRLDTKAFGLKKTSRIKAFVFRFISVPAKWIMTARQYVLNIYTENRAYAKPFKTEFG

SEQ ID NO: 7000 - protein, 599 aa, B.fragilis
LMKPGRPLSEPILRRKKPGNGTITDINGNFSLSVGTKSTIIISYIGYITKEVPVGNNTSLTVQLAENTKQLDEVVVTALGIKREEKALGYAVQKVDGDKLAAVKTVNVATSLTGKIAGLNVKNSTEFNTSPSLSLRASAPLLVIDGVPYGNVGLNDIAADDIESVDVLKGATASALYGARGGAGAVMITTKKGKEEGLNVTVNSSTMFAAGYLRKPEVQTSYSSGSQGTYSTGGYVWGDKLDIGRTALQYDPYTHEWVDMPLVSKGKNNLKNFQELSMVTNNNVSVSQKGKYGSVRTSLTHVYNKGQYPNQKLNKITYSVSGDMKWKKFSFDGGLTYNKRFYPNDMGAGYGGSGFLYNLLVWSGAEYDIRDYKNYWIKQDEQQNWMNDVWYDNPYYLAHEMTSSNDYDKVNTYLSGKYDIMPWLNFSMRAGADAYASRTEKKNAMSARGGWDKNGYFYTSKSTGFSFNGDALLSANHSFGDFAIDGFVGGTIYYYYDDAISSNTRNGLSIPGYYSLKASVDPIASSSSYKQKQVNSIYGKFSASWKSTVFVDVTARNDWSSTLPSETRSYFYPAVSGSIIMSQLLKMPESSPRGWKDRR

SEQ ID NO: 7001 - protein, 96 aa, B.fragilis
NHFYYYYDSTLSLKQKNIQEDIGVSTCMKVHRQFVWRQTVRQIEFFKSKSLQIYDNLLKLPIFREAEYIFALEKNTFVYETISNNVVCLCQHGICG

SEQ ID NO: 7002 - protein, 137 aa, B.fragilis
NFLNQNHYKSMTIYLNFQFFGRQNTFSLLKKIPLCMKLSAIMLFVFASMAFAAKGYSQSVRVTLNVNNSSLQKVLDEIEKQSEFHFFYNNKQVDISRNVTIKSNQKEISQVLNQLFAGTNIGYKILENSIILCPKHI

SEQ ID NO: 7003 - protein, 406 aa, B.fragilis
ETMLRMRLRFPAEPGRTEFHRLLCARCRYTCRPSFWAKIILFSKKIRFLVRRFLFWFVLSIKARIMDESCYINESVLLNYFAGELPADRRKEVEEWIAASEDNEKMARDIFRLYRAADTLDYMNRVDASAALQQVKGRIHKHRHRISWMVWGQRIAACMALPLLATTLYLILKNPPQEYVEIRTNPGMVAEANLPDGTKVWLNSGSSLKHPVKFTGDTRTVELDGEAYFSVRKDRSKRFVVNTPFNIQTEVLGTEFNMEAYRTDSVVRTTLVSGSVRLSFLGKGDTKETFVMKPDEEFVYNTATHEARAEKSYVEIYTAWKNGQVVLKNTSLAETLKILSKRFNVEFIVKDSTLYANSFTGVFSRQYLPLILEHFRYASGIQYKYLDLEYDATHKAIQEKTKIELY

SEQ ID NO: 7004 - protein, 93 aa, B.fragilis
KLTMQEEEVMIYIWELESCYVKDIVAKFEQPTPPYTTVASIVKNLERKKYVPCQTIRHPGVRYRMLLPNVRKDKEICNETKNCFVLSMQEERK

SEQ ID NO: 7005 - protein, 212 aa, B.fragilis
PKNVFFLKIILFLPKTKVYMYNDTSRTVSDETLFFQVQQGNEGAFEALFLRHYPALCAYARLFVEPDDGQEIVSDVMVWLWENKEMQAFESSLKSYLFKAVKNRCLTLINRNEVKQRIEKMIFDNLQSQYDDPDFYAIQELTEKIEEALARLPENVREAFELNRFQNLTYNEIAERLGVSPKTIDYRIQQALKQLRIDLKEYLPLLLPFLLH

SEQ ID NO: 7006 - protein, 67 aa, B.fragilis
SFQPRGEDHYWISSNAGLITINPITKQHFRQFTVNDGLQGNQFTAQSSLKTASGKLYFGGISGFNSV

SEQ ID NO: 7007 - protein, 129 aa, B.fragilis
LFRLCCTFMQMKKSNIYIGEIIKNVMSERQVTKAELARRLDVKPQSVDYLLTRKSIDTDTLYNISIALDYDFSLLYSIKREQRNSDNEGIRYKLGNAKIMVEIELQQDEIIKLNLKKKIAELLDGGANK

SEQ ID NO: 7008 - protein, 77 aa, B.fragilis
HRKTSPILPTKARPYDFNTADKLNTLLINALVSTGELKEIEEYDVDFDHQFLETEKYDGKTDLQKVPRLQAWRICYR

SEQ ID NO: 7009 - protein, 115 aa, B.fragilis
YDMAKIQIKSEKLTPFGGIFSIMEKFDSMLSPVIDSTLGQRCSSIFGYQFSEIVRSLMSVYFCGGSCVEDVTSQLMRHLSYHPTLRTCSSDTILRAIKELTQENISYTSDQGKTL

SEQ ID NO: 7010 - protein, 83 aa, B.fragilis; identical to SEQ ID NO: 6082

SEQ ID NO: 7011 - protein, 725 aa, B.fragilis
FLLNHIMKNMKKLTFKLACFFLSLLVSSVAMAESITSPNGLLKLNVSVNEKGEPVYELSYKGKEVIKPSKLGLELKDDPGLMDGFTLSDAKTSSFDETWEPVWGEVKQIRNNYNELAITLDQKAQDRKMVIRFRLYNDGLGFRYEFPQQKNLNYFVIKEEHSQFAMAGDHTAFWIPGDYDTQEYDYTRSKLSEIRGLMKTAVTPNASQTPFSPTGVQTALQMKTDDGLYINLHEAALVDYSCMHLNLDDKNFVFESWLTPDAQGTKGYMQTPCHSPWRTVMVSDDARDILASKLTLNLNEPCKLEDTSWIKPVKYVGVWWEMITGKSTWAYTDDVYSVKLGETDYTKTKPNGRHGANNENVKRYIDFAAEHGFDQVLVEGWNEGWEDWFGKSKDYVFDFVTPYPDFDVKMLNEYARSKGVKLMMHHETSASVRNYERHMDEAYQFMEDNGYNAVKSGYVGNIIPRGEHHYGQWLNNHYLYAVKKAADHKIMVNAHEAVRPTGLCRTYPNLIGNESARGTEYEAFGGNKPFHTTLLPFTRLIGGPMDYTPGIFDTQLSFLSGEHSFVHTTLAKQLALYVTLYSPLQMAADLPESYERYMDAFQFIKDVAVDWDESKYIEAEPGEYITVARKAKNTNNWFVGGITGENARTSTFVLDFLEPGKQYVATLYADGKDADYEKNPTSYQIKKGLVTYKTKISTDLARSGGFAISLIEATPADKKALKKWK

SEQ ID NO: 7012 - protein, 113 aa, B.fragilis
RKLRNTMLTLTISSLKRRSMMAKPTYKKFLGYRPGVYVIGDKNVYIENSEGNPIVRFHSADTHKKIFALLESQNNPVKRFRGKRGFPLQRKISVKKRKLCKLFYIPANPRHLV

SEQ ID NO: 7013 - protein, 628 aa, B.fragilis
ITPSFYFMAITIIILVLSAVFFMSGKVRSDLVALCALVLLILFNILTPEEALSGFSNSVVIMMVGLFVVGGAIFQTGLAKMISSRILKFAGTSELKLFILIILVTAAIGAFVSNTGTVALMLPIVVSMAMSANINVSRLLMPLAFASSMGGMMTLIGTPPNLVIQNALIEAGYERLSFFTFTPVGLVCVTVGLIVLIPLSKIFLTKKSDKEARGKRKNKSLQELAGEYQLSQNLYRVEVEESSGFVGKTIQELGIPQRYHVTILEVRRRSVSSRHFFKTKKQEMAEAGTLIEAEDILYVLGEFENVKRFAGENRLSLLDTHKTEGSLHDTDEGFDFQEIGIAEILLLPTANLINKPVKASGFRENYSINILGIQRKRDYLLKNLKDEKMHSGDILLVQGSWANIARLGEDQSQWVVLGQPLAEAAKVTLNHKAPVAALIMLGMIVTMMFDFIPVAPVTAVIIAALLMVLTGCFRNVEEAYKTINWESIVLIAGMLPMSLALEKTGASEVVSQSLVNGLGAYGPFALLAGIYFTTSLMTMFISNTATAVLLAPIALHSAVQLGLSPYPFLFAVTVAASMCFASPFSTPPNALVMPAGRYTFMDYVKVGLPLQIIMGVVMVFVLPLLFPF

SEQ ID NO: 7014 - protein, 355 aa, B.fragilis
QKGLKNIETMKKENDEITDLFRSRLGNAEMTVRDGFWEELNSEMMVRSHHRKVVFFRVAAAASVLLVLAASSAAFWFFSPKAEIEEAFTQVAVVSGNTTHLDGDVVKQDFTPMRSEPVLGKPAPKRSGVLAQSSGEEDDSVSVTVSMSFSFSSTTTRRRQNNHPDKSYWQAGGEGGALASSADGPRPDDHTVVADKSRTWAVKAAVGTALPAANGKYKMPVTAGLTVEKKINKHLAVETGLLYSNLRAEQNLHYLGIPVKLNMTLAETPKFDLYASVGGVADKCIAGAPDNSFKNEPVQLALTAGVGMNYKNNDKLALFAEPGVTHHFKTNSKLETVRSAKPTNFNLDCGLRMTY

SEQ ID NO: 7015 - protein, 345 aa, B.fragilis
CRQSRHRAMMKRHNILTVLAVLLLTFAACDKNSAPGFSFTTDSILTLTFDKELDAAFVGVGTQNYNPVGMRRSGDTLFIANRAEGSDGVWVVRASTGELLYSLTGWTYNGKNEKFDNQVMDVAVSSDYIFVVNRSSRIDLFRRNDYSYVTTIGRTGWQSSSLLQCEAAEVAGDKLFIRDKQKIKVVQISDCTPENRFKVPVFAQNTDSTSSNNGFNLESVARHEGLIYVSDYETSRILVIDPATVAVKGEPVRFLRSYRMPNKPLSMGFFQNEMYVVCANNRIVRVDLRTGKELGSYSSFAGGVGLGTPGRLFFHNDTFYLAGRNANAPRLIQGKVMFVEISELD

SEQ ID NO: 7016 - protein, 237 aa, B.fragilis
SLMSTDHISTHPDSPLHGNGIGSEAINLAAIRQEYTKGGLKEGDLSDNPLSLFNRWLHEAIDAQVDEPTAMLVGTVSPEGQPSTRTVLLKDLHDGKFIFYTNYESRKGTHLAKNPYISLSFVWHALERQVHIEGIASKVPAGESDTYFRQRPYKSRIGARISPQSRPLKSRMQLIRNFVAEAARWVGREVERPAHWGGYAVTPHRIEFWQGRANRLHDRFLYSLQPDGSWQKERLAP

SEQ ID NO: 7017 - protein, 406 aa, B.fragilis
IIRSLFLIYCLIKFIFVFLIPQDMKNTFILFLVALSFVCNSCNRTPSVEEPDVLKVELKETPVSVSDFFSKVEVIPLETSDSCLLARILRVRVSGDTTYILTQDYPTFRHITLMAFDKKGNYLRSIGRVGQGPGEYSQVYDAVISEQRNRVYMLSPFGSMYTYRLDGSFIDRKILPQKMNFQEIGLTPDGDLLTWSAQNKDDGACIMRLDADSAKLINEFWSDDFWLNWACRDMFYSYQGKAYFAPAFYEEVYELTSDSFRVAYRWDMGEQNINIAQYHFNSNPDTRREEDRRLNEYRETGKIAFNFTNQYQNGKYYYAQLLSLASKPKWKYTNLFYRKKDGAVFYFEKTREGIRIDPEVLTEDFMLCIVPTEELENYKSILPEEEYRVLSKRVEDDNPCVVKFYF

SEQ ID NO: 7018 - protein, 215 aa, B.fragilis
LKMFKYLKGFWRYLLRKRVSSLSLIDDLSTIHPTARVYSGCRIIQSDIGAYSYVGYGSILVNVAVGKFCSIAGDVEIGLATHRMDAISTSPLFYSSNNALGISWTSYSYFDDSHKPVSIGHDVWIGTRVVIMGGVKIGDGAVIGACAVVTRDIPPYAICVGIPAKVIRYRFPRETIDVLEHAEWWNWSEVLLKENIENFNGSDTLFFNRIPLKQK

SEQ ID NO: 7019 - protein, 245 aa, B.fragilis
IHPPMILDYIYHSGFAIEAEGVTLIIDYYKDSSETELNKGIVHDRLLQRPGKLYVLASHFHPDHFNREVLTWKEQRPDIIYIFSKDILKHHRAQKEDAIYINKGEEYEDDMLRIQAFGSTDVGISFLIHLQGKSIFHAGDLNNWHWSEESTEQEIRKAEGDFLAEIKYLQAAVPTIDLVMFPVDRRMGKDYMKGAQQFIERIKTTIFVPMHFSEDYEGGNAFRSIAEAGGCRFITITHRGESFDI

SEQ ID NO: 7020 - protein, 363 aa, B.fragilis
IKHTIMNKLTQIFLVLFMICLPVTLWADNDKDDDDSRYLAGAVPEVDGRVVFSREFSIPGMSQDEIYERMLKWLDGRMAQNKNNSRVVYKEKGVIAAAGEEWLVFSSTALSLDRTWLTYQVTVNCQPQKCTMEVEKIRYTYREKEKYAAEEWITDKYALNKAKTKMVRGLAKWRRKTVNFADNLFEEAAKALSQKPMEAKAEATPKKPAVVTAPKVVVIGDNQETGKVEKAAELTPAIPVISPSTMPGYKEVAPDQVPANAIQMGAGRLVIAIGSDPFNMTMMTANAGGSIGKISGSPVVFSILSPDQPYEQLEKAETYSIRFYPTGQKEPSVILECQKLPAPTPMEGQPRTYAGKITKAFMK

SEQ ID NO: 7021 - protein, 182 aa, B.fragilis
PFSTDVMKKTFLMLLTLVLSLLTCVSCSEETLDYNNPDVDLFVRQLKAGNYNTKSPKGFVEVPKFTEKDIPTLLNYAEDLTLITSFPLPPVSAYYSGKVRLGECMLWVVETIRLGHYASFGCKMVRANAENYEGIYFLTDEELLDAAARYRRWWENRQYPRTAWTIDACFDEPLCGSGYRWW

SEQ ID NO: 7022 - protein, 60 aa, B.fragilis
NALTMLIEERYKDEDTGSDGVNSLPKLELSYSAGVCFFLSKQAKRTIINLEIKNLPPNLI

SEQ ID NO: 7023 - protein, 157 aa, B.fragilis
MKTTLIVVGRTVEQHYITAINDYIERTKHFISFDMEVIPELKNTKSLTPEQQKEKEGELIAKALQPGDVVVLLDEHGKEMRSVEFARWMEKKLVNVNKRLVFIIGGPYGFSQKVYDAAHEKISMSKMTFSHQMIRLIFVEQIYRAMTILNGGPYHHE

SEQ ID NO: 7024 - protein, 961 aa, B.fragilis
TLPASVAEAYIPWRRRDANPEQKGIIVINASTGKAVDNVLPVEINREYGRIRFDASGNAGDYYVYYLPYHTSGGPYPKVNYPQQPDKADPQWKATCKATPAGKAVQAKLVRFESLGSFNSFYPMEIIATAQEKQALIDANSNKPFLLLPEDRKYPIRMFDDLSYRQVTQGATGEFFGEADLNEYYVLQLGLWAFKNPVNGVKVTFTDLKGKNESIPASALTCFNTEGTDWLGRPIHPEVNVGKGRVQPLWIGIQMPEHAGRGIYRGTVTVSDLSGASQEVNIAINLSDNVLVDKGDGDLWRLSRLRWLNSQYAVNNRPVKPFIPIKVADRTISVLGRSVTAGELGLPASIRSYFTEEMTSIGKEPKDILSQPMEFVIRQNGKPLPVTITSPLKFGKKEDGTVSWTATGKAGALDLTVLASMEFDGFMNYQIKVKAAENTSVDDIALLTSMPATTAKYRLGMGYEGSLRPKSDQWKWNVEQNQEGFWFGDVNAGMQCLFRAENYRRPLNTNFYKMQPLNMPPSWFNDGKGGISYKEKGNQVDIKTYSGSRTLQKGEELNFDFLVLVTPFKPIDTMKQWTDRYYHGYQPAEKLKEGDAHAYQAVDVVGETGANVINLHHGNAVNPHINYPFFRPAFMKQYVDESHAKGYKVKIYYTVRELTNHAPELFALKSLGHEIFSPGKGGGYAWLQEHLDGDYIGAWFVDAYKDAAIVNTGISRWHNFYVEGLNWLTKNVGIDGVYIDDLAFDRNTMKRIRRVLESNRPDPRIDVHSANQFNPADGYINSIFLYMEHMPYLDRLWFGEYFKYEKSPEYWLTDVSGIPFGMMSEMLQDGGNPYRGMLYGMTAREPMESIPSQLWKVWDAFGIKDSRMMGYWVSYNPVKTGRNDILATSFVKDGKVMIAIASWAKKDSDIKLQIDWEKLGIDADKARLTAPDIKGFQEGFSLSPKDKIKVPKDKGFIFILE

SEQ ID NO: 7025 - protein, 198 aa, B.fragilis
TNDADIRSILKRQLTLENEIELIKGCRAGKDSARKELYTLYSRQMLAVCFRYTGDMEAAHDVLHDGFIKIFTNFSFRGEASLGTWVTRVMVTQALDYLRRQKRVSQLEVHEEQLPDIPDLPEGGEAGRISEEQLMKFVADLPDGCRTVFNLYVFEEKSHKEIADMLGIKEHSSTSQLHRAKFLLAKRIKEYRNHEERK

SEQ ID NO: 7026 - protein, 195 aa, B.fragilis
KTFLNELIFQKTRIVMIEKVFKVGDTITIKRTSQAGTGYRYALVRLTGGVALVEELSEDADTPGGTSVQSFIFRFLQPGQVEIQFAYYRDSEEVLYEDVFSYEVVTSEKANPIIGGWGEFKPLTDQEKEIFRTCMTLKGVDYTPLLVAKQLASGYNYRFICMTELLIREPKYGFAKVTIYAPLRGEPILESIIEC

SEQ ID NO: 7027 - protein, 161 aa, B.fragilis
FQNYMNQVQNLQHIARELLYLGMDGSPIYTDHFRQLNTEVFRLSEALFSMKGATSEEEAAICLSLLMGYNATIYNDGDKESKIQSILDRSFAVLDHLPASLLKCQLLTYCYGEVFEEDLAQEAHQIMDSWKNRALSEEELEVMETLQTMEDNRYPCSEVED

SEQ ID NO: 7028 - protein, 60 aa, B.fragilis
TCKYFEKKCFIKIVFDKSDSLFTFANQLIIGKYEEKLFLCRWSVIASLGYGSMFRTRKSG

SEQ ID NO: 7029 - protein, 112 aa, B.fragilis
LFCLLRVVVEEKLNDMETVTDTESSSSPDDCAKTPERLGAGLPKTGSERIGVKSCFTTSPSRCVVFPLTTATWVKASSISAFGEKNQKAADEAANTSSTEAAAATRKKTTFR

SEQ ID NO: 7030 - protein, 172 aa, B.fragilis
MSEQQEYWFAARTKKDQEFSVRNALEKLGIEYFLPTQFVIRQLKYRRRRVEVPVIKNLIFVRTTKDRAWSITKDDHVPLYYMKDLYTHTLLIVPNKQMEDFKFVMDLAPENVTFDDLPLTVGTKVQVVKGEFCGIEGELSSLANRTYVVIRIHGVLSASVKVPKSYLRILSA

SEQ ID NO: 7031 - protein, 434 aa, B.fragilis
IINKNKMNMEEIRIAVIGLGYVGLPLARLFSTKFKTVGFDMNKSRVDSIMKGHDATLEVSDSLLQDAITNNHFMCSNELSIIKNCNFYIVAVPTPVDLDNRPDLRPLLSASETVGKVISKGDIVVYESTVYPGVTEEECIPLIEKVSGLKFNEDFFAGYSPERINPGDKEHTVEKIIKVTSGSTPEIAEIIDRVYNKVLVNGTHKAPSIKVAEASKIIENSQRDVNIAFMNELAKIFNAMGIDTNDVIAAASSKWNFIKLRPGLVGGHCISVDPYYLIQKAQVYGIFPRIMSAARRLNDGMGDYIANQVIQLMNKKGILVKDAHILILGVTFKENCPDIRNTKIVDIYSVLSEYTSNIKVYDPWVNQSKIKEEYGINVINEDLKNLEGKFDVIILGVAHDCFKNIQVNDLLKKEYGVVYDVKGVLDRNIVDGRL

SEQ ID NO: 7032 - protein, 342 aa, B.fragilis
NVNKKIMAYTIAFFGTKPYDEASFNEKNKEFGFELRFFKGHLNRHNVLLTQGVDAVCIFVNDTADAEVIRTMATNGVKLLALRCAGYNNVDLKAAAENGVTVVRVPAYSPYAVAEYTVALMLSLNRKIPRASWRTRDGNFSLHGLLGFDMHGKTAGIIGTGKIAKILIHILKGFGMNILAYDLYPDYNFARENQIVYTTLDELYHSSDIISLHCPLTEQTKYLINDYSISKMKDGVMIINTGRGQLIHTNALIEGLKNKKIGSAGLDVYEEESEYFYEDKSDRIIDDDVLARLLSFNNVIVTSHQAFFTREALANIAATTLENIRDFKNQKPLVNEVKLSNA

SEQ ID NO: 7033 - protein, 104 aa, B.fragilis
YPTKRNSNNIQDKLTNPLLRKEYITTKNGKNSIKDDVLTPHNIENKKEAATIEYFPYLNIISATNAIKAPPSLGLENKPFLYIKLLMPIASSDNFTTYFKLMIS

SEQ ID NO: 7034 - protein, 330 aa, B.fragilis
KINKGILVPFSKNDITMNRISSLFGIQYPIIQGGMVWCSGWKLASAVSNAGGLGLIGSGSMYPDVLREHIRKCRAATDKPFGVNIPLMYPQIEEIMNIVVEEGVKIVFTSAGNPKTWTGWLKERGITVAHVVSSSKFAMKCEEAGVDAIVAEGFEAGGHNGREETTTLCLIPAVREATTLPLIAAGGIGTGEAIFALMALGAEGVQMGTRFALTDESSASDIFKEYCLRLNEGDTKLLLKKLAPTRLVTNSFRDRVEAAEGRGASAEELRELLGRGRAKKGIFEGDLEEGELEIGQVAALFRRRQSVDEVMKELLEGYRRASDKIRSAGL

SEQ ID NO: 7035 - protein, 220 aa, B.fragilis
MMKNDSAVVLFSGGQDSTTCLFWAKKHFKKVYALSFLYGQKHAHEVELARGIAERAGVEFHVMDTSFIGSLGSNSLTDTSISMDEDKPKDSFPNTFVPGRNLFFLSIAAVFAREQGAFHLVTGVSQTDYSGYPDCRDSFIKSLNVTLNLAMDEQFVIHTPLMWIDKAETWALADELGVFDLVRNETLTCYNGIPADGCGHCPACKLRKQGLEEYLSKRNR

SEQ ID NO: 7036 - protein, 386 aa, B.fragilis
KVKKVKMCCLKRRNIFILFQFLLILCFIFSSIGETFYSSVNTNTQYIIVLFSFYYLFSILCCRGVYPDQLIILLYAILLSFFMTYLSSRGNINMLKINYIYIYPIFLGYLLSYRFENGFVLRVLQVCLIANFLAICYEIINLKYVVKLSEDAIGINNLIYRNGLFSNPKEGGAFIAFVALIMFKYGKYSIVAASFLFSILCGVRTSSFILFFPFLVVMYSFLKRGLVSLSWMLLLFLLVGYYMFYYMSDVSSLMERFINLLSTTDEGNSMRLVFMKKHVDICVDDYNLFDYLFGRFGYSRNQIGNGAESSWLDLLTNVGISTFLLYVIPLCQIIVCSQKWIMKITYLVLFVSMGISRFGIGITSGVLFWLLIFQELKESKLSKDIS

SEQ ID NO: 7037 - protein, 351 aa, B.fragilis
NIMNRYPYIIAEIGGNHNGDMELAREMIKSAKEHGADAVKFQLYRKEDLWTNDHLEELNNGVVNLENVSNWSTQELGLKNIFEQVEKFSVQEKDHIVFFDYAREFGIDYATSAFTKQDIDFCIDQKVAFLKIASCDITNLDLIEYAISKDYPLLISLGLADLGEIEQVVNLIPEKCRPNITLLHCVSLYPPKDEIVNLKFMHTLTSTFGLNVGYSDHTLGVSISLAAVALGAKVIEKHFTLDKEMPGWDHKVSANPEEMAVISRETKRIVDSLGNGIKTISEDEFEKRKKFRRSITTKYVLQEGHVISYDDILFKRPGTGISANRLKDVIGRRVNHTIEADKTLFWEDLIR

SEQ ID NO: 7038 - protein, 388 aa, B.fragilis
LYMKIVHLCLASFFVDNYTYQENLLPKYHKMAGHDVTIIASLVSFSEKRKPIILPGESIYETQEGCRVYRVDYKRSFYFFNRLLRRYNKLQSLLDKERPDMIFIHGVQFANVSIILKYKKKYPSVRILCDNHADWINSARNLLSKKILHGIIWRYYANKIEPYVTRFYGVTPLRCEFLKKMYNIPSSKVSLLVMGVDDWGIPWENRNAIHMKIRNQLNIAPSDFLIITGGKIDERKNIHLLMEAVLNSFESNIHLVVFGNIAPEMKKKIDSLEDNEKIHYVGWLSSEKTIEYFFASDLAVFPGTHSVLWEQAVGIGIPSIFKYWDGMTHVDLGGNCLFLFENSSEEISKKISSLSSRETKYLEMKKIASCFAHKFYYSDIAKKVIEDV

SEQ ID NO: 7039 - protein, 442 aa, B.fragilis
FNMKNKVDILSFTYSSKGRDIDIVEPVLSKLELELGVIIKRCWLYDNFVFDILRYKPKMLILANAIGCHYHFWAAKFASMLGIKVVTFVSEGDYRYINGSITTMLYGWNKEEHLYEDLHLEWSQRNINYFSTSPSFDENIVKLSGATGFDKYKLLKFLNKNDFLMKYDLGHYEKIVGLGGWTFDFAFNENHSTGPIFFGKELDGIKASLFALREGYRALVTNNPDILFICKKHPLTINEYYDEFSLVREYPNVITLQTEENIYDLINVSDLWITFDSTTALEAWLLGKTTLLYNPVIQDFNRSSIMKGSPILTTPEMLIDSVKEFYENNRIIDAFSQKENERNNIIKEVIAFCDGKNYLRAADLITSLYLGEKKKKEKVHVAFILKMGGCGIRNFLRNLVAYSNFFDVIPRVRRFKNTRLALYNEKEREYYRLIYKEAITND

SEQ ID NO: 7040 - protein, 200 aa, B.fragilis
ESMKKNFFYAGGLSLLLWGMAACSGQGKADKAAVVADSVVVKTDSVAADSTGYIVKVGESAPDFTITLTDGKQMKLSELRGKVVMLQFTASWCGVCRKEMPFIEKDIWLKHKNNPEFALIGIDRDEPLDKVIAFGKSVGVTYPLGLDPGADIFAKYALRESGITRNVLIDREGKIVKLTRLYNEEEFASLVDQIDEMLKK

SEQ ID NO: 7041 - protein, 431 aa, B.fragilis
LIMKTFFRSVAMLLGLGLLPLAAHAQKKVIIEDEEPNSVMFVSTNKAGDEIIRIMNETRLPRFHEPKAPRFVLTDRQGKFALGIGGYVRATAEYDFGGIVKDVDFYPALIPNKGSADRARNQFQMDISTSTLFLKLVGHTKRLGDFVVYTAANFRGDGKTFELQNAYATFLGFTLGYSYGNFMDLAALPPTIDFAGPNGSAFYRTTQLSYMCDKLKNWKFGVGVEMPSVDGTTNQYLTINTQRMPDFTASAQYNWNANSHLKLAAIVRSMTYSSSVDNKAHSKAGYGLQASTSFNVTPKWQVYGQVNYGKGIGQYLNDLSNLNVDIVPNPEKEGRMQTLPMLGWFAGLQYNISKNVFVSGTYSLSRLYSEHTYPSDEPDMYRKGQYLVANLFWNVTSNLQVGAEYLRGWRTDFSSNTRHANRMNALVQYSF

SEQ ID NO: 7042 - protein, 343 aa, B.fragilis
YEMKDRIILSNVKNIKDIIHAIDEYQKGVIAVVDDDNKLIGIVTDGDIRKAILYGELSIEKIINKRPVTFQYGSNQRSIINKLLEIKSSLIPLIEKDGTFVDFYFLGNNYKHYNSTKVVIMAGGLGSRLGELTENTPKPMLKIGGYPILEHILKSFRECGFVDFIFCVNYKSEVIQEYFQAGEKWNVNIEYVKENKRLGTGGALSLLNAMVDGDFFVINGDVLSTLNYDEFLYKHKNDQSVASMCLHKMDYQIPYGVIKTDEKSTIVDIVEKPTFYYYINTGIYVLNSCVLSYIPRDTFYDLPMLFKDLKEKSMLIKGYMTSDFWMDIGRKEDYWGIKKNFEL

SEQ ID NO: 7043 - protein, 281 aa, B.fragilis
LMKNLVALFTVFYSGAECFLKDFLSSLKEQSYKEFDLIIVNDGFEVGEFENLLCNLNVVEIKFSSTVSKNREYGLNYIKRAGYKYLILCDVDDFFSRKRVEISLNMLREFDVVVNDVDIVSNRNEILINNYFSRSLNSSTNIDLHFIKEKNLLGFSNTAIKTDLFDSINFPTNLEIVDWYFFTIILKKEPKVGFIHQALTYYRQHSNNLIGIGDYPIEFFKKMLDLKISHYSYLSDIDLDYKSLYIQYLDMKRKSDMDIIMGIDKNKKINKYPLWWENIKL

SEQ ID NO: 7044 - protein, 238 aa, B.fragilis
LMIDFFISILLYFYILLFRRGIRTAFPCLVSPLFVFNKTKKVTDVSLGKSFIGRDVMISDGCHFYDTPIVFGKVKIGRYTSINGPGTRICAFIHEINIGAFCSIASNVVIQEYNHCVNHVTTYNIYHHILNLKDSISISNTSKGPITIEDDVWIGSNVVILSGVKIGRGSVIGAGAVVVNDVPPYSVAVGNPARIVKKRFDDETISYIEKTRWWTWSIEEIKRKEDFFRKEFIKSEKG

SEQ ID NO: 7045 - protein, 647 aa, B.fragilis
QIIEHADGIFTVFGQQQERLVAVSIDQCLLLLCCGDDFHRIEAVETAQRFETYQLGLYRLSGRSGFTGCFPLRIRLIRLLRIVYFRIGPSRGVVGEVVHIIISGISACVKSDASVFTVDFHRKYIVYRFAGRCIDHNNPFLFGIGVTSAPGDISFRYGGGECSRNNGAMVPQCVGCPVVFAVKRGFGGRSLESLPEGLTSLTVPIKEFLHNVYLITMCKFTKNHLWIWQIGRFFIINRFCPKACVVIGYAISDVSLRLSGRIFLWEKYFLYYLCALKMNKPYTMNRKQILCISLLAFSLCACQDDDTADILDAFGTPPALTKMTAQEFLDQGEQMFEDGESVDEIVSADRAFYVNNPFNVSMADGKLRLFNGMAHDFKEVSLWLTMPHLRDTIQLMQFEEVPGFYNIKLDSPLKMGEVVYASKSGKPVRVNNLALLSPDQYELLLSCNDSVFDMLKTIKMKTRIQMGKYGSGNWGVMTANAARYYATSAVNMAVMFSSEIFRDSLMNYKGSIHNDAGKEIDREGLLNSILNKQSLVFGVVTGSGIAGLGGGNALGLREEYLAGFFYQNRVAIDCNWVLHVWIHELGHCLGYGHSSSLCYGSVPDEIVPKVYRYMMKHRMLPYIINPFKSYNDYNPGINDADNPDIEL

SEQ ID NO: 7046 - protein, 152 aa, B.fragilis
IMTELKEQLSLLGRKTEYKQDYAPEVLEAFDNKHPENDYWVRFNCPEFTSLCPITGQPDFAEIRISYLPDVKMVESKSLKLYLFSFRNHGAFHEDCVNIIMKDLIRLMDPKYIEVTGIFTPRGGISIYPYANYGRPGTKYEEMATHRLMNHE

SEQ ID NO: 7047 - protein, 167 aa, B.fragilis
FLGELTGNSSSNKQEYQLLKDNLVRSYNKALKKNAPYSIFAIKNGPKSHIGRHLMTSFLSMKGLTELTNVVGNWSDKRASAVARTTYTHQITAIPDHYFALVSRYYAYDPISKEMIALKDETNPIEEWQHIEQLKGSAEGSIRYPAWNGIISQEVLDYLSSYINRRI

SEQ ID NO: 7048 - protein, 167 aa, B.fragilis; identical to SEQ ID NO: 7047

SEQ ID NO: 7049 - protein, 433 aa, B.fragilis
MFNWTYLDGLSNYNIISRYSFNIINFMKIPFSPPYIDEAVINEVVDSLRSGWITSGPKVKALEEEIKSFSGAKEVLCVNSWTSGAIMMLRWLGVKEGDEVIVPAYTYSATALAVLHAGAKPVMVDSGTDFNISVEAVRKAITPKTKAIIPVDIAGFPCDYERIMALVQEPEMVKLFRSESPVQEKLGRILVMNDAAHSLGARYSNRQRTGCETDVAIFSLHAVKNVTTAEGGAICLNLPKPFDNTELYKELRMTSLNCQTKDAFSKSKAGGWRYDIVGFGMKINMADVNAAIGLAQIREYPELLKERKRVFNAYSDAFSACDWAIVPPSVDGEKESSYHIYALRIKDFTEEQRDRMIDEIAKSEVAVNVHFIPMPMLSFFKSMGYDIKDYPQAYQNFKSEISLPIYPQLDSEKLNFIIETVKAAYATVIAENR

SEQ ID NO: 7050 - protein, 481 aa, B.fragilis
FIDCMYKKQSFWSNIIKQSSWYYLCSALNNGLAILLLPFLSRRLSTEEYGIIQLSTGIGLFLPMVFSCGIDRAIYRFFNECRTHKAKKELISTVYWFVVIVGMVFLTIFVLSSSLWFKSVVHISPYPYVLLFAYPYLFAELSTIGQSYFQQVFDLKRMTIIEVIGTAINLLLSIYFVVTWDDGALARLVAITISFFFKSSIYSYYLLKRNLLVFRCNYIKVWEYVKFSLPLLPNSISLWLSRTFDRILISYYCGTAIAGVYSTAVQVSFVLYFIQDSVTQAFGPMQIRLFIQNKVEAVRCLKIMSKIFYIIMLVSVVFLSSFCKEIMNFVLDEKFVPPVIVVALLSSVYIYQAQYRLFSDILIYHKKNKYFMYAGIIQAVISLLINIVFIPKYGYVVAGWSSLIAVMLYTLIIAYYSVKIENLSLDYSFYIKYTLILMLALFLLLNPLFNMDMHILLKLLLVSGILVFGVRDVFKLKKNIV

SEQ ID NO: 7051 - protein, 246 aa, B.fragilis
FLMCELGYFISSYRLSPYKFRFFPISNYRIHRSGMIFLLYFCCKPKKNIMKKILFILFTVQFILIPRITGSYGANSIGNNHGHSVTNQGKKTIKKDIFGDTVIEDNHGNRKTIKKDIFGDTVIEDNRGNRKTIKKDIFGDTVIEDNRGNRKTIKKDIFGDTVIENNCGNRKTIKKDIFGDTVIEDNRGNRKSIKKDIFGNTVIENNKGYKKTIKTDIFGNKIIEDNHGKKQIIKKDIFGNVIIENY

SEQ ID NO: 7052 - protein, 236 aa, B.fragilis
NFILGGFDKMIAIIPARGGSKGLPGKNIRKMCGKPLIAYTIECALKSKYIDRVIVSTDDDEIARISLKFGAEVPFMRPSHLASDTVLAVENYLYTIDRIEKEENVIIDRFIVLQPTSPLRSVEDIDCAVELFKKKNADSVVSYTKEEHPIYWHKNIDNDNRLINIFDDKIVNRQELRTTYYPNGAIYIFKSSLIRNKKYYTDNSFAYVMPRDRSVDIDFLEDFLYAEYLLKKCSMK

SEQ ID NO: 7053 - protein, 62 aa, B.fragilis
GIILLCMSHSYNSLYNYLCLLYSQPTYEDKKDKQKIFRLYNDLFSEQKEYPNAYPCAIMGDG

SEQ ID NO: 7054 - protein, 272 aa, B.fragilis
KAIRSSYNKYQAFVDVYQLFLHPAGKLHRPHLFSVFVQQHNHVSRLKGFGYQFAFLLFLLLGCQAFRIFQFWNHLHIERNEVFGTLYVIVDCSDIMLLYSPSYDDKGCFHSSANSCLLHKNKKKILFLALNTYLCVSIILVIMKKRVLLWMAGLVFAVTSLFAQDIPVGVVVAFKKGNSQELNRYLGEKVNLVIQNRSESVDRQAAEGTLAAFFSSNKVSGFNVNHEGKRDESSFIIGTLTTANGNFRINCFFRRVQNKYLINQIRIDKTNE

SEQ ID NO: 7055 - protein, 172 aa, B.fragilis
KGKRAMEKMNITHKIVAMQPELEHFAYKLTADRESANDLVQDCLLKALDNKEKFVHTQNFKGWMYTIMRNIFINNYRKSLREVDMTDSTYNLYAQTMTEGEEGNRFETIYDLKELYKVINAVPEDLKKPFMMFVAGFKYREIAEKMDLPVGTIKSRLFLIRKRLQQDLKDFS

SEQ ID NO: 7056 - protein, 352 aa, B.fragilis
RFKRRKLSVSSVVRKQSSMNLKFLYLLLLISALCISCSKDEEPSDKGSTSPQEPVYTTFTDAGEVVVPGVLPANFTPRSVRVKGDTLFVANTNAADRSVLLLNLTTGELIGRIDSWVRKGVKETFNAEIGDMAVSDRYIFVGMYNSRINIFDRRTLQFVNAIGRSDGKWGDDIYSMTHCYGLRECGERLMVRDKNTIRGYWIYEAVTEPAFRVPWIGKVKVPEGVGYDYQARIHGMAEYDGRMYLTDWYNKSVQVFTPSKMEIVFGEETHITSDAVFKYDDIQPLGLLAYGGELLMSVQKSGKIQRYDPETGDLLGVLAEFPGKEIGRMEIARGMLYYIDLKAGKLMKAKGE

SEQ ID NO: 7057 - protein, 283 aa, B.fragilis
LMKSCSMLLPDTVAGGKTGSILVRHGPSTHALTSPFAEADTVGGKKLNQMKRIVFLMLSLGMAVTLHAQWTAKDSVNLQRILNGKEDIKLNMDAVKQIDFNSSPTVPKMSKERPGLRLDETLPQVLEKKKVVLTLRPYTANTKYNWDPIYQKKIRVDADTWRGDPFVELYQTVPSNWAKNVYDKGIRSSYEEIRSSGLRHNLFGERANGMMVPTQSMVHTSAMKLGKSGVTVNGGTIGGLDLMTIFTKDFWDKKGRNRRSRTLEVLKAYGDSTTVLLPEPIVH

SEQ ID NO: 7058 - protein, 214 aa, B.fragilis
CSFGSMKPLILVGGGGHCKSVIDVAESMRHSILGILDLPKNVGHSILGYPVLGTDDDIPLFVNQADFIVTVGFIKESSLRLKIHDKIRTSGGHLGTLIASTAYVSRHAQIGAGTVVMHHAFVNAGARIGSGCIINTFVNVEHDALIGDNCHISTGAMVNGDCKVGDCSFLGSQSVMVNGTSIISGCIIGAGSVVRKDILEKGIYSGNPAILKMK

SEQ ID NO: 7059 - protein, 68 aa, B.fragilis
NKKGKIMSLEDAIMGGIVFKGKKEGPKKDENKVKTKAKKTTYIKGTHGSGAAKMKAEIRRKRANRHKR

SEQ ID NO: 7060 - protein, 443 aa, B.fragilis
RKILNYNIMEKIVYIVHAVDTEGPLYESTEATFERLKSSFNIELEPTFANLQKLRHREIFLNGLEDKIVEFLDPSLQNYNDSWDKIDLMLSKILSNDFRFKFCDSFSGGWVYNWFCLDHVGYDYNPRRRDMGYHNIHDRYIELLDKYGKYKDDIQWHFHPMSHYKEAHRAGKSYEHSETLYQILSRRIIDRNFFPSVFRAGCVTERPDANWFLEQWIPFDCSNFAVENENKEQYRDQRNGQAGDWRRAPSDWRIYHPDFYDYQKEGCCHRSIGRFLNIVSRYGNITSYEIEKAFQRANEGLPTLLGIFNHDFRNMGNEIEYFCDLLYDISRKYNNVSFKFATAKEAFNAVLQNKLSEFDLNVRLKGNELYVDTIKGCVFGPQPYLAIKTKSGKYIHDNFDFGLDGKSWSYVFDENMIKFEDVDTIGVAANDMCGQVSLKCIKA

SEQ ID NO: 7061 - protein, 311 aa, B.fragilis
VVFFAFVFTLFSSFFGPSFFPLKTIPPIIASSKLIIFPFLFYIFRGQRYSFSVNSLSLPAVTTKNQSMNTSLLPAEKDPMGAAIADFYHRQKADRLRVFSSQFDEDEIPVKQLFRKAGQMPLLERTALAMATGTILDVGAGSGCHALALQESGKEVSAIDISPLSVEVMKLRGVKDARQVNLFDERFAATFDTILMLMNGSGIIGRLENMPLFFRKMKQLLRPDGCILMDSSDLRYLFEDEDGSFLIDLAGDYYGEIDFRMQYKDIQGDPFDWLYIDFQTLSAYAADNGFKAEMIKEGKHYDYLARLTVAL

SEQ ID NO: 7062 - protein, 244 aa, B.fragilis
NLFIKERIYIMKKVVHRSDTRGRSVYDWLDSHHSFSFDEYYNPERVHFGALRVLNDDRVAPGEGFQTHPHKNMEIVSIPLKGLLAHGDSKKNSRTITVGDIQVMSAGTGIYHSEMNGSKSEPVEFLQIWIIPKERNTHPLYQDYDIRGLLKKDELAFILSPDGSTPAKLLQDTWFSMGEIGAGKTVEYTLHGTDMGVYVFLIEGEVKIDDVILTRRDGLGISEIKNFEIETLKDSKILLIEVPM

SEQ ID NO: 7063 - protein, 198 aa, B.fragilis
ISFLIRFFDIVFSLLGILLLSPVFLLLYIAICLESKGGGFYKQLRVGRYGGDFYVYKFRSMRVGADKKGLITVGGRDPRITRTGYLIRKYKLDELPQLFNVLKGDMSLVGPRPEVRKYVDLYTDEQKKVLSVRPGITDYASIEYVDENMILGEASDPDRAYIEQIMPDKIRYNMKYICNRSVKEYFKIIFLTFWSIIR

SEQ ID NO: 7064 - protein, 372 aa, B.fragilis
SNVMIIGVPKEIKNNENRVGMTPSGVAELVKRGHTVYIQHTAGENSGFQDEAYTAVGAQILPTMEETYAMAQMIVKVKEPIAPEYRLIRKGQVVFTYFHFASDRELTLAMIENGSVCLAYETVEKADHSLPLLIPMSEVAGRMAIQEGARFLEKPQGGKGILPGGVPGVKPAKVLILGGGIVGSNAAQMAAGLGADVTIADINLSRLRYLSETLPKNVKTLYASEVRLKKELPDVDLVVGSVLIPGDKAPHLITRDMLKMMQPGTVLVDVAIDQGGCFETSHPTTHSEPTYVVDGIVHYAVANIPGAVPYTSTLALTNATLPYVIALANKGWRKACKKDPALALGLNVVEGKVVYRAIADVFGLKYEQLNLE

SEQ ID NO: 7065 - protein, 250 aa, B.fragilis
IGYMKHIFNKEQCQKATFILESPLAKLSELYSSEIKDLAVVWCYYSGRIEGNTYTYVETEALLKDGITSEKKYEDAKMLKNLYNTFISELEYIHQEKNKEIIDERTLFRLHQSISTGLVSNEESGFLRTRAVRISGTDYAPPKDLQEIKSKLGEILYEQDVYTNPLEKAVFLHCNIARLQPFIDGNKRTSRMIESVVMMNADIIPVYSAKDADILNYRKGLIRFYETGDYTKYSDYFLNRQLERIKEIDI

SEQ ID NO: 7066 - protein, 608 aa, B.fragilis
IRDMRKLLYVILLLLFRLLMFPGAVCAEILSLPDSLITDDNVYKYTFSDFDKAQQVMEQLRKRKSLSMFRMDVVEGDLYFNVGQYYKALKFYKRALDSDSVRNNDKNYMEQVHRMISCYDCLHNENKKSLYVYLLLKRAEQCGDKAMQSVALFNMGKMLYYQGNKEKGYEYLEQAIEMMSKTDYRYKYDNLRYDYNTLLIFQKSDRRNEEALRTLAALEKVVTEETGSETPMEGLSAKEKKAMYAHYAVVLFRLGQAEEAERYYRKFLAASEEYDRDDYLIMPYLFDRKMYDQVIRMNAAREKMYIMRGDTVNYYMTTIKRSLGWAYRDKGDYRTAARYFEQLAVLRDSIKNREQKSAALELAAVYETNEKDLFIQQQAADMQKRNLLLVFTLCIVFLLGVLLWRTIRHNRIIRRKNKAMVGTIEDLLIHKEELYRKKEENLILKEQLEREQNLRMSAGGGSLSTDKDGKAETTVVPEPQAGDGNDIHDRILFDKLEHEIISRQLYLQPDFSREELIKTIYIPKNKFAPLFKQYAGMSFSKYINNLRLEYAAKMLKNHPDYTVDTIAQECGMSTQSLYRLFSGKYGVTPTDFQVGVQHINNKNITEDK

SEQ ID NO: 7067 - protein, 261 aa, B.fragilis
SYTIKTEMKISIITVTFNSEKTINDTIQSVLMQSYSNIEYIIIDGKSNDSTLGIVKEYIPLFSGRLKYISEKDSGIYDAMNKGIKLASGDIIGIINSDDFYKSNNVIASVANAFNDNSIEVVFGNIQFVNPNNKTRIVRKYSGKGFRPWMFRWGIMPPHPSFFTRKSCYEKYGMYNSTFNISGDYDLMVRFLLVKKLKYKYMDLDMVIMRLGGASTKSIRSLLINNNYNVIRACRENGVYTNIFMVSLRYIKKISELIFKV

SEQ ID NO: 7068 - protein, 490 aa, B.fragilis
ANYMKQYIVALMLACSIQGHSQDVKQATFVPPFDFTLTLSGNFGEIRANHFHGGLDFKTQGVIGKPVRALADGYISRIRVTNGSGHVLDVVYNNGYTTINRHLSGFMPDIARRVEKLQYEKEDWEVEIVPEPGEYPVKAGQQIAWSGNTGYSFGPHLHLDVMETATGESIDPMPFFKSKIKDNTAPRAEGIMLFPQPGSGVVGGSPERQSFPINTARPIEAWGVIGSGIKAYDYMDGVHNRYGVHTVVLRVDGTEVFRSVVDRFSQDENRMINSWTCGQYMKSFIDPGNTLRMLRASNDNRGLVTIDEERDYKFEYELKDAFGNTSRYRFTVRGKRQPIQPLGHREKYFFAWDKTNFLQEPGLTLTVPRGMLYDNVPLNYEVHSDSGAIAYTYQLNDEKVPLHGGCELRIGLRRQPVADSTKYYVARVTPKGSMYSAGGTYEDGFMKTRIRELGTYTVAVDTVPPEITPVGKNTWGRNGKSSPRGWKDQR

SEQ ID NO: 7069 - protein, 282 aa, B.fragilis
IKPMNELIDRLIDLAFAEDIGDGDHTTLSCIPATAMGKSKLLIKEAGVLAGIEIAKEIFHRFDPTMKVEVFINDGAEVKPGDVAMIVEGKIQSLLQTERLMLNVMQRMSGIATMTRKYVKQLEGTKTRVLDTRKTTPGLRMLEKAAVKIGGGVNHRIGLFDMILLKDNHVDFAGGIDKAINRAKEYCKEKGKDLKIEIEVRNFDELRQVLSIGGVDRIMLDNFTPENTKKAVEMIGGKYETESSGGITFDTLRDYAECGVDFISVGALTHSVKGLDMSFKAC

SEQ ID NO: 7070 - protein, 230 aa, B.fragilis
KTGIMKEKVSVPFMLLGILFNVCLIAANLLETKVIQVGSITVTAGLLVFPISYIINDCIAEVWGFKKARLIIWSGFAMNFFVVALGLIAVALPAAPFWEGEQHFDFVFGMAPRIVVASLLAFLVGSFLNAYVMSKMKVASGGRNFSARAIWSTVVGETADSLIFFPIAFGGLIAWPELLVMMGTQIVLKSLYEVIILPITIRVVKAVKRIDGSDVYDTDISYNVLKVKDI

SEQ ID NO: 7071 - protein, 132 aa, B.fragilis
KTNLETMEIKSRFDHFNINVTDLERSIAFYEKALGLKEHHRKEAADGSFILVYLTDNTTGFLLELTWLRDHTEAYELGENESHLCFRVAGDYDAVRQYHKEMDCVCFENTSMGLYFINDPDDYWIEILPERL

SEQ ID NO: 7072 - protein, 61 aa, B.fragilis
FYDLKFDTMFLSVHMIYLLDVPPYNETLDGNATEYHLYICHIYPIIQCNDHVYYDIPYRVF

SEQ ID NO: 7073 - protein, 92 aa, B.fragilis
ATCFILFLEDTLRQLLARSRYLLFKAPGKWTDSQKRRAGILFKQFPDIKAVCYYALRWGKIFTDYIDKDVACAKNLEVGVKNRTFIMEVCCI

SEQ ID NO: 7074 - protein, 147 aa, B.fragilis
KEIVMSQLYFSSKKRNNGSILQIRGHYYANNRNDCFQPIGQLSPISFSAVKGNQLLITLNVPDTWCDKAGDGAWFAISVNDEIKSRGVYYSGKDGQRVPITLQTVVDVEEDHSYIIKGLWCNESGTENRNCNIGEFSETVLTVLVLD

SEQ ID NO: 7075 - protein, 85 aa, B.fragilis
GAFFFKALLYDLTKLSFNNWYSCLLLEELPVNSPRNYSIKISLHYEEQHITAVWVYLTVKFEEHWKPVDVEVEFRCKFKERKVDG

SEQ ID NO: 7076 - protein, 412 aa, B.fragilis
LYAFLKNNINMLNVDNFIGDHITFRRSSMFAPDIAANSDRLRQEVEGKSLLVIGGAGSIGSSYIKAILPFKPSKLVVIDLNENGLAELTRDLRSTYGLYIPDEYRTYTLNFADPIFERMFRKEQGFDIVANFSAHKHVRSEKDEYSVQALIENNVIKAKKLLDLLSEFPPRHFFCVSTDKAANPVNIMGASKRIMEDMIMAYSSKFKVTTARFANVAFSNGSLLAGFIDRIMKKQPLAAPNDVKRYFVSPEESGQICMLACVLGNNGEIFFPKLGEEKMITFSSICDRFLRTLGYEKKECATDEEARRYAAEMADDSKIYPVVYFKSDTTGEKGYEEFYVPGERLNLERFSSLGVIEDVSKRPLSELDSFFDDLESLFALPDCHKSDIVTALKRFLPNFEHVEKGKNLDQKM

SEQ ID NO: 7077 - protein, 501 aa, B.fragilis
MRKLFLISIGLLIVSTSTFAGGLLTNTNQHVLFLRMLARDASTQIDAVYSNPAGVAFMENGFHLSLNGQSAFQTRTITSTFAPFAGFGGNATKVYKGEASAPFIPSVFAVYKKDKWAFSGNFAVTGGGGKATFNEGLGSFESLVSVVPGMLVAAGNEMVDKGVLPINIFNGTNKYSVDSYMRGKQMIFGLQLGATYRITDYLSAFAGVRMNYVSNGYEGHIRNIEANIGGGEMVNVNKYFSDYAKQARTAADAYLAANDLANYAKYDAIAKEATKVAGLTADKELDCDQTGWGVTPILGLDFKMNKWNIGVKYEFNTKLNVENKTRIDNTGLFANGVNTPHDIPALLTVGVSYEILPVLRASVGYHHFFDTNARMADAKDPVTGQTMGKQHFIKQGTNEYLGGIEWDVCKWAQVSAGMQRTKYGVGDNYQSDMSFAVSSYSYGFGAGFDIAKNLKLNVAYFWTDYDKYTKETPNYGGTGIAGKDVFTRTNKVFGIGLDYKF

SEQ ID NO: 7078 - protein, 406 aa, B.fragilis
KIPSQFRTRGERKESGSENVMFTSMYNNITTFIHNLFGTDEFVPLHAPLFIGNEKKYLAECIDTTFVSSVGKFVDRFEEQVASYTGSKRAVVCVSGTNALHMGMLLVGVERDDEVLTQALTFIATCNAISYIGAHPVFLDVDRDTLGLSPLAVKRWLSGHAEVRNGQCYNKKTGRRIKACVPMHTFGHPMKIDELSAVCNEYHIELVEDAAESIGSFYKGRHTGTFGRVGAISFNGNKTITTGGGGMLLFQDEELGKFAKHLTTQAKVPHRWAFVHDHIGYNYRMPNINAALGCAQMENLDRYVSNKRETAERYREFFSRIPDVEFVVEPANSRSNYWLNAVLLKDRRAQQSFLEYTNDHGVMTRPVWELMNRLEMFRGCETDGLENTVWLEERIVNIPSSVRLGV

SEQ ID NO: 7079 - protein, 77 aa, B.fragilis
LLRTEELVLKKYLEDKEGDMSTIKIKQVKSRIGAPADQKRTLDALGLRKLNRVVEHESTPSILGMVDKVKHLVAIVK

SEQ ID NO: 7080 - protein, 113 aa, B.fragilis
RLLTVRVVILVSSRLETVWVTMLKCASSNSLTTTKTWLKRKLLRKQLVLVVQRKLLKLLLLPKYLQLKNRKLNQQNNSTIILIDIKKAALKRVAFFVDFTKDTLKTFEGEQSD

SEQ ID NO: 7081 - protein, 616 aa, B.fragilis
IYYFCGSNNQGNMEQLNLIIDTYQRIILESESKLAKVKQHIYRIGTLRLILFAAGIAGIIYFWDEGRLVIGGIAAITFIPFILLVKLHNRLFHQKDYLEKKIEINRQELQALTYDTSAFDNGEEFINPSHLYTYDLDVFGEHSLFQYINRTATQPGKKRLAEWMNMHLKSKAEIEKRQEAVRELAPELEMRQHFRVLGLLHKGKTADEEEIRNWASSPEYYRKKWYFRTLAILIPTANAVCIGLAIAGIISFTTWGIVFASIGLFSSSFSKGISRMQSVYGKKMLILTTYARLIHIIEEKKMRCSALKEIKELVGGEKQTASQAVKRLTELMNALDQRNNMLMQFVLNGLFFWELRQVMKIEAWKENYAAHLPDWLEAIGEMDAYCSLACFAYNHPGYVFPEIASKPFCVEAEALGHPLMNRNKCVRNDIRIAKRPFFIIITGANMAGKSTYLRTIGVSYLLACIGAPVWAEKMKLYPAQLVTSLRTTDSLADNESYFFAELKRLKLIIDKLNSGEELFIILDEILKGTNSMDKQKGSFALIKQFMALQANGIIATHDLLLGSLIDLFPKDIHNYCFEADITNNELTFSYKLRDGIAQNMNACFLMKKMGIAVIDD

SEQ ID NO: 7082 - protein, 193 aa, B.fragilis
EDKAMSRIGKLPISIPAGVTVTLKDDVVTVKGPKGELSQYVNPAINVAIEDGHITLTENENAMLDNPKQKHAFHGLYRSLVHNMVVGVSEGYKKELELVGVGYRASNQGNIIELALGYTHNIFIQLPPEVKVETKSERNKNPLILLESCDKQLLGQVCSKIRSFRKPEPYKGKGIKFVGEEIRRKSGKSAGAK

SEQ ID NO: 7083 - protein, 203 aa, B.fragilis
KEMARYPGPKSRIARKFGEGIFGADKVLSKKNYPPGQHGNSRKRKTSEYGIQLREKQKAKYTYGVLEKQFRNLFEKAATAKGITGEVLLQMLEGRLDNIVFRLGIAPTRAAARQLVGHKHITVDGQVVNIPSYAVKPGQLIGVRERSKSLEVIANSLAGFNHSKYAWLEWDEASKVGKLLHIPERADIPENIKEHLIVELYSK

SEQ ID NO: 7084 - protein, 162 aa, B.fragilis
KMRHNKKFNHLGRTASHRSAMLSNMACSLIKHKRITTTVAKAKALKKFVEPLITKSKEDTTNSRRVVFSNLQDKLAVTELFKEISVKIADRPGGYTRIIKTGNRLGDNAEMCFIELVDYNENMAKEKVAKKATRTRRSKKTTEAAPAAEVPATEEPKAESAE

SEQ ID NO: 7085 - protein, 335 aa, B.fragilis
IIINFMAILAFQKPDKVLMLEADAKFGKFEFRPLEPGFGITVGNALRRILLSSLEGFAITTIRIEGVEHEFSSVPGVKEDVTNIILNLKQVRFKQVVEEFESEKVSITIENSSEFKAGDIGKYLTGFEVLNPELVICHLDSKATMQIDITINKGRGYVPADENREYCTDVNVIPIDSIYTPIRNVKYAVENFRVEQKTDYEKLVLEITTDGSIHPKEALKEAAKILIYHFMLFSDEKITLESNDVDGNEEFDEEVLHMRQLLKTKLVDMDLSVRALNCLKAADVETLGDLVQFNKTDLLKFRNFGKKSLTELDDLLESLNLSFGTDISKYKLDKE

SEQ ID NO: 7086 - protein, 149 aa, B.fragilis
IYCLNIVRVVLINLIIFYMTDPIADYLTRLRNAINAKHRVVEVPASNLKKEITKILFEKGYILNYKFVEDGPQGTIKVALKYDSVNKVNAIKKLERISSPGMRQYTGYKDMPRVINGLGIAIISTSKGVMTNKEAAELKIGGEVLCYVY

SEQ ID NO: 7087 - protein, 186 aa, B.fragilis
VMSNTASLKKEYAERIAPALKSQFQYSSTMQIPVLKKIVINQGLGMAVADKKIIEVAINEMTAITGQKAVATISRKDIANFKLRKKMPIGVMVTLRRERMYEFLEKLVRVALPRIRDFKGIETKFDGKGNYTLGIQEQIIFPEINIDSITRILGMNITFVTSAQTDEEGYALLKEFGLPFKNAKKD

SEQ ID NO: 7088 - protein, 100 aa, B.fragilis
IMAKESMKAREIKRAKLVAKYAEKRAALKQIVRTGDPAEAFEAAQKLQELPKNSNPIRMHNRCKLTGRPKGYIRQFGVSRIQFREMASNGLIPGVKKASW

SEQ ID NO: 7089 - protein, 73 aa, B.fragilis
YMAKQSAIEQDGVIVEALSNAMFRVELENGHEITAHISGKMRMHYIKILPGDKVRVEMSPYDLSKGRIVFRYK

SEQ ID NO: 7090 - protein, 158 aa, B.fragilis
LFVEYKTNYNMNLSNLKPAEGSTKTRKRIGRGPGSGLGGTSTRGHKGAKSRSGYSKKIGFEGGQMPLQRRVPKFGFKNINRIEYKAINLETIQKLAEAKKLEKVGVNDFIEAGFISSSQLVKVLGNGTLTAKLSVEAHAFSKSAVAAIEAAGGNVVKL

SEQ ID NO: 7091 - protein, 148 aa, B.fragilis
TVGLNNLLYLQADMAKFIKIILFMLFAVALHSVANDYFAEKQAEQDIYMAMSTMKGDTHETVSSPQTPYFPDAELAGTGIQTHQIAMSRIQRIQAAESIFSLKALAQRLADRDAVLSQHWGKLYETTTSYWWHPVSEYYVFALRRIIV

SEQ ID NO: 7092 - protein, 118 aa, B.fragilis
ICIIMTTKIERRIKIKYRVRNKVSGTAARPRMSVFRSNKQIYVQIIDDLSGKTLAAASSLGMTEKLPKKEVAAKVGEIIAKKAQEAGITTVVFDRNGYLYHGRVKEVADAARNGGLKF

SEQ ID NO: 7093 - protein, 127 aa, B.fragilis
YMAIRIVGVDLPQNKRGEIALTYVYGIGRSSSAKILDKAGVDKDLKVKDWTDDQAAKIREIIGAEYKVEGDLRSEVQLNIKRLMDIGCYRGVRHRIGLPVRGQSTKNNARTRKGRKKTVANKKKATK

SEQ ID NO: 7094 - protein, 176 aa, B.fragilis
ILIIMAGVNNRVKITNDIELKDRLVAINRVTKVTKGGRTFSFSAIVVVGNEEGIIGWGLGKAGEVTAAIAKGVESAKKNLTRVPVLKGTVPHEQSAKFGGAEVFIKPASHGTGVVAGGAMRAVLESVGVTDVLAKSKGSSNPHNLVKATIMALGEMRDARMIAQNRGISVEKVFRG

SEQ ID NO: 7095 - protein, 267 aa, B.fragilis
VEMIFLKTEDEIELLRQSNLLVGRTLAEVAKLVKPGVTTKELDKVAEEFIRDHGAVPTFKGFPNQYGDPFPASLCTSVNEQVVHGIPGDIVLKDGDIVSVDCGTYMNGFCGDSAYTFCVGEVDEEVRQLLKVTKEALYIGIQNAVQGKRIGDIGYAIQQYCESHSYGVVREFVGHGIGKDMHEDPQVPNYGKRGYGTLLKKGLCIAIEPMITQGDRQVIMERDGWTVRTRDRKCAAHFEHTIAVGAGEADILSSFKFIEEVLGDKAI

SEQ ID NO: 7096 - protein, 215 aa, B.fragilis
EFNLLVLLLFYVAVPGSYRCGSIYQLLFTNNLNFNIMTTQAIDATIFASSHPDIAKRTSVSGLIFSCIMLLAGVIAFVSTFEMKDRSSTISMGLMVLGTALFLIGVFRLFWKSKEIVYLPTGSVAKEQSIFFDLKHLDELTDMVKSGDFSMQSTAKGGTSGNLRLDVMLSEDRKFAAVQLFQFVPYTYNPVTSVRYFTNGEAASIAAFLTKTKGH

SEQ ID NO: 7097 - protein, 134 aa, B.fragilis
IIIVDMAKKTVAAKKRNVKVDANGQLHVHSSFNNIIVSLANSEGQIISWSSAGKMGFRGSKKNTPYAAQMAAQDCAKIAFDLGLRKVKAYVKGPGNGRESAIRTIHGAGIEVTEIIDVTPLPHNGCRPPKRRRV

SEQ ID NO: 7098 - protein, 452 aa, B.fragilis
  UNSURE (67): Identity of amino acid sequences at the above locations are unknown.
NSDSMRKAIESSKNIWKIEDLRQRILITILFVAIYRFGSYVVFPGINPGMLTQLHRQTSEGLLALLXVFSGAAFSNASIFALGIMPYICASIVIQLLGIVVPYFQILQREGESGRRKMNQYTRYLTIAILLVQAPSYLLNLKMQAGPSLNASLDWTLFMVTSTIILAAGSMFILWLGERITDKGIGNGISFIILIGIIARLPQSLFQELISRMTDKTGGLIMFLFEIVFLLIVIAGAILLVQGTRKIPVQYAKRIVGNKQYGGARQYIPLKVNAAGVMPIIFAQAIMFIPITFIGFSNTNNVSGFVHAFTDHTSFWYNFVFAVMIILFTYFYTAITINPTQMAEDMKRNNGFIPGIKPGKKTAEYIDDIMSRITLPGSFFLAFIAIMPAFAGIFGVKAEFAQFFGGTSLLILVGVVLDTLQQVESHLLMRHYDGLLKSGRIKGRTGSSVAAY

SEQ ID NO: 7099 - protein, 61 aa, B.fragilis
IQKSHPKDKNTINSADTDSMPRLPIYKARSMVGNFIDMAEKITIAIALIPKQRLKDRGESP

SEQ ID NO: 7100 - protein, 177 aa, B.fragilis
ASIPPPIGAMTVAIPFIPPITASMPASCCPEYSSVAMEREITTPPAPAMPCKNRDVTNCEMVCEKMHPTVASRNRIMARSNGGRRPYLSLKGPKINCPAAKPIMLVVSPNCTIEDEVWKKSAIAGKVGKYMSIIKGPKALNTPKNNNKNRLEFCLSVIAILFDQYGCKITPSVRNRI

SEQ ID NO: 7101 - protein, 759 aa, B.fragilis
TYSTMKFKTFLAGCLGGLLSLNSCTNSPDMTDYVAYVNPFIGTGGHGHTFPGAIVPHGMISPSPDTRIDGWDACSGYYYADFTINGFSHTHLSGTGCCDYGDVLLMPTVGEQKYLPTGSQSQQMAYASAFSHQNETAEPGYYSVFLDTYQVKAELTASKRAAIHRYTFPESKEAGFILDLDYSLQRQTNKEMEIEVISPTEICGRKKTMYWAFDQYINFYAKFSKPFTYTLVTDSMALDDGGRLLPTCKALLHFDTTKDEQVFVKVGISAVDIEGARKNVETEIPDWDFDGVRKDARKAWNETLSKIDITTNDKNDKTIFYTALYHTAISPNLFTDVDGRYLGMDLQVHQGDTLNPMYTIFSLWDTFRALHPLMTIIDPDLNNAFIRSLIKKHQEGGIFPMWDMASNYTGTMIGYHAVPVIVDAYMKGDRNFDIQEAYRACVRAAEYDTTGIKCPDLVLPHLMPKAKYYKNSIGYVPCDRENESVAKALEYAYDDWCISVFADALNDYDTRDKYARFAKAYEFYFDPGTRFMRGLDSKGEWRTPFNPRSSTHRNDDYCEGTAWQWTWFVPHDIEGLVKLMGGEDAFIGKLDSLFTADSSLEGETTSSDISGLIGQYAHGNEPSHHVIHMYNYVNRPWRTQELVDSVYRSQYADAVDGLSGNEDCGQMSAWYVLNSMGFYQVCPGKPVYSIGRTAFDKAVVNLPDGKKFTVIVKNNSKKNKYIKSMTLNGKPLDKPFFTHDDIIAGSTLEIEMTDRRPQP

SEQ ID NO: 7102 - protein, 802 aa, B.fragilis
EGITETESILSPPAVYNAPSALMITSRNTKRRINQHTSSFVLHLYSLPLHTKSINYLKNSNPSRMKVLFHSLFILLFVFTACTSTPKQATIDYTQYVNPFIGTDFTGNTYPGAQVPFGMVQLSPDNGLPGWDRISGYFYPDSTIAGFSHTHLSGTGAGDLYDISFMPVTLPYKEAETPLGIYSKFSHQDESATAGYYQVLLKDYGINVELTATERCGIQRYTFPEAKAAIFLNLKKAMNWDFTNDSHIEVIDSVTIQGYRFSDGWARDQHVYFRTRFSKPFTAVQMDTTAILKDGKRMGTATIARFDFDTQKGEQILVNTALSGVSMEGAAQNLAAEVPEDNFDKYREAARDNWNRQLSKIAVKGDHKDDWVNFYTALYHTMLAPTIYSDVDGSYYGPDKKIHHTDGWVNYSTFSLWDTYRAAHPLFTYTEPERTNDMVQSFLAFYEQNGRLPVWNFYGSETDMMIGYHAVPVIVDAYLKGIGNFDPKKALEACVATANLDNYRGIGAYKELGYVPFNEKDSYNAENWSLSKTLEYAYDDYCIARMAEKLGKKEIADEFYKRSQNYRNVYNPATSFMQPRDDKGEFQKDFKADAYTPHICESNGWQYFWSVQHDIDGLIGLTGGKERFAQKLDSMFTFHPSADDELPLFSTGMIGQYAHGNEPSHHVIYLYNAVDQPWKTQEYVAKVMNELYLNSPAGLCGNEDCGQMSAWYVFSAMGFYPVNPISGQYEIGTPLFPEVQLHLDNGKTFTVKAPTVSKENIYIRSTKLNGKPYDKSYITHEQIMSGATLEFEMGKEKVTSDQ

SEQ ID NO: 7103 - protein, 1220 aa, B.fragilis
VVGLNIGLGCITQADIRFVGGYSPWFSSLPFLNINSMLNFKHLFLVSVALWSAVGMVRAQEFDPKQSYEIHTQNGLVLDNQESLDLGSKIFISKKEPHKESQVWNLIPCGDGCYSIVSPLTELGIDNSGNGSKECPVIQWDPNKENPNQQWRITALPNGNYLFTSVASGYNLGFPDAGLVAEPVYQLKPDAQKISQQWKIVKSNLKVVAEAFKTRSDNDWENERIFAVNKEEGRSTFVPFADTEEMKGDPSYTRPWIRNQSSRYLLLNGDWKFHWVKQPSERPVDFYKPGYDVSAWKEIPVPSNWEMLGYGTPIYTNITYPIRNNPPFIQGQRGYTVEKEPNAVGSYRREFSLPADWKNKEVFIHFDGVYSAMYLWINGKKVGYSQGANNDAEFNITQYVKPGKNILAVEVYRWSDGSYLEDQDMFRLSGIHRDVYLVATPKLRLRDVHLTSVISDRFDKADLCVKADVKNYGKSAVNASVRIALLDAGGRTLRTFTTAAGNLAAGKEICLPAKASIRDPQLWSAETPYLYTVNLELLDASGKVLEATTQQYGFRKIEIRDNKVYINDALVLFKGANRHDIHPRFGKAVPVESMIEDILLFKRFNLNTIRTSHYPNDPKMYALFDYYGLYVMDEADLECHGNMMLTKRESWKEAFVDRVVRMVKRDKNHPSVIFWSMGNESGGGPNFEAAYQAAREIDARFIHYEGMNDVADMDSRMYPSIESMIAQDNEPRNKPFFLCEYAHAMGNAVGNLEEYWDYIANQSKRMIGGCIWDWVDQGINKPGEAPDRYYFGGSFGDRPNDNDFCCNGLVTPDRRVTPKLWEVKKVYQYMTFEEVGENNVGLRNHYSFLNMRHFNLRYVILKDGVPVAEEEFGLPDGKPGEHRTIHIPYLRHLTEDADYHINLEVKLKHDCVWAKAGHVVATEQFLLRERKQKTEVPELSASLQVVEERQYIRFRAPGTEISFDSKTGMMIGLRYDGQNMIHGQQGPALNWYRSISNDPREWIQPVVVLRGFDWKLAEDGKSASVQSQIEVKVGQVNIPYTVRYRVYSNGRVDVAADFTTESNFDLPRLGLQMFLNPSLEQVEWYGRGPMENYRDRKNAAYMGRYKTTVTDMAEHYARAQTMGERTDTHWLALTDGQGKGLRITATDTLDFSAQHYTDKDLWQVKYGHDLSDIRRAEVVLNLDCIQRGLGNASCGPGPRPHYEIRKDTVYSYSFRMEPLR

SEQ ID NO: 7104 - protein, 378 aa, B.fragilis
KRQHKEHLINKKLKQKMKRIVFLDYVRVFACFLVMIVHSSENFYGAAGSTDMAGPQSYLASEADRLWVAVYDGFSRMAVPLFMIVSAFLLAPMKEEQTTWQFYRQRFLRIIPPFFIFMILYSTLPMLWGQINGETSLTDLSRIFLNFPTLAGHLWFMYPLISLYLFIPIISPWLRKASAKEERFFIGLFLLSTCIPYLNRWCGEVWGQCFWNEYHMLWYFSGYLGYLVLAHYIHTHLTWSRSKRFIIGTILMVIGAVLTIYSFYSQAIPGETLSTPVIEIGWAFCTINCVLLTAGTFLMFTCINSSKAPRIITEMSKLSYGMYLMHIFWLGLWATVFKYTLALPTVAAIPCIAVSTFICCFITSKLISFIPGSKWIIG

SEQ ID NO: 7105 - protein, 64 aa, B.fragilis
PYSNVHPMIHLLPGMNEMSFEVMKQQINVLTAMHGIAATVGSARVYLNTVAHNPNQKICIRYIP

SEQ ID NO: 7106 - protein, 234 aa, B.fragilis
TKKNIFIMKTVFNIVLGVCAIALVYICYASIMGPINFEKAKKHRDKAVVARLIDIRKAQAEYRNIYKQYTASFDTLIDFVKTQKIPFVSKEGVLSDKQLEDGMTEKKAMALINKAKKTNNWKEVEAAGLMGFKRDTIWVAVTDTIYDKSFNADSLRYVPFGNGAQFEMYTKNDTTKSGAPIFLFQANTPYDVYLNGLDKQEIANLKDLQVKLGKYAGLMVGSIDTPNNGAGNWE

SEQ ID NO: 7107 - protein, 736 aa, B.fragilis
SMKNKILFQRPRLLKASLVLLLAAAPIQWSFAQFTFSTSRTTLGQVIKTVQSQSKYQFFYDDQSSNMPIENLNVKNVSLEQLLNTALKGKNLTYKIEDNIVYLSQASKQQDPVQASAKRQISGTVVDANGEALIGVNVSVKGTSTGAITDLEGKYTLTVNDPKAEIVFSYIGYKQQVLPAKESILNVTMSEDTQMISEVVVTALGIKREKKMLGYAVQEIKGDQLNQTGDPSVTSALQGKVAGLQMNTAGTGLGGSTKITIRGNSSLADNNQPLWIVDGVPFSDNNNSDATYYGGVDRGGSSVDINPEDIESISVLKGPNAAALYGSRAGNGVILVTTKKGSKKDGFGVRYSGNFTWSQVAETLEMQDRYGQGHIVTQDENKNPLSQYYAKYDPTDSSSWGPVLDGSMQKAWNGDTYAFSKYGNKLKDYFDTGFAQNHNVSVSNVTDKSHFRASFGSSNNKGVFPNEKLNRINLDLNAGMEMNKYLSMDGKISLSRTKAEDRPYFGTYGAIAQLMGIPNNIRLDDLKQYSTDGNAHVNWTGPTAGIRNPYYVLNQRHNSDERWRAFGYYGMKINFTDWLHLSAKYAFDYYRTRIEETNAGDGINGESSIKDITDDEMNREEQNFFESNAEIVLMGDKQLTDNFRLGFTVGGNFMYQNYESLNAGVRNMLDKGQWIFNAANMLNAAGETGHERATNSVFGSLQLSCKQYLSLDLTARNDWSSTLPKKNTLSSTCLPT

SEQ ID NO: 7108 - protein, 347 aa, B.fragilis
YSEKSSAKIACFYYFCRINKRNIYKMRKVYYIYNPQTQTYDRIYPTVRQRALSILRRLFIGMGLGAGSFIILLLIFGSPSEKELRKENSQLLAQYNVLSRRLDEAMGVLQDIQQRDDNLYRVIFMADPVSPAIRQAGYGGTNRYEQLMDMANSKLVINTTQKMDVLSKQLYIQSKSFDDVVAMCKNHDQMLKCIPAIQPISNKDLRKTASGYGTRVDPIYGTTKFHAGMDFSAHPGTDVYATGDGTVVKMGWETGYGNTVEIDHGFGYRTRYAHLQEFRTKLGKKVVRGEVIAGVGSTGKSTGPHLHYEVHVKGQVVNPVNYYFMDLSAEDYERMIQIAANHGKVFD

SEQ ID NO: 7109 - protein, 135 aa, B.fragilis
KIRKMKQRVTSNHIERLQPNEIFVFGSNLSGHHGGGAALLAMNKWGAIWGQGVGLQGQTYGIPTMQGGVETIRPYVDEFIQFANKHPEMTFLVTEIGCGIAGFTPQEIAPLFAKATTTENIHLPQRFWDLLERIP

SEQ ID NO: 7110 - protein, 126 aa, B.fragilis
LKEKKIMQNTERDLKLYYSISEVAQMFDVNESLLRFWEKEFPQISPKKGSRGVRQYRKEDVETIRLIYHLVKERGMTLPGARQKLKDNREATIRNFEIIDRLKQIRQELIGMRDALDGFSTKTGGA

SEQ ID NO: 7111 - protein, 66 aa, B.fragilis
KEENRCFKSQRIVGFKGRILWFSINILNLKYLFVSESWLMVCFDFIFSRLHWILNLLLAFCQERTP

SEQ ID NO: 7112 - protein, 183 aa, B.fragilis
HASLINMRVISGIYKRRRFDVPRTFKARPTTDFAKENLFNVLSNYMNFEEGIVALDLFAGTGSISIELVSRGCDRVISVEKEGAHHAFISKIMKEVQTDKCLPIRGDVFKFINGSHERFDFIFADPPYELKELETIPDLIFKNNLLKEDGLFVLEHGKKNNFEDHPHFIERRVYGSVNFSFFR

SEQ ID NO: 7113 - protein, 389 aa, B.fragilis
MKQEKQTELLRTQQMLNEVNRKLLMTLGVAEVFPWKWELAEHMVWFDARPSDDPAGWEIFHNDSFPVSIARVYQGIYKEDRLRVIEACRGILKGKMKKVVVELRFWAKKREGFVLEWLEMHAIPGKVDENGRLLTVEGSLMSITRRKVMEEELTAAKEKAEEANRLKSALIANMNHEIRTPLNAIVGFASLLSIIDDEKEQQEYIGLIQSNTEHLLRLMNDVIDLSNIESGVMDIVGSDVVLDSLMKEMELTYVPKAETNNLVLAWDREQSNAHIYTDRDRLIQILEHLLDNAIKFTTKGTVRWGYQEKENGQIRFYVTDTGCGIPNDKKEVIFERFVKLDSFTQGLGLGLSLCKIIIERMHGTIGVESEVGEGSTFWFTIPNLSDNHI

SEQ ID NO: 7114 - protein, 375 aa, B.fragilis
VLSFTIYLRTPIFAVHKKHRTIMSKQEVILCEDLESSLKRAIDNCPHDRLFILTDDHTHRLCLSQLAGLSILKDAVEITIGAEDVHKTLETLASVWQVLSEKGATRHSLLINLGGGMVTDLGGFAAATFKRGIAYINIPTTLLAMVDASVGGKTGINFNGLKNEIGAFAPAASVLIETEFLRTLDAHNFFSGYAEMLKHGLISNTSHWAELLAFDTEKMDYGYLKKLVGHSVQVKEDIVEQDPFEHGIRKALNLGHTVGHAFESLALAENRPVLHGYAVAWGIVCELYLSHLKAGFPKEKMRQTIQFIKDNYGAFHFDCKQYDRLYEFMQHDKKNSAGVINFTLLKEIGDISINRTADKDTIFEMFDFYRECMGM

SEQ ID NO: 7115 - protein, 294 aa, B.fragilis
TYICCLKQTFMKTDRLLADTKTIRYEETDLASLISAPYHFRCGIYLICTQGEAVVSTGVQKYIFNEQTELIFLTGGLLQVLETSGDLQVKMLMFPKEAFLNAMLPIDTPYFNYTHEHPCYHHTADERSQKTWRQINLWMDMAQMLFTEPMPQFRGQQEHNFLQSLLMWLFNTIPEKLAVSKQYSRTQLLCHRFMQLIREYSMHEHQVAFYAEKLCISSRYLHKITVRHLDGKKPKQLIDEQLVAEIKVLLNEPRLSVTEIAEQLHFPDQSYLTHFFKKNTGISPKEFRAIKNLG

SEQ ID NO: 7116 - protein, 199 aa, B.fragilis
SITCSPHPQNQQLKKMDDTFDITYKALFRRYYPNLMFYATRLVGDEEAEDVVQDVFVELWKRRDSMVIGDQIQAFLYRAVYTRALNVLKHRSIEDGYCAAVKEINQKRAEFYQPDNNEVIRRIEDRELRNEIYQAINELPDKCKEVFKLSYLHEMKNKEIADVMGVSLRTVEAHMYKALKFLRNRLGHLWFLFLLFFIK

SEQ ID NO: 7117 - protein, 478 aa, B.fragilis
LFSRTKMINNYLERQIKENFSYQPTFEQEIAVKSLSEFLLSTANDTVFVLRGYAGTGKTSLVGALVKAMDKLQQKSVLLAPTGRAAKVFSAYAGHPAFTIHKKIYRQQSFSNEVSNFSINDNLTTHTLYIVDEASMISNEGLSGSMFGTGRLLDDLVEFVYSGVGCRLLLMGDTAQLPPVGEEQSPALATEALKGYGLNVIEVDLTQVVRQVQSSGILWNATQIRQLIAEDECFSLPKIKVSGFPDIQVVRGDELIDTLTGCYEKDGMDETIVVCRSNKRANIYNKGIRAQILYREDELNTGDLLMVAKNNYFWTEKYKEMDFIANGEIAVVRRVRRTRELYGFRFAEVLLAFPDQNDFELEANLLLDTLHSDAPALPKTENDRLFYSVLEDYVDITVKRERMKKMKADPHYNALQVKYAYAVTCHKAQGGQWQNVFLDQGYMSDEYLTPDYFRWLYTAFTRASKTLYLVNYPEEQIE

SEQ ID NO: 7118 - protein, 65 aa, B.fragilis
FGYRNQLPRQNNRQFILSKNMNIIKDTDLGSTSQTQNDHPNFGVGRNRRHTNVLHVLTNHKFIPQ

SEQ ID NO: 7119 - protein, 766 aa, B.fragilis
YPYSNTLIHTMRKILLTACLIACSLMAEAKDWTQYVNPLMGTQSSFELSTGNTYPAIARPWGMNFWTPQTGKMGDGWQYTYTANKIRGFKQTHQPSPWINDYGQFSIMPVTGKLEFDEEKRASWFSHKGEIATPSYYKVYLAEHDVVTEMTPTERAVLFRFTFPENEHSYIVVDAFDKGSYVKVIPEENKIIGYTTRNSGGVPENFKNYFVIEFDKPFTYKGTFADKKLEEGNLEQKADHTGAIIGFSTRKGEIVHARIASSFINFEQAAQNLKELGNDSFEQLAQKGNDAWNNVLGKIQGEGGNLDQYRTFYSCLYRSLLFPRKFYEFTADGQPIHYSPYNGQVLPGYMYTDTGFWDTFRCLFPFLNLMYPSVNKEIQEGLINTYKESGFFPEWASPGHRGCMIGNNSASVLVDAYMKGVKVDDVKTLYEGLIHGTENVHPEVSSTGRLGYQYYNKLGYVPYDVKINENTARTLEYAYDDWCIYQLAKALNRPKKEIELFAKRAMNYRNVFDKESKLMRGRNENGQFQSPFSPLKWGDAFTEGNSWHYSWSVFHDPQGLIDLMGGKKMFITMLDSVFAVPPVFDDSYYGQVIHEIREMTVMNMGNYAHGNQPIQHMIYLYNYAGQPWKAQYWLRQVMDRMYTPGPDGYCGDEDNGQTSAWYVFSALGFYPVCPGTDEYVIGAPLFKKATLHFENGNNLVIDAQNNSKENLYIESLRVNGQESTRNYLKHADLLQGGTIEFKMGSHPNLNRGINDDDAPYSFSKMK

SEQ ID NO: 7120 - protein, 430 aa, B.fragilis
  UNSURE (70): Identity of amino acid sequences at the above locations are unknown.
RQKRIDFLFLQPNITIEIKTMRYLLSAPSQIKATIQLPASKSISNRALIIHALSKGDDVPSNLSDCDDTXVMIKALTEGNEVIDILAAGTAMRFLTAYLSSTPGIHTITGTERMQQRPIQILVNALRELGAHIEYVRNEGFPPLRIEGRELTGSEITLKGNVSSQYISALLMIGPVLKNGLQLRLTGEIVSRPYINLTLQLMKDFGASASWTSDQNIQVDPQPYHCLPFTVESDWSAASYWYQIAALSPQADIELTGLFRHSYQGDSRGAEVFARLGVATEYTETGIRLKKNGTCVERLDEDFVDIPDLAQTFVVTCALLNVPFRFTGLQSLKIKETDRIEALKTEMKKLGYILHDKNDSILSWDGERVEQQTCPVIKTYEDHRMAMAFAPAAIHYPTIQIDEPQVVSKSYPGYWDDLRKAGFGIKVGEE

SEQ ID NO: 7121 - protein, 876 aa, B.fragilis
IYRSMLTAKETRDSFKNFFESKGHQIVPSAPMVIKDDPTLMFTNAGMNQFKDIILGNHPAKYHRVADSQKCLRVSGKHNDLEEVGHDTYHHTMFEMLGNWSFGDYFKKEAISWAWEYLVDVLKLNPEHLYATVFEGSPEEGLERDNEAASYWEQYLPKDHIINGNKHDNFWEMGDTGPCGPCSEIHIDLRPAEERAKISGRDLVNHDHPQVIEIWNLVFMQYNRKADSTLEPLPAKVIDTGMGFERLCMALQGKTSNYDTDVFQPLIKAIAQMAGTEYGKNEQNDIAMRVIADHIRTIAFSITDGQLPSNAKAGYVIRRILRRAVRYGYTFLGQKQAFMYKLLPVLIDSMGDAYPELIAQKELIEKVIKEEEESFLRTLETGIRLLDKTMADTKANGKTEISGKDAFTLYDTFGFPLDLTELILRENGMTVNVEEFDAEMQQQKQRARNAAAIETGDWIILKEGTTEFVGYDYTEYETSILRYRQVKQKNQTLYQIVLDYTPFYAESGGQVGDTGVLVNEFETIEVIDTKKENNLPIHITKNLPEHPEAPMMACVDTDKRAACAANHSATHLLDEALREVLGEHVEQKGSLVTPDSLRFDFSHFQKVTDEELRKVEHLVNAKIRANVPLQEHRNIPIEEAKELGAIALFGEKYGDHVRVIQFGSSIEFCGGTHVAATGNIGMVKIISESSVAAGVRRIEAYTGARVEEMLDTIQDTLSDLKALFNNAPDLGVAIRKYIDENAGLKKQVEDFMKEKEAAVKERLLKNVQEINGIKVIKFCLPMPAEVVKNIAFQLRGEITENLFFVAGTVDANKPMLTVMISDNLVAGGLKAGNLVKEAAKLIQGGGGGQPHFATAGGKNPDGLNAAVEKVLELAGI

SEQ ID NO: 7122 - protein, 146 aa, B.fragilis
EKAIFVTLNLDKMKALLPVFCRPLGYVILVISMFIPFLLLMQGMVTDSNLLFYKECIKLLMILGAMMIIFALSRNEGRETEIIRNKATRNAIFLTVLFLFGGMLYRVATGDIMTVDTSSFLIFLIINVLCLEFGMQKARIDKIFKR

SEQ ID NO: 7123 - protein, 656 aa, B.fragilis
RHDMKFVNRFFMILVALCLVCPGVSAVVNPKPFVIPELKEWKGAEGAFVPTETTKIVCPANQPELLRIARMLADDCETMFGHKPEVVQGKGGAGDVILAIRADKKLGKEGYTVKVTDRILLTAPESIGVYWGTRTLLQIAEQSENHQFPKGTLRDFPDYAMRGFMIDCGRKFIPLSFLQDYVKIMAYYKMNTLQIHLNDNGFKQFFGHDWSKTYAAFRLESDTYPGLAAEDGYYTKREFIDLQKLAENLYVEIIPEIDAPAHTLAFTHYKPEIGSKEYGMDHLDLFNPETYKFMDGLFKEYLEGDEPVFRGKKVHIGTDEYSNKKKDVVEKFRAFTDHYIRYVESFGKQACVWGALTHAKGDTPVKSENVIMSAWYNGYANPKDMIEQGYKLISIPDGLVYIVPAAGYYYDYLNTKYLYENWTPVQIGKAVFPEKDPSILGGMFAVWNDHVGNGISTKDIHHRVYPALQTLAVKMWTGKDVSVPYADFDKQRNAISEAPGVNQLGRIGTTPGLVYEQASVAPNSETPHREIGYDYLVTFDIDGANEAKGTELFRSPDAVFYLSDPIRGMLGFARDGYLNTFSHRIHKGEKATIGISGDNKSTRLLINGQVVEEMNTQKLYYNAGKDSMNYVRTLVFPLEKAGKFDSKITNLKVYKK

SEQ ID NO: 7124 - protein, 196 aa, B.fragilis
RYSMKIKIYKSLAMCTLLLGLAACNDFEEMNTDPYAPVYDPEIIGATPDGIDIDYELTPSALKSLQGTESAIGSVFANLTYEGLYNDYQVTTNLTHDIYAAYFANNVSGFVTNSPTYGYNDGWSKRRWEHFYDNRTVEEYSQLIKTFWFCGKERYHNAFYMTRIYYAFLISMQTDTYGAHSIGILRKNVQCPQTRK

SEQ ID NO: 7125 - protein, 499 aa, B.fragilis
ANLIYSDIQNCKIDEHMNLRNFFLAAGIAAVAVPVWGQKAPEPYGLTPSARQVEWYNREMIAFFHFGINTFEEYVNEGDGRAPAAIFNPTALDCGQWMRTLQSAGIPSAIITAKHADGFCLWPSKYTDYGVKNSAWKNGKGDVVREFVDACEEYGIKAGIYLGPHDRHEHLSPLYTTEKYKQYYGHQLEELMGDYGKVWETWWDGAGADELTTPVYTHWYKIVREKQPDCVIFGTKNSYPFADVRWMGNESGKAGDPCWSTTDSVCVRDEWKNYEGLNEGVKGGDAYIPAETDVSIRPSWFYHAEEDSRVKSVKELWDIYCTSVGHNSVLLLNFPPDRRGLIHPTDSLHAALLKQGLDETFGNNLLAKAKVKATNGRGGKFRPEFLTDNNKETYFAGRDGAKTSDIVFTLSRQTEFDCLMIQEVIELGHRTTKWSVEYSNDGRNWTPIPEATDKQTVGYKWIVRFAPVKAKQVRLRILDGFACPAIHTFGVYKQSALFQ

SEQ ID NO: 7126 - protein, 402 aa, B.fragilis
SKRIAMTDRQNSRRFLLLFLGVLSAFGPFIMDMYLPTLPAMADFFHTSSSMVQLGLTTSMIGLAAGQLIFGPLSDKYGRRPPLLLAMILFLLATVGCIFSHTISQFVTSRFLQGIAGAGGVVISRSIATDEYSGQQLAGMLAVIGGINGIATVIAPIGGGILAQITSWQGIFICLFFMGVVLLSGSLHLNESLPAKHRQTVSWQDLYHSFGEVLHNRRYVGYVLQYGFTMGILFVNISSAPFIMQQHYGLSPLSFSLCFGINAIAMVIFSAISIKLPTMERALYIGSRGMLSVSALLMVFLSLGCDFWIYELLIFALLSMIGMTFTASNTLAMECERRNAGIASALLGATGFAFGGIVSPLVSLGDMMTSTGILFLAGSACAYACTRYVLSPSVQPSGVLYH

SEQ ID NO: 7127 - protein, 281 aa, B.fragilis
VLSILLTTAQVTGNNPNMPDRAIAETIDFGKSEQYTLSIRLSTDGFSFSIYNPIHDSSLSFFEKEVEASLSLTANLKQAFRELDFLNHTYKRVNILMADKRFTLIPLELFEDDQSEMIFYHNHTPKENETVKYNILKKNNAVVIFGMDKSTCQFLSDQYPEARFYSQAAPLAEYFSAKSRLGNSKKIYASIRRDAIDFFCYERGHLLLANSFECRKTGDRIYYLLYLWKQLNFDQERDELHLTGAFNDKEKLMQELRKYIQQVFIMNPASNIDMQALLTCE

SEQ ID NO: 7128 - protein, 385 aa, B.fragilis
NTWIRKMYTTLSFKMLRSGPSLHWHNTPSTAQYSLGENDKCFGGDKDKWLRFANTLRLRLALRVSNVDPQLAKEQGEKAMADPAGLMQSDDDNMKQTPKYSYITGGNENIYTLLYNWSANVVLSKEMERAYKEQSTILDPRCEILWWRPTALEDLNQTEPKEDMTKDFNGCENGETSLGGSYTTTYSPSRVFIKQDQKKLDRKHWWCYAREIVWLGYSESLFLRAEAALRGWAGAKGTAEDLYKEGIEASFNYYQIGADEEGQEKISKYMEGLKGLQAFKSGDREAQLEQIITQKWIAVYPNGNEGWAEFRRTDYPRYMKTPKGGNNSGGEVANGKFIKRLRYPDSEVSNPNRPKDVDTQGTRLWWDVADTNDDGGNYVTPNNFR

SEQ ID NO: 7129 - protein, 303 aa, B.fragilis
LFYFCINKERILMPNRDSEKLITDGYTTTLLGDELMVCENMKHIRVTSVPSYTEVGMIILCLRGTAKICIFDNIHILAKNELAVILPGQLVSITELSPDFLCNIVVLSRALFDDTLSGFSRFSPLFFVYMRSHYWYELTGEEIERFKLFYGSLSQRAKDPTHFFRRESVLLLLRIFYLDIYNEYYSKSHLMKGGSDMGKSKLAHDFFCLIMQHYREHKDVAFYADKLCITSKYLSMVIKEASGKTAKDWIVEYAILEIKAMLKNSTMNIQEISIKTNFANQSSLGRFFRKHTGMTLTEYRMHR

SEQ ID NO: 7130 - protein, 989 aa, B.fragilis
TFCFEGCQTNDCYYSTYRQMKKLLIWTVLLLTATLSTYAQNKIVTVSGRVIEAGTKEPVELAAVQLLSLPDSAQVAGMTTSTQGYFSLSKQKPGKYLLKVSFIGYVTKIIPVQLTANVPAKKMGNIELATDAVMLQEAVVVAEAPQVTVVEDTLMYNSSAYRTPEGAMLEELVKKLPGAEIDDDGNVKINGKDLKKIMVDGKEFFGGDVKTGLKNLPVDMVDKLKTYDKKSDLARVTGIDDGEEETVLDLTVKKGMNQGWFGNADLGAGTKDRYTGRMMLNRFVDKTQFSIIGSANNVNDQGFSGGGGGPRWRSNNGLNATKMLGANFATQTNKLELGGSVRYNFQDADISSINSSERFLQNGNSYSNSNNKNRNKGTNLNADFRMEWKPDTLTNIIFRPNFSYGRTNNASRSESGTFNEDPFNLIVNPNDYLNFDNLSDDPLKDIRVNATNSASLSKGKSLSGNATLQVNRKLNNRGRNLTFRGVFGYGDNDSDQYTQSETRYYQLLNHLGGDSILYRNQYITTPTRNYNYTAQVTYSEPIAKATFLQFSYQFQYKYSKSDKTTFDLLDYPDWAIGGALPSGYESHAVDSLSKNAEYRYYNHDASVGLRFIRPKYQLNVGMSFQPQNSTLSYKKGDYMIDTTRTVFNFAPNMDLRFRFSKVSQLRFTYRGRSNQPTMENLLPITDNSNPLNIRMGNPGLKPSFAHTMRLFYNTYNAEKQRGIMTHFSFTATQNSISNSTRYNEETGGLITRPENINGNWNAFGMFGFNTALKNKKYTINTFTNVNYQNNVAFLYNQDTKNNDRNTSTGLTLGERVTGSYRNDWFEFSLNGSINYTAERNKLRPENNQEPYTYSYGASTNITMPWKMTLATNIANQSRRGYRDSSMNRDELIWNAQLAQSLLKGAATVSFEVYDILRQQSNISRSLSADMRSVSEYNGINSYCMVHFIYRLNIFGSKAAREKMMNSGRRGFGGPGRGPGGGFGGGHPRF

SEQ ID NO: 7131 - protein, 422 aa, B.fragilis
RLVVYTAKKEHSFFYLSANLSFVVSDFVRSLDKTLPNWLTFAKVRLSAAQVGKDTDPYQLYNTYGFKFEKGELIPSKSNVKMNDQLKPEISSSYEAGLDMKFLNNRLGFDFTYYYSRTKNQIMKVPAAAPWSGGKWVNAGLITNKGFEMMIYSTPVQLKDFSFDLNVNLAKNVSNVEKLADGVDYIYFNGDSNFPINVGARPGHKLGEIYAKTLYKRDEQGNIIINKENGLPMTTTDADERLAKPIGNIQPNLLMSVSPSFTYKGFTLSAMFDMKFGGDIISISEMNATGSGMAKRTMNRGESDNFMMIFPGVYEDGTPNTQKISASNYYGAQNAEDFIYDASFIKLKELAIGYTFPKSMLKKTPINSLNVSFVARNLAYLLKHTPGTSPEGGYDTTMFSQAIDFMAVPYTRTFGFSVNLGF

SEQ ID NO: 7132 - protein, 79 aa, B.fragilis
AVCLALLSFIFKVEPLAGIFRSGAQLLFIYLKRILSGSDLYMSEYKSSTWDYYIWGVSDFMEVAILKCSSYDPFAARYE

SEQ ID NO: 7133 - protein, 503 aa, B.fragilis
IGTVVVRIRYFPYICSLYNPRRANMIDWNYIASVIATVAFDIIYFGAIIGTIVIVILDNRNPVKTMAWILILMFLPVVGLVFYFFFGRSQRREKIIGKKSYDRLLKKPMAEYLAQNCCETPKEYERLIQLFQNTNQAFPFEGNRVDIYTGGYSKLQALLRELQKARLHIHMEYYIFEDDPVGRLVRDVLIEKAREGVEVRVIYDDVGCWHVPHRFFEEMRDAGIEVRSFLKVRFPLFTSKVNYRNHRKIVVIDGRIGFIGGMNLAERYMRGFSWGIWRDTHILLEGKAVHGLQTAFLLDWYFVDRTLITASRYFPKIEAYGNSLVQIVTSEPIGPWKEIMQGLTVAISGAKKYFYMQTPYFLPTEQILGAMQTAALAGVDIRLMLPEHADNRVTHLGSCSYLADVLRAGVKVYFYKKGFLHSKLMVSDDMLSTVGSTNLDFRSFEHNFEVNAFMYDMETALQMREIFLQDQRESTQIFLKSWEKRSSRQKAMESVVRLLAPLL

SEQ ID NO: 7134 - protein, 342 aa, B.fragilis
LFLLYNEKEKMNNLSEDILMRYLTGECSDEDFARVNAWIKESDDNARRLFRMEEVYHLGRHDSFPDQKKVARAEARLYKKLAQEDAHSRKVIRMHQWMRYAAIIVLALMIGTGGGYLYYQADPTRNMITASSTDGKVKEVMLPDGTKVWLNQSATLRYPKEFSESERDVYLDGEAYFEVTKNRRCPFVVESEAMRIKVLGTTFNFKCDKSHKLAEATLIEGEIEVRGNHDEGMIILSPGQKAELNKTTRRLVVKQVDAKLDAVWHNDLIPFEQADIFVITRTLERFYDVKIILSPDIKSDKTYSGVLKKKDNIESVLQSLDNSIPINYKIVGDNIFISSRNK

SEQ ID NO: 7135 - protein, 76 aa, B.fragilis
VRRFKQRQYPLLEAGIGRKATQVRGCFTAKLANSFQSFHRSIQSLYLALIKLLCIDLNFYICIAQTDKLWKTVSAY

SEQ ID NO: 7136 - protein, 384 aa, B.fragilis
VIRSDLRTLSAMSTDEERIYSIALTQIPGVGHIGAKRLVDGMGSATDVFRYRTELPDRLPGVNRAVVAALDSPQALKRAEQEYEFARNNRISCFTLADEDYPSRLRECDDAPVVLFFKGKANLNALHIINMVGTRNATDYGKHICVSFLQELQMLCPDVLVVSGLAYGIDINAHRSALSVELPTVGVLAHGLDRIYPSLHRKTAIDMLRQGGLLTEFLSGTNPDKHNFISRNRIVAGISDATIVVESAAKGGSLITADIAGSYHRDCFAFPGRVTDEYSKGCNQLIQDNKAVLLESASDFVKTMGWDSDLKSVKPETVQRNLFPDLSAEELRIVDILGKLGDLQINALMVQADIPINKISAILFELEMKGVIRVLAGGVYQLLR

SEQ ID NO: 7137 - protein, 310 aa, B.fragilis
GYFFIPSFIVFLNNSLTFVVNIQTNTPVYMPSSVCGDPMMCQNCKKSVPNAIFHVYHRRGFHYPAQKCEENFILFLIKGEMLVNSREYAGTMLKAGEFMLQPISSKIEMLAMTDVECIYYQFNQPELFCDIRYNRIMKETDPPLIPSPLPIIPELQHFLESARTYLSEKKICRDLLSLKRKELAFILGYFYSDYDLASLVHPLSKYTSSFECFVYQNYKKVKTVEEFAKLGGYSQTTFRRIFDNVFHEPVYEWMLSRRKEEIIYELQNTEATISEICYKFGFESLPHFSNFCKKSFGTSPRSIRLKRSSE

SEQ ID NO: 7138 - protein, 85 aa, B.fragilis
LHRPHQGKSIFGVAYNSKEMIMNERYNKVALHGSPLVSGGDGMQPAGYSGRLSGEWCGSAAGLERSDGEVAGRSSDYFLSERRKR

SEQ ID NO: 7139 - protein, 322 aa, B.fragilis
RMALDLFKRVESRKGLFAVEKITLIYNLLTSILILFMFQRMDHPLHMLWDRAVIAAMTFLLMYLYRLAPCKFSAFVRIAIQMSLLSYWYPDTFEFNRVFPNLDHLFATAEQWMFGGQPAVWFCHAFPQMWVSEPFNMGYFAYYPMILVVTLFYFIYRFDLFEKMSFVLVTCFFIYYLIYIFVPVAGPQFYFPAIGMDSVSQGVFPSIGDYFNHNQELLPGPGYQHGFFYSLVEGSQQVGERPTAAFPSSHVGVSTILMIMAWRASKKLFACLMPFYLLLCGATVYIQAHYLIDAIAGFVSAFVLYVLVTKMFKKWFAVPMFK

SEQ ID NO: 7140 - protein, 72 aa, B.fragilis
NPFTWEKYPTDPKNEKGIRMKLCPLSGKKSGFYSVFKAVIFSPLAARVRRARGESPKEALQKCAKCDKESNP

SEQ ID NO: 7141 - protein, 341 aa, B.fragilis
IIMYRFELLYLYCTNRQIMENRICILTLFVFLFLLSGESRAMVAMPDAWTRMMIGVNQKDWSLLRERVQADLHVPDREDVLMLIDYHRDDRMKCENLLRRLNGGEAYRYIMNKILPLLYVYREHSPVPIPDDKAAGVFLSTVNVLPRVKFVHPQPVVPEEGKIETPVIIEQRTVLALKNNLLYDLALAPNIEVEIPLNRRWSVNAEYKCPWWLNSSREFCYQLLSGGVEGRCWLGNRKRRNRLAGHFIGAYAEGGIYDFQFKGDGYQGRYYAASGLTYGYAKQIARHLSFEFSLGIGYLTTEYKKYTPYEGDLVWKSSARYNFIGPTKAKVSLVWLITARR

SEQ ID NO: 7142 - protein, 165 aa, B.fragilis
RLNQMKSNKNEFLKLLTAYQGIIHKVNRIYFRSEADREDNFQETVYQLWRSFPALQNKEKPASWIYTVAINTSISKVRKDSRIEFRDSPPDGEPVDPWEQQEQDENWQRLVNALQKLNEIDKSIMLLYMEDYSYEEIAGIVGISSSAVGVKIHRLKGQLQKQFKK

SEQ ID NO: 7143 - protein, 833 aa, B.fragilis
LMNHKVLYRVALFCLFSMLSAVLMHAGEQQQQSKGIVTGRIVDQQKQPYYPVAVAIEGVYIGGYTNENGVYHINDVPTGSQTIVVSGIGVKTKKVPIHVTAGKVNRIPDIEIDTQAEELEEVQVIGKSEARRQQEQAYAISVLDIKKAYNSAAPLNKLLNNVSSVRIREEGGMGSNYNFSLNGFSGNQVKFFLDGIPMDNFGSSFNLANISANMAERVEVYKGVLPVNLGADALGGAVNIVSRRDANYLDATYSFGSFNTHKVSVNGAYTHLKTGFTVRANAFYNYSDNDYKVFVPIIDLATNKKIDERWVRRFNDAYRSGGIRLETGITNKPYADYLLAGIILSKNDKDVQTGATMDAVYGGVKMKSESVIPSIRYKKDDLFLDGLSLSLYGTYNSVNTFNVDTIARRYNWLGESVPSTSAGEGYYTDSKIKNREWLGNGNISYVIDGHQSLILNHVVSAMRRTMNDKVRPDDENNNVPQQLTKNITGLGWQIRYDRWNANVFGKMYKLYSSTYKRLDEYTENARWEKVRDHKTNFGYGAAATYYILPSLQAKFSYEHAYRLPESIEMFGDGLIQQRNPDLKPESSRNLNLGLSFIQTFGAHQLSADGNFIYRYTTDFILKGVSLTSNPTTGYENLGKVLTKGVEAAVRYNYKDLFHTGAGFTYQDITDRQRYEKTKDSFVGEGITENITYKERLPNIPYLFANADAGVRFHDLIWRNSVLTFDYNLNYIHSYYLSFPGLGAKSSKKVIPEQFSHDLALGYSMDNGKYSVVVECTNLTNQKLYDNYRLQKPGRAFNVKLRYFFSKVKKSDDYNVSNLYVSPCCLPFIGCHGM

SEQ ID NO: 7144 - protein, 342 aa, B.fragilis
LKKHTIMKKILFAAVAAMAITGCSQNEEIEKAVQPVEISFNTAVSKTTRATTLVNSAFTKFTAYAYSTTEAFANATKVNALISGAEFTKGENSAWGSGNSVFYWPATDQVSFFAFSPNTKEQLSWGAAVAETAPTLTYTVKDAVKDQEDLVVAEVMNKQKATSGSTGAVALNFKHALTKVGFKIKGEGSGVTYTLNKIVINAKKKGVYTYATSTTDETTLGTWTIPSDVTANTAYTVEPTNALSITGADSDATVDATLVGADYTAMLIPQDLTGVTFEIYYKAEAGGAILCDKTTTPEEITFADGTWTAGQSVAYVLTLKGVEKMSITGSVADSWDFTETPK

SEQ ID NO: 7145 - protein, 377 aa, B.fragilis
EMNKTFRKACAKLHLWLGLLSGIVVFIVCITGCMYAFKDEITDATQPWRFVAPLEKEFLPPSRLLAIADSVMGGASATAITYGERSDAAWVDYYQPEAGMSTVFINPYSGQVLKSVVNHNGDFDFFRLVLSGHRTLWLPREIGSPIVGYSVLIFLITLITGVILWWPRSWTRKALVQRLTLKRPFTFSRLNFDLHNVAGFYAALVLAVLCFTGLIFSLNWFSRGVYSITSGGEELKPYVLPVSDTLQVVNRVTNPLDRLYTQLRLEEPAAKTFYFALPGQADGVYRVSVVHKRGSYYRTDNLFFDRYTLVSLKGAGPYAGKYTEASPADKFRRMNLEIHDGRIWGLPGKIIMFLASLTGASLPVTGFIIWYRKRCKR

SEQ ID NO: 7146 - protein, 96 aa, B.fragilis
HSVKMIIVFAQIGLFTAKSMGTKKNRFPYGLAIFFLLSQSKKKQPNRKQKQEKQEQNGRKKEYMKVFYLSGSLLHSRATGGAYSLILLQNRDKERT

SEQ ID NO: 7147 - protein, 142 aa, B.fragilis
KNLKGLNKMEKYIYELTLKVRDYECDLQGIVNNANYQHYLEHTRHEFLSSVGVSFAKLHEEGVDPVVARINMAFKTPLKSGDEFVSKLYMKKEGIKYVFYQDIFRKSDDKVVVKSTVETVCVVNGRLSNSELFDQIFAPYLQ

SEQ ID NO: 7148 - protein, 255 aa, B.fragilis
RKTKMDKNISFTLKVWRQKGPKAKGAFETYQMKDIPGDTSFLEMLDILNEQIINDGGEPIVFDHDCREGICGMCSLYINGHPHGPATGATTCQMYMRRFKDGDTITVEPWRSAGFPVIRDLMVDRSAYDKIMQAGGYVSVNTGAPQDANAILISKDIADEAMDAAACIGCGACVAACKNGSAMLFVSAKVSQLNLLPQGKVEAARRAKAMLSKMDELGFGNCTNTRACEAECPKNISISNIARLNRDFIIAKLKD

SEQ ID NO: 7149 - protein, 211 aa, B.fragilis
TSRKMKKFVLICFCVLSSVGGYAQNWDINTLHKINSLDSKFARNYSKAFSKSAPYIAVGVPVAMAVYAGIDKDKELLKDAIYIGTSVAEAVVITYGMKYAFDRERPYDRYPDRVDARSHESSPSFPSGHTAAAFSLATSLSIRYPKWYVIAPSAFWACSVGFSRMNEGVHYPSDVAAGAVIGAGCAVANIYVNRWLNKWLFGEKKKVTISY

SEQ ID NO: 7150 - protein, 342 aa, B.fragilis
LSFDQNFMESILITGASGFIGSFIVQEALKRRFGVWAGIRASSSKKYLKERKIHFLELDFAHPNELRAQLSGHKGTYNKFDYIVHCAGVTKCADKSDFDRVNYLQTKYFVDTLRELNMIPKQFIYISTLSVFGPIREKDYSPISEEDTPAPNTAYGLSKLKAELYIQSIPGFPYVIYRPTGVYGPREADYFLMAKSIRQHTDFSVGYKRQDLTFVYVKDIVQAIFLGIEKEVSRRAYFLSDGKVYKSRAFSDLIQKELGDPFVIHIKCPLIVLKVVSLLAEFIATRSGKSSTLNSDKYKIMKQRNWQCDITPAVKELGYAPEYDLEKGVKETIAWYKNEGWL

SEQ ID NO: 7151 - protein, 164 aa, B.fragilis
FYQENIVMKTVIIENKEQVEEIISRCDICFVGITDLEGNPYVIPMNFGYQDGVIYLHSGPTGSSIDMLARNNRVCITFSVDHELVFQHPKVACSYRMRAKSVICRGRVNFIEDPEEKREALNILMRHYSSREFVYSDPAVKNVKIWEIPIDSVTAKEYAVPHTK

SEQ ID NO: 7152 - protein, 330 aa, B.fragilis
IENRKKMKIGHIDLGERPVFLAPMEDVTDPAFRLMCKKFGADMVYTEFVSSDALIRSVNKTTQKLTICDEERPVAIQIYGKDTEAMVGAARIVEEAQPDILDINFGCPVKKVAGKGAGAGMLQNIPKMLEITRAVVDAVKIPVTVKTRLGWDADHKIIVDLAEQLQDCGIAALAIHGRTRAQMYTGEADWTLIGEVKNNPRMHIPIIGNGDVTTAAGAKECFERYGVDAIMIGRGSIGRPWIFREVKHYLETGEELPRESFEWYLDVLREEVLNSVARLDERRGIIHIRRHLAATPLFKGIPNFRETRIAMLRTESVEELFRIFDGLTTE

SEQ ID NO: 7153 - protein, 652 aa, B.fragilis
IVNSIMTKIDSKIPEGQLAEKWSNYKAHQKLVNPANKRRLDIIVVGTGLAGASAAASLGEMGFRVFNFCIQDSPRRAHSIAAQGGINAAKNYQNDGDSVYRLFYDTIKGGDYRAREANVYRLAEVSNAIIDQCVAQGVPFARDYGGTLDNRSFGGAQVSRTFYARGQTGQQLLLGAYSALSRQVQKGTVKLYTRYEMLDLVVIEGRARGIIARNLVTGEIERFAAHAVVIGTGGYGNAFFLSTNAMGSNGSVAIQCYKKGAYFANPCFAQIHPTCIPVHGDKQSKLTLMSESLRNDGRIWVPKKIEDAKALQAGTKKPTEIPDEDRDFYLERRYPAFGNLVPRDVASRAAKERCDAGFGVNNTGLAVFLDFKYAIDRLGEDVVRARYGNLFDMYEEITDENPYKTPMMIFPAIHYTMGGIWVDYELMTSIPGLFAIGEANFSDHGANRLGASALMQGLADGYFVLPYTIQNYLADQIQVPRFSTDLPEFAAAEKEVKDKIQKIKAVNGKHSVDSIHKKLGHIMWDFVGMARTKESLQKALTGIEEVKKDFWTNVRIPGDVNELNVELEKALRLIDFIEVGMLMARDGLNREESCGGHFRTEYQTPEGEALRDDKNFSYVACWKYTGENSEPELIKEDLNYQFVKVQTRNYKS

SEQ ID NO: 7154 - protein, 292 aa, B.fragilis
FMARETQCNRQTDCAQCPKATEGILVHRKFPKGQHFPPDKCTQNCILFILQGELLVNSEEYPGTTLREGQFILQSIGSKLELLALTDVNYVVYWFNEPPLICEQRYHEILQQSEAPLTYTPLVMTQRITNFMKDICDYLDEQMPCGAFIDLKCQELMYLIICYYPTPQLSKFFYPISSYTESFQYFVMQNYEKVKNVEEFAHLGGYTTTTFRRLFKNMYGVPVYEWILSKKREGILEDLQHTKQRITEISNRYGFDSLSHFAHFCKASFGDSPRALRTRAARGEKITALKTE

SEQ ID NO: 7155 - protein, 300 aa, B.fragilis
QMESEKSSREKGIYKVTIVGSIVNFLLLVFKFFAGIAGHSAAMLADAVHSLSDFITDIVVIVFVRIAGKPEDKGHDYGHGKYETLATAIIGLLLLCVGFGIFWNGASSIYTFLRGGQLESPGVVALVAALVSIVSKEILYQYTVIQGKKLNSQAVIANAWHHRSDALSSIGTAIGIGGAILLGDHWRVLDPVAAVVVSFFIMKVSVRLLIPCVDELLEKSLPEDVEKEIEQTVLSFPGVSQPHHLRTRRIGNYYAIELHVRMDGKITLEEAHSTATAIENKLKEMFGKGTHVGIHVEPTK

SEQ ID NO: 7156 - protein, 74 aa, B.fragilis
PYLSRAIKCIIYYNIMDSPIFENRIQVLYLNPEVFYLHKMMDSIEYYLGVSVKSQLSATEPVIDIFSTPFNVNT

SEQ ID NO: 7157 - protein, 317 aa, B.fragilis
TDMGKIAKKLTDLVGNTPLLELSNYNASNGLKARVVAKLEYFNPAGSVKDRISLAMVEDAEAKGTLKSGATIIEPTSGNTGVGLAFVAAAKGYKLILTMPDTMSMERRNLLKALGAELVLTPGANGMKGAIAKAEELRAATPGSVILQQFENPANPAVHVRTTGQEIWRDTDGKVDIFVAGVGTGGTVSGVGAALKEHNPAVRIVAVEPVDSPVLSGGVPGPHKIQGIGAGFIPKTYHAAVVDEIRQVGNDDAIRTSRELAAKEGLLVGISSGAAVYAATELAKLPENEGKLIVVLLPDTGERYLSTILYAFEEYPL

SEQ ID NO: 7158 - protein, 425 aa, B.fragilis
FVTMYKINDFEIMAPVGSRESLAAAIQAGADSIYFGIENLNMRARSANTFTIEDLREIARTCDEHGMKSYLTVNTIIYDKDIELMRTIVDAAKEAGISAVIAADVAVMSYANKIGQEVHLSTQLNISNAEALKFYAQFADVVVLARELNLEQVAEIYRQIQEEHICGPSGELIRIEMFCHGALCMAVSGKCYLSLHEMNHSANRGACMQICRRAYTVRDKDTDVELEVDNQYIMSPKDLKTIHFMNKMIDAGVRVFKIEGRARGPEYVRTVVECYKQAIRAYLDDSFTDEKIAAWDERLKTVFNRGFWDGYYLGQRLGEWTKNYGSAATERKIYVGKGIKYFSNIGVAEFLVEAAEVSVGDKLLITGPTTGAVFATLDEARVELNPVETVKKGEHFSMKLDKIRPSDKLYKLVSTEELKKFKGLE

SEQ ID NO: 7159 - protein, 321 aa, B.fragilis
MKDITRLLCMVLLSFLVVTGCSRRDILDDYPVSGVEVRLDWSGVTEKLPEGVRIIFYPKDEKGRKIDTYLSVTGGEVKVPSGHYAVVIYNYDTETVLIRGEESYETIQAYTNFCKLGIAGTEKMVWGPDPLYVVNIDDLDIQNSEETLILKLKPKLVIRTYSFSIKVQGLSNVSNVIGSIGGMADHYFLGKAYAMCDDYPINIDLNVKAGKIEGVFTTFGLPEAIITRLEIKLPVMMNLMIIKVDNSVQEVKINITEAVQEPTGGGEGGEGEETKPPALVEVEIEDEIKVDDVETPPSGGGGIGGDVGDWDDETNVELPVG

SEQ ID NO: 7160 - protein, 718 aa, B.fragilis
NEPIMAKKKEKKAGKRMKKKELSKAVLDFFHAKQDEVISLKYIFSELKLTTHPLKMLCMDILSDLLADDYITEVDKNKYKLNNHGIEMTGTFQRKSNGKNSFIPEGGGDPIFVAERNSAHAMNNDKVRIAFYAKRRGCEAEGEVIEILQRANDTFVGTLEVEKSYAFLVTENRTLANDIFIPKDKLKGGKTGDKAVVKVTEWPDKAKNPIGQVLDILGKAGDNTTEMHAILAEFGLPYVYPQSVEKAADKIPAEISAEEIARREDFRKVTTFTIDPKDAKDFDDALSIRPLKDGLWEVGVHIADVTHYVKEGSIIDKEAEKRATSVYLVDRTIPMLPERLCNFICSLRPNEEKLAFSAIFDITEKGEVRDSRIVHTVIESDRRFTYEEAQQIIETKEGDFKDEILMLDTIAKALREKRFTAGAINFDRYEVKFEIDEKGKPISVYFKESKDANKLVEEFMLLANRTVAEKIGKAPKGKKPKVLPYRIHDLPDPEKLDNLAQFIARFGYRLRTSGTKTDVSKSINHLLDDIQGKKEENLIETVSIRAMQKARYSTHNIGHYGLAFDYYTHFTSPIRRFPDMMVHRLVTRYMDGGRSVSETKYEDLCDHSSNMEQIAANAERASIKYKQVEFMSERLGQTYDGVISGVTEWGLYVELNENKCEGMIPIRDLDDDYYEFDEKNYCLRGRRKNRIYSLGDAITVKVARANLEKKQLDFALVE

SEQ ID NO: 7161 - protein, 409 aa, B.fragilis
KSLMITMYRIYMYLLAACLLLGVTACEEEGLGNEETPFAPYVLSLGINSNGTTTYYVVTAPELMSGTINAVAKGIEQNGYRDYEQAGQTVFSIGGLGLTSATGIVRDANGYLTERGDFVFNSSLNAFTQMDGQNMIGLELPANKESGDQMTLYTVNISDVSITSQVKAPVFPLNQLEWPSITGMCYSEGNVYVTYFPMNPSTFETLYTDTTFVAVYSYPDMQFKTLMKDTRTGPAGSWNAFNGIFKVESGDMYIMSNSAIANGFSQSTKNAAFLRIPKGETHFDDYYFDFETVSGGLKPAHIKYIGNGLVFAEVSSIVRHQSADRWGDKSLKCCIIDLNNKTVRDIKEIPVHNGDGGRRFAALVDGGYVYRPVTTSEGTYIYQVDPQAATAVRGAKVSTTFVGGFFRLD

SEQ ID NO: 7162 - protein, 286 aa, B.fragilis
CAAVQPRGEDLRTLNSMRKYLSFILLLIGLTLQAQETYKTVKDISYIPAGETDGYRKERCKLDVYYPVGKKDFPTIVWFHGGGLEGGGKHVPEMFMNQGFAIVAVNYRLSPKAQNPAYTEDAAAAVAWAYKHIEEYGGSPRRVFVTGHSAGGYLTLMVGLDKSYLQEYGVDADSIAAYLPISGQTVTHFTIRKERSLPEGIPVIDQYAPCNKARKDTPPFVLITGDRNLEMADRYEENALLASVLKNIGNKKVSLYELQGFDHGQVYVPGCCLVANYIRNFIADGR

SEQ ID NO: 7163 - protein, 64 aa, B.fragilis
YPNVYNYISIYLYHLEYFIFLAIFSENGLFFISSCISVPMSPDSKAHINISEGTVILLFTKYYK

SEQ ID NO: 7164 - protein, 206 aa, B.fragilis
KVNVMETNDIKETWKAGIERTIKPYPEERLNEMVVNSARKSIKTVYPGTVFRLVIIAVAVFLIVSQFVKEQNATRMYLDMGALAVLSVSYFLWERSAYKMRKYTHGMPVKEWLEYRIKEIEKSIRFNTKYDWIVYTCSFLSAIGFYVFYLMATNVVPGILNVIVIPLGMCIYLLIIKRSLKRNYRRTLQELKELYRQFEIEDQEGR

SEQ ID NO: 7165 - protein, 239 aa, B.fragilis
VVLLTERIKASLETNSVYTISAPNFLHIRRKAGSVTSSIGARNTGRSPRSMWPIFIFLRFSIHYLAAKVRKKPLPLHLIHLFNWIEIMKKRLFSIALCLTFILSATSVSAQDAAYREALSKMLEASGAMTTVKSMVPQMIGMMKHTYSNVPDEFWKNFEEQLSEKANTQFLDIYVSIYHRYLTISDLKKITAFYESPVGKKLAESTPVMTAEAMEAGQQIGMGIAKEIMANLKEKGYVQ

SEQ ID NO: 7166 - protein, 234 aa, B.fragilis
NQSFMWLSNSSVGRKVVMSVTGIALVLFLTFHMAMNLVAIISAEGYNLVCEFLGANWYALVATLGLAALFVIHIIYAFWLTIQNRAARGSERYAVVDKPKTVEWASQNMLVLGIIVILGLGLHLFNFWAKMQLPELVHNMGGVADTTYAADGVYHIMNTFSNPVYVVLYLVWLGALWFHLTHGFWSSMQSLGWNNKIWINRWKCISNIYSTIVVVCFALVVVVFFVKSLACGAC

SEQ ID NO: 7167 - protein, 132 aa, B.fragilis
KYNLKLLGMNEQKELTKAELQIMQVLWQKENAFVNEILQELEEPRPAYNTVSTVLRVLQNKGFVAYRSFGKNYQYYPLVSKESYTNRFMNRVVDNFFSGSVKAMVSFFTKKEKMSVQEIDELIEMLKENKKE

SEQ ID NO: 7168 - protein, 291 aa, B.fragilis
NMNKKNLLIIAVSVLVLALIGLTYLLFSEKQTNRELVQEFQLDKEDLENEYTRFAQQYDELKLTVSNDSLADLLAQEQVKTQRLLEELRTVKSSNATEIRRLKKELATLRKVMIGYINQIDSLNKLTAQQKQVIAEVTQKYNAASRQINNLSEEKKNLNQKVTLAAQLDATNIWIEPRNKRGKKAKKVKDIVKLAIGFTIVKNITAETGERTLYIRITKPDNDALTKSPSNTFPYENRTLTYSIKKYIEYNGEEQTINVFWDVEEFLYAGAYRVDIFADGTMIGSQKFTLD

SEQ ID NO: 7169 - protein, 1097 aa, B.fragilis
YKMKKLFMSAVALLFAGALWAQENPLWMRHCAISPDGTTIAFTYKGDIFTVPVSGGKATQITTNPAFDTTPIWSPDSKQIAFASDRMGSMDVFIVSKDGGEPRRLTTFSGGETPVAFTDAGHILFTADIMPSTEDAGFPSNGQFQQIYQIPVSGGRPVMFSSMPMECISINKEGTILYQDKKGYEDYWRKHQKSPIARDIWMLRPGQTPRYEKQTTFIGEDREPVWAPDGKSFYYLSEENGTFNVYQRTPGSDTSKQVTHHKQHPVRFLSMASNGNLCYGFDGEIYTLAPGGKPQKVSVKILSDRNDKDLIRQIKTSGATEMAVSPDGKEVAFILRGDVYVTSVEYKTTKQVTNTPCQERGIDFAPDGRTLVYASERGGLWQLYTSTIVRKDEKQFTYATELKEERLTNSDVASFNPKYSPDGKEIAFLENRTAIRVINLKTKKVRTVMDAQYQYSYSDGDQWFEWSPDSKWILSEFIGIGGWNNKDIVLLNADGKGEMHNLTESGYSDGNAKWVLGGKAMVWFSDRAGYRSHGSWGAQYDAYIMFFDVDAYDRFRMNKEDLALLEEAEKAEKAEKEKAEKKKKENKKDDKKKDAKEKNKKDGDEEKKEEVKPLKFDLDNRFDRIVRLTVNSSFMGDAVLTPKGDKLYYLAAFESGYDLWEHDLKENSTKILLKGVGGGSLLPDKKGENIFMCTGGGMKKIEIAGSKTTPIAFESFFDYQPGGERAYIFDHVWQQVDDKFYVKDLQGVDWPLYKKSYEKFLPYINNNYDFAELLSEMLGELNASHTGARYSGAGGALATAALGVFYDDTYNGDGLKIKEIIEQGPFTLKKTDVKPGCIIEKVDGTLIKKGEDYFPLFEGKVGRKVLLSVYDPATKKRFEETVKAISYGAQRELLYKRWVERNRKKVEELSGGRLGYVHIKGMDSQSFRKMYSELLGRYRNKEAVVVDVRHNGGGWLHDDVVTLLSGKEYQRFVPRGQYIGSDPFNKWLKPSCMLVCEDNYSNAHGTPYVYKTLGIGKLVGTPVAGTMTAVWWERQIDPSLVFGIPQVGCMDMQGNYLENHTLEPDVLIYNEPAASLKGEDAQLKAAVDCLLKELPKK

SEQ ID NO: 7170 - protein, 731 aa, B.fragilis
GMIDFDYSEWAILRFIGASFVLWLCYYLLFDRKAPFNQCRNYLLFSVLLAGAVSVLRIPVYPVEVVKPVKMEQIVVAQEAQTDKVSLMQIDNNGIQPDTLATAMLTDVNEAVTHQTEEEIVEEPFYVSWNYWQIAWIVYGSGVFILLVHLLVEMVRIWRLKRWGTCTTDADGICIVRNNEVVSPFSFYRMIFINRKLEGEVLRVVLLHEKAHIRNHHYRDTLFIEGLSILCWFNPFVWLVKRELRALHEFQVDRCLLSGEIELFEYQSILFEELMGYSPKVANGFHNSLIKKRFIMMKHQYKERLAGVRKIALLPLCIGVLALFSFTENPVLVEPVLPMVSVTIKAETPKVVLPEVTVDSAGNEKDFLLLDTPKIVHYVQSRDAHIVQSGAGQPLAQVSIFVPKALDTLSAESSDGTFSQEQNINHTVDIDLRADQVVLSRAPRKNNAYVRFIERSKEDTRVTLAIPIHYDRHWLQFEKGLSIVDEDSKDVYRIRSVTRGIELNRVYWVVGQEGQMLEFTLVFPPLDRKVKTVSIRDCFPEEKGLTPPNGGAWTLDNLKVDNFQPTAVRQAEYDREGRPLRSDKLEEVTLNANQLSVSSRHNGGRTQIQKIETLPDKTLVVLSVPIHYDRNWLVINKGLCIVDCKTGDEYPVLEEAHGIEMNKLLWVEGCQGSSVLLTLVFPKLPKRVKTIDFYNKYPDAGIISPTNGSSWNWWKIKIKDYQKEPYKRVIL

SEQ ID NO: 7171 - protein, 76 aa, B.fragilis
TIFGVSSNKKSFSLPALSTVTSGNTTFGVSAFIVTDTIGNTGSTSTGFSVKENKANTPIHKGSNAILRTPAKRSLY

SEQ ID NO: 7172 - protein, 317 aa, B.fragilis
NISIMSKVTVVGAGNVGATCANVLAFNEVADEVVMLDVKEGVSEGKAMDMMQTAQLLGFDTTIVGCTNDYAQTANSDVVVITSGIPRKPGMTREELIGVNAGIVKSVAENLLKYSPNAIIVVISNPMDTMTYLALKSLGLPKNRVIGMGGALDSSRFKYFLSQALGCNANEVEGMVIGGHGDTTMIPLARLATYKGQPVSTLLSEEKLNEVVASTMVGGATLTKLLGTSAWYAPGAAGAYVVESIIHNQKKMVPCSVMLEGEYGESDLCIGVPVILGKNGIEKIVELELNADEKAKFAASAAAVHKTNAALKEVGAL

SEQ ID NO: 7173 - protein, 676 aa, B.fragilis
RLIILILCICSSLQMQGALSALKGGKSNLALHLDGKDNNVRTGMGILEPSWTLESWIKGDDCQWDSLEVIIGGGEYSELNWVDYLPLVVKEGKIHSSRANLSSPQTLDDQWHHVALTCDGKQTILYLDGKQVDKADTATAILPGAIGVHDVYYTFGGLIDEVRVWRSALPEQTIRRWMNRPVEATHPAFKSLWGYYNFDDLKDETSVNWVGKGHQAYHIRNGRNKYNEKAPLAHAVPNDNPAFKEFDGNQQLFNAVIIQSEWDADQGSKNDQALKLRIAVQGSKNPLKLTELKLDFTGTTDLADIEQIHIYSTGSEARSTQRKELFGNGHTPEQSLTLRPTHGEEILLQPGINYFLLTFDVRSKATPGHTLYASVPFFKLNGKKIIPGTSAEEVRKQVTCNNQTQSNIVKVLQWNIWHGGIHLGNEGQQRVLDLIRSSRADVIMMQEAYGIQQMLADSLGYHLKTHSLKDNLAMYSRFPLEAIAWREPFKSNPAKITLPNGKRIMFVDCWLRYAYRPEYTSGYAEKGLDPSVWVAEDSILALPDIRNIYTKDIAPNLETDMPVIVTGDFNSCSHLDWTERAKPLHHGYGPVAFPASRYMLENGFKDSFREKNPDEVAYQGGTVAAIYGQMQMSRIDFIYYKGGLKVLSSKIVRTAPEIDYVWASDHAAVLTVFEVE

SEQ ID NO: 7174 - protein, 762 aa, B.fragilis
CMTKRTCQFPKHTCLREINFLKIAGISLLLFCTTSQIAVADSYEKNAVTATQQSKTEKITGKIVDESGEAIIGASVKVQGSTIGTITNMEGEFMIPNVPNKAVLEISYIGYKPLEVAVGKSKDLRITMEEDTKTLDEVIVVGYGTTSKRKTTAAIASVNTEDIIKAPTANITQSLAGRAPGLLVTTSGGGLNNFSSVSIRGGGTPLYVIDDVISEERDFRNLNAEDIDQITILKDAASTAVYGARAANGIVMIVTKQGKAGKMSVNYNFNYNWSQPANMPNKLDAHDAAFYKNMSMTNDGLAPAYTDDELELFRNGSDPRRYPNTDWQKLCLKNSAPEMQHTLTVTGGSEKIKAYTSLGFYDQKSLYKFDVNSFKRYNFRTNIVADFKEIGLKVTSSIEAYKTDLRSPNAKSGDSYYHTWGHIQNKAPWEIAYNPNGQIFNTPDNPLMEISPDAGYTKNENLSAIANLALEWSVPYVPGLRLKALGNYRINNDKSKSWKKSPLAYDWDGNPNDPGKPSLSKSYSNWSSYTVQGFANYDRTFNQVHTISATAGIEAYKLFKDDASLSREEYLLDVDQIGAGPVSTAKNSSSEGEEARAGVVARLKYDYASKYVAEASLRYDGSDNFPRGKRWGTFYAGSLAWVISEESFWQTLKDRHIFDQFKVRASYGEIGSDAIGRYAYLQSYGLNDRGYLLNGSWYPGFSEGALVSKDITWYTTRDFNIGFDFGSLNNRLSGSVDYFRKSTKGYLTSPSAVAYTDPLGSL

SEQ ID NO: 7175 - protein, 60 aa, B.fragilis
KRALFLKDIIHLLFKDIIIILISTSRFEIKRKNQPNDTIPQYGDEINHTKNEICVKNGII

SEQ ID NO: 7176 - protein, 62 aa, B.fragilis
LYSGKLNNSILYANFILCMIYFVSVLGNCIVRLIFSFDLEARGTYQNDNYVFEEQMDDIFQE

SEQ ID NO: 7177 - protein, 227 aa, B.fragilis
QVAVKAKSIFADKTVPKTTVVSYPIYHIENIVKPVSKGPHAKQVIFLSADAFGVLPPVSILNPEQAQYYFLSGFTAKLAGTERGITEPTPTFSACFGAAFLSLHPTKYAEELVKKMEMTGAKAYLVNTGWNGSGKRISIKDTRGIIDAILDGSIDKAPTKVIPFFDFVVPTELPGVDPKILDPRDTYADPAQWNEKAKDLAGRFIKNFAKFTGNEAGKKLVAAGPKL

SEQ ID NO: 7178 - protein, 71 aa, B.fragilis
GLCSFFLVIYVSFHTFPVKIPFTSSESLHPLTKGSIKSNNNKYLYFIFFYFFIPFLISNASIVGSCPLKRL

SEQ ID NO: 7179 - protein, 375 aa, B.fragilis
EVEPVEKNHIACSNRRRVRTSRLHRPPRSRHRFVWHCRTNRSAIHRLRNNRSGCDSGCCFRSVRTSFRPRQRILRPFITSNSGSQSRHLFPVSIDRRSTRRSIRLPYGYYYSTMKTNYHTHTTRCMHAVGDDEDYVRSAIKGGFQELGFSDHGPWKYHTDFVSDIRMLPEDLPEYIESIRALKEKYRNQISIKIGLEYEYFPEYIHWLKEIIKEYRLDYILFGNHHYHTDEKFPYFGHHTTNRDMLDLYEESTIEGMESGLFAYLAHPDLFMRSYPEFDKHCISVSRHICRAAARLHIPLEYNIGYVAINEARGITTYPCPQFWHIAANEGCTAIIGLDAHNNLDLENPTYYDRACQELNALKMPVIDTIPFLKY

SEQ ID NO: 7180 - protein, 165 aa, B.fragilis
IMATAYHNLSDYDFNSVPNAEEMKFGIVVSEWNANITGALLDGAVKTLKKHGAKEENILVKTVPGSFELTFGANQMMENSDIDAIIIIGCVIKGDTPHFDYVCMGVTQGVAQLNATGDIPVIYGLITTNTMEQAEDRAGGKLGNKGDECAITAIKMIDFVWSLNK

SEQ ID NO: 7181 - protein, 395 aa, B.fragilis
RHLFLFCDLKPRKSFYFCNQTQCAHMILKRISILNYKNLEQVELNFSAKLNCFFGQNGMGKTNLLDAVYFLSFCKSAGNPIDSQNIRHEQDFFVIQGFYEAMDGTPEEIYCGMKRRSKKQFKRNKKEYSRLSDHIGFIPLVMVSPADSELIAGGSDERRRFMDVVISQYDKEYLDALIRYNKALVQRNTLLKSEQPIEEELFLVWEEMMAQAGEVVFRKREAFISEFIPIFQSFYSYISQDKEQVGLTYESHARNASLLEVLKESRVRDKIMGYSLRGIHKDELNMLLGDFPIKREGSQGQNKTYLVALKLAQFDFLKRTGSTVPLLLLDDIFDKLDASRVEQIVKLVAGDNFGQIFITDTNREHLDRILYKVGSDYKMFRVESGAINEMEEKER

SEQ ID NO: 7182 - protein, 366 aa, B.fragilis
KHFLTFAPHSNETNANLEKYLNKYYKTLKSLNKMIKVGINGFGRIGRMVFRAAVKNFGNDIQIVGINDLLDAEYLAYMLKYDSVHGRFEGEVAVEDGALIVNGNKIRLTAEMDPANLKWNEVDADVVVESTGFFLTDETARKHIQAGAKKVIMSAPSKDSTPMFVYGVNHTSYAGQDIISNASCTTNCLAPIAKVLNDKFGIVKGLMTTVHAATATQKTVDGPSKKDWRGGRGILENIIPSSTGAAKAVGKVLPVLNGKLTGMAFRVPTSDVSVVDLTVVLEKAATMAEINAAMKEASEGELKGILGYTEDAVVSTDFRGCANTSIYDSKAGISLDSNFAKVVSWYDNEWGYSNKVCEMARVIAAK

SEQ ID NO: 7183 - protein, 517 aa, B.fragilis
FCAKFITYLYMQEKIIILDFGSQTTQLIGRRVRELDTYCEIVPYNKFPKGDETVKGVILSGSPFSVYDESAFKVDLSEIRGKYPILGICYGAQFMAYTNGGKVEPAGTREYGRAHLTSFCKDNVLFKGVREGTQVWMSHGDTITAIPENFKTIASTDKVAIAAYQVEGEQVWGVQFHPEVFHSEDGTQMLRNFVVDVCGCKQDWSPASFIESTVAELKAQLGDDKVVLGLSGGVDSSVAAVLLNRAIGKNLTCIFVDHGMLRKNEFKNVMHDYECLGLNVIGVDASEKFFSELEGVTEPERKRKIIGKGFIDVFDEEAHKLKDVKWLAQGTIYPDCIESLSITGTVIKSHHNVGGLPEKMNLKLCEPLRLLFKDEVRRVGRELGMPEHLITRHPFPGPGLAVRILGDITPEKVRILQDADDIFIQGLRDWGLYDQVWQAGVILLPVQSVGVMGDERTYERAVALRAVTSTDAMTADWAHLPYEFLGKVSNDIINKVKGVNRVTYDISSKPPATIEWE

SEQ ID NO: 7184 - protein, 236 aa, B.fragilis
KNNKKNHIKMAEQKNHNNELNVEDALTQSEAFLVKNKKAIIGAVVAVIVIVAGAILYKNFYAEPREEKAQAALFKSEQYFEQSAYEQALNGDSIGSIGFLKVADQFSGTKAANLAKAYAGICYQNLGKYEEAIKALDGFSGDDQMVAPAIQGAIGNCYAQLGQLDKATSALLKAADHADNSTLSPIFLLQAGEILMKQGKNEEAVKAFTKIKDKYFQSYQAMDIDKYIEQAKLLKK

SEQ ID NO: 7185 - protein, 62 aa, B.fragilis
NLCLIAYICLFVEYFGINVVFKVYIYSLFNTKIFYYESFNLRSLPYWGYVRLVMFRPYCRFV

SEQ ID NO: 7186 - protein, 716 aa, B.fragilis
DTLNKKKTVRKSVILCGEICNFVNVTLILLNMTNIANAQNPFFEKYTTPYGTVPFDKIKNEHYEPAIREGISRQAAEIDAIVNNPEAPTFANTILAYEKSGELLDRVTTVFGNLRSAETNDDLQKIAQEMIPLLSEHSNNISLNQELFERIKVVYGQKDSIELTPEQTKLLENAYNGFIRRGANLQGEAKEKYRELTKNLSKLTLDFSENNLKETNNYQLTLTDEAQLAGLPESAIEAAAETAREKGVNGWVFTLHAPSYIPFMTYADNRDLRRELYMAYNTKCTHDNEYNNLEIVKKIANIHMEIAQLLGYDNYAEYTLKERMAETGDAVYKLLNQLLDAYTPTAHKEYEAVQELARTEQGDAFEVMPWDWSYYSNKLKDRQFNINEEMLRPYFELSKVKAGVFGLATKLYGITFHKNPDIPVYHKDVDAYEVLDKDGSFLAVLYTDFHPREGKRSGAWMTEFKGQWIEDTGENSRPHVSVVMNFTKPTESKPALLTYDEVETFLHEFGHALHGMFANSTYQSLSGTNVYWDFVELPSQIMENFGIEKEFLHTFANHYQTGEPLPDELISRLVDASNFNVAYACLRQVSFGLLDMAWYTRNTPFEGDVKAYERQAWAQAQILPTVSETCMSTQFSHIFAGGYSAGYYSYKWAEVLDADAFSLFKQKGIFNEEVANSFRNNILSKGGTEHPMILYKRFRGQEPTIDALLIRNGIKK

SEQ ID NO: 7187 - protein, 82 aa, B.fragilis
LLEKSIYGNIIYNMLEKEAYIQYFNQSDQTVKKTVELLESEKAFLKAPVSVEPQKEEKKDGKKKTTAQVDSTGEEEILRLYA

SEQ ID NO: 7188 - protein, 102 aa, B.fragilis
NGGKREMKRNDAEPIGKLIQKYLRQESLESPLNEQRLLDSWETVLGPTIMSYTRDLYIRNQVLYVHLTSAALRQELMMGRELLVRNLNQKVGATVITNIIFR

SEQ ID NO: 7189 - protein, 427 aa, B.fragilis
LHMKTPSQTHVLGLAHPPLPMVRLAFIGLGNRGVLTLQRYLQIEGVEIKALCEIREGNLVKAQKILREAGYPQPDGYTGPDGWKRMCERDDIDLVFICTDWLTHTPMAVYSMEHGKHVAIEVPAAMTVEECWKLVDTAEKTRQHCMMLENCCYDPFALTTLNMAQQGVFGEITHVEGAYIHDLRSIYFADESKGGFHNHWGKKYSIEHTGNPYPTHGLGPVCQILNIHRGDRMNYLVSLSSLQAGMTEYARKNFGADSPEARQKYLLGDMNTTLIQTVKGKSIMIQYNVVTPRPYSRLHTVCGTKGFAQKYPVPSIALEPDAGSPLEGKALEEIMERYKHPFTATFGTEAHRRNLPNEMNYVMDCRLIYCLRNGLPLDMDVYDAAEWSCITELSEQSVLNGSIPVEIPDFTRGAWKKCHISRTSDLY

SEQ ID NO: 7190 - protein, 171 aa, B.fragilis
KKMKYKYLLLLLLMLPFVSGCNDSDDVNGIFTGKVWKLTYITKKNEHKPYDFWGDKDKYEQSIKNYINKEGAYTIKFEGETTDNVISGKFSGTLLSHSYTGTWSANGESNAFSASVKGSENDPLGFSNKFVEGLNRATSYKGNYDNLFIYYKDEGGRELCLVFHVDKDNNK

SEQ ID NO: 7191 - protein, 147 aa, B.fragilis
QRMDTANSKQSDLDKRYIRMASIWSENSYCQRRKVGALIVKDKMIISDGYNGTPSGFENVCEDDNNVTKPYVLHAEANAITKIARSNNSSDGATMYVTASPCIECAKLIIQAGIKRVVYSEHYRLEDGIELLQRAGIEVVFVDTSEK

SEQ ID NO: 7192 - protein, 675 aa, B.fragilis
TMRLKLKHIYFCSLIAMGGLAITSCEDFLDRSPISQVTPEKYFSTVDQVANYLNNYYNDYLDDSRNYKLYHQQAWNSGMQRNDANTDNLLADDSSLDYFAGNWQVGSGKSIQAPLNRIRTWNYLLEQVLPKEKEGSIQGSVEDLKHYIGEAYFFRAMAYYKALVKYGDYPIVDKVLPDQEEILLEYSTRAPRNEVARQILKDLDEAINRMHDQGFQNNQRINKQVAQLYKSRVALFEATFEKYHRGTGRVPGDESWPGAKMSYNSGKTFNIDGEIDFFLTEAMNAAAAVADHCTLTENSHVLNPEYGQIYNWNPYYEMFSTPDASGYSEVLLWKQYDKSLNVSHCAPARLQNGDRTGLTRGFITTFLMKSGLPIYAAGNEYHGDVSISDEKENRDERLQLFVWGEKDVLHSDTKNPAVAAAGTTLLFGVPNIISEQKQTQDLTGYRPRKAHTYDYAQTKGDELLGTNACVVFRSAEANLNYMEACYEKTGSLDAKAQKYWKALRTRAGVDDDYAKTIAATDLSKENDLAVYSGSKMVDVTLYNIRRERRCEFIGEGMRWDDLKRWRSWDQLLTKPYIIEGINFWDAAYKDHKDIKDDGTLDANVSPKSDSKYLRPLRRTSINNELYDGLTWRKAFYLDPIGIEDMSLTATNPEDINTTQLYQNPYWPMTAGKALE

SEQ ID NO: 7193 - protein, 184 aa, B.fragilis
NLKRRKRKMERKKQLRKWIAQEKKKYSDSTLKSLSEKVLITLEACPEFQKGHTILLYHSMKDEVQTHAFIEKWSRSKRIILPVVTGDELELRVYTGPQDLAIGSYGIAEPTGAPFTDYGTIDLAVIPGVAFDRYGHRLGRGKGYYDRLLPQIPAPKVGICFPFQLIEEVPAEAFDFRMDTIIAQ

SEQ ID NO: 7194 - protein, 494 aa, B.fragilis
KDMSTKNSSRFTPVIIAISVVIGILIGTFYAKHFAGNRLGIINGSSNKLNALLRIVDDQYVDTVNMADLVEKAMPQILAELDPHSTYIPAQNLEEVTSELEGSFSGIGIQFTIQDDTIHVNSVIQGGPSEKVGLMAGDRIVMVDDSLFVGKKVTNERAMRTLKGPKGTQVKLGVKRATEKDLLNFTITRGDIPQNTIDAAYMLTDDFGYIQVSKFGRTTHVELLNAIALLNHKNCKGLIIDLRGNTGGYMEAAVRMVNEFLPEGKLIVYTEGRKYPRADEFANGTGSCQKMPVIVLIDEGSASASEIFTGAIQDNDRGMVVGRRSFGKGLVQQPIDFSDGSAIRLTIARYYTPSGRCIQRPYQNGKDRNYEMDWLTRYEHGEYFSKDSIKLDENLRYSTALGRPVYGGGGIMPDVFVPQDTTGVTSYLTEVLSKGLTIQFTFHYTDNNRDKLKKYEDEESLLNYMRRQGLVEQFIRYADSKGVKRRIILIQKSY

SEQ ID NO: 7195 - protein, 609 aa, B.fragilis
NILGLMSFLKFIFTHCLILKSFIMRALIYVVCLIGAMCGWSCSDHIADSSDLSVQTRTIVSPEGVSTSNPDLISDWEHQSLLTLSTGERINTPWTPGASHSMSEETVSDIKKEDGWTMLFHTFKALNESPNSNYLCFYNELTGVIKVFYYIKNAQGNNGFQWRISTANGVGSSLLALNSYISPLDNSSDKPNCMNLSTFAQTPINGLTPGWNGFEFEVPYTTDYRNISLSINSYNQVITDFNFSGTTELKTEGTITKNVANGGGTTKTAATLASSGAKKYMDELKKKANGQPSNIAGDVKLGKKIVDALTSGNYFSAIAKGLKFIFGSTTTRPEVSKVSLTTTGVVTMGGTSQSGSHDNVEPLFSINLYDLMNGNLAALKKSPSFNSLVLPVDVTTRSGGERYAGVWTLKESPVIRMTRYGRVLNYNISGGVFTVASVLLPYLDSNVNKKASVILNPYLSQYVTSMQTMVDVVSCAKLNGEKYFNGYAISDFMSEDPIYEDKDLAIRKSAFSGSGGEICNQSISISDYNIGDGGNQNMYFFDWGTNIKGDEVAVVTVNIAYNYKGKVHNVSISRNYKVQYVHDPATDVKILGTAGTKKVVIVNNYPQFE

SEQ ID NO: 7196 - protein, 148 aa, B.fragilis
KKMGKSTFLQDFKAFAMKGNVVDMAVGVIIGGAFGKIVSSVVADIIMPPLGLLIGGVNFTDLKWVMKAAEYGADGKETAAAVTLNYGNFLQATFDFLIIAFSIFLFIKLITKLTQKKAEAPAAPPAPPAPTKEEILLTEIRDLLKEKQ

SEQ ID NO: 7197 - protein, 138 aa, B.fragilis
KQGVPSEVGDVPVRAHVFAKEFSCVVRMLGLYIKKENLISQILFRAEDGAQTRDPQLGRLMLYQLSYFRNFCGQRWIRTTEVERQQIYSLPHLATLVFALLFAFESLCFLLSRFVSQLRCKDTTIYLNSKQNRSFLLQ

SEQ ID NO: 7198 - protein, 66 aa, B.fragilis
SHLFRFTIENLVVEIANISFITVYVLWGEKLELSFDISLETKILWPFLLPSGNACFNSMLKQVFCI

SEQ ID NO: 7199 - protein, 83 aa, B.fragilis
  UNSURE (20): Identity of amino acid sequences at the above locations are unknown.
HFRAGQILRIFPKKVTGKVXPTLRPCSSDTILRAIKELTQENISYTSDQGKTYDFNTADKLNTLVINALGFTGQLKEIWEIRC

SEQ ID NO: 7200 - protein, 696 aa, B.fragilis
KALLLLYLKSNQKPMIKKILAALLLFPTFAYAQINTDRVMMIARNALYFEDYVLSIQYFNQVINAKPYLYEPYFFRGLAKINLDDYQGAEADCDAAIDRNPFVVGAYQIRGLARIKQNKYDGAIEDYKKALHFDPENITLWHNLTLCHIQKEDYKAAEDDLGKLLAVAPKYTRAYLMRGEVALKQQDTLRALNDFNTAIEMDKYDPDAWASRAIVRLQQGKYAEAESDLNHATHLNAKNAGNYINRALARFHQNNLRGAMSDYDLALDIDPNNFIGHYNRGLLRAQVGDDNRAIEDFDFVLQIEPDNMMATFNRGLLRAQTGDYRGAIKDYTKVIDVYPNFLAGYYQRAEARRKIGDRKGAEMDEFKVMKAQLDKQNGVSNADKSVADNKNGNNKDENKTRKKSDKDMNNYRKIVIADNSEVEQKYKSDIRGRVQDRNVNIKMEPMYALTYYEKMSDVKRAVHYYKYIDDLNRAGVLPKRLYITNMESPLTEEQVKFHFALIDTHTSAIVENPKDARTRFSRALDFYLVQDFASSIEDLTQAILLDDSFFPAYFMRSLVRCKQLEYQKAEEANAASATPATLPGISAPQKSEVSALDYDIVKSDLDHVITLAPDFVYAYYNRANVLAMLKDYRAAIADYDKAIELNKEFAEAYFNRGLTHIFLGNNKNGIADLSKAGELGIVSAYNILKRFTEVPE

SEQ ID NO: 7201 - protein, 649 aa, B.fragilis
HNIMIKITFPDGSVREYNEGVNGLQIAESISSRLAQDVLACGVNGEIYDLGRPINEDASVVLYKWEDEQGKHAFWHTSAHLLAEALQELYPGIQFGIGPAIENGFYYDVDPGEAVIKEADLPAIEAKMAELVAKKEAVVRRDIAKGDALKMFGDRGETYKCELISELEDGHITTYTQGDFTDLCRGPHLMTTAPIKAIKLTSVAGAYWRGHEDRKMLTRIYGITFPKKKMLDEYLALMEEAKKRDHRKIGKEMQLFMFSDTVGKGLPMWLPKGTALRLRLQDFLRRIQTRYDYQEVITPPIGNKLLYVTSGHYAKYGKDAFQPIHTPEEGEEYFLKPMNCPHHCEIYKNFPRSYKDLPLRIAEFGTVCRYEQSGELHGLTRVRSFTQDDAHIFCRPDQVKGEFLRVMDIISIVFRSMDFDNFEAQISLRDKVNREKYIGSDENWEKAEQAIIEACEEKGLKAKIEYGEAAFYGPKLDFMVKDAIGRRWQLGTIQVDYNLPERFELEYMGSDNQKHRPVMIHRAPFGSMERFVAVLIEHTAGKFPLWLTPEQVVILPISEKFNEYAEKVKTYLKMKEIRAIVDDRNEKIGRKIRDNEMKRIPYMLIVGEKEAENGEVSVRRQGEGDKGTMKFEEFGEILNEEVQNMINKW

SEQ ID NO: 7202 - protein, 421 aa, B.fragilis
KRLIANYTFIHLIIINMRQKSLLLLLPFLLLSCGGKKNSGQLSDTAVQIVKPEFPQIVPFETGIETEQEILLSEIADSIRYIPLETNNKCLIRGLKGSNIIRTKEYFFLPWIDKLFQYTKDGKFIRTLGRKGGGPGEFNWIMQIDVDEKKGLVYMLTTTGKINIYSMETGKFIRAMKVPNIEVSEFAMLRVQDTIAATFMRNNNGKRKERIYLSNLKGDTLKIFNRWDLFDLNSKYRWMISSDIDRYMFHYKSHTCYKEYYNDTLFTITQETLEPRYIFQMGKYSLPIECRFEYLNGDGKRFQEVAAPYIQYNTIETDSYIFMPYSNWAGEKAQEKQMAIYDKKAKNCFKVSTGHIKNDLTPGLPLRPITALDSHTLLYVWEAPELLEKAEKTPSILQIEPLKGLKEDDNPVMMIVYLKQP

SEQ ID NO: 7203 - protein, 116 aa, B.fragilis
LNLVDNKKQTGSKRYLMKNDSMKSQYRINEQIRAKEVRIVGDDVEPKVYPIFQALKLAEEKELDLVEISPNAQPPVCRIIDYSKFLYQLKKRQKEQKAKQVKVNVKEIRFGPQTDD

SEQ ID NO: 7204 - protein, 74 aa, B.fragilis
YSKSKCVRFMKIAEIKEMSTNDLVERVEAEVVNYNQMVINHSISPLENPAQIKQLRRTIARMRTELRQRELNNK

SEQ ID NO: 7205 - protein, 146 aa, B.fragilis
ETMLQPKKTKFRRQQKGRAKGNAQRGNQLAFGSFGIKALETKWITGRQIEAARIAVTRYMQRQGQIWIRIFPDKPITRKPADVRMGKGKGSPEGFVAPVTPGRIIIEAEGVSYEIAKEALRLAAQKLPITTKFVVRRDYDIQNQNA

SEQ ID NO: 7206 - protein, 244 aa, B.fragilis
MGQKVNPISNRLGIIRGWDSNWYGGNDYGDSLLEDSKIRKYLNARLAKASVSRIVIERTLKLVTITVCTARPGIIIGKGGQEVDKLKEELKKVTDKDIQINIFEVKRPELDAVIVANNIARQVEGKIAYRRAIKMAIANTMRMGAEGIKIQISGRLNGAEMARSEMYKEGRTPLHTFRADIDYCHAEALTKVGLLGIKVWICRGEVFGKRELAPNFTQSKESGRGNNGGNNGGGKNFKRKKNNR

SEQ ID NO: 7207 - protein, 210 aa, B.fragilis
KIMEVNVYNIKGEDTGRKVTLNESIFGIEPNDHAIYLDVKQFMANQRQGTHKSKERSEISGSTRKIGRQKGGGGARRGDMNSPVLVGGGRVFGPKPRDYYFKLNKKVKTLARKSALSYKAQDNAIVVVEDFNFEAPKTKVFVEMTKNLKVSDKKLLVVLPEANKNVYLSARNIEGANVQTISGLNTYRVLNAGVVVLTESSLKAIDNILI

SEQ ID NO: 7208 - protein, 90 aa, B.fragilis
TMSRSLKKGPYINVKLEKKVLAMNESGKKVVVKTWSRASMISPDFVGHTVAVHNGNKFIPVYVTENMVGHKLGEFAPTRTFRGHAGNKKK

SEQ ID NO: 7209 - protein, 279 aa, B.fragilis
QYLIKMAVRKFKPTTPGQRHKIIGTFEEITASVPEKSLVYGKKSSGGRNNEGKMTMRYLGGGHRKVIRIVDFKRNKDGVPAVVKTIEYDPNRSARIALLFYADGEKRYIIAPNGLQVGATLMSGENAAPEIGNALPLQNIPVGTVIHNIELRPGQGAALVRSAGNFAQLTSREGKYCVIKLPSGEVRQILSTCKATIGSVGNSDHGLESSGKAGRSRWQGRRPRNRGVVMNPVDHPMGGGEGRASGGHPRSRKGLYAKGLKTRAPKKQSSKYIIERRKK

SEQ ID NO: 7210 - protein, 97 aa, B.fragilis
IMGIIIKPLVTEKMTAITDKLNRFGFIVRPEANKLEIKSEVEALYNVTVVDVNTVKYAGKNKSRYTKAGIINGRTNAFKKAIVTLKEGDTIDFYSNI

SEQ ID NO: 7211 - protein, 64 aa, B.fragilis
TATVWPTKSGEIIEALDQVLTTTFLPDSFIASTFFSSFTLIYGPFFNERLIVYSINQITFFFSQ

SEQ ID NO: 7212 - protein, 89 aa, B.fragilis
MISLMEARNLRKERTGVVLSNKMEKTITVAAKFKEKHPIYGKFVSKTKKYHAHDEKNECNVGDTVRIMETRPLSKTKRWRLVEIIERAK

SEQ ID NO: 7213 - protein, 143 aa, B.fragilis
NNKVINIMGARKKISAEKRKEALKTMYFAKLQNVPTSPRKMRLVADMIRGMEVNRALGVLKFSSKEAAARVEKLLRSAIANWEQKNERKAESGELFVTKIFVDGGATLKRMRPAPQGRGYRIRKRSNHVTLFVGSKSNNEDQN

SEQ ID NO: 7214 - protein, 245 aa, B.fragilis
  UNSURE (245): Identity of amino acid sequences at the above locations are unknown.
PGDPVKVTQKQNHGMAMRKTGYITILLTGFLATLLLGSCSTDDVAELPLEEGVPVRFEIKRDGIMSRAPGDAALSVNRILILPFRKTDEASSNDAANFIPEYSAARQLDVNSFPAVVTMLTLSAASTYQLLVIGYNRSDYDFTGGGGATKRFNIGSTDTPATLANLYLQPVNPTVVPEFFSCFGNGYRGATLVGPIFKPSQINYVTGTLKRLVSGFTLEVTNVPAYVNSMTCLHHGAGRIRGGSX

SEQ ID NO: 7215 - protein, 400 aa, B.fragilis
SFHPRGEDVSWLSLFDIGIGNGLKNKLTESLAVNNIEYSRKLVSTSYVYSALIFSVILVISLIINCFIKWNLLLNVEQIFNNDLTITAFLVIIAFCVRFILQIITPVLAATQNIRFNSLIEFIGQIGAFIGVILLNYLGVKSIIIFTIVVLYVPLIILFVFSIYLYSNKLKELRPCIRFSDKQHFSEIFSLGINFFIIQISAIVIFQTNSFLIANSFGPADVTKYNIVFKYYNILILLWGILMTPLWPSYTNAYILGNYKWIKKSVKYCLFMFLLTIIVAVIMAFVGPAVIEYWLGQDLNISRSLLLAMLLFALVSIWNNIFGCVVGAIGKVRLGVYSTSLSALIFFPLFYLLKSLRLAIEGAIWSMIICISLSAFLSPIQIYYFIYTKKKSLFLTKLLS

SEQ ID NO: 7216 - protein, 61 aa, B.fragilis
NNSFNHSEISILKPRYFPYGSFVSEAPLLRISQISTERLCICFAMNHYYLLKLYPVIQLFK

SEQ ID NO: 7217 - protein, 383 aa, B.fragilis
FTKFYPMKLIINASTLSGTGVTQVAVSFIEECKRFEENYYFVFLSNHVYSQVEIEKFPSNFKFYVIDKHPRYFIEGYSTRRYLRTMEAIIKPDCVFSIFGPSYWTPKAPHLMGYAYPHYVYPESPVFDIMTVKDKIRFCLYKKIHKYFLKKNGFYYVCETEDVSNRLKKYLGISSDRVYTVSNTYNHYFDQFKLPLNSFVEKDVTEFKFLSLCSFAVHKNLQILNQVIPLLNDTLKNIKIIFVLTVDSKSFKYYLSEEAKKSIVNLGIIDVSKCPQLYNECDALFLPTLLECFSANYVEAMKMRKPIVTSNLPFATNVCKNAALYFDPMNAHDIVEKISLLVRNKQLYRNLCLEGDLVLKGFKTSQERAKSYLEICKSIIRKV

SEQ ID NO: 7218 - protein, 407 aa, B.fragilis
IKITLIIMIHVDLSKRNSIFSLILVWIFLTSTAPFVFFRWPGHPYKTLSFLCLFTMVFHLNVGRGVKRVDSSIFAIVLLQICYYILISFYHSDFKNINLCIQLISLCIIISYIKIYVGFDVFVKSFIWIMLIMGVGGTLTFFLHLLGLITPIFRVEYGSDISYFLGLTTTNVFFDSEGIRVIRYAGFFDEPGTFSLFSIFALILNKVYFNDKNKELLLILVTIFTFSIAFYVTIFFYFLFFYVTKKDMKYVPLIISVVFICYLSLQNSNGGSLGTIYKLTFERLDFSEDARGNNNRAGPMENDRRIFFNNFLLGVGLGSEEVEGSNVFAVFARYGVIGSFFFYAFLIYLLLLIVNVPLENRKLFFKIYIVILLTFFYRPELSSVMVLLVFYMLIDYIKSKKYLNCKN

SEQ ID NO: 7219 - protein, 93 aa, B.fragilis
GKMTKADIVNEIAKNTGVDKVTVLTTVEAFMDAVKDSLSKDENVYLRGFGSFVVKKRAQKTARNISKNTTIIIPEHNIPAFKPAKTFTLSVKK

SEQ ID NO: 7220 - protein, 309 aa, B.fragilis
YMNALVTNPLVSIVIPVYNRELYIEDAIKSAISQTYQNIEIIIVDNCSTDLTWSILNTWASKDHRIKIYQNKTNIGPVLNWNECFKHASGEYIKILWSDDWMALDFIERAVNLIDEKSAFVISNHKIVSENGIVDNVKYKKQKYTRKEYLYNILFQNIEKFPLSPGCALFRTKDLNDNFVIDIPNTDGLDSKKNGAGNDLLIFLNIVLNYAHISILQYDGSFFRAHKESFSIQNQLELYYEWAKVYFIQKKLNKTYYSNIKKIMFWQQINKGNKIYHNLYVCLKYNYWMPLSFCIIILGGVLNSLRNRK

SEQ ID NO: 7221 - protein, 321 aa, B.fragilis
RSYLEYDNLYLIKRFSIPYSNILFYLYEEKVFILNEIIELMNNLLSIFIPTYNRCNVLDTVLDRVISSVKEYDVCVQVYDNCSLDKTENIVCAKQKLYPYIFYCKNETNIGLDRNMLNVLNKQVSKYTLMLGDDDFLVDDFYKKIESYLKQCFDFIVLSVDSTFKTTVYVEKLSAFSFLWDKMPYGTVIIRNGLINRCDVEKYIGTSHAYSAIPWESMLSSNAIGKCLFYSDYILVELGEIEKTWKSNAIDIFMYQIPLWFSILPEQYIMKNKIYRGYMRNLFSLRNIWSLYRRYNFKSLSSMRFLSNINKFKFVLISRLQ

SEQ ID NO: 7222 - protein, 316 aa, B.fragilis
LMYYLIILVLLFLAELFYFHIADKYNIIDKPNERSSHTRITLRGGGIIFYLGALAYFLTNQFEYPWFMLALTLVTVISFVDDIRSISQGLRLVFHFTAMGLMFYQWELFTLPWWTVVVALIACTGIINAYNFMDGINGITGGYSLVVLGSLAFINHWVVSFVEPGLIYTMLCAVLVFNFFNFRKRAKCFAGDVGSVSIAFIILFLIGKLIIDTEDFSWIVLLAVYGADSVLTIVHRLMLHENIGLPHRKHLYQIMANELKIPHVAVSLTYMVVQGVVVAGYLVLREYGYVYLAGSILLLSILYLLFMKRFFHLHQF

SEQ ID NO: 7223 - protein, 320 aa, B.fragilis
MNILISGICGFVGTNLIKVLKKVHTLYGLDIIDVEKQMDIKRFSWTEFEPSAFPLQTLPKFDVIIHLAGKAHDTKKQSAAQSYFDINTGLTQKIFDFFLESSAKKFIFFSSVKAAADSVVGDVLTEDVIPTPVGPYGESKIQAEEYIKKHFTFSNTDKQVYILRPCMIHGPGNKGNLNLLYNVVKKGIPWPLGDFENRRSFTSIDNLCYVIEGLLTKDVPSGIYHMGDDEALSTNELIAIMCEVMGKQPHIWKMNKRFMEGCAGLGTLLHLPLNTERLRKLTENYVVSNTKIKVALGIDKMPVTAKEGLIKTIRSFEETE

SEQ ID NO: 7224 - protein, 253 aa, B.fragilis
KVIYYFMDKSGADPLFSIITVSYNAKESIEDTINSIVNQTYSNFEYIIVDGGSTDGTLDIIRKYEDKISYWISEPDNGIYDAMNKGLAICKGEWINFMNSGDLFYNDHVLVDIYRYCDFKKFHILYGKTVVKETGRVIVPPLKIRKKYFLLDTICHQSIFFNRSIFMDLGTYSLDYKIIADRDLLLKSIINEKRFLYVDVVVSLWESLGFSGNNLKLFKNEEKLLVNRNFNTVEIYFIRINYKFRQFLNKLKL

SEQ ID NO: 7225 - protein, 239 aa, B.fragilis
RAFHRGRSFLISAFAMALLREYKEIAYQWGIWKTEESPEELLALLPDPERYEQQLTRFSSPHRKLEWLSVRVLLYQLLGEEKTIEYAPSGKPHLADSSYFISISHTRGYVAVILSPVSEVGIDIEQYGQRVHKVAHKYMRPDELISEYQGEDTWSLLLHWSAKEVMFKCMDTSEVDFREHLRIMPFQVCEHGEFPAEEYRTEHKKKFMIRYLLHPDFVMTWQVTSAYSVNECDIMKKMQ

SEQ ID NO: 7226 - protein, 404 aa, B.fragilis
TTIHQKESGKSRCSSVENGSRYIAWIFSDHFFSYLFIKLNFAIMKKLMFLVAASLFVFAACSSEDDSSPEVNPENAAITFELSAVNGLTDGIGTRMPVYSQEATQHVTRVSVYAFVQNGSTYLHQKTYDITGWTDGTTFKRFAVPDADKLPVGVYKFLAVGRDATDRFSVTTPTSGNTNYTDMLASIVNSGDESEIFAGSADAEVMAQGGTRVSIEMTRKVAGVLGYFKNVPQVLNGSTVKYLRLKVSNSNQQVNLTNGVGINTAPTPYNIIDMDLSGQAVSNGVYVGNDLSGQGVVKVPNSQLGGSFYIPVSGVSMTLGLYDASGVAIKEWTVSDTNSSGATQFNLMANHFYSLGVKGATGSVDGGTPGNPGDDDAPVDLLTDQNIVITISPAWELIHNLVIQ

SEQ ID NO: 7227 - protein, 453 aa, B.fragilis
LKTNILDPDAYLCQLAEIFNGISVNTPSLSAIIAIILAGLLLLASGFASASEIAFFSLSPSDLNDIEEGNHPSDGKISNLLADSERLLATILITNNFVNVTIIMLCNFFFMNVFVFHSPLAEFLILTVILTFLLLLFGEIMPKIYSAQKTLAFCRFSAPVIYVLRKVFAPISAVLVHSTAFLNKHFAKKNHNISVDELSHALELTDKAELTEENNILEGIIRFGGETAKEVMTSRLDVVDLDIRTPFKDVIQCIIDNAYSRIPIYSGTRDNIKGVLYIKDLLPHLNKGDNFRWQSLIRPAYFVPETKMIDDLLRDFQANKIHIAIVVDEFGGTSGIVTMEDIIEEIVGEIHDEYDDEERTYTVINDHTWVFEAKTQLTDFYKITKVDEDDFDKVDGDADTLAGLLLEIKGEFPALHEKVLYHRYEFEVLAMDSRRILKVKFTVNEPSTEEEAS

SEQ ID NO: 7228 - protein, 64 aa, B.fragilis
LHKNIKSDIDLNIGYNNAQRNKLYTKINIFKIRMIERDQYIITYLQQDNSENGTIYPLNTSSNI

SEQ ID NO: 7229 - protein, 370 aa, B.fragilis
LNENDYFCARIKLTKSRIRPKSMNRNFSNAIENWYKEYKRELPWRDSADPYVIWISEIILQQTRVVQGYDYFVRFMKRFPDVATLAEADEDEVMKYWQGLGYYSRARNLHAAAKSMNGVFPKTYPEVRALKGVGEYTAAAICSFAYNMPYAVVDGNVYRVLSRYLGIDTPIDSTEGKKLFAAVADELLDRKNPALYNQAIMDFGAIQCSPQTPNCMFCPLADSCAALAKGTVAELPVKQHKIKTTNRYFNYIYVRMGVHTFINKRTGNDIWRNLFELPLIETPVAVSEEEFLALPELKALFAPKELPVVRSVCRDVKHVLSHRVIYANFYIVDLPEDSHSFAAYQKIKAEELEQYAVSKLVHAFIEKYID

SEQ ID NO: 7230 - protein, 156 aa, B.fragilis
NSENMSVNKVILIGNVGKDPEVRYLDTGIAVASFPLATTDRAYTLSNGTQVPERTEWHNLVLWRGLAETAEKYVHKGDKLYVEGKIRTRSYDDQNGAKRYVTEIFVDNMEMLTPKGTGSGSYAPAQQQTAAPVRPQSQQPQQPVSSQDNSADDLPF

SEQ ID NO: 7231 - protein, 105 aa, B.fragilis
SINLTQNAIITRKAVIVRSLLNICSTFKSRFHLIKQLIIKDITNITEKISAEYTYDVLTNFLEYSILFTAKDSVNLFFNPFPIPISNKLNHETSSPRGWKDQRWS

SEQ ID NO: 7232 - protein, 77 aa, B.fragilis
LIADFIASSMYSSLLYTGITIDTKGLVTSAFIYYCNLLINTNLNLLIFDKNRILLKLLKLYRLYKDQIFLKEKRFLI

SEQ ID NO: 7233 - protein, 781 aa, B.fragilis
YYEENAMIKRILLLAIVIGGGMTTVAQNSIDTLFMSVSQRLSGHPSELIYLQTGKDIYETGEDLWFKAYQLDAKSFALSEQSETLYLQMLNDKDSVVWAEKYPIEKGIAEGHVYIDTKLSEGNYRLGTYTRHSYYNDTTGISPERKIRIVRNIALDSLPEHREKPGEFRFNLFPEGGNLVSGLPFRLAFKATGSGGCPVDVEGTLYQDEIPVLSFKSSHDGMGVIPFTPSSGKEYRIELANGYSYALPEIYRQGMGLRLSGRDGKQLEFLISQTEGLSDQEVYLVGQIRGTVCCVAKGLLKDRLKMKIPLSEFPYQGIAEFTLFNAAMQPVAERLVYVHPEKKLHIDIVTEKESYVLREKAALKVKVTDDNGQPVKADLGISVFDKAYSNPDDRVNMLAYCYLSSQIRGAVCRPAYYFDEKNADRMQAMDLLLLTQGWRRYVWELNGAVRHGEMFLRDDVTGIQTLGSKKKSKGTGGAKQLIQVSGAEGNSTYLMTDSLGRFTVDTDLMKTLRGGYVYLKPMLSKEFKPELEIQDYFPAIDSIRRKKSFDCSLINCTQRPKEEIYDAPVVSGDSTILLDEVVIARKARKPFRDKLMGRLDSLAQMNLNSVYVCTSCGLLLNYNPDYQGHHALVGEGGCPAKGRKQPVDGETYRIAKYKYYGDAKGGGVYFSVVDAHSVVYHAAEFTEEELLRMNNMWRVKGYYGKREFYQPDEIDMQLPVPDARNTLLWAPSVVTDEKGEATVSFYCSDINTGFIGVAEGVDGTGLLGTDQCEFRVIRRAD

SEQ ID NO: 7234 - protein, 262 aa, B.fragilis
NHIFSFIAMNPILSFIIIEYHSFDDIVECIATIRSSTSLSYEVIVSSNSCYLLEVQERILKKMEHVKWVFNSKNGGFAYAMNRGIEKAVGDFLVIMNPDVRIKYGIEYMFDFLYFNEQVGIVSPKIVNSLGEVQDSFRKFLTPSNFILRQLRRIFYRRNEVITMTKLENVDWVIGAFMMISKKAYEAVCGMDEKYFLYCEDMDLCKKIHDKGYKVIYYPDAVVVYEGTRSARKSLKYACIFLSSLLHYWSKFGFKRLTSVFG

SEQ ID NO: 7235 - protein, 110 aa, B.fragilis
NKTRFKSKKIMTENYELIDNEEKHQYEFHVEGYVPRIEYIKSLNGEIYLTHTEVPAALGGHGIGSQLAEKVLTDIERQGLRLVPLCPFVAGYIHKHPEWKRIVLRGIHIQ

SEQ ID NO: 7236 - protein, 318 aa, B.fragilis
IKTMNILHDTCRLVFVYLGRLPEYVIYSLKINSKYNRITLLHDCEIQNHVANVEYINIDDFYDRRQFVNLIAESPLKNFRDGFWYKTTERFYVLRSYMDHYNVHAIFHAELDNIVYNLEGVSISLDKIGNGLFYPILNNKKAAASFMYINSFSELDALIGYFNEQKTFKDDMQLLAEYASASVNVFPLPSENSLCKMPVSNEVQCIYDAASIGQYLLGIDFRNASRPIFNGFQNENCIIDLSQLKFIQDGDKGILMFYDQAIYLLKNIHVHSKVFKRMYLSESYVPRIMKKINGGKKSLMSLNFKNMIKLFLDKSKLL

SEQ ID NO: 7237 - protein, 61 aa, B.fragilis
NVIIFKNNIVFSNISRTKTISYKKTISLEYYNSRYLYNKKINTKRKDFRKMLFIRKSNTRS

SEQ ID NO: 7238 - protein, 254 aa, B.fragilis
ELIIMLYSKVSIITASYNSEATLEATIESVYNQTYQDIEYIIIDGGSSDKTVSIIQKFEPLFSGRLKWISEPDKGIYDAWNKGLEIATGEWIAFLGSDDIYLPDSIHKYMNVLISKKCVNFISSKCKLVNSELKTLMIYGKPWGKLMNSYCCIAHVGCMHKRCLFDNYGSFNSDYKIAGDYDFLLRVKDVIIPYYLPEITAIVQDGGISNRNILKVCGETLKIKVSHKTKNLYFSLWDYCVAVFKYYVRSFMIK

SEQ ID NO: 7239 - protein, 526 aa, B.fragilis
ISKIMKRPYLLLACLSPVACLMAASGQKGGKNKQKVNDRQLPNVVFIYADDLGYGDLECYGAKNVQTPNVNRLASEGIRFTNAHATAATSTPSRYSMLTGEYAWRRPGTDVAAGNAGMIIRPEDYTMADMFKNSGYVTAALGKWHLGLGDKSGEQDWNAPLPAALGDLGFDYSYIMAATADRVPCVFIENGKVANYDPSAPIEVSYRKPFEGEPLGKDHPELLYNQKHSHGHDMAIVNGIGRIGYMKGGGKALWKDENIADSITTHAINFIREHKDEPFFMYFATNDVHVPRFPHERFRGKNPMGVRGDAIVQFDWSVGQILETLDKLGLSENTLIILSSDNGPVVDDGYQDRAEELLNGHSPAGPLRGNKYSAFEGGTRIPAIVRWPKKITQPQVSDVLVSQIDWLASLASLVDARVPKGAAPDSFDRLGNWLGTDSTDRPWVIEQASNHTLSVRTKDWKYIEPNDGPHMITWGPKIETGNLSIPQLYDMTKDYEQENLAEKNPAKLFELQTILRKVRNKTYRAL

SEQ ID NO: 7240 - protein, 299 aa, B.fragilis
IKKMEIDLVFVTKIDHLYVLNLALKKMVMLNDIRSVFIITNKKYFKYFPVRKDIKINLIDEDSVLPDMTLNQLSKLSLPFFPKRSGWYFQQFLKLGISKLDDLSENYLVLDADTIFLQRIPLFDNGRFVFTKAQEYHKPYFENYINLLKESPSREFSFISQYMLFNKNIVTEMLNKIESNFNFENHWNWIIINNLLGDDASLFSEYETYGNYIKNHYPEKVCFLDLKWLREGSKVLGSLFPKIEDIEKLHGYYFVSFELNTVGASFFTKVKKHLFCFLYPRFSFLKRIIYKVLPYEINN

SEQ ID NO: 7241 - protein, 291 aa, B.fragilis
TLEIMNRRVIQIFCMVVGMVLASSCGDECPVEQPYSVRVSVKDKNYLNISQFPQLSPVDENLPFRTYAGTLYYALYDASTGALIRESAVVSTEGEEKEYTLTFPGVPDGDYKLAVWGNLTTDYPAGILHQDGKEHTDIYVTSGDLHFSPDYQTEELTLERTKGKLLLLCSNFPSEITRIEQNVSHVYQSTDAALNYSGSTQVDKNVPFTSVLETLLAPTSAEGHSKLTLTFYTGGTRASETPYLKLPVMEMDMRRNEITAVSIDYNTSEGIWEIKMFIRGEWITIHRLDIF

SEQ ID NO: 7242 - protein, 123 aa, B.fragilis
VHNLQRKFSLTLNGRDCAWFLSVRSLRDIYISIRNGSVLYFVVFTFNNIKTVMGKQIEYSNGELTIVWQPELCRHAGICVKTLPNVYHPKERPWIKMENATTEELIAQIKMCPSGALSYKLKK

SEQ ID NO: 7243 - protein, 68 aa, B.fragilis
RFYVFYPGNITFNMKFILMFFFIIYQFIIFSHNLLTFKSCFILQHLEDKLCFLLLFIYESFKQLDDGI

SEQ ID NO: 7244 - protein, 527 aa, B.fragilis
EIEVTSELVVDVQPKEVSIALLEDKSLVELQSEGRNISFSVGNMYLGRVKKLMPGLNACFVDVGYEKDAFLHYLDLGPQFNSLEKYVKQTLSDKKKLNPISKATLLPDLDKDGTVANTLKVGQEVVVQIVKEPISTKGPRLTSEISFAGRYLVLIPFNDKVSVSQKIKSSEERARLKQLLMSIKPKNFGVIVRTVAEGKRVAELDGELKVLLKHWEESITKVQKATKFPTLIYEETSRAVALLRDLFNPSFENIYVNNEAVFNEIRDYVTLIAPERAGIVKLYKGQLPIYDNFGITKQIKSSFGKTVSYKSGAYLIIEHTEALHVVDVNSGNRTKNANGQEGNALEVNLGAADELARQLRLRDMGGIIVVDFIDMNEAENRQKLYERMCANMQKDRARHNILPLSKFGLMQITRQRVRPAMDVNTTETCPTCFGKGTIKSSILFTDTLESKIDYLVNKLKIKKFSLHIHPYVAAYLNQGLMSLKRKWQMKYGFGIKIIPSQKLAFLEYVFYDSHGEEIDMKEEFEIK

SEQ ID NO: 7245 - protein, 207 aa, B.fragilis
INNSESMRYLLMNYGVLGVIRLALDFIGTKIAFRKSRLIRFPIDIRGRSFIDFGSNLTTGRYCRLEVYPIEHKKGILKIGDNVEINDFVHIAARLSVQIGNNVLIASKVFISDIQHGCYNSNKMFNDCYPDIPPKERSLFAESVFVGDNVWIGESVSILAGVKIGDFSIIGANSVVCKSIPSYSIAVGNPATVIKKFNKTTNKWEKV

SEQ ID NO: 7246 - protein, 335 aa, B.fragilis
IRLSDYLHNLYLKKICKLKTRNKMNETLTVFMISEIERLREEGREPARRIYHNMLRTLRESAGKEEIGFEEVTPVFLGKYEHWLLGKRLSWNTVSTYMRALRAGYNRGMKGRPGYVTGLFDKVYTGTRSDVKRAVDARTVGRMIRMSGCPDESASAKAVDWFVLMFMLRGIPFVDLAHLRRSNLDKGVLTYCRHKTGQEVSISVPREAMEIINRRMVENCHPSYLLPILGQPRTRKRHTKKALTPYQEYQYALRNLNRRLERVSVDLRLGGRLSSYTARHTWATIAFHQETPVGVISRGLGHSSVKVTETYLKPFGDREVDRTNRKILNYVLNAV

SEQ ID NO: 7247 - protein, 529 aa, B.fragilis
LQCPMDTPINAPLRKLPIGIQSFEKLRSENFLYVDKTALIYRLAQAGNPCFLSRPRRFGKSLLLSSFEAYFQGKKELFRGLAIEKLEKEWLQYPVLHLSLNAEKYDSREGLIDILERQLRQWEELYRTGREGITHSGRFMTVIRRACEQTGRRVVVLIDEYDKPLLRSFDSQELQHDFRETLTAFYTVLKDADPWLQFVFITGVTKFAQMGIFSNLNQLNDISFDLDYNTLCGMTRAEIEATFSPELEALAVKSNATCRQVMDRLTRQYDGYRFTKDEEFTSMYNPFSVLSALQKRSYGNYWFASGTPTFLVEMLQKTDFDLREMEGIEVNEASLSDDRADINNPIPMIYQSGYLTIKDYDERFRMYTLGFPNEEVKYGFLNFVSPFYTPIAQTDTSFYIGKFIRELESGDVDAFLTRLRCFFAGIPYDLNDRTERHYQTVFYLVFQLMGQFTETEVRSARGRADAVVKTPDYIYVFEFKLNDSAEAALRQIDEKGYLLPYQADGRKVVKVGVAFEKEERNIGEWMIGG

SEQ ID NO: 7248 - protein, 68 aa, B.fragilis
TRSAAPGILRNLPRILKSMYVAVWAPARHRHRSGTWPFTDNRYLDPGGIFGSTTRKIQKKMLSLYLRV

SEQ ID NO: 7249 - protein, 104 aa, B.fragilis
RLHEQEETVKKDIRVLRYLIAKEEEAASPQAPRKRKIPQKQINDFFTRIALFYEDLQRRLNLRITYRCFCRWLCTRYEFESRYHDRHKLSPCTILGYFKRERGG

SEQ ID NO: 7250 - protein, 305 aa, B.fragilis
HCARVGSFQPRGEDIRFDWAVKRLLRNKANFGVLEGFLTVLLGEPIRIVEILESEGNQLNETDKFNRVDIKARNSKDEIIIVEVQNTREIYYLERILFGVAKAITEHIELGQLYSEVKKVYSISILYFDIGRGTDYLYHGQNSFVGVHTGDFLEVSTKEKDAIVRKLPAEIFPEYFLIRVNEFNKVAVTPLEEWIEYLKTGVIHPDTKAPGLEEARRKLVYYNMNKAEQLAYDEHINAIMIQNDVLSTAAMEGRQESLAEGRQGGLAESRMGEKQANAPEIEALTLPVETICQVTGLSAGEIENL

SEQ ID NO: 7251 - protein, 74 aa, B.fragilis
IRVVSLVVQHVKYRRKCYLCIYEYKKNKEECQLLHPLHFVTKCENLKNNCVHLQKTNFNAPWIHRSMPRLENSR

SEQ ID NO: 7252 - protein, 509 aa, B.fragilis
MLNFNWVKMKKTIFLSTIILLLTACQDYLETNPDSTFDVQIDSEDKIAELLAGAYPEASYFAFLEARTDNVGERTNGIHSRLNEAMYYWEDYDQEDLDTPLNYWNACYAGIAQANQALELLSKYPKSDRVKALYGEAFLLRAYLHFMLVNIWAEPYGTTKSATAPGIPYLTRPEKNALVDYERGTVKEVYEKIEKDLKLGLSLVNDDYYVKPKFHFNKKAAYAFASRFYLIKGEWDLVVSYSDYVLGVDPKPVLRNWQKYKKEFNSNHKYLYIRYASVDEPANLLLTTTESRVARNIPSEKYGVTIQSAEKVYNEHGIDGCFNFRKMKMQSFFLFNYNDGRIDDGQYIAKFDELSLSGYTGIRPRGLYVTNVLFSTDEVMLNRMEAYTMLGEYDKAIDNLLVYLSVKYGVYPSCGRSTYTQTSSENYQIYTPFYGMSINQLALVKILLGFRRQEFLHEGLRWFDIRRFYISVKRTSKYKFYRPLEKEDSRKLLQIPAEAINRGLVPNPR

SEQ ID NO: 7253 - protein, 362 aa, B.fragilis
IFDFTLRKNMKKMNYLLKCLFLSCLLISVVACTDGINETVISAYQLPVLPEPSYKFSRNGESSVNVLECGFLKSPIDRIFSEYMNEARMSTKRDYDEALRIYHEGNFGLKPQKEVSASSKHLKDRDKILKDIDAWFETSARIAGLGANIPSYEHRNREAVKGLTGYVGNGIGDKDICYVDERGIAVAEVYKYAIMGAIYLDKILNIHLSEQILENNEVLVRNDLTQLLPGHNYTELEHHWDLAYGYYDFWKTLAQSDGLPALKDCHLRISRSFVKGRALMTTSQYDEMRLQADTIRQELSRVVAIRAMHLLVGPNTLANLKENPRRAFRLLSQAYGLIYAAQFARNMEGKSLSSPRGWKDRQ

SEQ ID NO: 7254 - protein, 67 aa, B.fragilis
ERNNEQIQTSSKKVSEIHFSNNCFHMLDFILESSSIILYRGLGTSPRLMASAGICKSFLESSFSNGL

SEQ ID NO: 7255 - protein, 344 aa, B.fragilis
FKNKIKHMKTIIRKVNFRYFFRRSLYLLVISFLLAGCEEEASLSARSVVEAGETEREKTELDKWILDTFTRPYGIEVEYRWDKNAVQNGSYIYPPEVANVKSVLNTIKTLWIDLYTAPELGGDKFLLGKNPLKIYMYGGRNVDGNGMELLDNLEATTNEMFLYNVNEFNPQDEDKVFILMRSVHHQFARHLMELFPYDRSKFLSISRNKYIESTKSIAWIFKGETQGRRGFILAGYPNKKGFFTFHSLLSPEKDFAEIISLKLTYGPKDLLQALDRAKTPYNAGSDKDLQKEYDEQALQAYKELVEKQAFVEDYFSKEIKISLNYLQLISMKQVKEFINKNKKE

SEQ ID NO: 7256 - protein, 345 aa, B.fragilis
ERMKLGFQILILMVFCFSCKDEKVFDSSPSERNANHIGELRKELVNAPYGWAVTYFPRTDSLLFTNVNELITLPKGIFEDKNKYGYGGHYFLMKFSENGIVETVADYNEESLTKKLQSEFEVSQNTFTQLSFTTYTYLHSLVNDRFTGSSDFLYTGKDVDGNLIFKTSSYIEPAREYIIFTKLKNDESWQEDIQKSYDNKLFFEKMKNPQLIIRRAGRVYFHSDVQMNVTYGGDGSVNGKQPPEVYQRYRLFLARDYFASQGWLGNKVKGLGSGYVGTAAGLTFKPGIRYSETYIFYDFRREGERFVCELVKVVDPYSKKIHWVSKHLAPYGEESGVIAEIRDEI

SEQ ID NO: 7257 - protein, 227 aa, B.fragilis
LKSGMKFKLENNRINMKHVWIISCLLFVCSCNTVREDFVVNEDYEKLFPSKEIEKPENKRGELLVQLCDPDQALENYKYPGTETPNGADQYKITLMCSFQEKRWDGNLTKDVSAQYKVKYINEKKELVTISCGKRNIGNAGEDADGLRPNVMFNGEKLEISFNVHSGFPLYLSVSGEGPRSSNIRASITAVSTDGLVEIPSLQTEQYQNEEGINPLRYPYCEYLILP

SEQ ID NO: 7258 - protein, 646 aa, B.fragilis
  UNSURE (4): Identity of amino acid sequences at the above locations are unknown.
LGFXNILNEYENNYLKTEVLDLKLQGELSYRLNDHIEVKGLAMVRHAVTKSSHFIAEASNVVQAFRANETPYVARENIYLLKNKDDPMQLPGVALTHGGIFNKTETSLRSYLGRLALDYNRQLSEHNIRAFGFTEIRYADRSMNPFQGYGIQYDRGNQVFSNPLIFEKLANEGDTYFSLTERYERGVTLSGSATYGYAGKYIFNGVFNYEGANTAGKYSRSRWLPTWNIGAKWNLDQEKFMRKHTTISRLALRTSYGLTAKMNEQAVNSTTVFKHVMVNRTLLKDRENALRILHLENRDLTWEKMYELNFGLELGLFGNRISATFDVYQRNSFDLIDLIRTSGVGGQYYKYANFGDMRTRGVELAIQTQNILTDKFSWSTTVTISGMKQKITRLLNTPNTFDMVAGTGRGNIVGFPRGSLFSFNFQGLNSNGLPTFDFGLYPSNKGANSEISGADFLDAQYSKSYLIYHGPIEPQYIGGISNTFKYKNWEFSCFVTMQAGNKIRMNPSFDPAFADLNVFSKEYYNRWLNPGDERKTNIPVIPSQDLIHNIGKENIEKAYNTYNYSQNRVADGSFVRMKNISLGYRLPQRFLSHLKIKQMNVKVNVTNPFLIYSDRKLNGQDPEFYRSGGVSLPTPKQYTMTLNVEF

SEQ ID NO: 7259 - protein, 246 aa, B.fragilis
PLWVIDGAVYEDLVSLTLDQLASGDAVTLISSAVAGLNASDIEDIQVLKDASATSIYGARALNGVIVITTRSGKRNAPNRFSYSYELSMRSIPSYTNFDLLNSQESMSVYQEMGRKGYFSLQNTLYGRRSGVYYQMYKALNTIDPATGQYYLENTDDVKRAFMREREYANTNWFKELFTHRPIHTHTVTFSGGGENSAMYASIGFYDDRGWTLADNVKRITANIKNSFYWNEDKIKATISAQGKST

SEQ ID NO: 7260 - protein, 170 aa, B.fragilis
ESLSLCHIDCVSLHAKTKKDNMCGIVGYIGKREAYPILIKGLKRLKYRGYDSAGVAIINDNQLLNVYRPQGETFVFASDGIIETPTVILQEFPSQSYIFRNSTYTEVPVYSFSSFRPMHQFCKITASRAVRPETLKCSDSLIIREAFSDTLLQGGKDEATGIREESVTME

SEQ ID NO: 7261 - protein, 112 aa, B.fragilis
KHKSFKTITIMCGIAGIFNIKIQSRELRNKALRMARKIRHRGPDWSGMYCGGSAILATRAPFHSRSAKRRTASFIHPTGSKYWRLTAKSITTVTSAPNMPAATSSGPGVTVR

SEQ ID NO: 7262 - protein, 189 aa, B.fragilis
DMKSMNYSLIRTICALVIGLVLVLWPDAAINYIVITIGVLFLIPGFIVLIGYFGTKPEPGVSRRFPIEGVGSLLFGLWLVTMPGFFADVLMFLLGFILIMGGVQQIASLSMARRWTPVPGGFYVIPVLILIAGIVALFNPTGARNTAFMIIGVSSLVYAVSELINWFKFARRRPKTPLKGEIEDAEIIE

SEQ ID NO: 7263 - protein, 220 aa, B.fragilis
DSVSLCGEPNFKPKMMNDKLIKVCGMREAENIREVEQLKVDMIGFIFYPKSPRCLYELPAYMPVKAKRVGVFVNEDKKEIEIFADRFSLDYIQLHGNESPEYCHSLRATGLRLIKAFSIARRKDFENIGTYEESCDYFLFDTKCEQHGGSGNQFDWSMLNSYKGKKPFLLSGGINPYSPPTLKELRHPQLAGFDLNSRFETKPGLKDVERLRHFLEELRK

SEQ ID NO: 7264 - protein, 774 aa, B.fragilis
FYYPKMKMKKYIFFLVSLCCALLPAMADQPEHPELKASDANIIGHVLDKKTGEHLSYITIALKGTTIGTVTDATGHYFLKNLPEGNFVLEASSVGYKTISRNVSLRKGKTLEENFELEEDAVALDGVVVSANRSVTKRRLAPTLVNVVDMKMFENTNSPTLSQGLNFQPGVRVETNCQNCGFQQVRINGLDGPYTQILIDSRPIFSALSGVYGLEQIPANMIERVEVMRGGGSALFGSSAIAGTINIITKEPLRNSGQLAHTLTSIGGSSSFDNNTSLNASLVTDDHRAGLYVFGQNRHRDAYDHDGDGYSEMPKLKNQTVGFRSFLKTSTYSKLTFEYHHLQEFRRGGNLLNRPPHEADIAEQIQHSINGGGLKFDYFAPNEKHRLTVYTSAQHTDRDSYYGSKKDQNAYGKTTDLTFIGGSQYVYSFGKCLFMPADLTAGLEYNRDNLKDDMWGYNRYTKQTVNIGSAFLQNEWKNEKWSILLGGRLDKHNLINHVIFSPRANLRFNPSEDINLRLSYSSGFRAPQAFDEDLHIENVGGTVSMIERAKNLKEEKSQSFSASADMYHRFGAFQVNFLVEGFYTRLSDVFVLENIGERDGILIKERRNGSGAKVLGLSMEGKMAYLSLFQLQAGVTLQQSRYDEPEKWSETAPAEKKIFRTPNTYGYFTATYTPIKPLSLSLSGTYTGSMLVQHMAGYIDKDVAVNTRDFFDMGVKVAYDFKLYKSVDLQLSAGVQNVFNAYQNDFDQGVERDSGYIYGPAAPRSYFAGIKISY

SEQ ID NO: 7265 - protein, 214 aa, B.fragilis
PTLPIMALKEKIKQNPALKQAVHRFIMHPVKTRPNWWIRIFSFLYLKRGKGSVIYRSVRQDLPPFNLFSLGKYSVVEDFSCLNNAVGDLIIGEYTRIGLGNTIIGPATIGNHVNLAQNVTVTGLNHNYQDTGKRIDEQGVSTQPITIEDDVWVGANSVILPGVTLGKHCVVAAGSVVSRSIPPYSVCAGSPAKVVKQFNPESRTWEKTVSKNGK

SEQ ID NO: 7266 - protein, 210 aa, B.fragilis
QSPPPLPIYSDSYPAISIINGDFLFLPDRLSLPYHLKTRSEMNKIGVFYGSTTGTTEDVAHRIAEKLNVPNGDIHDASKLNDELVKEYDVLVLGTSTWGAGELQDDWYDGIKVLKKADLSHKFVALFGCGDSDSYSDTFCDGIGILYEELKDTHCTFCGATDPSGYTFDSSVAVINGKFVGLPLDEVNEDGKTDERIAQWTEALKKECIN

SEQ ID NO: 7267 - protein, 486 aa, B.fragilis
NSVLLYGESKIKLKRNEIMNAFNYTTHSKQVLGDLHTPVSIYLKVRDMYPQSALMESSDYHAGENSLSFIALCPLASIGINSGIVTTTYPDNTRREEPLSQSFRVENALNRFINRFHVEGDDKKFCGLYGYTTFNAVKYFEHIPVKESHDEQNDAPDLLYILYKYIIVFNHFKNELTLVEMLAEGEESNLSQLESAIENRNYASYNFSVTGPVTSTITDEEHKANVRKGIAHCLRGDVFQIVLSRRFIQPYAGDDFKVYRALRSINPSPYLFYFDFGGYRIFGSSPETHCKVESGQAYIDPIAGTTRRTGDTIKDKELTEALLADPKENAEHVMLVDLARNDLSRNCHDVRVVFYKEPQYYSHVIHLVSRVSGALNNGANPLKTFIDTFPAGTLSGAPKVRAMQLISEIEPHNRGAYGGCIGFIGLNGELNQAITIRTFVSRNNELWFQAGGGIVARSQDEYELQEVNNKLGALKKAIDLAVKLKN

SEQ ID NO: 7268 - protein, 69 aa, B.fragilis
NYPPHIRKAIKAFLYYLKIPKNTIFFLPKKLSITYSSFTFKNLYLIENHLKLFNTLNLYLIPNILFYLK

SEQ ID NO: 7269 - protein, 340 aa, B.fragilis
ERSTIVTINIKNVERMENVVPPFKVDVAGTFLLPAALREAREQYRNEQISLLTLRAVEDAEIRNLVDRLKAEGLKVVTDGRFRSDAWPLDFMCGLDGIRFRDDRKTSVELTGRIDVHHHPVLDDFVFLTGVTGGDVIAKQVLPAPSRLLAELMKDANRTELDSVYPDREILLVDLAQTYQKLIMELYRSGCRYLQLDDATRTVTDNAIRVNNMALENLPADLFIAFHSPTEMLFSLQGIHAFFLDYDSECCGKNRLLWFIREKQSVFGFVLSHYPVEEELEELRAKIDQIIRYIPSHRFSLCIPNAEVLPSESYEAAEEKQWHTLKMAEMVAGELWPEEG

SEQ ID NO: 7270 - protein, 449 aa, B.fragilis
SKGTPLRLIHSDTVEHGGEFVAVLGIVDALGGCSENVDVLGIETQGEIVRYLSAGGNNDSVRILQFKDIHHAFECQFVKVKPVTHIIVGRYGFGIIVDHHRTPSFLTDRIKRLHPAPVELHGRTDPVGTRTENDDRTMVTQVSDVVGCAAIGQVKIIGLCRIFGSQRIDLLHHGNNAQALTVIADIKAAVFHIAFVADGTCNLEIGESLTLGLLEQVGRQVGYLLVIVPPLMEFLRSIHDIHQFLEEPLVDLSQFVHLIDGISGTESLRDDKDTFIGRFVQCFVDVGDNEFLVFHKTMHPLSDHSQALLNRFLKSAANGHYLTDGLHRRAEFLVHTVELTEVPTRNFADYIIECRLKEGTGGFRHRVLQVEQPVAKSEFCSHKGKRITGSLGSQGRRTAQAGIHLDHAIVFTFGVESILHVTFSHNADVADDADGELAQFMILLIGQGL

SEQ ID NO: 7271 - protein, 813 aa, B.fragilis
AKQTGMKTSINKLCIAASILVTAAGISACVDDNKTLYDPEYKTPNPMEEISAPTGFDWSSTHAIKFNVEVNDEFDGQYYYTVEIVDKNPLEATTEEPYNTLAKGVARKGETYQTEVVSSKDTKYLYVRQTDPRGRDRIKQVEIDESTSHIQCSFTGTSAIKTRAFATTKGNNGGIDIPKRTEQNYDISRAIPVTSPSQVLQGGQTYIVTGNFSGKFTDISLSNSNKATVYIQGTWELAQVTQDFLDIIVLKDGKINGKYLMLQNTSTLTIQSGAEVSLSDQLICNTYSTICNFGDLKTKNMKLNTNDILYNGHKTDITNSLDASQGGNIHNFGKLDVENTIKLNTPSIVYNAPECKIEAKTYEAAGSTNVNFGEMEFDTYDSGKAGGSLYNNCMLFVEHMKAGGIVYLDHGVIAEEKEDDEENELFEEADDIEFYDNAKVTLANGSMIKAKNIIAKSGLSVNGEGNETSLLKATEKVQIQNWDVRFNGRLCITGKISCSNPDMYQAGSEVTFSESPDVIITGCNGKAEVPDPAPEPSDPVFPIIVDDNHNYTYLFEDQWPLYGDYDMNDIVLEVKKRKISIDKHNKVTEFDLSVELRAVGAQKTIAAAIMFDEIPASAVTQAVTYADNYQPVSFELTDKNIEKGQEYAVVPLFDNAHALMERPTGSFVNTISGSDNNQKNTQTIHFTLRFDSSVAPSSDALNINNLNIFIITDRGSKRKEIHVAGYRPTLLANTELFGGNNDASSLNGKKYYISKDNLAWGIMVPTQFKWPLEYTQIQKAYSQFAGWVTTGGADNKKWWNDFDNTKVFQTNKN

SEQ ID NO: 7272 - protein, 101 aa, B.fragilis
GKRTDSGNNQLLHDQCPDHERGPGIYRPESVRRGERTLFMGKKLQNGTSSWRFFDQMLYEDNVVRTPGVGFGPSGEGYIRLTAFGERDDCIEAMRRIKNRL

SEQ ID NO: 7273 - protein, 446 aa, B.fragilis
NIIANNWNLLACSYFLSLSKRRINRNRNMKRVIFSLSFSLFALLMYGQITLEECQRKTRENYPLVRQYGLIEKTKEYNLANASKGYLPQFTLSGKASWQSEVTELPVQVPGVDIKGLPKDQYQVMLELKQNIWDGGEIRSRKEQVKASSDVDREKLNVDMYALTERVNQVYFGILLLDEQLRQNQLFLEDLERTHKQISSYIENGIASQSDLDAVSVEQLNTRQKRIELTSSRQAYLSMLALLTGEEMPAGISLQKPVPEWDIPVIANNRPELIWFDAQNGRLQVQEEALKTQLMPRFGLFVQGAYGNPGLNMLKNEFSPYYVAGVRLSWNFGSLYTLRNDRRVIAANRQLLDSNRDVFLFNTRLQATQQGSAVESVRRQMADDDEIIRLRTSIRKASEAKVANGTMTVTDMLRDMTSENLARQTKALHEVQLLMNMYQLKYTTNN

SEQ ID NO: 7274 - protein, 431 aa, B.fragilis; identical to SEQ ID NO: 6067

SEQ ID NO: 7275 - protein, 384 aa, B.fragilis
TKHLLTTSSRCTNFKRKVNLNKEKIRMKNVTLILDDGSRFHGKSFGYEKPVAGEVVFNTAMTGYPESLTDPSYAGQLMTLTYPLVGNYGVPPFSIEPNGLATFMESERIHAEAIIVSDYSQEYSHWNAVESLADWLKREQVPGITGIDTRELTKVLREHGVMMGRIVFDDEPESAPEAVYSGVNYVDKVSCKEVIRYNEGADKKKVVLVDCGVKTNIIRCLLRRDVEVIRVPWNYDFNHLKFDGLFISNGPGDPDTCDAAVQNIRKAMQNPKLPIFGICMGNQLLSKAGGAKIYKLKYGHRSHNQPVRMVGTERCFITSQNHGYAVDNNTLGTDWEPLFINMNDGSNEGIRHKTNPWFSAQFHPEAASGPTDTEFLFDEFVKLL

SEQ ID NO: 7276 - protein, 231 aa, B.fragilis
SLVYRMFTRKYLLCETLCHSVVNPPNNFKTMNNEINTLNRQKGAILLLDNYDSFTYNLLHVVKEQGVTDIEVFRNDEITLDEVERFDKIILSPGPGIPEEAGLLLPIIRKYAATKSILGVCLGHQAIGEAFGATLENLTEVYHGVQTPVSILKEDILFRGLGREIPVGRYHSWVVSRKDFPGCLEITAESREGQIMALRHRTYDVHGIQFHPESVLTPQGKEIIKNFLNNR

SEQ ID NO: 7277 - protein, 97 aa, B.fragilis
CWFLFLNKLYLRNNINNKMFKKSFLFKRSIILPYISCTYNVHLLGPKVQGPFYAPIESEKKDKKTAITSNNQIVTNNNQQKQWTKKSRKVNSKKNTI

SEQ ID NO: 7278 - protein, 498 aa, B.fragilis
VSIYPLKGFFFGPPKKYVWGHAYNNSKPSLPIFQINYLHLRSCKKTWHLQTERTQHKKTSTMKKILFLLTILVSVPAFSQSADERIGAFLNQADWFGLEKNYPILKDSMQADFLKLMSEALIGYYFNRPDEALQSIHKLLVNHQAEIGGQNALNMAILACQIDGLKGNYATAAQNSRSIMEQLKQQNAEQGMYKSLEGICYFYDQLKNIPALGITCPQEDIIIPVDIEKVKLPTSIEPKGWRGTTILIPVTINGKTYQFIFDTGAGTSYMSQRMAKETGVRILSDSLVINSNLPGAMTGNFGTLENMQIGSITFHNSLITIAPPNAFDSIMIVDAVLGMDFIGLFDEVRIYPKDKKIVFPKSSTPLPSYGRNLMKVDRALKLKAQANGETLMLHFDTGNSTAGLFYQYYEKHKTEFESIGKKEKITGGGFNHVVTKDILRLPSFDMEIGDATAHLKNLAVDITPNGIPAEDDGNIGMDMINQFDCVTINLKDMFLKLE

SEQ ID NO: 7279 - protein, 362 aa, B.fragilis
NCYLCRENSKNDTDMKADYPSVLLIYTGGTIGMIENPETGALENFNFDHLLKHVPELKRFNYRISSYQFDPPIDSSDMEPAFWAKLVEIINYNYDSFDGFVILHGTDTMAYTASALSFMLENLSKPVILTGSQLPIGTLRTDGKENLITAIEIAAAKNPDGTAIVPEVCIFFENHLMRGNRTTKINAENFNAFRSFNYPPLARVGIHIKYEPNLIRKPDLSKPLKPHYLFDTNVVILTLFPGIQEGIVSALLHVPGLKAVVLKTFGSGNAPQKEWFIRELKDATDRGIIIVNITQCASGAVEMERYGTGIQLLQAGVISGYDSTPECAVTKLMFLLGHGLDNKEIRYKMNSCLIGEITKRVE

SEQ ID NO: 7280 - protein, 386 aa, B.fragilis
MLHLIYIGRHADTIEQFSKIAEGAFYAIQNSRKASEFIDKIREKYDIVILFEQRIISKDIPEIQYLRKKFPGVYIALVTEGINKEDRPAYLKAGINNSIPFNSTPETFKDITEFMMRRKQQKINDIHKKGANLLFFKLPLWKRLFDIVFSSIAILCLSPILIITAVAIRLESKGAVVYKSKRVGSNYKIFDFLKFRSMYTDADKHLRDFNQLNQYQTEEEPELSGEEFLIGDDIELNEEETMLISDDFIISEQNYTSKKSIEKKNAFVKLENDPRITKVGRIIRKYSIDELPQLVNILKGDMSIVGNRPLPLYEAELLTSDEYIDRFMGPAGLTGLWQVEKRGSSGKLSADERKQLDIKYAQTFSFLLDMEIILRTFTAFIQKENV

SEQ ID NO: 7281 - protein, 140 aa, B.fragilis
RCYHYIPINRDCSIMENFYLCPKLNGMNQGSLKIMRGFRPVLFNWDMPGITLFTHSHVVNGVTMVHSHPFKKASPHSHTPVEFQLIHLLNHVVTTEAGIFFLSLQFIACLLYTLSWRPDRAGYCSSVVGVVSLRAPPAGR

SEQ ID NO: 7282 - protein, 300 aa, B.fragilis
LHLHKLKIKMKKLFALLFISMISGMIMAQIPEVSGTIVFKKDGQPVVGALVSVLGTDISTITDVDGRFTLKEIPEKAQRIRVKYIGMQPKDVKIRPIMNVTLDLEKKLAFFIQAGVGVSGYNLENNNEDIYGGNNHLYIQGGVGLNYNFSTYFSLQPSVNVVAKGCKNMGRRGSDGQGEITVDPVYLEIPVLIAARFIISDFGRLIFNAGPYAAIGIAGKGKYTDEWEGTSMKFDLFSGDEAVLKRFDAGVQAGFAYEIKHIGFSYTFGYGLLKPFKEWNKEWGATPHNISHNFGLKYIF

SEQ ID NO: 7283 - protein, 401 aa, B.fragilis
PQIQITNKYRIMKSFLVDQDGYYGEFGGAYVPEILHKCVEELQNTYLDVIESEDFKKEFDQLLRDYVGRPSPLYPARRLSEKYGCKMYLKREDLNHTGAHKINNTIGQILLARRMGKKRIIAETGAGQHGVATATVCALMNMECIVYMGKTDVERQHINVEKMKMLGATVVPVTSGNMTLKDATNEAIRDWCCHPSDTYYIIGSTVGPHPYPDMVARLQSVISEEIKKQLQEKEGRDYPDYLIACVGGGSNAAGTIYHYIDDERVRIVLAEAGGKGIETGMTAATIQLGKMGIIHGARTFVIQNEDGQIEEPYSISAGLDYPGIGPMHANLADKKRAMVLAVNDDEAIRAAYELTRLEGIIPALESAHALGALEKITFKPEDVVVLTVSGRGDKDIETYLG

SEQ ID NO: 7284 - protein, 90 aa, B.fragilis
ISKQSRTKFRQILKHPEIKMIKAFLKKNRLTFIGLVIGAVGGFLYWKYVGCTSGTCPITSSPVNSTLWGAVMGGLLLNLFKTDSTPKKTN

SEQ ID NO: 7285 - protein, 83 aa, B.fragilis; identical to SEQ ID NO: 6082

SEQ ID NO: 7286 - protein, 104 aa, B.fragilis
KPYKSLFKENLNRFLINCFLIKQISNGKYYGDNILYGMKKEGGSRCVVSGREVVRLGGELISPQIETESYGVFCYFLLCGTLCYPVMVRLSNSSSPYAINVLAR

SEQ ID NO: 7287 - protein, 382 aa, B.fragilis
PMDNFIFQNPVKLIMGRGMISRLSEEIPADKRVMITFGGGSVKKNGVYDQVKEALKNHFTVEFWGIEPNPSIETLRKAIALGKEEKVDYLLAVGGGSVIDGTKLISAGLLYDGDAWDLVLAGRPVTHTVPLATVLTLPATGSEMNSGAVISRHETKEKYPFYSNYPLFSILDPEVTFTLPPHQVACGIADTFVHVMEQYMTTPGQSRVMDRWAEGILQTLMEIAPKIRENQHDYQLMSDFMLSATMALNGFIAMGVSQDWATHMIGHELTALHGLTHGHTLVIVFPGTLRVLRKAKGDKILQYGERVLGITSGSRDERIDEAIRRTEEFFRSLGLTTRLSEEGIGMETIDEIERRFNERGVRYGENEDVTGAVAKEILKSSL

SEQ ID NO: 7288 - protein, 1084 aa, B.fragilis
TKLKNIIIMKENNIKKVLLLGSGALKIGEAGEFDYSGSQALKALKEEGIETILINPNIATVQTSEGVADQIYFLPVTPYFVEKVIRKERPEGIMLAFGGQTALNCGVALYREGILEKYNVKVLGTPVQAIIDTEDRELFVDKLNEIDVKTIKSEAVENAEDARRAARELGYPVIVRAAYALGGLGSGFCDNEEELDLLVEKAFSFSPQVLVEKSLRGWKEVEYEVVRDRFDNCITVCNMENFDPLGIHTGESIVIAPSQTLTNKEYHKLRELAIRIIRHIGIVGECNVQYAFDPESEDYRVIEVNARLSRSSALASKATGYPLAFVAAKLGLGYGLFDLKNSVTKTTSAFFEPALDYVVCKIPRWDLGKFHGVDKELGSSMKSVGEVMAIGRTFEEAIQKGLRMIGQGMHGFVENKELVIPDIDKALHEPTDKRIFVISKAFRAGYTIDQVHELTKIDKWFLQKLMNIMNTSEELHQWGNNHKQIADLPADLLKQAKRQGFSDFQIARAIGYEGDMEDGSLYVRNYRKSLGIVPVVKQIDTLAAEYPAQTNYLYLTYSGTANDVTYLGDHRSIVVLGSGAYRIGSSVEFDWCGVQALNTIRKEGWRSVMINYNPETVSTDYDMCDRLYFDELTFERVMDVLELENPYGVIVSTGGQIPNNLALRLDAQNIHILGTSAQSIDNAEDRDKFSAMLDRIGVDQPEWRALTSLEDINSFVDKVGFPVLVRPSYVLSGAAMNVCSNQEELERFLQLAANVSKKHPVVVSQFIEHAKEVEMDAVAQNGEIIAYAISEHIEFAGVHSGDATIQFPPQKLYVETVRRIKRISREIAKALNISGPFNIQYLAKDNDIKVIECNLRASRSFPFVSKVLKINFIELATKVMLGLPVEKPEKNLFELDYVGIKASQFSFNRLQKADPVLGVDMASTGEVGCIGSDTSCAVLKAMLSVGYRIPKKKILLSTGTPKQKVDMLEAARMLQKKGYDIFATGGSSKFLTENGVENTRVYWPSEEGHPQALEMLHKKEIDMVVNIPKNLTAGELDNGYKIRRAAIDLNIPLITNARLASAFINAFCTMDIDDIAIKSWEEYK

SEQ ID NO: 7289 - protein, 395 aa, B.fragilis
NINNMTNELELKYGCNPNQKPARIFIKEGELPIEVLNGRPGYINLLDALNSWQLVKELKEATGLPAAASFKHVSPAGAAVAVEMNDTLKKIYFVDDMELSPMATAYARARGADRMSSYGDFIALSDICDEPTARIINREVSDGVIAPGYTPEALEILRNKRKGTYNVIKIDPAYRPAPIEHKDVFGITFEQGRNELKIDESLLKEMPTRNRIIPADAQRDLIIALITLKYTQSNSVCYAKDGQAIGIGAGQQSRIHCTRLAGNKADIWYLRQHPKVMNLPWKEKIRRADRDNTIDVYISDDYMDVLADGVWEQFFTRKPEVLTREEKRAWLDTQSGVALGSDAFFPFGDNIERAHKSGVSYIAQPGGSVRDDHVIETCDKYDIAMAFTGIRLFHH

SEQ ID NO: 7290 - protein, 313 aa, B.fragilis
NKNNMALVNEHFLKLPGSYLFSDIAKKVNTFKITHPKRDIIRLGIGDVTRPLPKACIEAMHKAVEEMTSAETFRGYGPEQGYDFLIEAIIKNDYAPRGIHLSPTEVFVNDGAKSDTGNIGDILRHDNSVGVTDPIYPVYIDSNVMCGRAGVLDTESGKWSNVTYMPCTAENHFIPAIPEKRIDIVYLCYPNNPTGTTLTKAELKKWVDYALANDTLILFDAAYEAYIREPDIPHSIYEIKGAKKCAIEFRSFSKTAGFTGVRCGYTVVPKELTAATLEGERIPLNRLWNPPAMHQIQRYVVHYATCGRSDLHS

SEQ ID NO: 7291 - protein, 505 aa, B.fragilis
SIRKAEDSLFYSSDRKQVLAVNGEIYNHRDIRAQYAGRYEFRTGSDCEVILALYRDKGIHFLEELNGIFAFALYDEEKDEYLIARDPIGVIPLYIGKDAEGHVYFGSELKALEGFCDEYEPFLPGHYYHSKERTMKRWYTRDWMEYKEENDKQADSRSPTRQIQDALENAVHRQLMSDVPYGVLLSGGLDSSVISAIAKKYAAKRIETDGASDAWWPQLHSFAIGLKGAPDLIKAREVAEYIGTVHHEINYTLQEGLDAIRDVIYFIETYDVTTVRASTPMYLLARVIKSMGIKMVLSGEGADEIFGGYLYFHKAPDARAFHEETVRKLSKLHLYDCLRANKSLAAWGVEGRVPFLDKEFLDVAMQLDPEIKMAPGKVIEKKVLREAFADMLPSGIAWRQKEQFSDGVGYSWIDTLKEITATAVSDEQMAHAAERFPIHTPMNKEEYYYRSIFEEHFPSESAARSVPSIPSVACSTAEALAWDTTFKNLNDPSGRAVKGVHEEAY

SEQ ID NO: 7292 - protein, 284 aa, B.fragilis
GSVNEEGSPEGLLRKVQLIRIPLRLGEDAFTTGEISEGKAEKLIRLMKAYKQLMKIFEVSDYRACATSAMRDARNGKEITRKIEKKTGIRVEIIDGQEEAHIVYDNHIEQLFASGQNYLYVDVGGGSTEINLICDSELKSSRSYNIGTVRMLSGMVKNEEKEQMRTDLQALAAEYTPIQIIGSGGNINKLFRLADKKDKKQSFLPIESLKEICETLKALSKEERIKQFKLKPDRADVIVPAAEIFLEVAKQVNATGITVPTIGLSDGIIDSLYTKNMRMETDAK

SEQ ID NO: 7293 - protein, 331 aa, B.fragilis
ICPNVFFLTRHGDYPKDFHRVYTKRKRITVRYRIMDTFIQTTDFILFLCFSLMTVYLGVLAIAASLRNDTPYPQAGKRHRFAILVPPGSTSLPLPHYPEELYQVFTYEDLTEAIAALNENDFDGVVVLGETTRIEPAFLEEINSVFDAGIQAIQLRHITEKRSTRKQYFQALNEEITQALFGTGATRLGVSSALYGADMVLDLKWLKKNQKSRKSNLERRLVRQGIFVEYLEKVKVYSSDIRAPRYKVRFSKALRALPEAIFTAHWDYCNKILRWILPSRKTNLISIALIATALLCYDWSLSLKWWSLLYILMFIICLAIPDYLVRQKTKK

SEQ ID NO: 7294 - protein, 165 aa, B.fragilis
KAEKMKKSILIPFLFMGLLAFASCKGTSENKSTTATDTVQAEKPQSGTIHLTRAEFLKKIADYENHSKEWKYLGDKPAIVDFYADWCGPCKMVAPILEELSKEYAGKIYIYKVNVDKEPELARDFGIQSIPTIWFVPMKGEPQVNMGALSKEQLKGYIDKVLLKQ

SEQ ID NO: 7295 - protein, 281 aa, B.fragilis
TDRKAITHQRNMKDILSEIIANKRFEIDLQKQAIPSEQLQEKLSDEVQPGYSMKQALASSATGIIAEFKRRSPSKGWIYKNACPEQVVPDYIAAGASALSILTDEKFFGGSLKDIRTARPLVNIPILRKDFIIDEYQLFQAKIVGADAILLIAAALEADQCHALAAKAHELGLEVLLEIHTAEELPFINKEIDMVGINNRNLGTFFTDVENSFRLAGQLPQDALLVSESGISDPETVKRLRKAGFRGFLIGETFMKAQQPGQKLKEFINDLNSPQSDTESH

SEQ ID NO: 7296 - protein, 238 aa, B.fragilis
IRCLMDKLQKYKPTDKMIDLIGDNYSLLQVMSRFGLSLGFGDKTVKEVCEMNNVDCQTFLVVVNFMAEGFSRMDGSADDISIPALVDYLRQAHIYFLDYCLPAIRRKLIEAIDCSQDDVSFLILKFFDGYMREVRKHMEYEEKTVFKYVDTLIHGNAPKNYQISTFSKHHDQVGERLTELKNIIIKYCPAKANTNVLNAALFDIYACEEGLESHCKVEDYLFVPAILKLERRMRENEK

SEQ ID NO: 7297 - protein, 265 aa, B.fragilis
KYMNRINQLFDSNPRDLLSIYFCAGYPTLEGTTEVIRTLEKHGVNMIEIGIPFSDPMADGMVIQNAATQALRNGMSLRLLFEQLHDIRRDVKIPLILMGYLNPIMQFGFDNFCRQCAECGIDGVIIPDLPFKDYQEHFRTIAERYDVKVIMLITPETSEERVREIDEHTDGFIYMVSSAATTGAQQDFDGQKRAYFKKIEKMNLRNPRMVGFGISNEATFRAACENASGAIIGSRFVTLLHEEKNPEKAITRLKAILNLSSNDLR

SEQ ID NO: 7298 - protein, 388 aa, B.fragilis
FCMKTSYLLLSSALLLGCLSACNTSPREPKAMEANDGSVTTIESNGNKLTVCDLSAVKDTIEVPLSEFVEDCRIVRFETSEEAYFKAWFINATDKHIGIRQGNQDVFKLFDRDGKFLYNVGSVGSGPGEYDTTLYDECIDEKNGHIFFTPFVGKRIMMYDINGQWIKDIPLPMQINKAKIWVNEDGSLSVVHMPFEEGEPLAFRVDTEGNILNQIPATAATKVMNFDGEVFSYRNCGDFDFFHTGIDTLFTYDSAGNKLLPKFTMTFPNMNEKPIHLYYRLPHHFIVTYWGNKGEGGGDVLVDTEKNASSYFRLVNDFYGNLPIPAPGHSFYRGYFIQSLEPGQLIEKIEKQIASGKCSGQDEQKLKELAATLTENDNNVLFIGKVKK

SEQ ID NO: 7299 - protein, 73 aa, B.fragilis
MQRESQSRQSDCRTVSSTASIPRICAWKRTLNKTGHHRLHRLTQIIYRVDSWYKRIYANVSYDSPQITRIFTD

SEQ ID NO: 7300 - protein, 269 aa, B.fragilis
IALLFISLKANQKLKYMKIKKLLFASALLFSAYNASAQTQVIAHRGFWKTEGSAQNSIAALLKADSIGCYGSEFDVWLAADDQLVVNHDPTFKGKRMENSPSTALTAIKLDNGESLPTLAKYLKAAQPLHTRLILELKAHSTPLRETKAIEKIVALVKDMGLEERMEYITFSLHATKEFIRLAPEGTPVYYLDGNLSPKELKELGCAGPDYHYTVFRKHPEWIQECHDLGMKVNAWTVNKTDDMKWLIDRKVDFITTNEPVQLKNLLKK

SEQ ID NO: 7301 - protein, 627 aa, B.fragilis
MEQLKHECGVAMIRLLKPLEYYEKKYGTWMYGLNKLYLLMEKQHNRGQEGAGLACVKLEVNPGEEYMFRERALGSGAITEIFETVQSNFKDLSKEQLHDAAFAKRTLPFAGEAYMGHLRYSTTGKSGISYVHPFLRRNNWRAKNLALCGNFNMTNVDEIFARITAIGQHPRKYADTYIMLEQVGHRLDREVERLFNLAEAEGLTGMGVTHYIEDHIDLANVLRTSSKEWDGGYVMCGLTGSGESFALRDPWGIRPAFWYQDDEIAVLASERPVIQTALNVPIGEIRELLPGQALLISKEGKLRTAQINKAREKKACSFERIYFSRGSDADIYKERKQLGEKLVPNILKAIDNDLDHTVFSFIPNTAEVAFYGMLQGLDNYLNEEKVRQIASLGHHPDHDELEVILSRRIRSEKVAIKDIKLRTFIAEGNSRNDLAAHVYDITYGSLRSGIDNLVIIDDSIVRGTTLKQSIIGILDRLGPKKIVIVSSSPQVRYPDYYGIDMAKMSEFIAFKAAIELLKDRDMKDVIASAYRKSKDQVGLPKEQMVNYVKDIYAPFTDEEISEKMVELLTPKGTKAKVQIVYQPLEGLHEACPNHTGDWYFSGNYPTPGGVKLLNEAFINYIEQVYQF

SEQ ID NO: 7302 - protein, 352 aa, B.fragilis
KNKLITPLMTTTNEQEQSRAYILAGIFTLSLRLVVGWTYFSAFWRRLVLENKLIPDSAGYIGEKFNHFLPNSIGIRPVIEYLVSTPDMLWWAMVIFTLVEGIVGLLYMLGFFTRLMSIGVFSLATGILLGSGWLGTTCLDEWQIGILGVAAGFTIFLSGGGKYSVDHLIERKFSLKKKAAWLSWLTSGELPVSAKRFANVSVAGAIVIFTLSLYTNQEFHNGVWGPLHNKSVKPKIEISDAQIENNSLSFSVYRVEGVDVYGSFLIGISLKNADGDIVLEKKGEELADFPIGNIDNKYIARVAPGKHSLVIPLGSKATLTIDDTAIGGLPKGKYELVLTDISGITWKKEIIH

SEQ ID NO: 7303 - protein, 119 aa, B.fragilis
KPELFLLPVVESTYKSIKSVIMNIAEQLDAVSGTNRLVLVEFYADWSPHYEWLEPVVRTYEKQVSEVIKVNIVEDKAVADSFNIETAPAFILLQRGHELWRQVGELTIDELKLVLEEFK

SEQ ID NO: 7304 - protein, 692 aa, B.fragilis
TLIRMKSDEAKRKKLYVERDISWMYFNQRILLEAARPEVPLLEQLTFLGIYSNNLDEFFRVRVATLNRIVEYDDKNIREERDTAARTLKQIGKLHNQYYRQFEETFASIMEKLKQENIHVIKDTELTPEQEHFITSLYRNRLNGSTNPLFLTKTSRHTDDQTDEDIYLAIRLLRKDSEGKVKMKDYAVIGLPTAEFGRFIRLPDSEGKTYLMFLDDVIRYCLPMIFIGMNYTDYEAYTFKFTKDAEMEIDSDLRTGVLQKISKGIKSRKRGEPIRFVYDKEMPKDLLRKLTDRLNVDKNDTRVAGGRYHNFKDLMKFPDCGRSDLKYPAWPPVFKQELNGTESILRLIRKQDRSLHYPYQSFDTVIRVLREAAISKEVKSIKMTLYRLAKDSKVVKALICAAQNGKKVTVIIELLARFDEASNISWSKRMQEAGIKVIFGVEGLKIHSKLVHIGTRFGDLACISTGNFHEGNARMYTDFTIMTAHRSIVREVDRVFDFIEKPYLPVNFKELLVSPNDMRKRLTALINQEIKNKRQGKEAYILAKVNHITDRILIQKLYEASTAGVQTDLVVRGNCSLVTGIPGVSDNIRINGIIDRYLEHPRIFIFANGGEEKYYIGSADWMPRNLDNRIEVLTPVYDKVIQAELKRVVCYGLRDTAKGRIVDGSGENKTWENSDAPFRSQEELYKYYKESE

SEQ ID NO: 7305 - protein, 75 aa, B.fragilis
NTTRTSWQFRLRSLRARSTSITCSAFSFGSAKRASVSSLSLMVSPVRRVVPAIGSIYACPLSTLQCVSGDEPKMR

SEQ ID NO: 7306 - protein, 547 aa, B.fragilis
FFLRAERCIAVFPSLVLAASVHDSPFGRVAKSVADHTFQFCLYHFVVYRRKHFDAVVQIAGHPVGRSYIVFFFPSVGEDEDARMFQITVDDAVDPDVVADSRDAGHQGAVAPDHQVCLYTGCRSFVEFLYQYPVGNMVHFGKDVCLFSLSLVLDFLVDQGCQPFAHIVGRHEQFLEVHREVGLLYEVEYPVYFPHNGAMCCHDGEIGIHPCVSFMKISGADTGQVAKPCSDMYQLGVDFQTFHSEYHFDSCLLHAFAPADVGRFVETGEQFDDNRYFFSVLCGADQSFHYLRVFGQAIESHLDAFHFFADGCLAQYTDHGIERLIGVMQRPVLFPDQSQDTFRPVQFLFEDGRPGRIFQVGPSAVGKLHQVFEVMIAPACYTGVVFIHVEAVGQLSQQIFRHLFVIDETDRFAPFPAFDPLRYFLEHTCTQITVYLHFGVFGELESVSFIVRIIHAYEDHRQAVADNVVQKHQIGFAFRIRQADEASELGGGEPDDGIIFHFHFSLTVFAQQADGKVDVFIGLVVRMTGRFSKKERIGRPIQPVPVE

SEQ ID NO: 7307 - protein, 342 aa, B.fragilis
PRMRNIEKTNYMKQILYKLFEHQYLGRDEARTILQNIAQGKYNDAQVASLITVFLMRNISVEELCGFRDALLEMRVPVDLSEFAPIDIVGTGGDGKNTFNISTAACFTVAGAGFPVVKHGNYGATSVSGASNVMEQHGVKFTDHTDRLRRSMEKCNIAYLHAPLFNPALKAVAPIRKALAVRTFFNMLGPLVNPVIPTYQLLGVYNLPLLRLYTYTYQESATRFAVVHSLDGYDEISLTDEFKVATCGNEKIYTPESLGFNRCRESELDGGNTPEDAARIFDAVMEGTATEAQKNVVIVNAAFAIRVICPEKPIEECIALARESLESGKARETLKKFVELNG

SEQ ID NO: 7308 - protein, 151 aa, B.fragilis
NKNRIAVMKSMKFIGCLYLLALLSACGSRTSDYDATGTFEATEVLVSAEASGKLLYFHVEEGTRLKAGEEVGLIDTLQLYLKKLQLQASMKSVESQRPDVNKQIAATRQQIATARREKRRVENLLKAGAANQKQLDDWGLHHGGGRYRVHG

SEQ ID NO: 7309 - protein, 64 aa, B.fragilis
MYRLLIHIRESHREFRQQFIAGGIVSEKSIYTGMEEIEIATVPIRENLSVEVHHLRCGSCRNLV

SEQ ID NO: 7310 - protein, 303 aa, B.fragilis
IDIRHAFYKNKSQKDISLCSNNAKGYINQPILIKMARAIQFTKMHGTGNDYIYVNTLRFPIARPEKAAIEWSAYHTGIGSDGLVLIGHSDKADFSMRIFNADGSEAMMCGNASRCIGKYLYEYGLTSKNVITLDTLSGIKILELHLEGRTVETVTVDMGIPLETGTIDFDGEFPFLSTQVSMGNPHLVTFVDDIRIVNLSEMGPKLEKHPLFPDRTNVEFAQITGENTIRMRVWERGSGITQACGTGACATAVAAHLTGRTGRTVNVVMDGGTLTIEWDEATGHISMTGPAVKVFDGTIELRE

SEQ ID NO: 7311 - protein, 60 aa, B.fragilis
LYRSDATHQEPTVMTDSHVTTDYTDFHRLIIYFIENQIKTSVLICVICGEYLPHLSSIIR

SEQ ID NO: 7312 - protein, 66 aa, B.fragilis
  UNSURE (35),(36),(37),(38),(39),(40),(41),(42),(43),(44),(45),(46),(47),(48),(50),(51),(57),(60),(61),(63): Identity of amino acid sequences at the above locations are unknown.
EYNGNNAIGPNGYTFLIYFGFFRLQAAYKKKKGGXXXXXXXXXXXXXXNXXPPLFTXISXXFXPKN

SEQ ID NO: 7313 - protein, 92 aa, B.fragilis
TGCGTRRQCTKFNGTSYITQRAAEAIYTPEGKEQIQETINYYMTNARIMKEGLESTGLKVYGGVNAPYLWVKNSKTEQARGASLTRCYTKTT

SEQ ID NO: 7314 - protein, 210 aa, B.fragilis
NWKGGCEKMKNNESIRIAVAETSVIIRSGLTLALKRLPNLKIQPVELLSVEALNDCLRTQFPDILVVNPTFGDFFDVARFREETAGKGIRVVALVSSFIDASLLSKYDASFSIFDDLEALANKINLLQNIEPEEEEDSQENLSQREKEIVICVVKGMTNKEIAEKLFLSIHTVITHRRNISKKLQIHSAAGLTIYAIVNKLVELSDVKDL

SEQ ID NO: 7315 - protein, 378 aa, B.fragilis
NNHISVFTTMKTHKLLFVTLLGTVCISCGHPSHKTGSEKEALGKLLFHDTSLSEPPGQSCATCHASSKGFADEQARAISEGAVQGLFSQRNSMSVCYAAFVPELHYDDDDENYVGGLFWDGRSPSLQDQAGIPLLNPVEMGNRDKQMVAEKVKRTPYYDRIVQIYGETEHADSLFAHVTDALAAYQASKEINPFTSKYDAYKKGNYQLTEQEARGKELFKDKGQCAECHILDRDKRAHRTLFTDHTYDNLGIPKLPDHPHYKVAAEYFLLAADSVDLGLGAIVNAESENGKFRVPTLRNVELTAPYGHNGYFKTLEEIVHFYNVRDVSDEFPPAEYPATVNKEELGNLGLTQEEEADIVAFMKTLTDGYMKVHKSEKR

SEQ ID NO: 7316 - protein, 143 aa, B.fragilis
AYSIHIKRTNSKTNNITLTNHIMRKLILLVDDKETIAKVASIYLGKDYDIQYFPDPIHALEWLHEGKTPDLIISDIRMPLMRGDEFLHYLKCNELFKDIPVIMLSSEESTSERIRLLQEGAVDYILKPFNPMELKIRVKKIIE

SEQ ID NO: 7317 - protein, 134 aa, B.fragilis
KKNVSTNLKTPTNVMAIERKVPGEIRIFLNHVYEFKKGVRNMVLYTMNKEHEAFAIRRLERQNISYLIQEVNANKINLFFGKAECMDAIRHIIIRPLNHLTPEEDFILGAMLGYDICQQCKRYCNKKGNIKIAG

SEQ ID NO: 7318 - protein, 321 aa, B.fragilis
NMLFFISDLLINRIFYLSLPCDKNRFMEKIKPLELALDLLKHSNIVRNNEYRFVTPDFGIVISFTHMESRLFRLGQPYRLKEGRIIRGLRGKARITINLIEYNIYPQTIATFLPGSIIELLEFTPDCDFQMIAADKDFLPLLRGDQLFESHTRQNLVMQVTDTEWKLSDAYFTLIWDTVQEVPFRREVVQYLLAALLHNIKYIRTEEANDTSRRFSHQEEIFWRFIALVNEFSKNERTVGFYADKLCLTPRYLNTLIRQVSHQTVMEWINQSVILEAKVLLKHSNLLVYQISDELHFPNPSFFCKFFKRMTGMTPQEYQKR

SEQ ID NO: 7319 - protein, 78 aa, B.fragilis
RAPPEMRLWKLSIWEDGYTIPCVCYYIEKEDVYELVDGYHRYKVMMTSPRIYKRENGLLPVTVIRKDLAERMSLYHPS

SEQ ID NO: 7320 - protein, 122 aa, B.fragilis
CNIAPNTKISGGKRISSHVPHRRNDVGLIFRSVASSLANAKNQLGNFYRRIRSRAGGKAAVIATAHKVTEIFFAMVANQTPYNPEKVGIDEKVLLEKRITRYKRELERITGMHIEIGNACVP

SEQ ID NO: 7321 - protein, 90 aa, B.fragilis
LPGYIDHGGTGIGKPSKLQGFKQLLLTDIMQANQRLAAVILADLPKPDVILTLKEAARILAGGFYLVGGKRDIIHRAVIFGTHIGTVRHI

SEQ ID NO: 7322 - protein, 1045 aa, B.fragilis
VNKYFSLITNQVTYLFFHGMEQISEYLFTTEEQAVIARSKAEGSYMKAPNGQATNLNEKQWAQVRTRAFRDWFGDWENCPDEASKVRDANGEPLVVYHGSRENFYEFKRWTDGLINSGHFFSPDRKNALGYGGNIYDVYLNLRNPLEVDAQGANFSSIEYGGEKVAASDLGNLAEMEGYDGVVISDVADSADMGSENDRTVDYISFAANQIKSASQNTGSFLESQDDIRFREISQDDGGKSLVGLHNISEEKLLKALKLGGLANPSAAVIDIARQSHEEYGEISLVLPSSMIDKRTGRNAGTFSGDAWTPVYPQIERQFSGDGSGRVRDAISRLPQEMQPDVRSAWNNYMDGRDEGSAFAYQFLYERGEAPEFRKVEPLFGEHLRNRISAIDALDNYDERNTALLEVYIEENFGGDQTKFKDYIETRKRVLQDKIQAFPEQKQKGLAYRKAVQKLNDIEERGYEYSSVQDFYDRVKTDIRQAGSVDTYHTLQDALDKINGSEALSRQYAEWKESLADKYGIKEVLFKGYTPDGIRIYLPHTLENVSGLMKQQGLAAATGWGGSFSKFAAALMKPVGTLDGIRRQKGKLITDHSDLEAFRDKWQEVYFDLGIKLNPGGGTFDDTGLYRVEDIALKPDPGSFAKREYGVELTREDVRQLKEMVDAIQNECPAMYFETKFERPVYLNEFVAAIVPENVNEDVSKSIRESGLQVFVYKPKDESSRNEAVKLASEIKGVRFRLAGGTGAFTPACTASGQVFLSGDERMAELSRHAVFLARKQHIPVNIIHSIGEVDSPKVRALIAGGKDIRGWYDIPSDRICLYLPKARGKEDIERTLLHEGVGHYGLRRLAGRKHMDAFLDDIFAGCGEKVRGEIIRLAGTGKMDIRTATEEYLAQMAESGTDARVWDKIRLAFRNLLRKLGFSIEVDDRELKGLLAASRENLKRTAATRIPEKIQTPKGELELTPGYAAGSLRSKDGVRDVTPFLKEMKRAGLKPASLSPEEWKSLFSGKGIALPDGRMLMAVKEPAGYGLKITAPALRSIKTAEMEI

SEQ ID NO: 7323 - protein, 126 aa, B.fragilis
RIMQVCVPMDRAKDNNRAFGAYTSDLHAILEWVRECGIKTVAMESTGVYWIPLFCRLQDDGLDVVLTNARDIKNITERKTDESDAEWLLLLHQYGLLKTSFQLHNDAKRMRTLTRHRDTLSREPQA

SEQ ID NO: 7324 - protein, 140 aa, B.fragilis
PQTNHVMLNENNRSSDRILTERILDDPDMILKIENPSLKQQMAAVQKKPELIASLPLAGEKVQLAAVIACPESILLVDTPAPAACFMAVERMLKEELLPVPGVLNAARELILQMKKDKADGRSSGAAIEKFLDEVKPIKN

SEQ ID NO: 7325 - protein, 155 aa, B.fragilis
IRTNYRDAYRNWQCMCSIEAIEAVKRCRQAGFQNISIDLIYGLPGETDQRWAQDLQQTVSLNVEHISAYHPIYEEGTPLYKMLQQHSVFQVDEDSSLNFFSTLIDTLSAAGYEHYEISNFCKPRMYSRYNTSYRQGIPYLGCGPSAHSFDGDSRE

SEQ ID NO: 7326 - protein, 84 aa, B.fragilis
KMPEPIRPDTKNGKVLNLLPNVIFYGIFLLFYNSRSFFQTVVDPRLNHILYKNVIYIVIRKNFVSAPNDWHRNSFNCQPLDITE

SEQ ID NO: 7327 - protein, 536 aa, B.fragilis
IVMENLIPYIKLIILALACLVTGVCTLSRKWYVNLAVFLICIAGETFMAYLFFPAYALWPACGSVAIFAFSTAWEHLKPSGRKENKSPIRLPVISGVPYRHLEFYYYYSNFLVYGGAGSGKTKSIGKWLLEEYIKLGFAGFIYDFKDVDYTQTAYNLTKKYGYPHKFYYVSFDKPERSYRFNPLKVVKDRTELMQLMEDVLLALLPKGEKQNEWVAGGLGILRGVAFRFWDEFPEYCTLPHIMAFIMTASTRQLSIFLQQNLVAEMMAGAYLKAEGSEKTQASYLSTLCNNLSTISQNEEIAYILSGDDFDFNLIDPEDPKLFAISNNFSKNSVYAPVIGMLMSISTRQFTMQNKVPFVYFLDEMTTVNIKNFETLPSVLREYKVGFVLLTQSGAKLEALYGKLDRASVEANFGIQFFGRTKDVEALKYYPQMFGKEEKERKSRSTGKSGSSSNRSVTISSQKEDIYQGRDFADLEPGEFIGSATRANVRYFKVMLGEFKEKDEKPLPDVRVLEPEEITRNFSRILAEVRSLFPCE

SEQ ID NO: 7328 - protein, 229 aa, B.fragilis
LRMDTERNMQSDCYFCKKNYFCELFILKIHRMSTHGSLSEVERFNLLYKSSFNKVCNFACFYVRNKQASEDITMDAFLQLLETMKVESVDNPMALLITIVKHKSLDYLKTQVRREDTKDDLIQWKQRELAIRISNLEGCNPSYIFSQEIKSIVMKTLNQLSEQTKKVFIMSRFENKSGKEIAQTLGISVKGVDYHMNKALKELRAALKDYLPILTWLCFMNPINKGWIS

SEQ ID NO: 7329 - protein, 157 aa, B.fragilis
ISTSICMKCMPMKLKVRIFEGKSPELYLAVGHFVLSPACLRENNNYPYKSSRMFTWHVLYHEGQVVAFMPVERKLDGGYKIDNYYATPDRERGNQLLKLLKSVIKESGDETSPLRATVQKRDVGIFKYMNFITIRETKLYVMMELVRMGSDSGKQDG

SEQ ID NO: 7330 - protein, 102 aa, B.fragilis
VLMRSLDRGGTSIPQKGEAYDLNGDGVKDVAVVDKEPPAGEKIKGVQYVVIGKTNRLSEGDHGYIEFGFNQGRKWDDKKYLRPIPLTATQINPALLPQNPGW

SEQ ID NO: 7331 - protein, 423 aa, B.fragilis
KRMGGTRMNVYQALRERIRRIFGEYDYVYLSFSGGKDSGVLLNACVEHIKQYGGRMGVFHMDYEVQYSLTTKYVDEMLSSNRDILDVYRCCVPFKVGSAASMYQRFWRPWDPCVRWVREMPVEYLGTEAFDFYTPQMWDYEFQECFSFWLRKQLGVQKVACLVGIRTQESFNRWRTIYRSTPGPSADWICPVDEGIDNVYPLYDWHTTDIWTANGRFRWKYNRLYDLYYQAGVPLNSQRVASPFISQAIPSLHLYRVIEPEMWGKMLGRVNGVNFAGVYGNSVAMGWRGVRLPEGMTWKKYLFFLLDTLPEDARNNYLDKLEVSVRFWREKGGCLAKETIMKLKRLNIPFELGGTSGYRTHKAPVRMEYLDDIDLPEFRDLPSYKRMCICILKNDHCANHGLFTEQSGERTPTPDDGRVRILF

SEQ ID NO: 7332 - protein, 296 aa, B.fragilis
LDAISLTEHIEYRPHKKDVVADHNRSFDLCQKQAEKLGILLIRGSEITRPMAPGHFNAIFLADSNPLEQKEYKDAFNEAKRQGAFIFWNHPGWAAQQPDTTKWWPEHTELYNEGCMHGIEVANGPLYMPEAIQWCLDKNLTMIGTSDIHQPIQTDYDFSKDEHRTMTFVFAKERSLKGIREALENRRTAAYYRELVIGREDLLRPFFEKCVEIEEISRNEKGVTLSITNTTDLVLKLKKTAHDTSLVYFRDMTLKPHTRYSVRIGFDNGIKGGDMNFEVTNFIVTPDKGLEYTISL

SEQ ID NO: 7333 - protein, 118 aa, B.fragilis
IMNMDKNDSFDGPLQEGRHTTLRSFSWGNREFTISSDKISLYVGGIPYDTKPMLDILRGSGVDPGKLSPARWISLLRGQPTRLPGCEKPFMLFKAPSGYTLKCLEITRGRNRAFQTEM

SEQ ID NO: 7334 - protein, 126 aa, B.fragilis
PRSMWMRCCLRTGIFWMFTAVACLSRSVRLHPCTRDSGGPGTLVSVGSGRCLWNTWVRKHLIFILRRCGITSSRNVFPFGSASNLECKKWHVWLEYVPRKALTVGERSIVALRALQPTGYVLSMRA

SEQ ID NO: 7335 - protein, 69 aa, B.fragilis
ASTIRHNRARGMHKIELMTRLVGELTRSGMSDSWIRRNLGMDKDELLRLKQISGLAELFADKEFRMAVE

SEQ ID NO: 7336 - protein, 69 aa, B.fragilis
IDNMKVKKVLVCTFLLATCLMNAQAQRRNEILVPDLDGYTTLKCDFHMHTVFSDGLVWPTVRVDDAYRE

SEQ ID NO: 7337 - protein, 439 aa, B.fragilis
KLIVMPTILERLTALFSRDMQAVLRNPRAISMIENPSIRVQMAAIRRDKSVICFIDKPVEKVQLAAVRNAPHNIHFIASPGEKVQLSVIRHKPGYIGFISNPTEKAQLTAVERRPECISLINKPAVKVQLMAVLKDPAHIASIKEPAEKVQLATVQKNPEYIRHIESPTVKVQHMAIQGNADTLRHIKSPADTVQLAAVQAKGETIKYVSEPSEAVQLAAVRNNPMNIRYIENPTEKVQLSVLHADREAAALISSPSEAVRKQAEEMYGLKLEKPADREAEPSSEATESSATRRAPRKKTEQSTQSTRKPSARQVKTAIEKLDKDLREIQEIPQVKNRDKKLIKAFEEFNSSAVPEKKGCDVESILKDLRGKGVKVEAMKAEEWHSLMNGKAIRPSLISGASKPAAKGAPFMLTKTPVGYAVKAVNTVNSLTRQASADM

SEQ ID NO: 7338 - protein, 213 aa, B.fragilis
ASSVVLRMQKAMQQMKIKLTLVLSDITGKSGIRIIEAILAGERNPDKLADMADLQCKTPKGEIAKALEGNWEEDLVFVLRQNYDTFKHFCTQLDRCDTELEKLMENYRTEVAEAGRPSYSPTKKRRDYHKRKRTVGFDVERKAYDMWEVNVFEIPGISHLIVLELMSELGRDFTQNSHPPNSSTVDATSHRTPRYQEEKGYQVTYHIVETMSG

SEQ ID NO: 7339 - protein, 102 aa, B.fragilis
NIASLNQYLSSVEQGQRQHETEQLDTQTRYNEYIITGLRTMWGISTEELNSKFGDRLWKYCSEQAKPYLENGKLKLHNDRLKLTREGIFVSDGIMSALLEIE

SEQ ID NO: 7340 - protein, 520 aa, B.fragilis
SPLTVHRSTTVHRRSFKTLPRFFSLFYLLMFVQRVNYGEISVIPFIFPLYSHYYLLLLRANYETIILYNHMANVIKLRKGLDINLKGKAAEELSTVKEPGFYALVPDDFPGVTPKVVVKEQEYVMAGGPLFIDKNHPEVKFVSPVSGVVTSVERGARRKVLNIVVEAAAEQDYEEFGKKDVSKLDGEAVKAALLEAGMFAFMKQRPYDVIADPTVAPRAIFISAFDSNPLAPDFEYVLKGEEANFQTGLDALAKIAKTYLGISIKQKSTALTQAKNVTVTVFDGPNPAGNVGVQINHVAPVVKGETVWTIGAEAVIFIGRLFNTGRVDLTRTVAVTGSEVVKPAYCRLKVGALLTHVFAGNVTKDKELRYISGNVLTGKQVKPNGFLGAFDSQLTVIPEGDDIHEMLGWIMPRFNQFSVNRSYFSWLMGNKKEYVLDARIKGGERHMIMSGEYDKVFPMDILPEFLIKAIIAGDIDRMEALGIYEVAPEDFALCEFVDSSKLELQRIVRAGLDMLRAEMM

SEQ ID NO: 7341 - protein, 361 aa, B.fragilis
LMKALRNYLDKIKPNFEEGGKLHAFRSVFDGFETFLFVPNTTSKSGAHIHDSIDSKRIMSIVVISLIPALLFGMYNVGYQHFTHTGAQGGFIEMFIYGFLAILPKIIVSYVVGLGIEFVVAQWKKEEIQEGFLVSGILIPMIVPVDCPLWILAIATAFAVIFAKEVFGGTGMNVFNVALVTRAFLFFAYPTKMSGDAVWVAQDSIFGLGNTVDGLTAATSLGVASTATDPNGFPAFSWDMVTGLIPGSIGETSVIAILIGAVILLWTGIASWRTMLSVFVGGAFMGWIFNTVGPDTAMAHMPWYEHLVLGGFCFGAPFMATDPVTSARTETGKYIFGFLIGAMAIIVFTRVSSARSIWSVH

SEQ ID NO: 7342 - protein, 432 aa, B.fragilis
IMCYELHHFSTKHIESGTNDALQFQFRRVDKFAQSKVFGRHFVDTQSFHAVDVPGNDCFDQEFRQNVHREYFVVFAGHNHVAFASLDTGIEHILLLIPHQPAEIRAVDAELIETGHDPSQHFVDVVTFGNHCELAVESAQESVRLHLFACQHIAADVTQLFVLRHVSGKHMGQQCADFQSAISWFHHFRSCNGYGTGQVHPSGIEQTSDEDYGFRADSPHRLTFHYGSYVIDLYPYISGRVRSVKYGYCDIFSLCQGCRFLFDADTQIRFGYFSQGIQSCLEISFFPFQNVFEIGCQRVAVESRDEDSPRSDCRIGNHVIRTLFHKCKHTSFQECSFHSLAIEFGYVLLAEFFVILLCGSLHHDVQHLTACTALHACYNAANGRNKFHFRMILVDKQGSPGHHIFLLFHHHLRSHSWEIIGYECVESRFFHR

SEQ ID NO: 7343 - protein, 355 aa, B.fragilis
ILRCTLSRHYNFFWDQLEKANLFLQGVIDTREKPMDDKMVEWLFRNPLSDGGTFTGVADIVSKYGLVPKEVMPETNSSENTSRMAGLIAEKLREYGLQLRDRAAKGAKQPALEKDKTEMLGTVYRMLVLNLGVPPTEFTWTRKDEKGNPVETAQYTPMSFLEKYGDKNLLDNYVMLMNDPSREYYKCYEIDFDRHRYDGRNWTYVNLPADEIKEMAIASLKDSTMMYFSCDVGKFLNSERGLLDVNNYDYASLMGTTFGMDKKQRVQTFASGSSHAMTLMAVDVKDNKPVKWMVENSWGATNGYQGHLIMTDEWFDEYMFRLVVEKKFATPKVLEILKQKPIRLPAWDPMFAPEQ

SEQ ID NO: 7344 - protein, 812 aa, B.fragilis
IYHTRSFFYICRIPSPIYVKSAGSFHLFTSFSTFICFIGYFCRRYNYRVSERELAEGVLNQNSYTMVKFNAMKTKPLRLLRQKRASWLKSVFVLTCLLLSTSVAMAQTKTVTGTVTDSFNEPLIGASILVKGTSTGAVTDMDGKYSISVTPNDVLVFSYVGYEKQEIKVGQQTVINVTLKDDSQMLAETVIIGYGSAKKRDLTGSITNIKGSEIANKPATNPLSSLQGKIAGVQIVNSGQAGADPEIRIRGTNSINGYKPLYVVDGLFNDNINFLNPEDIESMEVLKDPSSLAIFGVRGANGVIIVTTKRAKEGQTLVNINTSFGWKSVVDKIKMVNAPQFKELYNEQMANQGNALFDFSNWNANTDWQDEIFQTGFITNNNVSITGASEKHSFYLGVGYSHEQGNIKHEKYSKVTINASNDYKITKDIKVGFQFNGARMLPADSKTVLNAIRTTPVAPVYNEEYGLYTSLPEFQKAQMNNPMVDVNLRANTTRAVNYRASGSIYGEVDFLKHFTFKAMFSMDYATNDSRTYKPIIKVYDATFAGNVATLGNGKTEVSQNKQNETKVQSDYLLTYQNSFADGTHNLTATAGFTTYYNSLSGLDASRGQGIGLVIPNNPDKWFVSIGDLATATNGSTQWERTTVSMLARIIYNYKGKYLFNGSFRRDGSSAFAYTGNQWQNFYSIGAGWLMTEEEFMKDITWLDMLKLKGSWGTLGNQNMDKAYPAEPLLENAFAAVFGKPAIIYPGYQLAYLPNPRLRWEKVEAWETGFETNMFRNRFHFEGVYYKKNTKDLLATVPGLSGTRTGHRQSWRD

SEQ ID NO: 7345 - protein, 148 aa, B.fragilis
HIFLSLFRHRMSNSSAGQQGRSFFPARLYVCAMGKPIIKILYFHRRRTNASGWYRLEYIFQRGKKTLRYVLSTRDPEYLVCFCSPCMVERSEMIVFVAELLLEIHKVKYSYLKVTPSYAYATPKYKSRINQMCKKSRYHKTPVIIDGL

SEQ ID NO: 7346 - protein, 101 aa, B.fragilis
VVLYMEQSPKVQNKITKILEILEYIECIPTKYLKHIEGTDGLYEMRITLGSDIFRVFCFFDKGRLVVLLSGFQKKTQKTPKKEIDKAVRLMAQYYDDKKRR

SEQ ID NO: 7347 - protein, 316 aa, B.fragilis
FHTHINFVMGQQSRESLDYEKIILKNMANTNMEHGEIILYQPDNTIKLEVRIENETVWLTQAQIVNLFQSSKANISEHIRNIYDSDELSAESTVRKFRTVRMEGNRKVTRILEYYNLDMIISVGYRVNSKRGVQFRQWSTGVLKEYLLKGYAINQRVEQLENKANTHDRQLEELTNKVDFFVRTSLPPIEGVFFNGQIFDAYVFSAQLIKSAKSSLVLIDNFVDESVLLLLSKRLPGVTSIIYTKQVTPQLELDLTKHNSQYPPIDIRTYQHAHDRFLIIDNLEVYHIGASLKDLGKKLFAFSKMEMPAKIITDLL

SEQ ID NO: 7348 - protein, 89 aa, B.fragilis
HRVKACSLDVNKKFFKCKRLVICAQEPDNLQKTLTMLIEERYKDEDTGSGGVNSLPKPELSYSAGVYFFCLYFSDSLSVTDRNPLKLRF

SEQ ID NO: 7349 - protein, 60 aa, B.fragilis
ANHKHQYIKELSLQERAGIKRRIVELFHIYEEQFYNPLYKTSISQNRNQALRQICCKKTK

SEQ ID NO: 7350 - protein, 121 aa, B.fragilis
VLDNAYTSIFQRQLIPEEVTTLANTSFAATSGKGGTISGVPSSAQYLYFMANIKTDVGQVFPAVEGTTSADARLRLNRLQGTAPSDWTANAFVDYCTPLASALSFYPDVTISTPRYPRMSE

SEQ ID NO: 7351 - protein, 498 aa, B.fragilis
  UNSURE (489),(490),(491),(492),(495): Identity of amino acid sequences at the above locations are unknown.
PMRNLRAILIVLLCLCGIYVQAQQLEIKGLVTSSEDKQPLIGATVAVKGVPGRGVVTDMDGRYTLKIEPSDKILVISYIGMKSSEVKVPKNGVLNVVLQPESLNLDEVVVTGYGNFSKSSFTGSANTLRADMLKNVPVLSVEQKLQGMTTGVNITSGSGQPGANQSIRIRGMGSFNASNEPLFVIDGIPVTSGSMGAGTGADAAYMNNAKTNVMSTLNPADIENITVIKDAAAASLYGSRAANGVILITTKKGAVGRTKVTLSASGGFSNAAVNFRPTLNGEQRREMIYEGLYNSAVDKGLQSPEAYANANIDTYAGIPELGYTDWRKELIRTAHNQNYEVTASGGNERTTFYASLGFNRQEGLVENSNLDRYSARLNMTHKIGSRVEVGGNMMFTQISQEMNEERGSNINPFLCVAVSATPSMPVRDASGNYVGSYAGTNVNPLRDIRTDYNRSRMTRMFSTGYASVDIIKGLKLKEVFTGAAKGAHXXXXSKXFSR

SEQ ID NO: 7352 - protein, 332 aa, B.fragilis
KHGKPVLKPICSVTVSISKEYTIRRIPRTCSPPYRVCREPVPGIGNLGEIENKGVELMASWRDQIGDWGYSVSANLTTISNKVKSLVQDGYSIIAGDKSQSYTMAGYPIGYFYGYKVAGVYQNQAEIDASPVNTLATVTPGDLKFADVNGDGKITPDDRTKIGDPTPDVTYGISLGLSYKNWELSMEMMGQGGNQIYRTWDNYNWAQFNYMEQRLDRWHGEGTSNTQPLLNTKHAINSENSEYFIEDGSFFRIRNLQLAYSFDKTLLSKIRMQALKVYVNIQNLKTWKHNTGYTPQIGGSAIAFGVDNGTYPVPAVYTFGINLTFCLHQGAA

SEQ ID NO: 7353 - protein, 89 aa, B.fragilis
HTFCQLSFRYSIVISTAKVSNETNKSRKRCEQMETPCTFNIYRTWNPTNVEEASSMIYLPYDGCWILYNCMELCALIKELFELHLLSNC

SEQ ID NO: 7354 - protein, 68 aa, B.fragilis
TEYRSKNLNGFARMIEISPGRIIYGRSIQRAIYKTYNFYQKSIKVLIAATEYYSLIRGYLGVEIVTSG

SEQ ID NO: 7355 - protein, 101 aa, B.fragilis
KKEVMMDITTLDQFKDEIYGVKGTPRRDNLERELETLRIGVQIRNARQKKEMTQAQLAERINKKRTFISKVENDGGNLTLKTLIDIVERGLGGKLNIEVKI

SEQ ID NO: 7356 - protein, 373 aa, B.fragilis
IHKFMPRTAKKGFTYYGFDTDHFYDPKVKRLKNKFGMEGWAVFHFIVNEIHRVEGYYMIMDSDGLFDVSDYSRMDEQRIAGIVDYCAELGLFDKGLWRSRQVLTSEEIQNRYMGICKSIHRKPSISDDYLLLNAAAPAATSSPQVAAPCPATHTAPVAEPVRSGEKEKDTELMQAIADFKRRLQEPKSSAGVVREESGIIRENRPQNKIKENISSPNPSGESSYTPEREEERNSLSGKLQYLGVDSNVIQWVRLLKSRYPDFPIEKAISDMEQSNFQLTKENYLYPLIKNYIAKYNADHGSEERARQQEEILRTRRKTLELLGVPVKDQQEILQLASVAPLVLDTALKETWGNKKIKSPTMFLLSRMRRAVSA

SEQ ID NO: 7357 - protein, 125 aa, B.fragilis
IMDTENLRKKYILWSNIVDLRSRGINITRTAHCLGVSRDTVKHLQSLSSDELFRKYQESRRCKLQNYEQAVVSLLFTFPSTSSSRVHDYLKEHYPDFPNVCDKTVHNYVQFIRKKHHLPFRSCRL

SEQ ID NO: 7358 - protein, 209 aa, B.fragilis
YMPTIFQIPTFIQILEFIGTFAFAISGIRLASAKQFDWFGAYVAGVAVAIGGGTIRDVLLDVTPFWMTNPIYLICSALALLWVIFFRKHLIHMHNTFFIFDSIGLALFTVVGISKTIDLGYAFWVAIIMGTMTGAAGGVIRDVFINEIPLIFRKEIYAMACVIGGVIYWGLDRLGVDAALTQVISGCCIFVVRALAVKYQICLPILKGE

SEQ ID NO: 7359 - protein, 103 aa, B.fragilis
KKNLIHNRIEMDINQMIKKADDAYINYRHRCESLAKEAQKYIDWDDKVSCEHLPADGLCILATVPSDCNMSGMPECVCPADPFFSSVKAKEKITPDEFKEISI

SEQ ID NO: 7360 - protein, 446 aa, B.fragilis
NITYGTTANGYSHTGYISAKPIELFGRCKTNTTNGKSECSDKLQNLDKSRNLKDSWHILSFLCAKKQIIPQESVNLFLENCKNTKMKITIVAGARPNFMKIAPITRAIDAAKAQGKRISYRLVYTGVENDNSLDASLFADLHMKAPDAYLGVNGNNPTELTAGIMIAFERELTENPTHVVLVVDDLTATMSCAIVAKKQNIKVAHLVAGTRSFDMSMPKEINRMITDGLSDYLFTAGMVANRNLNQTGTENETVYYVGNILIDTIRYNRNRLIKPVWFSVLGLKEHEYILLTLNRHVLLNNKENLQELMETLLKKANGMPIVAPLHTYVRDAIKALGITAPNLHIMPTQSYLSFGYLMNQAKAIVTDSGNVAEEATFLGIPCITLNTFAEHPETWRTGTNELVGEDPAALGACMDKLMNGEWKQGTLPERWDGRTAERIVQILLGE

SEQ ID NO: 7361 - protein, 165 aa, B.fragilis
MAIENTEGYPLISWRASIIKTKYMNTQRQTGTCRSLSGHAQRHGREVRPSYEISTSQFSDMKVRRLTRNYGFGGYSIYRYLVSEALYKGEYFLPWCEETARAVASYWNASLEDITRIVDGCVQVGLFNDELYRKHGVLTSAAIQQDYLKLCGMGYIQEEFALSAS

SEQ ID NO: 7362 - protein, 88 aa, B.fragilis
NSLEMKITISEKVEQFISERTDKAGGYYEYIDVIAQKHALEAAEMVKQETKEKCQIAFRNFMLRATLANVSGESLDFEKEFADTMSQI

SEQ ID NO: 7363 - protein, 320 aa, B.fragilis
FVLETLKREFFENYNNYMLMTSQEANSIPLEDILSRYGYEPSRRYGGYDMYRSPFRCDSSPSFKVFRNENRWYDFGDSSHGRVVDLVMRIQNCSFPQAMKEIEGLGFSSGMIPQPRPVTVTVQKASGMTLLKIIPVENGHLLDYAASRGIDADIVREHCVEVHYCFEKNPREKYALGFANDHGGFELRNSMFKGCATAKDITGLAAGNRSCAVFEGFFDLLSFKQYAKDHPQMPALRKLDLCVLNSTSIVERSKDFLSRYEKVHAFLDNDSPGREALRKMRHFLPKDTVFVNEAERLYPSCNDFNEFLQKIKCPASGREM

SEQ ID NO: 7364 - protein, 731 aa, B.fragilis
DEVCMKQQYSKLLLVIFLLLSAPQAFAQLKGVITDSISHEPLMYISVFYEGKGVGGISNANGEYKVETRKGWNELTFSAVGYITKKVKIPAGAKELNVVLSPDDVMLEEVVVKPKKEKYSRKNNPAVEFMRKVIDHKKAQKLETNDYYQYSKYQKMKMSLNDVTPESLEKGIYKKFSFLKDQVEVSPETNKLILPISVQETSSKTIYRKDPESKKTIIEGMNSNGVEEFFSTGDMLGTILNDVFADINIYDDDIRLLQRRFVSPIGSGAISFYKFYLMDTVMVDKNKCVHLTFVPQNPQDFGFTGHLYVLDDSTYAVKKCTMNLPKKTGVNFVENLDVVQQYEQLPNGNWVLTDDDMTVDLLVMKAIQGIQVKRTTKYSNYVFEPIEPRLFRLKGNVIKEADMLTKSDEYWAGVRQVPLTKTESSMDLFMNRLEQIPGFKYVIFGAKALIENYVETGTKKHPSKFDFGPINTMISSNYVDGTRFRLSGMTTAKLNPHWFFNGYGAYGLKDKKWKYEGNVTYSFRKCEFFPWEFPKHYISASYRYDVMSPMDKFLDTDKDNVFVAWKTTTVDQMSYVRDATLRYEMETLSGFSVAAMARHRKDTPAGKLQYIRNDAAKTIVPDITTAELGLTLRYAPGETFVNTKQRRRPVSLDAPIFTLSHTTGFKGVLGGEYNFNLTEASIWKRFWLSSWGKVDVTLKGGAQWNTVPFPLLILPAANLSYITQKETFNLI

SEQ ID NO: 7365 - protein, 110 aa, B.fragilis
LIPIQMSKIEDLVKWKTVETVTPNYPDGVIFIKEDTSVEFPLAMVAFPLGGHENGTKKQRERAKLIAAAPELLNALQGMLERFDYNDQAIYSFATKEIDAAKAAIKKAIE

SEQ ID NO: 7366 - protein, 179 aa, B.fragilis
ILHMGHPTMQENDTAKLTPTRIMLLILFIAGTGIFTLQAQNREERKELKEQTVKEKIESENYRIDINTAYPRRGRMIPLTSIYSVTIRNDSVFSQLPYFGRAYSIPYGGGQGLMFNAPIDQYTMAMGKRGAAKINFTAKSPEDQFRFRITIYSNGSSSIDVDMQNRESISFSGDLILPE

SEQ ID NO: 7367 - protein, 65 aa, B.fragilis
RINMAWMVTQKNIKIHTCIDGIDSVEDVRVIISHKKLKALGAKRRVYKDTRESFFLIESDCEIIL

SEQ ID NO: 7368 - protein, 104 aa, B.fragilis
KLLVRNVEFIKTRERAFFLLNPIVKSSSKLEGMKKYLAIEIRGEIFVMNDNDELGGLIDNDVPFTVIGHVCTEECNTTCLHYRQGTCPCKIMKDTFGKVIHVFV

SEQ ID NO: 7369 - protein, 119 aa, B.fragilis
AVTACRRECENKQTIKNPILIKMEIRGKIIAVLPVKDGIGKTTGNEWKSREFVLETEESKPQSVCLQLMNANIERYAVEVGMTVHVKFDISARQWENRWFNTLTAWEVTVIKQKEEQPA

SEQ ID NO: 7370 - protein, 577 aa, B.fragilis
ALWRPCIQKLWLAFPSHPGSGESGVPVLTFKKMRKTRRIIPFVFCGLLISCTTERRLARVRISQPQMKETVADTGKQLPGQIAWTDDKGEEHLVKQVSHDSVTGENMTLIELSEVTVMAKSKQVAERNGKINLDFLVTVPGELINNKWQVQLTPVAYKPSDTLYLDKIFLSGADFAKMQEKGYMRYRAFMNSIIPDSLYMQRLLDSKGYKKALAELEEEYFQAWKHEVIAKERWVDWSDKTNARFALFNYKMERNRQAIAGYNSILEYLPAYWMRREIDGKYIPSKWKMFAEGNYKIRTRSITPEDSAAITERFTDYKKIAENQKRKEQAGAMYEKYVRFPYEPARLDTVIKQGNSFVYYYKQELPATENTKKIELTLDGQILSRDEVRTQLPPSDTITYYISSMVQFLDRTPRYRKKIITRKDEVSLRAYVTYKSGSTGFDEKTGNNKAEIDKVFETIRGINYTGEFLIDSIRMTATSSPEGSSEMNLFLSRERALALKKYLAARTEDREGVDTLFRPRWTGEEWSRLHELVLSDDSLANKAGILRILKETKNPDSREHALREYASDYKRIRERVF

SEQ ID NO: 7371 - protein, 118 aa, B.fragilis
AKGGTAGMKKRSFLLGSLLAFTLGVSAQSYSLRTNVLGLATTNLNLEASMTLGRKWSLHLPVQYNPFRFSRNRQFRNLYVAPGVRYWLLESYMGPFIGMHGTAGYIQCGQPLRQQVPL

SEQ ID NO: 7372 - protein, 109 aa, B.fragilis
RHMGYVSIKRGYCRSQKYRNKYIRWYFEGVTPGLRGQFEAMRSTSAEEVRVAALVHCHNAVIDRYLVTIGMCSAKVQPRNTKTDYSAYHSGMDDGRSISLHRQINGGNV

SEQ ID NO: 7373 - protein, 95 aa, B.fragilis
RMKGTYWYAVDYAGTGHLFTYKPERDAGIWNGEEALQVSQGALREVFPKITWQDSPVVVTLEVLPCEETFRLRLSKNCGYILRKYLRFPREGKNK

SEQ ID NO: 7374 - protein, 61 aa, B.fragilis
RKKGNGEIKGRGWKMGMRWFQGGFGSKLSWWEKGGGNEGEAEKRKIKMAWICEPVTVQNNI

SEQ ID NO: 7375 - protein, 73 aa, B.fragilis
VHRIYISPTIGVPDMKKKSEKQNMNVKNMNKINTEKSPAITLNNRRLHKQNKQYIALSSQTKLTKTLNIRIQI

SEQ ID NO: 7376 - protein, 138 aa, B.fragilis
TVDVSRGEWRYRIKDRNPLNNSHMYFIHYIQTYASVNRKGSELQEYVLQLKDSLIKDREVLDDLKEELHCRIGELDAKYPRTQPLHLDAASGRDSIQWIIHVKGKPDNLICIISITKVRNLLGEGTGFFLGEKTGGKE

SEQ ID NO: 7377 - protein, 432 aa, B.fragilis
LKYKCKRISLNSYLLVRKLFEAIFRLPYSVLLFASHTLRGIPIIARTYHACRLTNGITLELAVLHLTDDTIIVLHYDKFAQTFPSIESALRCHVGIVGQKLHSRFRILLVQLNSNCFNTFLCLVEGGFKFVLRSTYIADHQIVAGIYHVGHPVENPKSGVPGEGDVIGTVYTRIAYRSFGSTTIYGSENSHVGIIRTKPKHTAYSIGKIGTHLSHKNETALLCRDGTLIEILLVAYLESQRREAVRCFIRSGTKIIADVEGGSFIMVAHGILYILNGEFAFRLYEQRHRVIGLSLDIRQIGFTLVGKHIEVAPHTGFTETAGTEIERCISIGKAEVFVHTAEISFFAGKRNNVIRIHAVGLVSHIELMDARLVGMCRNAVVRHSDSYPYGSPDAGTFTYHLHNPYFIGIGNGEDSPCCNIRIPAPVQCLHRG

SEQ ID NO: 7378 - protein, 763 aa, B.fragilis
NLHKGMKNNTLSGAYYPKNPQIKHFFRIMRITLFLLMACVFSLYAGNSYSQNTRVSFAMDNVGLNKVLEEIESQTDYLFIYNSQINVNKLVTIKANKQTVSKVLDQILQNTGIEYKLEGSHIILEKKVEEVHNSSSAVQQQQTKKITGKVVDKTGEAIIGANVKIQGTDKGTITDLDGNFILEVAPKDVLVISYIGYLDTKVPIAGQKQIHVVLSEDNKMLDEVVVIGYGTTSTRKMASAVTAVKGEKLQDLPFNSVAASLAGRATGVIVQSSGGEPGSAPSISIRGGGAPVYVIDGVISDAWDFNTLNPNDIESLSILKDAASLAVYGSRAANGIVMVKTKQGGKGKTAVNYTFNAEFSQPTKLLKKTRGYDYAYNQMLAGINDGLDEADLPFNQEVLDIIKNQSDPYTSGHADTDWLGEGLKTVAPQYKHTVSLSGSGNKVNYYISLGMLNQGSIYTSNALNYDRYTVRSNVNTTFDKIGLKVSLNLNGAYEKKEYPSFSAAKIWEDLYNQSPLNPAYNKDGTYAAVTDHPLAEMDKRSGYNRNYGKFINTQVAADWTLPWLKELTLGAMFNYRLNDSHVKKFSTKAPQYYADGAVYPIGKPTLNEEGYWGESYNFEVSAAYVKTFAEKHTIDAKFVYNVAENTGWNFNAYCGEYLSTVVDQLFAGAAYTQQNGGYSDERGRMGLVGLLKYDFMNRNIVEGSFRYYGSDNFTPRHRWGFFPSGAEAWAISEEPFFKEWEQHVFNLLKLRPFLWTDPYGKWE

SEQ ID NO: 7379 - protein, 70 aa, B.fragilis
FGGKTALQDLIKRGFRVPPETALSWDYGGNSFILWDWNIGFFSTNRFVKGHLRNISYYRKPKGGVNIIPR

SEQ ID NO: 7380 - protein, 397 aa, B.fragilis
  UNSURE (387): Identity of amino acid sequences at the above locations are unknown.
PAVKTLNWCRNTDITAWRVFTIADPNEIWIMEMIGKGPGIRGAVWVAVRVPDDCISAHANQSRIHQFDMADKANCMYSNDVISFAREKGYFSGVNKDFSFADAYAPLDFGARRFCEARVWSYFNMFTDQGEAYLPYIQGKTNDPMPLFVKPKRKLSVQDVKNAMRDHYEGTALDISNDFGAGPYKTPYRLSPLTFKVGDQEYFNERPISTQQSGFVFVAQMRANLPDAVGGVLWFGTDDANMTVFTPVYCCTTKAPVCYTRVDGADYITFSWNSAFWIFNWVANMVYPRYDLMIGDVRATQNELETTFNEAQEGIEAVAVKLYEKNPETAVKFLTNYTDMTAQSTFDTWKRLGEFIIVKYNDGVIRKMKDGKFERNAIGQPAGVVRXGYYRNSSKSM

SEQ ID NO: 7381 - protein, 586 aa, B.fragilis
NIDRTMGNEELIKQVTEKAEKWLTPAYDAETQAEVKRMLENEDKTELIEAFYKDLEFGTGGLRGIMGVGTNRMNIYTVGAATQGLSNYLNANFKDMKQISVVVGYDCRNNSSLFAKISADIFSANGIKVYLFEEMRPTPEMSFAIRHLGCQSGIILTASHNPKEYNGYKAYWDDGAQVLAPHDKGIIDEVNKIASAADIKFQGNPDLIQIIGEDVDKIYLDMVKTVSIDPEAIARHKDMKIVYTPIHGTGMMLIPRALKMWGFENVYTVPEQMIKDGNFPTVVSPNPENAEALTMALNLAKEIDADLVMASDPDADRVGIACKNDKGEWVLINGNQTCLMYLYYIITQYNKLGKMTGNEFCVKTIVTTELIKKIADKNHIEMLDCYTGFKWIAREIRLREGKKKYIGGGEESYGFLAEDFVRDKDAVSACCLIAEVAAWAKDNGKTLYQLLMDIYVEYGFSKEFTVNVVKPGKSGAEEIKAMMENFRANPPKELGGSKVVLSKDYKTLKQTDAAGHVTDIDMPEPSNVLQYFTEDGGKVSVRPSGTEPKIKFYIEVKGEMGCRNCFATADAEATEKVEAVKKSLGI

SEQ ID NO: 7382 - protein, 64 aa, B.fragilis
  UNSURE (37): Identity of amino acid sequences at the above locations are unknown.
RTASSSVMPLVNLQAWYVRAIIGIPRRVCEANRRTLXGNRNIASKSFLTKRYEFKLILLHLYFN

SEQ ID NO: 7383 - protein, 81 aa, B.fragilis
ELFIQENDSDRFPVTLPIIVETGKISTRIGDIVRVEGTAQVLGFLENSPKRNAPSNEGQGIPIILWIHLYDAKYPSKEYLK

SEQ ID NO: 7384 - protein, 314 aa, B.fragilis
YIVMDKDLLYNFYKGKVSIEEGQRVKAWVEASDENERAFYRERKIFDALMLNNPLPVKKTSFFNFTHYKKIEWLKIAMAVILTFLLSYFYQEYKAGLDSVAMSTISVPEGQRTNVTLPDGSNVWLNACTTIQYPTSFNSRERFVILKGEAYFDVKKNKSRPFIVHTDAYSIEVLGTKFNVDAYPETEKFETTLMHGSVKVTLKADSSQTVILKPDHKLSLEKGRFVMTKVEDYNPYRWKEGLICFSDESFPNIMKDFEKYYGVKIVIENKNVLQINFTGKFRQTDGIDYALRILQKNIDFQYEKDNEKQIIYIK

SEQ ID NO: 7385 - protein, 195 aa, B.fragilis
SYVMHIKTNPKDKMSFNQLYNDYQTRFLNFANTYVRDWDVAEDITTEALIYYWENRNTLSEVSNIPAYILTIIKNKSLNYLRHLQIREEHSENIRKYIEWELNARIVSLDACEPYELLVKEMQELIQQTLDKLPERTRKIFILSRYENKSYKEIAALMNMTTKGVDFHICKALKALQINLKDYFPLFLYFLMKFH

SEQ ID NO: 7386 - protein, 629 aa, B.fragilis
EDRLKTMEENELIPVDNNPVEYTDDNIRHLSDMEHVRTRPGMYIGKLGDGSHTEDGIYVLLKEVIDNSIDEFKMQSGKKIEIRVEENLRVSVRDYGRGIPQGKLIEAVSVLNTGGKYDSKAFKKSVGLNGVGVKAVNALSSNFEVRSYRDGKVRCATFTKGELVTDHTEDTEEENGTYIFFEPDETLFLNYSFRPEFIETMLRNYTYLNTGLAIIYNGQRILSRNGLVDLLNDNMTATGLYPIVHLKGEDIEIAFTHTGQYGEEYYSFVNGQHTTQGGTHQSAFKEHIARTIKEFYNKNQDYTDIRNGLVAAIAVNVEEPMFESQTKIKLGSTNMSPGGITVNKFVGDFIKQEVDNFLHKHADIAEIMLQKIQDSEKERKAIAGVTKLARERAKKANLHNRKLRDCRVHLNDVKGKGLEEESCIFITEGDSASGSITKSRDVNTQAVFSLRGKPLNSFGLTKKVVYENEEFNLLQAALNIEDGIEGLRYNKVIVATDADVDGMHIRLLLITFFLQFFPDLIKKGHVYILQTPLFRVRNKKKTLYCYTEEERVNAIKELSPNPEITRFKGLGEISPDEFRHFIGKDMRLEQVSLRKTDTVKELLEFYMGKNTMERQNFIIDNLVIEEDIA

SEQ ID NO: 7387 - protein, 160 aa, B.fragilis
SGYRRRHRINMRRAIFPGTFDPFTIGHYSVVQRTLTFMDEVVIGIGINENKNTYFPIEKRVEMIRKFYKDEPRIKVESYDCLTIDFARQVDAQFIVRGIRTVKDFEYEETIADINRKLAGIETILLFTEPELTCVSSTIVRELLGYNKDISMFIPKGMEM

SEQ ID NO: 7388 - protein, 146 aa, B.fragilis
HNTRILPSIRVMVRLAKNNPKNQSRMPEPTKVKRSKLLMPVSRKGVMEALHPNTKKMLNRLLPITLPMAISGFFFKAATIDVASSGREVPPATSVSPITDSLTPRCRAMLLAPSTNHCPPKISPANPPRMKSTDFHIGRLLISSSG

SEQ ID NO: 7389 - protein, 381 aa, B.fragilis
IQAMAITIKKVSTKRELKKFIRFNYELYKENPYSVPDLYDDMLNTFNKKKNAAFEFCEAEYFLAYKDGKIVGRIAGIINHRANATWNKKDVRFGWIDFIDDLEVSSRLLQTVEEWGKSKGMENIQGPLGFTDFDAEGMLIEGFDQLSTMATIYNHPYYPQHMEKLGFEKDADWVEYKIYIPDAIPEKHQRISDLIQRKYNLKIKKYTSSRKIAADYGQAIFELMNEAYSPLYGYSPLSQRQIDQYVKMYLPIVDLRMVTLITDAEDKLIAVGISMPSLSEALQKSHGRLLPLGWYYLLKALFMKRRAKMLDLLLVAVKPEYQNKGVNALLFSDLIPVYQKLGFIFAESNPELEMNGKVQAQWEYFKTEQHKRRRAFTKKID

SEQ ID NO: 7390 - protein, 323 aa, B.fragilis
FKGIDMDILLLIGGLLLILIGANCLTDGAASVAKRFRIPSIVIGLTIVAFGTSAPELTVSVSSALKGSADIAVGNVVGSNIFNTLMIVGCTALFAPIVITRNTLRKEIPLCILSSIVLLICANDVFLNKASSNILSISDGLILLCFFTIFLGYTFAIASPTNNTQPEEEIKSLPMWKSVLFILGGLAGLIFGGQWFVEGASNIARHLGVSESVIGLTLVAGGTSLPELATSIVAALKKNPEIAIGNVIGSNLFNIFFVLGCSASITPLRLTGINNFDLFTLVGSGILLWFFGLFFAKRTITRIEGSILVLCYIAYTTYLIYQI

SEQ ID NO: 7391 - protein, 306 aa, B.fragilis
THVIMKRIIYLLIGLCSVLGLQAQNFGSPAMRKLQLAEFAISNLYVDTVNENKLVESAIIEMLAQLDPHSTYSDAEEVKKMNEPLQGNFEGIGVQFQMIEDTLLIVQPVSNGPSEKVGILAGDRIIAVNDTAIAGVKMGTEEIMGRLRGPKDSKVNLTIIRRGVKEPLLFNVKRDKIPILSLDAAYMIQPKIGYIRINRFGATTAEEFLKALKELQKKGMKDLILDLQGNGGGYLNAAIDLANEFLGQKKLIVYTERPSAQRNEVFGQGNGNFRNGRLVELVDKYSLWAVKIGTGAIQDWEQRNGG

SEQ ID NO: 7392 - protein, 209 aa, B.fragilis
SKETINVKLNFKREFMKRKLMLLLTCLFMGIGLVTAQTQKVTGVVISEEDGQPVVGASVLAKGTTVGVITDVDGKFTLSGIPSSAKTLQISYIGMQTAEVAIAPNIRVILKTDSKALDEVVVVAYGTQSARTVTASVSTVRADALKDVPSVSFDQMLQGRASGVSITTPSAGVGQAPIVRVRGVNSITSGTSPLYVVDVFTGGAMIARG

SEQ ID NO: 7393 - protein, 398 aa, B.fragilis
LKIKEMDKIIYSLVYNRKKSLNKKGMALVQVEAYLNRKKKYFSTKVYLSPDQWDFKKRMVKNHPNADAINHMLYEFMAEIEKKELGLWQQGKQISLDSLKNSMENQDDSTSFIAFFRNEIAKSSLKESTKRNHLSTLELLRSYKKDVSFSELTFEFISSFDHYLQQKGYHTNTIAKHMKHLKRHINVAINKEYMEIQKYAFRKYKIKSVENNHTHLSPEELGKIESLELGGRFTKLEKTKDAFLFCCYAGLRYSDFTNLSPENIVKMHQETWLIYKSVKTNTEVRLPLYLLFEGKGIEVLNKYQDDLADFFKLRDNSNVNKELLIIAKLSGLNKRISFHTARHTNATLLIYSGVNITTVQKLLGHKSVKTTQVYTNIMDITIVRDLEKSKNNRKVSYM

SEQ ID NO: 7394 - protein, 156 aa, B.fragilis
KLKPMKKNLYWMAAAFITLTAVGCTNAKKADVSAAGSDTTQVIDMHTAETSLDYYGVYKGTVPAADCPGIELTLTLKKDRTYTYHWAYIDRKDADFDETGTFTVKDNLLTLTEKGGEVSYFKVQEGSLVMLNNEKQPATGTLADAYVLKQEEVFLD

SEQ ID NO: 7395 - protein, 738 aa, B.fragilis
THFTKKYACMQRAKKNYLIYAVMLLLFGALIYMAIEEGDRFSHHAVASSTVAEDTPFTMFCQFVTDNLHHPLSILLIQIIAVLLMVRLFGFLFKHIGQPGVIGEIVAGIVLGPSVLGYFFPDVFQALFPPESLTNLELLSQVGLVLFMFVIGMELDFSVLKNKINETLVISHAGILVPFFLGIVASYWIYEEYAAAQTAFLPFALFIGISMSITAFPVLARIIQERNMTKTSLGTLAIASAANDDVTAWCLLAVVIAIAKAGTFASALYAIGLTALYIIIMFMVVRPFLKKVGEVYANQEVINKTFVALILLILIISSTLTEIIGIHALFGAFMAGVVMPPSIGFRKVMMEKVEDIALVFFLPLFFAFTGLRTEIGLINSPALWGVCLLLITVAVAGKLGGCAVAARLVGESWKDSFTIGTLMNTRGLMELVALNIGYEMGVLPPSIFVILVIMALVTTFMTTPLLHLVERVFARREERLSAKLKLVFCFGRPESGRSLLSIFFLLFGKKMKAAQVVAAHFTVGTDLNPLNAEQYARDSFSLVDEKASELGLSVENRYRVTDKLVQDMIRLARKERPDMFLLGAGSKYRPDTAGSNGVLWLSLFRDKIDDVMEQVKCPVAVFVNRGYSGSSPVSFVLGGVIDAFLLTYLESMLEGGAQVHLFLFDTDDEAFRQSTDPILAKYSSQIRTRPFSGAANLTSAAKDGLLVMSHLSYTKLSEEEEVFRDLPSLLVIRRPKKG

SEQ ID NO: 7396 - protein, 117 aa, B.fragilis
NEGTTAAGEDANLEQTRLQQQSLNEQMLLELTRAANNLDEAKLESELADRSLQQAEENRRVSKNQYEVGLETLSDHLEGQALWQQAYETKVNAHFQLYLNYVAYLKAAGILYNKINL

SEQ ID NO: 7397 - protein, 182 aa, B.fragilis
YDMAKIQIKSEKLTPFGGIFSIMEKFDSMLSPVIDSTLGQRCSSIFGYQFSEIVRSLMSVYFCGGSCVEDVTSQLMRHLSYHPTLRTCSSDTILRAIKELTQENISYTSDQGKTYDFNTADKLNTLLINALVSTGELKEIEEYDVDFDHQFLETEKYDAKPTYKKFLGYRPGVYVIGDKIVY

SEQ ID NO: 7398 - protein, 83 aa, B.fragilis; identical to SEQ ID NO: 6082

SEQ ID NO: 7399 - protein, 358 aa, B.fragilis
RLKKQNKRMTGIEKTVTNRSGAGALVLCTILFCLCACTEDASYTAGVWYRRSDFDGVARTDAAGFTIGNKGYICGGYNGKTTRLADTWEYDIDNDWWTQRADMPGTVRNAATGFPVGNKGYITTGYNPDQKYLADTWEYDPETNTWRQMDDFKGGARYYALGFGIDNYGYVGTGYNDNYLKDFYRFDPTAAAGSQWTIVNGFGGQKRQGATAFVINGKAYVCGGQNNNSDVSDFWRFDPSAATPWTQLRDIANTSDDDYDDDYTSIVRSYGVSFVIDGKAYLTLGSTAGGSYYSNYWIYDPETDLWEGDDLTAFEGSTRIHAVCFSTGTRGIIATGGSGSSSYFDDTWELKPYEYEEE

SEQ ID NO: 7400 - protein, 402 aa, B.fragilis
PMKRNLILLLTLCHSTLLIYSQNTTNSPTSMFGLGELSTGEGGQYSGLGGAGIALQSYNFLNTANPASLTAIEGQRFLIDAGVMGAYKVYTQTGTSNHSLVGNLNNLSIGCRITPRWYGAVFMAPVSSVGYAITLDQDITGTGSSTVSSLFEGEGGLSKMGISTAYRLFKGFSVGANLSYVTGTIKQTETQGSINVEESSYKHAFYADFGLQYKFSLSRNKYLVAGAVYGYSQDLAQDNTLSVSSTSGNESIDESQRHVRQCLPQFVGAGLAYNSPHWTLTVEYKYTDWSRMKSSQSNVRFENQHRLSAGTAYTAGNIYRNPVKLLLGAGVSNSYIVIQKKKATNYYVSAGSNFTLYNGNVLSLGVKYSDQLHLPNGMQRERGVTLFFNFTFSERTYRAKIQ

SEQ ID NO: 7401 - protein, 466 aa, B.fragilis
IVPISRSFFYRENKSSSFAAKMIRFMKRKNLSLFFITLFISLLASCRDELSTAGGKWVESSLRTIQTDTCTVRLSTILSDSLATSGDTVCQIGTIDDPVWGKIEAAFYVEYDVPTVSFSENADYRFDSITIRFYSSGNYLGDTLSPQRISLHSLSENLSLDEGYLYTTSKVSYHSTPLASFTFTPTPGETIREHEIRLPDEWGVEWFEHFQAGSREMESQEYFRDYFKGIAFIPEEGGNCVNGFMVNDSSLCITLYYHQTETDATELSADFLPNSDLRFNQVSCDRSRTALSSLQSGLNNGLPSEKSEHQSYLQGLTGMYINIDFPFLNDLRAEGRLVTIESALLRLYPVKGTYGKQYPLPESLTLYTADENNVTEDVVTDISGSSVQTGSLVTDEMMGEDTYYSFDITSFLQSNLGTVGYNRKILQLMLPDNLFFTTLNGVVFGDAGHPDSNPVKLTLLYKTYNP

SEQ ID NO: 7402 - protein, 87 aa, B.fragilis
GRRARPIAACTMGEKTVDEEVPVLFEYPLMNDVMRIVKEEEPEILSQSYDMDASMTLRIRQSAMPRLRSRLEKVETARITDEQEGNG

SEQ ID NO: 7403 - protein, 419 aa, B.fragilis
SAVLMATIKPFKGIRPPQDLVEQVASRPYDVLNSEEARAEAAGNDKSLYHIIKPEIDFPVGTDEHDEKVYAKAAENFRLFRDKGWLVQDDKENYYIYAQTMNGKTQYGLVVGAYVPDYMNGVIKKHELTRRDKEEDRMKHVRVNNANIEPVFFAYPDNAVLDAIIRKYTAQKPVYDFIAPGDGFGHTFWVIDNSEDIAVITKEFAAMPALYIADGHHRSAAAALVGAEKAKQNPNHRGDEEYNYFMAVCFPANQLTIIDYNRVVKDLNGLTPAEFLTALGKNFEIEEKGKEIYKPNALHNFALYLDGKWYSLTAKPGTYDDNDPIGVLDVTISSNLILDEILGIKDLRSDRRIDFVGGIRGLGELSRRVDSGEMKVALALYPVSMKQLMDIADTGNIMPPKTTWFEPKLRSGLVIHELE

SEQ ID NO: 7404 - protein, 211 aa, B.fragilis
NMSQLFSKKNKEVFATPLGLNNPVTVQVLGICSALAVTAKLEPAIVMGLSVTVITAFSNVVISLLRKTIPNRIRIIVQLVVVAALVTIVSEVLKAFAYDVSVQLSVYVGLIITNCILMGRLEAFAMANGPWESFLDGVGNGLGYAKILIIVAFFRELLGSGTLLNFRIIPESFYKMGYINNGLMLMPPMALIICACIIWYQRSRCKELQEK

SEQ ID NO: 7405 - protein, 164 aa, B.fragilis
FVANSFCVPDYSNMYVFPYLCRRSNYYQETDMGRKEEYKLQNEQFMQTLRTEADVHELPCGILYKVLEEGTGAATPRSNSVVSVHYKGTLINGREFDNSWKRNCPEAFRLNEVIEGWQIALQKMRVGDHWIVYIPYNMGYGTRTSGPIPAFSTLIFEVQLLGIA

SEQ ID NO: 7406 - protein, 429 aa, B.fragilis
SKKNKTMTSLILASIGVFLVVIILLVIILLVAKSYLSPSGEVTITMNGEQQLKTSQGGTLLGTLSANNVFLSSACGGKGSCGQCRCQVLEGGGEILPTETGFFSRKEQADHWRLGCQVKVKQDMSIKIDESILGVKEWECEVISNKNVATFIKEFIVALPPGEHMDFVPGSYAQIKIPTFSMDYDKDIDKSLIGDEYLPAWEKFGLLGLKCRNDEPTIRAYSMANYPAEGDRIMLTVRIATPPFKPKDQGPGFMDVMPGIASSYIFTLKPGDKVTMSGPYGDFHPILDSKNEMMWIGGGAGMAPLRAQIMHLTKTLHITDRTMNYFYGARALNEVFYLEDFLQIEKDFPNFKFHLALDRPDPAADAAGVKYTAGFVHNVIYETYLKNHEAPEDIEYYMCGPGPMSKAVEKMLDDLGVPSKNLMFDNFGG

SEQ ID NO: 7407 - protein, 152 aa, B.fragilis
KKIDRMAFEATKREWSELYVFFRLLADGKVSLGTPQAKKEDEKYRPIAMIQREEHDGTRRYYIEEEVIRMEGEKVEKSIPREDFATVADLILDAIKNSSADEVTSPDGVEEFLDEAGIFDLEARTEDRTDFSIAFWHPEAPLAGCLRHGPGE

SEQ ID NO: 7408 - protein, 471 aa, B.fragilis
SFGDHHKRNCFRVVRKQFFFIFVSLFKNVEKTMNGLKDILERLKIEQLNPMQEASVEAFDKGGEDLILLSPTGSGKTLAFLLPLVGSLKADVKGVQAVVLVPSRELALQIEQVFKAMGTEFKAMSCYGGRPAMEEHRTMKGMQPAVIIGTPGRMNDHLSKQNFDASTVSLLVIDEFDKCLEFGFQEEMATVIGQLPDLKRRFLTSATDAEEIPQFTGLNRTIKLDFLTNDVEESRLRLMKVVSPAKDKIETLYKLLCTLGSSSSIVFCNHRDAVDRVSALLTEKGVSNERFHGGMEQPDRERALYKFRNGSCPVLVSTDLAARGLDIPEVEHIIHYHLPVNEEAFTHRNGRTARWDATGTSYLILNPEEHVPDYIPSELEIFDLPENTPRPAKPQWVTIYIGKGKKDKLSKIDIAGFLYKKGNLAREDVGAIDVKDHYAFVAVRRPKMKQLLTLIRGEKIKGMKTVIEEAD

SEQ ID NO: 7409 - protein, 183 aa, B.fragilis
YGLWHTYQWPDSGFFNFDFRGTITGYSLNHQKKIPDIMTEDTYKTITEVSEGTYTEKRSKFIAIALPVRTLEEIKVHLEAYQKKYYDARHVCYAYMLGHERKNFRANDNGEPSGTAGKPILGQINSTELTDILIMWVRYSKGIKLGTSGLIVAYRAAARGPSLHAPWERKLWTRKYPYFSSIL

SEQ ID NO: 7410 - protein, 214 aa, B.fragilis
ESKRKIMEQLLSLFVRSIFVDNMIFAFFLGMCSYLAVSKNVKTAVGLGIAVTFVLVVTLPVNYLLQTKVLAANAIIEGVDLSFLSFILFIGRMAGFGQLVEMVVERFSPSLYASLGIFLPLIAVNCAIMGASLFMQQRITMDPSNPQAITGVGSAVVYALGSGIGWLLAIVGLAAIREKMAYSDVPAPLKGLGITFITVGLMAMAFMCFSGLKL

SEQ ID NO: 7411 - protein, 84 aa, B.fragilis
KLRGPFQPRGEDGAEIAGAAFQNEFSGKKVLKDGQVALAVEKNGKVTDPAYQVDGISGGTITSKGVDAMIKACLSQYDKFLTNN

SEQ ID NO: 7412 - protein, 365 aa, B.fragilis
RNCITKNTHQMKKHNFSAGPSILPREVIEETAKAILDFNGSGLSVLEVSHRGKDFQAVMDEAVALFKEILNIPEGYSVLFLGGGASMQFCMVPYNFLEKKAAYLNTGVWAKKAMKEAKGFGEVVEVASSADANYTFIPKDFTIPADADYFHVTTNNTIYGTELKGDLDSPVPMVADMSSDIFSRPVDVSKYICIYGGAQKNLAPSGVTFVIVKDDAVGKVSRYIPSMLNYKTHIDGGSMFNTPPVLPIYSAMQTLRWIKAQGGVKEMDRRATEKADMLYAEIDRNKMFVGTAAKEDRSRMNICFVMAPEYKDLEADFLKFATDKGMSGIKGHRSVGGFRASCYNAMPKESVQALIDCMQEFEKLH

SEQ ID NO: 7413 - protein, 327 aa, B.fragilis
MTAFGVCGILCGEFSQNRIREMKILVATEKPFAKIAVDGIKKEIEGAGFELALLEKYTDKAQLLDAVKDANAIIIRSDIIDAEVLDAAKELKIVVRAGAGYDNVDLNAATAHGVCVMNTPGQNSNAVAELVFGLLVYAVRNFYNGTSGTELMGKKLGIHAYGNVGRNVARIAKGFGMELYAYDAFCPKDVIEKDGVKAVDSAEELYKTCNIVSLHIPATAETKNSINHDLLANMPKGAILVNTARKEVINEDELIQLMEERPDFKYITDIMPAANTKFAELFAGRYFSTPKKMGAQTAEANINAGIAAARQIVGFLKEGCEKFRVNK

SEQ ID NO: 7414 - protein, 110 aa, B.fragilis
IVEFYNLRGGKERIFDDMNNGFGWSRLPKSFMAENTVFLLLTALIHNFYKTIMSRLDTKAFGLKKTSRIKAFVFRFISVPAKWIMTARQYVLNIYTENRAYAKPFKTEFG

SEQ ID NO: 7415 - protein, 86 aa, B.fragilis
IVTLCVLTFKLLYQMDKNEIGLNAGKVWQLLSNNDKWSYGNLKKKSGLKDKDLGAALGWLAREDKIEFEQEEEELYVYLCVNVYIG

SEQ ID NO: 7416 - protein, 61 aa, B.fragilis
IYEPFSPGKLANKEWDGRSDGEICRKLEEKKGDIAGHNRNALPGSRRTYPDTFLSVPSQNT

SEQ ID NO: 7417 - protein, 271 aa, B.fragilis
  UNSURE (271): Identity of amino acid sequences at the above locations are unknown.
YDMAKIQIKSEKLTPFGGIFSIMEKFDSMLSPVIDSTLGQRCSSIFGYQFSEIVRSLMSVYFCGGSCVEDVTSQLMRHLSYHPTLRTCSSDTILRAIKELTQENISYTSDQGKTYDFNTADKLNTLLINALVSTGELKEIEEYDVDFDHQFLETEKYDAKPTYKKFLGYRPGVYVIGDKIVYIENSDGNTNVRFHQADTHKRFFALLESQNIRVNRFRADCGSCSKEIVSEIEKHCKHFYIRANRCSSLYNDIFALRGWKTEEINGIQFEX

SEQ ID NO: 7418 - protein, 175 aa, B.fragilis
FYFYVFSFGGTSVVDAQTKGIVVDGVKGRSLSDVNIYLQKDSVEIGSTDRNGEFMFSRDQITISDTIVFSHVGYFPLKCTLSELQHLGYKVVLHEHPQLLHEVVVSGERPPFFLEWTSLSPLPKPLYSFGGFLHAGKIYVVAGDETLVRMVTDKHRRSTSLLSFTMTACMRWEEL

SEQ ID NO: 7419 - protein, 115 aa, B.fragilis
SVKYAMVKVILFPSLLFCFIIDAHSYFNTIYRNQYINKRGNEKKTERPNTLDPLRINLTYVNGNYISMRSYIYPLTVTPTHYVKRIPPVEKSCIFHIQSSQFVYAHCICFNMVDL

SEQ ID NO: 7420 - protein, 83 aa, B.fragilis; identical to SEQ ID NO: 6082

SEQ ID NO: 7421 - protein, 113 aa, B.fragilis
IKLNYSVAELRFIKTFPGYYYLQYTYKEQVLGEIWSRKTNQIVSRSILTRPNQFTTLRGIRFRFPSGTVIRLLPDYISGNKIAFFIPADEAMGEIPGIKIREDDNPILMVMEL

SEQ ID NO: 7422 - protein, 161 aa, B.fragilis
RKVDRRDRRGAETFAGKCEGKVASYPQKDLCIDERKGVMMETNKKHTENALKQALQRRQPGRLPSNFNYRMMEQIRLEAEKQQKRKERVMLCGMIAGILLLLGVGVYTLVFKLEFNFKEYLSGMDFSHADSSLLAFYSYIATLVLLLLGLDYWLRKKKFHS

SEQ ID NO: 7423 - protein, 198 aa, B.fragilis
TYKRTDKMKIVAFNGSPRKGGNTELLIKEVFKPIQEAGIETELVQLGGKLLRGCASCYTCFKTKDGKCAIKTDPMNEFIQKAQEADGIILASPTYYGSVSAEMKAFMDRLGLTTIGQGRTLTRKVGAAVISVRRGGAVTVYDELNRFMLGSGMIVPGSTYWNFGIGEMPGEVFDDAEGLRNMKDLGVQLAWLLKAIHN

SEQ ID NO: 7424 - protein, 339 aa, B.fragilis
HTMRSFASDNNSGVHPAIMEALTRANRDHALGYGDDLWTEEAVRKIKETFVADCEPLFVFNGTGSNVIALQLMTRPYNSILCAETAHIYVDECGSPVKMTGCQIRPIATPDGKLTPQLITPYLHGFADQHHSQPGAIYLSECTELGTIYTPDELKAITSLAHQYGMWVHMDGARIANACASLGLSLRALTVDCGIDVLSFGGTKNGLMMGECVIVFDDSLKSEARFIRKQSAQLASKMRYLSCQFTAYLTDELWLKNATHANAMAKRLADALEQVPGVRFTQKVESNQLFLTMPRAETDRMLQTYFFYFWNEEADEIRLVTSFDTTEEDIDTFIRILKN

SEQ ID NO: 7425 - protein, 736 aa, B.fragilis
TTFGPSSPVVKTSSYITAQTVIENPPFETRQGSIHTISKIELSPTETRLTIRTVFRPQWWTSLDSLTYIYAPESKKQLYPLRIEGRKFGEQVTTPASGIIEDDCVITYPPLPEGTTRIDWMDDNLNSETNTYGILLVKPQETKEQASLRKIHGNWQQADAQNGWDIGIYDSLAIMDNRFWKYDLCRKQGKKFKLNLKDETGEQCLLEITQEKDGNLCIGKNGGKANKYIRAGRPQRNYAATTAATAPQTAFFRKDTVHIRGFLDGYSPKLGFTTVLIYTDNHITNEGTPAVVTIHPDGRFESDFVVNYPGVHHLSMGNNWMTFYIRPGETLMLYINWEDHLDYLRQRRLKPMLTETLYMGPSSSINQELMPCEPLFSKDYHIIQNACKTLTPSEFKTQQEPMYKLWMHRVDSLEQSKTLQPEAMQMLKNDVMINYGAWLLEFILMRDMDARKDTTNTILKIKETPDYYDFLKAMPLNDVRSIGCNNFSTFINRIEFMNPFLPASWQIKNGTDDRMEKYAESWRKKKEILQDTTGMPFPVVGELILTRSYPFLAKTLENEKKAFALLDTLKGYLHDPFLVAEAERMYRQVYPVQGNKPQELPAGKGTDIIRKLTAPYLGKFVIIDFWATSCGPCRASIEQHADLRKDYRNSPDIKFIFVTSNQDSPEKAYENYVEKHLKEETIFRLPQSDYNYLRELFHFNGIPRYVLLDRDGKLLDENFPMYNIELFLKESKIRKE

SEQ ID NO: 7426 - protein, 186 aa, B.fragilis
PDIMVQNDETQYIARILDGDTECFSAFLDRYSRPLYVLIVQIVGCSEDAEELVQDVFLKAFRCLGSYRGECRFSTWLYRIAYTTAVSATRKKKQEFLYIEENTINNVPDEKADDILYPTDDEERTARLIQAIDLLNVEEKALITLFYYEEKSIEEIGEVLKLSPGNVKVKLHRTRKKIYVLMNGKE

SEQ ID NO: 7427 - protein, 146 aa, B.fragilis
KHTIMMDFITAPLIVGIITLGIYKLFELFACRRERITLIEKLGEKMSQTDLELNGKICLPDFNRPQLSFGALKGGCLLLGVGLGLLVGFILSYVSFSPYDLDRLDRGYTREMVGVIYGSCTLLFGGAGLVASFLIEQNFAAKKKEK

SEQ ID NO: 7428 - protein, 601 aa, B.fragilis
IYNFLSQLPVIATSNHLNLTINMAKKVAEQLVDTLIEAGVRRIYAVTGDSLNEVNEAVRQNEVMKWIHVRHEETGAYAAGAEAQLTGLPGCCAGSSGPGHVHLINGLYDAHRSGAPVIAIASTIPTGEFGTEYFQETNTVKLFNDCSFYNEVATTPEQFPRMLQSALQTATTRKGVAVVGLPGDLAKKPAVKVESSEQIYPLASSVCPAEEDLIRLAGMLNHYERITLFCGIGCKGAHEEIIRMSETLNAPVAYTFKGKMEVQYDNPYEVGMTGLLGMPSGYYSMHEAEVLVMLGTDFPYSAFLPDDIKIVQVDIKPERLGRRAKVDLGLCGDVRSTLRALLPMLQQKKNDSFLRKQLKRYEGVKKDLAAYTEDKGKMDQIHPEYVMSEINNISSDDAIYTVDTGMTCVWGARYLQATGKRHMLGSFNHGSMANALPQAIGAALACPDRQVIALCGDGGLSMTLGDLETVVQYKLPIKIIVFNNRSLGMVKLEMEVDGLPDWQTDMLNPNFAQVAEAMGMTGFNVSDPEEVLNTLCNAFELEGPVLINVMTDPNALAMPPKIELGQMVGFAQSMYKLLINGRSQEVIDTINSNFKHIREVF

SEQ ID NO: 7429 - protein, 89 aa, B.fragilis
LCDLKDGVSYPGLASDGSYIYIFENRNLQVYHIETDTMRIYELAALDVENAGLFYWRNTLYIVGGCNCQGIYVAPHRDVIAIDVSQINP

SEQ ID NO: 7430 - protein, 90 aa, B.fragilis
TQAVDFTSFIYDDCLYAMGGAIREKAYSNKKHTLDLKRGVWYELEGTLPAGRCGRMNGILVGDKVYFWGGYHTAPMWTAASYDLRTGEWR

SEQ ID NO: 7431 - protein, 70 aa, B.fragilis
SSTSGVTCCEASLHAQSGLQWLSTINPSKFRSIACWQRGATSSRFPPMWLGSQKIGSSGMRRRNSIGMCH

SEQ ID NO: 7432 - protein, 431 aa, B.fragilis; identical to SEQ ID NO: 6067

SEQ ID NO: 7433 - protein, 262 aa, B.fragilis
QIIHIMRILILGAGKMGSFFTDILSFQHETAVFDVNPHQLRFVYNTYRFTTLEEIKEFEPELVINAATVKYTLDAFRKILPVLPKDCILSDIASVKTGLKKFYEESGFRYVSTHPMFGPTFASLSNLSSESAIIISESDHLGKVFFKDLYNSLNLNIFEYTFDEHDETVAYSLSIPFVSTFVFAAVMKHQEAPGTTFKKHMAIAKGLLSEDDYLLQEILFNPRTPSQVENIRTELKQLLEIITNKDAEGMKKYLTKIREKIK

SEQ ID NO: 7434 - protein, 396 aa, B.fragilis
ANMQKENQTYKVAPADRLAGVSEYYFSKKLKEVARMNAEGKDVISLGIGSPDMPPSEQTIETLCNNAHDPNGHGYQPYVGIPELRKGFADWYKRWYGVELNPATEIQPLIGSKEGILHVTLAFVNPGEQVLVPNPGYPTYTSLSKILGAEVVNYNLKEEDGWMPDFDELEKMDLSRVKLMWTNYPNMPTGANATPELYKRLVEFARRKNIVIVNDNPYSFILNDKPISILSVPGAKECCIEFNSMSKSHNMPGWRIGMLASNAEFVQWILKVKSNIDSGMFRAMQLAAAKALEADSTWYEGNNVNYRNRRHLAGEIMKTLGCTYDEKQVGMFLWGKIPASCADVEELTEKVLQEARVFITPGFIFGSNGARYIRISLCCKDAKLAEALERIKLIMK

SEQ ID NO: 7435 - protein, 83 aa, B.fragilis; identical to SEQ ID NO: 6082

SEQ ID NO: 7436 - protein, 306 aa, B.fragilis
LNNKMKHYQRLEGMVAATFTPMDARGDINLSVIDKYADLMAESGMAGVFVCGTTGESHSLTTGERKAILAQWIKSARKRFKVIAHVGSNCQLEAMELARHAQEVEADAFAAMAPCFFKPSSVKDLVDFFTPIAQSAPDLPFYYYNMPSMTGVSLSVPSFLIEGKKTMPNLVGTKFTHNNLMEMGECLELNNGEFEVLHGYDEILIAGLALGAVAGVGSTYNYLPAVYQNLFDAFKKGDICTARRMQQKSIEIVKIIIKYGGGVRGGKAIMNLIGVDCGRCRLPVTPFGDDEYSSLKRDLEKIGFLN

SEQ ID NO: 7437 - protein, 165 aa, B.fragilis
IKLNYSVAELKESYKFMKKLGLLLFLFVCAAVVRAQSNIVKSLERNVPGQGKVTIHQDSRIEALLGTARTGTGEQTVIKSSGYRVQAYAGNNTRQAKNEAHQVGTRVKEYFPELSVYTSFNPPRWLCRVGDFRSIEEADAMMRKLKATGVFKEVSIVKDQINIPL

SEQ ID NO: 7438 - protein, 1102 aa, B.fragilis
KHTKMRKITRIKCLIVVLLTFIGTLAPVHAQQSGNFEISGVVKDTSGEPVIGATVIVKNTQIGTTTDVDGKFKLKVPHKSLLQISFIGMKTKDLKVTNNTFYEITLEDESVLLDEVVAIGYGTQSKATVTSGVVSVKKAELMSSVSASPLNNLQGKVAGLDIRQTTGQPGAQPVVLIRGGSTDPANDSPLFVIDGVVRSNMNGLNQEDIESMEVLKDAASAAIYGAKAANGIILITTKQGSSKDGKATISASYRLGVEQIRQHYPFSGARDYLYASRLAGSRGINDANVSGRLEGGAYPYSTGNINYKNGALEGYGYSRFTTEYLDDLISNMGQSYVDDLLNRQGYETMTDPYSGKQLIFKDNHYQKDVLFQTALTHNYDLSASGGNDKGNYYVSLGYINSEGIVLGTGYDRFSLTANGNYNLRSNLKLTVGLKHSTISNKATDPENSGTSTMDRSSRYPTTFRLYYDDGTPGIGEAGGSPRNRLHELYYQDISDKVYRNTIQLGLDWEILKGLHFKPSASYYMQENIYRFFEKYNEFNKGRKTLEKHDQYKQIMADAVFTYDKVFSDKHTLNAMIGMNYTQDDTYKLKGTGSEAPTDYVPTLAPTKPDLQRTTSSLDKEVLVGFFARVNYDYKRRYLLTVSARYDGASQFAEDHKFALFPAVSGGWNMHYEDWFPKTVVSRMKLRASWGQTGNNKLSYSNTQGEYASYIYAGNPGVLNSVLANNSLVWETTSNVDYGFDAGFFDNRLELSVTGYNKLTSDRLYDKALPAQTGFSSIKANLGTVQNEGFELSLTAHPLSTTSPVSWDVTGTFSMNRTYMKKLPYNGRDKNRVQGGLVWDAKSGTYVETGGLAEGERIGGRWGYKYLGVYDTDEEAAKAPVDTKVSGSKMNKKKVAGDAIWADLDNNGVIDDKDITFIGWANPDKKGALINNLSYKNFSLRLVVDFALGHSIANIWRCRANAYARNAIIPTTDVTNANIWWQTGDAATAKYPRYDVASDWDNGYRNHMRTIAYAGMNSNGNADNTAYYSKGDYLCFREVSLGYELPRSICSKMKVKGVSLNAGVTNIGYITAFDGLNPEQYDGQETGEYFLPIQFNFGVRLTF

SEQ ID NO: 7439 - protein, 683 aa, B.fragilis
LSKKYHVHLHPQGDKTMIDQATIDRILDAAQIVEVVSDFVTLRKRGVNYVGLCPFHNEKTPSFSVSPSKGLCKCFSCGKGGNAVHFIMEHEQMSYPEALRYLAKKYNIEIKERELTNEEKEVQSNRESMFIVNNFARDYFQNILKNHVDGRSIGLAYFRQRGFRDDIIDKFQLGFSTEGRDALAQEALRKGFKQEFLVKTGLCYETDDHKLRDRFWGRVMFPVHTLSGKVVAFGGRVLSTENKKLAKYVNSPESEIYHKSNELYGIYFAKQAIVKQDRCFLVEGYTDVISMHQSGVENVVASSGTSLTPGQIRLIHRFTNNITVLYDGDMAGIKASIRGIDMLLEEGMNIKVCLLPDGDDPDSFARKHNATEFQNFIQEHETDFIRFKAQLLMEDAGKDPMKRAELINDIVRSIAVIPEAIVRDVYIKECGQLLRIEDKLLVSEVAKRRELQAEKGNKPIASNNAPTPQPGEMPPPFPPEEMEADTYQSFIPQEGKEGQEFYKYERLIIQMIVRYGEKVMCNLTDEEGNEVPVTVVEYVINDLKEDELAFHNPLHRGILSEASEHIHDQEFASERFFVAHPDPKISTIATELASDRYQLSKYHSKTQKLVTDEERLYEMVPMLMINFKNAIVAEELKHIMYALQDPSIANDNAQCDAVMQRYKEMKEIQNLMAKRLGDRVVLR

SEQ ID NO: 7440 - protein, 534 aa, B.fragilis
NITDMKFVTLSLLATALTVGGNAAEQARSSKQPNILFILADDFGWRDLACTGSRYYESPNIDGIARNGVRFTQGYAACQVSSPSRASIMTGKFTARHGITNWIGEGSGEEWRKMGRHSKLLPAQYVWQLPKEDITLPEALKAHGYKTFMAGKWHLGGEGSYPEDHGFDINIGGHEAGGPYPGGYFAPYGNPKMKEGPDGENLSMRLAHETASFIETHTRRNKKQPFFAFLSFYAVHAPIETTEAKWRHFRNKADSMGIAPMGFEVDRTLPVRLQQDNPIYAGLIQQMDDAVGVVLAKLHELGLDENTIIVFTSDNGGVSSGDAYATSNYPLRGGKGRQWEGGIRVPLFIDFPGNTLKGDSCVVPVTGADLYPTFLDMAGIPLMPGQHQDGVSLLPLLQGKSIPERALYWHYPHYGNQGGEPSSIIRQGDWKLIHYYEDGRDELYNLRIDETESEPLNVQYPEKVEFLSKKLSVWLTEVGARYPEPDPQYNPAAEALYKKKTRERMMRTLEATRKKQLGKDFKPNADWWGSETKD

SEQ ID NO: 7441 - protein, 355 aa, B.fragilis
IDMELESILLPGVEDKRPMVIAGPCSAETEEQVMSTATQLAAKGVKIFRAGIWKPRTKPGGFEGIGVDGLAWLKEVKKETGMYVSTEVATAKHVYECLKAGIDVLWVGARTTANPFAVQEIADALKGVDIPVLVKNPVNPDLELWIGALERINNAGLKRLGAIHRGFSSYDKKLYRNLPQWHIPIELRRRIPELPIFCDPSHIGGKRELVAPLCQQAMDLNFDGLIVESHCNPDCAWSDASQQVTPDVLDYILNLLVIRKETQTTENLNVLRKQIDECDDNIIQELAKRMRVAREIGTYKKEHDITVLQTGRYNEILEKRGAQGEQCGMSAEFVKVIFEAIHEESVRQQMEIINK

SEQ ID NO: 7442 - protein, 300 aa, B.fragilis
YESRSDMDAGFFYTIYSIGMKRIAIQGTLGSYHDIAAHKYFEGEEIELICCANFEDVFAAIRKDSQTIGMLAIENTIAGSLLHNNELLRQSGTQIIGEYKLRISHSFVCLPEEDWNDITEVNSHPIALMQCREFLNQHPRIKVVEAEDTALSAEIIKRENLKGHAAICSRAAAERYGMKVLQEGIETNKHNFTRFLVVADPWQVDEIRKQNTVLNKANIVFTLPHSEGSLSQVLSILSFYNINLTKIQSLPIIGREWEYQFYVDVAFNDYLRYKQSITAITPLTKELKILGEYAEGKSNV

SEQ ID NO: 7443 - protein, 521 aa, B.fragilis
LVSGKVIVWRGAFVKRSSFEWSYKKNGNMKRLILPIACGICTVTSDAQTDKQPHPNVIFIYADDLGYKDLSCTGSRFYETPHIDKLAREGVWFTQSYAACPVSSPSRAALLTGKYPARINLTDYIPGDRAYGPHKNQRLASLPFNLHLSKDEITMAEAFRQNGYSTFMAGKWHLAESAEYYPEQNGFDINIGGNNTGHPSKGYFSPYGNPQLKDGPEGEYLTDRLTDEVIRYISEPKEKPFFVYLSYYTVHLPLQAKAEKIAKYRRRLSRAVPADSSFVKKGETYHKLVQDIPAYAAMVESLDENIGRLLDTLHRSGLDERTIVVFTSDNGGMATSNTTRNIPTSNLPLRAGKGYLYEGGIKVPAIIRWSGHLKGRQVSDTPIIGTDYYPTLLDLCGLRLLPGQHVDGVSMKPVLQGGRLSRPSLFWHYPHYSGGLGGRPSAAIREGDYKLIEFFEDHHVELYNVIQDESEEKDLSQIYPEIADGLRKKLYLWYKEVGARMPVDNPHYVSPVKDSDSFENK

SEQ ID NO: 7444 - protein, 63 aa, B.fragilis
  UNSURE (57): Identity of amino acid sequences at the above locations are unknown.
FNFIYKFLDQQKVAQDLPCQKFHLILVLQKENKQNSNMTWPKIQIKSEKLTTFWRIXFIHGRN

SEQ ID NO: 7445 - protein, 313 aa, B.fragilis
DRLMKIEKEILYRYFNGDATPEEEHKIRQYLEASDENWKEYLRERKFFDTIILKEQVVSEEKQMKRRQLIRKISLECLKVAAVLLIAFGTAFFWNNQSEKPATKSVVNTLKGQMANITLPDGSRVWLNSNTRIEYSQHFDDKREVQIDGEAYFEVVRNTGRPFIVYTPDDEQVEVLGTKFYVEAYSGTKKFETALIEGSVRVRAANSQFILQPSYKAVLKGGKMSVEKITDFDIYRWREGLICFKNRHFSEILEELKKYYGVHIRFDAAKINNPVLTVKFRLSDGIEYALRVLQKDVKFKYVRNDEENTFVIK

SEQ ID NO: 7446 - protein, 99 aa, B.fragilis
IVIILYNIKTPSLSSLADQVHKLFTGLSLIKSSCKVGSSSYGILFFHSAHLHTHMLGFHHDHYAQRIQRFLNTLFNLQRHPFLHLQPMRENIDHTGYFT

SEQ ID NO: 7447 - protein, 195 aa, B.fragilis
QNSMSATINDLASFNKFFTENQHRFIRFAWTYTRDEVVAEDIVMESLMAYWENRDHMTPEINPAAYVLTVVKNKCLNYLRHLQLVNDVSDRVASHSEWELSNRIATLDACEPNALFASEVQDIIDRVISRLSATTARIFLLSRYDNKSHKEIAEIMGMTVKGVEFHISKATKELRVALKDYLVLFPFLCDFLSRN

SEQ ID NO: 7448 - protein, 1128 aa, B.fragilis
SKDMKNTRCTDFCVPKNSSIKQLLKTMRVTIFLLFFCVFSTIAGTVNSQNARVSIHKTNVPLEEILNEIEHQTDYLFMYSNNIDVKERTSIRVSEKPVSEVLKKLLGNKIAYEMEGMHIILSDKRENQTAIAQQANKIQVKGNVTDMAGEPVIGASILEKGTTNGIVTDFNGDFSLNVNPGAVLVVSYIGYSAQEVKVIPGKVLKIKIKEDAELLDEVVVVGYGTQKKVNLTGAVETVDADVIENRPIRSATDALQGTVSGLTVTSGTGKPGEFASFKIRGNTSVNSAGALVIIDGMPGDINTVNPQDIETISVLKDAASAAIYGARAAEGVVLVTTKKGTSEKVKVEYTGNFSFNTPTRLPESNTGLDHALLSNVAFTNAGLAIPFSQKAIDAIKDPNTIAIPNGKEWTYTSDMDWIDLMMDHSFQQTHNLTISKASDRLKYLFSIGWLDQNGMFSEYGPDNYDRINLRSNISVELIKDKLSLDSRISYSRGVNLYHAAEGSWSIPYITFIQAGPNMPVYDPNGNYSRHRMQLNPIQALKEGGEGRTRNQRIEGVFTLEYKPVKGLSLRAVGGANILDGQKKEWRRAYGKYGVDGLISTAFGQKSPNSVTQNNSHRQYLTGQLIAEYKGVFGKHDINVLGGWSAEENLYEDLQGKRTNIVGNELPALNLGDTDGWSNAADENEWALLSGFMRASYAFAAKYLVEVNFRADASSRFSYKNRWGVFPSASVGWRITEEKFMQNQHIFDNLKLRASWGQLGNQNGLGLYDHIASYNINGYYPFKSELGQWAVISKLPSESRTWETVEVKNIAVDMAFLRNRLTVTGEYFIKKNKDMLVSIEIPSIIGIDVPTGNYGELKVKGWEVTVGWQDKIKDFSYGARFNLSDQKDKLVDYGVEYNGFVAGVNQKVQGYSLGSIFGYRTDGYFTSEEEVKNSAAFNKAITGVGDIKYIDKDGDGKISAPNDLEYLGTTTPRYTFGLNLTAAWKGFDLGVLLQGVGKRNFYLSSEVMNPYYATWNNFSYKMHNDYWTPENPNAAFPRYYAGANHNYQISDHWLQNAAYVRLKNLQLGYTISPKLTKSWGIQRLRVYFSGDNLCEYSKLNDNFDPELSDINGYVYPIMRNFSFGINVTL

SEQ ID NO: 7449 - protein, 493 aa, B.fragilis
LFKMIFTMKATKILICILCCTWICSCSLLEVDPVSTITSQSFWKTPGDAKAYLTGIYNKVRDLNNTSYYGEDRGDAFKAGEIGPTSVAWAHTLLESNAPSYRSAYNIIHHANLLFNKIESLKFTNETEKNRIKAECHFLRAYTYFLIVRIWGDAPIITDPVLSDNVELKPRSPKEDVMKLILEDIEQAVLLFPEDGYINKNLASKPAAYALKADVLMWKAKVLNGGNADLEEAIKAIDQVGGSGVSLLPDYAKVFANDNKKNNEIIFSFYFERYETGNLSIATNTTSRTDNLSMAVNLADAATSPNQSRHVYAPSDKARELYLKYPGDRRYKVAMIDLVDKDGNLILTQTNKFRGKAYSDDRYFDDDLIAHRWGDLLLLRAEANAALNKISESLVDLNEVRDRAGLEPYDGPKDKIAVEKEICDERLRELFIEQKRWFDLVRFHCGGTIDIYKEVPNLNDKPGYPLYFPINYNDMVLNDKLVQTDGYESNVER

SEQ ID NO: 7450 - protein, 199 aa, B.fragilis
YSSVIMLEKEEIISPALEDLKNHYRSIITLLGEDAEREGLLKTPERVAKAMLTLTKGYHMDPHEVLRSAKFQEEYSQMVIVKDIDFFSLCEHHMLPFYGKAHVAYIPNGYITGLSKIARVVDIFSHRLQVQERMTLQIKECIQETLNPLGVMVVVEAKHMCMQMRGVEKQNSVTTTSDFTGAFNQAKTREEFMNLIRQR

SEQ ID NO: 7451 - protein, 286 aa, B.fragilis
YIGLSLLMFAKWDVSVLKMLVFLLKTSFICQTNKINLILTKLNCYTMDTLKLHGQAITLVDQVEDNLLTYFRTKDLRAGDAIPNEMELAAALGVARSVLREALSRLKMVGMIETRTRRGMILTEPSILGGMKRVVDPRILSEHSLFDLLGFRIALELGICSDLFQNITPEDIVELKEIVRLGIAFENNEYAPISEFTFHAKLYEITGNATIREFQEIIHPVMVFVKDKFKELLEPINIEIKERGELVTHADLLGFLEKHDEAGYRKALEKHFAVYKIFMKRRIVNE

SEQ ID NO: 7452 - protein, 542 aa, B.fragilis
HFNSWSKMKNIYLFLLSVVILCSCNDFLDREPKTNLSPGSFWKSEEDLRLAANVFYQNMNRSYTLDNQSADGFANVGNLVSSGTHAPGNTDGIWTTAYKQIRHANNFLENYEKAEVSEATKNRYAGEARFFRAYFYFNLVKRFGDVPYVLRTLDMDSEELMGPRVPKEQVIAGIIEDLEFAETHIPLKSKLPTDVGRLTKGAAQAMLARVALYIGTWNKFHGSGEYKSYLQIAKEASKRLIDSKEYSLYADYRNLFLLPGEDSNEHILSFRYSAEADTYNPRIRATIADLSHSPTKVLADAFLCKDGLPLEKSAYRVEYLPAGKEFENRDPRMALTIWKPGDPFLGKPFVPNLTSQTRTGYMFKKYGDEESYSNMKSRIDEILIRYAEVLLTFAEASFELDDRISDEDLNLSVNALRNRFEGDPNRLPDLTNAFVVEHGLSMRDEIRRERRVELAAESFRYDDIIRWKTAETELPAAILGAKFDPELYPSTVPGKDVILDKNGFILVQNAESRTFDSSKDYLFPLPLREVSLNPNLKQNPNW

SEQ ID NO: 7453 - protein, 133 aa, B.fragilis
TICPFKVFLLTLSLYKILDMSIESFNLLLLVMGLMALVVFIALYFVRAGYGMFRSRSWGISANNKIAWILMEAPVFLVMGWCGGHSDRRFLPVELTFFLFFQLHYFPKGFCFSFPDERKEQDAGTHSFDGSDL

SEQ ID NO: 7454 - protein, 201 aa, B.fragilis
NTVTTMAKGNRTVPEINSSSTADIAFLLLIFFLITTSMDTDRGLARQLPPPPEKDQVDNDVVVKDRNVLQIFLNFQNQLMCGGEIVDVKQLREKAKEFIANPYNDEKLPEKHAKDVPFFGNVMVTENHVISLQSDRGSSYQAYFDVQNELVAAYNELRDELAQEKWQKNYADLNEDQQKAIRDIFPQKISEAEPKGVKKNN

SEQ ID NO: 7455 - protein, 183 aa, B.fragilis
SAPAHRWKSCGIIPHRTMSRISIIAAVDSRMAIGFQNKLLFWLPNDLKRFKALTTGNTIIMGRKTFESLPKGALPNRRNVVLSSNPAAECPGAEVFTSLEAALESCQAEEKVYIIGGASVYRQAISLADELCLTEVNDTAPEADAFFPAVDTTIWHEKSREVHPADEKHLCSYAFVDYVREID

SEQ ID NO: 7456 - protein, 405 aa, B.fragilis
YDMAKIQIKSEKLTPFGGIFSIMEKFDSMLSPVIDSTLGQRCSSIFGYQFSEIVRSLMSVYFCGGSCVEDVTSQLMRHLSYHPTLRTCSSDTILRAIKELTQENISYTSDQGKTYDFNTADKLNTLLINALVSTGELKEIEEYDVDFDHQFLETEKYDAKPTYKKFLGYRPGVYVIGDKIVYIENSDGNTNVRFHQADTHKRFFALLESQNIRVNRFRADCGSCSKEIVSEIEKHCKHFYIRANRCSSLYNDIFALRGWKTEEINGIQFELNSILVEKWEGKCYRLVIQRQRRNSGDLDLWEGEYTYRCILTNDYKSSTRDIVEFYNLRGGKERIFDDMNNGFGWSRLPKSFMAENTVFLLLTALIHNFYKTIMSRLDTKAFGLKKTSRIKAFVFRFISVPASGS

SEQ ID NO: 7457 - protein, 291 aa, B.fragilis
NKSAIVSTFVKTINSHDMKLILTLFTCLFVTGCAYAQNFSDYFTNKTLRIDYLFTGNADKQSICLDELSELPVWAGRRHHLPELPLEGNGQIVMRDVASGKVIYTTSFSSLFQEWLETDEAKEVTKGFENTYLLPYPIKPAEVEITLRNNKREVSANLKHVVKPDDILIHKKGLTHITPHKYLLKSGNEEQCIDVAILAEGYTTSEMETFYKDAAIACEALFSHEPFQSMKNRFNMVVVASLSADSGVSAPKQGAWKHSAFRFPLRYFLFRPLSDYQPGKSNKRRIGRHPL

SEQ ID NO: 7458 - protein, 88 aa, B.fragilis
SMSAGLVSREKIDEVLNEGFEAVQMARALLNEPGFVNRMRREEKARCNCGHSNYCIGRMYTIEMACHRHLTEELPLCLKKEIEQLENK

SEQ ID NO: 7459 - protein, 132 aa, B.fragilis
SRSARSSALISIYVFLLHRMSPPMFLPNTAGSPYTSSKSSCNWKATPICMPKSYRFSASSGEAPPKIAPIFKLAANKTAVFKRIISRYSSSFTSSRDSKFISICCPSQISSAVRLNKSITSLRCSDELAAIY

SEQ ID NO: 7460 - protein, 271 aa, B.fragilis
PKKYTIRMKQYLDLLDRVLTEGIEKGDRTGTGTISVFGHQMRFNLDEGFPCLTTKKLHLKSIIYELLWFLKGDTNVKYLQDHGVRIWNEWADGTGDLGHVYGYQWRSWPTYDGGFIDQISEAVDAIKHNPDSRRIIVSAWNVGDLDHMNLPPCHAFFQFYVANGRLSLQLYQRSADIFLGVPFNIASYALLLQMMAQVTGLQAGDFIHTLGDAHIYLNHLEQVKLQLSREPRPLPQMKINPDVKNIFDFQFEDFELVNYDPHPHIAGKVAV

SEQ ID NO: 7461 - protein, 190 aa, B.fragilis
AMGQENMLIYLQVVYHSKDSTIRIFDNGSYKHIIYNKQGKFLREISLADSEFNYLLHMQSDTYFFRGSFSKGKSEIIVTDTTLRVKFPILPFDSTADYITRGAIMLNTTGEECAPDICLFNHIYSDSVFLLTPDGLKLDFILRKGKYAPSLEDVKQFMKWNQYDPFIKGLFILKSATIIQYTIKGRFMSR

SEQ ID NO: 7462 - protein, 83 aa, B.fragilis; identical to SEQ ID NO: 6082

SEQ ID NO: 7463 - protein, 526 aa, B.fragilis
WKLLFFWLWDGVVGIPTDVFYLSNSLSFFFSNYITSQRAFVFPFLMKGKSKMPVLILLMGVIFNILNGLMQGEWIFYLAPSDYYTPGWLLTPCFWIGTLLFFAGMGINWHSDSVIRHLRAPGDTRHYLPQRGMYRYVTSANYLGEIVEWVGWAILTWSLSGCIFAWWTVANLVPRADAIWHRYREEFGTQRRIEETNFSFLILKYTVLMNTHSASKLFTPVTIGPLTLRNRTIRSAAFEGMCPGNAPSPMLLDYHRSVAAGGVGMTTIAYASVTRSGLSFPRQLWLRPEIIPGLREVTAAIHAEGAAASIQIGHCGNMSHKSICGVTPISASSGFNINSPTWVRGMKREELPEMAKAYGRAVCLAREAGFDAVQVHAGHGYLISQFLSPYTNHRKDEYGGSLENRMRFMTMVMNEVMKAAGKDLAVFVKMNMRDGFRGGMEIEETLEVARRLESLGAHALVLSGGFVSKAPMYVMRGAMPIKTLTHYMDCWWLKFGVKLAGRMMIPTVPFKEAYFLEDVSEVSFGN

SEQ ID NO: 7464 - protein, 281 aa, B.fragilis
LILKIRHTMKKLFAIVAVMGVLTFGSTQLVQAQDAAATEQAAPAADKPVADAVAEAAEASAPLAGAEEGGIHKEIKVKFIEGTASFMSLVAIALVIGLAFCIERIIYLSLAEINTKKFMSSIEAALEKGDVEAAKDIARNTRGPVASIYYQGLMRIDQGIDVVEKSVVSYGGVQAGYLEKGCSWITLFIAMAPSLGFLGTVVGMVMAFDKIQQQGDISPTVVAGGMKVALITTIFGLVVALILQVFYNYILAKIEALTSEMEDSSISLLDMVIKYNLKYKK

SEQ ID NO: 7465 - protein, 155 aa, B.fragilis
LMGKFNKTGKRGMPTLNTSSLPDLIFTLLFFFMIVTTMREVSLKVEFKIPQGTELEKLEKKSLVTFIYVGKPTAEFRKKLGSESRIQLNDAYAEVDEIQAYVTNERSSMKEEDQPFMTVSLKIDQDTKMGIVTDIKQALRQAYALKINYSARARE

SEQ ID NO: 7466 - protein, 239 aa, B.fragilis
KPEEHQFLYTNFMEVKKSPKADLEGKKTQWLLIGYVVVLAFIFVAFEWTERDIKIDTSQAVAQIEFEEEMIPITQQEEKPAPPPVEVPKQAEILKIVDDEADVQETAIASTEDTGQKVEVKYVPVEVKEEEPSEQEIFEVVENAPEFPGGMPACLQFLYKNIKYPPIAQENGTQGQVVLQFVVERDGSIGDIKVVKSVDPYLDKEALRVVKTMPKWKPGMQRGKPVRCRFTLPVRFRLQ

SEQ ID NO: 7467 - protein, 290 aa, B.fragilis
MMERKLAVITGADGGMGTEITRAVACAGYDVIMACYSSSKAETKCRELVKETGNEKIEVWQIDLASLSSVRAFADRMLRQKTPVALLMNNAGTMETGLHITEDGLERTVSVNYVGPYLLTRLLLPLMGEGTRIVNMVSCTYAIGKLDFPDFFLRGRKGSFWRIPIYSNTKLALLLFTIELAERLRARGITVNAADPGIVSTNIIRMDQWFDPLTDIFFRPFIRTPLQGAATAIGLLLDAEVEGRTATFNLNNHCRLLPEKYTRPDRRAQLWEETERILSEKGFLPINDKR

SEQ ID NO: 7468 - protein, 69 aa, B.fragilis
LKTLVVRIFFVICTRFEESANWRDARVVEEARLESVYTPKVYRGFESRSLRRKYKQETISKYNNNNLIN

SEQ ID NO: 7469 - protein, 158 aa, B.fragilis
SEMSKLTYKVSYYVLYAMFALIVIVLGLFYFGGQMETPIVYDMDNPANTDALLYLMYGLFGIAVVATVVAAIFQFGSALKDNPKGAIRSLLGLILLVLVLVVAWSMGSGETLTIQGYEGTDNVPFWLKLTDMFLYSIYFLMLVTVLAIIGSSIKKKLS

SEQ ID NO: 7470 - protein, 244 aa, B.fragilis
CTARCNIEMPYRRLPNTDQARIRALKTAVVKGDMCDVYDLPVSLKTLGEARIFLSKFETAHSYYVHCYGEQSRNSKKHQANVKTARLYISHFIQVLNLAVIRMEIKESHKALYGLPVDNFSVPDLSSEASLAEWGQKIIEGERKRTSQGGIPIYNPTIAKVKVHYDIFMEGYEKQKSLQSLTNRSLEQLASMRVQADRLILDIWNQVEAKFQDVSPNEKRLEKCRDYGLIYYYRTGEKQNKEIL

SEQ ID NO: 7471 - protein, 347 aa, B.fragilis
YKKRGCRPSSLFSFNLSFYNLFIMYTAFQLLDKINSHISDIRFTRTPAGLYDPIKYVLSMGGKRIRPVLMLMAYNLYKEDVSSIYDPATAIEVYHNYTLLHDDLMDRADMRRGKTTVHKVWNDNTAILSGDAMLVLAYQYMAASSSEHLKEVMDLFSLTALEICEGQQMDMNFESREDVKEEEYLEMIRLKTAVLLAASLKIGAILGGASPEDAENLYDFGMQIGVAFQLQDDLLDVYGDPAVFGKNIGGDILCNKKTYMLIKALERADRDQLEGLNHWLSTTSFCPEEKISAVTELYTQIGIKAVCENKMREYYTRAMTSLGAVSVIEDKKSELKKLMKHLMYREM

SEQ ID NO: 7472 - protein, 457 aa, B.fragilis
KIDGRSDPRETNKEYLIYKLSEAMKDCTRIDNELFPKFDVKRGLRNEDGTGVLVGLTKIGNVVGYERIPGGGLKPIPGKLFYRGYDLEDLAHAILKEKRFGFEEVAYLLLSGSLPDKEELASFRELINDNMPLEQKTKMNIIELEGNNIMNILARSVLEMYRFDPNPDDTSRDNLMRQSIDLISKFPTIIAYAFNMLRHATFGRSLHIRHPQENLSIAENFLYMLKRDYTELDARTLDLLLVLQAEHGGGNNSTFTVRVTSSTGTDTYSAIAAGIGSLKGPLHGGANIQVADMFHHLQENIQDWTNVDEIDTYFTRMLNKEVYNKTGLIYGIGHAVYTISDPRAVLLKELARDLAHEKGREREFAFLELLEERAIATFGKIKNNGKTVSSNVDFYSGFVYEMIGLPQEIYTPLFAMARIVGWCAHRNEELNFEGKRIIRPAYKNVLEEEQYVPLKKR

SEQ ID NO: 7473 - protein, 160 aa, B.fragilis
FKMGHHQLDTLDEQILKLIADNARIPFLEVARACNVSGAAIHQRIQKLTNLGILKGSEYVIDPEKIGYETCAYIGIYLKDPESFDSVTKALEAIPEVVECHFTTGKYDMFIKIYARNNHHLLSVIHDKLQPLGLARTETLISFHEAIKRQMPIMVDTDED

SEQ ID NO: 7474 - protein, 317 aa, B.fragilis
GVAILKKGCSHPVSMATPFLNHTFVIIMVKVEIDEGSGFCFGVVTAIHKAEEELAKGVTLYCLGDIVHNSREVERLKEMGLITINHEEFKQLHNAKVLLRAHGEPPETYIIAKENNIEIIDATCPVVLRLQKRIKQEYMQEDLDEKQIVIYGKNGHAEVLGLVGQTTGKAIVIEKLDEARRLDFSKSIRLYSQTTKSLDEFWEIVEYIKEHISPDVTFEYYDTICRQVANRMPNLRKFAASHDLIFFVSGKKSSNGKMLFEECKKVNPNSHLIDSADEIDDSLLPGVNSIGVCGATSTPKWLMEEISEAIKAQIKRQ

SEQ ID NO: 7475 - protein, 278 aa, B.fragilis
YIKIGVLLVFKLLLLLWHKYNADILKIQYIWRKNLDNTLKKGVNLLHNIMKKITIAIDGFSSCGKSTMAKDLAKEIGYIYIDSGAMYRAVTLYSIENGIFHGDTIDTDELKRRIGDIHISFRIDPETGRPNTYLNGVNVENKIRTMEVSSKVSPISALGFVREAMVAQQQEMGKAKGIVMDGRDIGTTVFPDAELKIFVTASAEIRAQRRYDELKAKGQETGFEEILENVKQRDHIDQTREVSPLKKADDALLLDNSHLTIAEQKEWLMAEYQKAIKA

SEQ ID NO: 7476 - protein, 331 aa, B.fragilis
KNMIVMGTVKCVGILTSGGDAPGMNAAIRAVTRAAIYNGLQVKGIYRGYRGLVTGEIKEFKSQNVSNIIQLGGTILKTARCKEFTTPEGRKMAYDNMVKEGIDALVVIGGDGSLTGARIFAQEYDIPCIGLPGTIDNDLYGTDTTIGYDTALNTILDAVDKIRDTATSHERLFFVEVMGRDAGFLALNGAIASGAEAAIIPEFSTEVDQLEEFIKSGFRKSKNSSIVLVAESELTGGAMHYAERVKNEYPQYDVRVTILGHLQRGGSPTAHDRILASRLGAAAIDAIMEDQRNVMIGIEHDEIVYVPFSKAIKNDKPVKRDLVNVLRELSI

SEQ ID NO: 7477 - protein, 259 aa, B.fragilis
NMLVDSHSHLFLEEFAEDLPFVMERARAAGVTHIFMPNIDSTTIEPMLSVCDTYRDFCFPMIGLHPTSVNESYEKELEIVAANLETSGRFVAVGEIGIDLYWDKTWLKEQLIAFEKQVQWALHYQLPIVIHCREAFDYIYKVLQPYKNSGLTGIFHSFTGTPGEAARMMEFPGFKIGINGVVTFKKSTLPETLKSVPLERIVLETDSPYLTPVPNRGKRNESANVKDTLIKVAEIYNEDPEKVAELTAVSALKVFGMLK

SEQ ID NO: 7478 - protein, 61 aa, B.fragilis
SYVFIGTILFVEPCIYRIISFVGFIQSCVYNICMDSEEERFTVLGAIGLRRGGLLPGGGLK

SEQ ID NO: 7479 - protein, 213 aa, B.fragilis
RIASTWWLWPVFRQTVGSALPNREHGSTRPSGSHFDTFYSDRYLTTSRVKAINDALAGIPYEHIIILANTEQYGGGGIYNAFTLTTAHHPNFRPVVVHEFGHSFGGLADEYFYDEDVMNGLYPLNIEPWEQNITTRINFASKWEDMLTKATPVPTPVANKAKYPIGVYEGGGYSAKGIYRPAFDCRMRTNEYPTFCPVCQRAIQRIIEFYTGK

SEQ ID NO: 7480 - protein, 350 aa, B.fragilis
IRLSLKLSSSIMSDSIKTFKTGYILLPVLIGLSVVGWLFYWEFNPELFSGIRFSWRLVGGLLLAVLFMFGRDGGLMWRFRFITDRELTWRQAFRVNMLCEFTSAVTPSAVGGSSLIVLFLNKEGINAGRSTALTISCLFLDELFLVLACPFALLLFSFDDLFGNVAILSSGIEVLFFLVYGVVTIWTFLLYLALFRRPEWVKRLLLTIFRLPLLRRWHKAIETLTDNLVLSSREMSQKSFTFWLKAFGITCLAWTSRYLVVNALLIAFTTSGSQLLAFVRQLILWVVMTISPTPGGSGVSEYMFREYYADFFDVAGMALVVAFVWRIITYYMYLLIGAIIIPGWVKKLRD

SEQ ID NO: 7481 - protein, 152 aa, B.fragilis
RKESYLCDRSIFLSIEFMKRRLIQFVTTYFLFVLIFVLQKPIFMGYYHTLYNKVSWTDYFSVMGHGLPLDFSLAGYLTAIPGLLLIASVWIQPAVIRQIRRGYFMIIAILLSCIFIGDLDCMNTEDSAWMPLRCSTSSPRPKMLWPVSAFGS

SEQ ID NO: 7482 - protein, 62 aa, B.fragilis
ARRSPYNRQESVYICMFDVLYIGQETMAGDQQTLKPDTTLVRSCTDCSFPNSSFSNHYTNLQ

SEQ ID NO: 7483 - protein, 705 aa, B.fragilis
QSIPTGTVYMTMMKQSYLNSGYLTQLIMKKRIQILIIVILYALMFVPLSAQTPHTISGIVKDRASVPISGVNIRVEGQKWKASTGKEGKFTLEIPQNSTITFSSVGYEPVTIHSGEKKWIEITLKESQSLLPEITVTSTLKNSMKFVFAPSDLELIKDMLYLKTRYKIPSKRFQSDSRVIIQPILSNNSRGTQKNFSPIVYDGKNYDILLRRGNVCGDRAEKEYYSRFAQVIDPDSICNQTLTYADSCTVDDINDLYTTEVRIKISTFCQDEYRDTIRITNGIIYPMRFFNYNLSAMDLDNSYIPKQTPLNFNEKGEMHLRFRPEDANIYENEGKNAEELRKMKKALDDIDKDRTKTLTTFQIIGYTSPEGTYEYNLKLAKKRMKNAEGKVFENISEETIRKAKVDNDAVVESWTTVCELMEKDSIQEVSQLKELIKRARGNHNEISWGARRMKIYPLIRDRYLPRLRRVEYFYEYSELRTLNKDEIDALYKKDPQKLTASEFWSYIMSQKDATDEKREALYREALSIHPDLMIAANNLASLLIKQNRADTTLLKPFITQDAPSAILVNQTVAYLQKRDFKRANHFAELLPDNKDTEIVKALAAAMDGKYQEAYPIFEKQGGINQAILLLSMKQNSKAWEVLKKVEDTSPDTEYVKAIAANRLNNVNEAVIHLRNAITQKPSLKEIAQKDGDVLDLLDLLDLDKK

SEQ ID NO: 7484 - protein, 378 aa, B.fragilis
SMKPHTLFLTLGILLLGFSACEPLNETPETPAFSLNLTSPDGEPSTDNDNAVLQKLVYHLFIFRSNTANPSPDNDGSNYTFWRHTGDLTLKQIREYTLSIPSESTDRSYLLLVHATPKEKPESEIISKEGMTFSESEISMIKENDNNYVPLSKDNYYAIQQLTPEDIAQGKTSIEFKLKRAVGELVFDVMKCDEKSHNPIDIDTECSSTLDRVFRIDIEINGVIPKVSLTNETKNPERINICFSKEIVLKSDYTPDFANNTEVIEPLTNAPLDTNEKAVKGATRICGPYLFSKMTLDHPDEEATDPEEGIKTILNFSYYDTTPLPNGSYSTKKLILSLTDKPLTIVKDHYTVTNIRLRNNRIIDLSVSGDFGIDWKWD

SEQ ID NO: 7485 - protein, 69 aa, B.fragilis
ILAAIFVIPKLKEYPPMSREELQQKSRFAMIGTLMTIVSLVFLFYVGSSLVNTTKKYKELAIEIACINK

SEQ ID NO: 7486 - protein, 134 aa, B.fragilis
KGEADSFSLFSYLFFSSARKAGVRGEKSGLGRMKVWLSNPNRRLLRPGQTPSSDKDEALFCYITIYVTGISPIVIGSSSIRLIKHKNAIDKIQLGFPFLLYELTDQGNKIFSVLFLFIFTNPVDVTEGFDCRGT

SEQ ID NO: 7487 - protein, 173 aa, B.fragilis
NYFLVLSTNGLKETKNMEIEKDFIDLLTEHKALIYKVCFMYASNQEDLNDLYQEVVVNLWCSYPKFRYESKLSTWIYRVALNTCISDLRKKKILDYVPLSVDIGVYDDCLRNDSLKEMYQLICQLDRYERMLVLLWLDENSYDEIASITGSNRNTVAVKLHRIKDKLKKMSNQ

SEQ ID NO: 7488 - protein, 565 aa, B.fragilis
ICSQPLKKCFMTRVPFTQNYRWHLPLLLLVFCCSFFINNGAIFADIMESRNIITAREMVYDHNWLVPTMNGELRLEKPPLPTWIAAITEMISPDNLPLQRAMAGFAAVMLVLFFYKFATKLTDNRTYALVSSLVLCTSYNIILMGRTATWDIYCHAFMIGAIYYLYLALRQNTCKWTYFIGAGIFMGLSFLGKGPVSFYALLLPFVCAYILYYRKETQMKGKWIALAVMILIGIVLSTWWYAYIYIYHQEMASYVFHKESSSWSNHNVRSWYYYWQFFLETGVWSLLTLTTLLVPFWKKRVESSKEYLFCLSWMLLILFFLSLLPEKKTRYLLPILLPAALTMGHLFVYWIRQAKQKMPQLKDRVLYRINAYLIVVAALALPIALYLFMYREGRMGTGMFVWLVVLFLTVAVWLFRSAFKLQPFSFLMGIVALFAVAELFVMPYIGSFVSNSDPKSISATRENPELQPLPFYHSKDEVLRIELVYEAHKKIGDMDLTNKEEIIKALPFVLISQKPAELLIPDSIRKDLNLRFIDCYDNNRWAKGHKRYDSVFISNVTIVEPIKEQ

SEQ ID NO: 7489 - protein, 85 aa, B.fragilis
HSVKACSLDVNKKFFKCKRLVICAQEPDNPQKALTMLIEKRYKDEDTGSDGVNSFPKLELSYSAGVCLFLLKQAKRTIINLKIKK

SEQ ID NO: 7490 - protein, 551 aa, B.fragilis
LNSKIVMAKEILFNIEARDQLKKGVDALANAVKVTLGPKGRNVIIEKKFGAPHITKDGVTVAKEIELTDAYQNTGAQLVKEVASKTGDDAGDGTTTATVLAQAIIAEGLKNVTAGASPMDIKRGIDKAVAKVVDSIKHQAEKVGDNYDKIEQVATVSANNDPVIGKLIADAMRKVSKDGVITIEEAKGTDTTIGVVEGMQFDRGYLSAYFVTNTEKMECEMEKPYILIYDKKISNLKDFLPILEPAVQSGRPLLVIAEDVDSEALTTLVVNRLRSQLKICAVKAPGFGDRRKEMLEDIAVLTGGVVISEEKGLKLEQATIEMLGTADKVTVSKDNTTIVNGAGAKENIKERCDQIKAQIAATKSDYDREKLQERLAKLSGGVAVLYVGAASEVEMKEKKDRVDDALRATRAAIEEGIVAGGGVAYIRAIESLDGLKGENDDETTGIAIIKRAIEEPLRQIVANAGKEGAVVVQKVSEGKGDFGYNARTDVYENMHAAGVVDPAKVTRVALENAASIAGMFLTTECVIVEKKEDKPEMPMGAPGMGGMGGMM

SEQ ID NO: 7491 - protein, 338 aa, B.fragilis
TVAKVRFFSLSLRINCGKTERYMAKIAKKLTELIGHTPLMELSGYSRKYGLQENIVAKLESFNPAGSVKDRVALSMIEDAEERGVLQPGATIIEPTSGNTGVGLAMVATIKGYRLILTMPETMSLERRNLLKALGAQIVLTNGQKGMAGSIAKAEELKKSIPGSVILQQFENPANTEVHARSTGEEIWQDTDGEVAVFVAGVGTGGTVCGVARALKKHNPNVYIVAVEPASSPVLEGGKAASHRIQGIGANFVPGIYDASVVDEVMPVPDDEAIRGGRELASTEGLLVGISSGAAVYAARQLAGRPEFKGKMIVTLLPDTGERYLTTELFAFDAYPLD

SEQ ID NO: 7492 - protein, 63 aa, B.fragilis
VRKKGEAVSFPLLLYFNLNIVYDYADKDTTINNKSQVLGLLFFRIICIVASVREHRQEALPAK

SEQ ID NO: 7493 - protein, 181 aa, B.fragilis
SMKKRAFFLLLLLLIPLTSILSQEIALKTNVLSWATTTINLGAEFKISPRLTAGADIMYKGWSFLSDNRKMGGFLVQPEAKYWFCIPFYKHFMGLHAHYGQYNGGFSKYRYQGDLYGIGLSYGYQWIWKRRWNIEVSAGIGYASMNYDKYERPKCGLFLGKDHSNYFGLTKLGVSLIYILK

SEQ ID NO: 7494 - protein, 270 aa, B.fragilis
LTTLRTRREDRFLRPNLTHSMDLYYGAWAVLDPTRNMVDAFECTDGKPWGESPLTVRPDESILYGNDDALKKAERAKMFMNRDRRLYESVNHSMMANFVDDGFKDEEVQVNESNNKGPTGFSALKYVQPTDVTPGYSTVSDADIVVLRYAHVLLMIAEAENEAHGATTTALNAINEVRTRSGQPAIEAGISQDDLRERIRNEWRIETCFEGLRYFQLKRWKLMDKRVNGVEDPAYPGYIKVYKPAFEFFPIPQSEIDKAGGVLKQDPAYE

SEQ ID NO: 7495 - protein, 232 aa, B.fragilis
IRKNMVIGFQWIIFIGIALVSWLVQMNLQNKFKKYSKIPTGNGMTGRDVAIKMLQDNGIYDVQVTHTPGQLTDHYNPANKTVNLSEGVYDSNSIMAAAVAAHECGHAVQHARAYAPLTLRSKLVPVVSFASQWMTWLLLAGILLLESFPQLLFAGIILFAMTTLFSFITLPVEIDASKRALVWLSASGITNSYNHRQAEDALRSAAYTYVVAALGSLATLIYYIMIFMGRRE

SEQ ID NO: 7496 - protein, 684 aa, B.fragilis
SMKKHLISMAATVILLTACGGAKKTNTAEADNFKYTVEQFADLQILRYRVPGFENLTLKQKELVYYLTQAALEGRDILFDQNGKYNLTIRRMLETIYTDYTGDRNSPDFVNLTTYLKRVWFSNGIHHHYGSEKFVPGFTPEFLKQALLSVDASKLPLAQGQTVEQLFEELSPVIFDPKVMPKRVNQADGEDLVLTSASNYYDGVTQQEAEAFYNALKNPKDETPVSYGLNSRLVKEDGKIIEKVWKVGGLYTQAIEKIVYWLKKAEGVAEDDAQKAAIGKLIEYYETGDLKTFDEYAILWVKDLNSRVDFTNGFTESYGDPLGMKASWESIVNFKDLEATRRTELISSNAQWFEDHSPVDKQFKKEKVKGVTAKVITAAILGGDLYPSTAIGINLPNSNWIRSHHGSKSVTIGNITDAYNKAAHGNGFNEEFVYSDTEKQLIDKYADLTGELHTDLHECLGHGSGKLLPGVDPDALKAYGSTIEEARADLFGLYYVADPKLLELGLVPSEDAYKAEYYTYLMNGLMTQLVRIEPGNSVEEAHMRNRQLIARWVFEKGKADKVVEMVQKDGKTYVVVNDYQKLRHLFGELLAEIQRIKSTGDFDAARSLVENYAVKVDPELHSEVLTRYKKLNLAPYKGFVNPRYDAVIDEQGNIVDVQVTYDEGYAEQMLRYSRDYSPLPSIND

SEQ ID NO: 7497 - protein, 294 aa, B.fragilis
KEIEESDVDFDHQFLETEKYDAKPTYKKFLGYRPGVYVIGDKIVYIENSDGNTNVRFHQADTHKRFFALLESQNIRVNRFRADCGSCSKEIVSEIEKHCKHFYIRANRCSSLYNDIFALRGWKTEEINGIQFELNSILVEKWEGKCYRLVIQRQRRNSGDLDLWEGEYTYRCILTNDYKSSTRDIVEFYNLRGGKERIFDDMNNGFGWSRLPKSFMAENTVFLLLTALIHNFYKTIMSRLDTKAFGLKKTSRIKAFVFRFISVPAKWIMTARQYVLNIYTENRAYAKPFKTEFG

SEQ ID NO: 7498 - protein, 225 aa, B.fragilis
PQNDMTNDMIQLLVNTDQNLLLYLNGFHNAFGDYFMSTFTGKWIWVPMYASILYVLLKNFNWKITLCCLTAIALTILFADQVCASLIRPAVERLRPSNPANPISDLVHIVNNYRGGRYGFPSCHASNSFGLAFFLVFLFRKRWLSLFILLWATLNCYTRIYLGVHYPGDLIVGAIIGCCGAAFMCYLLKKTARGASFGKVKHTEITIYVGLLTTIGIVVYASIMA

SEQ ID NO: 7499 - protein, 231 aa, B.fragilis
RYREGRYTGVQNEITNYKLKTTMDKKLLMMALLITTGLATHAQEKLTRYQVRNAITVRTPIMNDSINPKGEKHTAKALLQTPVVLDLANAPTQMTAADTAGLVTFAKADKDNLLYLIKTQLRAERFMKGKLKVTSPVRWELFINGESKMVKDASEDSISKAATKEVALRLEPEMDYEIAIKLLSTPDDKTVPSLKCELVKDDKFKEVACSTDPEQKHRFSLDNTNLRETGP

SEQ ID NO: 7500 - protein, 166 aa, B.fragilis
NGADMETQNVKDTVRQIFTEYLNANGHRKTPERYAILDTIYSIDGHFDIDMLYSQMMNQENFRVSRATLYNTIILLINARLVIKHQFGTSSQYEKSYNRETHHHQICTQCGKVTEFQNEALQNAIENTKLSKFQLSHYSLYIYGICSKCDRANKRKRVNNNNKKEK

SEQ ID NO: 7501 - protein, 608 aa, B.fragilis
KMNEKYQMIQTLKTYFGYDSFRPLQEEIIHNLISKKDSLVLMPTGGGKSICYQLPALLMEGTAIVISPLISLMKDQVETLRANGIPAGALNSSNDETENANLRRACISGQLKLLYISPEKLLSEADYLLRDMTLSLFAVDEAHCISQWGHDFRPEYARMGFLRNQFPNVPMIALTATADKITREDIVRQLQLRQPQIFISSFDRPNLSLSVKRGYQPKEKSKAIIDFITRHRGESGIVYCMSRSKTETVAQMLQKHGIRCGVYHAGLSARQRDETQDDFINDRIEVVCATIAFGMGIDKSNVRWVIHYNLPKSIESFYQEIGRAGRDGMASDTILFYSLGDLILLTKFATESNQQNINLEKLNRMQQYAESDICRRRILLSYFGETTTEDCGNCDVCRNPPERFDGTIIVQKALSAIARTNQQVSITLLIDILRGNPTTEITEKAYTELKTFGAGRDIPARDWQDYLLQMLQMGYFEIAYNENNHLKITGSGSDVLFGRERAMLVVIRREEPATAKRRKKSAATPTQAWAEESRSKEEDLFEALRALRKQLADQEALPAYIVLSDKVLHLLCLSRPTTVEAFGNINGIGEYKKKKYGKDFVALIRQFV

SEQ ID NO: 7502 - protein, 194 aa, B.fragilis
RNMELDELKQKWTELSEQVEKNELLNRQIIIDMIQSKKETHLQQQLRVEKMAFGVLGIFLGIVCYTFWRNVAPGWISWYLLGMVIWLLLMQTLMFRIIYTLKTVTEHVEQQYKRLQSYKVLMNLTYIFSYVIITPVIIAFFYIWHNPLFRTVLCVMILAGFLGDYFIYHKTGDRLKGFRDAVRALQDLKSGKQE

SEQ ID NO: 7503 - protein, 395 aa, B.fragilis
SDKLYIRYNRKLGSGRLRSMKIRTAFFIFCISLLLGACSQVATESRVQSISFEVGSSMIADTFFLDSLFLFMPETNEEALINNIDRVYESNGRYFILDKRMKQGALYTLFGKHLFTIHAVGNGKGEYVDLFDIAIDEAENKLLLLTYPSQILYYDLEGTYLSSYPLDDMYQSFAVDKGFIYLRNDTYANGVVSDYSLIVINKETGKQTSLLEPLYETAPFCSSGNYQITNTASVLFTRKFDNHIYRITGESIEPLYMVDWKDKAFPESDKQRQFQCNDLNQFCYQGKYVYTMTDLCDTPSYLLFRTNQPGMCLLSKATSTVNNYQVIINTDYQLPLPNYMSVEGKQSRIFFIYSSEVLCEQKKLSAEEDINEKMSSLLGQIKEGDNPVIFTYHVK

SEQ ID NO: 7504 - protein, 624 aa, B.fragilis
PRYWDNHSLKRSRTYCELTELKTGKVLLTNLRDGMRWMPKSNKLYYTVVAPEGNDVITLDPVTLKEEVLLRGIPEQGFSWSPNEDFLIYYPREEGVKDEGPLKRIVSPADRIPNTRGRSFLARYDIASGTSERLTYGNHSTYMQDISPDGKYLLYSSSKENITQRPFSLSSLFQVNLETLAVDTLFFEDRFLGGASYSPDGKQLLLTASPEAFDGIGKNCGNHPIANDFDSQAFIMDLATRKIDPITKEFNPSVNFLQWNKGDGCIYFSTNDEDCRNIYRYSPKDRKFEKLNLETDVTSAFAMSENNPSLAAYIGQGCYNAGVAYVYDLKKKTSRLIADPMKPTLEKIELGEMKPWNFTASDGTEIKGMMCLPPSFDPNKKYPLIVYYYGGTTPTERGISNPYCAQLFASRDYVVYVIQPSGTIGFGQEFSARHVNAWGKRTADDIIEGTKQFCKEHPFVNDKKIGCLGASYGGFMTQYLQTQTDIFAAAVSHAGISNVTSYWGEGYWGYGYNAIAAADSYPWNNPELFTKQGSLFNADKINTPLLLLHGTVDTNVPIGESIQLFNALKILGKTVEFITVDGENHFIADYPKRVQWHNSIMAWFARWLQDSPQWWEDMYPERHL

SEQ ID NO: 7505 - protein, 276 aa, B.fragilis
KNCWMGDVTLTIVAEKFQQPATDEGKLEENLSTRINSIRYYLYKDNVLIHSGIIDNVTDLNTDAYKLTFPKLAFGDYCLALATNVSEEELPDTTTPEALNLNYPGIEQTKDYFTSCYDFTVDCECGYQDFVILRRTQGVTQFQLKQLPENITGIGIEIHKVAATCQIDTLYKGETIAEYHTTVAEVTNAEEVADFSIGTFPTSGPENASITLKLYADDHSGSPIYQKTLNNISILRNQLTRISTDFNHSILGNSGFSIAINPDWDGIHDDDETIIP

SEQ ID NO: 7506 - protein, 273 aa, B.fragilis
MPNRFSRTLESVYDDYAAATMAGLMGKKEDAEYFGKRSEFYKNLFDKETQFMRPRYADGRWKTPFNPSDLAHAESRGGDYTEGNAWQYTWHVQHDVPGLIELFGGKEVFLNKLDSLFTIELKGSGLADVTGLIGQYAHGNEPSHHVTFLYALAGKPERTQELIREIFDTQYKNKPDGLCGNDDCGQMSAWYMFNAMGFYPVDPVSGHYVFGAPQMPKIVLHLPDGKTFTVIAENLSKEHKYIDSITLNGEPYTKNYISHEDIVKGGTLVYKMK

SEQ ID NO: 7507 - protein, 345 aa, B.fragilis
KKKLLSETEAAFLLATADIAWNALSRLYNCVHSYIQSKTNLYMKTHLIFLWFITFGVMACTSQPGINTGENKVEGDTIPVLDFASAIHKQVPDTFMWNSVARKITYIPLASSHLMDGHPVIEYLDDDMCIIMEGKSQWINCVDYKGNFLSTFRHVGNGPGEYVNLSSVVYHSKDSTIRIFDNGSYKHIIYNKQGKFLREISLADSEFNYLLHMQSDTYFFRGSFSKGKSEIIVTDTTLRVKFPILPFDSTADYITRGAIMLNTTGEECAPDICLFNHIYSDSVFLLTPDGLKLDFILRKGKYAPSLEDVKQFMKWNQYDPFIKGLFILKSATIIQYTIKGRFMSR

SEQ ID NO: 7508 - protein, 389 aa, B.fragilis
KSIRIFLPNPMTMKRYIRQILLGTLLLGSACTNHQEVIEEDTSVSVVFKTRQLPSTKGENDDEISVLIFRKEKDQFTKVESIQESPWLFEQEQLQKNILLPTGIYRFLLAKGFSNSPGNSGKISFVTDNNPGNLVSTSYDRNYYFQYPTRTLNGQTELNHCTTALFTDKNEESAQNSQTEYDLSQTNRTLIARKISHLQGQLCFIIQRAKKENGQYTLIDSPENSFDNALKKISAINLTIEGSSQCCYLSETGLIFKSPMSYHCLVQLQNGDYSFKRFDADQFVSLFSPIIEKTDYQRYEGAAYCEGPLLFPAPLDQTIRVTIDIDYTGTLKNKTFTLENIPLERNKMYLFTLWLLNEDVDISISPDADLDLEELKFNNQITGNDGFWN

SEQ ID NO: 7509 - protein, 506 aa, B.fragilis
FISRYSFLIKDTVSGQNHLHSHIFIKIILLPIKYEKSLFSSLYITLSHIASVRGKSVAYLINKLFSNYFPEALQAQHSYFKLIPTSSEGGDRPRPDHSLKKQQILNIMKSFKIMLITVLSVMTLSCSEKTTTEIPETELKNISCSTQLVTHSSAQTRGAAPTTLNENDFVLYAFKKNGEGNFSYEEAKHETSVIDGGVWKYNAAFPVGTYKFIAFYNLDEKNQAALNTTITGISNQTWENILKSIVITHFPSATDQYHEDMNEIFCGKTKDAIDISSGVGGDDNEIKIKLTLERIVSRIDIKFIKVASDDDHIEVPYATGNIFGGTGTTSLTSLIFTSSNVPLKYNLNGENPDYVTGVQCQVTYAAPSFQYGEANADAVKALDYQPFPKNADAINNNMETNIKKGIAKGGAYFMGSYLLPFPSSSQTLNANIQLNKANQERTIKVPGFTVTSNYVSIITVRLKSSTDAGDNNNGNDDEHLFNPKSTFIVEIEKTYDGIHNTNVDVE

SEQ ID NO: 7510 - protein, 375 aa, B.fragilis
LRNRLEMGLKNNNKNMMKNKLLSIWIGCGSVLCSYTSCSKEMEFIDSPNEQVTIQLTTTIDGQGFSTDNEIIPMKTRSTRSTDYYVTAIYDSRLVIIKETGQSAWSIEKIEDNVIPQGYIKSSDACKYTMQTTLRPGNYKFMLLVNGPKNEALHLYQNFSEEDVPWLTDTEKDYSGYEIFFATSGIVTIKKTDRLEESGQYHPLPTPLVLKRYSSLIRLCATGDGFWGSLERATDISYSIKEQSINGINLLGQIVSKDTELSFGTLTASIRKNFECQLGDKKLFFSYFGDEDEAKQLQNILTPSDGKDITVTIFQKEKQTPPIETTTQAKPNQVTTLILDKTESVLDWNQPPIIGTPIDWDPDNIPWGHLELNFL

SEQ ID NO: 7511 - protein, 297 aa, B.fragilis
LICGMNKEILKRLLAKPGEEHSVSEFDARYTGDLTKSEAEALLAENIGKLSSLQDKLYAQDRYAVLVIFQAMDAAGKDGTIKHVMSGINPQGCQVYSFKQPSAEELDHDYLWRINRCLPERGRIGIFNRSHYEDVLVAKVHPEIVLSAKLPGIMGPGDITPKFWKKRYRQINDYERYLTENGTVIIKFFLNVSKEEQKRRFLSRLEDEAKNWKFSVSDLKERSYWDDYMKAYSDMLTHTSTEEAPWYVIPADNKWFMRYAVGQILCDRMNELDLHYPEMPVEARHQIEDFKRALLNE

SEQ ID NO: 7512 - protein, 69 aa, B.fragilis
SLFIYIFVNADGGDRVYSKNSNTNQYGPYLITLRGQNVFAYRVVTETSCFGVRVINCTSGITESWVPVD

SEQ ID NO: 7513 - protein, 93 aa, B.fragilis
KVTMNIKPLADRVLILPAPAEEKTIGGIIIPDTAKEKPLKGEVVAVGHGTKDEEMVLKAGDTVLYGKYAGTELEVEGKKYLIMRQSDVLAVLG

SEQ ID NO: 7514 - protein, 422 aa, B.fragilis
IKLISNKKHMKTITLIITLLCLSLSGIAQNNAKKEFEKKYGALVKEIMNVREQKDYKKAEKLNWEILKLYDALPQTLQERARQIAGLTYYDLACYQSLQGKKKAALNNLEKAFANGWSNYNHAKSDSDLDNLRKEKRYLEVLSKMRLDSDYLYILQQANGYNRTETKPVCHNESLTDTLPRFTYMNPNDSNLVYLRKHFNLDSIAGSGDEISKIKNLLYWVHNIVPHDGNSRNPEEQNTIAMVELCQKEKRGVNCRMMAQMLNECYLAMGFKSRYITCMPKVMINDCHVINAVYSNTLDKWLWMDPTFNAYVTDEKGNLLGIGEVRERLRKNEPIVLNEDANWNNKNKQTKEYYLDYYMAKNLYYVTCPLRSEYNAETNYPGKKWSMHISLVPEGYSTNGKSGATPYDSHNDLYFWQSPYQE

SEQ ID NO: 7515 - protein, 300 aa, B.fragilis
YFIIFAFNILFMNRKTIMIPFREREGVRRKFLFLLFSCLLSVSLSAQTYQELSEKAVECVGKDSLVQAEDLLKQALKLEPKNAHNALLFSNLGLVQRKLGRYNDAVESYTYALNIAPLAVPILLNRAAIYLEQGMQDKAYVDYCQVMDVDKKNTEALLMRAYIYMLRRDYKGARLDYQRLLEIDPKNYNGRLGLATLEQKENKFREALDILNQLLVEFPEDAVLYVARADVEWDMKHDDLALVDLDEAIRLAPDSIDAYLLRGDIYLDQKKKSLAKADFEKAISLGVPPADVHEQMQQCK

SEQ ID NO: 7516 - protein, 386 aa, B.fragilis
WNTMIGLFNDCFPPIMDGVSLTTQNYAYWLHRKAGNVCVVTPKSPDARDAEEYPVYRYSSVPIPMRKPYRLGFPRIDWPFHERISRLSFELVHAHCPFSSGALAMQIAKEQHVPIVATFHSKYRADFERAIPSRLLVNYLIKKVIRFYEAADEVWIPQAAVEETLREYGYKGRIEVVDNGNDFAGTPFLQSVRQEARRTLGIRSGEFMFLFVGQHIWEKNLGFLLDSLVRLSDIPFRMYFVGSGYASHELKQKVVELGLASKVSFVGSIVEREILKRYYVAADLFLFPSLYDNAPLVIREAAALGTPSVLIRDSTASEIISDSVNGFLSPNSTEAYSNRIREILCSTAIIKQVGEEASRTIARSWEDVAGEVYDRYNRLIKRNGNK

SEQ ID NO: 7517 - protein, 426 aa, B.fragilis
KRKMKVDVLLGLQWGDEGKGKVVDVLTPKYDVVARFQGGPNAGHTLEFEGQKYVLRSIPSGIFQGDKVNIIGNGVVLDPALFKAEAEALEASGHNLKERLHISKKAHLILPTHRILDAAYEAAKGDAKVGTTGKGIGPTYTDKVSRNGVRVGDILHNFEQKYAAAKARHEQILKGLNYEYDLTELEKAWFEGIEYLKQFQLVDSEHEINGLLDNGKSILCEGAQGTMLDIDFGSYPFVTSSNTVCAGACTGLGVAPNKIGDVYGIFKAYCTRVGSGPFPTELFDKTGDQICTLGHEFGSVTGRKRRCGWVDLVALKYSIMVNGVTKLIMMKSDVLDTFETIKACVAYKMNGEEIDYFPYDITDEVEPIYVELPGWQTDMTKMQSEDEFPEEFNAYLSFLEEQLGVQIKIVSVGPDREQTIIRYTEE

SEQ ID NO: 7518 - protein, 457 aa, B.fragilis
NEAFLPPSLSGEARSEAFLFIILMKKHFITFLLLVGMTASLTAQQKYQPTEANLKARSEFQDNKFGIFLHWGLYAMLATGEWTMTNNNLNYKEYAKLAGGFYPSKFDADKWVAAIKASGAKYICFTTRHHEGFSMFDTKYSDYNIVKATPFKRDVVKELADACAKHGIKLHFYYSHIDWYREDAPQGRTGRRTGRPNPKGDWKSYYQFMNNQLTELLTNYGPIGAIWFDGWWDQDINPDFDWELPEQYALIHRLQPACLVGNNHHQTPFAGEDIQIFERDLPGENTAGLSGQSVSHLPLETCETMNGMWGYKITDQNYKSTKTLIHYLVKAAGKDANLLMNIGPQPDGELPEVAVQRLKEVGEWMSKYGETIYGTRGGLVAPHDWGVTTQKGNKLYVHILNLQDKALFLPIVDKKVKKAVVFADKTPVRFTKNKEGIVLELAKVPTDVDYVVELTID

SEQ ID NO: 7519 - protein, 68 aa, B.fragilis
KERIRNGYKRVKTKTAFHSNQDVTGCYGSCSVGLYCFFYGLFIQKISRKYFNYRMGKRLEKEDVRIIN

SEQ ID NO: 7520 - protein, 504 aa, B.fragilis
GFRLDATPLFYLFSSPKDAMASVSIWVVMAGLAAMAVYAALLYLIFYRVLIYQKQPVKIPFHRLSVSGVLLLATALLFIPIRGGFTVSTMNLSKAYFSSNQRLNHAAINPCFSLMESLSRQDNFDKQYRFMPAEEADKLFAELKDQPVAPTDSIPQLFTTEHPNVILIILESFSSKLMETLGGESNVAINMDQFGREGVLFTHFFANSFRTDRGLAAIISGYPAQPTTSIMKYPKKTQHLPSIPGSLKKAGYDLQYYYGGDADFTNMRSYLIQAGIDNIVSDKDFPLSERLSKWGAHDHVVFNRLLDDLKQHTPQKPFMKILQTSSSHEPFEVPFRRLENPRLNAFAYADSCAGDFVRQFKETPLWKNTVIVLVPDHLGAYPQDIDNLTVDRYRIPLIFIGGAVKEPRQIGTYGSQIDIAATLLGQLGLPHEEFIFSKNMLNPNSPHFGFFTFPNAFGMMTPENEVVFNCESNSIVSDEGTHKGENLPKAKAYLQKLYDDLAKR

SEQ ID NO: 7521 - protein, 221 aa, B.fragilis
LMDVKEQLKDIKTQLRLSMNGVVSQSMREKGLDYKLNFGVELPRIKSIAAAYEKSHDLAQALWKENIRECKILAGLLQPIDTFFPEIADIWVEDIRNIEIAELTCMNLFQNLPYAPAKTFQWIADEAEYTQVCGYLTIARLLMKKGDMAQRPAGELLDQAICAVQSGSYHVRNAAMLAIRKYMQHSEEHAFQVCRLVEGMENSEKEAEQMLYAMVKDEIND

SEQ ID NO: 7522 - protein, 474 aa, B.fragilis
FIKVIAMKFKSTFMTACLGIGLCTSCTPETPTAPQDYTQYVNTFIGAADNGHTFPGACLPFGLIQASPETNAIGWQYCSGYNYQDSLIWGFSQTHLNGTGCMDLGDLLVMPVTGQRVRDDYKSGFSKKTESATPGYYTVELDKYKVKAELTATDHVALHRYTYQNADSASLLLDLQHGLVWNPQQYKSHVKACEINWEDAQTLTGHVRSSVWVNQDLYFVMKFNKPVTDSIYLPMEETEKGKRLIMSFDMKPDEQLLMKVAISTVGVDGAHKNMEKELADWDFDGTRQKAKDSWNSYLSRIEVTGTPDELENFYTSFYHALIQPNNIADVDGRYRNAKDSIVKSSSGVYYSTFSIWDTYRAAHPFYTLAVPERVDGFINSMIEQNQAQGYLPVWTLWGKETNTMIGNHSVSVIAEAYKKGFRGFDAEKAFDAIKQTLTVSHPKSDWETYMKYGYYPTDKVDAESVFTYPRIGLR

SEQ ID NO: 7523 - protein, 713 aa, B.fragilis
NMIFETYFKHVYLYVACLYATSGTGLYAQTLHQHAGTQRDTVPVTFPVQHLEEVVITAGRPGITAGAVSNRISSSEIHRVAGSSLATLLERISGVSSLSTGTTVSKPVIHGMHGNRILIINNGARQTGQQWATDHAPEVDINESGNILVIKGADGVRYGSDALGGIIVMEQPPLAFGQEHPKGRIATFYGSNGHRYAATGSLEGTLPFLRNIAWRMQGTYSNSGDRSTAHYLLNNTGTRGLHFSASAGYDSGRLRIEGIYSHFGEQTGVMFGAQMGSEDLLAERIRLGRPVYTDPFTRHISYPYQKVVHRTAIGKVRYNAGAAGVFYWQTSWQKDDRRENRIRRMNHSDIPAVALLLSSIQNTFRWKLDYGPWQTEIGGQMIFTDNHSKAGTGIVPVIPNYTEMQAGAYGIQKYRYERTAVEAGIRLDRQETRAGGYDWTGNYYGGNRKFCNFTYGLGGHYRLSKYWELTSNFALTWRAPHVHELYSNGNELGSGMFVRGDASMNAERSHKWITSVSYRDKVFHIRLDSYLQWIKGYIYDEPLKENITVISGTYPVFRYRQTPAFFRGADFDFRFMPAASWEYHLIASFIRANEQGTGNYLPYIPSFHLSHELAWTHQTKSHILFRLTARHKFVAKQNRFNPATDLIPYTPPAYHLFGAEASMECPVKYGNKLTLTVTADNLLNREYKEYTNRSRYYAHDMGRDIRCTLNWNF

SEQ ID NO: 7524 - protein, 471 aa, B.fragilis
SIISYNFATQFNKTVRTMAAKPGIPKGTRDFSPVEMAKRNYIFNTIRDVYHLYGFQQIETPSMEMLSTLMGKYGEEGDKLLFKIQNSGDYFSGITDEELLSRNAAKLASKFCEKGLRYDLTVPFARYVVMHRDEITFPFKRYQIQPVWRADRPQKGRYREFYQCDADVVGSDSLLNEVELMQIVDTVFTRFGIRVCIKINNRKILTGIAEIIGEADKIVDITVAIDKLDKIGLDNVNKELAEKGISEEAIAKLQPIILLSGTNAEKLATLKTVLSDSETGLKGVEESEFILNTLQTMGLKNEIELDLTLARGLNYYTGAIFEVKALDVQIGSITGGGRYDNLTGVFGMAGVSGVGISFGADRIFDVLNQLELYPKEAVNGTQLLFINFGEKEAAFSMGILSKARAVGIRAEIFPDAAKMKKQMSYANVKNIPFVAIVGENEMNEGKAMLKNMESGEQQLVTAEELIGALTK

SEQ ID NO: 7525 - protein, 359 aa, B.fragilis
TGTSDYDFYSLYNINKPIERKMKTITSKTILMLLTGAFLVLLFNSCTKDPVIPEDETKNKLHEDPAKVTVRLVECHLHADWNEIQTNGGPHQNPESPARHIKRIQDITYELKAGQGWTLAEGSQKKFYVQKNGEYKNQGRFTPAPVYLMFIYYYNAKGELMNNQFVENGQENIHQHFFTPENIKPTFDGQIEADDNDPQKLIDYLYVDTTPWDKTYHSGEAEITGRDNPVGLKGIIRFLKDRKEFDLKVRLYHGYESKKNPQTGTFDPFYKPSGVLIQRGTWDINLNLPVVVFWSREEFIDIDEEANLEKVGEDSLDEGSNRTVHSIMETFNLTWKEALEEFITYTYKAGDAEGGAIWL

SEQ ID NO: 7526 - protein, 158 aa, B.fragilis
PVNSMSDLENKTQEETPKKRPYNLREKKEKKAAYRSLIRPELADELYDRILNIIVVQKKYRDPDYSAKDLAKELKTNTRYLSAVVNSRFGMNYSCLLNEYRVKDALHLLTDKRYADKNVEEISAMVGFANRQSFYAAFYKNVGETPNGYRKKHAEKKK

SEQ ID NO: 7527 - protein, 303 aa, B.fragilis
SVNPAYEERANNVRPVRSNRDNRTNQQWLEKALKKASQADVIVAALGESSKMSGESSSRTNFNLRNVQHTLLEALLKTGKPVVLVLFTGRPLVLNWEQEHVPAILNVWFGGSEAGPAIGDVLFGAVNPGGKLTMTFPKSVGQIPLYYAHKNTGRPLKEGKWFEKFRSNYLDVDNDALYPFGYGLSYTTFRFSDITLNRSSIGMDNELVASVTVTNTGDRAGSEVVQLYIRDLVGSVTRPVKELKGFEKIYLQPNESRTVRFTIAPEMLKFYNADLKFVAEPGDFDVMIGPDSRNVKTARFTLR

SEQ ID NO: 7528 - protein, 66 aa, B.fragilis
SFVYSILRENHLCGTLCDSVVNLILFYSLVYPVQRNVNRAVFTFRLSGPIITSKSPGSATNFKSAL

SEQ ID NO: 7529 - protein, 102 aa, B.fragilis
LEPFGLLFGKKGLDTRIKNKLDIRIKMKKVKKSTWVTVALLIYVSATAAYLLPRNHEVSDTEKYLTLAASYVIVLVLWLVLRKKEQMQQRRREEEHMNNLKK

SEQ ID NO: 7530 - protein, 707 aa, B.fragilis
KVYLIFILLTLIFRCMKQVNLRVCRMILPLLFGLFLSLSAYAQQVSVKGHVKDSTGEPVIGANVVVKDNSSIGTITDLNGNFVLSVPQNSTLVISFIGYKPVEMKAAPSVTVTLHEDAVMLQEAVVIGYGTVKKNDVTGSVMAIDADRMVKGMATSASDLLVGKAAGVSVITDGGAPGAGATIRVRGGSSMSASNDPLIVIDGVPVDNTEIKGMGNPLSTVHPNDIETFTILKDASATAIYGSRASNGVIIITTKKGQSGRVKVDYSGTFSISTKSNTVDVMKAEDFRNFVIEKFGENSLQANALGKTSTDWQDEIFRTAFSTDHNVSVSGAVPHMPYRVSVAYTNENGILKTSNMQRLTGAINLNPNFFDKKLNIQLNVKGVYNKNRFADRAAIGLATQYDPTQPVYMEGNPYGNGYFMYMKQEGDKASPIDIGLANPVAMLEEKDDTSTVYRSIGNAQIDYKFHFLPELRANLNLGYDVSKSKGDVIIADNSPLTYCTGNFKNGFGENSHYTQLKRNTLLDFYLNYANTFGVNYIDVMAGYSWQHFYNSTTNSYPYSAAYAEKTGEEFYKKGDDYASESYLVSFFGRLNYTLLNRYLVTFTLRNDGSSRFSPDNRWGLFPSVALAWKLNEESFLKNVNAISDLKLRLGYGVTGQQNLGNGDYPYMARYMYSKAGANYYFGDTEYSLIAPQPYDQNLEGEKTTPGT

SEQ ID NO: 7531 - protein, 1335 aa, B.fragilis
RIPACMKKILFLLLLLPLMVSAQTYKYIGVEDGLSNRRVYYIQKDKKGYMWFLTHEGVDRYDGKEFKRYKLMDDGEELNSLLNLNWLYLDHESTLWEIGKKGKVFRYDPLRDQFTLVYKLPEEKIKDRPAPISYSFIDRNNNIWLCNEETLYLYNTHTLQTLQIKNEIGEDITDIEQIDDTHFFIGTEQGIHHAELKNQGLHLLPCDKLDNLPIQINELYFHRPSRKLFIGTFERGIYVYDMNTKQSTQPHMSLTDVSITRIKPLNNKELLVATDGAGVYKININSYLTTPYIVADYNQYNEMNGNNISDFYVDDEQRIWLANYPIGITVRNNRHSSYNWIKHSIGNKQSLINDQVNSIIEDSERDLWYATNNGISYYNSETGVWHSFMSSFEKNGGNKNHIFVTLCEVEPGIIWAAGYSSGIYQINKRTLSVEYITPSSLYGVNIRPDKYIRSIIKTADGDIWSGGYYNLKRIDFHKKTLRLYPKLNSITSIMEKDSKQMWIGTATGLYLLEKESGKYQRIELPVESMYIYSLYQARNGLLYIGTSGSGLLIYDPEKRTFTHYHRDNCALISNNIYTILSDTDDDIIMSTENGLSSYYPAEKLFHNWTKDQGLMASHFNAGSGTLRKNGNFIFGSSDGAIEFNKEMKIPRKYSSKMVLSDLTIFYQTVYPGDENSPLSTDIDDTKELELSYSQNIFSLKVSSINYDYPSNILYSWKLEGFYDQWSRPGNENIIRFTNLSPGEYTLHIRAVSNEDKRIVLEERTMKISIAQPIWLSFWAMLVYAIVLAVIAIITLRIIILRKQRKVSDEKIHFFINTAHDIRTPLTLIKAPLEEIREREALTKDGISNMNTALRNVNALLRLTTNLINFERADVYSSELYISEYELNTYLTETFNAFRPYASVKHINFTYESNFRYLNVWIDKEKMDSILKNIISNALKYTPENGSVHIYASETNDSWNVEVNDTGIGIPANEQKKLFKIHFRGSNAINSKVTGSGIGLMLVWKLVHLHKGKINLSSVEHQGSSIKVSFPKDSKHFHKAHLATRTRELSTEQVPHVSPAEIYEKAKKQHDQNLQRLLIVEDNDELRNYLTHTLSDNYTIQTCSNGKEALTIVKEYMPELIISDIMMPEMRGDELCAAIKNDIETSHIPIILLTALNDEKNILEGLKIGADEYIVKPFNIGILKATIANLLTNRALLKSKYANLEVSEEEEVSPNCATDLDWKFIATVKKSVEENIDNPAFNVDVLCNLLNMSRTSFYNKLKALTDQAPADYIRLIRLKRAAALLKTGQHSVTEISELTGFNDVKYFREVFKKHFKVSPSKYCKEGGKEDVEEQQE

SEQ ID NO: 7532 - protein, 180 aa, B.fragilis
MNIYLEAFGIFFKIGAFTIGGGYAMVPLIENEIVTKRNWISKDDFIDLLAIAQSAPGILAVNISIFIGYKLRGIRGSLVTALGTVLPSFVIILAIAMFFHNFKDNPIVERIFKGIRPAVVALIAAPTFSMAKSAKVNRYTLWIPVVSALLIWLLGFSPIWIIIAAGVGGFCWGKWKQSHP

SEQ ID NO: 7533 - protein, 459 aa, B.fragilis
NRAYQLSGTGNDEINLLNKYTMKVKPDLSFWKLWNISFGFFGVQIAYALQSANISRIFATLGADPHSLSYFWILPPLAGIIVQPIIGAASDKTWTRFGRRIPYLFAGSLLAVWVMCLLPNAGSFGMAVGTAMIFGLVALMFLDTSINMAMQPFKMLVGDMVNEKQKGLAYSIQSFLCNVGSLIGYLFPFIFTFIGISNTADKGTVPDSVIYSFYIGAAILILCVIYTTVKVKEMPPKEFEEFHGITADEKKEKADFISLLKHAPKVFWTVGLVQFFCWAAFMYMWTYTNGAIAATVWGTTDVQSAGYQEAGNWVGVLFAVQAIGSVIWAVILPLFKARKQAYALSLVLGGIGFISTLFFHNEYLLFISYLLIGCAWAAMLAMPFTILTNSVSGKNMGAYLGLFNGTICVPQIAAALVGGGLLHLVGGHQVNMLVLAGVLLIAGAACVYFIKETMAHHEA

SEQ ID NO: 7534 - protein, 1294 aa, B.fragilis
AIRQTISCFHIGICLICFSAYPVIPPLTRGRLKFFYSISFSPPTNLLIFARKENKIVYTHMILFFRTPSKSVIAVESNHELNANDNNKLCWLFGEAMPESEENLQGCFVGPRREMITPWSTNAVEITQNMGLDGISRIEEYFPVKDENADHDPMLQRMYKGLNQNVFTTNRQPEAIIYIDDLEAYNEKEGLALSKEEMDYLKKVESDLGRRLTDSEVFGFAQINSEHCRHKIFGGTFIIDGVEQESSLFQMIKKTTQENPNKIISAYKDNVAFAEGPVVEQFAPADHSKPDFFRIKDIKSVISLKAETHNFPTTVEPFNGASTGTGGEIRDRMGGGKGSWPIAGTAVYMTSYPRTEEGREWEDILPVRKWLYQTPEQILIKASNGASDFGNKFGQPLICGSVLTFEHTENNETYAYDKVIMLAGGVGYGTQRDCLKGQPEAGNKVVVIGGDNYRIGLGGGSVSSVDTGRYSSGIELNAVQRANAEMQKRANNVVRALCEEDENPVVSIHDHGSAGHVNCLSELVEECGGLIDMSKLPIGDKTLSAKEIIANESQERMGLLIKEEAIEHVRQIAERERAPMYVVGETTGDHRFAFQQADGVRPFDLAVDQMFGSSPKTYMIDKTVERHYTMPEYETSKLHEYLTQVLQLEAVACKDWLTNKVDRSVTGKVARQQCQGEIQLPLSDCGVVALDYRGEKGIATSIGHAPQAALADPAAGSILSVSEALTNLVWAPLAEGLDSVSLSANWMWPCRSQEGEDARLYTAVKALSDFCCALQINVPTGKDSLSMTQKYPNGEKVVSPGTVIVSAGGEVSDVKKVVSPVLVNDAKTTLYHIDFSFDNLKLGGSAFAQSLGKVGSEVPCVQDAEYFRDAFLAVQELVNKGLILAGHDISAGGLITTLLEMCFANVEGGLEISLDKMKETDIVKILFAENPGIVIQISDKHKDEVKKILEDAGVGFIKLGKPTDERHILVNKEGATYQFGIDYMRDVWYSSSYLLDRKQSMNGCAKKRFENYKMQPLEFAFMPGFKGKLSQYGITPERRTPSGIRAAIIREKGTNGEREMAYSLYLAGFDVKDVTMTDLISGRETLEDVNMIVYCGGFSNSDVLGSAKGWAGGFLFNPKAKEALDKFYAREDTLSLGICNGCQLMMELGLVNPEHEKKGKMLHNESHKFESTFVGVTIPTNRSVMFGSLSGSKLGIWVAHGEGKFSLPYDEDQYNVVAKYSYDEYPGNPNGSDYSIAALASADGRHLAMMPHLERAIFPWQNACYPADRVHNDQVTPWIEAFVNARKWVEEKKK

SEQ ID NO: 7535 - protein, 1021 aa, B.fragilis
SVVHSKPYTIMNLAKYSLDNTKVIYFFLAVLLIGGVFSFGKLGKKEDAPFVIKSAVIMTRYPGAEPAEVERLITEPISREIQSMSGVYKIKSESMYGISKITFELLPSLPASSIPQKWDELRRKVLNIQPQLPSGSSVPTVSDDFGDVFGIYYGLTADDGFSYEEMRNWAERIKTQVVTADGVMKVALFGTQTEVVNISISVNKLAGMGIDPKQLAGLLQSQNQIINTGEITAGEQQLRVVANGMYTTVDDIRNQVITTRAGQVKLGDIAVIEKGYMDPPGTIMRVNGKRAIGIGVSTDPQRDVVLTGEMVDKKLAELLPLMPVGLNLESLYLENVIAKEANNGFIINLIESILIVIVIIMLVMGMRAGVLIGTSLVFSIGGTLLIMSFMGVGLNRTSLAGFIIAMGMLVDNAIVVTDNAQIAIARGVDRRKALIDGATGPQWGLLGATFIAICSFLPLYLAPSSVAEIVKPLFVVLAISLGLSWVLALTQTTVFGNFILKSKAKNAGKDPYDKPFYHKFEKILSVLIRRKIVTLGSMIVLFVVSLVVMGMMPQNFFPSLDKPYFRADVFYPDGYGVNDVAREMKKVEAHLLKLPEVKKVSITFGSTPLRYYLASTSVGPKPNFANVLVELNDSKYTKEYEEKFDVYMKANFPNAITRTSLFKLSPAVDAAIEIGFIGPNVDTLVALTNQALEIMHRNPDLINIRNSWGNKIPIWKPIYSPERAQPLGVSRQGMAQSIQIGTNGMTLGEFRQGDQVLPILLKGNSVADSFRINDLRTLPVFGNGPETTSLEQVVSEFDFRYRFSNVKDYNRQLVMMAQCDPRRGVNAIAAFNQIWSQVQKEIKIPEGYTLKYFGEQESQVESNEALAKNLPLTFFLMFTTLLLLFKTYRKPTVILLMLPLIFIGIVLGLLLLGKSFDFFAILGLLGLIGMNIKNAIVLVDQIDIENQSGLDPRKAVIKATISRIVPVAMASGTTILGMLPLLFDAMFGGMAATIMGGLLVASALTLFVLPVAYCAIHRIKG

SEQ ID NO: 7536 - protein, 437 aa, B.fragilis
LILNMKRMKAMHWMMYTLLGITLLLTACVDDDKDLSQPKEPEKTTDLIIPDDADWTTTRSVNLSIHSPVATRVAIYTDAACTDESLLAETPVSDTSKSIELDVAKANRALYVQYPAGKGKEVISVPINRASTRAELSIKLPENVSGFDTNGGEGAYSYQWYPVKGGEATLMMEDNWPETGDYDFNDFVIGYRTQATFFDGHGGSKKDYEQDGLEIKITFRAMGGYLPYRLGLQLDKTHARYIDDVIEIEGNDLVKMELQNPGEDAPAIFIFTGTEQLRKRNNGGTFYNTEPDHAIANNDLVTIKYRLKINCFKNLEKTQALWAAATSENQNFFLQKEKNGGREIHLRGYEPTAYYSNSYAGEAGGNMRTDIKYCSTDNFVWGIKIPVAIPHPIEKIDIMQVYSKFRSWITEPNHSDPSSPDFNENWFKYYDTSKVIG

SEQ ID NO: 7537 - protein, 165 aa, B.fragilis
KSRNVMKKLMWIVCLLVVSVTVQAQFEKGKWIVNPSVTGLGLSYSKSEKTQFGLQAQGGAFLVDNVALMLTAGANWSKPEDKYTLGVGGRYYFDKCGIYLGAGLKMNRYNWKVGDTTDFAFGAEAGYAFFLTRTVTIEPAVYYDLSFKDSDLSKFGLKVGFGFYF

SEQ ID NO: 7538 - protein, 354 aa, B.fragilis
SMGNMKKNYGCILAALILLTACGQKKEDSVTTVRPVKTARVESRSEIRKDFSGIVEAVDYVKLAFRVSGQIINLPVVEGQRVKKGQLIAAIDPRDLALQYAADKSAYETAAAQVERNKRLLARQAISVQEYEISVSTFQQKKSAYELSSNNMRDTRLTAPFDGSIEKRLVENYQRVNSGEGIVQLVNTKKLRIKFTIPDAYLYLLRSKDQRFRVEFDTYRGHIFNAKLEEYLDISTDGTGIPVTITIDDPAFDHALYEVKPGFTCSIRFSADVGPFLEESMTVVPLSAIFGESEGNKTYVWVLNGNQVNRREVTVYSPMGDAQAFISKGLKAGETVVTAGVTQLVEGETVKELK

SEQ ID NO: 7539 - protein, 773 aa, B.fragilis
KAMKQFLKVDEWNIIEEGFHPDNMRASESIFSLGNGRFGQRGNFEETYSSDSLQGSYVAGITFLDRTRVGWWKNGYPRFFSRVPNAPDWSGIYLRLIDEELDLVHWDVEAYRRRLDMREGISYRDFRVTSPKGHTLEVHVEHINSLANQNLCLIKYSVTSVNYEGKISLVPFLNGDVKHENSNFDEKMWNILRAEATNEYAYLWVQTKHEDSQICLGMTYRFYKNSKPTHISPIKIEKEKLTGFSAGADVKPGDRVTLEKYVAILSSLQCDRQELVEYAVDEAQAAKEQGWEALVGAHKQQWEEIWEESDVMIEGDPAAQQGIRFNIFQLNQSYRGDDARLNISPKGFTGEKYGGNTQWNTELCCVPYFLLSTPREISRKLLLYRYNQLPKAIENARKLGFGGGAALYPMVTIHGEECHNEWEITFEEIHRNNIIVYAIMQFSRVTGNKEYIAYYGLEVMIAISRFWSQRVSFSEARQKYVLLGVTGPNEYENNVNNNWYTNYSCVQCLQSTIECLEMVAHEYPEEYNRIRRSTEFRHAEETARWKEIIEKMYLPEDKERGIFVQDDGYPDKVLGTVDDIPVNERPINQHWSWDRILRSCYIKQSDVLLGLFLYYEHFDRETIRRNFRFYEPRTVHESSLSPFVHAILAAWIGDTEEAYRLFLHSTRLDLDDYNNEVHQGLHVTSMAGSWQIIVRGFAGMKILDGQLDFTPIIPEAWDSYTFKVNFRNCTLQMKVGKQEIKISLLEGYELNIRISEVVYNLKKGKDLIVPKQN

SEQ ID NO: 7540 - protein, 97 aa, B.fragilis
QIKLCALFIFRAILWYEWWEMILDQRQVRGDLFCHEGILLSLADRGCVGLKSGSLWFKREGTLILNQYPLSFKLKSHSRYSCFWSTFCLSAVYFYAS

SEQ ID NO: 7541 - protein, 80 aa, B.fragilis
GCDCFHFPQQKPPTPAAIIIQMGEKPNNQMSRAETTGIQRVYRLTLADFAMLKVGAAISATTAGRIPLKIRSTMGLSLKL

SEQ ID NO: 7542 - protein, 341 aa, B.fragilis
KPICTMSKPQITIKDIARELGVSPSTVSRALKDNPDISQETRDAIHKYAREHNYKPNVLALNLRTSRSNTIGVIIPQLVHHFFSCVLSGIERTAAEAGYNILVAQSNEEYEREVKIVHSFLAARVCGVITSLAKDTSRYDHYQELLDNNIPIVFYDRICTGINTERVVVDDYAGSFAAVEYMIQTGCKRIFFYSAAPHLEISKNRRNGYMDAMKKYRIPVDQSMIKLCDSREKAIAITPALLERPDHPDGFFAINDETASGILYSCKLTGRKVPDEVSICGFTDGAIAQSTDPKLTTVEQHGEEVGKSTIRLLIDKLEGNDEGKSGNKIVRTNLVVRGTTK

SEQ ID NO: 7543 - protein, 279 aa, B.fragilis
KPIMNLRKLILLLALFLATGVGAQIQQQSPYPKREFRGAWIQAVNGQFRGIPTEKLKQTLIDQLNSLQGAGINAIIFQVRPEADALYASQLEPWSRFLTGVQGQAPSPYWDPMQFMIDECHKRGMEFHAWINPYRVKTSLKSELSANHLYNIHPEWFVTYNNQLFFDPALPESRRHICMVVADIVSRYDVDAIHMDDYFYPYPAKGMDFPDDASFARYGGGFTNRADWRRSNVNILIQKIHETIRGLKPWVKFGISPFGIYRNGKERSARKQDQRPAEL

SEQ ID NO: 7544 - protein, 937 aa, B.fragilis
LTIFAVQVTKMLMTDSKYISIKGARVNNLKNIDVNIPRNKLVVITGLSGSGKSSLAFDTLYAEGQRRYVESLSSYARQFLGRMSKPECDFIKGIPPAIAIEQKVNSRNPRSTVGTSTEIYEYLRLLYARVGKTYSPVSGEEVKKHSIEDIVNCMLSYPEGTRYTVLTQIYLHDGRTLEQQLEIDRKQGFNRLEVNGEMVRIDEYAAGKEDVVYLLVDRMTAAKSKDAISRLTDSAETAMYEGDGMCMLRFYQPDGTTRLHTFSTKFEADGMTFEEPNDQMFSFNSPIGACPVCEGFGKVIGIDEHLVVPNRSLSVYDGAIVCWRGEKMGEWREELIHNAEKFNFPIFTPYYELTDEQRRVLWEGNQYFHGINDFFKMLEENQYKIQYRVMLARYRGKTLCPKCHGTRLKPEAGYVRVGGKNISELVDLPITELQKFFDSLTLNEHDQAVARRILTEINSRIRFLIDVGLGYLTLNRLSNSLSGGESQRINLATSLGSSLVGSLYILDEPSIGLHSRDTDRLVHVLRQLQQLGNTVVVVEHDEEIIRAADYIIDIGPNAGRLGGQVVYEGDMKDLKKGSNSYTVKYLLGEETIPVPEHRRPWNNYIEIKGARENNLKGVDARFPLNVMTVVTGVSGSGKSTLVRDIFYRALKRELDECSERPGEFVSIEGDLRNLRNVEFVDQNPIGKSSRSNPVTYIKAYDEIRKLWADQPLAKQMGYTAGHFSFNNEGGRCEECKGDGTITVEMQFMADLVLECESCHGKRFKADTLEVKFQDKNIYDVLEMTVNQAIEFFTEHGQKKVVKKLIPLQDVGLGYIKLGQSSSTLSGGENQRVKLAYYLSQEKADPTLFIFDEPTTGLHFHDIRKLLDAFDALIRRGHSIVIIEHNMDVIKCADYVIDLGPEGGDKGGNIVATGTPEEVAACAASYTGQFLQEKLNHL

SEQ ID NO: 7545 - protein, 256 aa, B.fragilis
ERGISSSPVVKTPIMFVSIACGAISGFHATQSPLMARCMTSERHGRPVFYGAMITEGIVALIWAAAATYFYREHGMEENNASVIVDAITKDWLGAVGGVLAILGVIAAPITSGDTAFRSARLIVADFLKLEQKSMRRRLYICVPMFIVAIGLLLYSLRDKDGFDMIWRYFAWANQTLSVFTLWAITVYLARARKWYGLTLVPALFMTAVCSTYICIAPEGLGLSHWVSYVTGGLCTLIGAVWFIVWKKGIGYSYKK

SEQ ID NO: 7546 - protein, 184 aa, B.fragilis
NIMIYLQLFYTFFKIGLFGFGGGYAMLSMIQGEVVTRYDWVSTQEFTDIVAISQSTPGPIGINAATYVGFTATGSIWGSVIATFAVVLPSFILMLTISKFFLKYQKHPAVEAVFCGLRPAVVGLLASAALVLMNVENFGSPTDDTYTFVISIIIFLVAFIGTKKYHANPILMIIACGIAGLILY

SEQ ID NO: 7547 - protein, 426 aa, B.fragilis
KYMMKNKLILLFALGLCAQVQAQVPHLSRETYRERVEAYSQVLKQQHLKSMASTDARKIAFTGFLPKVDISAEGTLNLKEMDSWDGPAGQYRNHTYQGIFVVSQPLYTGGALQAQNRIAKADEKLDQLSEELTRDQIHYQSDAFYWNASSARAMLNASAQYQEIVEKQYEIIQDRFKDGAISRTDLLMISTRRKEAELQYINARQNYTLALQKLNILMGEEPNAPVDSLCAIGVVCPPVTLLPLDDVLQRRADFASTEVNIQKSEAQRKAALSQYNPQVSMYVTGGWATASPNMGYDVKFTPIVGMSVNIPVLRWGARFKTNRQQKAYTGIQKLQQSYVVDQINQELAAALTKLKETEEQVKTAEENKELAEENLDLITFSYNEGKASMVDVLSAQLSWTQAHTSLINAYLAEKMAVAEYRKVISE

SEQ ID NO: 7548 - protein, 89 aa, B.fragilis
ITLVLSNEYLAKFMIVYGFECTTDYTDFHRLMIYIIDNKIKKSVLIRVICGEINYCVERALLFQFLYRFTFYQLCHTGCHHSLACFQSF

SEQ ID NO: 7549 - protein, 254 aa, B.fragilis
SSVLVRLVSTVTEKNDPLGSKTNGLQNYDDLYADVLLWARNGWVDYNIPQIYWQIGHPAADYETLVKWWAKNTENRPLFIGQSVMNTIQNADPKNPSMNQLPRKMALERAYQTIGGSCQWPASAVVENAGKYRDALVQEYHKYPALVPVFDFMDDKAPGKVRKVKKVWTEDGYMLFWTAPKAKDEMDRAVQYVVYRFDDKEKVNIDDASHIVAVTRNNFYKLPYKDGKNKYRYVVTALDRLHNESKSVSKKVKL

SEQ ID NO: 7550 - protein, 406 aa, B.fragilis
PHRAIGVREGTSYIIFTMKIHILFGMIGFILLSGCNRAAEKNPRFYDAGVSRELAGHRKAQIKNLKYELSFNIPRQKEAAIEGDITLRFDLASRQEVLIDFREEREKIKEVIANGVPVDKVRFENEHIILPASSTVEGANGIRIRFTAGNQSLNRNDEYLYTLLVPDRARTVFPCFEQPNLKAEFTLQLELPADWKAVSNTYIRSETVTDDRKTVCFAPTEPLSTYLFSFVAGKLERREYTRDGRTIAAYYRETDPKKVAQLDIVFGQVMASLHWLEEYTGIAYPFAKYDFIVLPGFQFGGMEHTGATLYNDNGIILSEHPTPDEELNRAELIAHETSHMWVGDSGTMDWFDDGWTKEVFANYIAARIVEPLFPEINHTQNKLKTFTAAITFRGSYYGDECHPSTA

SEQ ID NO: 7551 - protein, 522 aa, B.fragilis
LPMKRRTCGLAIRVPWIGLTTDGLKKFLPTILQPGLSNPCFRRSITPRISSRPLRQLSLSEDRTMGTNAIRQPLDNLRNAGLIYGQIIYNKAPVMMEKLVDKMGEANFRSGIQEYLKTYSYGNATWDDLIRILDSKTTEDLAAFSDVWVNRKGMPTLTFRTDGQELEIRQHDPYNRGLLWPQRFAVTLCGERDSVIRVNMTDTLFRMQLPFVPSRVLPNTDGRGYGVFVPDEPALHWLAAHWWEIEDDTARQSLLMVLYENYLAKHISADDWVNSLITGLPAEKNALVASTASGYLANVMWEIAPANRAEVEARIYTMTQNHPLPSCRIQLMRLFMQNAISEPMVKKLYILWQQQSDKHLNRQDYTTLAYELAIRMPLESEQILRTQRARIDDPDRLRQFDFISRAAVSDTARLDTLFNSLLAAENRRIEPWTTAVIRYLNHPLREDQSVKYIRPGLEVLEEVQRTGDIFFPKNWAAALLGNHLSSSAYEEVVRFLNERPDYSPLLKNKILQAAYPLYRANN

SEQ ID NO: 7552 - protein, 415 aa, B.fragilis
SRMKEFVISEAKVETAVLVGLITQTQDERKTNEYLDELAFLAETAGAEVVKRFTQKLPTANSVTYVGKGKLEEIKEYIRIEAEEDREVGMVIFDDELSAKQIRNIEAELKVKILDRTSLILDIFAMRAQTANAKTQVELAQYKYMLPRLQRLWTHLERQGGGSGSGKGGSVGLRGPGETQLEMDRRIILNRMSLLKERLAEIDKQKSTQRKNRGRMIRVALVGYTNVGKSTMMNLLAKSEVFAENKLFATLDTTVRKVIIDNLPFLLSDTVGFIRKLPTDLVDSFKSTLDEVREADLLVHVVDISHPGFEEQIEVVNKTLADIGGGGKPMILIFNKIDAYTYVEKALDDLTPKTKENLTLEELMKTWMAKMEDNCLFISAREKINIDELKSVVYQRVKELHVQKYPYNDFLYQTY

SEQ ID NO: 7553 - protein, 470 aa, B.fragilis
QIKETTMKKIILFSTLCASLFLGSCSSSFLDQEPPLYVNENDIFTSPTRIEATLNGLYAAIKNTGTKSLMGGKSYLVFDNRGDDVINISNNLVTLFNTYNMNVGITDAENADTWTYAYLAINKVNTFLQSLEGAREVAGENYDRYVQEAKFVRALAYYYLNNLYPTPYSVNPDAKSVPLRLTAEAGTENNNMPRSTVKQIYEHILSDLENISALDTEVNTYTGVTHATQAAANMLKMRVYMAMNEWDKAITAGELVTGYSLPEDVTLIYKAPYFSQESIFSLPMADTNIPNTQQSLAEYYYDGKIMLIDTKSGIMSKPDYSLATDKRIIAFKGEKDLLMKFTDAKTKLQWVPIFRYAETLLDLAECYANKAGGEATAKSLLKQVRGRSVDAATDPLNIDNLSGDALKEAIYNEKRLEFIGEGIRGIDIMRRGEHFIKVGENETINVGPSDEKYTWPIPQVELLLNKDINK

SEQ ID NO: 7554 - protein, 468 aa, B.fragilis
FVVCNKRSMGKTYRRLTEDEVLHLKSQSCLADDWNKVAVAEEFTTEFVHHTRFSGEVKLGVFHSDFILPGGIKKHSGLRHVTLHNVTVGDNCCIENIQNYIANYEIGNNTFIENVDIILVDGLTQFGNGVETAVLNETGGREVLINDKLSAHQAYILALYRHRPELISRMKEITDYYSNKHASAVGTIGNHVMILNTGSIKNVRIGDFCRICGTCRLYNGSINSNESAPVHIGHGVICDDFIISSGSHVDDGAMLTRCFVGQACQLGHNYSASDSLFFSNCQGENGEACAIFAGPYTVTHHKSTLLIAGMFSFMNAGSGSNQSNHMYKLGPIHQGTLERGAKTTSDSYILWPARVGAFSLVMGRHVNHADTSNLPFSYLIEQQNTTYLVPGVNLRSVGTIRDAQKWPKRDKRTDPNRLDYINYNLLSPYTIQKMFKGRSILKELKRVSGETSEIYSYQSAKNKKLLVE

SEQ ID NO: 7555 - protein, 227 aa, B.fragilis
RGCRARLRKSTLIRVPKIKNSSLNSGIRYYEIAIHKFLGNSIIKRLEGINFKDNEEIRRRLKPDTEIGVGEWVDIAGLIAPKSEVEKLIDGIESGEINRLKSMNACFAAMHDNYYTYEWTWAYHKIQEFYGLNPETITAKDIIAIVRAWREAVVGLDRMVYDDARKEFSLSSMTGFGADGSRDEMKLDFGQVRGDFESNPFVTAVLKHIDDKTALGEELINRIGQLA

SEQ ID NO: 7556 - protein, 982 aa, B.fragilis
YNCSSAKTLQISYIGMQTAEVAIAPVIKVILKTDSKALDEVVVVAYGTQSARTVTASVSTVRADALKDVPSVSFDQMLQGRASGVSITTPSAGVGQAPIVRVRGVNSITSGTSPLYVVDGVPIESGNLSYLANANALADINPADIVSMDVLKDAAAAALYGSRAANGVILITTKQGQSGKVKVSYDGFVGFSNATDFYEMMNAQEYVDFKNLAVKNRYGTDELSLTTGYVSPYGNKAFNMMKDANGNYVDTDWKDAAFQNGLSQSHSVAVSGGSDKVRYYLSGNYTTQEGIVKGDKYDRLGVKANINVQATDWLKVGMNTNVTTGTTSYVDAARRGSNFAVGGFPRLALINAPNLPMYNEDGTPYYLAQGLGYGGNTVFSTFSNPAAILSLGNGLSSDVTRFIGVFYAEATPLKGLSLKTQYGVDYARIEEQRFWSPLHGDGVNSKGLANAYNTKNNRWTWTNTATYNFSLGQNNFNLLAGTEASERNNSRWTAQRKDLQDDKFVVFQGPFGSATAGGSLSNNTMVSYFGRINYDYASKYIVSLNYRRDGYSALSEKNRWGNFGGVSAAWRVSEEGFFKPLRNVVDDLKIKGSYGVVGNTDIYDYASKSFYSSYNYGINGTYGLAQIADPNLKWESSEKYSIGFNARLLDRISVDFDYYYTKSSDLILDVPQSPSKGIPGNIITTNAGKMKNSGIELTVSADVIRNSQFTWETSFNITTNKNKVISLADGVENILKGDNGGLEITNITVPGKSIGRLYLYPTAGVDPKSGRRVFITPEGDRTLLMFEKGGWFYEDGIEYAGEFEPVDCGNTLPTWYGGWTNNFKYKGFDLSLFFQFSGGNKIYNGTKASVSDMRYWNNSKDVYKKYWTPERTHAEYPMPIYGDNYSNGSALPISDLVERGDYLRLKNVSLGYTFNTKNWSKAVGISALRLYVQAQNLFVITGYSGMDPETLTNVESATLSGGTDKNTLPQARTYTIGVNLTF

SEQ ID NO: 7557 - protein, 433 aa, B.fragilis
HYVIKLRDMATPPFKYQPMFEHGEDKTEYYLLTKDYVSVSEFEGTPVLKVQKEGLTAMANTAFRDVSFMLRRAHNEQVAKILSDPEASENDKYVALTFLRNAEVAAKGILPFCQDTGTAIIHGEKGQQVWTGYCDEEALSLGVYKTYTEENLRYSQNAPLNMYDEVNTKCNLPAQIDIEATEGMEYKFLCVTKGGGSANKTYLYQETKAILNPGTLVPFLVEKMKTLGTAACPPYHIAFVIGGTSAEKNLLTVKLASTHYYDELPTTGNEYGRAFRDVELEKEVLAEAQKIGLGAQFGGKYLAHDVRIIRLPRHGASCPVGLGVSCSADRNIKCKINKDGIWIEKLDSNPGSLIPAKLRSAGEGDVVKIDLNQPMADILKELTKYPVATRLSLNGTIIVGRDIAHAKLKETFERGKIWPKYQRPSDYYAVRRL

SEQ ID NO: 7558 - protein, 178 aa, B.fragilis
KKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKIPTCKM

SEQ ID NO: 7559 - protein, 179 aa, B.fragilis
KKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKSLHAKCK

SEQ ID NO: 7560 - protein, 188 aa, B.fragilis
KKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKNPYMQNVNDLIGCLLNT

SEQ ID NO: 7561 - protein, 104 aa, B.fragilis
SNNMDNRTEQYSLRELLESITENIKTKRLADVFRFISFHPGEMYGPHQHLRIEINYVKKGSCILHPDHESISLHHGAGRISGAFVKKKKSTNGGSDINKKNRAP

SEQ ID NO: 7562 - protein, 97 aa, B.fragilis
SGKSKDMDQLKTIKELINQGDIENALQALEEFLQTEPVGKDEAYYLMGNAYRKLGDWQKALNNYQSAIELNPDSPALQARKMVMDILNFYNKDMYNQ

SEQ ID NO: 7563 - protein, 281 aa, B.fragilis
ETRSLKRNKMEHKYLFVAVDAALKAGEEILSIYTDPASDFEIERKADHSPLTIADRKAHVTIATILDETPFPVLSEEGKHLEYNTRRNWDVMWIVDPLDGTKEFIKRNGEFTVNIALVKAGVPIIGVIYLPVKKELYFAGQEIGAYKLSGITTLEDDATLDKLVAASVRLPQDLQRDRFVVVASRSHLTPETEAYIDAVKQKHKHVELISSGSSIKICLVAEGKADVYPRFAPTMEWDTAAGHAIARAAGMEIYQADKKDVPLQYNKEDLLNPWFIVEKRR

SEQ ID NO: 7564 - protein, 159 aa, B.fragilis
LFSPQGGGSSPLSSPQQSGSLPKPEEVIKDATVKKALEEAWSDMLKRSTEVQRQEVGFWIYYDPVKKQYYIGKKRYGMAVKNDGKARGNISLGDKSPSINGVPATAKVVASFHTHTPMTEIKGKKRKAGPSKEDKENADKNKIPIDILVFRCILEIVIY

SEQ ID NO: 7565 - protein, 522 aa, B.fragilis
LFAFMTFEIAFVLLSLLGMVIALILDKMRPGMILFSVVVLFLCAGILTPKEMLEGFSNKGMITVALLFLVSEGIRQSGALGQVVKKLLPQKRTTVFRAQLRLLPAVAFISAFLNNTPVVVIFAPIIKRWARTVHLPATKFLIPLSYVTILGGICTLIGTSTNLVVHGMILESGHEGFTMFELGKVGLFIAIAGIIYLFAFSKKLLPDARPDTAVPDEEVEEGDKLHRVEAVLGARFPGINKTLGEFNFKRHYGAEVKEIKKRNGQRFINNLEEVILREGDTLVVMADDTFIPTWGESSVFVLLANGNDNEPIPGKGKRWFALILLILMIAGATIGELPVVKEMFPDMKLDMFFFVSVTTIIMAWTKIFPARKYTKYISWDILITIACAFAISKAMVNSGVADKVAGFIIGMSHDYGPHVLLAVLFIITNLFTELITNNAAAALAFPLALSLSVQLGVDPTPFFVVICMAASASFSTPIGYQTNLIVQGIGNYKFMDFVRIGLPLNLITFLISIFLIPLIWPF

SEQ ID NO: 7566 - protein, 166 aa, B.fragilis
EDQFELNSILVEKWEGKCYRLVIQRQRRNSGDLDLWEGEYTYRCILTNDYKSSTRDIVEFYNLRGGKERIFDDMNNGFGWSRLPKSFMAENTVFLLLTALIHNFYKTIMSRLDTKAFGLKKTSRIKAFVFRFISVPAKWIMTARQYVLNIYTENRAYAKPFKTEFG

SEQ ID NO: 7567 - protein, 272 aa, B.fragilis
RMYTVNLKRIFIVSLFIAIPFMLSAQLTYGTTGLLHAPSAEMQKDKTVMLGANFMNKEITPPTWYYHTYNYYLNVTILPWMEVAYTCTLFKAEALGLKPYGYSGFTNQDRYFSLRLRALKEGQFWKYMPAVVVGTSDPFTSSGNGVVAPTEGNGYFSRFYIAATRHVQLGRETVGVHLSYLYNKRIEYKLNGIAAGISYNPSFHPQLRLIAEYDSKDFALGATYLLFNHLHAQVELQRMKYFTGGLTFQFRLSGKDGMKKQKRNKELKQKMK

SEQ ID NO: 7568 - protein, 391 aa, B.fragilis
LFNTKTIMDIEHVRSRFIKHFDGTTGFVYASPGRINLIGEHTDYNGGFVFPGAIDKGMIAEIKPNGTDKVNAYSIDLKDYVTFGLNEEDAPRASWARYIFGVCREMIKRGVDVKGFNTAFSGDVPLGAGMSSSAALESTYAFALNDLFGENKIDKFELAKIGQATEHNYCGVNCGIMDQFASVFGKEGSLIRLDCRSLEYQYFPFKPEGYRLVLLDSVVKHELASSAYNKRRQSCEAAVAAIQKKHPHVEFLRDCTMDMLAEAKADISEEDYMRAEYVIEEIQRVLDVCDALERGDYETVGQKMYETHHGMSKLYEVSCEELDFLNDCAKECGVTGSRVMGGGFGGCTINLVKDELYDNFIEKAKESFKAKFGRSPKVYDVVISDGSRRLV

SEQ ID NO: 7569 - protein, 376 aa, B.fragilis
KQKTMKSKLVILSLLLAGATAATAQTKETFYSESFKDNIFVSVGVGAQGCVNPDNFDYGFGKAITPLINVSVGKLFNPVWGIRGQVAGAWTTLYSNYGQPADTYIKSKNKHYFTMRADGMFNLSNAIGGYNPDRLFTVSVFAGPGLTFAKAYGDQDKVNALINGSVGLAGQFNINKYLDINIEARGEVSPSPFGNISSAHTDGAVSLTAGVTYTFGGKRFVSCGSQVDQNAINEELNRYRSELAKAQSDLADAKNALANVKPVTKEVVKEIEVAGPRAIFFQIGKSKIDDYGMVNIQLAAKILKANPDKKYKVAGYADKATGSAKWNQKLSEARAQAVYDALIKEGVSKDQLELVGFGGTANMFGKNFLNRVVILE

SEQ ID NO: 7570 - protein, 280 aa, B.fragilis
TNLAAMKSNWKPKYLKYVVLGLISALVVTCWPRKEKPQGHPRDYAEIKESGILHAATEYNSISFYVDGDTVSGFHYELIEAFARDKGLQVQVSPVMSFNQRLEGLADGTYDVVAYGIPATSELKDSLLLTSPIILSKQVLVQRKVGENDSLAIRSQLDLAGKTLNVVKGSPSILRIRNLSNEIGDTIYVNEIEKYGSEQLIAMVAHGDIDYAVCDEGIARMAVDSLPQLDINTAISFTQFYSWGVSKQSPALLDSLNTWLSDFRKKGEYQSVYRKYYGKQ

SEQ ID NO: 7571 - protein, 90 aa, B.fragilis
YDMAKIQIKSEKLTPFGGIFSIMEKFDSMLSPVIDSTLGQRCSSIFGYQFSEIVRSLMSVYFCGGSCVEDVTSQLMRHLLVSSYPSYMQL

SEQ ID NO: 7572 - protein, 64 aa, B.fragilis
KNLFGNFGSDGCCLPVKKVSCEGCLLFCFTTWVDTLFIDNIKTGSQNIMYLCGMTNTLRSDLVL

SEQ ID NO: 7573 - protein, 364 aa, B.fragilis
IFNFIEMKMKSKFFGNGAKLALAVLAVCGTLFTSCYEKAEVDQATKPAEAKYYIAGTITDATTGQELTTAKVTLGDKSVTSSFNEQVNYKAEGYALVVSADGYYPVKRQVYLNQVSDGQTSVATVNVALVSVEAAVIPPVVPPTDPETDINEGEATKVADKAVEVAKPSESTVTDMLAGTTATPEEKKALDETLEMAGGMKVGETTPEVLADGSILAITPVKFTNPIQDAPAMVPYFYNEGCELTGDVKEVAAPVTRADGAVAADIQKAFLSNAAKALNMNAGFVQKIGYTRISVLNGYSILGYTIKGQLVSKKLTFLISGKYYEGIVSYQKSVMIYPNYYSHDSHDSHDSHGFNPNAGGGSND

SEQ ID NO: 7574 - protein, 522 aa, B.fragilis
IFNFIEMKMKSKLFGNGAKLALTLLAMCGMFASCYEKDEIDVPKVTDPTATTYQVAGIVTDAESNAVMDGVTVTNVTNSKSMTTAADGKYVLEAKVGETNVVTFAKSGYKTVTSSVFVTKQENGSIVAYTIDAKMEKGKETKPTKDVEYQIEGSVFDAESGEPVAIKTATMPGILTATIQNGNEFTMSNVGLGQHTIYITADGYKPATADVVISEVAGPEGEGIFIAKTSVTVAMQKKEVEVAPKYYLAGNIYNQDGGMVTKAEVTLNMSGYEVTTTASNGFYKFEIPADKVKGLTKATVTIRHNSYKIYVYTAFIAPVDNGQVSNTTVNVTLILKPDTEKPNDDDNVFIGGNVEIEVPTENAVEAAPEKAEGEKVPSKSAVEESINKVLEAAGSDIKITPAQAEQVVNTMEKYVANGTLTEIDKVAVLPIEKETTFKLESKVIDTNNDKEETVIDEIVLRANTIIIFTSGVASTLNISRTDEVKEGAFCREYDGTPTGTSFRNSDGSEIYSCCCRSSRRNS

SEQ ID NO: 7575 - protein, 63 aa, B.fragilis
SNNYSTMNPDKIRNVLNILFMILALAAIITYFVAKDDFKVFIYVCGAAIFVKLMEFFIRFTNR

SEQ ID NO: 7576 - protein, 131 aa, B.fragilis
LNEQDQNRAIMFTDDKSIENIQQLFAEFKKFLVLQKEYTKLELTEKLTILLSTLIMILVLTILGMVALFYLLFALAYILEPLVGGLMVSFGIIAGINVLLIAIIYFFRRQLIISPMVNFLANLFLNDSNKK

SEQ ID NO: 7577 - protein, 103 aa, B.fragilis
ISLQTYFSTTPIKNEAMNNSTPTPKKITLEDIAQRKQEVLQEICDQKQAMADTTRRIFAPLAPAASGGNALMRSFSTGMAIFDGVMLGMKMIRKVRGLFRKRY

SEQ ID NO: 7578 - protein, 83 aa, B.fragilis; identical to SEQ ID NO: 6082

SEQ ID NO: 7579 - protein, 305 aa, B.fragilis
KKTKHYKNMKHIYLLLFMLIPMTGMAQEGISQDTTLYVNGRKILIKENEGKIKVKLYEQSSHGDTIENDQIFEGIYTDGQTTERRTAFTVPFVKRKNHYRFDPHIAGFYMGYTRLSDGINFNTPDGLNINANKSWEIGFNLFQGSLTLSRDRQWGITTGLGWGYRSFRLGNNYAFRQIDGVTGIVPGVPDEEVYTKSRLRYFYFRIPVALEWQKRFSHSNAHGPLFFSAGLEAEIRHGAKSKAKVNGHKKNLDSGLNVHPVGINLLAQAGYGDIGVYLRYSTYSLFEHKKGPELYPYSFGLCWYW

SEQ ID NO: 7580 - protein, 460 aa, B.fragilis
KINKEITNLIFITNNFLKTMTQQKKNYVLPIAMMFALFAMISFVTGLTNPLGLIVKEQFQAANWMTQLGNAANFIAYAFMGLPAGMMLKRIGYKKTALTAVAVGFIGVGIQVLSGQMDYQPGELTVFWIYLTGAFVSGFSMCMLNAVVNPLLNTLAGGGKKGNQLIQFGGSLNSISATIVPVLGGYLIGTISQDTRISDANPALFIAMGIFAVVFIVLAIMDIPEPHKESASDHKVKDTHSPLSFRHFVLGTVAIFVYVGVEVGIPNFINLFLTTSPDAAGAKGFGMDTAMAGSIVGTYWFLMMIGRLCGGALGAKFSSKTQLTVVSSLALIFLLIGMFAPSATTVAMPVFKGGASIGFGMETVPVGIMFFALCGLCTSIMWGGIFNLAVEGLGKYTAMASGIFMVMVCGGGILPLIQGAVADVTSSYIASYWVIFAAVAYMLYYALVGCKNVNKDIPVE

SEQ ID NO: 7581 - protein, 83 aa, B.fragilis
PDSNIIPCTTRLVDVPIKVQIPPNIVTYERGIRNLVAGKWTVRAHRLIIGAKMTTTGVLFRKAEIKATAGNKRNCARKTVVRF

SEQ ID NO: 7582 - protein, 279 aa, B.fragilis
SACNAESITMLFVYAKYIKIMSNENKTIHDFELNLICDFFSNMERQGPGSPEVTLKALSFIDNLTEKSLIADIGCGTGGQTMVLAGHVTGQVTGLDFLSGFIDIFNRNARQSGLQNRVTGIVGSMDDLPFRNEELDLIWSEGAIYNIGFERGLNEWRKYLKKGGYLAVSECSWFTDERPAEINDFWMDAYPEIDTIPNQVAKIHKAGYLPVATFILPENCWTDHYFTPKVAAQKIFLTKYAGNKIAEEFSMLQSIEEELYHKYKEYYGYTFFIAKKIGL

SEQ ID NO: 7583 - protein, 396 aa, B.fragilis
TFLNRRTDLQRIIWENERISLYLQEILIIPDMINTFPTEGNLSGLSRKDFQKDINDKKTDLFILKNKKGMEVAVTNYGCAILSIMVPDKDGKYANVVLSYGTLDALMHGPEPFLSTTIGRYGNRIAKGKFTLYGEEHSLTINNGPNSLHGGPTGFHARVWDAEQLEEGVIRFNYTSADGEEGFPGNLEVEMTYRLEEEENAIVIEYRATTDKATVVNLTNHGFFNLAGTANPTPTVENNIVTINADFYTPIDEVSIPTGEIAKVEGTPMDFRTPHTVGERINDKFQQLIYGAGYDHCYVLNKAETGSLDLAATCKEPNSGRTMEVYTTEAGVQLYTGNWLGGFEGTNGATFPARSAICFEAQCFPDTPNKAHFPSATLLPGDEYQQVTIYKFGVEK

SEQ ID NO: 7584 - protein, 173 aa, B.fragilis
MELKQFKIAVLPLRDKLLSYARKLTDDHSDAEDAVQEVMLKLWKLRPKLDEYHSIEALAMTMTHHTCMDILRGKHPDNLSLDSVQAASPVATPERLLEEKDEFSLMRHIISTLPPLQQTILRMKDVEEYETEEIAEITGCSSEAIRSNLSRARKKVRDIYLQTIQQRKRRNEA

SEQ ID NO: 7585 - protein, 209 aa, B.fragilis
RLINLPLIVYWMIVADFRIEKLLKCHLINNNIMKKLLLLSVLSIFMIACHQPDTPPYSYSMNIDMQIISSLETTYPLDNLETVIINSRLELASSSYRIKTLISSNDLQESWLERPIVMLGREGHRYLSLPITFNEEKDRYNVKIEFYCPEIFKDDKYHTINIVYSIVKGKYLYNLESFTLDSYAGEIENQGENNAPIIVFSINTAEKKE

SEQ ID NO: 7586 - protein, 480 aa, B.fragilis
YKINREIPIIVWGKSIRQREYLAYLCNVNKKIKKPINHGNMKKIVLLSLFALCLPLLVMAQSNNDDLYFVPSKEKKQEAKKTPVKKEPEKKVVTTNIYTSPGTTVVVQDRKGNKRDMRDVDEYNRRYDVKDNEFAMEDDTLYVKEKAVSDPDGEWVNGFNGSQDDYEYAERIIRFRNPRFAVSISSPLYWDIVYGTNSWDWNVYTDGFYAYAFPTFTNRLWWDWRYNSYGSGWGWGWGWSSPYYAWGGYYPGYWGGYWGGYWGGWYGGGYWGHHHHYHPGWGGGGHYWASHNTYTNRRSYGPSRVSTSSRVNASSIRRTDSYTRSGNNISPSRGGDSRMNYGSRRVISVRDTERPDATTRTDASSSRRSTYTRPSSTRSSSSYNSNVHPNRSTNSGTYSRSTSRSSSTYTRGSSTTTPSRSYSNEGTRRSYGSSSSSRSYSSGSSTRSSSSYSSGSRSSGSSSRSTSGGGSYSRSSGGRR

SEQ ID NO: 7587 - protein, 66 aa, B.fragilis
NYSKPSIITNHNPYHNEEKYYSVIHQFTFIPAMHKGTSTRILHCRIFPAGRLRTRRLFHESCMAFL

SEQ ID NO: 7588 - protein, 76 aa, B.fragilis
IMAKIKGAIVVDTERCKGCNLCVVACPLNVISLAKEVNVKGYNYAQQILEDTCNGCSSCATVCPDGCISVYKVKVE

SEQ ID NO: 7589 - protein, 149 aa, B.fragilis
HIKKDMKKIGICCDHAGFELKEYVRGWLEAKGWEYKDFGTYSTDSCDYPDFAHPLALAVEASECYPGIAICGSGNGISMTLNKHQGIRAALCWTAEIAHMARLHNDANVLVMPGRYISTEEADMIMTEFFSTEFEGGRHQKRIDKIPVK

SEQ ID NO: 7590 - protein, 166 aa, B.fragilis
IMKKLVVLGMGVCVALAFASCKSSESAYKKAYEKAKQQELAEPQVEAPVEVTPVVAAPVETKKAVDNAAGVRQEKVTVVSGADGLKDYSVVCGSFGLKANAEGLKDFLDKEGYNATIAFNAETAMYRVIVNTFADRASAAQARDAFKAKYPSRKDFQGAWLLYRIY

SEQ ID NO: 7591 - protein, 528 aa, B.fragilis
DMKKIIIVSALVLLWTAGANAQTAYDAAKLVSKDLNGTARFVGMGGAMGALGGDISTMGTNPAGIGIYRSNDVMTSFSFSTYGTESKYGGKTFDNNNNRWSYDNIGIVFASKIGNHTPLRYVNFGFNYHRAKSFYKNMFMEGALNYSQIDYMTGQANGMLANGVSLKELSDNKLNPYSDNGVGWLGALGWDGLLFDFKNGEYIGVLPQTPYSTFRSREKGGIDQYDFNIAFNISDRVYLGLTIGAYDVDYTKSYYYSEDYGDKQNYNIGSMNRISGSGFDFKMGAIIRPFEDSPFRIGLAVHTPTFYRLTYTTSAYLESNIWMHNNDTGKDELLNSYFDTYKELKDMNQNREFRLKTPWKYNVSLGYTVGQNLAIGAEYEYEDYSSVKFRYPEGDKMEFETNAAKMVMKGVNTFRIGAEYKVIPQFAFRLGYNYSSSIFKNGAIKYLPYNSVNTDTDFANSKSLSNYTLGIGYRGTMIYADLAYKFSSYKEDFYPFYNEFNDRGIVTPNVTKITNTRSQVLFTLGMRF

SEQ ID NO: 7592 - protein, 375 aa, B.fragilis
NNMKSKIAILSLLLTGAAVSASAQTKEHYYSEKAKDNIFISVGVGAQGCVNPDNFDYGFGHAITPLIHASVGKLFNPIWGIRGQVAGCWSTLYSEYGMPEGEYKKMKNKKYFTLRADGLFNLSNAIGGYNPDRLFTVSVFAGPGLTFAKAYGNQDKLNALINGSVGLMGQFNINKYLDINVEARGEVSPSVFGHYSSARTDGAVSLTAGVTYTFGGKRFVSCGAQVDQNAINEELNRYRSELSKAQSDLADAKNALANVKPVTKEVVKEIEVAGPRAVFFQIGKSKIDDYGMVNIQLAAKILKANPDKKYKIAGYADKATGSAKWNQKLSEARAQAVYDALIKEGVSKDQLELVGFGGTANMFGKNFLNRVVILE

SEQ ID NO: 7593 - protein, 258 aa, B.fragilis
EEMKGKIVFITGASSGIGEGCARKFASQGSDLILNARNVAKLEELKVELEAKYGVRICLLPFDVRDRNAATMALASLPEEWKRIDVLVNNAGLVIGVDKEFEGNLDEWDIVIDTNIKALLAMTRIVVPGMVERGHGHIINIGSIAGDAAYPGGSVYCATKAAVKALSDGLRIDLVDTPLRVTNIKPGMVETNFTVVRYRGDKDAADAFYKGIRPLTGDDIAETVYYAASAPEHIQIAEVLVMPTYQATGTISYKKKDC

SEQ ID NO: 7594 - protein, 293 aa, B.fragilis
KNSKPSPSILSAKWRRELRIRSCCIASGRILSLWYGLAEKSFYPGKVPVPLMHIDSKWKFKEMIQFRDEYAKKYGWNLIVESNMEAFHAGVGPFTHGSKVHTDLMKTQALLRALDKYKFDAAFGGARRDEEKSRAKERIFSFRDKFHQWDPKNQRPELWDIYNARVHKGESIRVFPLSNWTELDIWQYIRLENIPIVPLYYAKERPVVQMDGNLIMADDERLPEKYRDQIEMKMVRFRTLGCWPLTGAVESEADTIEKIVEEMMTTTKSERTTRVIDFDQEGSMEQKKREGYF

SEQ ID NO: 7595 - protein, 75 aa, B.fragilis
NIGKDLIMNDERSTINDRDRLTSHYIPPVRTLLIVDRSSFFYLFHVTFSFLLRLAYVNGTKTIQNSRSSTPRQTA

SEQ ID NO: 7596 - protein, 79 aa, B.fragilis
NIDEEIIIKMKEEYKLSHLKELEAESIHIIREVAAGVENPVMLYSIGKDSFVMVRPCRKKLLSGQSTGSFDAYRFKVEI

SEQ ID NO: 7597 - protein, 84 aa, B.fragilis
IKFEIVNCFIFVTHYLNIFRIHEKHSNTFSIACRLNLNYNNKELLPKRVFREKTKGQSVAKKQIVYKTKSDLRVFVMPQRYIIF

SEQ ID NO: 7598 - protein, 491 aa, B.fragilis
HGTEETRRIFLNITTMADKLDIKAFLDKDEQKDLLRLLTAGSVDDGKSTLIGRLLFDSKKLYEDQLDALERDSKRLGNAGEHIDYALLLDGLKAEREQGITIDVAYRYFSTNNRKFIIADTPGHEQYTRNMITGGSTANLAIILVDARMGVITQTRRHTFLVSLLGIKHVVLAVNKMDLVDFSEERFNEIVAEYKKFVAPLGIPDVTCIPLSALDGDNVVDKSERTPWYEGLSLLDFLETVHIDSDNNFSDFRFPVQYVLRPNLDFRGFCGKVASGIIRKGDKVMALPSGKVSHVKSIVTFDGELDYAFPPQSVTLTLEDEIDVSRGEMLVHPDNLPVVDRNFEAMLVWMDEEPMDINKSFFIKQTTNVSRTRIDSIKYKVDVNTMEHSSVPFLSLNEIARVVFTTAKELFFDPYRKNKSCGSFILIDPITNNTSAVGMIIDRVEKKDMNIADDFPVLNLPELGIAPEHYEAIEKAVKSLSEQGFEVRIEK

SEQ ID NO: 7599 - protein, 82 aa, B.fragilis
YVKDDLFGAVFSLPEVTVIGRRPTSSENPFKWPFGDMPSESPKALPGLDDFFLLKEAVHLRYLHHSNQALCLNLKKSLRMQL

SEQ ID NO: 7600 - protein, 145 aa, B.fragilis
SYFCNPNMSRIVAIDYGRKRTGIAVSDTMQIIANGLTTVPTHELLDFITNYVKQESVERIIIGLPKQMNNEVSENMKNIEPFVRSLKKRLPDMPVEYVDERFTSVLAHRTMLEAGLKKKDRQNKALVDEISATIILQSYLETKRL

SEQ ID NO: 7601 - protein, 356 aa, B.fragilis
CAICSYHPTLRTCSSDTILRAIKELTQENISYTSDQGKTYDFNTADKLNTLLINALVSTGELKEIEEYDVDFDHQFLETEKYDAKPTYKKFLGYRPGVYVIGDKIVYIENSDGNTNVRFHQADTHKRFFALLESQNIRVNRFRADCGSCSKEIVSEIEKHCKHFYIRANRCSSLYNDIFALRGWKTEEINGIQFELNSILVEKWEGKCYRLVIQRQRRNSGDLDLWEGEYTYRCILTNDYKSSTRDIVEFYNLRGGKERIFDDMNNGFGWSRLPKSFMAENTVFLLLTALIHNFYKTIMSRLDTKAFGLKKTSRIKAFVFRFISVPAKWIMTARQYVLNIYTENRAYAKPFKTEFG

SEQ ID NO: 7602 - protein, 185 aa, B.fragilis
FLCRKKQSIVHIVYICKKRITILTIDFLYHMTKEELMRKAIELSRENVANGGGPFGAVIAKNGEIVATGVNRVTASCDPTAHAEVSAIRAAASKLGTFNLSGYEIYTSCEPCPMCLGAIYWARLDKMYYGNNKTDAKNIGFDDSFIYDELELKPENRKLPSEVLLHDEAIKAFEEWMEKEDKIEY

SEQ ID NO: 7603 - protein, 216 aa, B.fragilis
RERRIQPDATYHQYTSTSATDHPPDERCRRVRNRRNRRDNRMQLRSHPQQFIQGTEKSKRHLPANHTTKKKEKRSMNIEELLNKYFEGETTCEEERELRRFFTRGIVPEHLQMYRPMFAFLNEENRQSKTAVPEVPKTSVPLRRRLLYIFSGMAAGILLILGIAGLNRHFNTSTANYVIIDGKCYTDAKLVREQAMIAFRDVSISEEEVFATLFSE

SEQ ID NO: 7604 - protein, 659 aa, B.fragilis
VSLRLIMRRILLTYILLVVGLLTAQAQFNPTQQVDPRTGRDANGNQIDPAMRVQEDSTDVEIQGLPPTLYMWHVSENLGTIQRIPADTATHMFQNTNLVEGLTGHYNYLGNLGSPRLSRLFFERRDAEPTIFMEPFSSFFIRPDEFNFTNSNVPFTNLTYYKAGNKINGEERFKSYFSVNVNKRLAFGFNFDYLYGRGYYNNQNTSYFNAALFGSYIGDRYEATLLYSNNYLKMNENGGITDDRYITRPEEMAEGKKEYESQNIPTLLSKSANRNKDFYIFLTQRYKLGFTREVEKAKDDTTNTQKTEFVPVTSFIHTMKVERSRHQFTSEDELYKIYPEAYIQPGNKLVNDSTSYIGVKNTLGIALLEGFNKYAKAGLTAFISHKLSNYRLMDRDSVSVDKYSEHEVFVGGELAKRQGKTLHYRAMGEVGILDKAIGQFRVNANLDLNFRLWKDTVSFIARGSISNTLPAFYMRHYHSKYFYWDNDNMEKEFRTRLEGELNIEHWQTNLKAGVENIKNYTYFNQKALPQQNGGNIQVLSATLSQNFRLGILHLDNEVTWQKSSNNTVLPLPELSLYHNLYIQTTLAKKVLHVQLGADVRYFTKYYAPAYTPAIQQFHLQPEDDQVKIGGYPIINVYANLQLKRTRLFAMMYHVNQGNG

SEQ ID NO: 7605 - protein, 369 aa, B.fragilis
SKSRIKEKNMAEEVVLMKGNEAIAHAAIRCGADGYFGYPITPQSEVLETLAELRPWETTGMVVLQAESEVAAINMVYGGAGSGKMVMTSSSSPGVSLKQEGISYLAGAELPCLIVNVMRGGPGLGTIQPSQADYFQTVKGGGHGDYKLIALAPASVQEMADFVGLAFELAFKYRNPAIILADGVIGQMMEKVVLPPAKARRTDAEVIAQCPWASTGKTKDRKPNIITSLELRPEEMEKNNLRFQAKYRVIEENEVRFEEIDCEDAEYLIVAFGSMARIGQKAMELAREEGIKVGMLRPITLWPFPTKAIAEYANKVKGMLVTELNAGQMVEDVRLAVNGRVKVEHFGRLGGIVPDPDEIVTALKEQLIK

SEQ ID NO: 7606 - protein, 332 aa, B.fragilis
LPERKPCRIIVLNNNVPQISLYYQPSFKDSTVNISRQDWEVSYNLGNSWNKVKRNKKANSSLYKVDITIYPELSLKNLVITQIYQVLFNLSPAIEVSFWKGMKFTAQMVIPVYNDGYASRYDKLHPGFLELSQTVRLPYNFWATLAIGSFNNSRYGIDFNLIHHFKDERFSIEGRIGYTGTGYWEGFTMHYGTKMRATWSLGGSFYWPRYNVELNARVEQYLLKEKAVRVEAIRHFRYASIGFYAMKAKDVKANGGFRFQIALPPYRYKRKGYIPRITPSNNMGMSYNAGNEQYYYKTYRSAPDDNIMKNNSFNPYFTLIPQHYNLTLFISS

SEQ ID NO: 7607 - protein, 153 aa, B.fragilis
KKRSMNKVIRTTWIILLLTVASGMARAQQGLQIASVFQKYGKQKGVTMVELSNEMLETYQMTLYKSLVFKDVEEALPTILNCLDADKKKAKKVKEVVAGGQIQSGYYQLPQLKEDVNRFILFKTGKKGSATLIYIEGELDADDLVTMLFMKKN

SEQ ID NO: 7608 - protein, 330 aa, B.fragilis
KDMSNKIIKWGFIGCGEVTKYKSGPAFQKVEGSKVVAVMSRDGKKAKAYAKERNIPKWYDDAQELIDDPEVNAVYIATPPSSHATYAIMSMKAGKPVYIEKPMAQTYEECARINRISQETGVPCFVAYYRRYLPYFMKVKELVDKGTIGNVINVQIRFAQPPRDLDYNRENLPWRVQADIAGGGYFYDLAPHQIDLLQEMFGCILEASGYKSNRGGLYPAEDTLSACFQFDNGLVGSGSWCFVAHDSAREDRIEIIGDKGMICFSVFTYDPIALHTERGREEIMVENPEHVQQPLIQAVVDHLLGKSTCSCDGESATTTNWVMDKILGKI

SEQ ID NO: 7609 - protein, 376 aa, B.fragilis
LFWSMKKLGLLLMLFTFAACTNDDFSVLQENEEITLPTAVTRASGDKLYDLLGYGYDVTGLYFTSASAKSKIIDIVALRKDYEERVDIGAVPSNYARMTSGTTAQDYTRNVTSKVKLGGALSLFSGSLSSSFSSTQHYTSKYSIADYTSFIRRRRLFLTASTELLSKYLTKMFVDDLSKQSPSFIIQHYGTHVLTDITLGGRITVLYRSSINTSKKTATVEAGCASGIKNMFNLSVDGHYDQTLVKDNSEQEIVYRTEGGDPSRALIGQLNYDSKNPSVIDISSWQQSCDDNNMTLVDAEPGSLIPIYDLVSDMGKKEQLKLAVENYLKEHSYVDIDDSSKGGAVRNNSRGHNTSSYGNSTRVIGANGNRSTYRRP

SEQ ID NO: 7610 - protein, 325 aa, B.fragilis
KKGGKMIQKTYRLWVASLLTLCSASAAAQQKVEILPFGNMDQWVTREIKESGIIGGNTKKVYAIGPTETIVGAKPYTNKGGSPWGTSNVMARVSGITKTNTSVFPETRGDGFCARLDTRMESVKVLGIVDITVLAAGSMFLGTVHEPIKSTKNPNKMLQMGIPFTERPSAIQFDYKVKMSDRENRIRATGFSKITDVPGKDFPAVILLLQKRWEDAKGNVYAKRIGTMVNYYYHSTDWKNGSKYDIMYGDITKDPAYKAHMMRLQASEYFTVNSKGESVPIHEVAWGEADDVPTHMILQFTSSHGGAYIGSPGNSLYIDNVKLIY

SEQ ID NO: 7611 - protein, 411 aa, B.fragilis
DKRGYTSPTPIQEQSIPILLQGKDLLGCAQTGTGKTAAFSIPILQKLYKTDHRKGIKALVLTPTRELAIQIGESFEAYGRYTGLKHAVIFGGVGQKPQTDALRSGIQILVATPGRLLDLISQGFISLNSLDFFVLDEADRMLDMGFIHDIKRILKLLPARRQTLFFSATMPPEIETLANSMLTKPEKVEVTPASSTVDIISQQVYFVEKKEKKDLLIHLLKDTSIESVLIFTRTKYGADKLARVLTKAGIGAEAIHGNKTQNARQRALTNFKNHTLRALIATDIAARGIDVDQLSHVINYELPNVPETYVHRIGRTGRAGHEGVAISFCESEELPYLKDIQKLIGKNIPVVKDHPFVTTEGIKAQEEKQEEIKVKAKANKTYRGSRANGDFWRRKKQKTNQPSSTKQEKRK

SEQ ID NO: 7612 - protein, 332 aa, B.fragilis
SKFITRKTKMYPLKFEPILKQTLWGGDKIIPFKHLNDDLKGVGESWEISGVENNESVVANGPDKGLTLTDMVKKYREELVGEANYARFGNEFPLLIKFIDAKQDLSIQVHPTDELAKKRHNSKGKTEMWYVVGADEGAKLRSGFSEQITPKEYKDRVHNNTITDVLQEYEIHPGDVFFLPAGRIHSIGAGAFIAEIQQTSDITYRIYDFNRKDANGKTRELHTSQALDAINYEVLDDYRTKYEPLKDEPVELVACPYFTTSVYDMSEQISCDYSELDSFVIFICIEGSCLMTDNEGNEVRLGAGETVLLPATTQELTIVPQEGNVKLLETYV

SEQ ID NO: 7613 - protein, 185 aa, B.fragilis
VNIIKMKEEIIIAGFGGQGVLSMGKILAYSGLMEGKEVTWMPAYGPEQRGGTANVTVIVSDDKISSPILSKYDTAIILNQPSLEKFESRVKPGGILIYDGYGIINPPTRKDIKVYRIDAMDAANEMNNAKAFNMIVLGGLLKLRPIVTLENVVKGLKKTLPERHHHLIPMNEEAIKKGMELIREA

SEQ ID NO: 7614 - protein, 185 aa, B.fragilis
DMILPIYVYGQPVLRQVAEDITVDYPNLKELIENMFETMDHADGVGLAAPQIGLPIRVVVINLDVLSEDYPEYKDFRKAYINAHIDVVEGEEVSMEEGCLSLPGIHESVKRGSKIHVRYMDENFVEHNEVVEGFLARVMQHEFDHLDGKMFIDHISPLRKQMIKGKLNTMLKGKARSSYKMKQVK

SEQ ID NO: 7615 - protein, 312 aa, B.fragilis
SIDMNDSKLMNRAADNIRILAASMVEKANSGHPGGAMGGADFVNVLFSEFLVYDPQNPRWEGRDRFFLDPGHMSPMLYSVLAFTGKYTLDELKQFRQWGSPTPGHPEVNVDRGVENTSGPLGQGHTYAVGAAIAAKFLKARFGEVMNQTIYAYISDGGIQEEISQGAGRIAGTLGLDNLIMFYDSNDVQLSTNTEDVTTENVAMKYEAWDWKVITINGNDPDEIRKALTEAKAEKNRPTLIIGKTTMGKGARRADGSSYEADCATHGAPLGGDAYVNTIKNLGGNPENPFTIFPEVAELYAKRRGRTEEDCC

SEQ ID NO: 7616 - protein, 376 aa, B.fragilis
PNCMPNAAEELKKIVADKYAAKAEWAKANPEKAAKLAEFFSGKAPKVNWDAIEQKAGGATRAGSATVLGALATQVENMIVSSADLSNSDKTDGFLKKTHAFKKGDFSGAFLQAGVSELSMACICIGMSLHGGIIAACGTFFVFSDYMKPALRMAALMEQPVKFIWTHDAFRVGEDGPTHEPVEQEAQVRLLEKLKNHKGHNSMLVLRPADVEETTIAWKLAMENMSTPTALILSRQNIVNLPAGTDYSQAAKGAYIIADADENPDVILVASGSEVSTLVAGAELLRKEGVKVRIVSAPSEGLFRNQSKEYQESILPAGAKIFGLTAGLPVNLEGLVGSNGKVFGLESFGFSAPYKVLDEKLGFTAENVYNQVKAML

SEQ ID NO: 7617 - protein, 135 aa, B.fragilis
SNNMDNRTEQYSLRELLESITENIKTKRLADVFRFISFHPGEMYGPHQHLRIEINYVKKGSCILHPDHESITFREGEIMIITSDISHLFEAGADGTTLMQLEFLPEIFSHFNLNATADSNGSALLWTNRFKIKIE

SEQ ID NO: 7618 - protein, 205 aa, B.fragilis
HIIMEENNNIYPIFDRMLTRQDKEELLKQRGVMIWFTGLSGSGKSTIAIALERELHKRGLLCRILDGDNIRTGINNNLGFSETDRVENIRRIAEVSKLFIDTGIITIAAFISPNNDIREMAARIVGPDDFLEIFVSTPLAECEKRDVKGLYAKARRGEIKNFTGISAPFEAPEHPALSLDTSVLSLEESVNRLLEIVLPRVSRHE

SEQ ID NO: 7619 - protein, 898 aa, B.fragilis
LIIIPTTMKKSIILLFISLLLSPLCIKAHQPEFSTAGFFRLADSGRDVYSMNPAWRFYKGNCPGAETGNFDDRSWTVVSLPHGIEYLPTEASGCINYQGEVWYRKQFTPDAALKGKKLFLHFEAIMGKSKIYVNGKLLAEHFGGYLPVVVDVTDALEFGKENLIAVWADNSNDPNYPPGKQQEVLDFTYFGGIYRDCWLIAHNQVFITDPNYENEEAGGGLFVAYNNVSDHSAEVLLKIQIRNSGRKAFKGVVEYELQQPDGQQVASLNSVIRIKPGKSTYSSDKLTVKGPMLWSPENPALYNLIVRIRDEKGNPIDGYRRRIGIRSIEFKGEDGFWLNGKPYEAPLIGANRHQDFAIVGNAVPNSIHWRDAKKLRDAGMKVIRNAHCPQDPAFMDACDELGLFVIVNTPGWQFWNDAPVFAQRVYSDIRNLVRRDRNHPCVWMWEPILNETWYPANFARNAHDIVEAEYPYPYCYSGCDSEAKGKEHFQILFTHPLNGDGGAYSTNDIKKQLTYFTREWGDNVDDWNSHNSPSRVARNWGEQAMLIQAQHYARPSYKYTSYDALYRTPRQHVGGCLWHSFDHQRGYHPDPFYGGVMDVFRQPKYSYYMFMAQRSPIKEERLFQTGPMVYIAHEMTPFSGKDVTVYSNCDEVRLTYLKGGQTQTYVHKQEKEGMPHPVITFENVYDFMKDKALSRQGKQADVYLLAEGLIDGKVVATHKVAPARRPEKLLLWVDNEGTDLKADGSDFVTVIAAVADKDGNIKRLNNYTIKFQIEGEGRILGGAGNLANPAPVRWGTAPILVQSTLKPGKIKITASVLFEGSQMPSSAVLELESKPGDFPQIYDREESALIPNFTGQEAVNALAPKSEAALEKERLQKAENAAKLKEVEQQQEEFGEKK

SEQ ID NO: 7620 - protein, 418 aa, B.fragilis
SKQMNHKGPYMRKNITIGTTLRRISLILFCLLPLKGICQTGEATVDALVKMGFENVGWTEDTEERVFVIQNSAYRLEGVGIGKAVDLIQKMGLPENKPCRLIVLDNNVPQISLYYQPMKGDSIAEVSRADWSVSYDLGEGWKQARRIKKQNSSLFKVDIVVYPELLFRNYILSKVYEIVVNVSPAIEVSLWKGMKLTGQVIFPIYNDYGQRYKQIRPGFVTLSQTVRLPQRTFLTASVGFFNKFRWGGDLKAKHFFKDERFSVDARIGYTGRGYFEDWAFYHGTKWTLTGSIGANFYWPKYNTQFSLKGERYLEGEYGARFDMIRHFRYASIGFYGMKVQHAGNKGLNGGFLFQIALPPYKYKRKGYIPRVIPNNFGFQYNAGNERIYGKGYSPQASDNVMENNSFNPYFIKSELLNF

SEQ ID NO: 7621 - protein, 253 aa, B.fragilis
KLQIMMKKIFLIGLFLCCHLALSAQLTYGTTGLLHAPSAEMQRDKTVMIGGNFLNKEITPPTWDYHTYNYFLNVTIFPWLEIAYTCTLFQSQTIGIDWKVGKKKFTNQDRYFSARLRVLKEGQLWKYMPAVVVGTSDPYTESGDGQVGSADGNGYFCRFYVAATKHIPIGKEKIGVHLSYLYNRRVDYHLNGLAGGLTYAPSFAPDLTVIAEYDAKDFAFGATYLLFNHLHAQVELQRMKYFTGGLTYKIYLK

SEQ ID NO: 7622 - protein, 73 aa, B.fragilis
KQKIMKGLNVLAAFLGGAAVGAALGILFAPEKGEDTRHKIAEILRKKGIKLNRNEMENLVDEIAAEIKGEVID

SEQ ID NO: 7623 - protein, 138 aa, B.fragilis
VFEIQNVLMQQPARMLLHQEDLLILVQVVHVVALVIIVTFIRIVLQTLEHIQEVLVGLLLLILVEVRQQHLLVLIQMKVPVVLMALLHLLEAIPQVVLLALVVVILPVAEVVVAVLVRQVVEVATAEVAVVEDKKIVN

SEQ ID NO: 7624 - protein, 390 aa, B.fragilis
LFGVPICLLHAVCRHINNEHIIMGLLEFNKLPINTLVGADWRTFKAITGGREIDAAYTGKYRLTKAVCRLLSTLAPLQDKRYEKLLANKPLEHDPVFILGHWRSGTTFVHNVFSCDSHFGYNTTYQTVFPHLMMWGQPFFKKNMSWLMPDKRPTDNMELAVDLPQEEEFALANMMPYTYYNFWFLPRYQQEYADKYLLFDTISEAELKVFEETFTKLIKISLWNTQGTQFLSKNPPHTGRVKELVKMFPNAKFIYLMRNPYTVFESTRSFFTNTIQPLKLQDITPAELENNILSIYAKLYHKYEADKQFIPEGNLMEVKFEDFEADAMGMTENIYHALDIPGFAEARGSIEKYVGGKKGYKKNKYKYDDRTVQLVQDHWDFALKQWDYSL

SEQ ID NO: 7625 - protein, 269 aa, B.fragilis
TSAVLTKLKKVLSVVNTTVLQPELVFVTPMEVKFTPAVVVAQGETPEVALATLYFNEKTNTWEAEENYATYQNGVFVGNVHHFSKFKFGFEEADSKATAEAALDSMKFDKACYTEGETAKVKMEINWKGGIKCEGGASVEEIIKKAHSTLTTTTIKMVSAALEEAIKDDNANVTPGAAFTDKKFTYELEVPAYTQLTGFDVTRNVIKTTYVLPFAVYNKATKAIEKKTAEVTISKISSVVVRTIEAIGHGHGHGHGDDLNAGGGIIISE

SEQ ID NO: 7626 - protein, 64 aa, B.fragilis
IALVKVQVFSYSKTIKLYIIKSVKDYSNEIPSKTGFHKIISPYFSKLKFKYSNNTTQKKKTYLN

SEQ ID NO: 7627 - protein, 257 aa, B.fragilis
KKEVMTKEEIIKPENLVYKKPTLMNDNGMHYCPGCSHGVVHKLIAEVIEEMGLEDKAVGISPVGCAVFIYNYLDIDWQEAAHGRAPALATAIKRLWPDRLVFTYQGDGDLACIGTAETIHALNRGENITIIFINNAIYGMTGGQMAPTTLMGMKTATCPYGRDPELHGYPLKITEIAAQLEGTAYVTRQSVQSVPAIRKAKKAIRKAFENSMNGKGSNLVEIVSTCSSGWKMTPEKANKWMEEHMFPFYPLGDLKDK

SEQ ID NO: 7628 - protein, 410 aa, B.fragilis
KSFFMDFCYLFVTYNRIMSIFITKNIQTNNMKKEVRIKEPVRIRTKRLSNGCESIYLDIYMDGRRRYEFLKLYIIPEHTRTDKDLNQSTMKLASAVKAQRIIELQNGVYGFNHQQEKKDIMLIDYIKYLADKDIEKTSRKVSMYTLIYHLQHYDKMGIRLRQVDKKYILGFVEYLKTATQKHCKSVKNISANTQVHYYKVFHHCLNSAVIDEIITSNPMDKIKNEEKPKRRRTERAFLTIDELKILSQTDFHNATLKKAFLFSCFCGLRHSDIVALTWGNLKKGKVGKMELHMTQQKTQEILSLPLSKEALKQLPVRGKVPDTEKVFKGLISLGRTNEILPKWAAKAGIQKHITFHSARHTHATMMITLGADLYTVSKLLGHTNIQTTQIYAKIVDESKEKAIDLIPDIT

SEQ ID NO: 7629 - protein, 83 aa, B.fragilis
IALSHNYETRYIVTDLTVNSIQEFKNGYIIKRADTSYLNSKLRNEKIRSDTIRIRLSFVRAIMRFTLQCRFITYVTYPFASYK

SEQ ID NO: 7630 - protein, 283 aa, B.fragilis
HMDSFFQTLAFTYLLYPILGLLLVGLGIFIAKKNALLNNKRLVGYTIGAIVLLTLPALLGFLDYGFMPYGYIFLAMLYLLLGGYNIRMIAWVYKDDYKYRHEIILTGFILVVSMLFFTLVFNLCNELKYGLWASACLLPFVIVSVFIRTYRIFIAIPIPVYEVWRYTDDTEQDGYFDPGSLQVLQIELYKQESDREPVKLSVKAPDEMQFGTWFHRMIDDYNLKSPQAPIDDYAAKEGGWIFYRKPTLLSPRHYIDFNLTVKDNRIRSRDVIVAKRVMEHNEN

SEQ ID NO: 7631 - protein, 188 aa, B.fragilis
AERLRSPRKWAQEPHSPSGCLLRMSYKIRKRERTATCPGEAVGTQPSEVLPAKEETTEKEEDLRATAAGTEKATILIAEDTDSNFDLLNAILGRKYRLVRARDGMEAVTMYDEVNPDLILMDIKMPNLDGLEATRIIRQLSAEVPIIAQSAYAYEHDRNAAEEAGCNDFISKPIAQEKLKEKIKKWLK

SEQ ID NO: 7632 - protein, 66 aa, B.fragilis
SNLLVICGNGKLVYLWRKMELDNVLRADCYDTEEEKKLSPDMRTVSASKFIALYMPKDSNKLMELY

SEQ ID NO: 7633 - protein, 742 aa, B.fragilis
KLCPMDYVLYLLRALYRVKWWILLGTALITAIVYFRTGNLRGGYNVEATLYTGVVSGYGVEESTKVDWALAQNSMDNLINIIQAESTLKRVSLRLFSRILVKGSPDKDNEGITAASYNYTYNHMKNSPDGKALIALIDRTSEDKTMENFQKYERQDKNNYIYGLFYFQHVYYSYQALKNIKVERKGSSDLLKVSYQSGDPGIAYNTIEILMKEFVNEYQALRYEGTDKVIEYFKAELKRIGGDLTKYEDDLTQYNVENRIINYYDETKEIAAINKEFELREQNVLFEYNSSRAMLEELERQMDANSKRIIHNVELVDKLKQATNLTGKIIEMETISTAGDSTGMKLTEYKNRLIQSRRDLSTIANQYVAGQQTKEGVAKATIVEQWLDQLLLFEKAKAELKIVQRSRSDLNAKYTHFAPVGTTIKRKERTISFTEQNYLTNLKSYNDALLRKKNLEMTAAILKVLNPPAYPINEEVASRKKIVMMAAAGSFIFFVALFLLIEAIDRTLRDSTRTRKQTGSIVLGAYPAPLKLSPISKQCEEIATRYMSSAILRFFTERKEGMPFILNLLSTEQGSGKTYLAEQLQGYWESIGLKVRRLTDGTDFNSNSSAFTLAKNLTDLYTPGTEDILIVEYPSLEKANIPTPLLQDAQLNLLVASAVHGWKATDKVLLQKLKSQLGTSPYLYLNRAPKYEVETYTGMLPPYTFVHKQMYRLSQLALTESLFNWKKNSRKKPQDIDDDDDE

SEQ ID NO: 7634 - protein, 312 aa, B.fragilis
MVTTRILKIPFHPKAIHGIYGVNYYFHKKDALPQRLQFEATVEYCGQYMDEYSIYHISKKEYVVNRNETDEYLYDIAKKCADIIYPITVLLDRNGHPVFIRTDDIVERWSEKRHELDRYYKGDTAEYYLSKVEEAVNDPVKMMQLISNDLFFSQLFTFQYYNTVKFENDIMLIPFSIPLRFSSIQEMDIDSFSDSESDTIHIIHKGSTKNQYKNGDFYGSSEMNASQYNAILSAKYRIRYSLGKERHDFEAIEGDFVVSKEEEDVNSIKMEAYKLDEKVLEYGFDKELEKREREQKRIDNSLMNKLKRYFKT

SEQ ID NO: 7635 - protein, 156 aa, B.fragilis
NDNTMAIYSLHEMAGLLKTGLWQGGEVEKLGYIGTAVPHASPAPACGLTGVYISYDTMLERCEVSMQGGGCELFISQYHPYTGTYMTYVLESNLSDRRLLLAKLEEILADRRNPYLWSHNLYKRNSFGIERRYDTGHSSMWGGRIAVPRQSKFFGR

SEQ ID NO: 7636 - protein, 428 aa, B.fragilis
RINTKMKENISRFKIDYSVCKNSPGGSILEKVSNFQKELQLHEENSLHIYVKSPMVSGCGREVEVVDRKTNEVKKMLMFGSNSYLDATGIPSVVEKAVRVITDYGVGSGGVPLLSGTTIFQNELEKEIAKLTGFDDTILFSSGFTANIGVIVGLIRPNNLLVYDRLNHASLIDGALMSGAKMVRYKHNDPKALEKILKENAGQYKDGMMVVTDGVFSMDGDIADIPAILEITKKYNALLLIDDAHATGVIGGDGAGTLSYYDIKERENIIVTGTLSKAIGSIGGFITAKQNIIDYLRVYARSNMYSTSLPQSICAASLEVIKEMRNTDIQNALKRNAEYVRNGLKALGFNTLNSMTPIIPVIVGDEYILTQITKELYDRDIFTNAIFPPVVPPNMCRIRIGVMSSHTFEDCDRLINAFHEIGKKYGLI

SEQ ID NO: 7637 - protein, 146 aa, B.fragilis
NEDTMFGHKSFLRIGALGDSSISGLYKDSYELENCHFSFNQGTNTDGKPQTDVRGGTLYLTYAGLPQDDMLRWILNPKKYEDGAIVICDDSDEPLEKILFEQAACTGLNIEYTQKGKAYIHTKIILQARKIKVGETTFENRWTINE

SEQ ID NO: 7638 - protein, 605 aa, B.fragilis
NILTMASTNLDAVSVEIKVAGKVCDYVTMELFQSVSTHHRFKIKVNYRPDKPSVWAIGPDVIFKQLGEKVSIIMTHHESGEKTEFHGLISDIHVEGFDGNQGFVILEGGSPTILLDRDPAMDCYVEQNLNTIVSDILDKSGVKMNVTNNPKHTDIIPYVARYKETSYGFLSRLLRSYGEWFYYNGETLQIGDPEIETESRAGYDVDLTGVSINATIRSLNHSTYEFDPVNDKFYYDYSGTPKGATLGSRSAEKCSEPIFPTEAKLPSIRPAYSAMDLEHYGDAGFHRNYSQLSQIKASSRYCGIRLGELVVTRVPESFPGVKITDLGRYRITEITHTVDSRGRYSNTFCGVPGGTPVMPWGDAVMPVAYPEMARVVSNDDPKNQGRVKVQFMWQEVDGGESYWMRVQSPDAGKSDKVAKNRGFVFIPEPGDLVMVGFEQGNPDRPYVTGSLFYKANSEGAATDNSVKSIRTRSGHILEFNDDEGGDWGITIKDRNGCMFHLDTKGEEILISAPQKITIDAKDIVISANNQINMVADKGILANGRENISFVTKTMQTDVENDCVLSAKEFTGITEKTEIQSTKENLVLSSGKEVINKSKSKKIRLS

SEQ ID NO: 7639 - protein, 143 aa, B.fragilis
KQITMGFFDRLFKGKEVFADRRNPDMVCEITLCGQSHILSEFDIAYEPDNSSKEYMEAYAVFSEPVNAEVENWIMRADRKENGTVRFYLNSDAMDEGALFEINFSNASCVHYHNVSQGDTSVKTIVMTFPSVRMGGDEFELKR

SEQ ID NO: 7640 - protein, 290 aa, B.fragilis
VNTTKQTTSMEWYTKYLSIFGLTLSEIPGDTLSEIGTLLHEKQSDTPLVSVVVIAHNEEPHILSCLWSLGNNEYSYPIEILVVNNHSTDRTEQALQAVGATYFNELKKGPGYARQCGLDHAKGRYHICIDADTMYPPHYIDTHVRNLMKPGVACTFSLWSFIPDKRHSRLGLWLYECLRDLHLSIQAIKRPELCVRGMTFGFNTELGRLFGFRTDIRRGEDGSLALAMKPYGRLIFITSRKARALTSNSTIDADGSLARSFGVRLLKALKGATGLLYKKTTYKDKDSNLL

SEQ ID NO: 7641 - protein, 322 aa, B.fragilis
PLQTNAMEQPNKHPKVSVIIPIYNTCHYVQEALESICRQTLTELEIIAIDDGSTDSSRKVVEQVAATDMRIRVYSQANQGQSITRNNGMQYVQGKYVYFMDSDDRLEADTLETCYSACEAGQLDFVCFDADILNKDHPCARHFNYDRSACARPKQVYKGVELLQRQLSARVFSPSPCLNLISTSYLKTSGLTFYPRIIHEDQLFTSQLYLKAEKVGYIPQKFFLRRFRTDSTMTRQFTWRNMEGYLTVTDELLKAAPSYPENVRRLIRQFLCQMLDAAVWQAHTLPLRQRIGLFLLCLRHYRPYVRMRTLMVLMLKKKEEGR

SEQ ID NO: 7642 - protein, 1035 aa, B.fragilis
LNKTICTIKRNKMNYMQILSCWHKLEHFSPAILPKDKSLKPLKELPWMRPLEAKDPKKTIQYTIYLGVFSQISVSDFVKDFFKDERNNPNVTDAKVCYASLKLDNLGVYIQNTFGFSTMPWALRQLEAGKVNTNSWSEDFDKLRKNLLERLGENRKELAEDYSSYLSETQTLENLQQIQALIIQDLKWSTSPETEIYVRIEEVYKKNNTSDKEEANADLLNSFYIDDLERIITSSVKGSYNTAFRNYLSACLNKDFVHFDLSLQPEILKECLVPENYPDGCWPSPHTASLMQQFAVNTVSKELSGEKQEGIFSVNGPPGTGKTTLLRDIIAAILVKRAKKMVNFTEPAKAFRKIGEVQVSEKYTPSIYEPDSSICDGGIVVASSNNGAVENISKELPLKKEARGYSDQVGYFRQVSEECVGEESWGLIAAVMGNKENQRKLIYSIWDGDSEEESYTLKQQLKDYKPTEEEWLNIVVSFKNKLEEVEIEKSRLTGFMKDAESIEKLRIQLEDAESHLSHVDKELEGLLEEKNLLSTEIKRGKQQKEDAMTELKLLQSTRPGFFIHWFNKTVRTQYKKALTATLTKYNQLSEEITKQKTSLQALDLRVEKQRKIQEQSQKDYDRINSDYARLSELTEAARQELKGAYADASFWKQIESKEVQEISPWYSKRLKQLQSELFIEAMKVNELFILRANATSSRIKTTLDVFFNFLKTGGNLTEREIQAIWNTFWLIVPVVSSTFASIQRMFSQMKTGTIPWLFVDEAGQAVPQAAAGAIWRSKRAVIVGDPFQIEPVVTIPEQIVNNISHHFGLDKTQIQTSLSVQSMADRANPYGWITNDTWTGSPLRVHRRCVDPMFSIANEIAYNGMMYNSTLAESSQLFMRNGFLQVEGKVSGRHYVPEQGILIRQMIIDEIHHLQDLPDLFVISPFSEIPPILKKELRQPIKQALATYKSIEDNELKKWLDAHIGTVHTFQGKQAAGVILCLGLDEKSKGAASWASSKPNLLNVALTRAKQRFVAVGDGDIWLRQPYFSKLKALN

SEQ ID NO: 7643 - protein, 141 aa, B.fragilis
LLKTNGMELFSFLQVDSDLTAWFILDGQEYEMSHFDINFAQSVDHKGQPQDEVRGGIMSITLSQTLPENIYRWGMTSIPKNGSVIFKSKTTNPPLKINFINAYCIRFNRSIANEGGLESQLVISPDEMLINGISFDNHWVK

SEQ ID NO: 7644 - protein, 120 aa, B.fragilis
DEKTFLQNKKMIFFHKVICFILIIFRQLSVCATKVKFYFFTTVSRQDTIIQNIYIIFNRKHNSNAQTIIAQMKKKITKTLLIEPEDEKIEMVNNVIHQSIEELLVPYEKRRTYLPRKPPK

SEQ ID NO: 7645 - protein, 259 aa, B.fragilis
LNFLLFNKYYIIMMGQGDKKIRIRRTNEQLDKEVISEFEKLVGEFGFGNVNLSALMKAADLEANVFYRRYGSMDNLYDRLAKQYDFWINNTIDISTLNTLGPKKFFAETFKTLFRNLSENSVMQKLLLYEMTTINSTTKRSAETRDVMNLNLITFYENLFAPAKINIKSIASILIGGIYYLILHKECAKICTIDYKTKEGENAFSEGIDFLTDIIFDRLEMYDRDKKAIRQMISDGISESKICKYMGINKNDLKTLLSE

SEQ ID NO: 7646 - protein, 72 aa, B.fragilis
KEAAERAGIKHRVHVHMLRHSFATHLLEQGTDLRTIQELLGHNDIKTTSIYLHVTSAHKSSIPNPLDTLDDS

SEQ ID NO: 7647 - protein, 280 aa, B.fragilis
ITSAKISYGNNKPPIKIFMTDFNWMLWIVTPIIIVYYLYRHVWPAVRKFIRLFQGIRINPRSHLTEAEYKKLSVGSLYALQQGAYLNSLTLDSKDKLPTILADWWGICNAQDAKQTLEYLGKKGFAYYFPHVYQAFLLDDEEAKDRIFQQHMDSQEDYDKAVEQLHNLEDCYDELLECGTITCREDLLRYGVTGWDAGRLNFMARACYDMKYISEDEAWHYINHAYEMVHSRFSSWHDFAMSYVIGRALWGGKSASNSGMMYMAEDLLKSEKSPWTKIEW

SEQ ID NO: 7648 - protein, 326 aa, B.fragilis
IMKALFLTVILMAFASCGNAQVKTKTEKEMKQEIAKLEELIKEELQMVKTYPEKPAYYLQINKTGCRLLVRVDDIPIGYHFVENEGESMLYPINDVLFGSGKHTVSIQVYPRTGETEVTKNASVNIKIIYYQEKLVGMPKTLVELDTPEDIGTKKSPIYTDSVSFNAILPFDYKRILAEAKDLQKVPDLEKKVLAHYNKVRQMMIEGKYYEYEKMRLSTTWVLADMSYLGQDALRKAHIDEDYLFRFLCEPIDWIALPIENYEMVICGNRKLVYLRRKVELDDVLQVRYYDTEEQKRLSPDMRTVSAFQFIALYMPKDSNELMELY

SEQ ID NO: 7649 - protein, 135 aa, B.fragilis
CANFLTNSLYDFQIDDDGFPVREGSVVCVSPAPSRGMRNSSDEPMIYMVIQSKENSVGNYSTEDGTRTFYTELLHWIKEVLSENLDLMKSLLDNDLAEEKAKNLVGLDVTNDWSQESIEILFKLVLMYANREPYY

SEQ ID NO: 7650 - protein, 293 aa, B.fragilis
IKYYCIRCFISKKRGIFRALVANLSYICTDFASKQTIYTNKYIDMKRVLFILCSIPLLLFSPVSFANAQETSDFSKLNPEDYTNISLPPLDLLFENAKGGPIYELASVKEQIERKLLAKERRAFLQFFSVRGSYQWGRFGVDNTFTDVATPIMYNYSTSKQKMYTVGGAINIPFNELFDLVPRVRRQKLTVKTAVLEREVKFEEMKREIIELYATATSQLNVLKLRAEALELANMQYDIAEKNFVNNTINTGDLSVEKERQSTALEAFEKSRFEVTKSLMILEVVTRTPILKK

SEQ ID NO: 7651 - protein, 330 aa, B.fragilis
NKPYMDASKQRGSIVLTKQNIDGQDYIRIEYTDNQTIALLLSQDKGIKTIGNGSAYIQASTFQLPEFYTRYSPHAYIDYSRVYVRHPKPQREYVLPKGYLELLEQKRYSPSTIKTYRIYFSDFMEYHKGRNIDYLKVADINHYILYLVNEKKISVSQQNMRINAIKFYYERVKGGKCQYYGGITGAKEYKTLPEVLSRNEISRILSCLPNLKHHCMISLIYSVGLRRSELLNLIPKDIISERMLVRIMGKRKKCRYSLLSEKVLNELRTYYKEYRPKKWLFEGDSPGEQYSASALVKVLKRGCRTCRYQTSGTCTHAPSLFRYPFVGTRY

SEQ ID NO: 7652 - protein, 227 aa, B.fragilis
YGLYGNKIVFSGLENIKDCCKMKITRDELLIAAFKLFMSVNYEKASFAELGKMLGMSKAGIFKYYKNKQELFIAVVDKFWFSTQNPRNKFTETNGTFAEFIDEYVRGVQRTMDMLGDLIGAEREKVAQGKFTYHAQYFHFLFQLLQYDPDAKEKLRNLVDGDYAYWRAAIQRAIATGELREDVDVEDAVVMFRQVYMGLSFEMAFMGGLNTQRLAKHLHAVYSLLKR

SEQ ID NO: 7653 - protein, 235 aa, B.fragilis
NLEYMSDKHLVCKGATVYCSKSMVNNSPGTAIPLTITSNTLVELNGGKVAATDKDCTPANMCFGNCNTGTNPPPPCVANVQWSKFYEGAEVTEAGMKLLTEESEATCMAFGGKVKIAFHGQVANPQPEEPGEVSPEVMAGILPVNPRPEETIVITEGDEEREKKITDAYWVDEKTQEKMQEIYPGKKVTLCLKTSGYVEGEQADIKIKMEDGKEKTASGEVKRDGTVVIENFEID

SEQ ID NO: 7654 - protein, 251 aa, B.fragilis
QFRYEAVGIFVQGDCGLYERAPGGHYLLSGVCRATGTFTSDSIRNAFADWQYAVIPQAPDSTPILQVALFSKYPVKDSRLITYPDSRNCSMWCDLDVNGQTVRVFNNHLQTTEVSQNKRRLERELAKNELTGREEAVARQLLEGLNENFRKRAAQAKTLEQLIRTTPYPILVCGDFNSLPSSYTYSTVKGDNLQDGFQTCGHGYMYTFRYFKRLLRIDYIFHSKEFKGVDYYSPDLDLCSDHNPVVMEVKM

SEQ ID NO: 7655 - protein, 828 aa, B.fragilis
NMDFLNINETVQSVIRISKGVAREYGNASYAPAHLLFALMHKEVGLRSFVESLGKDADYLREWAEVRIEEYPKAAGAGEIMPDPKVNELFEQADNVRIKWGLLEINPLCLLAAIATPEAGFSTDELRSFPIREREIHDLFTSGMGNMKKSVSTQTDLPGSEAPLWTAGAGNLDKYCTDKTALAADKKVYPIVCRDRETRMMMEILGRMGKPNVLIIGDAGVGKTALVDGLACSIIEGTVPQYLKDMTIYELDTGTLIAGATYKGEIEERLKGIIKELSAHGNAILFIDEIHTLIDPKSGNSGAASILKPELAKGNITVIGVTTVDEYRKLIEPDHALNRRFEVLQVSEPDLASTVNMIQAALERYESYHGVGVDVDSLPECVALAKRYVKERRLPDAAIDLIDRTLSAVKMINQSGEKDIKGLAEQLAAIEAAEDQPEAERTEKLRLVNFTMKNRLSPILLGMLSDGQNEPESSDYGEWMDYILGVLDRLRELTKEKIGKITSHEVAAVISSSTGIPIGKIESGEKEKLLNMEDILRRRVVGQDNALKVLTDAIVESRSGMNKPGQPIGSFFLLGPTGTGKTELAKALAEALFNDEKAMIRFDMSEFKEEHSAALLLGAPPGYVGYEEGGVLVNRIRRQPYAVVLFDEIEKAHSSVYDIFLQIMDEGKLHDRLGKEGDFSNSIVLFTSNVGSEWLSKQINEGKNPSTTDLMEVMGSYFRPEFLARLSEIVPFSPINETMLVRIFEIQLKGVIALLEKQHIDIEITEKAKNLLATRGFTPKYGARQVAGTIRNYIRRPISKMIVAGTLAAGNTVVVDVADNGDIDWNVK

SEQ ID NO: 7656 - protein, 76 aa, B.fragilis
CKLQALRIVAYGDREDQDARQDGADDQRIEPGSAQGCHDGSRSGGYLYDETPQGDELKLFIAVEQRIGNDGGGSKK

SEQ ID NO: 7657 - protein, 162 aa, B.fragilis
TITNNCAMNKTVQSILSLTAVSLLLIVITFFLGGLGFGRLFGIYGVMEDSFLGMLMVIDMLVIYKVYKLYFCQPKAIMLLFGLECCSILLWLVFICLDQHLLDWQITNLLLQAVSLDGFAGDERGLNMLAVLCGMIYPLIGIGCLFTGLRFINKLVTTKDSI

SEQ ID NO: 7658 - protein, 87 aa, B.fragilis
GKNNCWFKYKQVILNLFSCHLAIQYELAGNKNAMSQGIILLLNILSFRIDNVQIFSLIVYMIFKLMMMVSRFVRVRLYVSLLLHRGA

SEQ ID NO: 7659 - protein, 419 aa, B.fragilis
  UNSURE (401): Identity of amino acid sequences at the above locations are unknown.
LTCKCTVPSSPVVKTPAAFVAAQDKGISTVKDGQTAVGNTFNTDTAKQDSTPALSKRELRRQRVARRNLHYNILGGPSYTPDFGLLIGGSALMTFRMNPSDTTQQRSVVPVAIALMFNGGLNLFSKPQLFFKGDRFRIFGQFSYKNTQENFYGIGYSTNKDYVRSDTTSQYRYSGLQINPWFLFRLGESNFFAGPQVDLNYDHMYDPAKYLVDQPSYKAAGGTDKGYKNFSSGVGFLLTYDTRDVPANAYRGMYLDFRGMMYQKFLGSDNNFYRLEIDYRQYKTLRKRGVLAWTAQTKNVFGDVPLNKYALSGTPFDLRGYYMGQYRDKSSHVVMAEYRQMINTDKGNWVKRMLNHVGYVAWAGCGFMGPNPGKIEGVLPNMGVGLRIEVQPRMNVRLDLXRNMVNKQNLFYFNMTEAF

SEQ ID NO: 7660 - protein, 293 aa, B.fragilis
IICNKMGKKIEIKKLSDFEAMVNAGNTTYTGLVEGIGYVYWTTETLYFIRTNPEQLWAIPKYQQIPFPYFQRKDAIIETKTLHTLHVLSKDELLKLDYDAYYAFYGIVEEMLKFIHRADAIKSYCEIPLPIIKSKGALKGNDARNGILSLGSQINDQIGAPLDAANMLMDNKHIGKIGDGLSLISIIDEVGNGEYWSAAGDILLFAAGKTKLSPYMTVISLGTWMYETDLMQWRLACINYSDYKKTLIKYRELQKKFESGDKSVEEKMNECHKILNSHYIEMQKNLGNLGVKF

SEQ ID NO: 7661 - protein, 584 aa, B.fragilis
LQINSEHFCYLCAININTHYLYMADDKKIIFSMVGVSKAFQPNKNVLKDIYLSFFYGAKIGIIGLNGSGKSTLLKIIAGLEKSYQGEVVFSPGYSVGYLAQEPYLDNTKTVKEIVMEGVQPIVDALNEYEEINQKFGLPEYYEDQDKMDQLFARQGELQDIIDATDAWNLDSKLERAMDALRCPPEDQSVANLSGGERRRVALCRLLLQKPDILLLDEPTNHLDAESIDWLEQHLQQYEGTVIAVTHDRYFLDHVAGWILELDRGEGIPWKGNYSSWLEQKTKRMEMEEKTASKRRKTLERELEWVRMAPKARQAKGKARLNSYDKLLNEDVKEKEEKLEIFIPNGPRLGNKVIEAKHVAKAYGDKLLFDDLNFMLPPNGIVGVIGPNGAGKTTLFRLIMGLETVDKGEFEVGETVKVAYVDQQHKDIDPNKSVYQVISGGNDLIRMGGRDINARAYLSRFNFSGADQEKLCGVLSGGERNRLHLAMALKEEGNVLLLDEPTNDIDVNTLRALEEGLEDFAGCAVVISHDRWFLDRICTHILAFEGDSNVFYFEGSYSEYEENKLKRLGNEEPKRVRYRKLIAD

SEQ ID NO: 7662 - protein, 306 aa, B.fragilis
KRIKGSSQTSMKQIPPLISFITICYNGLDDTCVLIESLRDTISSVSYEIIVVDNASRQDEASLIQERYPFVRTLRSEKNLGFSGGNNLGIQIAQGKYLFLINNDTYLTEDGLPALIERLESDPRIGAVSPKIRFAFPPQNIQFAGYTKLSRYTMRNKALGMGCPDDGTFDTPRPSAYLHGAALMLKREVIWKAGLMPEIYFLYYEELDWCTNMTRAGYQLWYEPRCTIFHKESQSTGRQSPLRTFYMMRNRMLYAWRNLPGMERCLAIAYQMLIVAPKDSLCFVLKGEPKLAKAVWHGVKGFWKLC

SEQ ID NO: 7663 - protein, 152 aa, B.fragilis
RKQKNSDGHQINKNIRWMQTYLYLHKENIDLPHGVYRGKYPLKHFDYGLSRNVGRKGEITSGVCGGEIRIVIDGFADATLLGWLFDTFRKEDGAIVTLDEHETTFAKLQFSGASVRSYRMNYDSRVKKGVVTIIVIEAKEIVTDNDLFFKNK

SEQ ID NO: 7664 - protein, 389 aa, B.fragilis
EYKNKTTYYMAKKNLVNWSDCMPLSAAIFNQHDDYFLDSIRDSIEVRTNSYNYGLLPARQNRDGENGIRISQHVTGHIEVRLKSCEAITSSGIRIQFDATETGSELVKNYSVESDTRKNITQWDIILSVDPFHRVGSGDPNPEEVPPRHPNALPSYRLFVMPKGEINVSELGAHYLTIGRIRKDAERFMVDADFIPPCTTMKSHPELQEYHAKFGNMFRSLENYSKIIIAKIHNRDNRGELGAHISLICREMLRYLATLQFTYTNKGLYNAPIDVLEAVSSLAHIMYVSFSYLSGTQKEETQKYFYEWSDVTPGSFDEQLADTLEMLYEHTDIRASMVRAYSFMYTLTELWQRLSTLEYIGQHKENIVVSERTTGNNTTGQNKTWSIMD

SEQ ID NO: 7665 - protein, 408 aa, B.fragilis
PIMNNTITTWLEILFWLSLFLVFYTHLGYGILLYMLVKLKELFVKPVRRQLPPDKRLPDVTLFITAFNEEEVVDEKMRNCLGLDYPADKLHIVWTTDGSNDSTNQRLEDWPQATVHFQPLRQGKTAAMTRGMMLVDTPLVVFTDANTMLNREAIREIVRAFEDPKVGCVAGEKRIAVQEKDGAAAGGEGIYWKYESTLKALDARLYSAVGAAGELFAVRRELFTVMEPDTLLDDFILSLRIAMQGYKIAYCTQAYAIESGSADMREEQKRKVRIAAGGLQSIWRLRELLNPFRYGVLTFQYVSHRVLRWSLAPVLLFALLPLNIAILLAGGSPVCYGTILALQLLFYIMGGWGYYLSTRQVKNKLLFIPYYFLFMNINVMKGVNYLRKKKGTGAWEKAKRTKTESLNQ

SEQ ID NO: 7666 - protein, 152 aa, B.fragilis
MIMKKFLFILTVITCFFASSVEARRVRFTIPVDNSIPKVVTLPDSSYYKTDEGSHLDLGYIEEDGKRTLVLFSESKPDTYYDISDEYAEAICRDLNVEELDTLIPKPTFWDQWGGSILFYGIAALVVIGVVSYLKDFIFNLLGLSKKKEEEE

SEQ ID NO: 7667 - protein, 150 aa, B.fragilis
ILWKMKQKYYKLPVRLEKLFEGDIRQLERCSELESIDQHIELLLTTCPGEHRFDPKYGCRIWELDFERIVSTEQWKELFTGYVMQAISTYEKRISDITLSVNLQEVVREEVLDNRMIRKRVDITVLATLNSTGAPCGFGYKLYMGPLSNE

SEQ ID NO: 7668 - protein, 132 aa, B.fragilis
LINDNSMDKDIIVAEDEDVKIIFHFKVFCELLKECMSIYGNTTIENAQQLVKNFHPLQQPISTTDDIVFFSHENIYHWAMLALYGETYWLIHPECEKLPDSYEKWVENALSRHSLDDCYEFMSKNNNVTNKA

SEQ ID NO: 7669 - protein, 437 aa, B.fragilis
DSAEMILCVICGEPQLNRFTQIYRPITYIKTYDTHLSLVDWILFVPLALCVAYLLVYAIASKFYRAPHYPEADKLHRIAVFFPAYREDKVIIDSVRSFLEQDYPKEMYDVYVISDHMQDSTNKALSRLPIRLLVATYEDSSKAKALLLAISTIEEDGKAKGLGNRQLAFMYDIAVVMDADNVTVPGFLSEVNRAYSAGVQAMQAHRTGKNLNTDIALLDGVSEEINNGFFRSGHNALGLSAGLAGSGMAFDYFWYYDAVQSLETAGEDKELELTLLECGMHTVYLEHLPVYDEKTQKKENIKNQRRRWMAAQFGILCEGLSFIKSVKQMEGWWRWWPSFDLVDKIIQWMLPPRLVQLVAVFGFTLLATLVYRPAASKWWILSVAQVAAMFIPVPARLLNGRLLKALMQVPSLALGTIASLFHLKGANKKFIHTEHGE

SEQ ID NO: 7670 - protein, 93 aa, B.fragilis
EEKLGKTYKTIQDKKGQDKTETIEKKRKPADVPAAVVAATIGMAEVSGIANAPIAAFAVPAAPSSGRRKGYFRYVRMRVGRHWWTKYKPTVSG

SEQ ID NO: 7671 - protein, 100 aa, B.fragilis
SKHCPVINVFVRKENNIISSAYWLLERMKVFNQLLCILYGSISIYRHALFQEFAKHFEMKDDFNIFILCYYNVFIHAVIIYKLFQVVTNVFNNHTLWCSS

SEQ ID NO: 7672 - protein, 467 aa, B.fragilis
RKACLTGKRTVERSRKILTMTMMNDELQKKRDPDQSEIAFYLLFSVQLVLIAIGIFVPIRMGVTTLPLVIALSMITLMRCTGQETDWKRGQNVMFGLFMVWGAYCLFEIGNPNHVQAAWNIAITHYWVYPLVFAFVVPLAIRNYKGIEWLLLIWSVFVLIAAFKGYWQKSHGFNAKELYFLYTLGGYRTHLIWSGIRYFSCFPDAANFGVHSAMAVTTFGIATFYVRKRWMKVYFAIIAICAIYGMGISGTRAAMAVPFGGIALFILVSKSWKSFAFSTLAFIAVFSFFNFTTIGDGNQYIRKMRSAFRPSEDASYQVRVENRKKMKGLMDEKPIGYGIGLSKGAQYGPKEVMPYPPDSWLVAVWVETGIVGLMLYLLIHGVLFAWCSWLLMFRIMNQRLRGLLAAWLCMNAGFFIAAYANDVMQYPNSIIVYTGFALCIAGPYIDPVMQKEDEELERERKEKKKRD

SEQ ID NO: 7673 - protein, 149 aa, B.fragilis
TIKRSCMGDIDILNKFDNDKLIDVVKNYKRYGYDDELRDYAINLLGERGWSREDLQQFGYLTNYDYDEAEKQYKAYNRNSLIGICTLVFSGGILAVVYLIFLILAYRNVAKFYNALGHNQDETALFNALGVLAYFHLKGRMKEELKGIR

SEQ ID NO: 7674 - protein, 269 aa, B.fragilis
LKRRLMTGELNHSRERLEKQKIKNVMAKIFIILIITLCTGCFGKQHSSKHNNVSNINESDIQLDSLPLTKYEYKMRGNLKDDIGDKLGAIEDYARAIKIDTSYDTAYYNRGLMKSAIGDREGELADYNKTLSINPKYLKAYFNRGLLKYEMGDYEGEIADYRLAIKYCKPDADIYNNLGRALYDLERFKESAEAYGEGIKYFPEDYRLYYGRGLARKRLGDRKGACEDWVKSSELGCTQANILLPLCDEYIKEENDSLKKEKESANKIE

SEQ ID NO: 7675 - protein, 632 aa, B.fragilis
IMNRNLLMPVAVSLILLSGCKYNDDNFEGLDDMTQPTNLMKIEYTLTDADYATISTNSVNKDSAANHKPDDLSKDLANVKTNMYLTEKITGATYIPAFLLDKYYTADKGSSAKITYKYKEAMSSLLSEYASVKYLKPTDAEYKLVYGENAFAPYLNEKTEGQMSKILNEKFKDAEKGTAVFVDYKLGEGQLENPLMWQNFEALPTGDLKELKGWFISSTGDTQWKVTSYDDNQYVQYSANGTKGACVGWMVTPAISVTAGDYLAFDVTVGYYNASCLSILISENFDGKNVGTANWVDVTSDFSIPTKPTSGYGTFASAGKVSLSAYAGKKVYVAFKYEGDGANKKTTTYQIDNIMVGTSIPANSLSTPTYAVKVYDGKNWKNKSNSVYVLTYADYGDMGQSKRYFTSDVPAVNYLPAYLSKMVAYPVDGDARVVVYRFYNGKALNIYSDEYTYSAEKARWELNTRIVDKTEQFVLSDGKWNFDPSTVVTLKAEKGNVEAAAFYQAITDWVKENHPEYVTSYGNNDYYYGGSAYNNNFDFRPSAWKAQNASAYGSMSDADLTKLMFERLPEAFLPGLKAIYGSADVVEGVDVFYTINFAIYDGSSTTQYTIKYKVTGKGQFEYVADSLTKKVE

SEQ ID NO: 7676 - protein, 464 aa, B.fragilis
KTIRTMEDNKNKSEVQAQETVQVSYKEKNGESSLASALDVLSRFGGFNFLESTVDGVQNLNPERKARKKIFLTDEQKQEEREVLKNKIDMWIDLLNSSSAVTEMIATSKAKSEAAASHLAKSQLVAVQSVRDMEQAYRGVMLFYKNTEADKVNNVTIVNASKEQLTDLDNPRFIDFVARELKQNYDKLDLRQNYSLLAIPGYLGSNKVLEKWAKIAYENKVMLYTDFADLDKPEDVVELFSSSNMASGEAFKSNTCMTCNWLVGRAGYREIGEEEDLHISPSIALMGKVYTTLMSQVTAGKKYGGINEIDAVVFPLKKSEISQLEKMGLIPMVNEYGKVMAFSAKTLFNGDNLGLQTYSVVRVFDYITKVLFDFLNRRSFENWSSKTERDLRGQIVQYLDSVQGADRLIEKFKIIRFEQDQKQKDRIYLDIHMTPFFPAKSFVIKLDGTKGDDGTNWNTNYEQA

SEQ ID NO: 7677 - protein, 801 aa, B.fragilis
IGQSMDRILHDVDNAHKILQLTSDTLILVDKNGTCLDIDPHSDLWFLQEDRLLGKNLFNLLPDHTFQKLLPDFKRVTQQGITVNRNYRLPLEGGETYYFKCIMQPYDCDKVLCQYRDITARNNVKLQLERTNYDLKEIQKAAQIGQWKYSSRERTFYYRGYNGIVCTEEERSINFQDYYETILSEDLPAVNTWMEANRRELLKEYIEYRILLEGQVYYMRQQCYLRNEEEDGNIVLEGYIQNITDIQRKRNDINTLTHAINNAKESVYAARRDGTLIFANRQFRLNHRIAEQADLSLIRVFDVVGDMTCIEDWEERYRSIREGQTLNFLAYQPLKHDKNTLAFEGTMYSVTTDDGEETFWSFTHDISERIRYESQIKRFNRIMDTTMENIPAGIVVKDIENDFRYIYRNRESYNRDISSENAIGMNDFDYYPPEMAQQKRKEDMEIAATGKGMHWIMEGKDKNGNLLILDKQKIMVESEDFSPIIVSIEWDITQLELMRRELIESKEKAETSDKLKSAFLANMSHEIRTPLNAIVGFSRIISESDNAEERREYYEIVDANNERLLQLINEILDLSKIESGIVEFTYGPVRLHTLCKEIHDAHVFRCPQGVELRFDSPDEALSIHSDKNRIFQVFSNLIGNAFKFTTEGSVSYGYKQEGERVVFYVKDTGLGIEPEKLGRVFQRFAKLNNFAQGTGLGLSICKTIIERLGGEIAVSSEVGTGTTFTFWLPLENVIQDTETGTNSHLPRRSRRNTAVGSAPGQRGNDGKGRGPSGNRSRNGESHHTDSRRHRQQLRPAERYSG

SEQ ID NO: 7678 - protein, 154 aa, B.fragilis
KQKRQMAILEYGIGGNEVKVDTSEAIANIPENRSLIVEQLTADEPVTPEAVKGLSTIEEVFAHFLPNIDVEFENEEGQPVKENFRFSSVADFSVKNMTQNSPFLHKLDTEKTFYEGMVTQLRSNKVLQRVLENPESKKAFISALEALSNELKTE

SEQ ID NO: 7679 - protein, 934 aa, B.fragilis
LTKRIMRRHLIHFLLVAVLTVCSAATAIAQVTVKGQVVDAETGEPLIGAAVTIVGTTQGSVTNLDGMFTQKAASGSTLLIKYLGYKEFSKKITQKGGTEDLGVIKMAADAMVLNDVIITSSVAVSRKTPVAVSTVDPVFIEEKLGTQEFPEVLKSTPGIYATKQGGGFGDSKVNIRGFKTENSAMMINGVPMNDMEWGGIYWSNWAGLSDVTRSMQVQRGLGASKVAAPSVGGSINIVTNTIDANKGGFVSYGMGNDGLNKILFKVSTGLTKSGWAMTLLGGKTWADGYIQGTNYEAYNWFVNITKRFNDNHQLSFTAFAAPQWHNQRGNKDGLTIEGWQEVAKNYMNGEKPYRYNPTYGFGLNGQRKSSAYNVYNKPQLSLNHLWQINEKSSLSTALYASIGRGYGYSGQGLTSADRSNWYGSNNGNLNMTFRKADGTFAYDEIYALNEASENGSVMAMSKSKNFHNWYGLLSTYTTKFGDYFDFYGGIDYRYYKGTHTNELVDLYGGDFYVDSSSRKSVLASNNAAAAAGSSFVNQKLKVGDIVYRDFDGYVMSEGVFAQGEYNRDKLSAFISGSVSNTGYWRYDRFYYDKAHAKSKTVNFIGWNAKGGLNYNLTENHNVFANIGYISRAPFFSGGAFLNSTVSNATNPDAVNEKVFSFEIGYGYRSSFLTVNINAYHTRWMDKTTTRSQDITNYYEGSLSEPYDASKLVSTKSVINMQGVNALHQGVELDFVAKPFQWLDLSGMFSIGNWRWDSNASGSFTVEGQFVNSASIKGSDGKDVTVLVNAAANGLEPGTMKLNLKDVKVGGSAQTTAALGATFKIDKALRLGIDWNLYARNYADWSLNSNDLVMNSEKDFSTPWRIPTASTFDLNASYKFNFGKLNAVLSGNVNNLFDQTYISDATDGSNHDWKTAYNVFYGFGRTYSLRLKVNF

SEQ ID NO: 7680 - protein, 84 aa, B.fragilis
ASFGSCRLLYMCELFGAVCKLVCMALGTPFFLCKVFIVWLAYCIFVSCRLNYWLQYSNYLFILLWGSCDKYRSYNSVGSIKLSF

SEQ ID NO: 7681 - protein, 72 aa, B.fragilis
GAIGTLRKKANLSTTEATEMMEIDRSLLSKPEHGKYVSIDKLAEIITYNISFIRGNSKGRISQQEILNEITT

SEQ ID NO: 7682 - protein, 495 aa, B.fragilis
IKNGYAMIEFIDPNSNKLVSSGPTMARKAYYIHGTTSDNDRWSNYPSTVQQLNRIAFGIGVDKNDTEGINDMGSEKFKEACCDFSFEWGNNGILKAGNNWFLNTVEDRRIASEKLIEHINGNIGKCEEVVLIGHSHGGNVAIQAADKIFSKIPAVKRVFVLTIGTPAFNRLFITSYINNKNLITFNEKVSEKILYLGKDYVVPVIKLGRKFWGPLGIFLYINCENPATWKNKDKITHIALWNKKDHVDDMAWVLDRNKYFPYHGMTNNSAYFTNSITDNVEFDFAPADIRDYYKREIKPFAEWLANLDYLRFCLVDLRLKGYDLPKMPTLLTYKEYIVRRKKMEASKLEEKKYVNERDALRVDIPKPKPIMMCASTRLREEANDLQELFKSTNGFYQFMTDIDEAKKDRSKVVDTQMVIDIYKQKHPEIQAIEEIKQEMYRETEFLEKAMAIYLLDNTSFGEHGFDLANPKLIEKAINDGRIKPFPNARNINTEF

SEQ ID NO: 7683 - protein, 262 aa, B.fragilis
YRILINMKNIILIILVLLSSCGFSQRQNNWRDGHVELDSIPLTAYEYKERGKRKSANGDKQGAIDDYTRAIMVEPTYDTAYHNRGVVRADIGYYKDAILDYTKAIEINPHFAASYFSRANAKVDLRDNKGALSDYSKAIELNPRFIDPYVNRGVLKSEMGDYEGEIADYHLAIKHCEPSVNLYNNLGRALYALERFKESAEAYGEGIKYFPEDYRLYYGRGLARKRTGDKKGACEDWMKSSELGCVEANLLLPLCKECDTKK

SEQ ID NO: 7684 - protein, 60 aa, B.fragilis
RFSIKFIFSKISSRYPYSEEYKKVGAARKQNLSNTMLLTDFQNFLYISYYIALPDNKGSR

SEQ ID NO: 7685 - protein, 771 aa, B.fragilis
YSNMKYMGNSLNKNKEWSVTNSPIIKLKVDKKEPKFNATEAVKIRITAECHNVTIPKNGLEYEWSYVDSTGFMKSFTTKKGVVMLHCPNFFCGRVMTIKVKVNLEISKFDEKIKFSSFDFGKFDTLEDTIEIKPQCNKKLSDNAEWLPDEVEMPNCVQSSVTLYGYNGSEMGLVRMIKEKGKIIWKGEDKVMVRDNVVSALFNRNHCTSSTADDSIYTLQFQLTDARNGSLLKSYSRDYTIKGREAIKPLAGCPIQPVVVGDITIAENNFKPCKYTQIDVEYTKDKEGKEKQKMTVFKEGLQSTNTVNLIGGERKITVTLLEYTPKKCTLKENSHKKKEEVPFMLYGENKSKLPISVSGKTGKIENIKIKYNYGIINAIKTLWLPMSGIVQTSKLYTSYANCRHFNDVIFNMYPDTKWEAFVELSSSKPRLYSHTNMPAEYSIFERHQKKALSAAKEDKDIGLSFSLMATYDDDIEIKLTADIEKSVKTVSHVLKTIRDALDVLSFKKSVDDNKDKLKARNVLPKSSKLPVFIEISSPVLKIGGGWQYDLNSENQLIRKGEIAIAASPLIEAKGGIDLIACSTFIPVVGQIIKAILKLNDFAEWATKYLSNDKAKYEGLIWFNIYLKGSLSIVGTVKLSEENRTVKFESPVNIVFVVELGISAEVKVETVTITGNNTYTVRAGASGEASTGLTFKPSMGYSTDEGIYLGFKVSFDGIILTVSGEAKFEQKKKGKKTLSIGPEINGEPLPPLIAPCSIWKGEVYPFRETNKK

SEQ ID NO: 7686 - protein, 321 aa, B.fragilis
WIDMEHRLPKEIKGLLPPNTMDTDFKAELYGALLAEAGFDTAQIMMVRDGNNLSNVSKDIRSVKYRNHVGIAEGTYIELKTNRRGIYDSLPEGLFHEALFPGKVKDLGLILEEMQQHSNEEFFIRRFFSLLESEVDREGIQAQLLELRYDKKNKYSDYAKLFAACWPVIHILSGQGALLFIKFMPHIHSIRGRLEEVSDALSQILEAPVKVRPKMVQRTIRAQNPNRLGNMRLGANSVNVGVLNSAGADLHIHISDLPTREVERFLPGNRSRKALEMLADIFLGAWQEFDVTVSVSPDERKTYLKPTGDASPCYLGINTYL

SEQ ID NO: 7687 - protein, 307 aa, B.fragilis
QPDIMNGLQIIKTLALKIRYASIVEWYNFWSIVLQHHQNIVPTVASIDETIRHITEGNRSISRFGDGEMLLTSPSKSIGFQEGSPLLAKRLREVLVSHEEGHLVAIPDVFSGLNRYRRKCRRFQRTHFFIYGKWWDQLLIPGRKYENAFLSRPYMDYTSKEHCARWFRELKTIWEGRDIVFIEGAMSRLGVGNDLFDNAGSIRRILCPPRNAFERYDRILNEALKVEKEVLFLIALGPTATVLAYDLHNAGYQAVDIGHIDVEYEWWRMKARRKVKLEKKYVNEAFGNKRVTDAGEGYRKEIIAQIS

SEQ ID NO: 7688 - protein, 158 aa, B.fragilis
YMDIAKIIYVSLTMLTAWVFMSIAFPIDTYKHLLGVVGSYICVSCSALFASWFAWHWVHPFSYVKYLLCGLLTAFLFHAGLTIGCSIPIIFLSCCGVHVISTEAITLWEVLSYLFSIFIMSFYFVGIFTFGQCLLTASITKIIIWKLNISNNITNNAR

SEQ ID NO: 7689 - protein, 106 aa, B.fragilis
ITSISITISIPKKLSSITPYIPNSRPKPKPPKKNVITISKRLTAVNDSIDWTVLFIAQLLVMVQQGTACRYLALLVILLLIFNFHIIIFVMLAVSKHCPKVKIPTK

SEQ ID NO: 7690 - protein, 64 aa, B.fragilis
DNTMPYITIEGGSLTREQKSELIRKVTEVASEVMQIPMEFFLCTVKELPDENIGIGGRTIDLIK

SEQ ID NO: 7691 - protein, 287 aa, B.fragilis
QMKIMEIKYIFCIVFCFWAMKTTMAQSDNNLFALEKQLCFIQDTLSILRQNYPYTDDNYCDSLQHRFSILLEELCAVDKEMKYDFIELRKKERQFTMAVSVDEDMRVFSRNTYFGGSMPLFASYIQYKDKEHLYFFDINEDNDMGICYDTIYSIQALNKRYYLLSGTSQIAAAYPLVVMKAVSCANGELKKEIIFVSGNQQTDYLSISYRYVKDNIDTRLFISGNLTFPRIVYVETQEEILKPVTVRDKDDIKYIGGEIDVYKLERNKNEIKFINNNESYHLNDDPF

SEQ ID NO: 7692 - protein, 65 aa, B.fragilis
AERIEYGYQQDADHQGRDQLDGEMAQAAVQRHPVHHPVALSEVDGKRERDACGYSFERAEPKNAQ

SEQ ID NO: 7693 - protein, 112 aa, B.fragilis
  UNSURE (104),(105),(107),(110),(111): Identity of amino acid sequences at the above locations are unknown.
RQSVLPRNKHLFIRIMKAKNSEKIIRGYLEFAGGLLISTALSMALLTGFIHTNGSEYKLMESKTQEYDKIYARQIALVDKVDSLYNYLVLMVFTTGLERAAAIXXSXSIXXP

SEQ ID NO: 7694 - protein, 104 aa, B.fragilis
FVRFRIVGRTIEFGRNSVHQQIGYAKCQRNEQDPVDQAQMSIISLNVGYGSIYLCKSVQLWFTTDYTEDHFGRVLQNPIESQRIPQDFTFSFMDIPQENDSSLC

SEQ ID NO: 7695 - protein, 1248 aa, B.fragilis
KNQVQNPKVMTSLKHQLFSGVFYTALAKYSGIGVSLVVAGVLARLISPDDFGVMAVATVIIAFFNLFTDVGLSPAIIQHKTLTGENLSGLFSFTVWTGIGLALLFAAASWPIAAYYDREILRPLCQLLAVNLFFASATIVPNALFYRNKEFKFIALRSFVIQIATGTAAVVAALCGAGLYALIIGPILSGILIFAVSIRHYPQRLKFTLGLDVLRRIFSYSAYQFLFNIINYFSRNLDKLLIGKYMGMSPLGYYEKSYRLMMLPLQNITQVITPVMHPIFSDYQDDLERLASGYERIVRFLAFIGLPLSVLLYFTAGEVTLIIFGDQWTPSIPVFRILTLSVGVQIILSSSGSIFQAAGDTKNLFMCGLFSSILNVTGILLGIFWFGTLEAVATCITLTFTVNFAQCYWMMYRMTLHRSLRHFAIQLISPLMVSILLIAVLYPLSLMTEGGNIFLTLIVKSIIFFCIFGCYIQLTGEYDITGKGKKHHKQKQTMKALFLIFHGFEEANGISKKIRYQVKALKECGMDVHTCYLNEENGHKCRMIDNHTLRDYGSGIKGKLRKRFELQSIVKYILQENIRLVYMRSYHNANPFTISMVKQLKRQGVKVVMEIPTYPYDQEYITRRMKLDLLVDRCFRRKLAAQLDGIVTFSDAETIFGGHTIRISNGIDFDAIPQKITRNDTSRELHLIGVAEVHYWHGFDRIIKGMADYYATHPSYKVYFHIVGALTGERERREILPVIAQYKLEPFVILHGQQHGEQLDKIFEQSDFGIGSLARHRSGITTIKTLKNREYAARGLPFIYSETDTDFDDKPYVLKAPANETPVRIQAIVDFYQTQTWDPAGIRQSISHLSWHAQMQKVIGKYQVTSEKKLKIAYCIPSIHCPGGMERVISLKVNYFTKKFGYDIHLILTDGKDKAPYYPLHPSITLHQLDINYDEMDGMPVLRHITRYVKKQKLFKKRLDACLNELKPDITISTLRRDINIINNMTDGSIKLGEIHFNKSNYRELSDKPLPAFLKKWIRSYWMKQLIRKLRKLKRFIVLSYEDAAEWTELNNVTVIHNPLPFFPDRQSDGSRKQVIAAGRYVPQKGFDMLIKAWKIVSEQHPDWTLRIYGDGFREELQKLIDGLGISRSCILEHTVSNIVDKYCESSIFALSSRYEGFGMVLVEAMVCGVPPVSFACPCGPRDIIDDGNDGLLVPKENINKLAEKIGYLISHENIRKEMGQRARIHVERFKIDHIASQWKELFNSLIS

SEQ ID NO: 7696 - protein, 70 aa, B.fragilis
YEEVNNAIEKIGQEMYRETEFLEKAMAIYLLDNTSFGEHGFDLANPKLIEEAINDGRIKPFPRATRKTKD

SEQ ID NO: 7697 - protein, 488 aa, B.fragilis
VNGVILMTCKYDRIMNIKTLLIMGLVNMFGLGGCANAEIGKQVLNLDDLDYGIDVVRYYAPAMEESKDTVEEHYYVNRDTVKFYDTETDKLLPVLIAYRHLAGVVKEQATFCGHSFTNVSMATMEDGHLIMVQCEVEMQPADLSQLLAAAVKKYGEPYTEEKDQFGKPDPKWRWETKDEYIQLNAKNMSGKETLNIETTDNVEEPVKIGNPKPYVKVALYRWAKKYHDLVLAEEPLYGFSPLNKEAETRWDNDHIKSAKFYTPEEVKPFFITAHYLDSLEHSGDVWGKIEASFYYRIPNSKVTDETGITDSVKINQEGCLPCWSFGGLDRDFKNGLSNAAYIARQMQKGVKFTEIMEDKELCPDVYYYGEAEWWKKKKVFGIVRFERDEKDNMVLREPETDRDDIRRRVLIINDNIKEELRKSGLDLEHTTARLMNAPGDITPLAFFTDGKLDMFMCIDEGRYSFSTPNHEWESNKIYRLYDYLSDIK

SEQ ID NO: 7698 - protein, 119 aa, B.fragilis
LKSFPEFSFYSAAVVPQRVIVYHPAFVSIFLVQITCVHVHSALFQRFYLIADFLADAVRFFKSVEYKKQCFHRLFLFMMLFALASDVVFTGQLYIAPKYTEKYNAFYNQGQKNVASFCH

SEQ ID NO: 7699 - protein, 130 aa, B.fragilis
NMAFRATLSFAGKEFDVLDCTYSLKRDVDSKGRPSSNIYGGQIRLHVESTDDTSILENMTNQFKPHSGSIVFKKGDEEAKMKELTWENGYITEFTENIDIVGSQPMTITFVVSAQVIKIGGAQFEQNWPK

SEQ ID NO: 7700 - protein, 611 aa, B.fragilis
NIKLKRMANLFTKESIKARMFKQAATLYDIRNIDGIDPLIRLLIEALSGEIFKLSGDMHAIESRLLEKVASALTPHTALVAKPAHAIAAARPYTPQATVSPTDLFSYKSTEIVKKYKMKNLFFTPLHETRIINAELKFLVTADEFCTITPEGERDATARFRSDVPVMGRKISIGMKIGNNVTTLNDLPLYIDIPLVADKSSYLKLLPYCHCTIAGIPVEIKGGIEYAPTRSVSEKYDLGRLITEEITSKYASHYLTLKAHGLKVRDLSRSRVPEEISFLLPSDFIAECDADTVWIDIEFPTAFSKEILEQIKVQMNTFIVVNKYPAKITRKVDSVSAILPLEKTEFEYFLFVDSITDNHGDRLREISGTQDEGRAGCYSVRRGGCERFNAMDAKDFLNRLTDLLYDESMAFSSTDKDGMKEVIEQIEERVSQLGDKNKDGVGGQEMLSYVVIDQRYDKDTRLTVDYTLTNGEFANDIYAGEPLNDCANPDIDKDTLRFVTFAHGGEPSPSVRRRMDMYPIMLLSHGSIYTKEDIRNFCMARYGDSIRSVEVKLGYAAGKKESEGFIRTLDVYLRLSEGMQGLDRDEFVVDLDSELRRLSPETYNYRVFINS

SEQ ID NO: 7701 - protein, 183 aa, B.fragilis
  UNSURE (107): Identity of amino acid sequences at the above locations are unknown.
NAKFKTMGKKAVSKLFYCTSIALTFVLAGITIAGAFAGHIPPEHSTLMPFIGLALSGLLLINLVAAIYWGIRRRFWIIIPLIAIAANWQYLGRIFQLLLRSEEKEAXTLKIATYKVDSFGTKQSGYSCKEIAAYMKEHRVDIICFQEFVGQPVLLLQTAYGTHLQTGSMPSFRKLRTAHLSCR

SEQ ID NO: 7702 - protein, 331 aa, B.fragilis
ELNSKIMNIRNLFFLGSILLLLSCKNSKQQEGYNSINIIKYINIYNENNRILTAQGTEYDYLYFGDNKDKEILANVNNFTKTYSYDNDSSCYTVEEPLSESLLKTMRYTENTIEELVLENNKDTFSYTFSTYYDKNKPKYNKSIIILGDEPSSDSRYEEYYYYDNNGNNTKKIHHDLNTGQREETYKFNDTDYKEAVNLVPSSDYKQNIECSLKQTVNDTLITRITLNGVLNRVMKEYIDGKKKIKEELDNDMTLVNKKTEYEENGLKVNVNHTIRSTGYSTDSIYYKGNKKVKHIYNSDYNGTITLEISEYDEQGNIVKKTKKLRWPSDK

SEQ ID NO: 7703 - protein, 100 aa, B.fragilis
PIFLTAASRRSLDRVSVPMWGTFLSEPLSIEGLVSRYLTNNLMERIPILYRNPLIMKPCGIIMLSGINLSFERLSPSKGQVGYVLLTRAPVASKESKLSS

SEQ ID NO: 7704 - protein, 63 aa, B.fragilis
PPTKLDDIPSECRVVPFGNLRIKGHLHLPEAYRSLSRPSSPPRAKASAMRPYLLSFIARDHFL

SEQ ID NO: 7705 - protein, 62 aa, B.fragilis
CRGRQFNSAWDYQQIDILSCMIGGLAQLARASALHAEGQRFESVILHSDTATEQACVLSNDL

SEQ ID NO: 7706 - protein, 667 aa, B.fragilis
SLIPLIMKMTLSNQLPEYPVFAEGIRRAPDRGYTLSPAQTVTALKNALRYIPVELHRKLAPEFLEELRTRGRIYGYRFRPAGDLKAKPVDEYQGNCIEGKAFQVMIDNNLCFDIALYPYELVTYGETGQVCQNWMQYRLIKQYLELLTREQTLVIESGHPLGLFHSRPDAPRVIITNSMMVGMFDNQHDWHEAAQMGVANYGQMTAGGWMYIGPQGIVHGTFNTLLNAGRLKLGIPQDKNLSGHLFVSSGLGGMSGAQPKAAEIAGAASIIAEVDRSRIETRYKQGWVEHVTTDLHTDFRMALSAAERHESCSVAYHGNVVDLLEYAVQEDIPIELLSDQTSCHAVYEGGYCPAGVTFKERTRLLHESPEAFRRLVDESLHRHFAVIKKLVSRGTYFFDYGNSFMKAVYDAGVKEISRNGTDEKDGFIWPSYVEDIMGPELFDYGYGPFRWVCLSGNPEDLARTDCAAMECIDVKRRGQDLDNYNWIRDAGKNRLVVGTQARILYQDAVGRLKIALRFNQMVRDGEVGPIMLGRDHHDVSGTDSPFRETSNIKDGSNVMADMAVQCFAGNCARGMSLVALHNGGGVGIGKAINGGFGMVCDGSLRVDEILRSSMLWDVMGGVARRSWARNEHAMETSEAFNLSHGDAYHITLPYLADEELIKRIVAE

SEQ ID NO: 7707 - protein, 81 aa, B.fragilis
VELFVNQQVDNGKIDIIPEYALLNAHLKKFDRTVRVPLPIVLQQTVYFRILLYIFKKTLVSPMECLNAPLITHKNDFKNIL

SEQ ID NO: 7708 - protein, 211 aa, B.fragilis
RIMLAELTVKEFLDKVAGSDPVPGGGSVAALNGAVASALTAMVAGLTIGKKGYEEHEELMKHISRLSIRQQELFVEYIDRDSEAYDHVFGCFKLPKSTDEEKAARSAAIQEATRFAALVPMQVARNACELMEIIADVARLGNQNAITDACVAMMAARSAVLGALLNVRINLGSLKDKTFVDELKREADHLEQLACMREKELLEVVNQELNQ

SEQ ID NO: 7709 - protein, 327 aa, B.fragilis
SCQPRTEPMNNVYYVGSGELTFSIIERIINENLKLELAPEAEQRIRKCRDYLDRKIAASTEPLYGITTGFGSLCSKNISSDELNTLQENLVKSHACSVGEELRPVIIKLMLLLKAHALSLGHSGVQVITVQRILDFFNNDVMPIVYDRGSLGASGDLAPLANLFLPLIGVGDVYYKGKKREAISVLDEFGWEPVRLMSKEGLALLNGTQFMSANGVFALLKAWRLSKKADMIAALSLEAFDGRIDPFMECIQQIRPHPGQIETGEIFRRLLHGSELIARTKKHVQDPYFFWLDSSGAWGHERCHPGRLFRFGDRDNSKCGHSALFPG

SEQ ID NO: 7710 - protein, 309 aa, B.fragilis
SVVPLKRCSMNWNKIVECVPNFSEGRDLEKMDRIVAPFRARSGVKLLDYSNDEDHNRLVVTLIGEPEALRDAVIEAIGVAVELIDLNHHRGQHPRMGAVDVVPFIPIKNVTMDEAVSLSREIGEKVAGLYHLPVFLYEKSATAPHRENLAAVRKGEFEGMAEKMKLPEWHPDYGPAGCHPTAGVVAIGARMPLVAYNINLSTDNLEIATKIAKNIRHINGGLRYVKAMGVELKERNITQVSINMTDYTRTALYRAFELVRIEARRYGVTILGSEIVGLVPMEALIDTASYYLGLENFSMRQVLESRIME

SEQ ID NO: 7711 - protein, 102 aa, B.fragilis
RRNQDMKSVLITFDQAYYERIIALLDRLGCRGFTYLERVQGRGSKTGDPHFGSHAWPSMCSAIITVVDDKKVDPLLDALHRMDMQTEQLGLRAFVTNVERSI

SEQ ID NO: 7712 - protein, 75 aa, B.fragilis
DTVQTPTGGSSEEYWSMGASLNQPSSVKDEGSMGRKLLLYKNRVQHVWCVVCIEGIMQTSYSRLHHAAVSIDERS

SEQ ID NO: 7713 - protein, 100 aa, B.fragilis
PIFLTAASRRSLDRVSVPMWGTFLSEPLSIEGLVGRYLTNNLMERIPILYRNPLIMKPCGIIMLSGINLSFERLSPSKGQVGYVLLTRAPVASKESKLSS

SEQ ID NO: 7714 - protein, 310 aa, B.fragilis
FMEKNSMKGERPMRLNRWLGVLILLLSGVWSVRAQDLLPACPQVDKGTKACKPMREPGSLGDTVSVKIVFPVAFKGVGRNEVVDSLGILAPVLEHLRLVQNGSSEDTVRIVHIGDSHIRGHIFPRTTGARLTETFGAISYTDMGVNGATCLTFTHPDRIAAIAALKPELLILSFGTNESHNRKYNSNVHYRQMEELLELLRDSLPDVPILMTTPPGSYESFRQRRRRRTYAINPRTVTAVNTIHDFARRHKLVVWDMYNVVGGSLRACKNWSDARLMRPDHVHYLPEGYTLQGELLYEAIIKAYNEYVSH

SEQ ID NO: 7715 - protein, 220 aa, B.fragilis
QQKNGLMIENAKENSQRVELKDRIIETASEAFTTHGIKSITMDDIAASLGISKRTLYEVFQDKESLLTQCILKRQEEMNAFLAETLANSKNVLEVILVCYQRSIETFHRTNKRFFEDIKKYPKVHSLLKNYRERDSDSTIEFFKMGIKQGIFRDDVNFAIVNLLVHEQLDLLMNTDICNKYSFLEVYEAIMFTYIRGISTEKGAKVLEDFITEYRKQRIH

SEQ ID NO: 7716 - protein, 1021 aa, B.fragilis
LPIDLYPDIDTNTIMVMTAYPGASASDIENNVTRPLENTLNAVSNLKHITSRSSENMSLITLEFEYGNDIDVLTNDVRDKLDMVSSQLPDDVENPIIFKFSTDMIPIVLLSVQANESQSALYKILDDRVVNPLARIPGVGTVSISGAPQREIQVYCDPGKLEAYNLTIETISSIIGAENKNIPGGNFDIGNETYSLRVEGEFDDSRQLEDVVVGSYNGANVYLRDVARVVDTVEERAQETYNNGVKGAMIVVQKQSGANSVDISKKVAEALPKLQKNLPSDVKLGVIVDTSDNILNTIDSLAETVLYALLFVVIVVFLFLGRWRATLIICITIPLSLIASFIYLAVTGNTINIISLSSLSIAIGMVVDDAIVVLENVTTHIERGSDPKQAAVHGTNEVAISVIASTLTMIAVFFPLTMVSGMSGVMFKQLGWMMCAIMFISTVAALSLTPMLCSQLLRLQKKQSKTFKLLFGPIEKGLDALDTGYARMLNWAVRHRPIVIFGCIVFFVVSLFCAKSIGTEFFPAQDNARIAVQLELPIGTRKELAQEVSEKLTNQWLNKYKGVMTVCNYTVGQADSDNTWASMQDNGSHIISFNISLVDPGDRDISLEQVCDEMREDLKKYPEFSKAQVILGGSNTGMSAQASADFEVYGYSMEETDSVAARLKRELLNVKGVSEVNISRSDYQPEYQVDFDREKLALHGLNLATAGNYLRNRINGAIASKYREDGDEYDIKVRYAPEYRTSIESIENILIYNSRGEAVRVKELGKVVERFAPPTIERKDRERIVTVSAVISGEALGNVVNAGNAIIDKMDIPSNVTIQVAGSYEDQQDSFRDLGTLAILIVVLVFIVMAAQFESLTYPFIIMFSLPFAFSGVLMALFFTKSTLSVMSLLGAIMLIGIVVKNGIVLIDYITLCRERGLAVLNSVVTAGKSRLRPVLMTTATTVLGMIPMAIGGGQGSEMWSPMAIAVIGGLTVSTILTLVLIPTLYCVFAGTGIKHQRKVLRRKRELEAYFEEHKDEMIKK

SEQ ID NO: 7717 - protein, 64 aa, B.fragilis
RNIENKGYTKTGNKEIPKEDKQLKLLYEQNEMFLKQKDAFGGGCTALGGLCTGTGGKGHRATDA

SEQ ID NO: 7718 - protein, 75 aa, B.fragilis
GENRDFNRNLTEIKRGLSKKLGGTPWRELNGNQTEIERKTALTLLMRLGRHLFQGRKEQSFGFKKTCYLETKGLI

SEQ ID NO: 7719 - protein, 419 aa, B.fragilis
RIMSENLIIFNAKVVTPLGFSARKGKEMAELRILEKATVEVVDGIITYVGPNRGEVRDGYYHHFWHYNARGKCLLPGFVDSHTHFVFGGERAEEFSWRLKGESYMSIMQRGGGIASTVQATRELSFIHLRSKAEGLLKKMTAMGITTVEGKSGYGLNRETELLQLKVMRSLNKDEGVRVDIVPTFLGAHALPDEYKERPDDYIDFLIRELLPVIQRDSLAEFCDVFCEEGVFSIEQSRRLLTAAGDYGLLPKLHADEIVSLGGAELAAELGAVSADHLLHASDAGIEAMARKGVVATLLPLTAFALKEPYARGRDMIDAGCAVALATDLNPGSCFSGSIPLTFALACIHMQLTVEEAITALTLNGAAALNRADSIGSIEVGKKGDFVVLDSDNYHILPYYVGMNCVNTTIKGGMLYPSV

SEQ ID NO: 7720 - protein, 489 aa, B.fragilis
HQRRICVNFMQILLSFYGFYLSLQLLIKLRACMKNYLKYSLWLTLIVLFALIGMHWLPAITIDGHTMRRVDLLSDVRMPEPDKDEVVADSLPPVPVVKPAFVDTCRSGMTCIEDYSDSTMRGMTPFYRALDEIQSKGRLVRIAVFGDSFIEADIFTADLREMLQKRFGGCGVGFVTITSMTSGYRPTVRHSFGGWSSHAVTDSVYFDKKKQGISGHYFVPRERAYVELRGQNKYASLLDTCQIASIFFYNKGEVNLSVCVNRGEAEARDFSTTGRLQQMKVNGRIGSVRWDINRADSTLFYGVAMDGTQGVVVDNFSLRGSSGLSLRSIPSKMLQEFNAQRPYDLIILEYGLNVATERGRNYDPYKKGLLTAINHLKECFPQAGFLLLSVGDRDYKTDTGELRTMPGVKNLIRYQQNIAAESGIAFWNMFEAMGGEGSMAGLVHAKPSLANYDYTHINFRGGRHLAGLLYETLIYGKEQYERRKAYEAE

SEQ ID NO: 7721 - protein, 213 aa, B.fragilis
DAFMKKLCFLLLMSWVVMDVTAQNVVYSNLKGLLACEGDTVASLKVEKRTKNHILMTGGADYKISAGPDDSMCKYLKSRCYAVQADTSLYVNCKRLRYKKFRFGGWYAPALRIGDHIYFSAIPLGSVAAGSDATMDVMLGGQFGDAIAASALISKRVYYEIDPETNKVGFVGKERMEELLGGHPDWKAAYLNENSESAKVTDKYLRLLKAEEK

SEQ ID NO: 7722 - protein, 309 aa, B.fragilis
NLNMKRCFQLVALLAVVLLGSCTGGKDKSAAEKTEEKPKVKLADVTARPVEQIQEYTATVEAEVKNNIAPSSPVRIDKIFVEVGDHVSKGQKLVQMDAANLKQTKLQLDNQEVEFNRIDELYKVGGASKSEWDAAKMAYDVKKTAYQNLLENTSLLSPISGVVTARNYDSGDMYSGGNPVLTVEKITPVKLLINVSEVYFTKVKKGAPVNVKLDVYGDEAFEGKISLIYPTIDPSTRTFQVEIQLPNQNQKVRPGMFARASLNFGTEENVVVPDLAIVKQAGARRPLCVCIQGWKSDIQQSGTGTSHGG

SEQ ID NO: 7723 - protein, 453 aa, B.fragilis
NYCMNKMKCFLSKKMLLAVVVLLSVGYVQAQEAKDIVLLTLDKALEIALSENPTMKVAGQEIQLKKEAKKEAYGGLFPEVSLTGSYSRTLKKQTMVMDFGGESQTIQVGSDNSYNGGLNVSLPVFAPTLYKSINLTKTDVELAVEKARSSKLDLVNQVTKAYYQLLLAQDSYKVLLQSYAQAEANYEVVKAKYEQGTVSEYDKIRADVQVRSLKPSVVSAGNGVNLARLQLQVLMGMDTEVEIAADGNLKDYEMVMFRRQMESNQLNLNNNSDLKQLDLNADLLKKTLAVQRTNFMPTLAASFNYSYTSLNNDFKMSHYKWFPYSTVGLSLSIPLFKASNFTKVKQTKIQMQQLAENRTNVYRQLTMQATSYLDNMAASTEQVVSNKEGIVQAEKGRLIAQKRYEVGKGTILELNDSEVALTQAQLTYNQSIYDYLVAKADLDQVLGREEVTE

SEQ ID NO: 7724 - protein, 159 aa, B.fragilis
FSAIAMAELGNISERRVAPVNYGVACLPEFLVANPGLNSGFMIPQYAAASMVSQNKMYCYAASSDSIVSSNGQEDHVSMGANAATKLFRIMDNLEHILAIELMNAAQGIEFRRPAKTSPILERYLAAYRKEVPFVKDDIVMYKEIHKTVAFLNRTRSEY

SEQ ID NO: 7725 - protein, 525 aa, B.fragilis
CVRITYIICLKAIRFRENYYMKPLLKPIMNMFPIDIDFSRLLEAFKYNPDAPMIFSSGIFLWLFAAFMVIYTLLQHRNTVRILFVALFSYYFYYKSSGTYFFLLAIVTVTDFMIAWLMDRTDVRWKRKFCVVLSVSVNLGLLCYFKYTNFLGGVIASLMGGEFTALDIFLPVGISFFTFQSLSYTIDVYRKEIKPLTSLLDYAFYVSFFPQLVAGPIVRARDFIPQIRKPLYVSQEMFGRGIFLIVAGLFKKAVISDYISINFVERIFDNPTLYSGVENLMGLYGYALQIYCDFSGYSDMAIGIALLLGFHFNLNFNSPYKSASITEFWRRWHISLSSWLRDYLYISLGGNRHGKFRQYLNLIITMFLGGLWHGASWNFVLWGTFHGVALALHKAWMSIIGRKKGETSHGIRRVLGVIITFHFVCFCWIFFRNADFHNSMDMLNQIFTAFRPQLFPQLIEGYWRVFALMAVGFLLHFAPDSWENAVCRGVIKLPFLGKAIVMVAMIYLVIQMKSSEIQPFIYFQF

SEQ ID NO: 7726 - protein, 63 aa, B.fragilis
SKLVPGDRYVYVYKDGKVTYNKVELGRRMGAEYELKSGVPNNSQVVIAGQTRLINGTEVEVEK

SEQ ID NO: 7727 - protein, 197 aa, B.fragilis
IKETSSISRMQSNHLLKTQKSFSDIYSIYYVRMLRFSQTYVIAEEDAENIVQDTFLYLWEHLELLEDIDHLDAFLFTLIKNRCLNFLKHQSYIQAKTCSLKADEELESQLNLYALEQFDEAVSSISEVENLLSRTMQKLPERCREIFLLSRIEGLKYKEIAERLDISVNTVENQISIALRKLRSELKEYLPLLVFII

SEQ ID NO: 7728 - protein, 77 aa, B.fragilis
QKVKSSNRKRKNKRGKRIENEGNREKRGYFLGKGISAGPKGIVVIKASMGAGNFKKQGWEWKQEELTIKPHRTLLKN

SEQ ID NO: 7729 - protein, 811 aa, B.fragilis
TYDKVMKKNLLQKWYVHQQLELTHIIRIMKLSVFFIFVFLFQLQAGNVKSQEVRVTLSKSSLTFGELMREIEKQTNYLFMYRDAEIDLSQKIEVKNTSATVKEILTTALRNKKLTYKFSNNYISLYVDKEKAPETMVTQQERKIKIKGVVIDQVGEPIIGANISLKGQPGTGDITDIEGNFTLEVPEKAVLVISYIGYLTQEIPVNGKASFNIQMKEDTKTLDEVVVVGYGSQKKQTVTASASTLKVSSLKNVPTANLASSLGGRVSGVLIQQTGGEAGYDDPTIIIRGSSSPTSSSPLIVVDGIIGRSMSQLDPSEIESMTVLKDASAVAPYGARGANGVILITTKRGKSGKAQVDYNFKIGFGTPTRMPEIASSYDHARFMNDAWRNKEMDLGEDPGMYGIYTEEELQKFRDGSDPYGYPNTDWNKEVLLPRAWQQMHSLTASGGSDKVKYFAGFGYVKQDALYGDTRTNKSTSGFNRYNARVNIDANIVDKYLNLSADMAYRQEDRNSIAGSTSDVFNNMHRNPQTDPGRFPDGNLGKVSLGVNPIGLATEGGWVKDRKSVLNTRFMLDFNVPGLEGLNLKGIFSYDKIFNSIKRWTTPVDFYVWNKITGEYDGHSPNREGAELKQTYSTSQAMTFEFQAAYNKTIAQDHQLGALFVFSRSEGADENFWASRTKYRIYSIQQLFAGPDKDKDNSGSASETGKVGSVFRLTYNYKEKYMLEANGRLDGSEKFPKSKRYGFFPSVSAAWRISAEPIMEPFSGVLSNLKLRTSWGRAGTDNIGQFQYMSAYGTGGDAVFGRSESGNSPGIH

SEQ ID NO: 7730 - protein, 346 aa, B.fragilis
YFFCISFGGKCILDCLYYKTTQGTMNDELEKYFAGTLSATEKTEFLNKLRDNPEAKKEFARMKAVWAVSGLMAQEGDPQKTVRGIAEFDKRLKRRSVHRFRIGFFKYAAMIVLLISTTWFIANWYTQKEQKKQYTEINVPKGQRVNMTLPDGTSVWLSPQSKIKIPNEFNRKNRMVELNGEGYFEVTKNAKKPFIVKTQLFNIQVLGTRFNVFAYAGKESKFETCLVEGRVLVYNKNNKNEKVYLNPHEKVSLVNNRMVVSTSNFDNEEYLKSGIFSFRSKPFGEILSYLTLWYNVQFNFTGDVKLDERISGKIRQSEDVDNILIALQGVYPFKFKKTDDEHYEIY

SEQ ID NO: 7731 - protein, 381 aa, B.fragilis
ELHGDAPEQTTSVNSSICPLMVPAVMPYLAGQNPEIAPGYTETRFPNPNITWETSEMFNIGIDASFFNGKLNLEADWFYKKTNDILRERTDMPAILGYKLPAANVGKVDNRGIDLNITHRNHLRDFNYSIAGNLTWARNKVIDLLEPAGEKNNPRQRSTGHSMSQYFGYEALGLFQSDEEANNWPQPQFGKAKAGDIKYKDQNGDGIIDAEDEIAIGRSNYPELVYGLNLNAEWKGFDITFFFQGAALADFYYNGYLAFPYIEGRGGALLEHHIGNTWTPENPKAEFPRLYYGGNANNQLFSSFWMRNGSYLRLKNVEIGYDFKKLLLSKVSEIQGLRLYFSGSNLLTWSQIKYFDPELRSTDGSAYPQMKTFVFGANITF

SEQ ID NO: 7732 - protein, 167 aa, B.fragilis
FFFIFVLMEKYYSTNCPINTITIIKTIIVAMLFIIAAIIVFASGGYWLGISIILLLLVIMVVTYFCIPRKIIVTDTDIVLYNHGFKRKIPKCDILKARSVTAKDRNGLWRKFAVEGVWGYCGIYASKIHKNLYIYASQNKNWILIETERKNYIVSPENLDIIDVINK

SEQ ID NO: 7733 - protein, 95 aa, B.fragilis
NVIMKKINTALFCLFVLLFCSCDVLNKAPLDEIADDSFWSDETLVKYYVNDLYSEISVDGLQLQENRSDNSVSAQRDKHRASWFKFNYDMVSASD

SEQ ID NO: 7734 - protein, 109 aa, B.fragilis
LFPSFSCTLWVEVISVLLGTVRPLIVSVLKCTVMVLAPANGTMRMVVLRVVFGLNAAVLFVLAATTLVEGPIFHDVEFPPCFTYTPVQLVIVLLGNPVGLMVIVSLHNF

SEQ ID NO: 7735 - protein, 431 aa, B.fragilis
RYKSSKDMKILLLGSGGREHALAWKIAQSPKVEKLFIAPGNAGTGEVGENVNIKATDFAALGAFALEESIDMIVVGPEDPLVEGIYDHFQSNPCLKNIAIIGPSKEGARLEGSKEFAKEFMHRHHIPTARYQSVTADTLNEGLAFLETLEAPYVLKADGLCAGKGVLILPTLEEAKKELKEMLGGMFGNASATVVIEEFLSGIECSVFVLTDGDHYKVLPVAKDYKRIGEGDKGLNTGGMGSVTPVPFADEVFMEKVRTRIIEPTVNGLKAEGITYKGFIFLGLINVKGEPMVIEYNVRMGDPETESVMLRIQSDLVELLEGVAEGNLDARSLVIDPRTATCVMMVSGGYPEAYQKGYAINGLEAARATDSILFHAGTAMKDGQAVTSGGRVLAICSYGNDKADALAQCYKVADMIDFKDKNYRRDIGFDL

SEQ ID NO: 7736 - protein, 246 aa, B.fragilis
LFLSVYNFVDSNIPMKAIEIQKELETYIDPVKREYLPGFFKTGKGQYGEGDRFLGIVVPATRLVAKKYKNAPFEVMAELLQSEWHECRLCALLMMVERFKKSGGEEREAIYRFYLSQTERINNWDLVDLSAPYIVGEYLKDKSRDDLYRLAESTLLWDQRIAVVSTVTFIRNNDFIDILRLSELLLQHKHDLMRKAIGWMLREMGKRDKTLLLQFLDKYSKVMPRTMLRYSIEKLTDEERKLYMGR

SEQ ID NO: 7737 - protein, 65 aa, B.fragilis
DFRSERETIIKMAYEMILASYLHMPSYFLKTFTEYPVVWVFVAGPESPFFKVSGLLASDFIWQTR

SEQ ID NO: 7738 - protein, 68 aa, B.fragilis
TTLFRYFLGLVVVRIVFKELISMIFRHYLFANITEAPKSRSDIEENREMSNWTACPVRVLLHKKNTIF

SEQ ID NO: 7739 - protein, 614 aa, B.fragilis
SLCPFFMDTNQELKTSEYLKGIVSNLPERPGIYQYLNAEGTIIYVGKAKNLKRRVYSYFSKEHQPGKTRVLVSKIADIRYIVVNSEEDALLLENNLIKKYKPRYNVLLKDDKTYPSICVQNEYFPRVFKTRRIIRNGSSYYGPYSHSPSMHAVLDLIKHLYPLRTCNLNLSPENIRAGKFNVCLEYHIKNCAGPCIGLQSQEEYLKNIAEIKEILKGNTQEISRLLYERMQDLAAEMKFEEAQKVKEKYALIENYRSKSEVVSSVLHNIDVFSIEEDGEKSAFINYLHITNGAINQAFTFEYKKKLNETKEELLTLGIIEMRERYKSASREIIVPFDIEIELNDVTFTIPQRGDKKKLLELSLLNVKQYKADRMKQAEKLNPEQRSMRLMKEIQQELHLDRLPMQIECFDNSNIQGTDAVAACVVFKKAKPSKSDYRKYNIKTVVGADDYASMKEVVRRRYQRAIEEESPLPDLIITDGGKGQMEVVRQVMEELQLDIPIAGLAKDRKHRTSEVLFGFPPQTIGIKQHSPLFRLLEQIQDEVHRFAITFHRDKRSKRQVASALDNIKGIGEKTKTALLKEFKSVKRIKEATIEEVSAIIGESKAKIIKEGLDNH

SEQ ID NO: 7740 - protein, 288 aa, B.fragilis
TRIPITNLKQFMDKERKPHKHTEAATSSPLLSIRGLSAAYDGRTVLHDVDLEVYEHDFLGIIGPNGGGKTTLIKCILGLLRPTGGEIIKYHEPLTTGYLPQYNSIDRSFPISVLEVVLSGLSSKKSLTGRFNDRHREKARQVIHRMGLEGLEHRAIGQLSGGQLQRALLGRAIISDPQLLILDEPSTYIDKRFEARLYQLLAEINRDCAIILVSHDIGTVLQQVKNIACVNETLDYHPAASVNTEWLERNFNCPIELLGHGTLPHRVLGEHCHCHEKSSDTPHPQTDK

SEQ ID NO: 7741 - protein, 530 aa, B.fragilis
RNSPISIWGAVSTIVRKHCLMISGNTINHKNNMAGLKSLVKDTALYGLSSMVGRFLNYLLVPLYTAVLPAASGGYGVVTNVYAWAGLIMVLLTFGMETGFFRFANKSEEDPVKVYANSLISVGGISLIFAILCLTFLQPVSHLLEYGDHPDFIGMMIIVMALDAFLCIPFAYLRFKKRPIKFVAIKFVSIIANIVLNLFFLLLCPWLHEHFPAWVDWFYNPTYLVGYIFVSNLITTCLQLFCLIPELRGFAYRVDKQLLKRMLIYSFPILIFGLVGILNQTVDKIIYPFLFADRQEGLVQLGIYGAATKIAMVMAMFTQAFRYAYEPFVFGKQKEGDNRRMYAQAMKYFLIFAMFAFLVVMFYLDLLRYMVAPDYWAGLSVVAIVIGAEIFKGIYFNLSFWYKLIDETRWGAYFSIVGCVIIVGMNVMLVPTYGFVASAWASVAGYAVITILSYWIGQKKYPIHYDLKHLGTYVLFTAVLYVIGEWVPIENIVLRLAFRTVLLLIFMAYVVRKDLPLSQIPVINRIIKKK

SEQ ID NO: 7742 - protein, 451 aa, B.fragilis
ISIAFIGIFESTKLYTDKNSQKSRNEWKHILNFVGKLTGIFMVLNYIWIAFFVIAFVVAVCKLLFFGDTQIFTEIINSTFDSSKTAFEISLGLTGVLSLWLGVMKIGENSGLINALSRWLSPVFCRLFPDIPKGHPVMGSIFMNMSANMLGLDNAATPMGLKAMKELQELNPKKDTASNPMIMFLVINTSGLIIIPISIMVYRAQMGAAQPTDIFIPILLSTFISTLVGVIAVSISQRINLINKAILTLMGCLSLFFGGIIYLTTTLSREEMGVYSTLIANVILFSVILLFIIAGIRKKINVYDSFVEGAKEGFTTAVRIIPYLVAFLVGIAVFRTSGAMDILVGGIGAIVEFCGLDTGFVGALPTALMKSLSGSGANGLMIDTMKQFGPDSFVGRVSCVVRGASDTTFYILAVYFGSVGITKTRNAVTCGLIADFAGIIAAILISYLFFF

SEQ ID NO: 7743 - protein, 159 aa, B.fragilis
YMDAFIETVSQILIDWGYPGLFISALLAGSIVPFSSEIVLLGLVKLGLDPTLCLISASLGNTAGGMTCYYMGRLGRIDWIEKYFKVKKEKIDKMQRFLQGKGALMAFFAFLPAIGEVISIALGYMRSNVWLTTASMFAGKLIRYIILLKAMQEALNLVM

SEQ ID NO: 7744 - protein, 408 aa, B.fragilis
RRPAVLLCLACNEAGRTVSVTVSNATSLERSGEMVEVSMGEVSSKLHLPDTAQIVVVDAEGQQVPYQITSDEKVIFPVTVQANGSAVYTIKAGIPQECPVKACGRYYPERVDDVAWENDLTAFRAYGPALQETGERAFGYDIWTKYNTTEPVVEARYEGELNSDMKAKIAELGKTDPKAAQELYRSVSYHVDHGNGLDCYKVGPTLGGGTTALMAGDTIIYPYCYATQEILDNGPLRFTVKLVYNPLVVKGDSTIIETRIITLDAGSYCNKTVVSYTNLKETMPLAVGIVLHEPDGAIVADAANGYMTYVDPTDNAGGDNGKIFVGAAFPTLVKEAKGVLFPEKEKKELRGGADGHVLAISEYEPGADFTYYWGAAWSKADIKDSAAWNAYMADFAQKVRNPLTVTVK

SEQ ID NO: 7745 - protein, 253 aa, B.fragilis
EIMYKVIIIDDEKAAIETLRRDLEVQADLEIKGTAGNGAKGKKLIMDIHPDLLFLDIELPDIQGIRLLSEIREQVLWDMKVVFYTAYDKYLLQALRESAFDYLLKPYDIEELNLIIERYRKTMASARPLPSFASAVGTLMPGRDLFMISTVTGFRFLRLEEIGYFEYLKDKRLWQVELFNQTKLCLKKNTTAGDIIGYSDVFVQISQSAIININYLAMIKSKQCLLYPPFSDKEDLIISRGFLKELQERFCII

SEQ ID NO: 7746 - protein, 245 aa, B.fragilis
EHPYKPHFTFCSSRPAPGMHLLYAGDVAAVTFLISLYFLFKSYQQPRPAGYLFHSFALLSAGSVAFPQLTYFIPIWLMGASGFQSLTFRSFCGAIIGWSIPYWFLLGHAFFHNEIELFYQPFIHLADFRDIDFGRDFQLWEVVTLGYLFILYIVSSIHCIVAGYEDKIRTRAYLHFLIFLNFCIFLFIVLQPALSMNLLSLLLIGISILVGHLFVLTNSKSSNLFFIGSMITLIALFCFNIWTLL

SEQ ID NO: 7747 - protein, 1119 aa, B.fragilis
MKQYKTVNNLVGWITFLIAATVYCMTIEPTASFWDCPEFITTAYKLEVGHPPGAPFFMLTANLFTQFVSDPALVAKMVNYMSALMSGACILFLFWSITHLVRKLVITDETNITRGQLITVMGSGLVGALAYTFSDTFWFSAVEGEVYAYSSMFTAIVFWLILKWEDVADQPHSDRWIILIAYLTGLSIGVHLLNLLCLPAIVLVYYYKKVPGANAKGSLLALAGSMVLVAAVLYGIVPGVVKVGGWFELLFVNSLGMPFNTGVIVYVALLAAAIIWGIYESYNEKSRTRMNLSFLLTIAMLGIPFYGHGASAVIIGILVLGVLAAYLFASKLNEKIRMSARTMNTALLCTMMIMVGYSSYALIVIRSVANTPMDQNSPEDIFTLGEYLGREQYGTRPLFYGPAYSSKVALDVEDGYCVPRQKSTDTKYVRKEKTSPDEKDSYVELPGRVEYEYAQNMLFPRMYSSAHTAYYKSWQDITGYDVPYDQCGEMLMVNMPTQWDNIKFFFSYQLNFMYWRYFMWNFAGRQNDIQSSGEIEHGNWITGIPFIDNLLYGDQNMLPQELKDNKGHNVFYCLPLILGIIGLFWQAWRGQKGIQQFWVVFFLFFMTGIAIVLYLNQTPGQPRERDYAYAGSFYAFAIWIGMGVAGIVHLLRNYMKEVPAAALTSAVCLLVPIQMASQTWDDHDRSGRYVARDFGQNYLMSLQESGNPIIYTNGDNDTFPLWYNQETESFRTDARTCNLSYLQTDWYIDQMKRPAYDSPALPITWDRTEYMEGQNEYVPIRPDFKKQIDKAYKAAEEEVLNGKNPEALNNIRAQFGDNPYELKNILKYWVRTKDGQAVIPTDSIVVKIDKEAVRRSGMMIPEALGDSIPDYMHISLKDEKGNPKRALYKSELMMLEMLANANWERPIYMAITVGTDNQLNMREHFIQEGLTYRFTPFDTEALGATIDSEKMYDNLMNKFKFGGIDKPGIYIDENTMRMCYTHRRIFAQLITQLMKEGKKDKALAALEYAEKMIPAFNVPYDVQNGALEMAEAYYQLGNNTKADQIIDELANKSVEYLTWYLSLDDNHLLMSQREFIMHLSALDMEVKMMEKYKSKLAGNYTPKVNELYNIYVGRMKAHQ

SEQ ID NO: 7748 - protein, 305 aa, B.fragilis
SDIHSPRIYEEQCMADHGFNVRRKTDTLHHPAESHAGSPEPGYVKKNMERIIEYTADGSATLFVPELNEHYHSVKGALTESSHIFIDMGLKASASPAPHILEIGFGTGLNALLTLIEAERSGRQIHYTGIELYPLPWETVEKLRYNDRPGGDGEQRLTTGDEQAAQWMKALHTSPWGEDVRITPHFTLRKIQGDFTIMDRSSLITDRTSLFSLLYFDAFAPEKQPEMWTQELFDELYVMMEEEGILTTYCAKGVVRRMLQAAGFIVERLPGPPGGKREILRAKKRSQDSPAVTQCNAQPTLKQKG

SEQ ID NO: 7749 - protein, 323 aa, B.fragilis
RATHIKTERINIMRMNRIHQSIVTHIPGRGMRGQTVLFLFLLLLSACSGRGKGDAGERIITVTMEPQRYFTEAIAGDKFTVRSMVPKGSSPETYDPTPQQLVSLGESEAYLRIGYIGFERSWMDRLMNNTPHIQVFDTSTGVDLIFESAFDHGDHRHEGGVEPHIWNSTANALIIAGNTFKALTVLDKGNEAYYKARYDSLCQRIEQTDSLIRQTLSVPGADRAFIIYHPALSYFARDYGLHQISIEEGGKEPSPAHLKGLMDLCKKEGVRVIFVQPEFDRRNAEIIAKQTGTRVISINPLSYDWEEEMLNVARSLRGEPGYQ

SEQ ID NO: 7750 - protein, 243 aa, B.fragilis
QRIKINKSMAEQALFQPFNRNQQRENLENTKETGLLISLIPSLQEDFYVDSLTTGASKETLSKLLLRNPGIKNETAVIEMIHFLHDEGDRISFSILLPFLVAEYDPKELEEKIRERFFGIELFIRKCNNLHHFITCIKADQTIKIGEEELKRGVLAWDMGRMVCLTRIAYDAGFIDESLAWNYICSAGQQCIQAFNDWTEVGKSFLLGQAMEATEKRKQELYIRLYRQATENPNSPWKKRTLK

SEQ ID NO: 7751 - protein, 293 aa, B.fragilis
PNYKEEIVMKADNRNIFAIKAFLREYLDLRKDKDNELATVDSIRKGVEFKGANLWILIFAIFMASLGLNVNSTAVIIGAMLISPLMGPIMGAGLSVGMNDFELMKRSLKSFLITTAFSVTTATVFFLFTPIAEAQSELLARTSPTIYDVFIALFGGLAGVVALSTKEKGNVIPGVAIATALMPPLCTAGYGLASGNLIYFLGAFYLYFINSVFISLATFIGVRLMHFQRKEFVDKNREKKVRKYIVLIVILTMCPAIYLTMGIIRSTFFEAAANRFVSEQLNFDNTQVLNKKI

SEQ ID NO: 7752 - protein, 143 aa, B.fragilis
KSNNMAITYQTEGIKMPDIKKRETTEWIKAVAATYEKRIGEIAYIFCSDEKILEVNRQYLQHDYYTDIITFDYCEGNRLSGDLFISLETVKTNSEQFNTPYEEELHRTIIHGILHLCGINDKGPGEREIMEAAENKALAMRKQ

SEQ ID NO: 7753 - protein, 120 aa, B.fragilis
IMIKQIMKTNSKQKSALLVMLLSLLIPNIMAQEPKIPTLEDLIPGGATYRSAENISGLQWWGDQCIKPGIEAVFMINPKNGKETPLTTRNIVNKALEAGNHGKLQHFYNASFPWPKKTLC

SEQ ID NO: 7754 - protein, 409 aa, B.fragilis
YEMKEIFKLILLLVILSGCIENDEEIILNNSDLEDVSEYKRAEDLICQFSERIDKEKGGTRSSTSQIILSLAGKKSVVIPKIATRTGEISTDSVNMFIFDTEKDGRFGFAIATGKAEVGRVYAYVENGILSDTIENEGMAYLVSQIPDIIKQDQLNPNLTRSGEQRTTHVSIPLVKTEWNQHYPYNAQMPTNGKCSISYYYAGCIPIAVAQAITYYRKCPVAYDWDAFTVNTGIYDTNLIAPVSQFVKKVADGIKVGYKCDGTGAKNLGSTNDFLKGWGYNVERHKTNDVDKNLLYKCLITKNVVIFGGKKKKSTGHVWLVDGGVFEYSGNMMIGCTNIQVKAIHCNFGWNRANNGWYAIKDGAYNRPANSASQDGNNPTNDKNSPNGNFYTENDYIYFHEAMGTEILW

SEQ ID NO: 7755 - protein, 405 aa, B.fragilis
FVHLRGIVTGEFRLIFLHHFDFHIQCAEVHDKFTLRHEQMIVVQAEVPGEVFYRLVCQFIDNLVGFRIVSQLVVSFCHFECSVLYIVGHVESRNHLFGVFQCCQRFVLFAFFHQLGDQLGKDAAMGVAHAHRILVDVDAGFVDASELELVHQVVIHLFTVDGGSESFRIERCEAVCQTLLNEMLAHVQLIVRTDGDGHVNGAFPVGIGQHFEHHQLALVESPFRVTLFVFERYVHVVGDGVTQCLRNHHTRTANGFFVDFDNDAVGRYHCLSVFGAYPIFQDVLQLVRIIAELGTDVVQCFRILAVQHLFFGGFVGFVDLLLEVRTDGDVFVLTFHVFRSVPSDGQCRRVVGRTFHLVDVPVGLEVAQVTGTCVGAEAFGFLVVPQREGIVITVGIDDRVAAFLK

SEQ ID NO: 7756 - protein, 140 aa, B.fragilis
QFKDLKTDIMKTTGFLKTVALSAVLLVSSVAVSARNYDNNLIYNSEEENGMLIGQTVYKKEGSSLANYMKYNYKYDDNKRMIESQTMKWNSYKNNWENDLLVRYTYEGKTITTNYYKWNNRKSEFILAPEMTVTMDNPNL

SEQ ID NO: 7757 - protein, 302 aa, B.fragilis
VNMEMNDTPQDKYLTALAKYDTQLNDADVQVQVAALIEKKVPENNTEEVKKFLFNCIDLTTLNTTDSDESVMRFTEKVNRFDDEFPDLKNVAAICVYPNFAQVVKDTLEVEGINIACVSGGFPSSQTFTEVKIAETAMALADGADEIDIVIPVGAFLSGDYETMCEEIMELKETCKEHHLKVILETGALKTASNIKKASILSMYSGADFIKTSTGKQQPAATPEAAYVMCQAIKEYYEQTGNKVGFKPAGGINTVNDALIYYTIVKEVLGKEWLSNELFRLGTSRLANLLLSEIKGEELKFF

SEQ ID NO: 7758 - protein, 627 aa, B.fragilis
TRRWKPEITVSCNTSTMPVSHGQRKPYADRPADKYIVYDFDYREVISTRPLPKEGANRDYHPETGHVAYTIGNNLYVDDRAVTNEPEGIVCGQSVHRNEFGIKKGTFWSPSGNLLAFYRMDQSMVAQYPLVDVTAPIAEVNNIRYPMAGMTSHQVKVGIYNPATGKSIYLNAGDPTDRYFTNISWAPDEKSLYLIELNRDQNHAKLCRYDVETGELTATLFEEKSDKYVEPQDPIIFLPWDNSKFIYQSQKDGFSHLYLYDTNGRQIRQLTEGDWLVKEVLGFDTKKKEIIIASTEFSPLQNNLFRLDTKTGTRTPLGSAEGVHSGQLSPSGRYLIDQYNSPTVPRSINIIDVQSGKSVNLLTAADPFTGYKMPGIETGTIKAADGKTDLYYRLIKPADFDPNKKYPAIVYVYGGPHAQLVTNGWQNGARGWDIYMANKGYIMFTVDGRGSSNRGLDFENVTFRQLGIEEGRDQVKGTEFLKSLPYVDGNRIGVHGWSFGGHMTTALLLRYPEIFKVGVAGGPVIDWGYYEVMYGERYMDTPQSNPKGYKECNLKNLAGNLKGHLMIIHDDHDDTCVPQHTLSFMKACIDARTYPDLFIYPCHKHNVSGRDRVHLHEKITRYFEDYL

SEQ ID NO: 7759 - protein, 132 aa, B.fragilis
KKKCGNFAFEIKKHITMKTKMIVLVGMLFTQIVFTSNNVYGEDVMAIMKDRHKVHLITHKEANLQRSTLLVACGYIEESQLFLNFNSSLENRKIQVVDSETGQTVFDDTITGTSFSIFLERDSDSFDIYIGR

SEQ ID NO: 7760 - protein, 151 aa, B.fragilis
FELCIRERSENRRIRSRHESRVIERRTCNYLHRYQKQGIMTLEEAQKAVDEWIHKYGVRYFSELTNMAVLTEEVGELARIMARKYGDQSFKEGEKDDISDEITDVLWVLLCIANQTGVNLTEAFARNLEKKTQRDNKRHINNPKLSEHGNE

SEQ ID NO: 7761 - protein, 377 aa, B.fragilis
VRKCFAPSFLWFLFIGLGMGCVGTLLVAMTMLAQHPVRQCAVSQQLDRAVEVPFQPFGVDACGRVIVQCFVHAGDVLYLLQHRPDVMADEDDGAVAVDLRQQLVEAGFEALVDVGARLVENKQLRVADDGSSQQGALQLSAAQLSDGPVFKSLESHAVDHLSGFLAVTVIETAGQRLLGAESREDYLENRDGEGAVDRVVLREIARREWFVIFDDFSSCGAKQSQNAFDKSCLASAVGPDDAEEIVLVDLQIDIVEHRASVIGGGESSDGEEGGGSRCFRMLVGFSFFIHELLEVGYWYPGSPRRLLATFSISSSQSYERGLMEITRVPVCFAMISAFRRSNSGWTKMTRTPSFLQRSISPFRWAGDGSLPPSSILI

SEQ ID NO: 7762 - protein, 304 aa, B.fragilis
NINRLKRITESMKIVIKEKVIPYILISLFSFIGLSAYGYKAEGQGGSKAVVWSISKIDTMQKNVQRNDERNPNIQNIEYLKKMFRQKAVDEISENIVYPLKRTSPIPSVENAEELKERFDSIFDEDLIRIITSSDIDQWSEMGWRGIMLDDGILWMDYDGKITAVNYQSKYEKKLAKKLTSKVKGDLSSDLRHNFKGEVYKFKTKNYFIRIDELKNGMYRYACWKKENPESTKPDLVLENGKIEFSGSGGNHVITFKNNIYEYKVFHNKIAASGIADITLVVEKNGKEILSEDGKLEDDITQTD

SEQ ID NO: 7763 - protein, 544 aa, B.fragilis
YMNRTFIMRECLGKALWLCFCLSITGCAEDDRMTPLSADSGDTADELIPIHISLTGDNDYHSSSFNDASTRSHSPLIAEWVGVKAFSPTRTGEQPDYDGPRIASMELTEDTLPRVSTRATVPAGVYFRLIVFRKSGSEYVFQSAADYTSNGTGTPVLKQGRLLTRSGTIRVVGYSFNTTTAADLGTMPSTYAYNSSTVSIPNMSKDFMTFDSGDITNVNSLSHNLPVSFNQKLCKLTITISPTGFPSNTITNCTGVYVKQGGNSTSWKIGPSTNVVAANTNNTAAFSPKTTLSTTIRMVPFAGARTITVHFNTLTISGRTVPNNTEITSTQSVQLKEGKSYTMKIQFKKAIGINVPASNINLTQNGCTENDKTILSKLRWAEGNLNSQSNYNLTWASSTTDYGYYYIWKNVYVSSGYTGYGAVDPCTRLDESKYGSGWRTPTRSEFISLSRCSNKQLVKYNGIQGMWFMNSSTGLFLPAAGWRDGNNGSGTTATAYTDGTGSYYWSSDLNGNSAYGLYILKNDVFVDANGNRKSGVSVRCVHNL

SEQ ID NO: 7764 - protein, 154 aa, B.fragilis
QLSRSDITITYNTMTEFRYSICEPLNPKVIEKGMIAPDSVIGLFNDFQWDYYLKQIEVAETRKMDIYFSPSLEVENKANKNGLTISAVGDPEDPEFYIFYKRPISVVKKQFFRKPQTVVEDYVSEITGQTKEDIIECLNALIKNDQEFLRRKIA

SEQ ID NO: 7765 - protein, 158 aa, B.fragilis
QRLSNIIRMRVVIQRVSHASVTIDGHCKSAIQKGMMILVGIEETDSREDIDWLCKKIVNLRIFDDENGVMNKSILEDEGNILVLSQFTLHASTKKGNRPSYIKAAKPEISIPLYEQFCNDLSCALGKEVKTGEFGADMKVELLNDGPVTICIDTKNKE

SEQ ID NO: 7766 - protein, 191 aa, B.fragilis
TRKRRSHALPQTLPPLSASPPFPQNPTIMAKYKLTLKKNPNKRNEPGKWYAIPTTVNSLDTRAVTRAVTRNTTVAPTELETSMNLVCDGIPALLQQGNSVRIGSLGTLRLSFGSTGTENIDDFNAATMIKNVKIVFTPSKELKAAVQEGLSFENAGVIETGFTYPSVQDYKKYKVADRPAGGGDIVDDPTA

SEQ ID NO: 7767 - protein, 303 aa, B.fragilis
NSLIMSPLNFTHILTQTVDELSESESYKGLFHQHKDGEPLPSPRVLCDVIELARSILFPGYYGNSTVNSRTINYHIGVNVEKLFNLLTEQILAGLCFGNGDRCDECTEAKREEAARLAAKFISKLPHLRRVLATDVEAAYNGDPAAQSFGEVIFCYPAIKAISNYRIAHELLELGVPLIPRIITEMAHSETGIDIHPGARIGTHFTIDHGTGVVIGATSIIGNNVKLYQGVTLGARSFPLDADGKPIKGIPRHPILEDNVIVYSNATILGRITIGRDATVGGNIWVTENIPAGARIVQTKAKK

SEQ ID NO: 7768 - protein, 631 aa, B.fragilis
EINIDSMDFKYDVIVIGAGHAGCEAAAAAANLGSKTCLITMDMNKVAQMSCNPAVGGIAKGQIVREIDALGGYMGLVTDQTAIQFRILNRSKGPAMWSPRAQCDRNKFIWAWREILENIPNLHIWQDTVKEIIVENGEVVGLKTFWDVTFHARCIVLTAGTFLNGLMHVGKTQLPGGRMAEPASYKLTESIAEHGIEYGRMKTGTPVRIDGRSVHYELMDTQDGECDFHKFSFMNTSVRHLKQLQCWTCFTNEEAHNVLRNGLADSPLFNGQIQSIGPRYCPSIETKIVTFPDKEQHQLFLEPEGETTQELYLNGFSSSLPMEIQIEALKKIPAFKDLVIYRPGYAIEYDYFDPTQLKHTLESKKIKNLFFAGQVNGTTGYEEAGGQGIIAGINAHINCHGGEPFTLARDEAYIGVLIDDLVTKGVDEPYRMFTSRAEYRILLRMDDADMRLTERAYKLGLVKEDRYALLKSKREAVENIVNFTRNYSIKAALINDALENLGTTPLRQGCKLIDLINRPQITIENISEYVPAFKRELDKITDERKEEILEAAEILIKYEGYIGRERIIADKLARLESIKIKGKFDYDSLQSLSTEARQKLKKIDPETIAQASRIPGVSPSDINVLLVLSGR

SEQ ID NO: 7769 - protein, 454 aa, B.fragilis
HTGMLSIFMSEQFEMIAKTFQGLEEILAEELTTLGANDVQIGRRMVSFTGDKEMMYKANFCLRTAIRILKPIKHFTAKDADAVYEQIKAIRWEEILDVDKTFAVDAVVFSDEFRHSKFVSYKVKDAIVDYFRELNGKRPSVRISRPDVLLNIHIAQTTCTLSLDSSGESLHRRGYRQEAVEAPLNEVLAAGMILMTGWKGECDLIDPMCGSGTIPIEAALIARNIAPGVFRKEFAFEKWGDFDQNLFDRIYNDDSQEREFTHKIYGYDNNPKANEIATHNVKAAGVSKDIILKLQPFQQFEQPAEKSIIITNPPYGERISTNDLLGLYNMIGERLKHAFVGNDAWILSYREECFDQIGLKPSVKTPLFNGPLECEFRKYQIFDGKYKEFKSQEGGDENGERAPKERREFKPRREEGGFRGERRPREERNSEYGDRRPREFKGNREPKIKKPQED

SEQ ID NO: 7770 - protein, 566 aa, B.fragilis
SILIMNKTFVGFIFLLFLVGGVVSCQRSSSPYPYSLRYADSLMEISPERTLAYLRKLDVSTYSAGDRAYFSLLFTQATDKNMLSLLPCDSLIDTALDYYIKKDGVNLAKAWLYKGRIQKKMNMTEQALKSCFTALQGVEGNTGEELKLKGMLYEDMGSIYLHQSLYQKAFDAFYRSYQCDSLLNDHRLVMYPLSNMGWVRVIQGKTVEAFYYLNQSIQLALRLNDSAFVSDIYERMSLNCENVDSAFLYAHLSHQYLTKDGDSISLWLTFGDLYLDKQELDSAEYYLKRILDTADFKRKILASYSLAEVEKIRGNYQRAFEYQSYYGDNIDSIFLLNKASDIERLAYKYDSEAKVVKEKEKQRFFIQQLCYGGVLFLLVIAIIFQRIYRRRQIARLLYEQRITYLNEKTALSQLQIERLEVQISALKQSGMEREQEIDLKQAELCCVIDEKARLRNCLFMETSIFKHIRELSTQPRLGQNGTKGSPKVLLMKEQEQLKNILFGIYDDYIRYLKGTYPKITDNDCIYCCLKLCEFDDQTIAYCFGNVSKQIVAQRRLRLKKKMAEAN

SEQ ID NO: 7771 - protein, 312 aa, B.fragilis
VTIMETKINSKALKAEALRLGFSACGIAPAEPIDQAHQNALKMWLDADRQAGMTYMANHFDKRCDPALLVEGTRCVVSVALNYYPATRIPDEEYQFAWYAYGKDYHDLMREKLAALFRFIQESDVPELNGRMFCDTAPVPERYWAWRAGLGWIGKNTQLIIPHAGSTFFLGELFLNAEADTYDRPQPNRCGRCNRCLQACPTKALETPYSLNAHRCLSYLTIENKSEIPDSIAPFMGNRVYGCDECQKACPWNRFATPCRTPELQPSPEFMNMKKEDWKQLSEEKYRALFKGSAVKRAKYSGLIRNIRQMED

SEQ ID NO: 7772 - protein, 240 aa, B.fragilis
QPSITFDRSPAKTEEDRPRNNSSGKPHPRRVTKRHQCIISAFGTIDCCVSRETKHLKKQHKRMIMSKEKLIKSIREIPDFPIPGILFYDVTTLFKDSERLQELSDIMYEMYKDKGITKVVGIESRGFIMGPILATRLGTGFIPIRKPGKLPAETMEESFHKEYGKDSVQIHKDALNENDVVLLHDDLLATVGTMKAACNLVKKLHPKKVYVNFIIELKELNGKQVFENDQDVDIQSVLSL

SEQ ID NO: 7773 - protein, 679 aa, B.fragilis
IKTMRHRANLAIVFFCLLLPLTGCKQKINRSDSAFGGMSIDSVERCAQDSLFSNTRYSRSLLRHAMADAPDSLSYYYLLSFYSKSYFVTADFDSVLYYNRLVKRFCNEVELSAEVHDLLSTVYNMEGNVLMQRTQPDSAIISYKKAYEERLQGQQTDYLPDLCINLADANVHKGDYAYAAYYYRRALFICDSLGLPDRNKFPVYYGLGQTYMELRDFELSNHYYELAGNFFPQMSVSEKWTYLNNRGNHFYYKKDYPQAVHYIGRALEVVKSYPQMVFEQNLCKANLGELYVITNKLDSAQLYLDESYRFFSGIGNQSALYYIETQMIELALKKGNVALAGDIIRRSADYGHIDANMINIRNHYLQHYYEQVGNYKKAYEYQKHDLQLNDSIRNERVRTRVAELDMRYRQDTIVMRKELVIEKQKGEMEVLKLTTYIWALIGIVSVIVAGLVYWYMKKKRMFLQERHINQISRFRMENIRNRLSPHFTFNVLNREISRFRDGETLCGDLTELVKLLRKSLELTEKLSISLYDELEFVKTYIHLEQGRLGSDFSMDVKIEEDLDIQQVVIPSMVVQIPVENALKHGLAGIDGLKLLGISVCRKGSGILIDICDNGRGYSPQTLSSTRGTGTGLKVLYQTIQLLNDKNREKIRFEIKNLVNNGQTGTQVLIYIPLDYSYNL

SEQ ID NO: 7774 - protein, 207 aa, B.fragilis
PKEMFIEQPPWFFRAIYPDAIFRMDPDEKAVYLTFDDGPIPEVTPWVLELLDKHNIKATFFMVGDNIRKHPDVFRMVVERGHRIGNHTFNHIRGFEYLSSNYLANTDKANEMMKTDLFRPPHGHMRWMQYMTLKRHYKIIMWDLVTRDYSKKLRPPQVLANVMRYARNGSIITFHDSLKSWNNGNLQYALPRAIDFLKEEGYEFRLL

SEQ ID NO: 7775 - protein, 371 aa, B.fragilis
TYFVKEKLCETLPYYVAKSISLLPIYKKGMEEDFNIRDHQLTSRERDFENALRPLSFEDFNGQDKVVDNLRIFVKAARLRAEALDHVLLHGPPGLGKTTLSNIIANELGVGFKVTSGPVLDKPGDLAGVLTSLEPNDVLFIDEIHRLSPVVEEYLYSAMEDYRIDIMIDKGPSARSIQIDLNPFTLVGATTRSGLLTAPLRARFGINLHLEYYDDDILSNIISRSAGILDVPCSSQAAGEIASRSRGTPRIANALLRRVRDFAQVKGSGSIDTEIANYALEALNIDKYGLDEIDNKILCTIIDKFKGGPVGLTTIATALGEDAGTIEEVYEPFLIKEGFLKRTPRGREVTELAYKHLGRSLYNSQKTLFND

SEQ ID NO: 7776 - protein, 354 aa, B.fragilis
FIFFSFFMVKVQKNTVLTVLLLLLCSNSVCMDSLSLIKSPITTELEDFKNLFDSSLSSSNLLLNNVIAHIRQRNGKMMRPILVLLVAKLYGEIKPETLHAAVSLELLHTASLVHDDVVDESTERRGQLSVNAIFNNKVAVLVGDFLLATSLVHAERTRNHDIIGVVACLGQDLAEGEILQLSNVSNREYSETIYFDVIRKKTAALFAACTKAAALSVEVTDEKAEFARLFGENIGICFQIKDDIFDYFESKEIGKPTGNDMLEGKLTLPALYVLNTTTDAWAQEMALRVKAGTATVDEITRLIEFIKQNGGIEYAVKVMYEYKERALDLLRTLPDSAVKTSLITYLDYVVDRDK

SEQ ID NO: 7777 - protein, 136 aa, B.fragilis
NFVVKYKLIIMKKVFFLYCISLLCIYGCNDDSDKYSSNFLKSREVTLNAEGGDITVEGREKFILVQTEEILNQDTIFSIGEINGVEYQGGWYQLEVNGKEMTLNCDRNLTGNKRKVVLHFQGTGNSFDVFSLTQLE

SEQ ID NO: 7778 - protein, 1001 aa, B.fragilis
AITLLSKRFELDRELSNRFLKSSSSVVIGDFIKDKLSMHTLFEHKSNNKTVNTVFFCTFTMKKLKNMNQNSKLFLLDAYALIYRAYYAFIKNPRINSKGFNTSAILGFVNTLEEVLKKENPTHIGVAFDPPGPTFRHEAFEQYKAQREETPEAIRLSVPIIKDIIKAYRIPILEVAGYEADDVIGTLATEAGNQGITTYMMTPDKDYGQLVTDHVFMYRPKYGDKEFEVMGVEQVKAKFDIQSPAQVIDMLGLMGDSSDNIPGCPGVGEKTAQKLIAEFGSIENLLEHTDQLKGALKTKVETNREMIIFSKFLATIKVDVPIRLDMNSLVREQADEDTLRKIFEELEFRTLMERIFKKESSPASPIAGTLFNQENGPVQGNLFEEFTPDHTNEEKKSNLESLNSLSYDYQLIDTEEKRNEIIKKLLTSEILALDTETTGTDPMDAELVGMSFSITENQAFYVPVPAEREEAIKIVREFEPVFKNEKSLKVGQNIKYDMLVLQNYGIEVRGKLFDTMVAHYVLQPELRHNMDYLAEIYLHYQTIHIEELIGPKGKGQKNMRDLSPQEVYLYACEDADVTLKLKNILEQELKKNDAEKLFYEIEMPLVPVLVNIESNGVRLDTEALKQSSEHFTTRLQSIEKEIYTLAEGEFNIASPKQVGEILFDKLKIVEKAKKTKTGQYVTSEEVLESLRNKHDIIGKILEYRGLKKLLSTYIDALPQLINPKTGRIHTSFNQTVTATGRLSSSNPNLQNIPIRDEDGKEIRKAFIPDDGCSFFSADYSQIELRIMAHLSEDKNMIDAFLSGYDIHAATAAKIYKVDIKEVTADMRRKAKTANFGIIYGISVFGLAERMNVDRKEAKELIDGYFETYPQVKSYMDKSIQVAREHGYVETIFHRKRFLPDINSRNAVVRGYAERNAINAPIQGSAADIIKVAMARIYERFKAEGLKAKMILQVHDELNFSVPAKEKEIVEQVVIEEMEKAYRMHVPLKADCGWGTNWLEAH

SEQ ID NO: 7779 - protein, 256 aa, B.fragilis
SLISKWNALPKMKPNKFIIEKQVSEFRMDNGLSATEPITLKSLLLKLNILTVFRPLSDNFSGMCLKDNSEHRFMLINSNQPRGRQHFTIAHELYHLYIEKKPTPHKCNPGCASKDPIEQCADMFASSLLMPEGGICQLIPEMELKTKNISMATVLKLEHYFSVSRSALLYRLQNIGLITESTRSQLAEIKVKYSAKCFGYDTALYEPANEGLVIGDFGEKARKLFEQEKISEGHYIELLHKININGTQENEDSTLC

SEQ ID NO: 7780 - protein, 71 aa, B.fragilis
QTRFAFSLQKFPVLENFLYQEERKVLQKFLLKQEQLIALTVTFVADFSTKKRFSHKGTLCKSATVPAAVIL

SEQ ID NO: 7781 - protein, 266 aa, B.fragilis
HTNSVTVNLLFTQTNLLMKTNFCRFLIGLVAFVVGIPVMAQTGPDKVKPFSHLSVSLNAGTLGGGLQVAAPLNDYLGLRAGFSLLKFKCNYDYDGIRDDQLIQDAGTRTGYNPDKYYTVPLKAKANMTNGMLLLDYFPFKRSVFHVTAGLLFGTSSILKVSGQTDERIEVGDIIIEPGADGRVEAALKTNAVKPYVGIGFGRSVAHSRVGFKFELGAMFHGNPKIEATTGKIVEEAIDQDLSRFNKFLKNFKAYPVLNFQLSYRIF

SEQ ID NO: 7782 - protein, 352 aa, B.fragilis
PILSEKKYICFRKSTLQFMKLQKIYRQLWMEVHPRLQSADTDQWYVDFANRLLPLFEKSELTGQMIHKNRAVLYFTWYLEDCVNNSGGWNKFIRLHKRLYGRFLPFYTLTGAYADDEINFEDVSFLLWSLLSPVTDDSPVPWNPTDKSLLRLATDIYALLEAHFEQAPLTDDESMDWLPEIRALLPPPGPVLDIFPEMELPHDVTKFLNATQGKQLVYFEDYAGLRRFCVDALEWADEDDSLMPELADEENFVFFANPKGILLAPNIGACFRDERNSTYNPGIAEQEGAELFYVPGLCPIDLLHYAMQHDLLSEVTFPFEDGRRVLHENWDFIARRYLGKYYNEDFYEEERK

SEQ ID NO: 7783 - protein, 92 aa, B.fragilis
ENSPLRNLEATVPHRKKIITLKEDTFRDLSVMAAKQGTNLKRLIESMLDKAADEYDGNESYRYLSENYPDGKVMLGKEEREEFIDWLGVVEK

SEQ ID NO: 7784 - protein, 309 aa, B.fragilis
RNVLNKTNKKMKKVRAAIVGYGNIGRYVLEALQAAPDFEIAGVVRRAGAENKPAELNDYAVVKDIKELQGVDVAILCTPTRSVEKYAKEILAMGINTVDSFDIHTGIVDLRRELGACAKEHGAVSIISAGWDPGSDSIVRTMLEAIAPKGITYTNFGPGMSMGHTVAVKAIDGVKAALSMTIPTGTGIHRRMVYIELKDGYKFEEVAAAIKSDAYFVNDETHVKQVPSVDALLDMGHGVNLTRKGVSGKTQNQLFEFNMRINNPALTAQVLVCVARASMKQQPGCYTMVEVPVIDLLPGDREEWIGHLV

SEQ ID NO: 7785 - protein, 205 aa, B.fragilis
IMNPTERITTPHKTGEAKVIIFSAPSGSGKSTIINYLLAQKLNLAFSISATSRPPRGNEKHGVEYFFLSPDEFRQRIANNEFLEYEEVYTDRFYGTLKAQVEKQLATGQNVVFDVDVVGGCNIKKYYGERALSLFIQPPCIDELRRRLIGRGTDTPEVIESRIAKAEYELSFAPKFDKVIINDDLETAKAHALKVIKEFLGIDTE

SEQ ID NO: 7786 - protein, 152 aa, B.fragilis
LPGPIATLVTAPAAGYLVERIHPGILGSIGMALFCIGLYSLSTLTADSSVTGIILRLMLCGAGFGLFQTPNNSTIISSAPTRRSGGASGMLGMARLLGQTFGTTLVALLFSFVVHEKSTAVCLIAGSGFAFVAAVVSSMRLSQPSTLKTKPR

SEQ ID NO: 7787 - protein, 819 aa, B.fragilis
VRRPAEKVNILKKNLKLSGVKVMNYAEICIIKRDGKREDFSISKIKNAVSKAFSATGINDEQQLIADITMNVIGQFASPTITVEEIQDLVEKELMKVRPEVAKKYIIYREWRNTERDKKTQMKHVMDGIVAIDKNDVNLSNANMSSHTPAGQMMTFASEVTKDYTYKYLLPKRFAEAHQLGDIHIHDLDYYPTKTTTCIQYDMDDLFERGFRTKNGSIRTPQSIQSYATLATIIFQTNQNEQHGGQAIPAFDFFMAKGVSKSFRKHLASFISFYVQMNKGEEIEEKAIRTVIAEHLSSIKASELERETLRMALTALQINIDKEHLNQIIEKAFVQTQKDTHQAMEGFIHNLNTMHSRGGNQVVFSSINYGTDTSAEGRMVIEELLKATVEGLGTRGEVPVFPIQIFKIKNGVSYTEADYEKAMANFDAAMEGKLKFEAPNFDLFLKACHTTAKALFPNYMFLDAPFKQHEQWDANDPQRYRYELATMGCRTRVSENVAGEKSSLGRGNLSFTTLNMPRLAIEARIKAENMTEDGHNKDAVERKAKEIFIESIHETATLIAEQLYERYQYQRTALARQFPFMMGNDVWKGGAALNPNEQVGDVLRSGTLGIGFLGGHNAMVALYGEGHGHSQKAWDTLYEAVLEINKVADEYKAKYNLNYSVLATPAEGLSGRFTRMDRRKYGKIKGVTDNDYYVNSFHVDVKEPISIVEKIKREAPFHAITRGGHITYVELDGEAQKNVRAIAKIVKVMFDEGIGYGSINHPVDTCHNCGYKGVIYDKCPVCQSENILRMRRITGYLTGDLSSWNSAKRAEEKDRVKHG

SEQ ID NO: 7788 - protein, 481 aa, B.fragilis
YFTFLIVYMSEISVTKKDIIWGYLAQFFLVASGLITLPLVLNILSAEEIGMNYLMLTIGSLVSLLDFGFAPQFGRNITYIFSGAQKLQKEGISTEKGDLNYKLLATMISAAKLIYKVMAVVVLVIMLTLGTVYIYKATMGFTSVKYALLIWVIYSISAFFAIYYTYYTSLLMGKGLIMESKKAMLASRITCILLTFIFLFMGWGLLGIAVANLLAPFVNRYFSYRYFFVPELRNKIENYYVNRKEKWEIFSIIWYNAKKLGMVFIGNYAISKLSLFLAGLYLSLQEIASYGLMIQLVTVLTVSSVTLFTISEPYLISLRIEGKRSELLKRFSFTMNVYYCLFIIGSLFLIILAPLLLEFIGSNTKLPSTYILTLYCFVIFLENNNCNFSTFILLDNKIPFMWPSLCTGVFIIMGDFLILQYTSFALGGLIMVQLICQSAYVNWRWIYVVCRDFKISFSSFLALGLKETFNKIRLSLFMLKY

SEQ ID NO: 7789 - protein, 94 aa, B.fragilis
WGITGTTSMIMLMKRRKETMYRLFLILNLDYCEAKIVYHWIKNKQCYLKNKKTDASYFLPRSITEPFFVNDQRLKIDSMLLCVLCGEFRHTCLK

SEQ ID NO: 7790 - protein, 334 aa, B.fragilis
YVNAMTTPTVSFIIPVYNVDKYLSQCIESILVQSYRNFEIILVNDGSIDNSPYLCDIYQSKDERVKTVHKKNGGLSDARNVGLTLAKGEYIIFLDSDDFWISQNDLQLLVHRLDSLINCDFMCFNCCYYYPSKHLFKRWTPFADELLLSVDKSKSIISLVSSGTFPMSACLKIIRRNFLLENNITFQKGIQSEDILWFMELLEKAHSIAFLNQYIYAYRREVENSITSSFTPKKYNDLFSVLENGIQRIEAYKWDIQTKNALLSFMAYEYCTLLAFLYYFPFALRKELEGKLFQYNWLLKYKLNPKVKKVSFCMRFLGKRLTLLLLYRYMKNLV

SEQ ID NO: 7791 - protein, 96 aa, B.fragilis
TVIAIEVNISIMRAFVAVRQLVSALPVNDITRLQDEIKELKEYVEAAFADYNDINEDTRMQLELINQAIAELQAKDKQAGGKTRNPIGFISYNKEK

SEQ ID NO: 7792 - protein, 118 aa, B.fragilis
YNLYYLCVMKKIITYKNYFAEFMDKLSELERKKIQRALSLFKAEDKIPSHYIKFIRDGVYEFRVACGNNELRIFFIYDGENVVVLFNCFRKKTQKTPDNEIKKAINLKKEYYEAKGNK

SEQ ID NO: 7793 - protein, 239 aa, B.fragilis
SMILSSLVHTDFQPYLLPNTDAWALPRDKALELLVYLKQQGVRQIYCVPPVKVENEGNAFSFLKDAFQYLQQQYSGNISLRLSARYRLDEGFPALLEKGDLLTIGGGKELLVDVSPLQQPEGLSEMIHAICRSGYIPVLMQPERSLYWGTEDYLHLRESGCRLMLNLYSLFGYNGDGALNYSRMLLRKEWYTYLCSGREDTKVMRYGESFSIEDDDDLAMKLQEIERNSRLLWSATENG

SEQ ID NO: 7794 - protein, 167 aa, B.fragilis
NKQYTRIYRNIHIRTTNFAFVIKKLIRRNEQKKPNEGVVLNMGNTPYVVIVNEKSDEGQKVLEALEENIEKMDIGSHRELVIFFFVWLNHQQKDPKKRKNIRELAKIMHRSLFFGQKHNSNEEMKPDSIETEIFKILRILKSMKKAEDKDLIINLLDDISLFLDENV

SEQ ID NO: 7795 - protein, 185 aa, B.fragilis
DWLHLHQFMNFTAMDITLRTLTENDLPFVKDIYDYYTLHTTVVYFVHCASIDELKNYIPVGDPVYRSFIIETPEGAPCGFCYFARFKPREAFRISVELTLYLKPEFTGRGYGKQAILRLEEIIRQEGFSNIMALISGENEASIRLFEKCGFECCANIRQVAEKFGKKLDLRMYQKIISDNSHLTP

SEQ ID NO: 7796 - protein, 60 aa, B.fragilis
HSVKTCSLDVNKKFFKCKRLVICAQEPDNLQKALTMLIEERYKDEDTGSNGVNSLPKLEL

SEQ ID NO: 7797 - protein, 370 aa, B.fragilis
LKTKSLIDMKPYLLLTPGPLTTSETVKETMMTDWCTWDEDYNLHIVEALRKELVGIATRNTEEYTSVLLQGSGTYCVEAVIGAAIGKNDKLLICSNGAYGDRMGNIAEYYHIDYELLAFDETEQVSVDYVDDYLSNNSDVTHVAFVHCETTTGILNPLKELAHVVKMHGKKLIVDAMSSFGGIPMDVSELGIDFLISSANKCIQGVPGFGFIIARRSELVRCKGVARSLSLDIYDQWETMEKGHGKWRFTSPTHVVRAFKQALTELIEEGGVEARHRRYCENHRVLVEGMRSLGFVTLLDDAIQSPIITSFLYPKTGFDFKAFYTALKSKGFVIYPGKISKADTFRIGNIGDVHPEDFARLVEVVRETEY

SEQ ID NO: 7798 - protein, 69 aa, B.fragilis
VFAKSSNHSPPKPGSSTRYHQEINDYLLMISEVTPILFQRSAKLLIYTKSALDKKKARTEMLYLCFFVN

SEQ ID NO: 7799 - protein, 388 aa, B.fragilis
QINKSIIKNMKTYLVTGAAGFIGANYLKYILAKHSDIKVVVLDALTYAGNLGTIANDIDNERCFFVKGDICDRELADRLFGEYKFDYVVNFAAESHVDRSIENPQLFLMTNILGTQNLLDAARRAWVTGKDEYGYPTWRKGVRYHQVSTDEVYSSLGAESYFHETTPLCPHSPYSASKNHADMVVMAYHDTYKMPVTITRCSNNYGPYHFPEKLIPLIIKNILEGKKLPVYGDGSNVRDWLYVEDHCKAIDLVVREGVEGEVYNVGGHNEKTNLEIVKLTIATIHRLMAEHPEYREVLKKKEKNADGEISIDWINEDLITFVKDRLGHDQRYAIDPTKITNALGWYPETKFEVGIVKTIEWYLNNQEWVEEVTSGDYQKYYERMYSKR

SEQ ID NO: 7800 - protein, 456 aa, B.fragilis
IVNNLMETFLIRALQLIMSLSLLVIIHEGGHFLFARLFKVRVEKFCLFFDPWFTLFKFKPKKSETEYAVGWLPLGGYVKIAGMIDESMDTEQMKQPEQPWEFRSKPAWQRLLIMVGGVLFNFLLALFIYSMILFKWGDQYIPVQKAPLGMDFNETAKAVGFQDGDILLSADGVDFVRYDPDMLSQIADAREVTVLREGKKASVYIPEDMMQRLLGDSVRFAEFRFPYVVDSVMVNSPAAMAGIQPGDSIIALDGKPVSYTDFLAAMAERRQNAKALQNDSINPHQISLTYVRDGKTDVLTLTTDSAFKIGVAVNPYTDQLLPVIRKEYGFFESFPAGVALGVKTLKGYVGNMKYLFSKEGAKQLGGFGTIGSIFPATWNWHQFWYMTAFLSIILAFMNILPIPALDGGHVLFLFYEIIARRKPSDKFMEYAQMAGMILLFGLLIWANFNDILRFFF

SEQ ID NO: 7801 - protein, 221 aa, B.fragilis
QTNKQKQLKNNSNMKRIIIALMVAVTFCSLAMAQNPTITQDNKNSSDSTIVTEYTDIVDSSTVDTDYQSSSFDFGNEFPFNIDKGAINGGILTGLVVIILIFGFPFFIVFIAFYFRYKNRKAKYRLMEQALATGQPLPEGIFKDTLPQDYRTKGIKNICTGIGLFIFLWAITDEFSIGCIGLLVMFTGIGQWIISRNQQHERPEDPFTRPTHKDETLNEQK

SEQ ID NO: 7802 - protein, 245 aa, B.fragilis
SENNHVNLRQFNNLILMSCILHIETSTAVCSVAVSEDGQNIFVKEDLKGPSHAVSLGVFVDEALSFIDSHAIPLDAVAVSCGPGSYTGLRIGVSMAKGICYGRNVPLIGIPTLEVLSVPVLLYHELPEDALLCPMIDARRMEVYAAIYDRALNVKREISADIVDENSYLEYLEQHPVYFFGNGAAKCREKITHPNAHFIDDLHPLAKMMFPLAEKTVAINDYKDVAYFEPFYLKEFVASQPKKLL

SEQ ID NO: 7803 - protein, 305 aa, B.fragilis
LLRNHSVQPVCSRHLHDEPHLLSQNREPLGGLPAHNDQYCHNLRWLLLLFSSFYWFCLTHFFISVAKLVIFFVFRSLKGVKVSFCYSRFVKHNIYYLCVLIITIMIEYIKGEIAELSPATAVIDCNGLGYAVNISLNTYSAIQGKSSCKLYIYEAIREDAYVLYGFADKQERELFLLLISVSGIGGNTARMILSALSPAELVNVISTENANMLKTVKGIGLKTAQRVIVDLKDKIKTGAMAATAVGGAAGALLPAMNAEVQEEAIAALTMLGFAAAPSQKAVLAILKEEPDAPVEKVIKLALKRL

SEQ ID NO: 7804 - protein, 310 aa, B.fragilis
SVCKGTTFRSSLSTLHSKFVFLPSITKNNKMKKLIVLTCTLSLLTACGDSIEKKAGEKLAAARAAFEHNDYNEAKLQIDSIKILYPKAFDTRKEGIKLMQQVELKEQQESLVYLDSMLQVKQKEFEAIKNKYTFEKNEEYQKIGNYFWPTQTVEKNLHRSFLRFQVNEQGVMTLTSIYCGPSNIHHVAVKVIAPDGSFAETPASNDSYETTDLGEKIEKADYKMGEDGNVLSFLYMNRDKKNIRVEYLGERKFSTTMTPSDREALVGTYELAKLLSSIRQIQQEKEEANLKIEFVKRKMEQKAQEEAAEK

SEQ ID NO: 7805 - protein, 202 aa, B.fragilis
HMAKTKTGIFSGSFNPIHIGHLALANYLCEFEGLDEVWFMVTPHNPFKNQADLWPDELRLQLVQLAIEGYPRFRVSDFEFHLPRPSYTIHTLNRLKQEYPEREFQLIIGSDNWMVFDRWFESERIVSENKILVYPRPGFSVDKSQLPPNVHVADSPIFEISSTFIREALATGKDIRYFLHPAVYKRIIQQTDSIDSSHSCHT

SEQ ID NO: 7806 - protein, 146 aa, B.fragilis
MVKKITISKRDREKLKEQKRKEKQQRKEERQSNGPSSFEDMIAYVDQFGVLHSVPQERLEEEVDASHIEVSVPKQEDVEVAPLMGRIEYFNAAKGYGFVKDADCGEKYFFHISSAPATIAEGDRVTFEIERGMRGMNAVRISIVTE

SEQ ID NO: 7807 - protein, 438 aa, B.fragilis
SPRNMASFVIEGGHRLSGEIHPQGAKNEVLQIICATLLTAEEVTVNNIPDILDVNNLIQLMRDMGVTVAKTGVDSYSFKAANVDLAYLESDNFLKKCSSLRGSVMLIGPMVARFGKAMISKPGGDKIGRRRLDTHFIGIQNLGADFTYNEEREIYEISAEELKGTSMLLDEASVTGTANIVMAAVLAKGKTTIYNAACEPYLQQLCKMLNRMGAKISGIASNLLTIEGVEELHGTDHTVLPDMIEVGSFIGMAAMTRSEITIKNVSYENLGIIPESFRRLGIKLEQRGDDIFVPAQDCYQIESFIDGSIMTIADAPWPGLTPDLLSVMLVVATQAKGSVLIHQKMFESRLFFVDKLIDMGAQIILCDPHRAVVIGHNHGFTLRGGNMTSPDIRAGIALLIAAMSAEGISRIHNIEQIDRGYQNIEGRLNAIGARITRI

SEQ ID NO: 7808 - protein, 154 aa, B.fragilis
GIMNILYTYPETIVDGEGIRYSIYLAGCRHGCPGCHNPESWNPQAGEELSEGRLASIIREINSNPLLDGVTFSGGDPFYDPEAFLPVIRRVKTETGQNIWCYTGYTYEEIESDPKLAAILPYIDVLVDGRFKQELYSPHLEFRGSSNQRIIKLK

SEQ ID NO: 7809 - protein, 210 aa, B.fragilis
DHMNASKTDIRITSPDREVLSYSGVPKEHPFVKESPELFWYAVRVTYSRELALKEYLDGECIENFIPMHYEYIVKNERRVRKLVPAVHNLVFIRSSRERIDRIKDEMGMTLPIRYIMDRESRQPIVVPTSQMRSFMAVAGSYDQQLVYLEPSAVAFRKGQRVRVTGGIFAGVEGEFIRVKNDRRVMVSIQGVMAVATTYIHPSLIEPLDL

SEQ ID NO: 7810 - protein, 474 aa, B.fragilis
GKMKLPISFIESTRALMGDEEYQELSVALEQEPPASVRLNSKFPGLAACSSISGRIPWAAEGYYLNQRLTFTFDPLFHAGCYYVQEASSMFVEQVLRRYVTTPVKMLDLCAAPGGKSTHARSVLPEGSLLVANEVIRNRSQILAENLTKWGYADVVVTNNDPSDFSRIGSFFDVILTDVPCSGEGMFRKDPGAIEEWSPENVEICWQRQRRIITDIWPCLKPGGILIYSTCTYNTREDEENIAWIRQEFGAEPLPLAVPTEWNITGSLLVGVDAPVYRFLPHKTQGEGFFLAALRKPEEDREADTDLFSPKKKKSKGDTAASPVSKENLAIAKSWLASSDEYNLLVNGTAITAFPVYYQNDLALLRQSLRIVQAGTEVAEVKGKDLIPAHGLAMSRLLKTSVFSTEALTYEQAIAYLRKEAIVLPPSVPKGYVLVTYKEIPLGFVKNIGNRANNLYPQEWRIRSGYLPDDIRTL

SEQ ID NO: 7811 - protein, 1032 aa, B.fragilis
RKKNMLNKIIHFSLQNRILVLVASVLLLIGGTYTAMHTEVDVFPDLNAPTVVIMTEANGMAAEEVEQLVTFPVETAVNGATGVRRVRSSSTNGFSVVWVEFDWGTDIYLARQIVSEKLAIVGEELPSNVGKPTLGPQSSILGEVLIIGLTADSTSMLDLRTIADWTIRPRLLSTGGVAQVAVLGGELKEYQIQLDPERMRHYGVSMNEVMTVTRGMNLNANGGVLYEYGNEYIVRGVLSTANIEQLGKAVVKSIDSVPVLLEDIADVRIGPKAPKLGTASERGKPAVLMTVTKQPATSTLELTDKLEASLQDLRKNLPPDVKVSTDIFRQSRFIDSSISNVKKSLFEGGIFVVIVLFLFLANVRTTIISLVTLPLSLLVSILTLHFMGLTINTMSLGGMAIAIGSLVDDAIVDVENVYKRLRENRLLPENERLSVIQVVFNASKEVRMPILNSTLIIVVSFVPLFFLSGMEGRMLVPLGIAFIVALFASTIVALTLTPVLCSYLLGKEKGDKLPKEAFVARWMKGVYEKALTWVLIHKRLTLGSTIGLFIITLGFFFTLGRSFLPPFNEGSFTINISSLPGISLEESDKMGHRAEELLLSIPEIQTVARKTGRAELDEHALGVNVSEIEAPFELKDRSRNELMADVREKLGTITGANIEIGQPISHRIDAMLSGTKANIAIKLFGDDLNKMFSLGNQIKEAIGNIPGIADLNVEQQIERPQLKITPKREMLAKYGITLPEFSEYINVALAGEVISQVYEQGKSFDLIVKVKNNFRDEAEKIRNLMVDTQDGKKVPLSYIADVASSMGPNTINRENVKRKIVISANVADRDLRSVVNDIQKQVDEQIKLPEGYHIEYGGQFESEQAASRTLALTSFMSIVVIFLLLYHEFRSVKESAVILINLPLALIGGVFALLITTGEISIPAIIGFISLFGIATRNGMLLISHYNHLQQVEGLGVYESVIRGSLDRLNPIVMTALSSALALIPLALSGSLPGNEIQSPMAKVILGGLLTSTFLNGFIIPIVYLMMNGKRK

SEQ ID NO: 7812 - protein, 139 aa, B.fragilis
KANLLYKMDIEEIKDFRPLILVAEDDDSNFKLIKAIIGKKCDILWAKNGEEMLNLYREHTQDAHAILMDIKMPIMNGLEATRIIREEGASLPIIMQTAYAFSSDRENAMQAGASEVLVKPITVSALRGCLSSYFPEIKW

SEQ ID NO: 7813 - protein, 483 aa, B.fragilis
YMNLNPIINNFQRPIRKVQICCILIFSCAACSLNIPYENQYSDPDAITTVTAARELLASAYDAIPKPEFSLSVLSDDFQPTFLINLNADLNNLYKWHPKPMEDLSNSLWEKYYSAIAIANTVLERIHYVSPISDSDKQELQCIVSEAKTLKAYCYFNLLRLFAPTYPEGPEKDGIILKERFELAFLKRSSISECVNAIRQLLTEAVTVDNRPSQVYWFSRQSAYYLLAALELYAENYDKAEEYALKILSSTNAYNVLAPVHYKKLWEQEPCEECIFSLHTTNSYYTDMNYERKKGDYFTINSTLTQLYTANDIRYEATVYPQEMPGESIGETLPVLYLGKYNKQNWNYKPIQYINKLRVSGICFILAEAYCQDQKGHDALALEVINNYLAQREAPLLDTSLSGAPLLKAILQEKWKEFAGEGERYFDLKRYRKSLLSDWNLSATMKNKPIKPDDYRWLFPIPKGEYLYNENISQNAGWTKIEK

SEQ ID NO: 7814 - protein, 429 aa, B.fragilis
IKTEVLKLYVLIIAIILSIGTARTQNIDSLLMQREDTTQFIRSDSLVLQFLEYSNIPITDNNKVKLIKSGREKFEDLFEAIRGAKHHIHLEYFNFRNDSIANALFDLLGEKVKEGVKVRAMFDAFGNWSNNKPLKKRHLKAIREKGIEIVKFDPFKFPYINHAAHRDHRKIAVIDGKIGYTGGMNIADYYINGLPKIGTWRDMHIRIEGDAVNILQEIFLDIWNKTTKQNIVGEEYFPNHPERADSCNTVISIVDRTPKRNSRMLSHTYAMSIYAAQHDVRIVNPYFVPTSSIRKALKRALNRGTKVEIMISSKSDIPFTPDASLYAVQKLMKKGAMIYLYNGGFHHSKIMMVDDLFCTVGTANLNSRSLRYDYETNAFIFDKDITQQLNDVFEADMLHCTRLTPEMWKQKSAWKKFKCWFANLFTPFL

SEQ ID NO: 7815 - protein, 448 aa, B.fragilis
IVDEIGGNLHQSGEQTADQCRYPIEFSVGKSQCTTYHYRSNGTCQCFGAGRKYPCLQRVTFHFFHFLFLSSVFERTKIGQKTYIFAFLSIFALLILENMKKIIYLLAALLLLLSSCKSKKNLVSPIPRPVLNVDSVRPDSSDVVARLFSPDTSELKKFSVKRKREKTHVASPVITRSAPSIVARGTRITSSAVSVSSVYPGIDRVKKYEFTHRDVPDAFDGFRIAFISDLHYKSLFQGEGLESLVRLLNAQHADVLLMGGDYQEGCQYVPELFAALAKVKTPMGTYGVMGNNDYERCHDEIIREMQRYGMRPLEHQIDTLRRDGAQIILAGVRNPFDLANNGVSPTLSLSPSDFVILLVHTPDYAEDVSVANSDLVLAGHTHGGQVRILGYAPIIPSHYGSRFLTGLKYNSAKIPMIVTNGIGTSNKNIRIGAPAEIVIITLHRLRNE

SEQ ID NO: 7816 - protein, 482 aa, B.fragilis
KMIELTQEELKQHFSEPIFGQISETADALGLECYVVGGYVRDIFLQRPSKDIDVVVVGSGIAMAEALGKRLGRGAHVSVFKNFGTAQVKCHGTEVEFVGARKESYQRDSRKPMVEDGTLEDDQNRRDFTINALAVCLNKGRFGELVDPFGGMNDLKEKIIRTPLDPDITFSDDPLRMMRCIRFATQLNFYIDDDTFESLCRNRERIEIISRERIADELNKIMLSPIPSKGFIDLDRSGLLELIFPELVALQGVETRNGRAHKDNFYHTLEVLDNISRVTDNLWLRWSALLHDIAKPVTKRWEPKAGWTFHNHNFIGEKMIPNIFRKMKLPMNEKMKYVQKMVSLHMRPIVIADDVVTDSAVRRLLFEAGDDIDDLMTLCEADITSKNMERKQRFLNNFQLVRQKLKDLEEKDRVRNFQPPVSGEEIMEVFNLGPCRQVGSLKSAIKDAILDGVIPNEYEAAYAFMLQKAAKMGLKPVQNKEV

SEQ ID NO: 7817 - protein, 205 aa, B.fragilis
HRADRPRISKYRRSTQRYRCKNYTNMIKREDVYKIGLFNKPHGIHGELSFTFTDDIFDRADCDYLICRLDDIFVPFFIEEYRFRSDSTALVKLEGVDTAERARMFTNVEVYFPVKHAEEAAPGELSWDFFVGFRVEDVRHGALGEVTDVDTSTVNTLFVVDRDGDELLIPAQEKLIAGIDQKHKIITVDLPEGLLSLDECDDEES

SEQ ID NO: 7818 - protein, 98 aa, B.fragilis
NHKELFYGSATKINKIGLLRLGEVVIYKFFYTLKLDGEGVEGRLHHRFHRSTSNVIVDSPSDKPLIFVQSVVISTLVYLYLFQFDNPLITASSEFQMR

SEQ ID NO: 7819 - protein, 404 aa, B.fragilis
TEKENNKNFNNYMKRITILAATLFALSGLQAQTSIDGVLRNIETNNKELQANAQLIASQKLETRTDNNLPDPTLSYAHLWNNKDKNNTIGELVVSQSFDFPSLYATRSQLNRLKAGAFDGQKSVFRQGILLQAKDVCLDIIMLRKQQQILTERLRNAEELSAMYAKRLQTGDANVIETNKINLELLNVKTEASLNETALRNKIQELTALNGNIPVVFEDADYPAVIFPSNYEELKTEVLASDYTLQALNSESAAARKQIAVNKSQWLPKLELGYRRNTESGEPFNGVVVGFSFPLFENRNKVKIAKAQSLNVDLQRANTSVQVESELTQLYREAHTLRTSMEEYEKTFQAQQDLSLLKQALTGGQISMIEYFVEVSVVYQSKQNYLQLENQYQKAMAKIYKNKL

SEQ ID NO: 7820 - protein, 176 aa, B.fragilis
TSMEHKKTKIVLYADVIIHFMEANYFSILPDIFPEYEYLILDVVYNEISQNSGTKDFIDKYLHFFPKLKKEVFSPKRESMKEFFLLQRTLGKGESACMIYCRDNRDVLGSSNLKDIKEYCSKNNITYLTTLDFLYYAYCRKKMTEQECKEFMQEVNNAGSKLPIIDITQYTCTVQI

SEQ ID NO: 7821 - protein, 300 aa, B.fragilis
KMILQTIKQISCLLCLCCFLQQSAFSQDDKDKPAYTLFDNTGKQISYGELIKRLSGYDVIFLGELHNCPITHWLEFEITRSIYNIHKDQLMLGAEMFESDNQLIFDEYMQQKISYDRFEAEARLWDNYRTDYYPVVFFAKEHHIPFIATNIPRRYANIVKNKGFEALDSLSEEAKRYIAPLPIDFEYDEAQSAAAFSMMNMMGGRRAGDNRKLAQAQAIKDATMGWFIARNIKNKFLHINGSYHSNRQGGIIPYLLRYRPNTSIVTVTSVRQESIRKLDDDHKGLADFYICVPEDMVNSY

SEQ ID NO: 7822 - protein, 105 aa, B.fragilis
YVVCFCYLYAIVKFRLFINLKLKNMKDLEDDEREFPIRVYTKVELALLYAPHLSENAALNNLSRWMRHNKLLMAALEEVGYYKYRHSFTPKEVRLIFRYMGEPGA

SEQ ID NO: 7823 - protein, 295 aa, B.fragilis
LVTCNIQNMKGIILAGGSATRLYPLSKAISKQMMPVYDKPMIYYPLSTLMLAGIREVLVISTPRDLPLFRELLGSGEEFGMSFSYLVQEQPNGLAQAFVLGADFLNGEPGCLILGDNLFYGQGFSAMLRRAATIEKGACIFGYYVKDPRAYGVVEFDGSGKVVSLEEKPAVPKSNYAVPGLYFYDATVTEKALALEPSARGEYEITDLNKLYLDEGTLKVELFGRGFAWLDTGNCNSLLEASNFVATIQNRQGFYVSCIEEIAWRNGWISSAQLKALGEKLEKTEYGKYLIDLAN

SEQ ID NO: 7824 - protein, 395 aa, B.fragilis
KIHCILIMNEIKKKQIAILGSTGSIGTQALQVIEEHPELYEVYALTANNKVDLLIAQARKFMPEAVVIANEEKYAQLKEALSDLPVKVYAGAAALCQIVESGPIDVVLTAMVGYAGLKPTMNAIRAGKAIALANKETLVVAGELINQLARQYRTPILPVDSEHSAVFQCLTGEVGNPIEKVILTASGGPFRTCTMEQLKTVTKVQALKHPNWEMGAKITIDSASMMNKGFEVIEAKWLFGVQPGQIEVVVHPQSVIHSMVQFEDGAIKAQLGMPDMRLPIQYAFSYPDRINSSFDRLDFSKCTNLTFEQPDTKRFRNLALAYESMYRGGNMPCIVNAANEVVVAAFLRDEISFLGMSDVIEHTMGQVSFVQTPTYDEYVATDAEARRIARELICK

SEQ ID NO: 7825 - protein, 292 aa, B.fragilis
NESCGIHFCSVRDALLLHQIQKQGNYRHKMKKIECIIMDWAGTAVDYGCFAPVAAFIKAFAGKGLTIDVEQTRKPMGLPKIQHIRELLTMPEVNEQFINRYRRAWTEEDVVELNHLFEKYLFASLKEYTDPIPGVIPTLEKLRAEGLKIGSTTGYTREMMDVVLPEAQAKGYRVDYCATPNLLPAGRPAPYMIFENLTKLAVPDPDTVVKVGDTIVDIQEGVHAKVWSVGVVLGSNEMALTEEETHALPAAELENRIAEVKQRMLAAGASYVIRSIEELPALIQLINSKLNH

SEQ ID NO: 7826 - protein, 108 aa, B.fragilis
SEVRFFISRMDSSGESWDTCFFVNYKRGLTRPKTELDSMSKRKLATQFEEEPFSYVFGCRTFVIEIPDSKIIMAENSKQFLLTKMSFLSIYSDYLKIIPYFCTKLLVI

SEQ ID NO: 7827 - protein, 95 aa, B.fragilis
KRNRMKKLVFCAAFVAAMCMAGTTTAQAQDVKKKEVKKEQCDKKDSKACCKKEKKACCKKEADKKTTDGCKHKADCKAKAGCKDSKCTKDKGGKK

SEQ ID NO: 7828 - protein, 562 aa, B.fragilis
INKRRNHHRLHKYQWFIGRTINDNIGSRSVKSVVKTTFHSLPIKFQCVKKLIYHYLPQPKKSDFVYFCSTSIKKFFMILHTQTPVVDETDGLPLPHRIWAVVGISFALCMSVLDINIINVVLPTLSHDFGTSPAVTTWIINGYQLAIVISLLSFSSLGEIYGYRKIFLSGIAMFIVTSLICALSHSFWTLTIARIFQGFSASAITSVNTAQLRTIYPRKQIGRGMGINAMVVAISAAAGPSVASGILFVASWHWLFAINVPLGLVALTLGLKYLPRKEERSNRKFDKLSAIANAITFGLLIYTLDGFAHHENNDYIVIQLAVLAVVGTYYVRRQLNQPSPLLPLDLLGIPIFRLSILTSICSFTAQMLAMVSLPFFLQNSLGYSEVMTGLLLTPWPYSHTGDSTGSRISGGTHSSRHTGQHRDGIVLYRTLLSVYINGGFIGHRHHPAIDALWCRFRSFPDTEQQYNHLFRPYPTFGRSQRNVGYGTALGTDIRYDTGCFALQFCSTREEYGGLSDSRQRICVCRSSGKQHAAFTTLHIKDEAPITISIHVYRPTGSQSNTK

SEQ ID NO: 7829 - protein, 237 aa, B.fragilis
TSVSMKWESSLVEHLQWSDTITNRESKEQLARMIAMRVQEGEIIGAGSGSTVYLALLAIAERIRTENLHVTVIPASMEISMECVRLGIPQTTLWMCRPDWTFDGADEVDPDHNLIKGRGGALFKEKLLICSSNRTFILVDESKQVSFLGSRFPVPIEVFPMALPYVEREVLTMGALRTELRLAKGKDGPVITENGNLILDAWFGNIHSSLEKEIKSITGVVENGLFMGYDVEVMVAK

SEQ ID NO: 7830 - protein, 701 aa, B.fragilis
GMNRMKCGFYTYRGIAFCFVAAMFCGQTMAQVVEKRGFDSQKKINAFDNTTFCTAYLSDGALYTMRDIAINDVRKIERIVFNPTGSSIALLRAKNPISIYSFRDRNKKLFELKEKRKKLKAKPMPVSMCYSADARSFIVGNSLGEIVIYDTKEYMPLAYIQGEAPATALAMSSNNYFIAAAAGQNINIWNFQTKELRKAIPMPAVVKEVTFSPDAALLAVTTDDNHLTIIDTKNWDKVDIFDKLGGTLSSPSFHPEGKYISVVKDGKNIEIINLKNGVVEQDIVDPIGDVTGGRFFKNNQNSEVFLLTNRTKQMVFWDANGLNPFYGKIMGREVDAKMNEWVKMMQGESMEDYAIRVNDETRIKQQQLFAQEVATALAGDRISMDNPFIDGYDASNNMLNIGFKGLPSIGLEVPSNEAGDFKDGKMKFSNAVYVLNDKDEFELAYVEVTNETTNKVYIYDNIGRTKLTALEADENFVPLEIMQQATREEAQLAEIKEQVIEEKKQDKLITDNTQINVKTEVIPGVDANGKKILNYKVGYQYEVINKEFSAKEDFPSGGYNIERSNAAMSLMKIIKNAFEGDFAKYLSEGKQVKVIITGSADAAPIRGRLAYDGRYGEFVDEPYYKDGNLDNITVTKAGGITQNEQLALMRAAGVKTYIEKNVTTLGNTKNEYEYHVEVAKERGGEFRKINVEFVIMDAFQQ

SEQ ID NO: 7831 - protein, 138 aa, B.fragilis
SKLRMRNKRYIVSFLLFISMIMLVVPVIPHHHHADGVICMKNDLTPEPQCPKHYHHPGNDSCCNDGCMTRLNSPTPSVQADNNPHYLFTAILFTDFIIENLFRPQERRIKNYYAYRESLHGTAVNRAFGLRAPPYPVV

SEQ ID NO: 7832 - protein, 99 aa, B.fragilis
CTIRIPKIAEKNNPMHSFEQTEVQIQNVGKLKIIRRILSSIKFLISKISTAHFINPKESNIKGKLDTTLNPPKTLPSIPPKNLIKSVEEVNGNGIPEVI

SEQ ID NO: 7833 - protein, 373 aa, B.fragilis
CTKRMKFQISGFKVSRFWFIYFVVRLFYLLFSVLVFPTLTTFGDPIHYMTSGIPFPFTSSTDLMRFLGGILGSVLGGFNVVSNFPFMLLSFGLIKWAVDILDIRNLIDDKILLIILSLPTFCIWTSVCSKECIGLFFSAILGILIVHYLNGNFKIHFRDYVAFSLCLFFKPQYLPFIVSTLFYLRFAFGLHSRRRLIILSVFYVSAIIFVLYLSRDLIDLYSLGVQKAFEFDSQFSNSTRDTLFFVNKYDYFSKAPMGIFIAFWGPTLTEALQKPFQMAVYIESFVVLCVFIYFLKTPLKKLIVNGIVNLRLIVSYSILFLGILLVHYPFGVFNAGSATRYRTNYLFLFIILLMYLFSYYRKKNDKVDTLFGC

SEQ ID NO: 7834 - protein, 955 aa, B.fragilis
FMKRNNKNRYLYIAAIFIAAMLPCIACPQSTPILLPTGTVEGRLPNGLHYLILHNASPASRVEFRLIMRVGSVQETEQEKGCAHFLEHITFGGTRHFPKRSLVEYLESLGMKYGQDINAFTGFDRTIYMFAVPTDFAKDEALDRSLLILHDWLDGVTIDPEKVENEKGIILEELRGFDPEDDFYPLKIGQGIFSHRMPLGTTDDIRKVTPQVLKNYYHKWYVPSLATLVIVGDISPLEIESKIKERFKSLPGRPVNDFRNYPLEYTQGIHLASIRDSLQPRTKVELMIPHPCTVERTMEDAIAKEKGRLLVSAISSRFRARKLKTDVTDQWYLSDKNHFVLTVEGENRKEILTSISTTVSLLNDLIRNGWQEDELQDIKNNFCRRMKLSTDAPSRPSSMWCDDFADYVISGDRYLTDPSQQQQLKEAMSRVSGQSLQTLLKEWMSYREETLLVACSTHPGLGAPLSETEIASAWAQGEQVECTPFLYFRPEKQEEIDIETPPCLAARFPFDPASVLRQTEYPQNRIREVELKNGIRLVLKPTLEADSTLLITSFAPFGTSSLSDEEYPLLEGFAGYIDMGDIAKVDGQVLSDYLFRKEISLSMAVENHWHGFIGMSPTANAPELFNLIYEKIFDPELKYDEFEEIRQDLLENQDKETILEKMLQRSPDRLLSARINELTGTGFARSSQKLSSEQIKNLNLDSIAAFYKKLYTNPQGTTYVICGNFNADTLMQQFVSVFGRIPVSSHLSRFSYPHFNFPVRKHIEGFPNDNDTQTLFDYLLPGHYQPGLKNTLTLKLMRDLIRNRLISVLREQKSLVYSPYISLMYEGIPQGIFYFDINASADNDNMPQIEQLLKEILHQLKQQEVDNEELNTLKRSFLIAKREALNEESPSAWRAALVGLLKNGETISDFDHYEQCLDSITPAILREAFRRYLDTENYILLYLSKNKLKNDTSNH

SEQ ID NO: 7835 - protein, 720 aa, B.fragilis
KMKSISITTYRGFSKVKGKCSLQELIGWVRSRQYANLIEKIGRLVSEGKTKEAENVKRQLDYFTVTANYHECRLAHSIAAYNDTSTIDIDKLREEELERIRALIEADEATLACFLTAKQHGFKILAYLTDLEAEAWRNSFFKTATITYDRLEQYHAGIYELTRKHYEKLLQTEVDTSGKDLSRGVFASYDPKAFYSAERVARIPERTLTIEAPEPAQRGRKKKKEPETGQTGDISAYTCMEFNKCLCSTQRLMKYTEGSRNSFLFTLGNKCFRKGLEESEVKRLAAERLGDGGGMDTDTPIGNAYTYTDRTERAEEKKKIPLVEQVIDYLNKNYAFRRNTVLDRLEMCDLSQTEEKSFYAMRNKDFNSIFLNISRQGIAYPLNSLKSVIDSDYSPEFNPFTHYFEGNARWDRKTDHIRKLADTIQAEDQEFWREGFRRWIVAMVASALRPGKANQEALVLHGAQGKGKSTWIRHLLPPELAEYYRNGMIDPANKDDLLLLSTRLLINMEEFEGVKTGDIAELKRIIGQENVTIRKVYDTQAQLYPRRASFIGSTNNMQFLKDYGGNRRFLVIPVKTIDYRTPVDHKGVYAQAVQLIEDGFRYWFEGNEIDDINTRNERHRMKDPLEENLYVYFRPAGEKDFEVKWKPAAAILATLSVYGRTQANAQTQQVLVQILERDAFGKRVNIHGITEYAVVELTQQEVSENFRKRDKGKEMDELPF

SEQ ID NO: 7836 - protein, 921 aa, B.fragilis
TMKRFFLLTIILTVVVTGKVGAQEAASASKRANQQYVLFESERDKGTNVTAMYDYLMDSYENFMKVVEAPDNSQYIGGAKNRLRALYPYLLNGAVYYSEQKQPSKALDFAAAYIDMPQLKLFRSELLPKDNRYASVVYYAAVAAFNLEKNEKALRYFQEYLNTGTEAQQKDCYVYMNMIYQKQKKYADQERVLEQAIAKYPVSLDFLYNLVNVHIATNNMEKLIGAIDRILAVDPNNDKVLPIKARILERQGKNVEALDIYKRLYALHPESFELMTGVARANFNCATEIVNNGATIANDTEYALVRQRASGYLMDAKDLFLKILQKDPSSKMYMQGLAGVYQYMDMKPEYEVLNKIVQDGASYTAFPSRLAAYKEALKKTENVAQEQQAVPVPIEPAMLVIKVDQFTDANNNKVIDAGESFAIRFTIENQGKGDAYNVRLRLAEQQGYDQYFDGPRELDGGNIAAGKSKEYTFRYIAKKELPTSLAKINIYAFEANGFDADPSELIVNTQEYAMPRLRVADHQFFASEGSSITLGKNGKLTVALQNFGTQTARKVKVNFTLPKNVYTTDTPEIIVDSIAPGDVAILDYGFLVNKRFDGDSIAVMLAVTESTRSASLNEAYKVKVGEYLSASASMNLSGNVAARKVNVKDFSLGFKSELMEDVPVGAVNRHRYALIIGNEDYSMTGANAEINVPYAVNDAVLFREYCVRTFGVPDGQIKVVPNATAGMMHEQLDWLVNMASTDPQAELIFYYSGHGNNDEATKEPYLLPVDITGKNIRLGISLSDLYKKLATYPVKGAYVFLDACFSGGYKSAAPLLAQKGVRVVPKVGLPQGNTLSFSSSSGDQTSSVYHEKKQGYYTYFLIKTIRDAKGNISMKELFDRTSAAVKRATALIDKIQEPQCMASPTWIGWEDIKLETPVVTP

SEQ ID NO: 7837 - protein, 700 aa, B.fragilis
LYLGKPYVQMENKYQYFKRDISWLSFNYRVLLEADDDRLPLYERINFISIYSSNLEEFYKIRVADHKAVASGVTDGTEESLQSAKDLLEEINREVNRQLEDRIHIYEKKIIPALRKNHVVFYQSRNVEPFHQQFVKDFFREEIFPYLQPVPVSKDKVISFLRDNRLYLAVRLFLKGTNKEDADHLQYFVMKLPYSKVPRFIELPKHGREYYLMFIEDIIKANIDVIFPGYEVDCSYCIKISRDADIMIDDTINSVDLVEQVKKKIKKRKIGAVCRFVYDRAMPDDFLNFLVDAFRIRHEELVPGDKHLNLEDLRHLPNPNHSIPRIERPIPMKLNRLNDKESIFSYVEKKDLLLYYPYHSFDHFIHFLYEAVHNPETREIMVTQYRVAENSAVINTLIAAAQNGKKVTVFVELKARFDEENNLATAEMMKAAGINIIYSIPGLKVHAKVALIRRRSFNGEKIHSYAYISTGNFNEKTATLYADCGLFTSNPVIVHDLTNLFRTLRGKENPRFTRLLVARFNLIPELNRLIDKEIELAEKGRGRRIILKMNALQDPIMIDRLYEASQKGVKIDLIVRGICCLIPGQEYSCNIRVTRIVDSFLEHARIWYFGNAGHPKVYMGSPDWMRRNLYRRIEAVVPILDNELREEIVDMLHIQLSDNQKACFVDDKLNNIFKFKTNAAPVRAQYTFYNYLKEKNETFL

SEQ ID NO: 7838 - protein, 120 aa, B.fragilis
NKHYWTSTLYIVEFYNLRGGKERIFDDMNNGFGWSRLPKSFMAENTVFLLLTALIHNFYKTIMSRLDTKAFGLKKTSRIKAFVFRFISVPAKWIMTARQYVLNIYTENRAYAKPFKTEFG

SEQ ID NO: 7839 - protein, 377 aa, B.fragilis
LPVIIPDILNSCPFRDGAADRHKLNSQNKTQMIRTMIASCLLACSGFVSAQMTGGNPEEVKQTAPAPLYRDPVYDGVADPVVVWNKEDRSWWMLYTQRRANVNAGNVAYCYGNDIGIASSRDHGRTWVYRGVLDLNMERGKNTFWAPEVVNFNGVYHLFVSYIEGVRTDWGGHARMAHYTSKNMWDWKFEGFVKLSSDKTIDATFFRMPDGKWRAWYKDETRNAAIMTAESDDLFHWTLNDTPVIDQSRQEGPKVFRFGGYYWMLTDEWHGMRVYRSKDATTWEKQGVILDKPGTRPEDTPSGAHGDVVVVGDKAYVIYFTHPGRKAHSEETKDEDGNIPYHLRRSSAQVAELLIKDGQLVADRSPEFNFYLPDMEE

SEQ ID NO: 7840 - protein, 400 aa, B.fragilis
MKTIMKKLFIYAVGICLLPAFTSCKDDREENKYTGINKIYLSAETPVITESENIPLTVNVDLTLTCEQDLVLNFELPDDKNGVLKLENNPVTIKAGKRSATFEVVSNQKNLLTEDTYFQVGISQFPTDNLMLNETLQVRVKPNPKIPELSPQQKALIKGYKTKYGIDLNKWLGVLSCHTTVQSPADGYLQPFAAAFTKEYDGKTVITLSEQATEDMPVLKMTDNPFGLTEYLYFVLRSETVADPEFWTQQPEPQKLMKLLNWNKESKETFAVSLDAIRLKDITSTSTRLEYLGPGKNYYGDPITIVPFTYQFSALDRQNKLLESGNAEIKEINDQGASADPAYYLNCYDLVNSDNYDTPENFIKSTGNIDFATDKMTYQFLLSHVNAGGYTRITVVYEKK

SEQ ID NO: 7841 - protein, 417 aa, B.fragilis
RIYIIMKKLIFMGILGLFILGSCNSKSGGNHEGHDHGTEAHDHEHEGHDHEHEGEDHEGHDHEGDEHSRSSEPATGHSDEIILPKAKAEAAGVKTSIIEPEVFEQVIKTSGQVLAAQGDESVAVATVAGVVSFRGKVTEGMSVGKGTALVTISSSNIADGDPVQRARIAYDISRKEYERMQALVKNKIVSDKEFAQAEQNYENARISYEALAKNHSAGGQAVTSPISGFVKNILVKEGDYVTIGQPLVSITQNRRLFLRAEVSEKYYPSLRTIGSANFKTPYDNKVYELKELNGRLLSFGKSAGENSFYVPVTFEFDNKGDIIPGSFVEVYLLSSPMENVLSLPRTALTEEQGLFFAYLQLDEEGYKKQEVTLGADNGKSVQVLSGIKAGDRVVTQGAYQVKLASASNAIPAHSHEH

SEQ ID NO: 7842 - protein, 1019 aa, B.fragilis
NANMKAVIISFFITLSTLTSHAQQRDIVLTGTVTDHQNEPLPGATIRIKGTQFGTVTDTDGHYLLRGKWKENDLILFSFIGMKEIRVKYTGQKVQDAAMQEDPKALDEVIIVARQNINELDIRAKSGVVQRVDVERLNSKPMIDMSLALQGTVPGLIITNTGDLGSKPEIRIRGNSSFRKGDMANEPLYVMDGKVISSDAFMTLNPADIQEIKVLKDAVACALYGIKAANGVIEITSQRGNPDGRLTTSYSFNIGITTRGRRGVKMMDSEEKLELERRLQNISTPGYRYSEDYYRKYYATAPNLDELIAEGQQVLDSLKNIHTDWFDELIHRSIYQRHNLSIKGGTDKTSYYISTNYAKQGGRVPGNDTQRFTARMSLDQKLGNWGYFSLSTDAGYSATDTPNGSTHSPTDLIYQLNPYETKTGKLISYSEKSSEYTLNDLMSQYHSKSTDKRGGVSGSFNLRPLEGLEIDVVTGIDFLLNEALTLVPSTSIAEREMGIAIAERGKLTKEKNTTTNISSNIRITYNKTFAGRHDLTIGGNMDYYLTQTDNMSATGYGVGTQMSLNAINHSITGARKPTASSLLDKTAQLGFGIVMGYSFDSTYDLFATYKADASSVLPPDKRWNAAWAVGLGWTLSRYPFLKNNKVITLLNLKGSHGRMANLSGVSASATIGTFSYSTNYYGNARLLQLLGFYNTDLKPEQTSTTDFSLSIEFFKRLTLGLNLYRRETSDALLDVPIPLSNGFNTMKRNIGVLRNEGYELTAALKVLDTPDWRVSLRGSLAYNRNKVISLYYTDRLYTSETALTPDYEVGKAYNMLYGLKSLGINPITGLPVFQGADGSEIPPTQNPARENFIVLGHSTPPYSGTFNLNFSYRNFDLDMDFYYVFGGIKPYNYSYVRSADSANKNAIQKQLENMWFHRGDEGKIYHSPFYISPANASLQQPNTETVGKSDYLKLAMLSLRYRVPHTFLEKNCHFIKYANIAFQASNLFMITPYKESDPETGSLAGAMQPVLTINLSLTF

SEQ ID NO: 7843 - protein, 166 aa, B.fragilis
IVNISMNSLDSQITALYTLAHELLYLGSDGSPIYSDHFSRLNGDVLSRANTLYPHHGSTDEEEARLCLSLLMGYNATIYNNGDKEVRIQQILNRCWEVLDRLPASLLKVRLLTYCYGEVFDDDLSREAHSIIDSWGERALSGDECEIAEQLRSLEENPYPNWEVEE

SEQ ID NO: 7844 - protein, 105 aa, B.fragilis
KKNIMKLKEISKDIYDVDAWLDEELGKEGTPEREASIEKAWEEYNGQILLDARKNARLTQEELANRIGADKSYISKIERGLITPTVSTLYRIAAAMGLSVELRPL

SEQ ID NO: 7845 - protein, 179 aa, B.fragilis
NTDMNIFGTYAYAYFKYLLLKDMDVLISFFRKKGICIGENCFIYSAICTPEPYLIIIKNNVTISVGVQLITHDNSVCKVLPNRTDAFGRIVIGNNSFIGAGSIILPGVTIGDNCIVAAGSIVTKSLGDNVVIGGNPAKIISTIDEYKDKISDKSFNVNGMTFVQKRNHILSSLDKLIQK

SEQ ID NO: 7846 - protein, 547 aa, B.fragilis
RSDMISVDGLAVEFGGTTLFSDISFVINEKDRIALMGKNGAGKSTLLKILAGVRQPTRGRISAPKECVIAYLPQHLMTEDGRTVFEETAQAFAHLHEMEAEIERMNKELETRTDYESDSYMELIENVSTLSEKFYAIDATNYEEDVEKALLGLGFMREDFHRQTSDFSGGWRMRIELAKLLLQKPDVLLLDEPTNHLDIESIQWLEDFLINNGKAVIVISHDRKFVDNITTRTIEVTMGRIYDYKVNYSKYLELRKERREQQQKAYEEQQKFIAETKDFIERFKGTYSKTLQVQSRVKMLEKLEILEVDEEDTSALRLKFPPSPRSGNYPVIMDGVGKSYGDKVVFRNATLTVERGDKVAFVGKNGEGKSTLVKCIMNEIEHDGTLTLGHNVQIGYFAQNQASLLDENLTVFQTIDDVAKGEIRNKIRDLLGAFMFGGPEESMKKVKVLSGGERTRLAMIKLLLEPVNLLILDEPTNHLDLKTKDILKQALKDFDGTLIVVSHDRDFLDGLVTKVYEFGNQKVTEHLCGIYEFLDKKKMDSLRELEK

SEQ ID NO: 7847 - protein, 473 aa, B.fragilis
HYCIIHIGHKQNIHRTKRTRNQQDRYHRLSWCETHCQELMMNMVLVRFERALATANTNHHHTDHIECRDNQRTESNHESTFGIRGDIQIVLAVFDGKEREHIAQSQAARITHKNLTGTFRTAEDVIVKERDQHTERGKGEHAVRPKFFLHEQEAEDKQGNAAQTGGKTVDTVNQIDGIGDKDNQKNRKRHTYPGRKGIQAEKTVEVIDPKAGQGKKRSTDDLDHKFLTVAHSDKVIGNTRQVEQSHPADQKQALGQQVHRTEGGNIITHQDAKGEHATGGKQDGGEERDTAQTGNGTFMNLALTRHIEKLLPQRDKQDAGNDKPGNRSRDDKSQYDEKDIQDKGDLGYIQCCVEKEKSLLLYFPVGIRILFKTAELFGNLTFIAGKGTLSPAVDDAMRLTGEVVVKDFTIAISQKAHLQQGSGQAVEHFPTTVQDLLDADFLVTVIVDRRVITHQKRKAQTGFFLVGGAMMGI

SEQ ID NO: 7848 - protein, 189 aa, B.fragilis
SIGICFPFARKVCPNIVTFAEINKESMTKVGLLSDTHSWWDEKYLQYFETCDEIWHAGDIGSVEVAQKLAAFRPFRAVYGNIDGQEIRRMFPQVNRFTVDGAEVLMKHIGGYPGNYDPSIKGSLLVHPPKLFISGHSHILKVKYDKTLDMLHINPGAAGMSGFHKVRTMVRFAIDNGVFKDLEVIELAG

SEQ ID NO: 7849 - protein, 165 aa, B.fragilis
LLTIKNYQTMAVPYKKIARKDPRKTDAIEKFYPQLVTLGQSASLESIAYEMKEKSSLSSGDIKSVLTNFVEAMRTSLYNGQSVNIRDFGVFSLSARTKGVDTEKECTAKNIMAVKINFRPSSSVRPNLTSTRAGDKIEFIDIKAALEGKESEKGGDGDIVDDPTA

SEQ ID NO: 7850 - protein, 208 aa, B.fragilis
FNYMQYNTQQKRMPLPEYGRSIQNMVDFALTIQDRSERQRCANTIINIMGNMFPHLRDVPDFKHKLWDHLAIMADFKLDIDYPYEIIRKDNLVTKPDPIPYPSTKIRYRHYGRTLEILIKKACEFQEGDEKKNLVALICNHMKKDYMAWNKDTVDDRKIAEDLAEFSGGKLQMDDEILRLMSERIAQNYRPRTNNNNNQRNNNQRRKF

SEQ ID NO: 7851 - protein, 290 aa, B.fragilis
YSIIMPKKKRSKAFWNNIKFKYKLTIINENTLEEVVGLHVSKLNGLSVLLSVLTVLFLFAAAIITFTPLRNYLPGYMNSDIRAQVVENALRVDSLQQLVDRQNMYIMNIQDIFSGTVRVDTVQSMDSLTTMREDSLIARSEREEAFRRQYEETEKYNLTSITAQPDVNGLIFYRPTRGMISDHFDAEKKHFGTDIAANPNESVLATLDGTVILSTYTAETGYLIEVQHNQDFVSVYKHCGSLLKREGDTVKGGEAIALVGNSGTLTTGPHLHFELWHRGRPVNPEKYIVF

SEQ ID NO: 7852 - protein, 185 aa, B.fragilis
TKIMSQLNDISLVAQVVVFRNTRAFDQLVQKYQSPVRRFFLNLTCGDSELSDDLAQDTFIKAYTNIANFKNLSSFSTWLYRIAYNVFYDYIRSRKETTDLDAREVDAANSTEQVNVGEQMDVYQSLRTLKEIERTCITLFYMEDVSIDKIAGITGCPVGTVKSHLSRAKDKLAIYLKQNGYDGNR

SEQ ID NO: 7853 - protein, 341 aa, B.fragilis
IYKIVMKIYLVCQTWSNTKNNHAGILYLCNQLAAINPDIQVIAMPEFKSIGRFFLYHIWHLYYAFYLYLSTKDGDCVILMEYLLSKSLDQSLIASFLKRTKPNVRIIALPHLVSKLIKKHFSEKEIVDRISKVDSVWVLGSSLKTFLCSLGVPNDKIRVIFHYVDTEYYKGEVCKVPNFRLRVVVMGNMQRDYDLLFEVISALPLIDFDVCAGVSKATENLTSLKNVTLHSYMSEDTLRGIMNKADVSLNIMKDTIGSNVIVTSMAMGLAMVVSDVGSIRDYVDESNGLFCLTSKDFIIALSRLEADRDMVKRMQLKSVSKAQGMNVSEFYRWFRTMVYES

SEQ ID NO: 7854 - protein, 301 aa, B.fragilis
KKKMEEVKRNSLQAWILAARPKTLAGAITPVMIGCALAFADGKFNWIPALICCLFAGLMQVAANFINDLFDFLKGTDREDRLGPERACAQGWISAAAMKQGIFITVGLACLIGCTLLFYAGWELILIGALCVLFAFLYTTGPYPLSYKGWGDVLVIVFFGFVPVGGTYYVQALNWTPNVTVASLVCGLIVDTLLVVNNYRDRDADRKSGKKTVVVRFGESFGRYFYLLLGITAAWLCFWFLFNGHLYATLLPQLYLFFHIRTWKKMVQIHSGKKLNSILGETSRNMLLMGILLSIGLVING

SEQ ID NO: 7855 - protein, 240 aa, B.fragilis
LSPIIEKIKICGHLLLDKHSGLHTMKNKRYSRGEELSNTLSHGAGTLLGITAGYFLLEKALANPHPYWATGCVLAYLVGMLASYISSTWYHGSRPGKRKELLRKFDHGAIYLHIAGTYTPFTLLVLRHAGGWGWGIFTFVWLSAIVGFILAFKKLKEHSNLETICFVGMGSAILVALKPLMDCLSAIGASPAFWWLLGGGASYIMGAVFYSLRKPYMHAVFHLFCLGGSIGHIIAIWLIL

SEQ ID NO: 7856 - protein, 368 aa, B.fragilis
IPFVLNILFIILAFVISASVARLIIPRILLISLRKKLFDMPSERKVHKRAIPRLGGVSFFPTILLSSCGVFALRILMGYDVPALRAVYLLPECLFLVCGMTLLYLTGIADDLVGVRYRQKFVIQIICASFFPLAGLWINNFYGLFGLYALPAWIGMPFTVLLVVFVTNAINLIDGIDGLASGLSSVALLVFGFLFMQKELWTYSMLAFATFGVLVPFFYYNVFGSAERARKIFMGDTGSLTLGYVLSFLAIKYSQYNLDVTPYTEGAFVIAFSTLIVPAFDVIRVVMVRVRSGKSPFEPDKNHIHHKFLAMGFTPRKAMITILLISCAFSAVNILFMPYVNNTIMLIGDITVWVGLNLWWDRIRDNKC

SEQ ID NO: 7857 - protein, 143 aa, B.fragilis
ANIVWQYLYIQEIIGTFATEIRRRAVMKTVNQIIGENLKKIRELSGFTQEQVAQSIKIERSTYSNYEGGTREIPYTILEDISNLFGCEPFILFEDNIQTNNEIMATAFRISNLGENDLKEIAAFKDIVKSYLKMERIAQNEAE

SEQ ID NO: 7858 - protein, 775 aa, B.fragilis
NISVTCMTFLCNTKIRPLQSEITYTFMETIYLCIIIFLFVLAVFDLMVGVSNDAVNFLNSAVGAKAASFKTILFIAGAGIFIGASLSNGMMDIARHGIYQPEHFYFAEIMCILLAVMLTDVVLLDVFNSMGMPTSTTVSMVFELLGGTFALALIKVHNSDTLGLGDLINTDKALSVIMAIFVSVAIAFFFGMLVQWLARMVFTFNYKSNIKYSIALFGGIASTAIVYFMVIKGLKDSSFMTPENKQWVQENTMMLVSCFFVISTILMQILHWLKVNVFKVVVLLGTFALALAFAGNDLVNFIGVPLAGYSSFIDYTANGTSVGPDGFLMTSLMGSAKTPWYFLIGAGAVMVYALCTSKKAHAVIKTSVDLSRQDEGEENFGSTPIARTLVRFSLTLANGISRITPPSAKRWIDTRFRKDEAIIADGAAFDLVRASVNLVLAGLLIAVGTSLKLPLSTTYVTFMVAMGTSLADRAWGRDSAVYRITGVLSVIGGWFITAGAAFTICFFVAMVIHFGGSIAIIALIGLAAFTLIRSQLMYKKKKEKEKGNETLKQLMQATSSHEALELMRKHTREELSKVLEYAEQNFELTVTSFLHENLRGLRRAMGSTKFEKQLIKQMKRTGTVAMCKLDNHTVLEKGLYYYQGNDFASELVYSISRLCEPCLEHIDNNFNPLDAIQKGEFGDVAEDITYLIQQCRQKLEGNNYSNLEEDLHRANDLNSQLSHLKRQELQRIQSQTGSIKVSMVYLTMIQEAQNVVTYTINLMKVSRKFQIETDI

SEQ ID NO: 7859 - protein, 297 aa, B.fragilis
CVDVLMNELEDIYKRIEYLRNNGVKMKEIADWIHMAPSVLSALYSSVLPTYLNLQKTKPREEALDEALALVNNVSKKRLLGNLGEMKERLFDLEPNQEANITGNAFLKLLEKEMQESVGEVYNYSGTYLSYSLSSSTDSLKAEPYLICASENNDYVKVGMINAYKSVHWGSGIISNHQNSYLMFNERELPQFALVTIYLQLPHYEFPHMLKGLYLCLDYNHNPIARRIVLVKQSDSTDIDEFLKMEGKLISRSELTPEEEIYYNYTCQEGDYIKTCTVPSPKLNESDLEREKKMLKI

SEQ ID NO: 7860 - protein, 304 aa, B.fragilis
NYPVFLHKTFGNMIQSMTGYGKATAELPDKKINVEIKSLNSKAMDLSARIAPAYREKEMEIRNEIARVLERGKVDFSLWVEKKECADAATPINQVLVEGYYNQIKAISENLHIAVPTDWFQTLLRMPDVMTRTETQELSEEEWGIVYAAVKEAVSHLVDFRKQEGAALEKKFREKIANIHRLLESVTPYEKERVDKVKERITDALEKTLNVDYDKNRLEQELIYYIEKLDINEEKQRLGNHLKYFISTLESGSGQGKKLGFIAQEMGREINTLGSKSNHAEMQKIVVQMKDELEQIKEQVLNVM

SEQ ID NO: 7861 - protein, 376 aa, B.fragilis
SIHVYEYMKKILFMGNTAWSMYNFRRVVFSDLISLGYIIYIVAPLDVKFQKELEKLGCKFISLDIKAKGTNPFRDFILIFQIKKILEKVQPDFCFFYTIKPNIYGSIAASMLHIPHIAIITGLGYTFINHNLISYIAKCLYKIALVKAKEVWFLNKDDKETFVSKKIVKGTKVQLLPGEGIDLKRFSKKPMVPDVSFLLMARMLWDKGIGEFVEAAKFIKQRYPDTRFCLLGFIGVDNPTAIPKERIEEWCSMGLVEYLGVTSDVRPFIENCSCVVLPSYREGVPVSLLEGAAMGRPLITTDAAGCKEAVEDTVNGYLCEVKDVETLVSAMEKIILMSMEQRVTMGEAGRVKMQCEFDIKLVTERYINTLHYYLGF

SEQ ID NO: 7862 - protein, 125 aa, B.fragilis
YTKVMELQIIQSKIYGIRGQKVMLDFDLAGLYQVETRVLNQAVKRNSKQFPTDLMFQLNTEEWEILKSQIVISSWGGTRKLPFAFTEQGLAMLSGVLNSDRHRSEYFHYASFCSCPPIGLGSSGE

SEQ ID NO: 7863 - protein, 113 aa, B.fragilis
NKTVMTETDDKLLKQFFGEQKQEIEDNGFSRRVMRNLPGRNHRLVQAWGAACAVVCVILFFTLGGLQATISTLREVFVSMVQQSATTGFDPKSLYIAALVLAFFGARKAWSMA

SEQ ID NO: 7864 - protein, 64 aa, B.fragilis
ILTTSVSFLFVTFLYMWQAKFAKLSDLTKSFLIYLWGFVKRELFYCNFVLWSKQIVYILFRYGL

SEQ ID NO: 7865 - protein, 151 aa, B.fragilis
GTDYAPSGQFEKMFNTDLGAGVGTGVAQIAGGQADGYNFFPQQDLSSPTTKEDVMKKSIHVIMEVEFDKKVGGSGPETGWLNVVALKDNTATNYITDFEAGKVYFINLADIKDIMDVPVPPVTPDPDPETVSVDLTVSIGQWTVVQVKPEV

SEQ ID NO: 7866 - protein, 206 aa, B.fragilis
IFIKMRITKSILALMAATMTFAACSNDEKITESTPKTVALTVKLPEFGGASSRAIDPETTTGNKVTINGPVKIIARVSQGGAITNTISENITAGSMSTITVSGAAQWIEVEANGDNSTETDNVNTRQGSATSSKVRLFGGATINPGSGGNATCTPTINPDMARVEVKGSLAGPWTHLNDLKIKGIYINNVKLTRGASSLTRIVSAA

SEQ ID NO: 7867 - protein, 267 aa, B.fragilis
CMTKRTCQFPKHTCLREINFLKIAGISLLLFCTTSQIAVADSYEKNAVTATQQSKTEKITGKIVDESGEAIIGASVKVQGSTIGTITNMEGEFMIPNVPNKAVLEISYIGYKPLEVAVGKSKDLRITMEEDTKTLDEVIVVGYGTTSKRKTTAAIASVNTEDIIKAPTANITQSLAGRAPGLLVTTSGGGLNNFSSVSIRGGGTPLYVIDDVISEERDFRNLNAEDIDQITILKDAASTAVYGARAANGIVMIVTKQGQSRENERQL

SEQ ID NO: 7868 - protein, 540 aa, B.fragilis
LIQKKMANLDLSKYGITGVTEILHNPSYDVLFAEETKPGLEGFEKGQVTELGAVNVMTGVYTGRSPKDKFFVKNEASENSVWWTSEEYKNDNKPCSEEAWADLKAKAVKELSNKRLFVVDTFCGANEGTRMKVRFIMEVAWQAHFVTNMFIRPTAEELANYGEPDFVCFNASKAKVDNYKELGLNSETATVFNLKTKEQVILNTWYGGEMKKGMFSIMNYMNPLRGIASMHCSANTDMEGTSSAIFFGLSGTGKTTLSTDPKRKLIGDDEHGWDNEGVFNYEGGCYAKVINLDKESEPDIFNAIKRDALLENVTVAADGKINFADKSVTENTRVSYPIYHIENIVKPVSKGPHAKQVIFLSADAFGVLPPVSILNPEQAQYYFLSGFTAKLAGTERGITEPTPTFSACFGAAFLSLHPTKYAEELVKKMEMTGAKAYLVNTGWNGSGKRISIKDTRGIIDAILDGSIDKAPTKVIPFFDFVVPTELPGVDPKILDPRDTYADPAQWNEKAKDLAGRFIKNFAKFTGNEAGKKLVAAGPKL

SEQ ID NO: 7869 - protein, 538 aa, B.fragilis
RQENIMNNKRKNMSIYITVLLWILIPLLIINGLIFLTSDMLSVFVGGMLSLKLLCYSLFFSYSFLLGYKAQTGGGIIILVLLLILGLFLWQSFISWVEPGTLWREAVGAIIFLGVILSVGILCRYGIKAGGLLRLSSILAFAIVAFVYITVCLSTVCGAYSPIPEELFWKDAYPEKGKNGTVFFHHSKLHINPFDSRVIGVFRFNDKKEYVGYSASMYESHEIVNSGFKVDDTIKASTCDFIHSSYEPLLSNFMSDCQDALYMKEGDYCVFLYTEKGALYRKEFDYHRNGIVKQARTYTYDRKTGFHIEREKTIEFDELGFCDKSGRVRWNIKDFHQTDTVIDMESRYGQAYDPAARNRKYALPQQLIIDSFVTVESKTASPDSLRKYSSLDFPLDEYYKLGGVNGHAISVYVNTDEYKWRKIYLSDFTQLGNVEQMYSFIDALELSCLDTGMWVRIGEQSMVVGEDDECCSFVLKEVVKGGKALALYFFDDYAVTTDSRFCFYFNPSIHKDMEIQKRAGAAWNEMKKIFMEYKEKEN

SEQ ID NO: 7870 - protein, 60 aa, B.fragilis; identical to SEQ ID NO: 7175

SEQ ID NO: 7871 - protein, 637 aa, B.fragilis
YSKNTLTPVHVNPKFKYINRIMADEMMVKELEEVVVRFSGDSGDGMQLAGNIFSNVSATVGNDICTFPDYPADIRAPQGSLTGVSGFQVHVGASKIFTPGDHCHVLVAMNPAALKTQIKFCKPQGLVITDSDSFGEKDLEKAQFKTGNPFEEMGITQQVLEVPISSMCKESLKDSGLDNKAMLRCKNMFALGLVCWLFNRNLSAAEKMLNEKFAKKPEIAAANIKVLNDGYNYGANTHASTSTYKIESKTPKAAGLYTDINGNKATSYGLIAAAEKAGLELYLGSYPITPATDILHELAKHKSLGVKTVQCEDEIAGCASAVGAAFAGDLAVTTTSGPGVCLKSEAMNLAVIAELPLVVVNVQRGGPSTGMPTKSEQTDLLQALYGRNGESPMPVIAATSPTNCFDAAYMAAKIALEHMTPVVLLTDAFIANGSAAWKLPNMDEYPAINPPYVTPDMIGTWTPFQRNEKTGVRYWAVPGTEGFMHRIGGLEKSSETGVISTEPENHQKMTLLRQAKVDKIADSIPEQEVQGDADADLLVVGWGGTYGHLYSAVEHMRKNGKKVALAHFQYINPLPKNTAEILKKYKKIVVAEQNLGQFAGYLRMKVPGLNISQFNQVKGQPFVTRELVEAFTKLLEE

SEQ ID NO: 7872 - protein, 222 aa, B.fragilis
NAVEKMKIINLSETDSILNQYVSEIRNVEVQNDRLRFRRNIERIGEVMAYEMSKTFAYSVKEIQTPLGIAPVRTPDNPLVISTILRAGLPFHQGFLSYFDYAENAFVSAYRKYKDTLKFDIHIEYIASPRIDGKTLIITDPMLATGGSMELSYQAMLTKGHPSEIHVASIIASQRAVDHIASILPEDKTTIWCAAIDPEINEHSYIVPGLGDAGDLAFGEKE

SEQ ID NO: 7873 - protein, 337 aa, B.fragilis
EMSETVYTAKDYKSGQPRWCPGCGDHAFLNSLHKAMAELGVAPHNIAVISGIGCSSRLPYYVNTYGFHTIHGRAAAVATGAKVANPDLTIWQISGDGDGLAIGGNHFIHAVRRNIDLNMILLNNRIYGLTKGQYSPTSDRGFVSKSSPYGTVEDPFHPAELCFGARGRFFARCVAVDGPASVEVLKAAANHKGASVVEVLQNCVIFNDGTHESVATKEGRSKNAIYLEHGKPMLFGENKEFGLMQEGFGLKVVKLGENGVTEKDILIHNAHSMDNTLQLKLALMEGPDFPIALGVIRDVEAPTYNDAVAEQIDEVKAKKKYHNFQELLMTNETWEVK

SEQ ID NO: 7874 - protein, 60 aa, B.fragilis
QGKDNAPAKRITYPKQPFTSPFPRLYFKILIINMLVFELPDQLSWGITEILFAVFIETGR

SEQ ID NO: 7875 - protein, 415 aa, B.fragilis
FILEKKIGKLSIRVLLNTHRRNDCEIYPLIIRVVYHRRKSEYSLGWKIHTSNFSADRERVVYSSTGNLKRKDLGLINDAISQERERLLKIFAFLQQNMPGFSLSQLMDKYRMERNLRYVDAFIVREIERLRQEGRSGTAGLYLSGLYSLRRFLRGQKITFRELTYCFLTDYIHFLRMRGISENTVNMYIRNLRAVYNKAQKQGINMGCESPFRELKLQTQETAKRALCKHDIARIVSVDLSSEPLLDRARDLFMFSFYARGMPFVDIVFLKHDSIINGIIYYERNKTGQRMQVRVIPPLAALIEKYRSSYPYVLPYITSFSDRTSYMQYRYALGNVNRLLKRLGRRLHLPLVLTTYVARHSWATIAKEEGFSIASISEGLGHTSEATTQIYLQSFNSEVIDKINEQVVASIGRHI

SEQ ID NO: 7876 - protein, 117 aa, B.fragilis
AEGERKENEGNCLTVTCLIFISSSVFFRISRLAFEAMRSNSTENAEFQVNPSSTLTSPVTGVEEAAFLIRISRCLHTTNSAVSTGRVTGTLLISDKDGSPVNAEFMPVVSLPITNKS

SEQ ID NO: 7877 - protein, 300 aa, B.fragilis
FTKLKMKLHYKKEHISCTNYKSESYEGFGIGTLTSGSNFNSQTLSVKTNFLIFILEGEVEIIPKEGKIKRVIAQEFFFISALSTYEIQVRVPGRYIYMSFLYNDIKLCEKHMLESYLKEVREASEEVGILSVRHPLNLFLELMDAYLRAGVNCKHLHSIKEKELFIILRTSYSKQEIVNLFHEIIGTNMSFKAAVLLHVDRVNNREELAQAMGMSITDLARKFKVEFGESVYSWLLKQKNKKIIYRLAQPGASVKEIVYEFGFSSAASFNKYCKKNFGNSPRELVRQLKDKHIDNQNLKI

SEQ ID NO: 7878 - protein, 261 aa, B.fragilis
MCMRSTPSAFIGKNVSGQRSTFEEMATEMPIDLPEGKWTFLCLEGKVGDYEIGIYRQVFPHKFSPAVSPGITTLSDFRVKAYYEQKENLEYSLGELFFGRLDSMEITADNGGTGVVDLMKNTNKIEVRVKGIADGSSARITSDNGRFNSENVTPADAGTIIYVPYYSASQTDDTRVFQFDVLRLYTDGHLFLKLLNPDGTDVIPGFTKDLINAIMSSPAYHTQEDLDREDTYLIELVLSKDGVIVSLRVNGWETVSTTPEV

SEQ ID NO: 7879 - protein, 81 aa, B.fragilis
  UNSURE (48): Identity of amino acid sequences at the above locations are unknown.
NRQRTLLYCKPTTMSSPLSRYPHGGAMDLEFVMRQTARMSQRSMNPDXSWGFTSLDPSPLNLLIKKSKVFPGLPVPFKKHW

SEQ ID NO: 7880 - protein, 277 aa, B.fragilis
SIVRVEKRFSKIFSIVVYAFLALWMGACKSEPVRLPELSGHRGADCIAPENTLASADSCIKYKIDFMECDICISKDSVFYLLHDSTLDRTTNGTGLIREWLSADIDTLDAGSWFGEKFSGQCVPRLDVLLRKAKQNGLKLTLDYRTGDFGQLLDLVRREGMLENCTFTFWSDKEAKAFRQVAPEIRTLQAYVGGGAELDKVIAEINPNIAVIRIDSLDKLLVERCHKKGLKVLALALGTDDVEESDRKAIELGVDVLATDRPELFVKKYRPEHTWTK

SEQ ID NO: 7881 - protein, 62 aa, B.fragilis; identical to SEQ ID NO: 7176

SEQ ID NO: 7882 - protein, 798 aa, B.fragilis
PSKGKAGKMSVNYNFNYNWSQPANMPNKLDAHDAAFYKNMSMTNDGLAPAYTDDELELFRNGSDPRRYPNTDWQKLCLKNSAPEMQHTLTVTGGSEKIKAYTSLGFYDQKSLYKFDVNSFKRYNFRTNIVADFKEIGLKVTSSIEAYKTDLRSPNAKSGDSYYHTWGHIQNKAPWEIAYNPNGQIFNTPDNPLMEISPDAGYTKNENLSAIANLALEWSVPYVPGLRLKALGNYRINNDKSKSWKKSPLAYDWDGNPNDPGKPSLSKSYSNWSSYTVQGFANYDRTFNQVHTISATAGIEAYKLFKDDASLSREEYLLDVDQIGAGPVSTAKNSSSEGEEARAGVVARLKYDYASKYVAEASLRYDGSDNFPRGKRWGTFYAGSLAWVISEESFWQTLKDRHIFDQFKVRASYGEIGSDAIGRYAYLQSYGLNDRGYLLNGSWYPGFSEGALVSKDITWYTTRDFNIGFDFGSLNNRLSGSVDYFRKSTKGYLTSPSAVAYTDPLGIALPKVKSNGEFIRQGAEFILQWKEKRGDFEYTLSGNFTYFDQYWNINPNEAETDTKNPYKRTTQAKGYWGIGYDCLGYYQNQEDIMNSPKRQSSVNLGAGDLKYNDFNGDGIIDGSDQHRIGKNSMPRGQYGFSADLNYKGWFMNMLWQGATPADLYMGGMIQGSQSGSGYPPVIYDFQTDVWTPNNTGARYPRLRSTASYNGSNNYGSSDFWLINTGYLRLKTLSIGYDFKHKLLKRVAWMNKCNVSLNGYNLLTFSKANKFDIDPEIGDGNLYTYPVSRVYSISVNVGF

SEQ ID NO: 7883 - protein, 579 aa, B.fragilis
SHFLFCCKMIHQKKFVTISIGYRIYKMLGMLCLCVLVYSCGSKSPLTMRLFMQAGGATVELPNTSSADSVFTVSETVGFRDSVVVDNPVSSVDSLEEDIWKSIDMDRIDIVAQRKSIERILERNGEVTLMFYVKAPKVLLDSCWKLTMYPELIEKDSSVLLSPVILRGKEFIRTQESQYKAYDDFLKGIIPESKYDSAFVDREGIRKDIFARQRLFWKVYEAERRRRLAYLRWKALMDKRHGWISTKAEGNRNTLKQRMQRNVLERSVEKFIAGYDTVGIRASYQKKYDRRTDFWPAYRLPRAMTVKDVPSRFQELYLSGGRLEDIRNYSFTRRDSIEIASHRYFRKAIAENEYNRDHQDLIRDRIIRFPYADSAMVNQTADPSEDFSYLYMYRIPVREGMKKLYITLRGNVLATDHSVWSLPPADTLTFVIASVADLADATLARRFDIAGDSVNHLTPEREEYAQGLEALSNREYQRALGILEKYPDYNTAVALTCLGYHAKSEDLLKQLPQTAAVEYLRAIVNVRLEDYQAAAELLLEACRKDTKYVYRTEMDSDIAALLPRFMGLKEELERIASEE

SEQ ID NO: 7884 - protein, 189 aa, B.fragilis
IIVMAFKRSVFLFLLVVSSTFLGVEIARGQVYSLQTNVLGWGTTNMNLEFGLKFSHRWTFHFPLQYNPFSFGDARLRNLSASPGVRYWIRESYGRSYFLGIHGVSTMYNVGGVFGDKYRYEGYGFGGGLSLGYNRPLSPHWNLEFEAGLGVLWTHYDKYVCKACGQKVATFKGARLIPTKLAVNIVYLF

SEQ ID NO: 7885 - protein, 392 aa, B.fragilis
LHKMSLLKKKYMRCVKGIYIFFLLLSFISCELEDKIGRYTSGDNPVEVELMTRNVTLGGSESGVTLKRLRVIAVAKNSGKVEMNRRADLSDPSSSGLEHTGGVFKLYLRPGDYDLFVIGNETTGMNSALTGEPSLSEIKSVPVTLPVDTAEFVVCKHLDIRIRNAASSTPVTGEVSVDEGLTWNSAFSVELERIASKASLEIRKNTDEDIKIRQVTVKQLPSFSFLSPSAYPLSGGLTVTDTRSFSTPVSIAGEKDVPSGYPYTSVVQGKNSFILPEYIWDNTAGKGRASFMEIEAERNGASETWQILLGKSTDIPADYSLGRNTYYRYMLTVNPLNVDVNVSVEPWQNTTAYDTIPGAKIVFSRVNVGYSYASESVVTFTTKNLPPVSVSL

SEQ ID NO: 7886 - protein, 90 aa, B.fragilis
YMIFVGKKNSTSFFLLISLILGLALYTALFSSCVYEDLSKCSRMFMLQPRYLLHTGEGDRFGEAVHHIDVYAFDSLGIYRQKCFGTKEHI

SEQ ID NO: 7887 - protein, 66 aa, B.fragilis
SGYSGIYRIETMRFPSLIIEKASYSFAHIIGGLVVFIKTECGVILDFDSTPFLQDAIMQNRIFPPR

SEQ ID NO: 7888 - protein, 443 aa, B.fragilis
SLVKPIDSMIKLYFKQAWQLLKQNPLFSSVYVLGTGLGIAMTMSLVIIYYIKMAPVYPEENRNRILVSKGMTAIEQGNENNWFSSNVSFQTVKRFYYPLKSAEAVGCSLDGHTTSLLELSESKDLKEVQVKLVDAGFWKVFSFAFVDGKPFTRADFDSGLRKAVISVTLARRLYGDNAPVGRTFVLDSDEYQVCGVVKDVSFITPATYADIWLPLTVDAEVVEEKEGSYELIGNLSVYMLAPSVGSKDKVAGEVRDAFRKYNFSQKKYKVDLYGQPVSYWKSTFYEYCNSAPDWGKLIRTYGTILLALLFVPALNLAGMIASRMKRQLSEMGIRKAFGASKASLLMQVFWENLFLTGLGGLLGLLLSYLIVYCGRNWLPDLLSAYSDVIPEGVDSFLTPGMLLNPVVIGITFLVSLILNVLSALIPALHALKKDIVYSLNDKR

SEQ ID NO: 7889 - protein, 425 aa, B.fragilis
IAMNLMMILRQLWNQRAANGWILGELVVVTYFLWGVVDPVYVLLSDKALPDNYDLTDTYLLSIGAYSANHTRYNPELDSDSLKQVDFMRIVDQVRRYPGVSDVTVSFFNSYPQSGTWNGGQLFNDTIFANIQQMTFLSGTDYFGVFRIHDARTGEIPPVLAEGEQGIYLTPDVAEKLFGEKYPQNKWIHWGDSTRKSPLTAVIDPLQIRSISQPGPLVFKATSELIHLPGAARICFRVRDGLASPAFTETFKREMRPRMQIGNYYLASLTDFETVSKHFEYYMGTTGTIRLQIILASFFLLCVFLGMGGTFWLRCNSRREEMGIYMTMGSTRHRLIRQFLLEAWWMVTIAFVIGALAQFQIVYLNGFAFAPDDPNPDYIQNRPVLHFLIVSAISYILILAVSFVATYIPVSKAARMNPADALRDE

SEQ ID NO: 7890 - protein, 113 aa, B.fragilis
LRVKCVGNTVAFDKSTTVTKGCNVSRPYILLYWSTELSLITSSIGHLVVYSVTNVRIFIICSMGEEIKTGIGVKISVIRVVSSAFFLPMYPRLIELLVHQRAVCSFSDTQLSA

SEQ ID NO: 7891 - protein, 304 aa, B.fragilis
TTRCPMEEVIKLNSVDQYNKMYGLETLHPLVTVVDLSKATVFPTHFTLNYGLYALFLKQTKCGDLRYGRQMYDYQEGTVTSFAPGQVVEVKLNDGVRPMSHGILFHPDLIRGTSLGQEIKHYSFFSYASNEALHLSDDEKKIFQDCLDKVQQELSRPIDKHSKRLIARNIELLLDYCMRFYERQFVTRSKVNKDVLMKFEDLLDVYFQSEQSPNEKLPTVKYFADKVNLSSNYFGDLIKKETGKTAQEYIQGKIINIAKERILASEKTVSEIAYELGFQYPQHFTRIFKKVVGCTPTEYRVIQV

SEQ ID NO: 7892 - protein, 429 aa, B.fragilis
NMIRLIMKNLWARRRKNGWLLAELILVSIVTWVIVDPLVVLTHDRNLPEGYRPDHLFLLQLASYPAGSEQFRAEENDTLARKANFERLLNKLKHYEGVKYTTFILNEQYPSALSISNGNTMFDTIPVRTLRLAFIPHTDYFRTMGMEGAEGMTAEQLDNRDFLWTESVLTADISQRLKDGKPLYGRRLGNGDEEDYRVGGVIAPVRYRSYMQPMPIELYVYEEFPDYMYYYIPLIALRIDDHLSEKFFLHHFREWMNKELTVGNYYVKSVQSFSDIQEQHEFSEGITNQYRLNLALGIFFLVNLCLGVAGTFWMQTRSRREEVGIMLSFGGTPSHITRLLLYEGWILTTLGTLTGCLLYLQYALRDGLYTTCNSAEEAMPAYWINHFGLHFTAVTLIVYLLLLIVVSIGIWMPAHKLSRISPVDALRDE

SEQ ID NO: 7893 - protein, 427 aa, B.fragilis
KELMIKQYFKQSLVLLQQNKLLSVIAIIGTALAIAMIMCIVLIYQARTANYEPEINRDRTLSIEMTIAQKIDDKGWNMGNQLSLRTIKECFYPMTTAEAVSAVHYSMTSLAATPDGTREVKCAVSYTDDNFWRVFGFRFLHGKPYGQEFVSGEKKLVVTRSLARRLFGIDNAVGRIISLGFVDYTVCGVVADVSVLAEAAYAEAWAPYTALPDYERSVSEGLQGGYSCYILVPKGADPDVVRTEAQQNVDRMNANQKELKLLLGGAPDTRLMSLARDNPFDDPDTSRLVLIYIVVITILLLVPAINLSGITLSRMRRRMEEIGVRRAFGATRGELLRQVLAENLVVTLMGGVLGLILSYIAVLCMRDWLLNTSMSGYYGVDTQVSAGMVIQPFVFVCALLFCLLMNLLSAGIPAIRVSRTNIVNAIK

SEQ ID NO: 7894 - protein, 224 aa, B.fragilis
TKVMITLTSLSKIYRTNEIETVALENVNLKVDRGEFLSIMGPSGCGKSTLLNIMGLLDAPTAGTIEINGTHTEGMKDKELAAFRNKTLGFVFQSFHLINSLNVMDNVELPLLYRHIASSERRKLAQEVLEKVGLSHRMRHFPTQLSGGQCQRVAIARAIIGNPEIILADEPTGNLDSKMGAEVMELLHRLNKEDGRTIVMVTHNEEQAGQTSRTVRFFDGRQVQ

SEQ ID NO: 7895 - protein, 401 aa, B.fragilis
IEEIMIKHLLKQIWAQRSVNAWLWFELMIVSVCLFYVMDYLYVPGRLYAPPLGFDTEHVYRVKLASIPPGGKEYKPGDTDSLKIEQWFSILSRLRAYPGVEAVSLSIGSHPYNQNSSSGSRGIDTTWVHGYVYNVSPDYFRVFRITDKQGKTESLVQAANQENTWIISAETEREFSAKGTDALGKGVKNWGETEPTHTIRGICNTIRFDDFYPLYPTYIECHSEAALLGRRGNNAEFCVRVRPDADGVDFPSRFRKDMKVQLRVGNFYLLDITSFDDLLENYYRSNGKINDVKTRIAALGFFLLNILMGVIGTFWIRTQQRRSEMGLRLALGSTRANLRSLLIGEGVLLLILATVPAAVISLNLAFMDLLTDTMPVVTVTRFLIVQAMTFVSIVVMIVIGI

SEQ ID NO: 7896 - protein, 215 aa, B.fragilis
SHKVGTYVVYFKVRQKEDMPKLYAEVNELVRKYNTSQKEYTVDIFHQPDPYWQTWFREGNTNEIDWASVIKLYGGALLALLLVPAINLSGMISSRMDDRLAEMGIRKAFGANRKQLLNQVLWENLLLTCIGGLMGLIVSWGLLVLGRNWVFSLFDKYPTVISDGVDVAINPQMLFSPLMFCVTFAFCLILNLLSAWWPTWRSLHKDIIDSLNEKK

SEQ ID NO: 7897 - protein, 81 aa, B.fragilis
CKASKQKDKKFFSGKRCSLLILNNAHLYIMNGIKVGYSSHGTWKKVINRLLYNFEPSDSSFFFIISPVRVVVLVREADYVK

SEQ ID NO: 7898 - protein, 133 aa, B.fragilis
SFHSIMKNTFCVLACFFITIFCQAQSVEEHYYFKNLSIRNGLSQNTVNAILQDRKGFMWLGTKDGLNRYDGLSFRKFKHDAANPRSIGTVLSLRFTKISMVNIWSVLMQEYIFTILRRRLLRNSIARAWRRQG

SEQ ID NO: 7899 - protein, 127 aa, B.fragilis
EARFIISLLMWKELLRIVKHKINHSNKPRLMKRTKENYPSFNLFSIVGTWESINLNPTVIIYRNDNDYLLSIIYVSETTKQASPATYEIQKEGSLYFIAPAPKRVYIDYDPVKDVLNLSSLGDYLRN

SEQ ID NO: 7900 - protein, 107 aa, B.fragilis
SDMSTIELTEWELAIREQLIKAASEGKTLYYSDLVKEKDVSLVRSLGTVLERITRYDIENKQPILASIAVLNSTGLPSEGFFELCDTLDISARLSDLQQSCFEYWKQ

SEQ ID NO: 7901 - protein, 203 aa, B.fragilis
NIQSPTKKYMDKFSYAIGLGIGQNLLGMGAKGIAVDDFAQAIKDVLEGNQTAISHQEAREIVNKYFEELETKMNAANIEQGKAFLEENKKRPNVVTLPSGLQYEVITEGTGKKAQATDQVKCHYEGTLIDGTLFDSSIKRGQPAVFGVNQVIPGWVEALQLMPEGSKWKLFIPSELAYGAQGAGEMIPPHSTLVFEVELIEVL

SEQ ID NO: 7902 - protein, 499 aa, B.fragilis
LKKSIAFALLLRMFYLCTTLYFKQFTFMSTELFSTLPYKVADITLADFGRKEIDLAEKEMPGLMALREKYGESKPLKGARIMGSLHMTIQTAVLIETLVALGAEVRWCSCNIYSTQDHAAAAIAASGVAVFAWKGETLADYWWCTLQALNFEGGKGPTVIVDDGGDATMMIHVGYEAENNAAVLDKEVHAEDEIELNAILKKVLAEDKERWHRVAAEVRGVSEETTTGVHRLYQMQEEGKLLFPAFNVNDSVTKSKFDNLYGCRESLADGIKRATDVMIAGKVVVVCGYGDVGKGCSHSMRSYGARVLVTEVDPICALQAAMEGFEVVTMEDACKEGNIFVTTTGNIDIIRIDHMEQMKDQAIVCNIGHFDNEIQVDALKHYPGIKRVNIKPQVDRYYFPDGHSIILLADGRLVNLGCATGHPSFVMSNSFTNQTLAQIELFNKKYDINVYRLPKHLDEEVARLHLEKIGVKLTKLTPEQAAYIGVSVDGPYKADHYRY

SEQ ID NO: 7903 - protein, 120 aa, B.fragilis
KIFPAIHCGIKDNAYLCTLKETFYRSIILLIMYLDAAKKQEIFSKYGKSNTDTGSAEAQIALFSYRITHLTEHMKLNRKDYSTERALTMLVGKRRALLDYLKAKDITRYRDIIKELGLRK

SEQ ID NO: 7904 - protein, 532 aa, B.fragilis
KSVLSVVKLKPNELETNPRMNQKIIYSSALLVGLGSPQAFAHKEKAHTPQKPNIIFIMCDDMGYGDLGCYGQPYISTPNIDNMAREGMRFTQAYAGSPVSAPSRASLMTGQHTGHCEVRGNKEYWTQASTVMYGDNKEFSVVGQHPYDPEHVILPEIMKDNGYTTGMFGKWAGGYEGSASTPDKRGIDEYYGYICQFQAHLYYPNFLNRYSPSLGDTGVVRVVMEENIKYPMYGPDYHKRTQYSADLIHQKAMEWIEKQDGEQPFFGIFTYTLPHAELVQPEDSILNHYKTQFADDKAFGGQKGSRYNAITHVHAQFAGMITRLDYYVGEVLKKLEEKGFDENTIVIFTSDNGPHEEGGADPTFFGRDGKLRGLKRQCYEGGIRVPFIVRWPGQVAAGTVNDHQCAFYDVMPTLCDLTGVKNFTKKYVNKKKEADYFDGISFAPTILGKKNQKKHDFLYWEFNETNQIGVRMGDWKMVVKKGTPFLYNLATDIHEDHNVAAENPDIVKKMVGIIHQQHTENPNFKVTLPPTM

SEQ ID NO: 7905 - protein, 60 aa, B.fragilis
STSTPFNGLFRQSAALSLLRLHITPTGSTGILTCSAIGLTVRLSLRTRLTLIRLALIRKP

SEQ ID NO: 7906 - protein, 452 aa, B.fragilis
FYFTFNYKIMSSNSTNIDPAILTSILGEKRASEKYAKLGIKYNPFPRSGTTNINGNDIYNRFMIPIDPVVLGQLNMFISNSLANNEIDNTDKFISATVLGNYGSGKTQLLMYTRFLLNMIATSSDYEATPYVIYIDNPGVSLLEFIGNIIARIGEENLRKYLWNNIINVIDNEYEYKNILLPYVNNTILLFDTENKDPFAAENRVSYKQFLTVFTQNITTTDKRKKFDLEFRNLLLKVLDYYTKDSVVSYYFYEFISGDYGVNKTWEALTSGSLKQLKGKEARVIKYIVKLVKEQGFSDFFILVDEFEDITEGRLTKSQIDNYVYNLRTLLDEQREWCLMFTMTPLALKKLRSVSPPLADRISSREIWLQDLNTEQAISIVKNYMTIVEHDSLLPFTEDGIAYLVDIVDGNIRRFLKMCFRLIEEAALTFTSPDNKINKAFIESQNLLEQES

SEQ ID NO: 7907 - protein, 113 aa, B.fragilis
PHTTTTLPAIITSVARLMPSANDSRQPYRLSNLDLVTESFTLKAGNNNLPSSCIWYRRCTPVVVSSETPRTSAATRCQRSLSSASTFFSIAFNSISSSACTSLSNTAALFSAS

SEQ ID NO: 7908 - protein, 78 aa, B.fragilis
VRSTSVPFKSSIITEFFFTTVSVSDDEMIPTSVTTPIMNKTMPDNTMPVTVASVNLKKSFIVHIVFMPALLKLTKINN

SEQ ID NO: 7909 - protein, 329 aa, B.fragilis
IYRTMHIDFAPPSKGTYNNAGSSRQLASYMEHEDLERMEKGIYTDGFFNLVDDNIYKSMVIKDIDSNIGQLLKTDAKFYATHVSPSEKELRAMGSTEKEQAEAMKRYIREVFIPEYAKNFNKELSASDIKFYGKIHFDRNRSDNGLNMHCHLIISRKDQANKKKLSPLTNHKNTKNGVIKGGFARVNLFQQAEQGFDKLFGYDRQQSESFDYHNTMKNGSISEQTKLQEQDIQSSDRKAGINQGSNQENLLSINLVNKRINNQASSIDTHIVIKQKDNAYSTSSFNQETNQIFGSFISSAAQDIRSSSNHEDQTLKSKKKKKKERINKL

SEQ ID NO: 7910 - protein, 64 aa, B.fragilis
LQMTCLFDTTSKNYWTSFPNGFSSSYNSPILCIEFNEEYGVIIQIIHLIYKEFLRKSLSLHVPK

SEQ ID NO: 7911 - protein, 682 aa, B.fragilis
NEKTLMKMILKTMVCLAVAFSGTAGAANYSPEKSQASLALKVPGNPAVEYPLTLSKLSDSYFDYEWKAKEKIPVTIFQQISTVDDKQQVTVVLTAMEDVYFNFEERIRTDFRHDDCQFYLPGFWYRRNLRSPKEAPSFHTSDSWVVREDRLSTPLTGIFDEKQKKYMTVVRRAEYIQDALSTHKEGEVILSGTTSLGFTGFENLDGTAALAFGFPYKEAPKTYIRKLTLAPSVTAFQLLKKGESISLTWEIHEGKGEDFAEFVSHTWEYCYDTFQPKPVETDYTPDYTKEILSHFFIESFVGDRPLNYNSGVHMRTDDCQNTGSAEVGFVGRVLLNAFNAWEYGWKNNRADLKENAAKVFDTYLVNGFSPAGFFKEFVDYRTGYEETVFSIRRQSEGIYAIFHYLDFEKRNGRKHPEWEAKVRKMLDVFLQLQNPEGSFPRKFKDDLSIVDKSGGSTPSATLPLVMGYKYFKDKRYLESAKRTAEYLEKELISKSDYFSSTLDANCEDKEASLYAATATYYLALVSQGKEREHYTGLTKKAAYFALSWYYLWDVPFAPGQMLGDIGLKTRGWGNVSVENNHIDVFIFEFASILNWLSKEYSEPRFSQFAEVISTSMRQLLPYEGHLCGVAKCGYYPEVVQHTNWDYGKNGKGYYNDIFAPGWTVASLWELFSPGRAEQFFLI

SEQ ID NO: 7912 - protein, 323 aa, B.fragilis
IRYFKMKTDFIQIASYASKAPSGHNTQPWKFHITDSTITVLPNLNVALPVVDRNNRELFISLGCAVENLCIAASYFGYTTHIIECSIEAIILELTKNDLTIEDPLFHQIEKRQTNRNIYNGNKISNGILQQLQSIPKENGIQFYFTEINTPFANTITQYIMKGNEIQMADIAFKNELLSWMRFNKKQVEATHNGLSYLVFGNPPLPRILARPIVSLFLKPNAQNKSDRKKIDSSSHFVVCTTQRDTIEEWINLGRTLQRFLLKVTEIGIAYAFLNQPCEVAALAFDLREKLPVNKEHPTLIMRIGYAKQIPYSPRKKIETLLV

SEQ ID NO: 7913 - protein, 261 aa, B.fragilis
ICKAFFHVSFERWGVRPVYLKIKASMKNLVVLSGAGMSAESGISTFRDAGGLWDRYPVEQVATPEGYARDPELVTHFYNERRKQLLEVEPNRGHELLAELEKDFRVTIVTQNIDNLHERAGSRHIIHLHGELTKVCSSRDPNNPHYIKELKPEEFEVKIGDLAGDGSQLRPFIVWFGESVPEIETAIDWVEKADVFVIIGTSMNVYPAAGLLNYVPRNAEIYLIDPKPVDVHSSRPIHVIQKGASEGVAELRERLLTTNHA

SEQ ID NO: 7914 - protein, 262 aa, B.fragilis
KYLYCMNKMNVAIIEDEIPAARLLHSMVSGLRPQWELTLIPGSVDEAVAWFDEHPHPDLIFLDIHLADGNAFDFLSAAHPSSVIIFTTAYDQYAIRAFTVNSIDYILKPIDEKRLSDAITKYESLLTNAVPRPEDYLGTLFEALQYKEKRYRTRFLISGVDRFWSLQVADIAYFYSENKVTFAVTRKGQEHILDLSLNKLMEQLDPERFFRANRQVLVCIDAIDHAEPFFNGKIVVTVRPPYKQKITISEEKLSAFKLWLNH

SEQ ID NO: 7915 - protein, 353 aa, B.fragilis
ILPYHKIRYMRTEIATLGEFGLIKHLTEGIKLENESSKYGVGDDAAVLSYPADKQVLVTTDLLMEGVHFDLTYTPLKHLGYKSAVVNFSDIYAMNGTPKQITASLALSKRFSVEDMDEFYSGLRLACQQYKVDIVGGDTTSSLTGFAISITCIGEADKDKVVYRNGAKDTDLICVSGDLGAAYMGLQLLEREKAVFKGEQDAQPDFSGKEYLLERQLKPEARKDIIEKLSAANIVPTSMMDISDGLSSELLHICTQSKAGCRVYEEHIPIDYQTAVMAEEFNMNLTTCAMNGGEDYELLFTVPIADHEKVSEMEGVRLIGHITKPELGCALITRDGQEFELKAQGWNPLQENK

SEQ ID NO: 7916 - protein, 440 aa, B.fragilis
KANYEGGYRINILIFAYIKKIKMDFLHSEIGSAKDNFYSPVHNWYKFTAGFSYKFVEAILEGEKNSQNIVFEPFAGCGTTLVSSQKCGVKAIGNEGQEFMLDIIKAKLYWNIDKTECINSLNYIDSYIKEHLTNFSMEEVHPLLSTLYDNETLKVLYLTRDSLDHISNDKIRLFLKLALSQTMHKVGLYPIAVPYISRTKRMANSGHAFARFQSIVLQMLEDIGPLQNIEQTSEIYLHDSRFENPNIGDSICNYCITSPPYLNNLDYGEVSKVHTHFFGLTENWNDITQKVRKNLVTGATTHYRDIDFDINIFKENDFSKENQLVFDELFTSYIQIMEIAKTRNGKKSFNILMMHYFEDMYYVLKEMRRVLKKGSKAYLILGDSAPYGIYIPTTELLGRIAYSVGFNKYHIYKIRTRGTKWKSLKYRHNIELSENVLVLE

SEQ ID NO: 7917 - protein, 167 aa, B.fragilis
TRILYMKKKNEQWLRYSNRALSGLLMLFGFVSCDNGGGDIPVEYGMPSAKYRVKGKVIDADTQEPVPGIEVVTGAVHTGDGKEWLSYPDTLITDKDGAFATERTEFPSKKYRFIVRDVDGDANGTYSKDSVEVEAGGFTGGSHWYRGETSIDKTIEIKKETAKDNEK

SEQ ID NO: 7918 - protein, 112 aa, B.fragilis
SKMYIDNENFEKWMEKLSKKLTEIGKDLKSLINTDKVLDDNEKILDNQDLAFLLKVSFRTLQRYRVSGLLPFFTIGKKTYYRAGDIRSFVRERADFQAYKQFEKANQLENQP

SEQ ID NO: 7919 - protein, 232 aa, B.fragilis
KKDLSLCLEILSITRKTMNMNKKIMQKGWLYEYEVGEEYRRNYNCELTDVRYVLGEQFDMDKQSALICIGINPSMAMPNFLDPTLKRVQEYAKRSGEYGAWYMLNVYPQRATNPNNMDTDDNYNMEIHLRNLVAIKKMLSTIDNADVWCAWGATISDPKRTYLSDLLFGNENKNIQGIIGLFNGNYHFKAYGATTKGYPKHPLLIGKGAKLKTLNEVELKELSDRITNIIKK

SEQ ID NO: 7920 - protein, 180 aa, B.fragilis
QSIHRKSKFIRTGIIMESWSQTPIKDFKVSFFLDTNILCYLVDSTYPNLNKFINYLGNNPFSDVISSDYVLLEFIGIRKREHYLRAVLKKGEQDGQSVNLSSLLKFHNQYSAPEVDFISIIPQIKESVDHDEEEITTQYNIDFNCKFHIDLFEPTKNICLVSLKSATIIQYTIKGRFMSR

SEQ ID NO: 7921 - protein, 613 aa, B.fragilis
ISTQLFIFVSFKRAGIKTICTMKDFFKFTLATVTGIVLSGIVLFIIGVVTLVGIISSSDTETVVKKNSVMMLDLKGTLVERTQESLEGLLGKFTGETADTYGLDDILASIKKAKENDNIKGIYIQASWLNASYASLQAIRKALDDFKESGKFIVAYSDNYTQGLYYLSSVADKVMLNPKGMIEWRGLASAPIFYKDLLQKLGIEMQVFKVGTYKSAVEPFTATEMSPANRKQVTAFIGSIWNQILDGVSASRKIGKDSLNMYADRMLMFYPSDESVKCRLADTLIYQNDVRDYLKTLVKIDEDDRLPILGLEEMVNIKKNVPKDKSGNILAVYYASGEITDYAGSAASDEGIIGSKMIRDLRKLKEDDDVKAVVLRVNSPGGSAFASEQIWHAVKELKAKKPVIVSMGDYAASGGYYISCAADSIIAEPTTLTGSIGIFGMIPNVKGLTEKIGLTYDVVKTNQFSDFGNLMRPVNSDERALLQMMIGQGYDLFVSRCAEGRHMSKDKIEKIAEGRVWTGEMAKKIGLVDELGGIGKALEIAAQKADLKGYTIISYPAKKDILSTLLDVHPGNYVESQVLKSQLGDYYKDFSLLKNIKERAMIQARVPFELNVK

SEQ ID NO: 7922 - protein, 1178 aa, B.fragilis
SYNQKMKDMRLCFSVCNRRFLTGVIMFMLLYPMSVFAVQGQIAVQGKAMSIKQAIQVIEKNSKYTFFYKAADLSNAKIRDIHCEGSIEEVLNVLFKDSGISYVIKDNEVILKSTPVVVATPQQSNKIVVKGNIRDTLGESVIGATIMEKNNAQNGSISDINGDFSLSVSPGAVIVISYIGYVTQELKAIAGAPLKVVLKDDSRTLDEVVVVGFGSQKKANLTGAVSSIKMDEIIGDRPIMTASDALQGTVPGLLVSNSGNAPGSGKSFQLRGAYSVGIKNSDGSYGANVAPLILIDNVEGSLDMLNPEDIETVTVLKDAASAAIYGARAAGGVVLVTTKRPKEATAFRLNYNNNFGFATATNLPKQASLMDYLQAYQDGGYSDAYWSYGSPSVSKWKEYLTQYRQDPSSIKTVGDGIFADTDGALYYLNEHDPYKNFMETSFQMNHNLSVSGGTDKLRYRMSAGYVSTDGVLITDKDTYERLNINSYISADITKWFTQELTMSYARTNQSQPNSGLGSMFGSNQVSYQPEGNMPSDVCSTISQDLPFNTPRNQVLLANKWKKSYDNPRVFVKSILKPFKGFEAVFEYTFDKNMYDYNFYTGKTQYTDIQGGNNIWNAAKDYLQKEKQFTDYNAFNIYGTYKFDLNKDHHFSVMAGFNQESKYTEGVNVLSYNQAVVEVPALGSGTGDLKATDSYNEYSVRGGFFRVNYNYMDKYLLEVNGRYDGSSKFPKDSRFGFFPSVSLGWNVAQEKFMEVTRNYIDGLKIRASYGVIGNQNVVNYAYFPTMSVSNKYNGWLSGGDYVTAINSLPNLVSTSFTWEKVATTDIGLDLNMFGNRMNVVFDWYQRDTKGMLAPGMQLPAVVGASSPFQNTADMRTRGWELAVNWRDRIGKFNYRVGFNLSDSYSEITKYDDNAASKLLSNFYPGQRLGEIWGYEVDGFYTVDDFVDTNSWKLKDGVASIKGVSPRPGDLKFKNLRDDDKSTNQIDSGDGTLDNPGDQKVIGNSLPKYLYGITLGANYKGFDLNIMMQGTGQRDAWIANNLVFPMYIYSVNDIKYQPLFDGLTDYWRPVDAANGDYTAVNPNAKYPRMYGQNPTVGSNYGRKTDKYLSNAAYFRIKNVTLSYTVPKTWISRIGLNQLKGFVSVENLATFSSLPSGIDPETLSWNYPAFRTVSFGINFTL

SEQ ID NO: 7923 - protein, 656 aa, B.fragilis
THNQELKMKKIYLSLAILAGIGLAGCNDSFLEHAPVTSLTENNAFRSYDNFKSFAWPCYEIFKDNNIANTINGTGQGSCYAGDMNAGYLESRANESGNDYAFGRVQSVASGNGWGFSGTFRRANILLANIDKSEMTDAEKDHWRAVGYFFHSYWYMELINRFGAVPWVNTALNENSPEAYGPRVDREIVADSVLNRLKWAEANIGDFEKQDGANTINRDCIRAAISRFALREATWRKYHGIDGAQKFFDECIRVSRLLMNDYPTLYYGTDGQPAAGYGEMWTTEDLGKVPGVILYMEFVQDIKMANFSALEHMDSHNVEMNQHTVDLYLCKDGKPIATSANYHGDKTPYATFRDRDPRLYHVVMPPYKVKAKVKTKEDPRTWDYTDDPADREYIDIMGPNESCDNPGIGMKRLPGQNWSASLVPSSPNFMGGIGATGFVRSRSGYYFWKNWSNWETNRNGGVTLNTSDKPIFKIEEVLLNYAEAMCETGQFTQAVADESINKLRRRAGVADMKVADIDDSFDPNRGRYYPKGNEQGVLVDPVLWEVRRERIVELMGEGFGFYDIRRWRMAPWFLNRQFKGMWMTKDKFRHGAQFLLNETTGGPDPADGAMTEGYIYLQPDPIKAGEGWQERYYLYEVPTQEIILNPALAPNNPGWE

SEQ ID NO: 7924 - protein, 95 aa, B.fragilis
LQSQRRQHTTSIAGSYTTVTTNAISQTNFMQKEIRLQEFQFFRQRYQCFILTLQNITVYTGQMLGEMNSITRVIFYFSNQRIETIKQKMGIQLTL

SEQ ID NO: 7925 - protein, 66 aa, B.fragilis
KNNHIVLMLLKAVLKNDLIGLIMLRMAFSDFGHILSEKDILNMKIHLYHFYMHQNEKRLYFLFETN

SEQ ID NO: 7926 - protein, 62 aa, B.fragilis
RIDQNYYLAQNLFLSSLLLFLIVIRYICSYGFYLALGKGVLAPVIRGLSPFQCRSAQVLIPF

SEQ ID NO: 7927 - protein, 375 aa, B.fragilis
RMKQLYLFILIVFCCMGCQRNTLRGPIPTIIMHPDSCLKSLDISVMMKDSIEVIKLETTDSCLIGFINKISFTDKHILVSDARVSQKIYLFDKGGKFIRYISNKGTGPGEYSVIGDFTIKGDSVFIQDYYQNKYVIYDMVANEIKDDIPYKTHHSGVVALDNYLYFISNYFTSPIGDYNCWRYDLSTRKTEGYLPFTVDHIANQPAWTINHPCGQIDKLKSFAYYRSNDTIYQIDKLTVSPQCVIHFPNSGDRTSSTEGGHISGIVHLQQSVGYILGTYTEGKGLRYFLIDKRNYSSQMGKLLRFNNLDRKSINNEFFIEDNYLIFWDTMQSLKLWRRYFDKAEFTNPADKQRIQSIIDLSQDDDNPVIFRCRVK

SEQ ID NO: 7928 - protein, 443 aa, B.fragilis
MIMQDLKETNLFPIKTLPEIFRTISESLFLSFGYPLSYTAMAIIAAVATAVGTTVKLQFKQGFEIFGNIYCYFISDPGTCKSHPISWAFRPIDKRHQSMLRGYRKAYEAYLLKTSGNKNKNVVKEPVFEAFIVKDFTPESLLMQLCRSPKGVVAIIDELIGMFKNANRYNSSAFSEFLNEVFSNITIYKTRIGSEPLHCLIPYLTVIGTTQPSMLSEIYSNDKSKNGGMARFIPIFPKDLSIPIWSDKEHDVEIERVYSEMIDKLLDIEVKLNEEGDPTPRTIEFTAEAKEKIIDWQRHYAEKIESEDRGQTYQDAKTKLPIYLLKFSLLNQMMRMIAGESNADAVDITSVNNAIAQIEYIDGEILKVHDFVYSRNILLKMTEQQRKVYALLPNSFCISDVYDLVMAKADFTKDQLKKFVRVRDYFVRASKGHYVKKYEDLSD

SEQ ID NO: 7929 - protein, 1251 aa, B.fragilis
STQHWNSFITSLYEDFNGKHLVGTDAGVYIYYPEKEAFEEFDCQSLEKTRIERSVSMIAGDKQGRVWIAVEAQGMFCYDARQKLLRNYPLSEISSNIKCFTFDSGGTLWLGFYGDGLYYSKDNLATVHPYGSPEDGKREFEGGVITKIVQGNYNCLYIGSVKEGVSELNLTSGQVRNLLAIDESGESIFCRDLLPYSDNELWIGTESGIYIYNLRTAQFIHLRASLYDSYSLSDNAIYALYKDREEGLWIGSYFGGVDYYPRQYTYFAKYYPKNIANSLHGKRVREFCRADDGTLWIGTEDGGLNHFNPKTKEFHFFEPSAGFTNIHGLCMDGSHLWVGTFSKGLRVIDTRTGVVLRTYTEGHTPHSLNDNSIFSICRTSAGEIYLGTLFGLLRYNRTQDSFDCIPELNGKFVYDIKEDSYGNLWLATYANGAYCYDVSARRWKNYVFDAEDERSLPYDKVLSVFEDSYRQIWLTTQGGGFCLFHPDTETFTRYGLKDGLPNDVVYQIVEDDDRFLWLTTNNGLVRFDPKTMEMKVFSTANGLPTNQFNYRSGFKDEAGNIYLGSINGFVAFDPRTFAENRQVPAVAITDFLLFNKEVSVGETDSPLKSSITFSDKVVLTADQNSFSFRIAALSYQAPRMNKLMYKLEGFDEGWLTIGESPLVTYSNLGYGDYVFKVKASNSDGVWNEQETSLHLSILPPFYLSGWAYCFYVLFFMGCLVCVIFYFKRRNYRKQHRQMEMLEQEKEREVYHAKINFFTNVAHEIRTPLTLIKGPLENIILKKEVDSETKEDLYIMKQNTERLLNLTNQLLDFRKTETRGFRLNFTECDVVAVLRETYLRFTSLAKQKGLDFILELPQECFMADVNQEALTKIISNLLNNGVKYASTYLRISLETDEKVFHIRTFNDGEMIPDTMKEEIFKPFVRLDKEDEVTTGTGIGLALSRSLAELHQGSLMMEKGEEVNCFCLTLPVNQDSTITLSAENVSQVEENSCGWEQEETDTKEKKPMILVVEDNPDMLAFIRKQLTTEYSVLTAMNGIEALAVLDNHYVNLVVSDVMMPQMDGFELCKTIKSDLSYSHIPVVLLTAKTNIQSKIEGLELGADAYIEKPFSVEYLLANISSLIHNREKLRQTFAKSPFVAANTMALTKADEEFIWKLNDIIQANLHNPEFSMEDMADALKMSRSSFYRKIKGVLDLSPNEYLRLERLKQAAQLLKEGKSRVNEICYTVGFNSPSYFSKCFLKQFGVLPKDFIG

SEQ ID NO: 7930 - protein, 85 aa, B.fragilis
HRVKACSLDVNKKFFKCKRLVICAQKPDNLQKTLTMLIEERYKDEDTGSDGVNSLSKLELSYSAGVCFFLLKQAKRTIINLEIKK

SEQ ID NO: 7931 - protein, 100 aa, B.fragilis
PIFLTAASRRSLDRVSVPMWGTFLSEPLSIEGLVSRYLTNNLMERIPILYRNPLIIKPCGIIIPSGINLSFERLSPSKGQVGYVLLTRAPVASKESKLSS

SEQ ID NO: 7932 - protein, 567 aa, B.fragilis
FIPKMIKKLYLPLLMALVVALSSCSNKMGALSSDYFTTTPQVLEAVGGKVPVTINGKFPEKYFKKNAVVEVTPVLKWEGGQVKGQPAVFQGEKVEGNDQTISYKMGGNYTMKTTFDYVPEMAKSELYLEFNAKVGKKTIAIPAVKIADGVISTSELINNTLSSANPALGDDAFQRIIKEAHNANIMFLIQQANIRSSELKTAKEFNKEVANVNDAENKKISNIEISAYASPDGGVKLNTGLAENREGNTTKLINKDLKKAKIEVPVDAKYTAQDWEGFQELVSKSNIQDKELILRVLSMYQDPEQRETEIKNISSVYKTLADEILPQLRRSRLTLNYEIIGKSDEEIANLAATDPKQLNVEEILYAATLTNDPAKKADIYTKASQQFPNDYRAFNNLGKLAYQAGDLDKAQSYVKKAESIKSAPEVNMNLGLIALAKGDKAAAESYLGKAAGAKELNETLGNLYVAQGQYERAVNAFGDTKTNSAALAQILAKDYNKAKNTLAGIATPDAYTDYLMAVLGARTNNTSMLTSSLKSAVAKNPALAKKAATDLEFAKYYTNADFMSIVK

SEQ ID NO: 7933 - protein, 246 aa, B.fragilis
QFNKTNMNKMGLTLIYLWLVSLCSCQQELIEYEKGDVKVHIEQGEQWLHDFPLFLGINKKNPPQIAIWLEDTQGNYLSTVYVTHKIATQSWQASGGNRRKEALPHWCYSRGIKYDDELYLPTKKEPLTDGISGATPHGSFDIKLSPTTALKKFVVKIEINHSTDFNEAFPKLAKEGETNYSGGKEGSGQPAIVYTANVDLLSGEKSFEANLIGHSSPDGSSGEINEDTSGLTTALHIVKRITVTIQ

SEQ ID NO: 7934 - protein, 410 aa, B.fragilis
TYNNLNMMTHNIIRHLKSLRQTLSQDKKPIGFFISAGCPLSIEITPPENWPLIPDMKKLSEYVTSILKSSDTTKLSTYDRLISELEKTNKSKENLEDILSFIRSLKDVAQGGGTVRGLTETELEDLETNICKLIVGKIRVNLPNKNTPYHKLAKWISSIDREKPIELFTTNYDLLMEQALEDVGVPYFDGFVGSRQSFFDLRTVEEDLAPRHWTRLWKIHGSINWFQKENKDVFRSDAYKNDTDESSYLIYPSHLKYDQSRKMPFLALSDQLGRFLKQPSAALILCGYSFNDEHINDTIVNAIKSNPTAIVIALMFGNMEDGSIERYPKGVELALKRHNISFWTNDEAIIGTNRGQWIVLDKDVDDPLIQLVEVNSSTNNKTIKFGDFKVFSTFLTSLIGYQEEENKNDK

SEQ ID NO: 7935 - protein, 435 aa, B.fragilis
SRNKSMKMKYLLAACTAFFLVSCSNDDEPQPSPQYGDIVGLNIKDAKYIYTSGSNTRSSSAEYRQIKKDGRDMELSWIDSKGDTIKISGNPKIWNINKKYLMINTGVPINYQPKYDEDGDRLPDSTPLGGYSYLIDKTTEAIYDLAEGLNGENAVTDNKGNIYAVDNSTGAVLFKIHTQDAANLKLELYAKASTSHKTPFVVNNKGICFYDYRYIRPSYGTQQFIISNFISGTEYGNAFVSHDNEDMYITAINSSLEEGKSNLIVSKLKENKEIQSEVMAELSFDGIWQSQMSDGIQVKWNDRRGTMLIHLYRYNESTYEYLLATKTLTKIPVNLGGFFTKDYSTYITTNALYAQKSVNKLDIIALEDYSTKTLDLSGKGIDFRSIYTMEGSDLLYFAGFQYSTSQSVIGTIDIDGNIEISESTPNPITNIIQIN

SEQ ID NO: 7936 - protein, 87 aa, B.fragilis
HSVKMYFEIPQNQFFVPWKQEESKKRRNTLFQEVRESENTVKCYHKDKIPRAFTLRKKPGNLINIRNNTFKKSPPNSVLEEKAVLFP

SEQ ID NO: 7937 - protein, 61 aa, B.fragilis
INVNPILFILVLLNCYFIIVTNREHGKQKNIRLVMFQSFYGENKGFALHNQFSLLMLGVPY

SEQ ID NO: 7938 - protein, 633 aa, B.fragilis
LGTKKKKIKMTSKATYIGDVQNVNGTTVSVTFSPNCISGLTYVNGEGYKIGQVGSFVKIPLGYTDLFGIVSQIGANAVPEAQIESQPHGNRWITIQLIGEGQRSGGFERGISQYPTIGDEVHLVSESDLKHIYGNIDKTNLVNIGHIAGAESIPALIDINKLITRHSAIVGSTGSGKSTTVAGLLDALSNNNKYPASRILIFDIHGEYSKTFKDSANIYKINPEETSEPNIKSLDIPYWAMSFDELISLTLGDIDEKEKAPIGELIIELKKKTFTDSPDKYPDIDINRITVDTPLPFSLKRLWLYLYRLVYSTHNTQSTGQRFCSITENFDIRNTTEAFKLDSEDTPLQLGNAEDIIPPHYLPQQASRIYQSSSTLNIRRPISLLTSKLRDPRYDFVFNPGSWTVDLEGNIEQDLDSLFKMWIGEKNISILDLSGIPNNILNTIIGILLRIIYDAIFWSRKLPQGGKERPLLLVMEEAHNYLNDNFKGVASSIVQRIVKEGRKYGIGAMIVSQRPSEINSTILSQCGTIISLRLSNATDRGHVTGTVTDSLEGLMNMLPILRTGEAIVVGESVKLPMRAQISAPSKERRPDSQDPIVVSENENDKIGWRNETSISDNDYTKMIKAWRKQDPNV

SEQ ID NO: 7939 - protein, 285 aa, B.fragilis
KYYKINKIILTNTLLAMLEKIQETAAFLKGKMHTSPETAIILGTGLGSLANEITEKYEIKYEDIPNFPVSTVEGHSGKLIFGKLGNKEIMAMQGRFHYYEGYSMKEVTFPVRVMRELGIKTLFVSNASGGTNPEFEIGDLMIITDHINYFPEHPLRGKNIPYGPRFPDMSEAYDKELIRKADVIAAEKGIKVQHGIYIGTQGPTFETPAEYKLFHILGADAVGMSTVPEVIVANHCGIKVFGISVVTDLGVEGKIVEVSHEEVQKAADAAQPKMTTIMRELINRA

SEQ ID NO: 7940 - protein, 640 aa, B.fragilis
VTINVFSLWIRHWAVVQFKKDDVAYERDYFMSYPANVMAIRFKADRPGKQNLTFSYSPNPVSTGSMSADGANGLAYTAHLDNNGMQYVVRIHAIAKGGTLSNANGKITVKDADEAVFLVTADTDYKINFDPDFKDPKAYVGVNPAETTRQWMDNAVAMGYDVLFKQHYDDYAALFNRVKLQLNPDAQSANLPTGKRLQNYRKGQPDFYLEELYYQFGRYLLIASSRPGNMPANLQGIWHNNVDGPWRVDYHNNINIQMNYWPACSTNLYECTLPLIDFIRTLVKPGQKTAQAYFGTRGWTASISANIFGFTTPLESEEMAWNFNPMAGPWLATHVWEYYDYTRDKKFLKETGYDLIKSSAQFATDFLWRKPDGTYTAAPSTSPEHGPIDEGTTFVHAVIREILQDAIEASKVLGVDSKERKQWQEVLTHLAPYKVGRYGQLMEWSKDIDDPKDEHRHVNHLFGLHPGHTLSPITTPDLAKAARVVLEHRGDGATGWSMGWKLNQWARLQDGNHAYKLFGNLLKNGTLDNLWDTHPPFQIDGNFGGTAGITEMLLQSHMGFIQLLPALPDAWKDGSISGICAKGNFEVDLSWKNGQLAEATIFSKAGEPCTVRYGDKTLSFKTSKGKVYKLALDADRLVIK

SEQ ID NO: 7941 - protein, 688 aa, B.fragilis
ITINTRNISMEKNFKRTTVTSALPYANGPVHIGHLAGVYVPADIYVRYLRLKKEDVLFIGGSDEHGVPITIRAKKEGITPQDVVDRYHFLIKKSFEEFGISFDVYSRTSSKTHHELASDFFKKLYEKGEFIEKTSEQYYDEEAHQFLADRYITGECPHCHSEGAYGDQCEKCGTSLSPTDLINPKSAISGSKPVMKETKHWYLPLDKHETWLRQWILEEHKEWRPNVYGQCKSWLDMGLQPRAVSRDLDWGIPVPVEGAEGKVLYVWFDAPIGYISNTKELLPDSWETWWKDPETRLVHFIGKDNIVFHCIVFPAMLKAEGSYILPDNVPSNEFLNLEGDKISTSRNWAVWLHEYLEDFPGKQDVLRYVLTANAPETKDNDFTWKDFQARNNNELVAVYGNFVNRAMVLTQKYFEGKVPAAGELTDYDKETLKEFSDVKAEVEKLLNVFKFRDAQKEAMNLARIGNKYLADTEPWKLAKTDMERVGTILNISLQLVANLAIAFEPFLPFSSERLRQMLNMDSFDWAELGRNDLLPAGHQLNKPELLFEKIEDATIEAQVQKLLDTKKANEEANYKAKPIRANIEFDDFMKLDIRVGTVLECQKVPKADKLLQFKIDDGLETRTIVSGIAQHYKPEELVGKQVCFIANLAPRKLKGIVSEGMILSAENNDGSLAVVMPGREVKPGSEVK

SEQ ID NO: 7942 - protein, 67 aa, B.fragilis
SISLLKAELVFVMVRKGHVKVGHAQKSGYNQIEDETAIFIYINSFLLHGLSAKYIARSYSYYYYASG

SEQ ID NO: 7943 - protein, 64 aa, B.fragilis
PPTKLDDIPSECRVVPFGNLRIKGHLHLPEAYRSLSRPSSPPRAKASAMRPYLLSFIARFISFS

SEQ ID NO: 7944 - protein, 62 aa, B.fragilis; identical to SEQ ID NO: 6799

SEQ ID NO: 7945 - protein, 114 aa, B.fragilis
IAQNYKKKKNMKAKFSMIGVLLISLFTVVNIVKSNQKNKRIEDIMLVNVESLAFPESGIGSDMRIATKHVCYLNNEVFDESTGRLEHIPVEGRIGICDGTEGACKSWPCTEVWL

SEQ ID NO: 7946 - protein, 682 aa, B.fragilis
LLKNTKIMKIKMKYIVAQACLVAGASIALTSCNDFLDREPLDQVTPQEYFQTADHLAAYTISKYNSMFSTHSGWNAGTVNNDGGTDNMVVGGYNSTYYEKGIWKVPSNNDNWSNGLSLARYCNYFFEQVLPKYEAGKISGAEDDLKHYIGEMYFMRALIYYNQLRKYGDYPIITEVLPDDEAILIEKSVRQPRNKVARFILEDLDKAIGLMKNQGFMNNNRLNKQCALLIKSRVALYEATFEKYHQGTGRVPGDETWPGKSVHPNFSLDVTAEINFFLDQCMDAASQVADAITLTENTGVFNPLSDSEYSGWNPYFEMFSAEDMSGYSEVLFWKDYLRSGSINISHGAPNYIYSGGNNGMLRSYVQTFLMENGLPWYASNSGFKGDSRIQEEKEGRDQRLQLFLFGEKDKQAPRADGDGTMPEFGEPALFELQEVRDLTGYRIRKCLTYKKDQIISGSDQSTTGCIIYRGVEAYLNYLEAYYLRNGKVDGKAAQYWTAIRKRGGVDTDYEKTIRNTDMSKEVDWAKYSGSTLVDATLFNIRRERRCEFIGEGMRWDDLMRWRAMDQLLTTKYIPEGFNFWDEAYDDYVAMKNDKGEPKYKIVSDGSSTANMSAKELGKYVRPYSIVKANNAVFDGYTFAKAYYLYPVPIRQMELLSPDRSVNNSVLYQNPYWPSKTSEPAIE

SEQ ID NO: 7947 - protein, 321 aa, B.fragilis
HTCLLKILSFWGLCGYFFVYLASGFVACVKCLLLMRAIFIFVCILLFVSCQNSDKSRIAHMIDEWDGKEIIYPDDLVFTTMGEDTVKWFLKDSRYTIVTYADSIGCMGCKLKLPAWKDFISYLDSVSDHTVKVIFILHPRDKKEMVHLLEYNDFSYPVCLDIKGSFDKINKIPSNLAFQTFLLDNRNKVIAIGNPIHNPNVRTLYLNLILSDSICESRDLIQTKISLPETIDMGVFDWSEEKEAMLIIKNLGVVSLTVENIVTSCGCTSVEYSRRPVSLKDSLVIKIKYKAESPGYFNKDIAIYCNVPSSPVYVKLSGKAQ

SEQ ID NO: 7948 - protein, 349 aa, B.fragilis
IIRKRTCIGIGMDEISIIQSNHIPLSFLTGKDAYSLYNKGWGYSFVYSLQEVRDIYLAIQKYKYINLGQFTDEYVIPHIPNVGVAWNKRRVLEILNALVNFGLLTPQYELTNTVHLFEDYQIGKPIDDNDNKIFRRIFFSYHRFRDFSSLYLPIDNNYSNIEEVLLNNSMPLFSFGSERKYTDSFFKTFKDNPDIYYIPEYNKDNEKNSGCKMFWDVFISWGVQLKVMEKFNSSIFNYKLSNGKTFSCSYFLSSDNLLMPSLIDFIKNNYPERKNIDLSLLIFTLCTIFRKSLSSTKDYIIEEYKRNKEYISLVRTSEVFIKSGKFAENSTVIYPKYKDSFISHLIIRL

SEQ ID NO: 7949 - protein, 357 aa, B.fragilis
RMRKIGLLFITIFCLLACKNNSSRISLEGEIKGLTNDTLYLYGTDALYDRIDTIYAEKGKFSYNLNIDSTVIDTLTTAVLLINGHVEYPVFLDKGNQITIKGNIDDLSYLDINGNEPNTSLSLFMKEQRGLGSASDKMMQEKAETFIRQHNSSLASVYLLDKYFVQTPQPDYIKIKEITEAMTGALLDRPYIENISDYIDQLEKVTVGKSAPYFSLPNEKGEKLSRSAERFRNRYLLLNFWASWCDPQPETNAELKRLNKEYKKNKNFVMLGISLDIDREAWETAIKKDTLSWDQVCDFTGLSSETAKQYAILTLPTNILLSPTGKILARDIQGEALTDKLKELLKTEEKKPGKSIR

SEQ ID NO: 7950 - protein, 98 aa, B.fragilis
IVGKSSCSSVASRLNIRSKTISCTSSGRQFGLSTLLITTIGFNPISKAFCSTKRVCGIGPSKASTNRMHPSAMLSTRSTSPPKSLCPGVSIILILVPL

SEQ ID NO: 7951 - protein, 105 aa, B.fragilis
KDMKQEYLIELVNCSTEDSIMLQVNETDTSVKAMKSWIMQQETIQPCKKHHLHIIGNKTCDLELEDVYTLCKIIQAVVAEPLSWDIIERVLSEKDSNLVASLLLY

SEQ ID NO: 7952 - protein, 185 aa, B.fragilis
RLMNEKEAIIKLKTCNDKAAFAFLYRSYWAKVYNFTRLYITSAVDVEEIVQEVFIKIWENREALDEEQNFAGYLFITMRNLVFNRSRKNLNEPFYQLSVIEAVEESYDIEEELDAANLRTHISALISMLPPRQQEVFRLSRDEELSYREIAERLQISERTVEHHISDALKFLRKNIKLYLLFLSL

SEQ ID NO: 7953 - protein, 209 aa, B.fragilis
EIMKLNYLLILIICVLLLCFNLYIFKQNSASDRMQDTIIRLAYEDSIKESSHRIEREIRNYELRTNGKVMNPLFEVFDTNGDKRTLSKIIDGNKFVLRYSELNCNTCVNKQIELLNLYVDSIGVDHIILLTNYDSNFYMKQFKRISKIKYPIFNIGANLNECIPDIERPYFFIIDSNFRINSVYVPQIDESNVTKTYFHRILQYYFDIP

SEQ ID NO: 7954 - protein, 291 aa, B.fragilis
SKMKKVSILAAVAMATGLASCTAQAPKATLKTDVDSLSYAIGISQTQGLKDYLSQRMEMDTTYMADFLKGVNDAANKTSKKDQAYLLGLQIGSQMAGPQAIKGMNHQLFADDSTMTVNKGDILAGVFAGVLNKDMKMRPEEAQVLIQKMMESIKGKAAEKKYADNKAAGEKFLAENKTKEGVKTTASGLQYKVITEGKGEIPNDTCKVKVNYRGKLIDGTEFESTYERKEPFVTNVGGVIKGWTEALKMMPVGSKWELYIPQELAYGSRDMGQIKPFSTLIFEIELLDIEK

SEQ ID NO: 7955 - protein, 504 aa, B.fragilis
RKMKIKILFFICIVLSSIDITNAQNIVTKKTYWDWGNSRLHEIFTVIAGTGTRHGSYKEYDKNGMLLISANYNHGALHGLCVGYFGTPQNYISKSTNYLNGEKNGVEKNYNLGSSGHYLIEECVYKKDEMIEKTSYYTDVKYKGRKKSHAKLVDDKQFNTNWYQNGQIEYEGVLQVTPGNYGNVTTPIQYTRYSEAGALMEKLNDNIISFYAEDGKTITQKENLSTDVIEYYDNGTLTKSIKILKEDGDEYYEVSLYKNNSIYSKKVVDRNGNDAELIKKEKQLALQYDSLYNRLKEMLHSNVSMNITKMVFANPDRVYCRKGQYESSGKFSALEAIIRTHEKELDDVVRQRNEYTERGFKRNDGKYYKSVEQIKEYIDKISQNFMQKYDTLSVMKKIAEQINDDLYYIECSYTYYTGQQGYKDNVPGKHKNAYKAYISTTEYLTSNMEGKNLSETLTMLQQYATISSKMRKWYNMKITPIEKLFKKTEIPETQLNIFMNNDVE

SEQ ID NO: 7956 - protein, 466 aa, B.fragilis
FLMKHFTGILFLLLLCFSCTPVHDAPLEQALTLAGDNRKELQQVLGHYEGDSLKHKAACFLIENMIGKGTIRYLLRESDSCYIRQEPEPDLTCITADYLIENIDLAFEVWQKYPWCKQLSFREFCRNILPYRLKQEPLDRWRSYYYTRYKMTVDSLARAGATMREIVFFFNSRHGKKYLHDAAKIPGDFSIELIEKLGGGTCDHLALNAVQLMRAVGIPLNLDILPYHGKVNGGHAYNSFTDENGKFFYFSPYEREPERNQWIAPLIQRVCYERQPEPKIGRNRWNAQLVNRLLKEVTAEYYLSDSVRLPVHTSDTVAYIATFNRGAFKVVSQGRVESNSVLHRVLPYGLLYFQMADKKGKLVPTGSPFVMTPDSIHFITPIRQTTVLNGILTYDVKRVLELGDEAYTLYYWKDGWQPVKEVTSKDSRTLDFGEVPVRSLFLVCGNTYMGRMQRPFLLEDGKPVYY

SEQ ID NO: 7957 - protein, 119 aa, B.fragilis
TYKNMNNKNIFTQNCVKYSLKNATQEFSLIRLRMTIGGVRFSYCLPVEYKIKSSFWDKEAGKAIEDAKRNTELKGNPMLQVALRNINKEIEKTTNTLIKQKPGYNPDSQPDKRRVDKGT

SEQ ID NO: 7958 - protein, 370 aa, B.fragilis
NINLKTNIMRKALLTVISFTLCLYITSCSQSSKPEKARTIETIATDAQQTLSFNHEPLSIDPIGIGDIIVTDTFLILALNKEENMLHVYNLPHLQFLGSFQKIGNGPDEVILPSAFTQWFNKDGQIQLVMRSYQKFTGLLNISKSLIENKAIYDNKYTYNAPKGKNSFQQSSVSYLLGDSIFLINRSIIMRPQDNQNDFFEVYDYKNDSILRSFYASNFPKELLEHHGRDQAFQKDIAISNDCKKMVIAYRFLNMISIVNIEKEEINNLFTDGNKLNWEQVIEGTPKPYYTKVHCNNAYIWAMAIEGEDPSTFRSRLDIFDWKGNYLCKAHLDKWVSSFSIDERNQTMYAVTADDMLVRYNIKELLDQLP

SEQ ID NO: 7959 - protein, 355 aa, B.fragilis
IVYDNYPKYDSFVRMKWNVLLYGLLFSGLGIFSYLLLVNYTELTPKVADVLYSKGAFVFFITAFNVLGYSTLRISSWINTQYALNIRHRWKIIVIYVAVILLFLLLNYSLLIAAKLLAGIDNLFTFSNGGWRILIVVWLVELVIVGLLLANRSIQNNLKLQQEAAKLQTENDTARYAALQSQLNPHFLFNSLNTLIAEIEYNPGNAVHFTKHLSSVYRYVLQCQDKTLVTLTEELEFLQSYLFLHKVRLGDCISCNCCIASGYTSCMLPPLTLQLLAENVINHNSITLSKPMKIDIRLEEGYLAVSNPIQPKKSHESPGVGLKNLSNRCQLMLGKEIIVHNDEKVFIVKVPLLYE

SEQ ID NO: 7960 - protein, 380 aa, B.fragilis
RLNECRFKRHLSKRKYQKGRIQIFKTVNTIFYTSMNTIKIDQQLKRIQIKEFEIENEIVFNFFNRISASERDDKLVQAIYIGILALMEDRFSSFLSKTSNELGAELESLKMIFDMKKEVFYKSSIKGILAENDIAEFLIDHFKDKKISDEVFLTGNIAGKLSKNKTGDIVCCIEGKEEQKIVIECKFDKSIRLGDIESKDIFTRKTDTAWSQLLEAQVNREAQVGIIVLDISLVDNSVFKKYENIGYIPNVGFIAIIDSQKGDYSNLSIAYFLARDIILNSHKVEFNKDILTIIVGRIIKDINEIKTIKSCVINNIENNKIILRQLEKSMLLMEFNQEYLIKFLKDGTLTKEDLLEFYQGETIKERYKIIEKEIDNEFSS

SEQ ID NO: 7961 - protein, 384 aa, B.fragilis
TECEIANCMEENSIKIHKWLYPASWLYGAGVALRNKLFDWGKLQSKSFNVPIICIGNIAVGGTGKTPHTEYLIKLLHDEFQVAVLSRGYKRHTKGFVLSTAESDARSIGDEPYQIQSKFSDIRVAVDEDRCHGIERLLTLKEPPVEVILLDDAFQHRYVKAGLNILLTDYHRLFCDDTLMPAGRLRESAQGKNRAQIVIVTKCPPDIKPIDYNIITKRLNLFPYQQLYFSSFRYGNLRAVFPDCATVQERKLSSLQTEEQILLITGIASPDTIIRELEIHTRNIDLLAFSDHHNFSQRDLAQIKERFGKLRKGQRLIVTTEKDATRLICHQELDEGLKPFIYALPIEVEILQNQQDNFNQHIIGYVRENTRNGSLPERKDAHKS

SEQ ID NO: 7962 - protein, 1087 aa, B.fragilis
CMTEKTNLFPNLIRFRETNRLKMAIAASIMLWCATPQQAAADTYEKHEIASVQQQKVKTTGTVLDQNGEAMIGVSVKVKDNATMGTITDLEGKFSIDAPKGATLEISYIGYKTVTVKAEGTALHITMKEDAEVLDEVVIVGYGSQKKVNVTGAVGMVNSEVLEARPVQNVSQALQGVVPGLNLSVGNSGGALDSSMSINIRGAGTIGDGSGSSPLILIDGIEGDLNSVNPNDIENVSVLKDAASASIYGARAAFGVILVTTKSGKSGKAKVSYNGNVRFSDALCVPEMMDSYQFALYFNRAAENAGDSGPFSQEALDRILAYQAGTLKETMTMNEQTRKWQAYGGANANTDWFKEFYNDWVPSQEHSLSISGGSEKTQYTISGSFLDQNGLLRHGSDNFQRYTMNGKITSQIADWFTVTYSTKWTREDFDRPSYLTGLFFHNIARRWPTNPAYDPNGHPVDGMEIEQLENGGKQINQKDLNTQQLQFIFEPIKNWRINVEGSLRTTNTNEHWDVLPVYAYNADNEPYLISWNGGALGLSQVNEYSYKENYYTTNIYSDYFKQFDSGHYFKVMAGFNSELYKTRYVQAQKSTLISSSVPTINTATEDPKAWGGYAHNAVAGFFGRINYNYKDRYMVEANGRYDGSSRFIGDKRWGFFPSFSAGWNVAQEPFFERIAEKCSIGTLKLRASWGQLGNTDTKDAWYPFYQTMPTGSNYGWLLNGALPNYANNPGIVSMKKTWETIETWDVGLDWGLFNNRLTGSFDYFVRYTYDMIGPAPELAASLGTGVPKINNADMKSYGFELELGWRDRIRDFSYGVKFVLSDSQQKILKYPNEDYNIGTYYRGQKLNNIWGYKTIGIAQSQEEMDAHLAKVDQSALGSKWGAGDIMYADLDGDGKISTGSNKLGDTGDRVILGNSTPRFNYGLTIDASWKGIDFRAFFQGIGKRDYWLQGPYFWGSTGLGQWQAAGFKEHWDFWRPEGDPLGANTNAYYPRVARNGGKNTNVQSRYLQNAAYCRLKNIQIGYTLPKTWTEKAGMSSVRVYVSGDNLLTFSDITGIFDPEAIGSTYDANNGKLYPLQRVISVGLNVNF

SEQ ID NO: 7963 - protein, 638 aa, B.fragilis
ACKDRHYLLSHNELQEIFSIVSLFSNPIFVPLSPNNRYYMQNIRNIAIIAHVDHGKTTLVDKMLLAGNLFRGNQTSGELILDNNDLERERGITILSKNVSINYNGTKINIIDTPGHSDFGGEVERVLNMADGCILLVDAFEGPMPQTRFVLQKALEIGLKPIVVINKVDKPNCRPDEVHEMVFDLMFSLDATEEQLDFPTIYGSAKNNWMSTDWKEQTDSIVPLLDCIVENIPAPEQLEGTPQMLITSLDYSSYTGRIAVGRVHRGTLKEGMNVSLAKRDGSIVKSKIKEVHVFEGLGRVKTTEVSSGDICALVGIDGFEIGDTICDYENPEALPPIAIDEPTMSMLFAINDSPFYGKDGKFVTSRHIHDRLTKELDKNLALRVRKSEEDGKWVVSGRGVLHLSVLIETMRREGYELQVGQPQVIYKEIDGVKCEPIEELTINVPEEYSSKIIDMVTRRKGEMTMMENTGERINLEFDMPSRGIIGLRTNVLTASAGEAIMAHRFKEYQPFKGDIERRTNGSIIAMESGTAFAYAIDKLQDRGKFFIFPQEEVYAGQVVGEHAHEKDLVVNVTKSKKLTNMRASGSDEKARLIPPVQFSLEEALEYIKEDEYVEVTPKAMRMRKVILDETERKRANKS

SEQ ID NO: 7964 - protein, 435 aa, B.fragilis
DKREMMMKKINRWLIFLLCVPTVAFAQQNSLLQKYRSMALDYNHDLKAADKNIAASIELEKAAQKDLRPKLSGEANFQYTGNPLQLNIDLPSMQTPLAFEGRNMKYGASLSLLQPVYTGGRLLESIRMAKHQQSLAIHQADYFRSAVSYQTDMQYWNTVARAEIVRVTTEYRNSVATFSQSIRERVEAGLVDPQDLLMAEVKLNEAEYQLLQAKRNLETGRMALNSLIGVELHAPTEIEDTISAVRADKDLWGEGEIDRPELKMAYARIKIAESSKKLTDAKYKPQFYIGVDGSYSAPGYDFRSDLDPNYAIYAKVSVPLFEWGKRRDEKRASSFKVGMATDYLNQVTDQVKLEVETARVSLSQTMEQVRLTEGSLSKAFENERMALERYTEGKASVIEVIEAQTYRQASQLNHVQAKVSAQGAYSELIRALNKY

SEQ ID NO: 7965 - protein, 358 aa, B.fragilis
DCMEENEDMCPLSGNEISNSMEAKQDTDSLFDRTSECDLSIEEYLHFLRNALHIVDLSMRMKVSQQDIDEFFIEFYLKHENSYKRSEGFAAKLIFGSILPIFANSIFIDINKAKEWERNCEIDIEKYGMASGNGYAQEYYDKNKIIEYKYKSLLKIFSDPEIYAELRKQTLEPIELLLKKNKNMNFEKDKVSSKKDTTLCSILLENSVDVIGKINKRHSKLSAELIGILTLCENEVKLFSSLGKKPQVDNYNSLTARERVILTACRLYNEGFRGLPESRIARVIAMEYGGAEETFRKILKQLNNDNFNCAKLKTLKDLTEVLKKEANESNVRIANEKYKKITEFRIGSLRELMRKTKE

SEQ ID NO: 7966 - protein, 392 aa, B.fragilis
KPVDLQVAAIGTVEKQVLIKQLKSRRRQQKTMKNNSGRLSLRKRLGLEIALKIRNNLRELHPLRQLFWECTLQCNLACKHCGSDCRKMSEQKDMPATDFLQVVDSITPHVNPNEVNIIITGGEPLMRDDLEEVGMALYRKGYPWGIVSNGLYLTRERLDSLMAAGLHAVTISLDGFAEEHNWLRGNPDSYEKALEAIKMLVHEPELTWDVVTCVNRKNYSYLEELKAYLYTIGVRNWRIFTIFPVGRAANHPEFQLTDEEFTGVLEFIKKVRKEGRVHLSYGCEGFLGKYESEVRDHFYSCNAGISVASVLADGSISSCPSIRSNFHQGNIYEDDFMEVWEKRFQVFRNREWARKGECADCSFFRYCEGNGMHLHNDNGDLLFCHQKRIVEL

SEQ ID NO: 7967 - protein, 496 aa, B.fragilis
TLSECPSPTSKEQQWAVARPQFSGSGTSMQVFTGKSGEAHTAGPLLNLHRPAYPESWFNGGKGGFAIRKEADGVIAVAYSGERMLEAGSSITFHFAMIITPVKMLDMKSQFTDRYYHNGPKPTPSQADIEAGVRIINVHQGNDYNPFINYPFLTVDKMKEFTKEWHARGCKIKIYYTLRELSNATAEIWAIRSLGNEILRGGNGEGFPWCREHFVTNYTPQWYEHFDNADKQGITADASILTAEGDSRWYNYYIEGLRWMVQNMDIDGIYLDDVSFDRRILKRMRRAMESVKPGCLIDLHSNTGFSRGPANQYTEFFPYVDKLWFGESFLYDKMTPANWLVESSGIPFGLSGDMLYRGGNAWLGMQYGMTVRYPWYTEGVNCDPRQVWKIWDSFGIAEATMLGFWEEHPAVSTSDEAVKVTVYRKPEKVLLSLGNYSDEVKTVKLNIDWKQIGLNPQKAKLTTPEIPDMQQAHEWNVDTPIVTAPRKGWIIYLTSE

SEQ ID NO: 7968 - protein, 60 aa, B.fragilis
AHGFRDYFTLLFEVLFTFPSQYWFAIGLSGVFSLTGWSRLIHAEFLVLRATQDTTTLRLP

SEQ ID NO: 7969 - protein, 243 aa, B.fragilis
IQHWLDSKKLSTTANLPSRLFACFRQVTYICSRIVTMCKMKGKSITGERDREATEKRLLDTIGKMIAEDGFEKIGINAIATQSGVSKILIYRYFGSVEGLMAAYIRQHDFWINFPLEYPSREKLPAFVKRMFQGQIEQLRNNPTLKRLYRWELSCNNDMIVKLREQREKVGIDLVKKVSELTGHPQKEIAAIASMLTASITYLVMLEDFCPVYNGIPLNENSGWEQINEGIEILINKVFQDEN

SEQ ID NO: 7970 - protein, 106 aa, B.fragilis
LKHCCMNKKELISTIAEKAGLNKSESRKLLNVIIGIVIEEMKKDGKLLLMGFGTFSVKRKPARKGMNPSTFVPIEIPAKKVVIFKPSDCLNSLLKKKRGRKRIVRN

SEQ ID NO: 7971 - protein, 126 aa, B.fragilis
RVSCGTSQVYQPTVCQQNDTVTVREIIAVYLWLDIDTFDTRIMFQCIYLDFIVKMADVANDSLIFHLFHVIDTDDIDITGSSNKDVTFFAGVFHCYYFKTFHGSLQCTDRIDLCNQHPGSVGTHRV

SEQ ID NO: 7972 - protein, 419 aa, B.fragilis
KDRCFVEVNLPFYIARRYLFSKKKHNAINIISAISVCGVALATMAMVCTLSVFNGFQDTVADLFTVFDPELKVTIAEGKVFDAQDPRIQAIRQMPEVDVLTETLEENAMVQYKDRQTMAVIKGVQNNFEQLTAIDSILYGAGEFLLNDSIVDYGVMGIELVSTLGTGIRFVDPLQIYIPKRSGKVNMANPAASFNMDYLYSPGVVFVVNQQKYDGQYILTSLDFARRLLDYTTEVSAIELKLKPGSDLSFVKAKIKKELGDDFVIRNRYEQQEDVFRIMEIEKLVSYLFLTFILVIACFNVIGSLSMLILDKKEDVDTLRKLGANDRLVSRIFLFEGCMISFYGAIIGIVLGLLLCWVQMTYGIISLGGGSAAGNFVVDAYPVSVHLWDVIVIFITVFAVGFLSVWYPVRYLSKRLLKM

SEQ ID NO: 7973 - protein, 64 aa, B.fragilis
ISPCQYVIRPHCVLTYDIWLYSQGRKVMKGRLRDDGMLDDIFVYSRILVKFVRPSFTFLLRGGE

SEQ ID NO: 7974 - protein, 104 aa, B.fragilis
PMEWLNEYHLSGLLIGICTFLIIGLFHPVVVKAEYYWGTKCWWIFLILGIAGVAASLSTDNILVSSLLGVFAFSSFWTIKEVFEQEERVKKGWFPKNPKRTYKF

SEQ ID NO: 7975 - protein, 486 aa, B.fragilis
IMLLKQTKIVASISDRRCDVDFIKELFDAGMNVVRMNTAHASREGFEALIANVRAVSNRIAILMDTKGPEVRTTANADPILYQIGEKVKIVGDPDRETTRECIAVSYPNFVHDLNVGGTILIDDGDLELRVIDKTTEYLLCEVQNEATLGSRKSVNVPGVRINLPSLTEKDRNNILYAIEKDIDFIAHSFVRNRQDVLDIRGILDAHNSDIRIIAKIENQEGVDNIDEILEVADGVMVARGDLGIEVPQERIPGIQRMLIRKCILAKKPVIVATQMLHTMINNPRPTRAEVTDIANAIYYRTDALMLSGETAYGKYPVEAVKTMTKIAAQAEKDKLEENDIRIPLDENSNDVTAFLAKQAVKATTKLKIRAIITDSYQGRTARNLAAFRGKYPVLAICYKEKTMRHLALSYGVEAIYMPELANGQEYYFAALRRLLKEGRLHPTDMVGYLSSGKAGTQTSFLEINVVEDALKHAGDSVLPNSNRYL

SEQ ID NO: 7976 - protein, 403 aa, B.fragilis
LFMLMKTRMIYHSLAICCLLPAFAFTTGENDPFIKSPTVAKLTNTPNGPLISCDLKALKDTVNFPLSQLTEELQIVKLDNRDEALIGGWIRTTVGEKYILVSNNKQTPYKLFDRTGKFITNIGSYGQGPNEYLNTYAEQLDEANNRIYILPWQSSKILVFDLKGNALDPIPLCLRVPKGKFRVNTAKSEVTVTVLPFPKWPAVVWTQDLKGKRKNFVAPGSLAMPQDFSNEVSMGNNTAAYDVMLMKIMPQPSVDTLYHYNAASNKLEGRFTVKYPSNDKIPWHAYYEIPKYFIGDVSFPIQIDESTFSGSKPAYYMVDKKTLHGNYVRLYNDFISTPSQTIYPSFNNGYYVTNMEPMALKEILEKEVNKKGLTADKKKKVQNLIKTLNDNDNNIVMFAKLKQ

SEQ ID NO: 7977 - protein, 194 aa, B.fragilis
RYIRAYNSFTHCKTHNCNDPMKKIILLIIASYTVAMATAQKKEHFTFATSVGTGIDMSEPAATPFSLQVLGYYAINKRFSVGVGTGLSIYEKVLIPLFADAKFLIIKPRKFTPYIECGVGYSFAPNKNANGGFYLNPSAGVEYSICKSKKLFLALGYESQKLERLKTQKQSLFTAEFTEKLSHNAISIKIGFMF

SEQ ID NO: 7978 - protein, 76 aa, B.fragilis
AFTRKEVSIFLKCPYVPEISPIVVRNISYCYPKRVLAEEFFLPLTIADKALYTDRKAGRRPEKEPFTGRTVIPPSK

SEQ ID NO: 7979 - protein, 514 aa, B.fragilis
KHVLIKVFGAAVQGIEATLITIEVNSSRGCMFYMVGLPDSAVKESHQRILSALQVTGYKMPTSNIVINMAPADIRKEGSSYDLPLAIGMLAAGETISCQKLSRYMMMGELSLDGTIQPIKGALPIAIKAREEGFDGLIVPSQNAREAAVVNNLSVYGVNNIQEVIEFINGKRELTPTIVNTREEFYACQSDFEYDFADVKGQENVKRALEVAAAGGHNLIMVGAPGSGKSMMAKRLPSILPPLSLGESLETTKIHSVAGKLGRNSSLISQRPFRAPHHTISQVAMVGGGSFPQPGEISLAHNGVLFLDELPEFNRSVLEVLRQPLEDRRITISRVKSTIDYPASFMLVASMNPCPCGYYNHPTKPCVCNPGQVQKYLNKISGPLLDRIDIQIEIVPVPFEKISDRQQGESSAAIRQRVIKARQKQEERFSGYPGTYCNAQMTSKQLSSFAQPDTKGLLLLKNAMERLNLSARAYDRILKVSRTIADLEESEQIQPSHLAEAISYRNLDRENWAG

SEQ ID NO: 7980 - protein, 404 aa, B.fragilis
GDIRMKKVVFLGLGYIGLPTAAVAAGHGYEVVGVDVNPSVVETINQGKIHIVEPELDQIVKEVVRTGNLRAVSKPEQADAFFVVVPTPFKQNHRADITYVESATRSVIPYLREGNLFVIESTSPVFTTERMAEVIYKERPELKDKIYIAYCPERVLPGNTLYELVHNDRVIGGVNPESTAKAIEFYSAFVQGKLHPTNARTAEMCKLTENSSRDSQIAFANELSMICDKAGINVWELIELANKHPRVNILQPGCGVGGHCIAVDPWFIVSDYPEQAQIIKRARETNDYKADWCANKVMEACQQFVEKNDREPVVACMGLAFKPNIDDLRESPAKYIASRIVSESRAEVLIVEPNVASHASFHLTDYREAYQKADIVVWLVRHTPFVELPREESKLELDFCGVRK

SEQ ID NO: 7981 - protein, 379 aa, B.fragilis
SLTLMKKPSSTLAPALASLDILRGFDLFLLVFFQPVLWTLAHQLNLPWLNSILFQFDHEVWEGFRFWDLVMPLFLFMTGASMPFSFSKFKDNPDKGPVYRKIIKRFILLFIFGMIVQGNLLGLDPKHLYLYSNTLQAIATGYLIAAIIQLHCNFRWQLMVTALLLLIYWIPMTFLGDFTPEGNFAEKVDRLVLGHFRDGVFWNEDGSWSFSAHYNYTWIWSSLTFGATVMLGAFAGKIMKAGKDNRRKVVQTLLIIGISLIAFSLIWSLQMPIIKRLWTSSMTLFSGGLCFLLMGAFYYRIDYKGHSRGLNWLKIYGMNSITAYILGEVINFRCIAASVSYGLEQYLGGYYQVWLSFANYLIVFLILRIMYRQKIFLKI

SEQ ID NO: 7982 - protein, 222 aa, B.fragilis
SFNSSTTMTDLTILIAVIALALWPIVFLISRILHERNKRAKPSGDTASAETEEVTEEMTTSALIMSILQQLGCQPEVNEENHISFKYQGDDFLVAAEDGLRLIIVWNPWWASISIDNQALPYLKEIINAVNMNSLVTTVYALDEDEKTFGIHSKCHMLFAPEEEEPEKSFTDLLDSFFTTHNTIKENLKQLGNGMPDMEKKERVRIKGFAAYKDNSTELKGE

SEQ ID NO: 7983 - protein, 87 aa, B.fragilis
YKNRPKVKTHLQKHLNNDKFRENLITFGQTNLINKSAWFRKEQEKNDIHTVTSNNYAYEVEKTNPLQTLFRKQNKIRNPKTNYQINV

SEQ ID NO: 7984 - protein, 88 aa, B.fragilis
SLPRAHIDGGVWHLDVGSSHPGAGEGPKGWAVRPLKWHASWVQNVVRQFGLYLSWAYEICVALTLVREDRVGLTSGLPVVPPGALPGI

SEQ ID NO: 7985 - protein, 229 aa, B.fragilis
RVTRIRCNDICNNHFLFNGYYQGFIYSYFYKKVITMPNNSRKTIFTTISIDKETATLVGKICKRYSLKKSEVVKLAFGYIDKAHINPSEAPESVKSELAKINKRQDDIIRFIRHYEEKQLNPMIRVTNSIALRFDAIGKTLETLILSQLEANQERQTAVLKKLSEQFCNHADVINNQSKQINALYQIHQRDYKKLLHLIQLYSELSTCGVMDGKRKENLKAEIVNLINI

SEQ ID NO: 7986 - protein, 110 aa, B.fragilis
TIKSKSMEVVTIEKRTFLYICERFTEFAKRTESLCNTHTQEVENWLDSQEVCLLLGFSKRTLQYYRSSGRLAYSQIGSKIYYKSSDVERIIADSETQNQSLKQATPYEKN

SEQ ID NO: 7987 - protein, 346 aa, B.fragilis
LNKSRDITPTASLIKDELIKALKNKKEEEKPIFPDFISYIDYYMDLCKQGKILNVDGTKLSSATLATYKSTRNILKKYAAARNVTIRIEEVDSEFRNDFINFLYDTKHHNGEYKLNSIGKFIKTIKVFMRHAFDNNVTSNNSVFKKDFVPLKEEANTIYLTESELEALYNLDLPSNQAEVRDCFLISCYTGLRYSDISRLDVKHINVEKNTITIVTYKTRNQVIIPIHRIVRGILKRYGNRPPKPQCNQSTNRMLKKLCEQAGITEIISYTETVGGAHKECTARKCDKVTTHTARRSFATNAYKRNVPTLAIMAITGHKTETSFMKYIRISKEENAQLLQTHEFFV

SEQ ID NO: 7988 - protein, 60 aa, B.fragilis
LWERERSGKERDTLLYYIGEIYRGEGKGDLPRKGEGEVFAGGKGMFRGRISRKELGLGER

SEQ ID NO: 7989 - protein, 104 aa, B.fragilis
VMRSTKWMVGIILFACVLTLIGVTKSVRAKNQLGKLTFLGVESLADGEGGGSDYREATPHDCNYSKDVFLEGADHIINVTVPGKKGICDGTNGTCNSWPCREVK

SEQ ID NO: 7990 - protein, 71 aa, B.fragilis
FILGFVSSSFGFNFTTDNTDFHRLIIYFIDNKIRSSVKICVICGETGSLLFRFNYSHPGLLGASAGFKIIS

SEQ ID NO: 7991 - protein, 370 aa, B.fragilis
FWGGSCVEDVTSKLMRHLWYHPPLRTCSSDTILRAIKELTQENISYTSDQGKTYDFNTADKLNTLLINALVSTGELKEIEEYDVDFDHQFLETEKYDAKPTYKKFLGYRPGVYVIGDKIVYIENSDGNTNVRFHQADTHKRFFALLESQNIRVNRFRADCGSCSKEIVSEIEKHCKHFYIRANRCSSLYNDIFALRGWKTEEINGIQFELNSILVEKWEGKCYRLVIQRQRRNSGDLDLWEGEYTYRCILTNDYKSSTRDIVEFYNLRGGKERIFDDMNNGFGWSRLPKSFMAENTVFLLLTALIHNFYKTIMSRLDTKAFGLKKTSRIKAFVFRFISVPAKWIMTARQYVLNIYTENRAYAKPFKTEFG

SEQ ID NO: 7992 - protein, 111 aa, B.fragilis
CPAGSRSFRPSSAQSKLSMFSIWRKRSELNGRNGSKAIARLATSCRDIFRIVPTRSISVFASFQGSVSARYLFPIRARFMASFCASRNLNTLSSFSTSALTSENSFSVSLS

SEQ ID NO: 7993 - protein, 74 aa, B.fragilis
NIFIMEREPVVSSNIASIGYDENNNILEVEFNNGNVYEYYDVPLHEYEGLMSADSKGTYLNANIKKGGYRYSKL

SEQ ID NO: 7994 - protein, 68 aa, B.fragilis
GKFIGEREKGICRERGKEKCLREEKGCFEEEYRGRNWGWERDKLKNRWGIDGSWTGNQTRTERELNEN

SEQ ID NO: 7995 - protein, 537 aa, B.fragilis
CDAIYNKTDLNRLKSMGHYEHKTKEELLEIVCKLEKKVEGLSSELDSLKKGRFRERYSTRILDALPDMLTVFDHNANIVELASSPTTNHVEGTTSDSIINSNVKDIVPEEAYESVRHNMDKVIHTGKSSTAEHSLMLDGVLHHYENRIFPLDDQYLLCMCRDVSQETEMAKINETQRSEIVRLNSLMNDILNNIPVYLFVKDTGNDFRYLYWNKAFAEHSGISVQRAVGSTDADIFPDKKDAEHFREDDLKVMKLGRIEYLENYTTMSGEVRTVTTMKTVVPSGGQHPYIIGVSWDVTEIKKTEKELIAARIKAEEADRMKSSFLANMSHEIRTPLNAIVGFSKLIIEADNECEKRQYADIVEHNSTVLLNLFNDILDLSALEAGSLELSYHPVRLKDICLQLYELHVKSVKPEVRLVLDEVDSQLCIQGDWERISQVLVNLITNAIKFTSVGEIHFGFQKKADMVQFYMSDTGKGIPAERVATIFQRFGKIDDFVQGTGLGLTICRMLVEKMGGRIWVRSKQGEGTVFYFTLPMAK

SEQ ID NO: 7996 - protein, 146 aa, B.fragilis
KSYISASRGKNALKNSYLHKVLAIINVELELLSLKIKHPESFVSPISPTSESDLYVIPKSKDLGIIGIAEIVIGLSFLGEVVGKDGKPVPLVRLAHGFEVLFNLKFGSIYDKLDAIFMRKPFNLTKTLDALKSAINKEARKRANKH

SEQ ID NO: 7997 - protein, 692 aa, B.fragilis
SYNMQSMITTQLLRPQSIVVVGASNNTHKPGGAILKNLINGGYQGELRAVNPKETEVQGVPSFADAKELPDTDLAILAIPAVLCPEVVETLAAEKQTRAFIILSAGFGEETQEGALLEERILETVNKYGASLIGPNCIGLMNTWHHSVFTQPIPNLNPHGVDLISSSGATAVFILESAVTKGLQFNSVWSVGNAKQIGVEDVLQYMDENFDVRKDSKIKLIYIESIKNPDRLLFHASSLIRKGCKIAAIKAGSSESGSRAASSHTGAIASSDSAVEALFRKAGIVRCYSRGELTTVGCIFTLPELKGKNFAIVTHAGGPGVMLTDALSKGGLNVPKLEGPVAEELKSKLFPGASVGNPIDILATGTPEHLSIAIDYCEEKFENIDAILAIFGTPGLVTMFETYEVLHQKMLTCKKPLFPVLPSVRTAGEEVAFFLEKGHVNFADEVMLGTALSRIINAPKPAVPEIELFGVDVPRIRRIIDSIPQNGYIEPHYVQALLHSAGIPVVEEFVSGNKDEVLAFARRCGFPVVAKVVGPVHKSDVGGVVLNIKGEQHLAFEFDRMMQIPEARAIMVQPMLKGTEMFIGAKYEEKFGHVVLCGLGGIFVEVLKDVSSGLAPLSYEEAYSMIHSLRAYKIIQGTRGQKGVNEDKFAEIIVRLSTLLRFATEIKEMDINPLLATEKEVVAVDARIRIEK

SEQ ID NO: 7998 - protein, 282 aa, B.fragilis
EKDMKKLGIFKYKYVGENVIQSGFTVLDKITYGWKNGELIVIGGRPAMGKTAFGLSLVRNIAIIDRIPTAYFSLEMSSVQFMNRFLLNLSGIERFQSKPYNKKEQAILDDAEKVIDDAPIFLDDTPSLSVQELRTRAFRLVREYQVKLIIIDYLQLMNASGMVFNNRKEEISTITRSLKALAMELNIPIIAFSQLNRGVESREGIEGKRPQLRDLRESGNIEQDADMVCFLHRPEYYKIYQDDKGNDLHGMAEIIVSKNRNGKTGDALLKFSGQFLRFENPT

SEQ ID NO: 7999 - protein, 260 aa, B.fragilis
QEDMHSHPSPKFSVITVTYNAEKVLEDTVQSVISQTYHHVEYIIIDGASKDGTLEIVNRYRDRINQLVSEPDKGLYDAMNKGIALATGDYLCFLNAGDSFHEDDTLQKIVHSINGNELPDILYGETALVDAERHFLRMRRLSAPETLNWKSFKQGMLVCHQAFFPRHTLIEPYDLQYRFSADFDWCIRIMKKARTFHNTHLILIDYLAEGMTTQNHKASLLERFRIMTRHYGLLSTLAYHAWFVVRSLSRNSATPSDAPF

SEQ ID NO: 8000 - protein, 380 aa, B.fragilis
SDRIMKKILLVFGTRPEAIKMAPLVKALQRDTEHFETKVCVTAQHRQMLDQVLEVFDIIPDYDLNIMAPNQDLYDITTKVLLGLRDVLKDFCPDTVLVHGDTTTSMAASLAAFYRQVAVGHVEAGLRTYDMLSPWPEEMNRQVTDRICTYYFAPTGKSKQNLLQENIDAKKIFVTGNTVIDALLMAVDIISKKPGIKEKLHQELRDKGYEVGQREYILVTGHRRENFGEGFLHICKAIRELAALHPEMDIVYPVHLNPNVQKPVYELLSGVDNVYLISPLDYLPFIYAMQHSTLLLTDSGGVQEEAPSLGKPVLVMRNTTERPEAVEAGTVKLVGTDAEAIVSNVTELLRNKELYRRMSETHNPYGDGHACERILSVLTR

SEQ ID NO: 8001 - protein, 1014 aa, B.fragilis
DKLIMKLVKYFLQKRAVTILLLVLVLAGGLFSYFKMGKLEDAPFTIKQALVLTSYPGASPAEVQSQVTDILEEAIQSLGELYYLKTENRAGLSKITVYVKKEIRAEEMQQLWDKLRRKVNDVQDKLPAGAGTSIVNDDFGDVLGVFYGLTGDGHTYRELEDQAKFIKNELLKVKDVAKIEIYGVQTPTIDVLISPSVMAQSGVTTADMMRAFETQNKMVDAGGINAGTNRIRIESTGNFYSLDDIRDLTIVSRTGEHFRLADIAQIEEGYQTPPANQMRINGSPAVGIAISTVPTGNVVDMAEDIKMRIGELSQSMPDGYELISIYDQGYESAVANQGFILNLIISVITVVAILLFFIGFKNGLLIGSGLVFSIFATLIVMMACDIALQRMSLAAIIIAMGMLVDNAIVVSDSALINMERGMRKRVAIMRACSSTALPLLAATVIAILTFLPIYYSPHITGELLSSLVVVIGVSLMFSWVFALTQTPFFIQEFVRRPRPEELKASLFDGKYYHLFRKLLRWVLRHRTMTIASLVVLLLLSAWSFKFIPKVFVPALDKQYFTVDMWLPEGTTIGETDRIAGEISDYIRTHEETEMVSSYIGRTPPRYYLSNISFGPQSNYAQLLVKCKSSKESRALNALLQDSIRLKYPEPLIKVNKFELSPLTEAMIEARFLGPDPAVLDSLAGEAIEIMRRNPKVADARNEWGNMSMVMRPVYDPVKAGALGITKSQMMESVKSISDGTRVGVYRNDEKKVPVLLKSEGANITDARSLGNFSVWNGEHSAPLSQVTERIETTWEWPQMRTYNRQLSMAAMCGVKSGYTMAEVHGEIRREIEAMKLPEGYTFFWDSQYKDQREAMQAIGKFFPLAFLVLVVILVALFGNFRDPVIILCVLPLSIIGVAVGMLLTGFDFGFFPIAGWLGLLGMVIKNVIVLLDEIDVQRREGVVPYTAVIESTVSRTRPVLMAATTTILGMVPLLFDIAFGGMAATIIFGLTFATLLTLFVTPALYAIFYKIKEK

SEQ ID NO: 8002 - protein, 122 aa, B.fragilis
HGTIIYISFVPLIYRCIVNRGFNSNLKKMKNEGIILIKGTELQDLINKAVALAFENVCLADRRKAKTAEKLLSRNEASKALKISLSSLNRRVNDGSIKCYKIGARSFFKESELENLLTFLNK

SEQ ID NO: 8003 - protein, 213 aa, B.fragilis
HPNMKKLYSLLLTALFALPAAHVHATDYTQGLSIWFDTPNTLQGRAIWYGSRPDLWKGESKPESAGDTARNPDANWESQSLPIGNGSIGANIMGSIEAERITFNEKTLWRGGPNTSRGADAYWNVNKQSAHVLKEIRQAFTDGDQKKAEMLTRKNFNSEVPYESNREKPFRFGNFTTMGELYIETGLSTVNMSDYKRILSMDSALGRCTIQER

SEQ ID NO: 8004 - protein, 396 aa, B.fragilis
VMNILIQQTKAFPHRANSFYWFYAQLTEWLTAHGVDSKLYFSYLELADSEFENGLLLPDHYSQFYTPRNIEAICRFIIDKQIDVILDYSHVIPGDTRKYYLEIKKRNPGIKICTMIHNCPSHTTQLKQYELSTLRFKDVHGPKKLFQWMLPQLYISLLKKVVSHQNRSAYDTLDEVVLLSPAYIPEFKKLIGKKDAWKLSAIPNAIKPVHSNIPIEEKDKEIIFVGRMATEKALPKLLKIWGMVQDKLPDWKLTLVGDGPQFGTCRQIIAEKKLKRVCLTGHQMSIPYIDRARILCLTSVIEGLPTVFTEAMSLGVIPIGFDSFNAIYDMIDDGIDGFIIPDNNYEQYAETILRLAQNDTLRCQIAYKAQKRKNRYDIEQVGPLWMETFRKHGLIK

SEQ ID NO: 8005 - protein, 165 aa, B.fragilis
ATSILHKPRNPRLNIQKNSHTSPKKIKFLINTYVNTVFFKIRSKYKLYLQIITFNKNSMKQTLSKAVVTIIIACTALYAWNHKQPVLTNVQLQNLEAIAAGEEGACIRWIEQTCYYSFSEEHDNEPHYECNGSSGQAGMTSCGVINNKKPTFGYVKGTCLICIEH

SEQ ID NO: 8006 - protein, 401 aa, B.fragilis
LCGISIENMQKYLLFLFLFICASCIGSKNGVLEQNKIFDIMIDPDRVTDDLDLSCILTDSIEIIKLNTSDECLIGEIKQVSFTDQFIFVSDPYVSQKIFMFDKNGKFVKNIGRQGGGPGEYSIISKFTITGDSLLIQDYNLHKYLVYSIKEDCFVSDIRYEPHHHSIVAYPDILYFVSGYFPADAGCYNLYRFDLRNSSMESYLPFSQKIAVNRSAWSIEEQCSRVCERSFVFYALSDTIYQVNKDKAIPVYTLNFSKRSIPDDFKESHSGDEIMDLAFQEGYVRGPIHLQHSDRWMLGTYVDGKEYRYMLIDKKTGQYQIGKQLGARKEGNLTIPHNFLIEDNYFISWLPVRLLKLWKNHFSPNTFRDKGRVGKWERLIDSLDIDDNPVLIKCKIRNNET

SEQ ID NO: 8007 - protein, 85 aa, B.fragilis
YSLIIKHFMLMNDLSKTRIIILLTDSSQKVTDTEMQDAYDEFIRCIATIGNSKDNSNIFRMLNLTRIEIAPLKELYQCEQGEKCA

SEQ ID NO: 8008 - protein, 339 aa, B.fragilis
ENTMKVTIYPYSINKSDIRVNPYISDFIHALQQNGITIANPPHKNPLFSLIPRKADSDAYIFHWPENVPDYKYGMLQTLAAIWLLFKIKCHHKKIIWFLHNKQPHVMKHRWSKKLLIHLLLRKADLIVTHATEGIKVVQDQYPKAVAKTVFLHHPTKNRIEEYIPQPPETDLLIWGNISRYKGVPEFVRFATQHSLKLKTKIIGKCSSQELLEELRKESNEMISIEDRSIPFEELKQEIRRSRFVLVPYAAESILSSGILMDSLSFGAKVIGPAVGSFRDYAAEPLLNVYTFHTFDDIQELVDKANEATDIAGYNRFLNAHSWNEFGKKFQNLLQKIIQ

SEQ ID NO: 8009 - protein, 95 aa, B.fragilis; identical to SEQ ID NO: 6800

SEQ ID NO: 8010 - protein, 306 aa, B.fragilis
LLKIITMMTKRDFVPSNSFGQYVSPYRRLDDQIAIFHFLCKFFPADLVQEVLVWLGVMATYRFCCNGKFGALFKFVDYSDTIRRVQEVCLDPETGRILQSGDARAQIANTLRPNATYSCMPEGYKACMIEKELMNSKSEVVYDCKPCFFGQAQCFEHARYDRPYGIVKHVVSAIFLNICGYKDKNSPVWLATGGSELTGCDLSKADILKFFQFKEMILFPGAELYDQSKEIEQQIRLMGMKARTSYFMEKVEYKDKQRGDDISNYIISEINRGVHYKEAYESALDRGALALDWGSAMVDNNRMMKE

SEQ ID NO: 8011 - protein, 99 aa, B.fragilis
PMKIYISGQITGLEEEKAKRYFDKAEEILLEKGYGPVNPMSVNPPMENKSWKDYMIDDLKLLFDCEAIYLIDNWQSSKGARIECYIAKELGMRILENIE

SEQ ID NO: 8012 - protein, 574 aa, B.fragilis
IGKIGPGNVKNKSIMKKSFLIILCLALLSCVTGCKDSTQTLLKKSVEMEGISTDSMLFYLQQIQSPNHLNDKQRAEYCFQLYKATLWKTQKPKDSLLKVCIPLFLHVGDTAQWLQAQLEQANSFFYKDQPDSILHSARELRDKTKYMTPTQQRYYYNIQKFTYFNQKKYPEALKLANKVLALNNPSNDTLSLFYDHRTQLEILRKMGKTDEVIEGYYKMLEWFAPSKEYHYLTYTIAEDIVNYYLGQQDFDKALESVQNLRLYRRNRYDIPYYQLIRGQIFQSLHQLDSAGYYYKQAATSTSPYIAIEATSRLYQLTNATQQPEQAYYLAKTEDILYKDLTSNLKAKETTRKYNEVKLQNELYQLRLTQQEKELWMMGIAVILLLIALLILFFYHQEKKKRLVSERRLQAEQAGEEARRLQHENELLHKEAELSALREKEIIMRNKESEMREALFRHISFFQKLPSLHIENSTDDNPNRKKITVSDAEWCEVKQAVNDAFNNFVDRLQEDYPQLNEKDICFCCLVKINVNIQDLSDIYCVSKAAITKRKYRIKTEKMHISDETLSLDAILQNFG

SEQ ID NO: 8013 - protein, 320 aa, B.fragilis
KKEMKLEEKTKKKDEQGLIIKKYQQYLKLEKSLSKNTLEAYLTDLEKLLSFLSAEGVEILEVSLTDLQRFAAGLHDIGIHARSQARIISGIKSFFHFLIIADYIEADPSELLEGPKIGFKLPEVLTVEEIDRIISTIDLSKNEGQRNRAILETLYSCGLRVSELTGLKLSDLYFDEGFIKVEGKGSKQRLVPISPKAIQEIKLYFLDRNRINIKKDHEDYLFLSRRGTHLSRIMIFHLIKELADMAGITKNISPHTFRHSFATHLLEGGANLRAIQCMLGHESISTTEIYTHIDRNMLRSEIIEHHPRNIKYRQEKKPFR

SEQ ID NO: 8014 - protein, 417 aa, B.fragilis
LERIRQKVSKFTSENNTVMKVLYTFGGMPHYLNAMLNKLHNKGVEITVITPQKGNATIGKGVKMVEGGTYRHLTAIEKKAFYGKSSYPSLPEIVREEKPDILIMGWPYFLQVFFQPRLRKAMKECRTRLVIREIPFQTPPYGKIKEYFHENPMYDENMRLVSTGTGFYLKQWLTAKIRKYCYARITGTLNYSTAAYDILPSYGVKQEQIHVTYNSTDTDALLKEKEAVLTSPPLLPPSSKRALHIGRLVKWKRVDLLIDAFTKVIASHPDAELVVVGDGPELDNLKKQAADLNLTEQVRFIGAVYSPKELGAYMNESTVYVLAGMGGLSINDAMTYGLPVVCSVCDSTERDLVTDGVNGLFFKEGNADSLSDKLNKLFASPERCASMGRESERIIREKINIETVSERYLQAFRTFMQ

SEQ ID NO: 8015 - protein, 174 aa, B.fragilis
TKRIMAKESVKILQGKLDVKSLIDQLNAALSEEWLAYYQYWVGALVVEGAMRADVQGEFEEHAEEERHHAQLIADRIIELEGVPVLDPKKWFELARCKYDSPTAFDSVSLLNQNVSSERCAILRYQEIANFTNGKDYTTCDIAKHILAEEEEHEQDLQDYLTDIARMKESFLKK

SEQ ID NO: 8016 - protein, 203 aa, B.fragilis
IITFYRENTFNIMDTSKIVGEKIKSLRENKGISIEELAERSGLAIEQIERIENNIDLPSLAPLIKIARVLGVRLGTFLDDQDETGPVVSRKMEATDTISFSNNAIHSRKHMQYHSLSKSKADRHMEPFIIDVAPTQDSDFVLSSHEGEEFIMVMEGVMEISYGKSTYLLEEGDSIYYDSIVPHHVHAYEGQAAKILAVIYTPI

SEQ ID NO: 8017 - protein, 89 aa, B.fragilis
CFLMNYASILVKKLTLSRMSQNLYVRLGFLGNQPFFTLSSCSKTSLMVQKEEKANTPNKDETSILSVLNEAATPAIPNIRKIHQHFVPQ

SEQ ID NO: 8018 - protein, 338 aa, B.fragilis
KPMIVMNNFLVFDTIKIVTCGTYLKISDKSVFTTDVDLLDGRTIKSVTFNSQRNRSIVPFELYIHANLLSNKMCIEFSSKILWEDYPKLISSETFAQCLRNIEKTGICTLDIDRIMEDCYVTKLHVTKDIELELTPAILNCLNLCTGNFRRYNWERYKTAILFSKNVKSSNSKEAISIYDKGIEIVQTKNKGFLGLVENADKIVEYFAGKTRFEVKYENMSKIKKELGIKDTSLKSVFGVKKNIVLTQFDKIFTERTISTDVRIETFSEYGIWNIVCNHNGDLKAIEQEIKDLGIYAKGSRAVLGRTMKKIKEIAQIWGNREMKTDVVLEKIRLLLRG

SEQ ID NO: 8019 - protein, 560 aa, B.fragilis
SAMIALHITKNMQLYERTLGQWLEHWAETTPDKEYIVYSDRNLRFTWKQFNKRVDDMAKGLIAIGVERGTHVGIWAANVPDWLTLLYACAKIGAVYVTVNTNYKQAELEYLCENSDMHTLCIVNGEKDSDFVQMTYTMLPELKTCERGHLKSERFPYMKNVIYVGQEKHRGMYNTQEILLLGDNIEDTELNELKSQVDCHDVVNMQYTSGTTGFPKGVMLTHYNISNNGFLTGEHMKFTGNDKLCCCVPLFHCFGVVLATMNCLTHGCTQVMVERFDPLIVLASIHKEKCTALYGVPTMFIAELNHPMFDMFDMSSLRTGIMAGSLCPVELMKQVEEKMYMKVTSVYGLTEAAPGMTATRIDDPFDVRCNTVGRDFEFTEVKVLNPETGEECPVGVQGEMCNRGYNTMKGYYKNPQATAEVIDKNNFLHSGDLGIKDEDGNYRITGRIKDMIIRGGENIYPREIEEFLYKLDGVKDVQVSGIPSKKYGEAVGAFIILHEGVTMQASDVQDFCRNKISRYKIPKYIFFIDEFPMTGSGKIQKFKLKDLGLKLCEEQGIQII

SEQ ID NO: 8020 - protein, 83 aa, B.fragilis
KQKISPDIVISSKSSACVSNHLLRTKFKSRFLSMEETAFIFYLSPLLGYKISLILQQNELNYNLLPGKYIQHYGYKQNRRRKN

SEQ ID NO: 8021 - protein, 348 aa, B.fragilis
DMKISVLLAALLLLFSCTDKDSKQSQDLIVKTAQAVSASGIKTTEFPFIAQPFRTSELSFRVGGPIDRLDVYAGNHYKQGSIIAEIDPRDFHIRKERAEAIYHQAKAEFERIEKLYEKNNVSASTYEKTKADYTTAKTAFDTASNELGDTRLTAPFDGYVGEVYIEKYQDVKPAQPVISFIDINRLKIEIYVTQNIAFASHPTDSVRIYFDAQPDKYYKAQIVEVSKGTTRNNLSYLLTAVLPNKEGKLLAGMSGKAIFDAPGTTDLTGVSIPQTALCYRPSEGEYVWVIDTNTRQVNRRTVKKGNLLPGGYVTITEGLRASETVATSGLRFLSDGMKVEISTKTNSL

SEQ ID NO: 8022 - protein, 95 aa, B.fragilis
PYRMVPADSRRIPRAPRYSGYHYASVTLEYRAITVYGTTFQSFLLNNCLARAWSYNPTHAVTWVVWANPRSLATTRGIIIYFLFLQVLRCFSSLR

SEQ ID NO: 8023 - protein, 96 aa, B.fragilis
DKNLQGFFFLGAQAGAHSDILALLPHIQHFIYRFCYYFCRRNKLYQYAPTQMYISCVLGSDGATTTQQREGAIALLYSTPTLIEQQACHKIAIFFT

SEQ ID NO: 8024 - protein, 143 aa, B.fragilis
QDCVMRIQIINGPNINLLGKREPSIYGSVTFEEYLAELRKKYPDVELGYFQSNVEGEIIDIIQQTGFDVDGIILNAGAYTHTSIALQDAIRSVTSPVIEVHISNVHAREQFRHVSMIACACKGVICGFGLNSYRLALEALLDK

SEQ ID NO: 8025 - protein, 117 aa, B.fragilis
NNYVEKFMETTRQNKISRLLQKELSEIFLLQTKAMPGVLVSVSAVRISPDMSIARVYLSIFPSEKSEEMVKNINNNMKSIRFELGTRVRHQLRIIPELKFFVDDSLDYIEKIDALLK

SEQ ID NO: 8026 - protein, 587 aa, B.fragilis
  UNSURE (498): Identity of amino acid sequences at the above locations are unknown.
QIFFISMRLHVLSLTCLLLTVGGTGPVAAQKPQNYPYGVPSEPWEESFGNHRAVLQIEKPAQIANLDFQWRRPDKDAGHRRFLIIHAATGDTIRNIRRIEVNDEHCRLQFGPVEQKGTYYFYYLPYQVQKGYGFYSGGYLPKENEPDAAWQAQGGSTLKSTRAKVVRVESRQAFDSFYPMEVAATAREKENYINRHKASLYLFAEDRRFPIRMRSNLPTKWLADKQGKLFRGEAAPNEYYTFQIGLWAAVNQADKIAYRASSLKCGREIIPATAITCFNVEGTDPYGKAFKKEVNVPKGEVQALWFGIDIPDGQKEGIYTGTITLSDADGAQSSIPLSIRIAGKALPDRGDSELWRCSRLRWLNSTLGIADTPTAPYTAMTVNENRIGCLGRSITIDEGTGLPAQIRSWNNDVLSSPIEFVIQTAGGVKSLKAVPELTERTEGHVAGNWKAEDEDMTVSCKAIMEFDGWINYIYTITPKKQIQVKDVRLVLPVRNEIXTYFLGMGLPGQPTPQQYDRKWDAPEKTVNTFGVSIPNFQRTTMGCGPSTIFWIGNQHAGIHWQIRGSTYSRSAIESAPSGLSGKLVQRG

SEQ ID NO: 8027 - protein, 458 aa, B.fragilis
ITKVRVYSGLYERRPDTPFIFTNGQERKYNMAEQSLKEKTAKGLFWGGFSNGIQQLLNLLFGIIITRMLDSTDYGMIGMLAIFTAVANSIQESGFTAALANKQTFRHEDYNAVFWFSFLMGASLYLLLFFCAPFIAAFYKTPQLIPLSRFLFLGFLISSCGTAHNAVLFKKLMVKEKAKATITALLCSGTIGIVMAYNGMAFWGLAVQQITYIFIANALLWYFSPWRPTFSFNFKPIREMLPFSSKLLITNVFHYINDNIFSVLLGRFYTSQDVGYYTQANKWTNMGFSLISNMINGVSQPVLVETSSDAMRQKNIFRKMLRFTAFISFPAMFGLALIANEFIVIAVTAKWQACVPIMQILCIWGAFVPITYMYSNLLISKGKSNLFMWNTIAQSLVQLTMLLCTISQGILVMAVIYTVINIGWLLIWHYFVNKQIHITLWEVMKDITPYLLISGGVI

SEQ ID NO: 8028 - protein, 439 aa, B.fragilis
LCTVSHRKPLFLPKHFDRMRVLIINTSERLGGAAVAASRLMESLKNNGIKAKMLVRDKQTDQISVVGLQRNWWQVWRFVWERIVIWKANRFKKNNLFAVDIANTGTDITSLPEFQQADVIHLHWVNQGMLSLNDIRKILKSGKPVVWTMHDMWPCTGICHHARECTNYHQECNHCPYLYGGGSKKDLSNRIFRKKQQLYKEAPITFITCSQWLKGQAEKSALLTGETVISIPNPINTNLFKPRNKKEARSKCHLPQNGKLILFGSAKITDKRKGIDYLIESCKLLAAKHPELKDSLSVVVFGKQSEQLKPLLPFKVYPLNYVSNEHELVDVYNAVDLFVTPSLEENLPNTIMEAMACGVPCIGFNVGGIPEMIDHLHNGYVAQYKSSEDFANGIYWALTDPDYPSLSEQANRKVIANYSEGIIAKRYIDVYNKITGRYA

SEQ ID NO: 8029 - protein, 220 aa, B.fragilis
QPLFIRDEMKETDLLDEYILQHIDEEGEYLKSLYRDTHVKLLRPRMASGHLQGRMLKMFVRMIRPRQILEIGTYSGYSALCLAEGLEEGGMLHTFEINDEQEDFTRPWLENSAYADKIKFYIGDALRLIPALGITFDLAFVDGDKRKYIEYYEMTLAHLSVGGYIIADNTLWDGHVLEEPHSNDHQTIGIKAFNELVAHDERVEKVILPLRDGLTIIRKK

SEQ ID NO: 8030 - protein, 83 aa, B.fragilis
QVLLDIPVSYLFIIKSDRFMWWNYMKVLMFNTLNPNNLFRQRPSGFNLPMIILYIKLDSQNAKIDQKTLIGHLPSFHYDFWRL

SEQ ID NO: 8031 - protein, 101 aa, B.fragilis
CQVFINPMQFGPINDAPYLLTVSRMRSSNKAPSCVSSPNPAERIMKARVCFSAASVSTTSGQRTAGIARIARSVSGNSFASAKEGTPCTSVSLGLTARSSP

SEQ ID NO: 8032 - protein, 329 aa, B.fragilis
LGFLERNIKNMKISNKYDRLVRKLIAGESSSEEMEELAHWNVVETKMKKQFDAAKNIVENGAIERRIWDKIDSRCQAPVERSQKLQLRYWRVALAACITALLIIGGGIFFFDKGHTASQRITEYTEVVSSNSRLYILPDSSKVWIQAGSRLRFSQDFMSNREVWLEGVSTFEVTKRKGHNFKVYIDQAFVEVKGTVFRVQSTCQDGAEVTLFSGKVDFNVKASQRKVEMKPLQQIVFHPEKDEVILKNIGNISWDEGRYKFVDMRMDDLIEAIHDIYHIPVELDRKVARNDLFTGYMRYDDPASKVIEKICINMNLKFKKETQKIIIYK

SEQ ID NO: 8033 - protein, 90 aa, B.fragilis
IFFSSLQVQKQCFMKSEIDLFVINKIKEKRKELKVSQRGMAEILDCSAGFIGQVESENSDTKYSVYQLYLIAKDFNCSPADFFPPFNIKD

SEQ ID NO: 8034 - protein, 832 aa, B.fragilis
MKKFLPDLIAILAFIVISFIYFFPAITEDRILFQHDTVAGAGAGQEAKEYYERTGERTRWTNALFGGMPTYQMSPSYDSTEPLTFVQKVYHLFLPNYVWLTFIMMLGFYILLRAFGIPAWLAGLGGIIWGFSSYFFILIAAGHIWKFITLAYIPPTIAGIVLAYRKKYLLGGIITALFMAMQILSNHVQMTYYFLFVILFMVGAFFEDAWRKKELPQFFKATGVLIVAGLIGVSINLSNLYHTYEYSKETMRGKSELKYEGAAAKQTSSGLNRDYITQWSYGIGETFSLLVPNVKGGASVPLSRSEKAMEKANPMYSSLYSQLTQYFGDQPMTSGPVYVGAFVLMLFILGCFIVKGPMKWALLGATIFSILLSWGKNFMGLTDFFIDYIPMYNKFRAVSSILVIAEFTIPLLAILTLKEILTKPELLKEKLKYIYISFGLTGGLALLFAIAPRLFFPTYIPDNEMAALQNALPADQLSPIIANLEEMRVHLFTSDAWRSFFIVTIGTLLLLAYNAKKLKATWTVAAIALLCLGDMWSVNKRYLYDEQFIPKSEQTATFRKTQTDELILQDPSLDYRVLNFAGNTFEENNTSYWHKSVGGYHAAKLRRYQEMIDHHIAKEMQAAYQEVATAGGQMDSVNAAKFPVLNMLNTKYFIFPAGQQGQTVPIENPYTFGNAWFIDKIQYVNNANEEIDAIGQVDLQQTAIVDSKFKEALKGVNEGYKDSLSTIRLTSYEPNQLVYETSSPQDGIVVFSEIYYPGWTATIDGKPADIARADYILRAMNVPAGKHTIEMRFDPQSLHITEGIAYGAMALLLVGVIILIWIYRKKYSENSK

SEQ ID NO: 8035 - protein, 162 aa, B.fragilis
QLEFTFIIMEKIDNLDRQILEIISQNARIPFKDVAAECGVSRAAIHQRVQRLIDLGVIVGSGYHVNPKSLGYRTCTYVGIKLEKGSMYKAVVAELQKIPEIVECHFTTGPYTMLTKVYARDNEHLMDLLNNKMQEIPGVTATETLISLEQSIKKEIPIHADK

SEQ ID NO: 8036 - protein, 417 aa, B.fragilis
NINSKYMKQLILSCIFVLGFFFLPILVSGADAQENYLFSISGEIDGLMPNDTLSFWKTTLPYKGEEGEVAFNVIVSEPNKFCYSGEQPHTQCYSMIYKPVSGESQASSRQALMIIVEEGDYHLKGETDFIYYSAISGGLYDDPSLKEIVHMEDSLEIIRTRYRKIVDEARKKGDMEKAKEYVDKFNRFHSNHQESYALLQRKTKELVANNPSSTWVIVEYLQKVSYAAPEEMKSVLLNMDQEAQNSYYGQIFRREVEAIERLAPGNEAPLFSVTTTDGKRITSDDTRGKYLLLYHWGLCPGSISVDKRVTVFYEKYKDHLSVVGITDNMETICELNKNVGEDDEVLGMKLKPVLENMLAHPWPEVESTGDNHKIIEDFAFAGLPYFVFISPDGKIISRDFRKAFDKAQEVMKSEFDD

SEQ ID NO: 8037 - protein, 128 aa, B.fragilis
RSISTSTYRSSPRRLNTESSAILKVIYRSPAGPPLMPSPPYPFNLITCPSATPAGIVIRTCLPFTFNTCLWVRAASRRDRCNSALKSCPRKPALPRPPPPLCPNIDSKKSENPPASPPENPSPSDEYQ

SEQ ID NO: 8038 - protein, 635 aa, B.fragilis
TTTTSRVRTMTSGYVKRTLRCSERWGYVENAGLTCNPARSRIHYRFDFGRYLGIDKCQHLETLLPFGTFVVFCVESRRIISIFTVDSSQHAIMTIQLLLVTGVTDCLWLYVLSLLLFLTVCFLLYQNFLLRKSASADDDYRRFLFDILDNLPFPIMVKDIQEQFKYTYWNKESELQSGISRKDAVGFSDVDIFGEERGKQYRKIDEDLVRAGIPYKAEERYVTADGKVHDTLVMKSIISSGKLGKWLLVARWEITQLKMYERELLAAKEQLEGAVCKQKLALRSIDFGLIYIDRNYLVQWEETGNIKNLVSGRHYTPGTVCYRTTGQGTQPCGKCAFREAIGTGKIVRHITHVDHVDFEITATPVYDDTGNEIIGGLLRFEDITEKLKVERMLQEAKEKAEESNRLKSAFLANMSHEIRTPLNAIIGFSDLICQTDDAEEKEEYIRIVTSNNELLLQLIDDILDLSKIEAGTMDFSYAPTDINELMEDICLQMQQKNQRPEVQIMFTEKEPGCVINTDRLRLSQVIMNLMNNAMKFTSEGSITLGYRLTRQKDELYFFVKDTGIGIPADQAGKVFERFVKLNTFIKGTGLGLAICRVIIERLGGTIGVETREGKGSCFWFRLPVREDMLLESPVR

SEQ ID NO: 8039 - protein, 78 aa, B.fragilis
GRTTDRGLGQYTSLFCLTSLNGLLNEETMVKLKDWNSFLRKTLVEVLMGSTPLAQNYQRDSVFRWEGPLYCPVSKGHR

SEQ ID NO: 8040 - protein, 1066 aa, B.fragilis
KNQTKPLLLTQNKIVMLKITRQVTLLLLAGALSFPAYSYATQATEVLVPEVTQEKVTGTVEDALGPVIGASVMVKGTTNGVITDLEGKFSLNDVKKGDIIVISYIGYVTQEIPYTGKPIQVKLAEDSKALEEVVVVGYATVKKANLTGAVSAVDGKVLEDRPIVNLGQGLQGAIPNLNVTTSGRPGQGSSFNIRGTTAMSGSSPLVLVDGVEMDPNLINPQDVKSVSVLKDAASASIYGARAAYGVVLITTKGGRKDQPTQVSFDASVSFNGPTTRPTYMNSMQYATWMNTAQQNTVGRDYFDAEWMQHIEAYYKDPVNNSPVFIHSDPSISKNGTKYTYAGNTNWMKELYKKNYPVQKYNVNISGGGKKATYYTSLGYTDQGSLIRFGNEQFKKFNVMNNINYDVNDWLHLSMKTSFNRTKLRGLNQDNVHGDNFMGGDTRPIMPVKHPDGNWAGQGDFTNFPAILEDGGSRLTNKNDLWNTITMKLTPIKGMSINMDYTFNYYSENNKVHMKSFDEYGANGQFLQTFAWTNPNSVSQSQANDTYNAFNFFGDYEKTLGKHYLKGMIGYNQESKHTTGFNAGREQLISNDLGSLSYATGDRWVGSSDNSWATRSGFFRINYGYDERYLLEVNGRYDLSSKFPKHDRAVFNPSFSAAWRLSNESWFKSWTNSFFDELKIRGSYGSLGNQALNNGWYAYLSNYSTGQISWIMGSNQPQYVVPGGLVSSSITWETVTQWDLGLDFNFLNSRLKGAFDYYQRRTSDILAAGKILPGVLGANEPQENAAESLTKGWEFEISWNDQLANGFHYTVGFNLSDYQSEVTKFDNESKELGNWYVGQKQGEIWGYETYGLFQSEQEIAGAANQDKVSGGIKLMPGDIRFVDRNNDGVIDWGDNTVDNPGDKKIIGNSTPRYHYGINLGADWKGFDLGIFFQGVGKRDLYLPGTSFRSHYGSEWQVPSAYNNDYWTEENTGAYFPRARFNGGSAINQAQTRYMVDASYCRLKSVSIGYTLPKVLTQKASIEKIRIYFTGENLFTISDTPDGLDPELDNPYTYPMQRSLSVGLSLTF

SEQ ID NO: 8041 - protein, 68 aa, B.fragilis
TPPTPRANQSVKASAGCGGLTNDGYSLISSDGLQPGDKIVSSGVHHIENGETVKTLPEITHTNIGGLL

SEQ ID NO: 8042 - protein, 206 aa, B.fragilis
KETANSFSCCTPAGHTSTIGNDILRKVRFSNYDSPADQNLRYQHNVINAYINSIRYTDDFLSRLIVVLQQQDAGSDILYTSDHGEDICDDHCHLFVHASPVHSKYQLHVPFIVWTSDTYREKYPEHMDAIQKNRHKSVVSNRVVFHSVLDLAGVTTTYVNDSLSVASPSYTEFPRFYLNDHNEPRSYDDIGLRKEDFEMFGKMGIR

SEQ ID NO: 8043 - protein, 66 aa, B.fragilis
IPFLIDRGESKILCLKPQTMNIPNTSYEVDFERGNPIFLKALRARLPFGKLWDLGIRINNRTFQPF

SEQ ID NO: 8044 - protein, 282 aa, B.fragilis
MSVYKNTSFVLPLQKKSTKKALLTIKSPAKEIESTNRGILSVIIYLCSPKKIPISNMKKIWILAVLTICSVATQAQEVFINADLVSSYIWRGMKNGNASVQPTLGVEWKGWTLSAWGSTEFRNENNEIDLTLEYEYKNLQLCLNNYFYQSENEPFKYFHYTPRTTGHTFEAGAVYTVSERFPLSIGWYTTFAGNDYRENEERAWSSYCEFSYPFTVKGVDLAVEAGFTPWEGEYADKLNVVNVGLSATKTLNISSGFTPAIFGKLIANPYENRFYFVFGISL

SEQ ID NO: 8045 - protein, 309 aa, B.fragilis
  UNSURE (22): Identity of amino acid sequences at the above locations are unknown.
NLAYGLIWNRFLIKNRRMIDTXMPFRRILLTSDTFQILKEGQIISTFNKCGIFYCQRGSVEVSLEGCHYHIKPGDVYIYMASTLVHLLHKSEDAEGIMVEVDFYYILPIVNKVINVESQLFMRKNPCVSLSGEQCAHFEYLLNNLWDRINAEDCQKENVQYQHLKLELIKSMGQTICYEILNMYFTNQPLQPLQQGKKDVVFQNFMLSLFRFYRKERDVSFYARMQHITPRYFSAIIKEKTGDSALQWIVRMVITEAKQLLEESDLSIKEIADQLNFPTQSFFGKYFKQYVGVSPKEYRNNTATTRIKR

SEQ ID NO: 8046 - protein, 754 aa, B.fragilis
NHSHKYRRTVIMDISKWAFHNRNLIYFLIAVLMFGGAYSCYQMSKLEDPEIKVKLAMVVTTYPGASAHQVELEVTDVLEKNIRTMGNIDNIESYSYNDLSLIQIELLSTVPDDDVEQCWDMLRRKVNDARASLPEGVSAPIVKDDFGNVYGMFYALTGDGLSDRELSDYAELIKREVGELEGVDRIDLYGKRPECINISLLQDRMANLGVKPAEVLATLNGQNKTTYTGYYDNGDNRIRVTVNDKFKTVEDIGKMLIQGHDDDQLRLSDIAQIEKGYEEPVRNEMYYDGERALGILIAATSGSDIVKVGHAVEARLAELKAERLPAGVEYQKVFYQPEHVGESLGTFVINLIESVIIVVLILMIAMGFKSGVIIGISLVVTVFGSFLFLYSAGGTMQRVSLAAFVLAMGMLVDNAIVIIDGILVDLKAGKDRMEAMTAIGRQTAMPLLGATLIAIIAFLPIYMSPDTAGVYTRDLFIVLAVSLLLSWVLALVHVPLMANRRLHFAVEAYSGGKRVYKGKIYAALRTALRFGLAHRWSFVFTMVGLLALSVFGYQYMRQGFFPDMVYDQLYMEYKLPEGNNYTRVEQDLKEIEAYLKGRKEITHVTASIGGTPGRYNLVRSVANPSLSYGELIIDFTSPEELVDNMDEIQRYLSATYPDAYIKLKRYNLMFKKYPIEAQFLGPDPAVLHQLADSARNIMKNTPEVCLITTDWEPQIPVLTIEYDQPAARALGLSRSDVSMSLLTACRGIPIGSFY

SEQ ID NO: 8047 - protein, 76 aa, B.fragilis
CLPQAMPVKVVRENIPEEDAGPASAYQAPVSAKGAVTNAPEMYWETPSPYPVTPFLPDSGGVASASDSEIVYVEED

SEQ ID NO: 8048 - protein, 253 aa, B.fragilis
CFTNYSVIMIKCIAVDDEPLALEQLTGYIARVPFLQLIASCQDAFSAMQVLSEEEVDLMFVDIHMPDLNGLDLVRSLVVKPLIVFTTAYPEYAVEGFKVDAVDYLLKPFEFQDLLKAADKARRQFEYHLQDNGGGTETDLLEKDGSLFVKSEYKIIRINVADICYIEGMSEYVRIYTDTADKPVVTLLSMRKLEERLPQEMFMRVHRSYIVNLRKITEVSRLRIIFNKNIYIPVGDNYKERFTEYINKICVSS

SEQ ID NO: 8049 - protein, 568 aa, B.fragilis
EMANFYLDTPELKHHLNHPLMKRIVELKERNYADKDKFDYAPVDFEDAMDSYDKVLEIVGEICGDIIAPNAEGVDHEGPVCADNRVTYASGTTRNLDACRKAGLMGMAMPRRFGGLNFPITPYIMAADIVSRSDAGFENLWGLQDCAETIYEFANEEQKQRYITRVCQGETMSMDLTEPDAGSDLQSVMLKATYSEKDQCWYLNGVKRFITNGDADIHLVLARSEEGTHDGRGLSMFIYDKRNGGVNVRRIENKMGIKGSPTCELVYKNAKAELCGDRKLGLIKYVMALMNGARLGIAAQSVGLSQAAYNEALAYAKDRKQFGKAIIEFPAVAEILSLMKAKLDASRSLLYETARFVDVYKALDDIAKERKLTPEERAEQKTFAKLADAFTPLGKGMGSEFANQNAYDCIQIHGGSGFMKDYACERIYRDSRITSIYEGTTQLQVVAAIRYVTTGAYLARIQEYENMPVAPELEGLQNRLKSMASKYAACVTQITEAKDQELLDFCARRLVEMAAHIIMGHLMVQDASKSDLFSESAQVYVRYAEAEVEKHINFIRKFDKDDLAYYRK

SEQ ID NO: 8050 - protein, 81 aa, B.fragilis
YIIKSISLKSISLVIVLPGIICFMSFDLYLMCCNIMIYGFKSNVNQGLLRKRDVIGLLKNEEIISNKIFNIFINEELDLLY

SEQ ID NO: 8051 - protein, 317 aa, B.fragilis
IYKNMAYIDYYKILGVDKNASQDDIKKAFRKLARKYHPDLNPNDPSAKDKFQEINEANEVLSDPEKRKKYDEYGEHWKHADEFEAQKKARQHTGGGGGGFSGFGGDGGSYWYSSDGEGFSGGDAGGFSDFFESMFGHRGGGGRGNAGFRGQDFNAELHLSLRDAARTHKQVLNVNGKQVRITIPAGVADGQVIKLKGYGGEGINGGPAGDLYITFKIAEDSVFKRLGDDLYVDVEMDLYTAVLGGEKVIDTLEGKVKLKIKPETQNGTKVRLKGKGFPVYKKEGQFGDLIITYSVKIPTNLTDRQKELFRELQQSMN

SEQ ID NO: 8052 - protein, 344 aa, B.fragilis
EERKDMNNLFVYCEIEDGIVADVSLELLTKGRSLANQLGCQLEAVVAGTGLKDIEKQILPYGVDKLHVFDGEGLYPYTSLPHISILVNLFKEEQPQICLMGATVIGRDLGPRVSSALTSGLTADCTSLEIGDHEDKKEGKVYKNLLYQIRPAFGGNIVATIVNPEHRPQMATVREGVMKKAILAADYKGEVIHHDVKKYVADTDYVVKVIERHVEKAKNNLKGSPIIIAGGYGVGSKENFNLLFDLAKVLNAEVGASRAAVDAGFVEHDRQIGQTGVTVRPKLYIACGISGQIQHIAGMQESGIIISINNDPSAPINTIADYVINGTIEEVVPKMIKYYKQNSK

SEQ ID NO: 8053 - protein, 628 aa, B.fragilis
HIMKINKLLYAGAALTLLGACAPAVKAPEAILPVPEEKQVDWQKMETYAFVHFGLNTFNDREWGYGDSEPKTFNPTKLDCEQWVKTFVESGMKGVILTAKHHDGFCLWPTQLTEYCIRNTPYKDGKGDIVGELAAACKKYGIKFAVYLSPWDRHQANYGTPEYVDYFHKQLTELMTNYGEVFEVWFDGANGGDGWYGGAKDSRTIDRKTYYNYPRIYEILDKLQPQAIVFSDGGPGCRWVGNENGFAGATNWSFLRAGEVYPGYPKYRELQYGHADGNQWVPAECDVSIRPGWFYHPEEDDRVKTVEQLTDLYYRSVGHNATLLLNFPVDRDGLIHPIDSANAVNFHKNVQKQLAHNLFAGIRPKASDERGGQFSAKAATDESWDTYWATNDGVTAADIEFDFPKTEKVNRMMIQEYIPLGQRVKSFIVEYDKDGKWLPVKLNEETTTVGYKRLLRFETVSTDKLRIRFTDARACLCINNIEAYYAGETADTFTVEAKELKSYPFTLVGVPEEETKKCMDKDKNTTAFVEGDALVIDLGEERTITSFHYLPDQSEYNKGLISSYELSVGTEANAVNRIVAQGEFSNIKNNPILQSVYFTPVKARYLSLKPTKMVTEGETMGFAEIGIQ

SEQ ID NO: 8054 - protein, 70 aa, B.fragilis
GYTLTGNRNPCIALYNLFICDKLPAHAQKELHQPNIRSLTADTNLVNIFCKSFLIVISHRYIYILIENDA

SEQ ID NO: 8055 - protein, 62 aa, B.fragilis
VKHCKTKTTTGLKVSFTTDEQIYKDIHLQATEIPVLPYTICSSVINFRHMLKKSFTNLTSGH

SEQ ID NO: 8056 - protein, 435 aa, B.fragilis
KQYCDNENKTLKYSSKDRRSFPYLGIFSYLCRININKNDIIMKKTILLAALGLISLSALGQDKPQEEGFVFTTVKENPITSIKNQNRSSTCWSFSSLGFLESELLRTGKGEYDLSEMFVVHHTMVDRAVNYVRYHGDSSFSPGGSFYDIMFCMKNYGLVPQDAMPGIMYGDSLPVHNELDATAGAYVNAIAKGNLKKLTPVWKKGLCAIYDTYLGQCPEKFTYKGKEYTPMTFAQSLGLNPDDYVSLTSYTHHPFYSQFAIEIQDNWRNGLSYNLPLDEFMAVMDNAVKNGYTFAWGSDVSEEGFTRDGIAVVPDAAKGAELTGSDMARWTGMTAADKRKELTSKPLPEMKITQEMRQTAFDNWETTDDHGMIIYGIAKDQNGKEYFMVKNSWGTNNKYKGTWYASKAFVAYKTMNILVHKDALPKDIAKKLGIK

SEQ ID NO: 8057 - protein, 62 aa, B.fragilis
AGKLNAPASKSRVTCLVIFNITILFWVNNKGFVWFFYILPFLLIILSYFFKNGLVLAELGEM

SEQ ID NO: 8058 - protein, 250 aa, B.fragilis
KPLRTLVFLFGVSGTINKIYVKDGAQVRAGQLLAELDPTDYQVQLDATEAEYRQVKAEAERVMALYKENGTTPNANDKAVYGLKQITAKYKHHQDQLAYTRLYAPFSGYVQKRLFEAHETIGAGMPVISMVSAGAPEVEINLPAAEYIRRNRFNRYHCTFDIYPGETYPLQLISVTPKANANQLYTMRLQLIPGKQAVPSPGMNAMVTIFCDTDRSGTLSVPTSAILQKDGKSYVFIYNEPHRRRARTNL

SEQ ID NO: 8059 - protein, 323 aa, B.fragilis
ICRLIVNRIVNSKNLTTDYWLLTCRNTNTKINNMSLKIVVLAKQVPDTRNVGKDAMKADGTINRAALPAIFNPEDLNALEQALRLKDAHPGSTVTILTMGPGRAADIIREGLFRGADNGYLLTDRAFAGADTLATSYALATAIKKIGEYDIIIGGRQAIDGDTAQVGPQVAEKLGLTQITYAEEILKVGDGSITVKRHIDGGVETVEGPLPIVITVNGSAAPCRPRNAKLVQKYKHAKTITEKQQGNLDYTDLYDTRDYLNLVEWSVADVNGDLKQCGLSGSPTKVKAIQNIVFQAKESKTISGSDREVEELIVELLENHTIG

SEQ ID NO: 8060 - protein, 1348 aa, B.fragilis
SIKRKTIMRKITLGLILCSMVTLCFAGQRPLEGFKYASEKAPVGNEWESPENIALNKEQPRAWFFSFQDVESARKVLPENSKYWLSLNGDWKFNWAPDPDSRPKDFYQTTFDVSGWDNIPVPSSWNIYGIQKDGSLKYGVPIYVNQPVIFMHKVKVDDWRGGVMRTPPTNWTTYKYRNEVGSYRRDFDIPQDWDGREVFINFDGVDSFFYLWINGQYVGFSKNSRNTASFNITPYLQKGKNTVAAEVYRSSDGSFLEAQDMFRLPGIFRTVALYSTPKVQVRDLVVIPDLDETYTNGSLAISADIRNFGKKAAKGYQMAYTLYANKLYSDENTPVANAVASATVNLVNPNETVEAEKAIMNVQSPNKWSAEFPHLYTLVAELKDKKGKTIETVSTTVGFRKVEIKDTPASADEFGLAGRYYYVNGKTVKLKGVNRHESNPAVGHAITREMMEKEVMLMKRANINHVRNSHYPDDPYWYYLCNKYGLYLEDEANIESHEYYYGAASLSHPVEWKNAHVARVMEMVHANVNNPSIVIWSLGNEAGPGKNFVAAYDALKAFDLSRPVQYERNNDIVDMGSNQYPSIGWMRGAVKGNYDIKYPFHVSEYAHSMGNACGNLVDYWEAIESTNFFCGGAIWDWVDQSMYNYDKKTGERYLAYGGDFGDTPNDGQFVMNGIVFGDLEPKPQYYEVKKVYQHIDVKAIDVEKGRFEVFNKYYFKNLSDYDVKWSLYENGKEAQSGLLSIGEVAPRTRTQITVPYQFSKLKADSEYFVKIQFLLKDNMPWADKNFAQAEEQILVKEATARPSIATVAAEGDKPEVMMTKASDIITIKGNGYTAQFDIKTGTIYSLTYGNEKVITDGNGPKLDALRAFTNNDNWFYSQWFDNGLHNLKHSATGFNMTTKEDGTVVLSFTVQSQAPNAAKILGGTSSGKNKIEELTDKKFGSSDFKFTTNQVWTVYKDGSIELEASITSNQPSLVLPRLGYMVRVPQQYANFTYYGRGPIDNYADRKVGQFIEQHKNTVAGEFVNFPKPQDMGNHEDVRWCALTNNAGNGAVFIATDRLSTSALPYSALDLILASHPYQLPKAGDTYLHLDAAVTGLGGNSCGQGGPLEQDRVFASHHNTGFIIRPAGKDLTVTANVAPAGEMPLSITRNRAGVVSVSSQKKDAVILYTVDKSKSKTYTEPIALRNGGTVTAWFKDAPFIKASMTFDKIESIQTEVIYASSEESDGGEAKNLTDGDPNTIWHTMFSVTVAKHPHWVDLDAGEVKTIKGFTYLPRQDSSNGNVKDYTIHVSMDGKEWGEPILKGTFARDLKEKKVMFDKPVKARYIRFTALSEQRGQDYASGAELTILAE

SEQ ID NO: 8061 - protein, 77 aa, B.fragilis
EVFGMFMVWGFRQRIFDSPLSIRKGIYYPLSKEAGFKTSCLSPNKCTNNSIIYFFAREADRCVFIKEDSLTPGQNLW

SEQ ID NO: 8062 - protein, 406 aa, B.fragilis
DKGGIFVNRHSRRTFWSMKQINKQKLLEQMVYLVIWLTVISVPLVGDYLFASISPVHTFSWQTIRMAWLLTLPFILLFVVNNYFLAPRLLLRKRYWAYALSLAGVVTLLFILYPSINPPQHKQFQNLMPMQPRRYPEGKVLPDREREFPNTFPEHSSPLLLPKQELDMRWRGPHPLPGYFLGRLSLALLVVGINVAIKLLFKSMRDEEALKELEHQHLQSELQYLKYQINPHFFMNTLNNIHALVDMDAGKAKRTIVELSKLMRYVLYEASNRTILLSREIQFLDNYIALMKLRYTGRVRIECCMPDEVPEVQIPPLLFISFVENAFKHGVSYQEESFIRVFMSVEDGRLVFRCSNSNHGRSVEQHHGIGLENIRKRLRLLFGQDYTLSINERDDSFNVLLIIPLL

SEQ ID NO: 8063 - protein, 106 aa, B.fragilis
KSTMQTELIIVSEYCHKCHIEPSFIDLLEEGGLIEVRTEGGEHYLLASQLPDVERYSRMYYDLSINMEGIDAIHHLLERMEIMRREISSLRNQLIVFKREGIMEDW

SEQ ID NO: 8064 - protein, 587 aa, B.fragilis
PIHISDAKIIICWFKSHILNTKHLMKIKYLFYIGVATLALSGCNDGFLERAPEAINDKTFWNTTGDLETYANQFYSYLPGGVTSIADGESDNQVPNSIPQFFWNQLSTPAEAASWCNWSKGGWQPIRLVNYFLTHYQTVSGKESEINQYVAEVRFFKAMQYAGLMRTFGDIPWLDKDLGTGDTDILYGPKLKRYEVMDKIIEEFDFAIQWLPEKPATGRIGKDVARQLKARTCLHEGTYYKYHTELGWADKADRLLKMAADETDAIMATGKYEIYNTGHPEKDYYDVFVMEDKTNLKEAILPVTYLDGKRKHGMSRTLAEANTGFSKDFVESYLCLNGKPITGNDQYKGDTNMKDETTDRDPRLKQTILTWDFPTRVTVATNDSTYIEKEEDFISQYCLTGYKSIKYFIPTDKAFEANNNTYDGIAYRYAETLLINAEAKAELGTITQADLNKTINVLRDRAGMPHLTLEVGFTDPNWPAWGYSLTPLLQEIRRERRIELAGEGFRWDDLARWKAGAICNNVKTYIGKREPYKEGQYAIVYPAYTNDNYSYEAGKSRTWNDRLYLRPIPTGELQRNDNLLPQNPGWE

SEQ ID NO: 8065 - protein, 62 aa, B.fragilis
QPVVSSKVLAIHYPVNYQPANLSKRLVLTRNLSEKCTSLRILSNLSDSYDHEYRVIVNFQIF

SEQ ID NO: 8066 - protein, 66 aa, B.fragilis
MGFAPMNNPKIAIAVYVENGGFGAVYGVPIGALMMEQYLKGKLSPENEIRAEEYSNRVIMYGNEER

SEQ ID NO: 8067 - protein, 437 aa, B.fragilis
LCMETRSVSLWKTLDWVTIVIYLLLIIGGWFSVCGASYDYGDRDFLDFSTRAGRQFVWIICSFGLGFILLMLEERMYDMFAYLIYIGMILLLIVTIFIAPDTKGSRSWLILGPVSLQPAEFAKFATALALAKFMNAYSFNIKKWKCFLPLVAFILLPMLLIILQKETGSALVYLAFFLVLYREGMPGVVLFSGVCAVVYFVVGIRFDQVFIADTPTPIGEFAVLLMILLFAGSMVWVYRKKWEPVRNMIGGSLLVLLIAYLVSEYLSPFNLVWVEWGLCVVTIGYLLYLSLSERQRAYLLIGLFALGSIGFLYSSDYVFDNILEPHQQIRLKVVLGMEEDLAGPGSNLNQSKIAIGSGGLTGKGFLNGTQTRLKYGPKQNTDFFFWTGGEEQGFVVRDPFFVFLGVILRFIATENGKIFFWGGVMVFRVRTIPCPIG

SEQ ID NO: 8068 - protein, 346 aa, B.fragilis
FILTAPSAMRCNTGPLKDLMIDGIIGGVGGVIVFLPNILILYFCISLMEDSGYMARAAFIMDKIMHKMGLHGKSFIPLIMGFGCNVPAIMASRTIENRKSRLITMLVNPLMSCSARLPIYLLLVGAFFPKNGSLVLLAIYAIGIALAVIMARLFSRFLVKGDDTPFVMELPPYRMPTMKSIFRHTWEKGAQYLKKMGGIIMIASIIIWFLGYYPDHDAYPTQAEQQENSYIGQIGQAVEPVLKPLGFDWKLSIGLLSGVGAKELVVSTLGVLYTNDADADVVSLAERIPITPLAAFSYMLFVLIYFPCIATLVAIKQESGSWKWAIFTAGYTTALAWLVSFAVYQI

SEQ ID NO: 8069 - protein, 94 aa, B.fragilis
LEVGYLHGRIYHGVGMACFICRLSDMRNVFMNWQEWVVGLLIVLCVTRILYGIYLFFRRVKENDNPCASCASGCELKDMMEKNQKECSFKKKIT

SEQ ID NO: 8070 - protein, 830 aa, B.fragilis
YIKSICYLYICVYKYGITMNRHKLAFSLIGIFIVQLSYAGYFKHIGREEGLSQSSVMAIYQDKLGRMWFGTREGVNIYNSNKMAVYKAWIQNGNRPDQKILIGNEVSAITGSQNGDVFLIVDHALLKYDIRKETFERLRQGSVYALTSHAGEIWCAGHDSIFRYNPQNNQLDFQLKTGISSINYLTINGNRFYIGAKEGLYTTENKGRVQCLIPKVDVYRIFQSSCQELWVGCRTQGLYRINRNGRINRIPYDPSSPNGISSEQIREFVEDQQGNIWFGTFDGLQKYDPSTQTYSLIKQEQRPGGLSHSSIFSLYQDVQGTIWIGSYYGGVNYFNPDNNAFNYYTYNPDRSDCLNYPFAGAMTEDKDHHLWICTDGGGLACLDRQAGHFTTYTAGGPNSLPHNNLKSICYDPKRDCLYIGTHMGGLSRFDRKTGRFYNYLNHSTKGLKEPNDVIFQVSFYNDQLIVSARNGVFSMNPDTNEFRLLYDGYYYQTFTIDPKGFLWLSAGTNLYSINLKHPEEVKSFSLPASIGQFGISKILKGNNQYLYIATLGSGLFCYNEQTQTCINYTPEQNQLLSNYCYNLLQTSTDNILITSDRGITLFNPTTESFRSIELDNGLSLSSIINGCGVWMCSDHTIFIGGTGGLSSFLEKDLNKEYPKPKLYFSSLSVNNARISPDDKSRILTEGLPFVREINLNATQNNLTVEFASSNYVDILNNTWYEYQLEGFDKQWSLTSQTSLKYTNLDPGDYVLHVRQKGNSLKMRKAQEILLQIHINTPWYLTWWAWLSYITISISVTYFIWREKSSRRTLAILRQSLSSLTYHQILFNPAI

SEQ ID NO: 8071 - protein, 247 aa, B.fragilis
MIKSILIALCTVLLCWNSIPAEAQTPQDSVRFIGYLPVRHTDPTKWITRYQSEIDRYQTENQMLKDTSCDVLFLGSSSINLWDNIYRDMAPLKILRRSYGGAALRDMLYNYDVIARGYHPRSIVIYVENDLAGTPEDLTVGETFDFFRLLTNRLQRDYPDIPIFILSYKPSLARKEMIPKHEIINALLQEYASKRGGLTYIDVASCLYDNNGKLRKDIFKQDGLHMNQNGYDLWTAILKPKILESIR

SEQ ID NO: 8072 - protein, 189 aa, B.fragilis
KASNCTSAIRVEKRVRYFGHNTLSSDSIPWGLKDEYCPSYFNEMRNLTLVNREYCIRNPKHYKGYGPDCWGLTASYSVDGYAAHGPLERDDRGVISPTAALSSIVYTPDQSLQVMHHLYEMGDKVFGPYGFYDAFSETADWYPKRYLAIDQGPIAVMIENYRTGLLWKLFMSHPDVQNGLKKLGFNVKK

SEQ ID NO: 8073 - protein, 559 aa, B.fragilis
LSRSSRRTLAMSLEKERIEKEHIEEMNQAKLRFFTNVSHEFRTPLTLIISQVELMLQKNTIPPSLHNSIFRIRKHAQQMKLLISELLDFRKFDQNYIQLKLSEQSLNTFLEEVYLSFSAYASQKSISYHLKLLEQDISIWIDDWQMRKVLFNLLSNAFKHVPDKGEISILTSTTPDQVVIAVKDSGNGISKEEQERIFDRFYQADNRNKAIHVGTGIGLALTKSIIQLHHGTIEVESELNEGSCFIVKLPKTRDCFEKDTEVVFLESPEKEPMVQENTIPDENFMKKDDSTFETPLIDEREGKRKVLLVEDNVELLQVLKEIFSSLYQVVTAANGEEGLKQAFAEVPDLIVSDVMMPVMTGTEMCLKIKNNINLCHIPVVLLTALDTVDQNIEGLRRGADDYITKPFNAKILITRCNNLIRNRLLMQSRFAKDQILEINLLAANPIDKGFLDRVIKVVDKHIDNEDFDIGMLCQELGMGRTLLHTKFKALTGMTPNEFILNHRLKIASLMLKNEPYLQVAEISDRLGFGSPRYFSRCFKNQYNVTPMEYRKGAKQENLK

SEQ ID NO: 8074 - protein, 1008 aa, B.fragilis
SIMRKSKLHLLPLSSKRVLVSTSLIMLLSGSAWAVSSQETVENGDAITAVPQQRRTVKGIVKDANGEPIIGANVIVKGNKTIGVITNLNGEFSLEVPSNATLQISYIGYLNKEVKVSGNQVSFNIQLEEDSKTLDEVVVVGYGTQKKANLTGAVSSVDFEEQTKSRPITTVSSALAGLSPGLQASSGSAMPGEDNTTLRVRGNGTMNNASPLIIIDGMEGSLNAINPQDIENISILKDAASCAIYGARAANGVILVTTKSGDRDKIQVNYSGRISFNSPTRMIETMSNYADYMELMNESCENVGSGTLFDQKYIDLWREKSKDPNGVNENGVPNYIAYPNTNWLKELYSGGMIHEHNLSVSGGSNKIRFLLSARYQDNEGIVDNTANKTYSVRANIEANPTQWLTLGTRTYASQMDREVGDFSNANTFLRQSTAGTYPEWNGSFGYPECPDERATANNPLYKLARNDGFKRYNRFNTTLFSKVKFFKDLSWDFNFNYNRYIYETRQWGVPAYQTRFSDGVIVDGITPPSQLSTSFGYESNYSYTLENLLNYHHTFAQKHDVSALLGYQEFYKNYYTVDAAKKGLIDESLNQFDEATEMTSTKGATQDYATRSVFGRVNYAYNSRYLFEANFRYDGSSRFHKDHRWGFFPSLSGAWRISEESFMENTRTWLDNLKVRASWGKLGNSEIGNYEYMWVYSTTNAVFGNALNSALYMGAIANSLLKWESTTSVNFGIDVNLLKNRLSISADLYQKKTDGILYRPTIPYVFGTMTAPRQNLAKVSNKGVELSLGWRDNIGGVSYSINGNFSYNKSNIDAYNGTYERTWVEDPNNKLTGGKWEDNIGKVSSGGTTPIVEGRMMNEYYLRNVYHGNGSYYNADGSVNPQGGPKTGMIRTEKDMAWVKDMIAAGYEFQPGKTVAKNKIWYGEYIYADSKYNGVYGDDNDYTFQKTSNKPKYNFRFQAFCRMERIRPSLWYGRNLPDLTYFGGPPQDTTPNLLKWGRPFAPPVAGEY

SEQ ID NO: 8075 - protein, 311 aa, B.fragilis
LKFVRPRPFQPRGEDHNSKLLFVLFALFLFVACKPKEKPSPATSLTDDALMDTVQRRTFNYFWDAAEPNSGLARERYHMDGEYPAGGPEIVTSGGSGFGIMAILAGIDRGYVSREEGLQRMEKIVGFLEKADRFKGAYPHWWNGETGHVQPFGQKDNGGDLVETAFLMQGLLAVHQYYAEGSAEEKKLAGRIDKLWREVDWNWYRHGGQNVLYWHWSPEYGWEMNFPVHGYNECLIMYILAAASPTHGVPAAVYHERWAQNGAIVSPHKVEGIELHLRYQGGEAGPLFWAQYSFLGLDPVGAERRVLSELF

SEQ ID NO: 8076 - protein, 90 aa, B.fragilis
YIDPCTVRTEDFYNFDLIIGMDDRNMDDLKEKAPSPAEWKKIHRMTEYCTRIPADHVPDPYYGGAEGFEYVLDILEDACAGLLTSLTQDS

SEQ ID NO: 8077 - protein, 112 aa, B.fragilis
LGDPCGTLVHADFYIFIFRLTHSVIYSLLCLCLCNICRFYTAEGVMLHPINDAGLERELVIDSTGILAYHQVELTDSRMHAHAVLRGYELIHRSVYCPYGRFLQLRSYNRYG

SEQ ID NO: 8078 - protein, 67 aa, B.fragilis
LPFQAGVVNRMEHHSFRRVKAANVAEAKAKKAVYHAMGQSKYKDIKIRMHQRAAWISQLRVSACGII

SEQ ID NO: 8079 - protein, 63 aa, B.fragilis
SVCLTCIVAASRVQKLIIKKVSGSIILTFNRNLTKKMPELFVPVLKEHGVKSSFSKSGDRGWV

SEQ ID NO: 8080 - protein, 494 aa, B.fragilis
PDLNGLNYSLSEFKNSKGDVLPADAFSGGFVRYVMTDELNKDGRGGCGYRPDHSIYDSLLVADPIDHLLTSMPMEAKSTQAIWINCQVPQTVSPGVYRGTVEVKDGDNRLSTLKMDIKVSSRVLPAPSQWAFHLDLWQSPFAVARYYQVPLWSQAHIDAMRPVMKMLADAGQKIITASIMHKPWNGQTYDYFESMVTWTKKVNGTWAFDYDVFDKWVEMMMSVGIDKQINCYSMVPWKLSFQYFDQATNSMQYVKTAPGEKAYEEMWVAMLKSFSKHLREKSWFDICTIAMDERPMEVMQKTLQVIRKADPEFKVSLAGNFHKELEADIYDYCIPIGASYPAEVLARRAQNNLPTTYYTCCTEAFPNTFTFSDPAEAAWMSYYSAKDHLDGYLRWAYNSWPKEPLLDSRFEAWAGGDTYLVYPGARSSIRFEKLIEGVQAHEKITILRKEFTDKKNKTGFKKLEKMLSTFNLRDFPEVPAAETVNKANKILNSL

SEQ ID NO: 8081 - protein, 392 aa, B.fragilis
FCHDLPILTQIMAERKVRVRFAPSPTGALHIGGVRTALYNYLFARQHGGDLIFRIEDTDSNRFVPGAEEYILESFKWLGIQFDEGVSFGGEYGPYRQSERREIYKKYVQVLLDNGKAYIAFDTPEELYVKRAEMAYLHYDASTRVGMRNSMTLPKEEVEALIADGKQYVVRFKIEPNEDIHVNDLIRGEVVINSSILDDKVLYKSADELPTYHLANIVDDHLMEVSHVIRGEEWLPSAPLHVLLYRAFGWEDTMPAFAHLPLLLKPEGNGKLSKRDGDRLGFPVFPLEWHDPKSGEISSGYRESGYLPEAVINFLALLGWNPGNDQEVMSMDELIRLFDLHRCSKSGAKIDYKKGIWFNHTYIQQKSDKKNARTVCTGAERAWSKKFLFKKW

SEQ ID NO: 8082 - protein, 704 aa, B.fragilis
TFFSTLLFFFVLFAKNSRVMEHWKKKNSFSYKDLLYKALIFVGTVAFIVYFLPRDGKFNYQFDINKPWKYGQLMATFDFPIYKDEAVVKREQDSLLASFQPYFELDKEVEKSALAKLKENYHAHLKGILPSTDYIRYIERGLKAIYQSGVVSTEEMRTLLHDSIFSVMVIEDKLANQRTTDGIYTVKRAYENLISGDTAHYNRDILRQCALNDYITPNLIYDSVRTETARKELLDNYSWANGVVQSGQKIIDRGEIVNKQTYNILESLRKESIKRSESIGQKRLILGGQILFVGILILCFMLYLELFRKDYYERKGSLSLLFALIVFYCVITALMVTNNIFNVYILPYAMLPIIIRVFLDSRTAFLTHVITILICSITLRYPHEFILTQIAAGLVAIFSLRELSQRSQLFRTALLVILTYAAIYFAFELISENDLSKLNVSMYIYFIINGVLLLFAYPLLFLLEKTIGFTSNVTLVELSNINNDLLKKMSETGPGTFQHSMQVANLAAEAAIRIGAKRQLVRTGALYHDIGKMENPAFFTENQSGVNPHKNLSYEQSAQVVISHVTDGLKLADKHNLPKVIKDFISTHHGRGKTKFFYISWKNEHPGEEPNEEVFTYPGPNPFSKETAILMMADSVEAASRSLPEYTEESISNLVDKIIDSQVQEGYFKECPITFKDIATIKAVFKEKLKTIYHTRISYPELKK

SEQ ID NO: 8083 - protein, 107 aa, B.fragilis
SLIPSLFTEHSCACSVPISKQYKSSIMNFIWYILIGILAGYFAGKIMRGGGFGLLVNLLLGIIGGVLGGWVFALLGLAATGIIGSLITSVVGAILFLWIASFFSRSR

SEQ ID NO: 8084 - protein, 183 aa, B.fragilis
VNSPEGELKTSRNRQPRTKTLFFEQMRKAKPKKRVILPDPVFNDQKVSKFVNHLMYDGKKNTSYEIFYAALETVKAKLPNEEKTALEIWKKALDNVTPQVEVKSRRVGGATFQVPTEIRPDRKESISMKNLILFARKRGGKSMADKLAAEIMDAFNEQGGAFKRKEDMHRMAEANRAFAHFRF

SEQ ID NO: 8085 - protein, 161 aa, B.fragilis
KSNLKYRTKESVCCPCSLERSVGLLKKQLLLLEEIYSNYSSSTEGEIITQSHRTVNAKRIPISFSYEGGITLDTETLHYSSPSEKFATTWKNILFHTISIRIIIGLHKSNMEPSEWREIIHQNTYQKFHRKHRRRLPLSFRERYTQYKNKASDAFNQDAPK

SEQ ID NO: 8086 - protein, 147 aa, B.fragilis
FTGLRMNNIVYGYTSEDTFVQSSNNFVIVLEVSTNQSAKRTAVFFINNHIMRNVNQTTSQVSRIGSLQSSIRQTFTGTVSRDKVLQHRKSLFKVRQDRILDDLTTFSTCLLRFCHQTTHTGELTDLLFRTTGTGIKHHVHRVETLII

SEQ ID NO: 8087 - protein, 167 aa, B.fragilis
RTAQHRNYSHLNSCIAKSSQYFFFCNSRRIIKVFFHQRIIKFSYFFKHFISPFVGFVNEISRNFFYGIVSTHCFIVPVDSFHFDQINQSFEVFFCTDRNNNRTRICTQNSLHLANNFKEVSTRTVHFVNVSDTRYVIFVSLTPYSFRLRFYTTYSTVSSNSTIKDTK

SEQ ID NO: 8088 - protein, 139 aa, B.fragilis
IKKQFKMPTIQQLVRKGREVLVEKSKSPALDSCPQRRGVCVRVYTTTPKKPNSAMRKVARVRLTNQKEVNSYIPGEGHNLQEHSIVLVRGGRVKDLPGVRYHIVRGTLDTAGVAGRTQRRSKYGAKRPKPGQAAPAKKK

SEQ ID NO: 8089 - protein, 90 aa, B.fragilis
HLVKEIIFVQKKILRPMKNINYSIKKQFKISDEGICLLPMLLRALCRLTKKTAVTTGRNLFQLLLVHRRGNHHTISPDGECKKDPDFFFV

SEQ ID NO: 8090 - protein, 709 aa, B.fragilis
RKKKMAKNDLHLTRNIGIMAHIDAGKTTTSERILFYTGLTHKIGEVHDGAATMDWMEQEQERGITITSAATTTRWKYAGDTYKINLIDTPGHVDFTAEVERSLRILDGAVAAYCAVGGVEPQSETVWRQADKYNVPRIAYVNKMDRSGADFFEVVRQMKAVLGANPCPVVIPIGAEENFKGLVDLIKMKAIYWHDETMGADYTIEEIPANLVDEANEWRDKMLEKVAEFDDALMEKYFDDPSTITEEEVLRALRNATVQMAVVPMLCGSSFKNKGVQTLLDYVCAFLPSPLDAENVVGTNPDTGAEEDRKPSEDDKTSALAFKIATDPYVGRLTFFRVYSGKIEAGSYIYNSRSGKKERVSRLFQMHSNKQNPVEVIGAGDIGAGVGFKDIHTGDTLCDETAPIVLESMDFPEPVIGIAVEPKTQKDMDKLSNGLAKLAEEDPTFTVKTDEQTGQTVISGMGELHLDIIIDRLKREFKVECNQGKPQVNYKEAITKTVNLREVYKKQSGGRGKFADIIVNIGPVDEDFTQGGLQFVDEVKGGNIPKEFIPSVQKGFQTAMKNGVLAGYPLDSLKVTLVDGSFHPGDSDQLSFEICAIQAYKNACAKAGPVLMEPIMKLEVVTPEENMGDVIGDLNKRRGQVEGMESSRSGARIVKAMVPLAEMFGYVTALRTITSGRATSSMVYSHHAQVSSSIAKAVLEEVKGRADLL

SEQ ID NO: 8091 - protein, 105 aa, B.fragilis
LKELMSQKIRIKLKSYDHNLVDKSAEKIVRTVKATGAIVSGPIPLPTHKRIFTVNRSTFVNKKSREQFELSSFKRLIDIYSSTAKTVDALMKLELPSGVEVEIKV

SEQ ID NO: 8092 - protein, 87 aa, B.fragilis
FMGSGNAKFLVGLGIGSAIGALVYHFSRTAKAKKLKNDVFNALHEIEADAELAVVEAKDKAVKAGAKVAGKVADKATEVKEKLTPNS

SEQ ID NO: 8093 - protein, 382 aa, B.fragilis
INYIMELKKKENIGWIDLLRVLACFFVVFSHSCDAFIGQFDANRESFLTGVFLGSLMRPCVPIFVMMTGVLLLPVQTDMAAFYKKRIGRLIPPMIFWSLVLPVLYFIYLNYINPDTQNPLISMPDHSLEALWFKLYTFIFNFNFDTVPLWYLYMLIGLYLIMPIISGWLEKVSKKELKLFLGIWGISLIAPYVKMFAPALGYQGNYGNMGLWGVCDWNDYGTFYYFSGFIGYLLLAYYLTKYPLKWSWKKLLSITIPMFLTGYLITSYGYVITQNYFPGNYAYLEIVWYFAGINVFMMTFPVFVIVQKIKVPSNHRLSHMASLAFGIYLSHYVFVFIAYDLLDTELLPYTVRIICMACIVFLTCYAIVWLMSKSKLTNRFIR

SEQ ID NO: 8094 - protein, 1437 aa, B.fragilis
LISILYNYKSMAFRKENKIKSNFSKISIGLASPEEILENSSGEVLKPETINYRTYKPERDGLFCERIFGPIKDYECHCGKYKRIRYKGIVCDRCGVEVTEKKVRRERMGHIQLVVPVAHIWYFRSLPNKIGYLLGLPTKKLDSIIYYERYVVIQPGVKAEDGIAEFDLLSEEEYLDILDTLPKDNQYLEDTDPNKFIAKMGAEAIYDLLARLDLDALSYELRHRAGNDASQQRKNEALKRLQVVESFRASRGRNKPEWMIVRIVPVIPPELRPLVPLDGGRFATSDLNDLYRRVIIRNNRLKRLIEIKAPEVILRNEKRMLQESVDSLFDNSRKSSAVKTDANRPLKSLSDSLKGKQGRFRQNLLGKRVDYSARSVIVVGPELRMHECGIPKLMAAELYKPFIIRKLIERGIVKTVKSAKKIVDRKEPVIWDILEHVMKGHPVLLNRAPTLHRLGIQAFQPKMIEGKAIQLHPLACTAFNADFDGDQMAVHLPLSNEAVLEAQMLMLASHNILNPANGAPITVPSQDMVLGLYYITKLRKGAKGEGLTFYGPEEALIAYNEGKVDIHAPVKVIVKDLDENGNIVDVMRETSVGRVIVNEIVPPEVGYINTIISKKSLRDIISAVIKACGVARTADFLDGIKNLGYKMAFQGGLSFNLGDIIIPKEKETLVQRGYEEVEQVISNYNMGFITNNERYNQVIDIWTHVNSELSNILMKTISSDDQGFNSVYMMLDSGARGSKEQIRQLSGMRGLMAKPQKAGAEGGQIIENPILSNFKEGLSVLEYFISTHGARKGLADTALKTADAGYLTRRLVDVSHDVIINEEDCGTLRGLVCTDLKNNDEVIATLYERILGRVSVHDIIHPQTGELLVAGGEEITEDIAKKIQESPIESVEIRSVLTCESKKGVCAKCYGRNLATNHMVQKGEAVGVIAAQSIGEPGTQLTLRTFHAGGTAANIAANASIVAKNNARLEFEELRTVDIVDETGEAAKVVVGRLAEVRFIDVNTGIVLSTHNVPYGSTLYVADGEVVEKGKLIAKWDPFNAVIITEATGKIEFEGVIENVTYKIESDEATGLREIIIIESKDKTKVPSAHILTEDGDLIRTYNLPVGGHVVIENGQKVKAGEVIVKIPRAVGKAGDITGGLPRVTELFEARNPSNPAVVSEIDGEVTMGKVKRGNREIIVTSKTGEVKKYLVPLSKQILVQENDYVRAGTPLSDGATTPADILAIKGPTAVQEYIVNEVQDVYRLQGVKINDKHFEIIVRQMMRKVTIDEPGDTRFLEQQVVDKLEFMEENDRIWGKKVVVDAGDSENLKAGQIVTARKLRDENSMLKRRDLKPVEVRDAVAATSTQILQGITRAALQTSSFMSAASFQETTKVLNEAAINGKIDKLEGMKENVICGHLIPAGTGLREFDKIIVGSKEEYDRILANKKTVLDYNEVE

SEQ ID NO: 8095 - protein, 110 aa, B.fragilis
NQSIIKDMENQNPDNQLQIELKEEVAQGTYANLAIITHSSSEFVLDFVRVLPGLPKAGVQSRVILAPEHAKRLQRALEENIAKYERAFGPIRLQEDGVDTPPILDIKGEA

SEQ ID NO: 8096 - protein, 125 aa, B.fragilis
YLKISEMPGLLGKKIGMTSVFSADGKNVPCTVIEAGPCVVTQVKTVEKDGYAAVQLGFQDKKEKHTTKPLMGHFKKAGVTPKRHLAEFKEFENELNLGDTVTVELFDGADYVDVVGLLKVKAFRV

SEQ ID NO: 8097 - protein, 64 aa, B.fragilis
LHTFNLATAFVQVTDNVTHVFFRSNDFQLHDRLHQYRTCLSTSILICLDSTDFERQLVRVTRVE

SEQ ID NO: 8098 - protein, 276 aa, B.fragilis
FVSLILNFIKKYKELDAELKRKKFAITIGDELPAGIIQMAKVYIAKKRKIGVGDKMAGRHGNKGIVSRVVRQEDMPFLEDGTPVDIVLNPLGVPSRMNIGQIFEAVLGRAGKNLGVKFATPIFDGATLDDLNEWTDKAGLPRYCKTYLCDGGTGERFDQPATVGVTYMLKLGHMVEDKMHARSIGPYSLITQQPLGGKAQFGGQRFGEMEVWALEGFGASHILQEILTIKSDDVVGRSKAYEAIVKGEPMPQPGIPESLNVLLHELRGLGLSINLE

SEQ ID NO: 8099 - protein, 142 aa, B.fragilis
RNEFLRNVTTLHFINELQTTLSKVFINRADVHNNISELTTTTRLFLINLTQVNCLSDSLFVVNLRFTLVTFYFEFTFQTVDNDIQVKLTHTGNNCLTCLFVSFHCECRVFFSQFSQTVRQFVHILLSFRFHSNTDYRFREVH

SEQ ID NO: 8100 - protein, 95 aa, B.fragilis
IRSSITKEVLGSSPEFGSSQKRYCGFSAMARAMATRFCIPPLISPGNLSLASVRLTRSRQNIARLVCSRKVSVPNMLSGNITLSKTDMESNNAAL

SEQ ID NO: 8101 - protein, 132 aa, B.fragilis
QRLLKCLNLFGMAKIKTEKQYKAACSRIEELLKVVSNDTPTDDKNFLELDLISDLVADYEEEHFPIEAPSLVDVIKLRMYEMGLTQTKLSELLNVSPSRISEYLSGKCEPTLKVAREISRKLNIDANIVLGV

SEQ ID NO: 8102 - protein, 495 aa, B.fragilis
THSPMSFIADKIVMDGLTYDDVLLIPAYSEVLPRTVDLSTKFSRNIELKIPFVTAAMDTVTEAKMAIAIAREGGIGVIHKNMSIKEQAKQVATVKRAENGMIYDPVTIKQGSTVRDALALMAEYKIGGIPVVDDNRYLVGIVTNRDLRFERNMDKRIDEVMTKENLVTTNQSTDLEAASQILQYHKIEKLPVVDKEGKLIGLVTYKDITKAKDKPMACKDSKGRLRVAAGVGVTADTFDRMQALVDAGADAIVIDTAHGHSKGVIDTLREAKKRYPDIDIVVGNIATGDAAKALVEAGADGVKVGIGPGSICTTRVVAGVGVPQLSAVYDVAKALKGTGIPLIADGGLRYSGDVVKALAAGGYSVMIGSLVAGTEESPGETIIFNGRKFKSYRGMGSLEAMENGSKDRYFQSGEMDVKKLVPEGIAARVPYKGTLYEVIYQLTGGLRAGMGYCGAPDIEKLHDAKFTRITNAGVMESHPHDVTITSESPNYSRPE

SEQ ID NO: 8103 - protein, 788 aa, B.fragilis
NRALIKKDMDRRDYYVEYYEVLDRVLSDYVNQLREKREHWLKMGRHDVGVPLINLLFWQFTWHREEYDRLRKEGKSCGEALGSVKEILADKQVEEWERQEEEYKIYDHEWYEALAPYGGQLVIYIYNARQLVYLTPLIERLEEPVLLLSEYEIPDETELPDFVTAITLEFTKTAPLVNPFLKEWFPLIFQYANTFDILMRILQPKGLIFLEGCHYQQLLLATIGRDYGVPTLCIQQGWPSLMHTAFRRMPYRYYLMWGEGFRTLWEKHNPLPDFVPTGYMYQVEPRNETKKECVTFFLQGPFFLSDKRYLQEMIRLIGTVAVEFPARRFLVREHPEFRIGEEVRMEWEQIPNIEMVTDGKLAEVFARTRVGVAHYSSSLMEGVAHGAVPLVYDPTEGSRYSPDVEAEGLGMIAKTKEELTGGLSRILGNYEDFKQRIEKEQPLWLQATGEETLRNMVGFIKEKMPPVTLKEIYVVDTDTLTRERPVGVSGVLRCKNCEDFLEMCIDSCIDGLDELIAVYHDCTDRTPEILRQKAAQYPDKIRVFEYRPSVYPIDLDEEELEKAKLLPPDSIHTLAGYCNYALSKASYRYAVKIDADQVYFTDRLKHICDAYRSDKKVRFNVAECISYNLYRAYVDSFNRIEMRPFRWLERIALWTHASYASYLEKMIIRYKVPVSMSGINLFRKDREWMVGLGQEHPEPDSKEILPPFNGVRDTFFFEVSADRIFRYVTETKPDGRHRGVEVMRCPNEILDVGFCWFHLRALMKEHEEGYRQSYRKHPEVFTTVQEIS

SEQ ID NO: 8104 - protein, 60 aa, B.fragilis; identical to SEQ ID NO: 7905

SEQ ID NO: 8105 - protein, 68 aa, B.fragilis
TYATKLQVPKMKSKFEDGQYLNIYHIKSATYINSFLFDGQTGLTTRPTEAISGTPSSILSLCLRLLKA

SEQ ID NO: 8106 - protein, 87 aa, B.fragilis
NFVTMKKLSKIKLTNLSQEDLADREMNALRGGHNCGCACSSTSKATNHSSNEDRDLHSPEGNVICTWVGGAGSDISVYGGSKAPGMP

SEQ ID NO: 8107 - protein, 89 aa, B.fragilis
NFVTMKKLSKIKLTNLSQEDLADREMNALRGGHTCGCACIKGAEFKATNYSANVADDKYSPEGNIICNWVGGSGSDMAVYGGSKVPGMP

SEQ ID NO: 8108 - protein, 259 aa, B.fragilis
PQRTDSFGRGRWKLFVQRRPSGPVLPAGLSKDDSLLFAEHYVRSWVEDVLLFNQAQSNIPDNGEIDKLVENYRKALIMHTYQQELISQKLSGEIPEQEIADYYEKNKELFKLDRPLMKGLFIKVPLTAPQLGNVRKWYKTETQDAVEHLEKYSLQNAVKYEYFYDKWVRVADVLDMIPLKAESPEAYMDKNRHIELKDTAFYYFLNISDFRVAGEQEPYEFAQPKVKDMLVNIKRVDFMKQVKDDLYERAVKRKKIINY

SEQ ID NO: 8109 - protein, 102 aa, B.fragilis
YEIAMGMFNVRKPRGFNHQYIYVDERKEKLAKMEEDAKRDLGILPEKEFSPEDIRGKFIEGTTHLKRRKESGRKPAHLGVILAIIALLIFLWHYLQTGSWSF

SEQ ID NO: 8110 - protein, 195 aa, B.fragilis
KREALGKFDKYKIDLKGMQADSCKYEFLLDNLFFAHIDGPEVQKGKVNVELTVKKTSRAFELSFRTEGIVWVPCDRCLDEMEQPVTSSDKLMVKFGHEYAEEGDNLIVIPEEEGEINVAWFMYEFIALAIPMKHVHAPGKCNKAVTSKLNKHLRTSGDDDAEESFGAGEDIVVEDEAEEQIDPRWNELKKILDNN

SEQ ID NO: 8111 - protein, 431 aa, B.fragilis; identical to SEQ ID NO: 6067

SEQ ID NO: 8112 - protein, 63 aa, B.fragilis
KKMAHPKRRQSKTRTAKRRTHDKAVAPTLAICPNCGEWHVYHTVCGACGYYRGKLAIEKEAAV

SEQ ID NO: 8113 - protein, 728 aa, B.fragilis
IKMAGKINLTDQLKKYFGFDNFKGNQEPIIQNLLDGNDTFVLMPTGGGKSLCYQLPSLLMEGTAIVISPLIALMKNQVDAMRNFSEEDGVAHFINSSLNKGAIDQVRSDILAGKTKLLYVAPESLTKEENVEFLRSVKISFYAVDEAHCISEWGHDFRPEYRRIRPIINEIGKAPLIALTATATPKVQHDIQKNLGMVDAHVFKSSFNRPNLYYEVRPKTQNVDKDIIKFIKNNPEKSGIIYCLSRKKVEELAEILQANGINARAYHAGMDSATRTQNQDDFLMEKIDVIVATIAFGMGIDKPDVRYVIHYDIPKSLEGYYQETGRAGRDGGEGQCITFYTNKDLQKLEKFMQGKPVAEQEIGKQLLLETAAYAESSVCRRKTLLHYFGEEYTEENCGNCDNCLNPKKQVEAQELLCAVIETIIAVKENFKADYIIDVLQGRETSEVQAHLHEDLEVFGSGMGEEDKTWNAVIRQALIAGYLSKDVENYGLLKVTDAGKKFLKHPKSFKITEDNDFEEVEEETPARGGGSCAVDPVLYSMLKDLRKKLSKKLEVPPYVIFQDPSLEAMATIYPVTLEELQNIPGVGAGKAKRYGEEFCKLIKRHCEENEIERPEDLRVRTVANKSKMKVAIIQAIDRKVALDDIALSKGIEFSELLDEVEAIVYSGTKLNIDYFLDEIMDEDHMLDIYDYFKESTTDKIDDALDELGDEFTEEEVRLVRIKFISEMAN

SEQ ID NO: 8114 - protein, 398 aa, B.fragilis
NLFYMKARHFFYPFLSLFSVAMFASCSSSVPKSPEQRVEYNEDFFSIAVSDVKDTIKVYIEDLVDSLVILPLDNDKKALCAPLTVYITEQHIGLTPSERGGTYKLFSRDGSFLCNVGGFGQGPGEYTALLYHQIDEKAKRIYLNTFEASQIMVYDFKGQYLHDIPLASILHKGSFKVDSEHKMIYCFDVPAGQSPFVWKQDFEGNIKGKIHSYPYTLKPDFGNDVQTMFNTEAFYTSVSAGFEQLEGMNDTLYHYYPETDVLTPVFYADFGKEGHQHRYLNTPLNYYVGLSSGYTNDRGPFTTLDYTVIKVDKKTHEASYIKLFSRGYGGLSLDLYYAQFRFGYFYLWMEPIELKEQLSQILKLSEMDTAMRGKVEKLYNGLSENGNSVLLFGRLKQK

SEQ ID NO: 8115 - protein, 424 aa, B.fragilis
PINYRPMKLDYIALFLVLFFLAACGSKSSSPDMMDDNALPTEETFKEIDLANNLEDCGKPLLLSDIVKDVEYVKLETQDNILVGDIKQLKRTEQYIFIYSRRQNHIMMFDKSGKFIRRIGRVGQGPGEMSNIQSFTTNDNRVFIYPLSRSSSFMIYDTQNNDFIKEVSLKYPVSVNDKIDIMDNCLIYYPGIIYFPGNKEGFISACVINTDGQIVREQVPEMPVEAKKIDMAIDPDISWNYQGKSNIYSLINDTIYGITCDSIFPRYHLSLGKYKLPPEKYNFCNNLDLGDFILIKSVCETKDYLLFSYWFNCKMWFSRYDKNKDKIDSWEQVPFEVRYWMIRDAPGVTNDIDGTQSFRGNNNMKDVGENCFCFVITPDNLDQVRRNVAEAKVKFPEKQAELLKLLDEMGEDDNPIIAFYKLKD

SEQ ID NO: 8116 - protein, 312 aa, B.fragilis
NASYFDSMRFFVSINKWKTMHKAGFVNIVGNPNVGKSTLMNVLVGERISIATFKAQTTRHRIMGIYNTDDMQIVFSDTPGVLKPNYKLQESMLNFSTSALADADVLLYVTDVIETPDKNNEFIQKVRQQSAPILLLINKIDLTDQEKLVKLVEEWKELLPQAEIIPISAATKFNVDYVMKRIKDLLPDSPPYFDKDQWTDKPARFFVNEIIREKILLYYDKEIPYSVEVVVEEFKEDAKKIHIHAVIYVERDSQKGIIIGKQGKALKKVATEARRDLERFFGKTVFLETYVKVDKDWRSSDKELRNFGYQLD

SEQ ID NO: 8117 - protein, 423 aa, B.fragilis
YREYRRRSILEIWIKDDSFMKHIYLIGNGSRAAQYGVGTYIRQMLEFFRQTSSVRLTIVELNSEVKEVTEECDNSGKVCYLKIPAQKSEGRKGDVAHCYRNIAYLLALHFLKDEQNVLHLNYLHHAPLADWLKKIGVEFYLLVTIHYLDWCFMLKGNTRLFRSIIHKEEQSNEWGKKIRNSYERDKRLFQHSDKVICLSQYTQNLLREDYGVEKEKLVVVYNGLKDEAIKLSKEERLEKRSALGFRETDKIILFVGRLDRIKGVQYLIEAFRQVIRKNPNSRLVIVGDGDYDKYLKQCAGIWSYVVLTGKVEKEVLYTFYQIADVGVLPSFHEQCSYVAIEMLMHGLPLIGTGSTGLKEMVEGMHCLPLKEEDDSVDLPIDLLVQWLIEDQEHLRSEKYRRRFEERYTLRKMSENMFSIYLNL

SEQ ID NO: 8118 - protein, 495 aa, B.fragilis
IHRYMKNDIAFSTPFHAYVYSFRHKEYLPLHPILKRIYTVVEEKKNIEEDEELKCYPKEQILHYLQKYKFLKENEFIGEKVKTEFGEITETMVRREVENLTVLTFEVTERCNLRCRYCAFGDLYYGYDERKGENLDFPKAKQILDFLFGIWEKIPHLSVARTLTVGFYGGEPLMNMDLIKQIVSYIDEHKPEGMKFAYNMTTNAMLLRVYQDFLVEHKFHLLVSLDGTEADDCHRVTVNGKSSFAQVFEQIKNLQFCYPEYFKKYVSFNSVIHSESNIERIVDFFRAEFDKQTSLSELNNSSIAQEGKYAEMRKSVFQSIALSPRRKEIDQQLMYNAPDISTVTYFLHHLSNEVFRDYRSMFYGKRNFKLLPTGTCIPFNRKMYVTVHGKILVCERIDHDFAVGHVTDEGVELNFAHVAENHRKYCSKLLSQCKQCYMQESCSQCMYYTNVLADKVVCRNFKNREMFAGYLAMNVDYLEHNRWAYSKVMKEIFIF

SEQ ID NO: 8119 - protein, 413 aa, B.fragilis
NLFHMKARHFFYPLLFLFSVAMFASCSSYVPKEGDIIEDSAFRSVDLRIIEKAEGTVMSLSDLVESYEVIKLENRDEALIKTYPFGIFASDNYILLNPDAISPIKLFTRKGQYVADIGGIGQGPGEYKTIHFCMIDEKQKRIYLGPGRANKILTYDLKGNYLSDEAIHFKEIVHKPCIWMDHDKKHVTVVGLPFSENENSNFEISNNVCWVQNREGDIVHRISANHYGLIGDYSNGLVACRNVDAISFSIFEDPMLRTRPDTLYHYDAVKNIITPRFTIDHVVSENQSACTVLYETSRSYWARVTLYPNDISSNSSPVRLTTFNVCVSKKDGSVKRIDRFTNDFLGLSYPFLTMRNGYVCISYDPLELMDALDKVLTQTDLKPEIRKRATGLRNSLHENDNDILMIGKLKSNY

SEQ ID NO: 8120 - protein, 78 aa, B.fragilis
RIEQTYSFSGKVYIYPVDHLIILSQIPCRLLQHIVSLIRNPPLMWTLSMTGSLDYSKIVSNHVNIIISFNHLEPHFYQ

SEQ ID NO: 8121 - protein, 88 aa, B.fragilis
SLMQRIIVLSSYLKLSIIQLTMRKTGLLVISLLFCASCADKHDRKGQTPLVEVDGNFLYKEDLQGRCSPPVCQKMTVFFSPSTTSVAG

SEQ ID NO: 8122 - protein, 214 aa, B.fragilis
QRQQEDTSMVGSLLIGNKHFLVRELVQAGRSTSCLGLTNGKMGIAIALFRYGRLSGELAYEEVASELLDDVCQNLNYSMPISFNDGLCGIGWGIEYLIQHGYVDADGDEILRDIDLYLIRCIHIYGLSGLSLRNGIVGLGRYILIRITPTFLFGDTFSSALLKEYFIYLIDWLEEELKRVDEPVDDLLDFLFDLYPTGFYQTKVSDLIKYCMNK

SEQ ID NO: 8123 - protein, 83 aa, B.fragilis; identical to SEQ ID NO: 6082

SEQ ID NO: 8124 - protein, 571 aa, B.fragilis
LQFNNGTNFLTIFRINHCESFGNLTDIHFIHHFSNLLRQILHFEFSGLVLRVLHQTVAVARIFVLRQSRSSLIKGKLIATDIVGNRVETRIGFIQLLIRHFGLQQDMTGVDTVATFFDQLDDMETILRLYDFRDLLGILQVESDIGVFGNHLPFTHKTGFTTFDSRAAIFGIQQGKRREITFTLIDTVGVFTQASFYIFNFGNRYFRLLRNNLYFYLGGDVRNTVLGKLLKVTAYFRRSHFDITYQFLLHPLYNQSVTGILAHGFTNLCRGLIKLCFHSFSATQSLNIITDLIVDTLYDFCLGHFNTVEHSLVHIKFLYGQLFGNHTIRITIKLTPFIQSGQSCFFHIGLQDSFVANDPNHFVNHIVLCIGCHVSNQCQGKHNNKLKVHKLLHSVYLIIYNLLSFYCTLVQIVFHLFHKVNPLDVDKHILDFRLSKFIRFLFARHTEITDIQKIVKCRIFQFNMPVFIHIGFRGFRFQRDHIQHIGHPHPFIIKILILHCVLQTILFQMLNGILSLRFVPLTHVAQLGSGQRNFDKQTFHQWTVQLKQFFVLFVIVCYFLFGDLARQFLAD

SEQ ID NO: 8125 - protein, 75 aa, B.fragilis
FNNKRIKETESLQKRLCAGSKNLVIEIEKLIDHLSAAKKRIKTGIAITFSLFLYTKPMNFSDLERFRGENRKYGL

SEQ ID NO: 8126 - protein, 458 aa, B.fragilis
ISINESKSSICWDIWALCTNLPQVGVKLEKEEKAVHANSIREIFYTFLNRFIMKNLYLILVLSALVACTGSSQKEKPACVNTPVEPFTGLPVFDLQGQYPEKEIILQDIADVRYVVLETGDSSLVGTRTILMTDSLLVTVNKKSDVIFFDKSGKYLHSFNHTGMSGEEYGDVVSGYCIDEKAREIFIYDGLQSRIQVYGYGGAYRRTLKLPQNRMFASSIFEYDENFLFGEDYRLVDYQIGKYPVNKTPYYKISKKDGKLTSVPITVKGRIRDGLYTVGDGESGGYVSLSMSPVARLGSDILIADYSLDTAYVYRDDHLIPLTVRRNHTSENNIPILATVDVMTGRYLLWYTIVKDIDVKNNRVSDPVSYLYDRFTNEYCRVDLVNRDGVSATNVPAFQMRLSANYHVVPENYAIQCYPAEKLIELNGQGKLKGELKEIASKLNDEDNPVLLIAKFKE

SEQ ID NO: 8127 - protein, 264 aa, B.fragilis
INKKTMKYSEQITIGIPVRIDSPARMRNLQVLLRHLSLSGIKIHVWEAGDVRSELSGFASNKDTYTYERDESLVYHKTLYVNRLLKAASTPVVAIWDADILLPLSQIEASVLAIIEQGYLLSIPYDGVVKMLSEAQSEAFEYSGQGCDYLTMFAATYARLMRRPSCGGVFVVDREKYLHWGGDNERFVSWGPEDAERIRRIEILGYPVHWVKEGPLYHLWHPRGENSGYATEELAFQNRMEFIKVCSMERNELREYIKSWKNNG

SEQ ID NO: 8128 - protein, 203 aa, B.fragilis
NPGKTMGKVDEALLKRIADHQMLHGSFRRDLGVLNGKMGIVLFFFHYARYTGRVLYEDFAGEMLEEVIQELHSDLPIRFSDGLCGIGWGVEYLIQNAFIAGDSDEILEDLDQKIMEWDPRRATDLSFESGLEGVACYASSRLKSTVRNRMPFDQVYLSELEMAVQQKGLRMRLELDDVFVRVIDIGNIEEEVSWKYGLKMIAL

SEQ ID NO: 8129 - protein, 438 aa, B.fragilis
TMGNLVAIVGRPNVGKSTLFNRLTKTRQAIVNDEAGTTRDRQYGKSEWLGREFSVVDTGGWVVNSDDIFEEEIRKQVLMAVDEADVILFVVDVTNGVTDLDMQVAAILRRAKSPVIMVANKTDNHELRYNAPEFYRLGLGDPYCISAISGSGTGDLMDLIVSKFKKESDEILDEDIPRFAVVGRPNAGKSSIVNAFIGEERNIVTEIAGTTRDSIYTRYNKFGFDFYLVDTAGIRKKNKVNEDLEYYSVVRSIRAIEGADVCILMVDATRGIESQDLNIFSLIQKNSKGLVVVVNKWDLVENKTDKVMKTFEEAIRSRFAPFVDFPIVFASALTKQRILKVLEEARKVYENRMIKIPTARLNEEMLPLIEAYPPPATKGKYIKIKYVTQLPNTQVPSFVFFANLPQYVKEPYRRFLENKMREKWDLSGTPINIYIRQK

SEQ ID NO: 8130 - protein, 519 aa, B.fragilis
NDMKKILVGTLTCLFGAIAGHAQQDPVLMRINGQDITRSEFERFCHRNKPSGIAGKETLKRCADLFVDMKLKLSAAQKAGLDTVSDFRTEMENYHRALSRSYLTDSATDEAYAKKLYDQMKTRSAAGEVKVMRIFRYLPQTALPHHLREAQILMDSLYHVLETHPDIDFRTLVNKYSDDKKEFWMGWLQTSQEFEEVAFSLKDGEYSKPFFTPKGIQIIKVTGRREIPPFEQIRGELIHKLSRRPGTDKEIELWVNKLKSTCQYTPDKAGMEELLASGRTSRTLFTLDGKSFTGKDFERFADAHPMGIKRQLNAFVVKSILDYENNRLEQKYPDFRLALQQRRDDLLLAAITRRESRQVSLSDSVALKAFFKEHRTDYNWDSPRYRGAVLHGTHKKTLKSARKFLKKLPEEEWKDAIRLTFNTPASPATIRIEQGTFAEGDNVFVDKLVFKKGDFEPLKSYPFTVVLGEKKKGPESYHEIIPQLIRDYQNHLDALWTERLRASAKVEINQEVLKTVNNH

SEQ ID NO: 8131 - protein, 627 aa, B.fragilis
RQMKSSYICCVLLFVLFLVSCTDGRSEGQVARLLRQAEMCMEECPDSALVYLHQIPDPEKLTGENQADYCLLLTQAMDKNDLPLSSDSLIQIAVGYYSNGKDRLKKGKASFYLGRVKSSRGMLEDAQKYFLEALSILDVTDNLKYQALVRNHLGQLYMNLDLYQDALIMNSQSVSLFQQLTDTANLVYAERDMGRIYLLEGRQDSASLYYQQAINDALSYFKSDIYKDIVSEWGQISMYLEMSPSAEQMLLSNLESDLVLDKTPVCLSLGIYYLSNKLYSKAEGYLLKAAASSRPYTRVSAYKYLGHLETRNLDLIYWDQYEQALDSLERQNLAYAVKEIQEKYNNAALQAHTFKLENERLHSTISYLSVILLLLSITSVIYVFYMKERRRRQIEKEEFNRNMKAHEQERARLLAELSDSKLHVEKLEQLKSEQKQSSLEVQEKTNALLEQEKEHSCKISQQLEELKKKWKNQLSINIDLRARNKDLSYKIKSLKDSDMENTPGLYASINLLVRILTCDLSEIKTLKVDDWEGLFQCIDLLYGNSLRKFIDQYQKQHDEELDRRVVAICYFEYIKVKHARQAAILRVSAQALSKRKQRLKIELGVPDMASVGRVVKPVCPSNKKELM

SEQ ID NO: 8132 - protein, 571 aa, B.fragilis
SYFDMFRFNKENKFQGRHRFLLAGTLCLLAVCFLMAQDKKPQHDKKAQPEQKVEPEKAQGKKKTRVDLLHADQGQADKLARPDVQVLIGSVKLRHDSMYMYCDSALIYEKTNSFEAFSNVRMEQGDTLFIYGDYLFYDGMTQIAQLRENVKMINRNTTLLTDSLNYDRLYNLGYYFDGGTLMDEENVLTSDWGEYSPATKLSVFNHDVKLVNPRFVLTSDTLKYSTDTKIATILGPSDIVSEQNHIYSERGIYNTVSGQAELLDRSVLTNDGKRLTGDSLFYDRKAGYGEAFDNVQMNDTVNKNMLTGDYCYYDELKQNALATKRAVAVDYSRGDSLFMHADTLLMNSYNLDTDSLFREMRAFHKVRMYSIDLQGVCDSLVFNTKDSCLTMYRDPILWNEGQQLLGEEIKVYMNDSTIDWAHIINQALTVEQKDSIHFNQISGKEIKAYFAEGEARKVDVIGNVLVVYYPQEQDSTMIGMNTSETSLLNMYLKDRKMERMVMSPKSNGTLYPMNQIPPDKMKLPTFSWFDYVRPLSKEDIFNWRGKKAGEALRKTERKAISGPKREIINMK

SEQ ID NO: 8133 - protein, 107 aa, B.fragilis
CFFDMKSQRLGLQPIKNYERVVNPRKKRFHMSSRMNSHGKIIITKIADYESNYIKKAGLLEGDEIIAINEIPIKMITIEENTKLNRRGQGKSYKIPVVIDRNEVQGD

SEQ ID NO: 8134 - protein, 69 aa, B.fragilis
KHAEIYGSFIKHHSFRNMFIKFIFVLTYQKEEHYCHFPTIHYKAFQLYPSSQYPFRKVSISAIAALSIQ

SEQ ID NO: 8135 - protein, 339 aa, B.fragilis
IKTELMEKINAVITGVGGYVPDYVLTNDEISKMVDTNDEWIMTRIGVKERRILNEEGLGTSYMARKAAKQLMKKTGSNPDDIDLVIVATTTPDYHFPSTASILCDKLGLKNAFAFDLQAACSGFLFLMETAANFIRSGRYKKIIIVGADKMSSMVDYTERATCPIFGDGAAAFMVEPTTEDLGIMDAILRTDGKGLPFLHMKAGGSVCPPSYFTVDNKMHYIHQEGRTVFKYAVSNMSDVSAAIAEKNGLTKDNIDWIVPHQANMRIIEAVAHRMEVPMEKVLVDIQHYGNTSAGTLPLCIWDFEEKLKKGDNIIFTAFGAGFTWGAVYVKWGYDGKKE

SEQ ID NO: 8136 - protein, 130 aa, B.fragilis
SISFSISITRFLLPAQRRFCKLSVSLILLLLNHLPESFISFISFFIIFTMNIYVGNLSYRVKEADLQQVMEDYGTVTSCKVIMDRETGKSKGFGFVEIADDAAGAKAIAELNGAEYEGRTMVVKEARPRE

SEQ ID NO: 8137 - protein, 62 aa, B.fragilis
NRLLRNKDFSLSVIGIDKARDYPVKCIEIREVADVEYIPLEAVSSSLLINDIWGYYVFYLSK

SEQ ID NO: 8138 - protein, 257 aa, B.fragilis
QRIWKKASKMVLRTEDLVKKYGKRTVVSHVSINVKQGEIVGLLGPNGAGKTTSFYMTVGLITPNEGRIFLDDLEITKYPVYKRAQTGIGYLAQEASVFRQMTVEDNIASVLEMTNKPLDYQKDKLESLIAEFRLQKVRKNKGTQLSGGERRRTEIARCLAIDPKFIMLDEPFAGVDPIAVEDIQQIVWKLKDKNIGILITDHNVQETLSITDRAYLLFEGKILFQGTPEELAENKIVREKYLSNSFVLRRKDFQLKD

SEQ ID NO: 8139 - protein, 224 aa, B.fragilis
LMNRTFCFVPVRKGSRGIPGKNLRLLGDKPLVCWIIDTILASGIADEVCVATNCDEMESLIRGRYKGVVQIFRRSEWSARDEASSLEVVQEYLNYRKPDRNDDFILLQATSPFTTAQELRGLVEEMKRGEADSYVACCRLKKFRWSDEGRPLDYSFETKPRRQEYKGFLIESGAFYASTVGRILDSGQLLSGVVKVVEVGPAGMIDVDEEADWRLAEHYIETGL

SEQ ID NO: 8140 - protein, 455 aa, B.fragilis
IIVRMNVSLQNIDKVSALLTVKLEKADYQPQVDKSLKNIRQKAQVPGFRPGMVPMSLVKKMYGKSVIADEVNKLLSEKVYAYIKENIINILGDPMPIEEKQPDIDFDTKEEFEFVFDIAWAPEFKAEVSDQDKVDYYTIEVPDEMVENQIKAYTQRNGKYEKVDAYEENDMLKGLLAELDEEGNTKEGGIQVEGAVMMPSYMKNDEQKAIFANAKVNDVLVFNPNTAYEGNAVEMASLLKIDKEAAAEVKGNFSFQVEEVTRFVNGELNQEIFDQVFGKDVVKTEEEFRAKVKESIAAQFVADSDYKFLIDVRKVLTDKVGKLEFPDALLKRVMLVNNKDKGEEFVNENYDKSIEELTWHLIKEQLVKENDIKVEQDDVINMAKEATKAQFAQYGMLTIPDDILENYAKEMLKKKESIDGLVNRVVETKLAAALKGKVTLENKTVSMEEFNKMFE

SEQ ID NO: 8141 - protein, 88 aa, B.fragilis; identical to SEQ ID NO: 7984

SEQ ID NO: 8142 - protein, 80 aa, B.fragilis
SLQRYKKSPNVMYYLTNFHLNLKLVDIIRATKIRIIILITYKLSVNIRILNSILFITRFPYSQGQSRNRAARRSLSFPPV

SEQ ID NO: 8143 - protein, 96 aa, B.fragilis
CVMRIISFAAIRNYAKKHADADVPLRDWYKKTEKADWSCLADIKQTFNSVDYVGNDRFVFNIKGNDYRLVAMILFAAKKVFIRWIGTHKEYDNKDC

SEQ ID NO: 8144 - protein, 260 aa, B.fragilis
TFNGMIEVKGLYKSFEGKTVLHNIDATFENGKTSLIIGQSGSGKTVLMKCIVGLLTPEKGEVLYDGRNFLAMGKKEKKHLRREMGMIFQSAALFDSMSVLDNVMFPLNMFGTDTLREQTKRAMFCLDRVNLTEAKDKFPGEISGGMQKRVAIARAIALNPQYLFCDEPNSGLDPKTSLVIDDLIHDITREYNMTTIINTHDMNSVMGIGEKIIYIYQGTKEWEGTKDDIFTSTNEQLNNFIFASDLLRKVKDVEIQNLEG

SEQ ID NO: 8145 - protein, 84 aa, B.fragilis
VSTGRRPIISGISPNDFKSCGAIYCIMLFLSIVAVLREALYPTTWVLRRWAIFFSMPSNAPPQMKRMFFVFTGIIFWSGCLRPP

SEQ ID NO: 8146 - protein, 410 aa, B.fragilis
STLIFDVYNLINMRMNKYWGTWIVFIGVFFHSCKQEVKQNNISFYSVDLLEMEKMKGEEILLSDLIESLEIIKLDNREEALIATYPFGIDVSSNYILIEPDGVSALKLFTRKGRYVADIGGVGQGPGEYKYAVNRFLDEKQGRVAIAENKKILFFDLKGQFLSEESISLPETITKSSIWIDLENEKAVVVVLPFADIGNPKAPISKNLCWVQDFKGNILQKISAINYAIVPDYSNEVLAPRNVDAYSFSLCQVVGRTRPDTLYHYDIANNLLKPYFTLDNVMQEDKYIVTSLYETPEYYWSRVTIGPAKVLSDGAPVRMTVFNVRVSKKDGSVKRIDRFTNDFLGLSYPFLTMRNGYVCITYEPLELMEALDKVLAQTDLKPDVRKRATDLRNSLHENDNDILIIGKLKQ

SEQ ID NO: 8147 - protein, 403 aa, B.fragilis
REYMKKYLYFIFFVTLWSCSADKVNVKSEDNSFYSVDLRIIEKTKGTVMSLGDLMESYEIIRLDNRDEALIKTYPYGVYVTDNYILLRPADVVSPVKLFTRKGRYVADIGGVGQGPGEYLYLFSWLVDEKENRIYLGPGRADKVLVYDLKGNYLPDEVIRFGEIVHKSQIWVDYDKKNVVVVTLPFSANVNSNFAINKNVCWVQNRDGDIVHRIPVNHYGLIGDYSNALVARRNVDAISFSISEIPMLRTRPDTLYHYDAVKNIITPCFTIDHVVSENQSASTVLYETSRSYWAYVTLYPNDISSSAFSVRLTTFNVCVSKKDGNVRRIDRFTDPLLGLSHLFLMMNNGYICISYDPLELMDALDKVLTQTDLELDVRKRATDLRNSLHENDNDILIIGKLKQ

SEQ ID NO: 8148 - protein, 83 aa, B.fragilis
ILNIMKTLRRIKLNSLSQEDLADREMNMLRGGSNCSCGCMGVSSKASNLEGNKDCGYPLSCTCGCTGPYALAANQEANKGAGI

SEQ ID NO: 8149 - protein, 167 aa, B.fragilis
SVSIIILVKFRFMDKIYLWLLLLISCSCSHTKEKVSNDMDSSLCVIDVTCEYPVEKVNIHDVADVEYVPLETTRNSLLASDCSVFRISDDYITVASGVDNGNIFFFNRKGRYLWTFNRRGGSAEEYSSITAWDADFGMQEIYIYDSFRKKIYTLIPQHYNLTLFISS

SEQ ID NO: 8150 - protein, 268 aa, B.fragilis
LRILGYIYSFDGRYKRSHALPMKDCTFIDLYNYDKDYLIGYNRFYDFRKKKKVDTHPYYLIDKQSGEMSSIGIVVDKPISEKVHTEIVKFPGGAYKDQVLFLITALIKNGDAFLIADYALDTIYSYRHHKLVPIAVQTPSVYASDPPVIVACELYTDSYLHFRIIPMYYNPSAPMSPMADAPELVLNRHTGKIAEWKMYDYNYSSDIERPVPTMILQSADRENYGISMFTAERLIEQYQAGGLKGELKDIASRLSIDDNDILMICKYK

SEQ ID NO: 8151 - protein, 418 aa, B.fragilis
EINMAESKNNKKRCSFCGRSENEVGFLITGMNGYICDSCATQAYEITQEAMGAGKQSAGATRLNLKELPKPVEIKNFLDQYVIGQDDAKRFLAVSVYNHYKRLLQKDSGDDVEIEKSNIIMVGSTGTGKTLLARTIAKLLHVPFTIVDATVLTEAGYVGEDIESILTRLLQVADYNVPEAEQGIVFIDEIDKIARKGDNPSITRDVSGEGVQQGLLKLLEGSVVNVPPQGGRKHPDQKMIPVNTKNILFICGGAFDGIEKKIAQRLNTHVVGYNASRKTATIDKNNMMQYIAPQDLKSFGLIPEIIGRLPVLTYLNPLDRNALRAILTEPKNSIIKQYIKLFEMDGVKLTFQPEVYEYIVDKAVEYKLGARGLRSIVETIMMDVMFEIPSEDQKEYEVTLDYAKHQLEKANLARLQTA

SEQ ID NO: 8152 - protein, 246 aa, B.fragilis
LCVFLCLCVLFCFFAVTLLIIERNVTMDDFRKYATKHLGMNAMVLDDVIKSQAGYLNPYILEERQLNVTQLDVFSRLMMDRIIFLGTQIDDYTANTLQAQLLYLDSVDPGKDISIYINSPGGSVYAGLGIYDTMQFISSDVATICTGMAASMASVLLVAGAKGKRSALPHSRVMIHQPMGGAQGQASDIEITAREIQKLKKELYTIIADHSGTSFDKVWADSDRDYWMTAQEAKEYGMIDEVLIKK

SEQ ID NO: 8153 - protein, 139 aa, B.fragilis
LKKIAMKHLLSTIIFLFAVILKGNAESYSFPSPNEINSVINLDLKGIFSSTHTKSLPLTPVEASLVDNTLLNISFVVHSGEVTVRILSEKGILYSSCINSDQQNSLAISVEDFERGDYKLELTTPAGGYVYGWFTINWE

SEQ ID NO: 8154 - protein, 459 aa, B.fragilis
IHRMKKFVNFKFVVMFALALVANVASYAQDNVIDEVVWVIGDEAILKSDVEEARLAALYEGRKFDGDPYCVIPEELAVQKLYMHQAVLDSIEVPEAEVIQRVDYQISNYIQALGSRERMEAEFNKTSTQIREAMRENARDGLIVQRMQQKLVGDIKVTPAEVRRYFKELPQDSIPYVPTQVEVQIITQQPKIPVAEIEDVKRRLREYTDRINKGESDFSTLALLYSEDRGSAIKGGETGFMGKGQMVPEYANVAFNLQDTKKISKIVESEYGFHIIQLIEKRGDRINTRHILLKPKVSDKELDEANARLDSIANDIRSDKFTFDQAASALSQDKDTRNSHGLMQNPQNQTAKFEMQDLPQEIAKVVDKMNIGEISKAFTMVNPKDGKEVCAIVKLKSRINGHKATITDDYQNLKEIVLDKRREEALQKWIVEKQKHTYVRINPAWQRCDFKYPGWIKKD

SEQ ID NO: 8155 - protein, 323 aa, B.fragilis
NEVVFPAPFGPSKPTISPCFTLMETWLTTVRLPYFFTKSSVRSTILLAFFHILCYFAANVAKISRKNVHLQTNIRVMIKALRTVGRYIMLMGRTFSRPERMRMFFRQYIKEIEQLGVNSIGIVLLISFFIGAVITIQIKLNIESPWMPRWTVGYVTREILLLEFSSSIMCLILAGKVGSNIASELGTMRVTQQIDALEIMGVNSANYLILPKITAMVTMIPILVTFSIFAGIIGAFATCWFGGIMTATDLEYGLQYMFVEWFVWCGIIKSLFFAFIIASVSSFFGYTVEGGSIEVGKASTDSVVSSSVLILFADLVLTKLLMG

SEQ ID NO: 8156 - protein, 634 aa, B.fragilis
TKTVKAKSIMSDIIHLLPDSVANQIAAGEVIQRPASVIKELVENAIDAEAQNIHVLVTDAGKTCIQVIDDGKGMSETDARLSFERHATSKIREASDLFALRTMGFRGEALASIAAVAQVELKTRPESEELGTKIIIAGSKVESQEAVSCPKGSNFSIKNLFFNIPARRKFLKANSTELSNILAEFERIALVHPEVAFSLYSNDSELFNLPACHLRQRILSVFGKKLNQQLLSVEVNTTMVKVSGYVAKPETARKKGAHQYFFVNGRYMRHPYFHKAVMDAYEQLIPAGEQISYFIYFEVDPANIDVNIHPTKTEIKFENEQAIWQILSASIKESLGKFNAVPSIDFDTEDMPDIPAFEQNLPPAPPKVHFNSDFNPFKPSSSSGGGNYSRPKVDWEDLYGGLEKASKMNQPFSDSDPESEEFAVIEEESIATAAPETLYAGEPAVIEKGTQHLQFKGRFILTSVKSGLMLIDQHRAHIRVLFDRYRAQIQQKQGFSQGVLFPEILQLPASEAAVLQSIMDDLSAVGFDLSDLGGGSYAINGVPSGIDGLNPVDLVRSMLHTAMEKGNDVKEEIQDILALTLARAAAIVYGQVLSNEEMVSLVDNLFACPSPNYTPDGRVVLTTIKEEEIDKLFR

SEQ ID NO: 8157 - protein, 236 aa, B.fragilis
CFLFIFVQSKKKQTINTDKGYMEAKAEILLVDDHALVLEGMRRMLESVSDVRVADAVTSGAKAAELIGERDYDIYVLDVNLPDISGFDLVDMIREINESARIIISTMHEEIWIINRLIRQKVNAVILKSSEAVEFENAVKSVLEGNPYTCPRFQSIRQKLSLSPVQIHSKDIPTKRELDVLKAVARGCNTHEVAAELKISENTVETFRKRLIQKFCAKNAIDMVVKAMSKGWIELE

SEQ ID NO: 8158 - protein, 410 aa, B.fragilis
YLIFNAMNYYLYIEPYTLFFRKKGECLFYNTLNKKVLKIDVSNDMYFILDKLETDKYTILSDENLQTQTVSFWVNRLRETFNGDILPFSDGSVPPAIFPPFINNQRDFERLNTYEWVEKDNQVMNYLEEIYLYLNGCEEEDDSIWKQIPSYLCSDKEMDSRKLLQWLDGCIDKQISQVYLLGGDVLMYKDLNEIWGMLEQKSMSIQLYYRYDLFTENHKKLLNATIGQLTFVVPMWKFDEELFSSLSRTVEGIEQNKRWLFLITSDNEYELAEQLVSKYSLESRSIRPVYKEDNLSFFKDAVYLEETDICNTCLEKRDFYVSQKINKNDFGRLTVLPDDKIYANVNHAEIGVMEKDTIASVLYKEMTEGHSWLRIRDQKPCCDCIYQWLCPSPSNYELAIGKPNLCHVKP

SEQ ID NO: 8159 - protein, 539 aa, B.fragilis
VSAFLLIIHTLFITYDKQYFVTLRTKYLISKSMSESKRIKTALVSVYHKEGLDEIITKLHEEGVEFLSTGGTRQFIESLGYPCKAVEDLTSYPSILGGRVKTLHPKIFGGILCRRGLEQDIQQIEKYEIPEIDLVIVDLYPFEATVASGADEAAIIEKIDIGGISLIRAAAKNFNDVIIVASQAQYKPLLDMLMEHGATSSLEERRWMAKEAFAVSSHYDSAIFNYFDAEEGSAFRCSANSQKTLRYGENPHQKGYFYGNLDEMFDQIHGKEISYNNLLDINAAVDLIDEFDDVTFAILKHNNACGLASRPTVLEAWKDALAGDPVSAFGGVLITNAVIDKETAEEINKIFFEVVIAPDYDVDALEILGQKKNRIILVRKEAKLPRKQFRSLLNGVLVQDRDLNIETTADLKTVTDKAPTPEEVEDMLFANKIVKNSKSNAIVLAKGKQLLASGVGQTSRVDALKQAIEKAKLFGFDLQGAVMASDAFFPFPDCVEIADKEGVTAVIQPGGSVKDQLTFDYCNEHGMAMVTTGIRHFKH

SEQ ID NO: 8160 - protein, 127 aa, B.fragilis
QTLTFMNFKESKAIYLQIADRICDEILLGQYQEEERIPSVREYAAMVEVNANTAMRSFDYLQSQDIIYNKRGIGYFVSSGAKELIFSLRRETFLKDELEHVFRQLYTLGVSDDELLTMYRNFMMKQK

SEQ ID NO: 8161 - protein, 220 aa, B.fragilis
KRTTMSAEVQESGKKKGNSKQKKMTVRVDFTPMVDMNMLLITFFMLCTSLSKPQTMEISMPSNDKNITEEQQSKVKASQAITLLLGPDDKLYYYEGEPNYKDYTSLKETTYKPDGLRGILLKKNATAVRQVNDLKQKKLELKISEDEFTKQLSEIKSGKNTPTVIIKAMDNASYKNLIDALDEMQICNIGKYVITNIAEADEFLVKNFESKGELSQNIAD

SEQ ID NO: 8162 - protein, 473 aa, B.fragilis
FKSANIRLYLKTSYLCSSQKEAKANIMRSILIVEDDITFGMMLKTWLGKKGFNVSSVSNIARAQKHIDAQPVDLILSDLRLPDHDGIHLLKWMGEKELHIPLIIMTGYADIQSAVQAMKLGAQDYIAKPVNPEELLKKMSEALQKKEAPLPKTPLTEKSPKTKQESHSYLEGESDAAKQLYNYVSLVAPTNMSVLINGASGTGKEYVAHRIHQLSKRSDKPFIAIDCGSIPKELAASEFFGHIKGSFTGALSDKTGAFVAANGGTIFLDEIGNLSYEIQIQLLRALQERKIRPVGSNSEITVDIRLVSATNENLEQAIEKGTFREDLYHRINEFTLRMPTLKERGGDILLFANFFLDQANKELDKQLIGFDANASKALLEYHWPGNLRQMKNIIKRATLLAQGSFIGLAELGSEILETQLSTPKMTLRDEDAEKEHILEALRQTGNNKSRAAQLLDIDRKTLYNKLKLYGIDL

SEQ ID NO: 8163 - protein, 431 aa, B.fragilis; identical to SEQ ID NO: 6067

SEQ ID NO: 8164 - protein, 288 aa, B.fragilis
ATGAGRLSYICYSTFGEYFGIGLFKINFTNKMRILRDLQNVIASEYYKTRHDVAAKLFLFFPVLLTVAFIVYDLWNLSQEGYDGTNLWIYNIGRTLFMFYGMLYPLMAALFCAAYIGKEFKNDNYLLLFLFPVPRGTVYVAKLIYLLSMTFLSVLIAYVAFMLSGFILGVCLPSMGFQNFDVRILVISVFFRVFIGLLPILVIQYVFSFLFKNYALALGFSFFMTVFSMIASNWRYINFIPYSSILHAYSSFMQQTVYYWKSFETINISYFIVFSIVGYILYRYKKWR

SEQ ID NO: 8165 - protein, 513 aa, B.fragilis
PKIYFTMIGYRNLLISLFCSMAVSAAGQPRLVKSLVPDMPSQASDYFCTWNLQGYVASYKSTELTRAAMTEDYLFGDGLYQNWVDCYPAIRKDLYFVMDDSWDIPKDVNDSPNPYLGCVELSSDRFPSFRGDAVERLKQLSEQIKSKGWKGVGGWICAQKAETHAAIPEEEYWKQRIKAANAAGFDYWKVDWGKEDRNGEWRRKLTAIGKRYAPHLYIEHALRNEFIEFSDVFRTYDVENITAQPITIRRICDLLPYKTVEGAKGIINCEDEPYIAVGLGCAIGVMRHPFAGTLPDGAQDFVFPPVGRDIKRRLDEVVRGVRWHRIAEPFAVGYGTFAIDSVKLTDHWILQENETWNKGRTVGADVTADAPARVARNMKLPEVSGAPLSVCPFVLASRYPNGAVAVSTIGRNVGREYVTEKVAVSISVDRWDIPIGLFGYFKEVTMVFPSPLKTGKHTVFAQDLAGENPVDITSNVVIKDNRLIIPGEVISRVGLMNASEGDCSDPGMVIRVM

SEQ ID NO: 8166 - protein, 269 aa, B.fragilis
KRNFMKRTTYIFIGILVSVLVILMAGVVYISFQKSETNSYTLTLSEKILRTEFSGIRAVKVYANDTRRVWLDEACVNVVSSTDGKTRLLSPESEYLKISQNADTLVICLDLTTYDLPKQKKEYLIPALQAKGLQLTIEADSNLAFVANAIRGLRTRIDRLHADSLTTYIRGGELRLDSCEIRAFCVDGDGVTFNAHQSIIPHLYLDLDGVRNWGVHESVIGTEHLTGSGVYHNNLQRGECKKMIWTPKKEDAELRLTIREKGSLILQEE

SEQ ID NO: 8167 - protein, 83 aa, B.fragilis; identical to SEQ ID NO: 6082

SEQ ID NO: 8168 - protein, 100 aa, B.fragilis
PIFLTAASRRSLDRVSVPMWGTFLSEPLSIEGLVSRYLTNNLMERIPILYRNPLIMKPCGIIMLSGINLSFERLSPSKGQVGYVLLTRAPVASKESKLSF

SEQ ID NO: 8169 - protein, 283 aa, B.fragilis
ILNNKFFNKKNFIMETTQKKSTKIVGIKNAGLVIICCFIIAVCIYHFILGNPTNFMNNDPNNHPLPGNFMGTIYKGGVIVPVIQTLLLTVLALSIERYFALRSAFGRGSLVKFVSNIKEALSVGDLRKAQEICDKQRGSVANVVTSTLRKYEEMENESSLSKDQKLLAIQKELEEATALELPMMEQNLPIIGTITTLGTLMGLLGTVIGMIRSFAALAAGGSADSMALSQGISEALINTAFGILTGALAVISYNYYTNKIDKLTYSLDEVGFSIVQTFAATHK

SEQ ID NO: 8170 - protein, 65 aa, B.fragilis
NKIKTMNGYLPVGRFYRLYRIVARKKRETEGYDYQFDTLTNRPSPPSRLPEGDLKFTGRERTKEV

SEQ ID NO: 8171 - protein, 64 aa, B.fragilis; identical to SEQ ID NO: 7943

SEQ ID NO: 8172 - protein, 792 aa, B.fragilis
LINNRDLNRMIRKETVHIIWGTIQAGLVMLLLGACSTTKHLPEGEILYTGSKTIVENEPQAPLTEDALTELDAALDKAPSTKILGFVPIPFKMWAYNSLVRYKKGFGHWLFNRFAANPPVFISTVNPEIRAKVGTNLLHDYGYFNGTVRFQTVPDKKDSLKASIRYTVDMKDPYYIDTVYYTRFNPRTLRIMERGRRGSLLTPGEQFNVSDLDAERSRISTLLRNRGYFYFRPDYMKYQADTLLNPGHVSLRLIPVPGLPDAAQRPYYVGKTSVFLYGKGGEVPNSTLEYRGLDIHYYKKMQVRPNMLYRWLNYQAYVRNDSLRNSAHSRLYSQYRQTRIQERLSQLSIFRYLDLQYIPQDSTATCDTLNVRLQATFDKPYDAELEFNLTTKSNNQTGPGASFGLTRYNVFGGGETWNVKLKGSYEWQTGQNKGSSLMNSWEMGVSTALTFPRVVFPSFGGREYDFPATTTFRLYIDQLNRAKYYKLLAFGGNATYDFQPTRISRHSLTPLRVTFNVLQHTTKAFEEIADQNKALYRSLQNQFIPAMEYTYTFDNAALRGVRNPIWWQTTFTSAGNITSGIYRIFGKKFSQRDKKLFGVPFAQFLKVNSDFRYTWKIDKNQSIASRVAGGIIWAYGNTNTAPYSEQFYIGGANSVRAFTARSIGPGGFRPTKTSKGLYLDQTGDIRMEANVEYRFRIYGDLHGAVFLDAGNVWMLRKDEEAPEKQLRWKTFGKQIALGTGAGIRYDLDFLILRLDCGVPLHDPYDTGKKGYYNVTGSFWKGLGLHFAVGYPF

SEQ ID NO: 8173 - protein, 283 aa, B.fragilis
IKLNYSVAELRLNIVGNYILINGKLGFPELGLLGAGISTLFSRIVMVLVFAFVFFSSRRFLRYKLGFIRLGWSRTLFRQLNALGWPVAFQMGMETASFSLSTVMVGWLGTIALASHQVMLTISQFTFMMFYGMGAAVAVRVSNFKGQNDIVNVRRTAYAGAHIILAMGVVLLSIVFLFRYQVGGWFTDNTEVSAMVVVLMVPFLAYQFGDGMQINFANALRGISDVKPMMLIAFIAYFIISLPAGYFFGFVMGWGLLGVWMAFPFGLSSAAIMLWLRFRYKTR

SEQ ID NO: 8174 - protein, 347 aa, B.fragilis
RIRNLFIMGLFSFTQEIAMDLGTANTIIITGGKIVVDEPSVVALDRRTDKMIAVGEKAKLMHEKTHENIRTIRPLRDGVIADFYACEQMMRGLIKQVNTRNRLFSPSLRMVIGVPSGSTEVELRAVRDSAEHAGGRDVYLVFEPMAAAIGIGIDVEAPEGNMIVDIGGGSTEIAVISLGGIVSNNSIRIAGDDLTADIQEYMSRQHNVKVSERMAERIKINVGAALTELGEDAPEDYIVHGPNRITALPMEVPVCYQEVAHCLEKSISKIETAILSALENTPPELYADIVHNGIYLAGGGALLRGLDKRLTDKINIPFHIAEDPLHAVAKGTGVALKNVDRFSFLMR

SEQ ID NO: 8175 - protein, 70 aa, B.fragilis
VIRKTIKKTTVNTNQREKYFSNDVAGVIRTESRPVFDFILSIVNEALKQPNTQSPHIKITRLNSQVLSVS

SEQ ID NO: 8176 - protein, 798 aa, B.fragilis
LYMKKLLCLIILLFSFIRSEAQSDHICPHEKLYVHTDRANYERGDTVRFRAYLMDTRHEATAYSRYVYAELLADSQVISREMVKDDHGVFSGYLSLGDTLRSGNYTLRFYTRYLSSLPAPRYFYRQIIVGGRPFQDYRKESVTRMAASYHVSFFPEGGRLPSGCVSRVAFKALSPDGLGTDVQGFVVNQRGDTVTTLRSVHRGMGFFNLEPVSGDSYTAVCRNREGMELRFPLPPADPSAVSLRVDVRKDDFLVRLNSGVSPSPGHSLRVEYRDSILLHAAFSGSRPLRLPRSPLPPGVLRFVLLDGSGVPISGRTAFNQSSSVCADVDFSARLKEEKGRSFWDVSLGLRDSSGEPLGGTLSVSVTDDRYALQDTTVNILSSFLLSSDLQGYVEAPSFYFSGDDSRTSYLLDLLMLTQGWVKYSFVPDYGSFPVERSQCVSGKVVSEYSEKKCIADAVVTLFSFDKKIMRQTTSDASGCFRFDSLSFPRGTHFILQARKKKGGTDVALLVDRDSVPSVHSSLPVYADWFRAEMDEPVVSEQSGNDPSPTSANVFQRSSTVPFSMEQYLDEVVVSTKKIEKKKRYAIESLMAHSDWNKTYHVDEMTLSPYSSTKDLLINTPGVGWAVDSNSGDFFYITRLRAGGSSTPPPALLMVDGLETSYSELVGIPVSIVESIELVKDAAQMAYIGSKASNGAILISTKSGLGTVGKKASNFRIIRPIGYQVKRESYSPSYPVVYGAINNGGNSFRTIYWSPDLLLDKAASHLEFGNPKQGRLTLVVQGITPDGKLINLTRTLGNE

SEQ ID NO: 8177 - protein, 479 aa, B.fragilis
ITMKRFQLFLVGAFVAAGPLFAQSADADWHSEVAKVKELIQTNPAQASEEAAQLLKGKNKKNTDLLIAIGQAYLEAGKINEAEAYAALGQKANSKSAAVSVLQGDIAVAKKDAGKACQLYEQAIYFDPNYKEAYLKFADVYKGASPQLAIEKLEQLKNLDPSCVAADKKLAEVYYLNNKFDKAAEAYAHFINTPEATEDDLTKYSFALFLNHDFEKSLQIALMGLQKNPRDAAFNRLAMYNYTDLKRYDEAMKAADAFFKESDKADFSYLDYMYFGHLLNAVKKYDQAVEAYMKAITLDPAKTDLWREVSSSYELNNEFTKAIEAYKKYSESLSADKRTPDVQFQIGKLYYEKGTQSDTLTVSLDERKAALVSADSIFTEIAKVAPDSYLGNFWRARTNSALDPETTQGLAKPYYEEVAAFLIDKNDPRYNSALIECYSYLGYYYLVANKLPESKEYWNKILAIDPANATAKRALDGIK

SEQ ID NO: 8178 - protein, 187 aa, B.fragilis
GACDCKNWSERAKRVGTKEFGAMIINYIHRVGWFVGLILLQVLILNNVHIAGVATPFLYVYFILKFNSGTSRNELMVWGFCMGLAIDIFSNTPGMNAAATVLLAFLRPLFLRLFTPRDTLDSIVPSLKSMGIASFLKYLVVSVFVHHFMLLTLEFFSFTSIPLLLLRVVSSTILTITCIMAVEGVRR

SEQ ID NO: 8179 - protein, 102 aa, B.fragilis
RVSFIVVAMFMFVCDGFNLDLNMKLKTDNQNFNKKIIMKKLVLVVAMFMFACGSFFTMAQDPVKKDPKKEVKDTAKTEPKKEVADTTAITVAASGAFAQFAE

SEQ ID NO: 8180 - protein, 65 aa, B.fragilis
NYTESTSKEHQGVEYFHTLFHIFHNIPHCIPFPFIFYSPTNQQISSHVFFLAQDLGNTQYKCLTK

SEQ ID NO: 8181 - protein, 364 aa, B.fragilis
RSEEIGMAKDYVLEKRKYVIGGVALAIVLIYLLRLFSLQIATDDYKKNADSNAFLNKIQYPSRGAMYDRNDKLLVFNQPAYDITMVPKEVENLDTLDLCQTLNITRAQFLKIMSDMKDRRRNPGYSRYTNQVFMSQLSAEECGVFQEKLFKFHGFYIQRRTIRQYSYNSAAHVLGDIGEVSMKDIENDDYYIRGDYIGKQGIEKSYESYLRGEKGVEVLLRDAHGRIQGHYMDGKYDKRPIPGKNLKLGIDIDLQMLGERLLKNKIGSIVAIEPETGEILCMVSSPDFDPRLMIGRQRGKNHLMLQRDPMKPLLNRSIMGVYPPGSTFKTAQALTFLQEGIIQTNTPAFPCGLHHRAEGSSGGL

SEQ ID NO: 8182 - protein, 60 aa, B.fragilis; identical to SEQ ID NO: 7968

SEQ ID NO: 8183 - protein, 290 aa, B.fragilis
IVVCNLYVFMRNLLNFLLKYNHWFLFILLEVISFVLLFRFNHYQHSVYFSSANVVAGKVYEVSGGITSYFHLKSVNEDLLDRIMELEQQNRNLENALVKHLSDSTELNSIRNLSDTDYEIFKARVINNSLNLVDNYITLNRGSKDGIRPEMGVVDGNGVVGIVYETSSHYSRVISVLNSKSSISCKIVGSEYFGYLKWEYGDARYAYLKDLPRHAEFNLGDTVVTSGYSTVFPEGIMIGTVDDMADSNDGLSYLLKVKLATDFGKVSEVRVIARTGQREQKELEQKSLAQ

SEQ ID NO: 8184 - protein, 681 aa, B.fragilis
FIKCMKVIKYLPILAICCMATGCNSKKEAVLTSGIDLANLDTTALPGTSFYQYACGGWMKNHPLTDEYSRFGSFDMLAENNRQQLRGLIEGLAAEKHEAGSIAQKVGELYNIAMDSVKLNKEGAAPIKPELEKIGAIKDKAEIYPLIVEMQKRGMYPYFILYVSADDMNSNENMVHTMQGGLGMGERDYYLEDDAQTKEIRDKYQQHVSKMFQLAGYDEATARKAVKAVMNIETRLAQSARSQVELRDPHANYNKKTLEELQKEYPSFAWDVFFSTAGLNNLKEVNIGQPDALKEVNAIIDTVSLADQNYCLQWNLINSAANYLSDDFIAQDFDFYGRTMSGKKEMQPRWKRAVSTVDGSLGEAVGQMYVEKYFPAAAKERMVALVKNLQESLGERIKGLSWMGEETKEKALEKLATFHVKIGYPDKWKDYSSLEIKDDSYWANIERANQWSYNEMIGKYGKPVDKDEWYMTPQTVNAYYNPTTNEICFPAGILQYPFFDMNADDAFNYGAIGVVIGHEMTHGFDDQGRQYDKDGNLKDWWTAEDAKNFEARAAVMANFFDSIEVAPGVHANGEFTLGENIADHGGLQVSYQAFKKATAAAPLKIENGFTPEQRFFLSYANVWAGNIRPEEILKRTKTDPHSLGKWRVDGALPQIGAWYEAFNITEKDPMYLPVDKRVSIW

SEQ ID NO: 8185 - protein, 422 aa, B.fragilis
INMLQINRHILDNGLRLVHAQDTSTQMVALNILYNVGARDENPEHTGFAHLFEHLMFGGSVNIPDYDAPLQLAGGENNAWTNNDITNYYLTVPRQNVETGFWLESDRMLSLDFSERSLEVQRGVVMEEFKQRCLNQPYGDVGHLLRPLAYRVHPYQWPTIGKELSHIANATLEEVKDFFFRFYAPNNAVLAVTGNISFEEALHLTEKWFGPIPRREVPLRQLPPEPVQTEERRLVVERNVPLDSLFMAYHMCDRADSDYYAFDILSDILSNGRSSRLNQHLVQEKQLFSSIDAYISGTLDAGLFHISGKPAAGVSLEEAEAAVREELNELQSALIQEQELEKVKNKFESTQIFGNINYLNVATNLAWFELNGRAEDMEKEVERYRAVTADRLNAVAQTAFREENGVVLYYKSSRGEKDETYI

SEQ ID NO: 8186 - protein, 85 aa, B.fragilis
HYHRHSTIHQRNTKQIGLPILHHLFTAKIHKTRLTEKSISYHNSICLEWNNAEILSGTAKVALNNNSRLISESSPDSLGKSKKLP

SEQ ID NO: 8187 - protein, 252 aa, B.fragilis
FKFSMGLLDGKTAIVTGAARGIGKAIALKFASEGANIAFTDLVIDENAQNTAKEIEAMGVKAKGYASNAANFEDTAKVVEEIHKDFGRIDILVNNAGITRDGLMMRMSEQQWDMVINVNLKSAFNFVHACTPIMMRQKAGSIINMASVVGVHGNAGQANYSASKAGMIGLAKSIAQELGSRGIRANAIAPGFIITDMTAGLSEEVKTEWAKKIPLRRGGTPEDVANIATFLASDMSSYVSGQVIQVDGGMNM

SEQ ID NO: 8188 - protein, 88 aa, B.fragilis; identical to SEQ ID NO: 7984

SEQ ID NO: 8189 - protein, 462 aa, B.fragilis
LKEGCSREYFSFLAASFFSYLKLKAMKNFRVAIRRSYLSVILLLLALVCYLLYPLEIPALSSESAIEIDRYVHSVPCTVQMPDTATDFLCFLDEELKNKQILLLGEQLHQDGATLQMKTRMVRYLHEKLGYNVILYETGLYDMYLMNQDGRQRMNPSKAVWTFWWGSNETKSLWEYYRSHPSIALDGFDCQLTNYGQGRKHMESVEKYLNGYSSSLSDFPYVQRFFLQMSEFNGNWNYFGYRLDRMLKDSIVQDFNKLENRIHEESRYSMEDGLHQRYIAGLKLRYESIWKYRNVGDLTRMNLRDSIMADNLTWLVDSVYKDQKVIVWCANVHVFNRGRMQVDSTRFTSMGQRLKIHFGDRMYTIAFTSYARRNTDGGIRDPLSTLSLEYLLHRRKVGFAYLNFNELPVDSRWRQAFISGLDQGASLSEVWSEQMDMLFYIDLNYDVYYDKTFINKMYKWAK

SEQ ID NO: 8190 - protein, 200 aa, B.fragilis
YFIIRVVEERRMRLIYKNHYKALFLLGLPIVIGQVGVIVLGFADTLMIGHHSTNELGAASFVNNMFTLAIIFSTGFSYGLTPIVGGFYGTRRFASAGQALRCSLLANLLVGILLTVIMGILYLNVERLGQPEELLPLIKPYYLILLASLVFVLLFNGFKQFTDGITDTKTAMWILLGGNVLNLKSATIIQYTIKGRFMSR

SEQ ID NO: 8191 - protein, 243 aa, B.fragilis
YVFLCIRSGDSGRWWYEYVIFGMTVIYEDNHIIVVNKTASEIVQGDKTGDTPLSETVKQYLKDKYQKPGNVFIGVTHRLDRPVSGLVIFAKTSKALSRLNEMFKNSEVKKTYWAIVKNCPKQPEGELVHYLVRNEKQNKSYAYDKEVPNSKKAILNYKLIGHSDHYFLLEVDLKTGRHHQIRCQLAKMGCPIKGDLKYGSARSNPDGSICLHARHVRFVHPVSKELIELDAPVPDSNLWHGFQ

SEQ ID NO: 8192 - protein, 767 aa, B.fragilis
VMAIPSRFTKVKIAAGYTLLLVVLLLSLLFVHREMEKLSDTDDVQSLQTDSLLLLLKEKDENTIRMLQIINEANESMITPVELDSIIAEQDTVITQQRVQHRIITKRDSVITKRKKKGFFRRLGEVFAPSKEDTAVLVNTAVEFATDTILEPYNPIDSLHQRIRTVTKRKSRPVVRPNYNARLRRMNKELTTRIDSMITTYEQVVTQRAMDNASEQQELRNRSTRTIGGIAIAAVLLSACFLIMIWRDITRSNRYRKELEEANKRAEALLEAREKLMLAITHDFKAPLGSIIGYTDLLTGLTTDKRQRFYLDNMKSSSQHLLKLVSDLLDFHRLDLNKAEVNRVTFNPAQLFEEIRISFKPLTDAKHLTLSCSIDAELDGRFISDPLRIRQIVNNLLSNAVKFTAKGSIALNITYHSSSVRIEVVDTGKGMAPGDREKIFQEFTRLPGAQGEEGFGLGLSIVHKLVTLLEGSISVQSTLGEGSRFIVILPLYPVGPVTGEKREGNVSSVSTTDQAGEDGVMASPKLNRVLLIDDDRIQLALTAAMLEQQGIQAVCCQQPDELIEQLRTATFDVLLTDVQMPAINGFDLLKLLRASNIPQARTIPVIAVTARSEMNEQDFQEHGFAGCLHKPFTVKELLTIISGEEMTGSSAELTPDSLNFRALTAFSEDDPEAASTIIQTFIEETEKNRNRMESAIRATDVDGIAGMAHKLLPLFTLLGASEALPLLLWLEQRRGEAVSDEMIQKANEALRQVDIVMAEARRYAAGD

SEQ ID NO: 8193 - protein, 319 aa, B.fragilis
TTVIMTKKQFWLIGAWSLIALSACSSKPKDGLTDTYTSGVIAITADESFQPIVQEEIDVFEGLFPLAGIVPRYTTEVDAINQLLKDSVRLAITTRTLTPEEMNSFHSRKFFPREIKLATDGLALIVNRQNADSLISVRDIRRILTGQVQKWKELYPASGLGDIQLVFDNKNSSTVRFAVDSICKGAPLSDKDVKALKTNQQVIDYVAHTPDAIGVIGVNWLGNRSDTTNLSFRDEIRVMSVSADDVATVENSYKPYQAYLYYGNYPLARPIYVLLNDPRNALPWGFASFLTSDRGQRIILKSGLVPATQPVRIVDVKDE

SEQ ID NO: 8194 - protein, 205 aa, B.fragilis
ILTIMGRAKIKKKSTFIDMTAMSDVTVLLLTFFMLTSTFVKKEPVQVTTPASVSEIKIPEKNILQILVDPNGKIFMSMDKQSDLKAVLESMGQEYGVTFTPEQEKKFMLASTFGVPMKNMKTYLDLPTDKQDAVLKNEGIPCDSLDNQFKSWVRNARAVNADLRIAIKADADTPYSVIKNVMNSLQDLRENRYNLITSLKTTSEN

SEQ ID NO: 8195 - protein, 274 aa, B.fragilis
KSKMAKIDLTSFEWCELIFKGKNKAYGAYKMRADSPKRHNVAMVIVLIIALVGFSLPTLIKMATPKQKEVMTEVTTLSQLEEPEVKQEEMKRVEPVAPPPPALKSSIKFTAPVIKKDEEVHEDDEIKSQEELTQTKVAISIADVKGNDEANGKDIADLKQVVTQAEPAEEQVFDMVEQMPTFPGGTTELMKYIGEHLKYPPIAAENGTQGKVICRFVIGKDGQVRDVTIARSLDPYCDKEAIRVIKSMPKWIPGKQNGKAVAVNFTVPIVFKLQ

SEQ ID NO: 8196 - protein, 300 aa, B.fragilis
MGKIEIRNLCFRYGKQMVLNNLNLDIPENALYGYLGNNGSGKTTTIQVLLGLARPVKGEVLYDGQPFRDQREKQLRKIGLCPGEPFYYDNLTGYEHLAYLDHIYHCGRTAINKVLAITGIENARNKKLRHYSTGMIHRLGMAMALLHDPDILFLDEPLNGLDPEGIHSIRELLLQLHQEGKTVFLSSHLLDEVEKTCTHVGILQHGCLLYQGDLSELLNSIEKRIHIRLDKVDLLHSVCKEVQIDSRIKSESILEVILSNDTTYDRLIELLGQGGYHISAIQPLENTLESVYLKLTSQTK

SEQ ID NO: 8197 - protein, 275 aa, B.fragilis
TNRIMIRDTFFSQTRFVNLCRKEMVENWKSNLLRVALMYGAMAVIMLWSGYLSYRAVGQDTDSTWEFNLVIFMWGLCVFGCLSASFTMERMKSKTGRLSVLMTPATSFEKYFSRWLVFTVVFLIVFLITYKLADYTKVLVYSLVYPENNAIAITPLSHLFGENTDYYTVFKHTHTFVLMIASYFFCQSCFVLGSSVWPKNSFIKTFSAGMIIFIAYVLIVVGFAKLIWPDQISYNPDMSEETAFACLSAIAVLFTLTNWTLAYFRFKESEIINRM

SEQ ID NO: 8198 - protein, 286 aa, B.fragilis
MKMITVENLSFLYRKSKRAVLHDFSLSLEKGRVYGLLGKNGAGKSTLLYLMSGLLTPKSGKVVYHDVDVRRRLPITLQDMFLVPEEFDLPPVSLISYIELNSPFYPRFSKEDMVKYLHYFEMDINIDLGALSMGQKKKVFMSFALATNTSLLLMDEPTNGLDIPGKSQFRKFIASGMTDDKTILISTHQVRDIDKVLDHVLIMDNSRVLLNESTMSICDKLFFTESENRELLQSSLFSTPSIQGNFLLLPNESGEDSEINLELLFNATLAVPERISALFHSKQIEL

SEQ ID NO: 8199 - protein, 653 aa, B.fragilis
KEVISVEGLTVEFNATPLFEDVSYVINKKDRIALVGKNGAGKSTMLKILAGLQSPTRGVIAIPRDVTIGYLPQVMILADNHTVMEEAELAFEHIFELQADLERMNQELADRTDYDSEEYHKLIDRFTHENDRFLMMGGTNFHAEIERTLIGLGFSREDFNRPTSEFSGGWRMRIELAKLLLRKPDVLLLDEPTNHLDIESIQWLETFLSTRANAVVLVSHDRAFLNNVTTRTIEITCGQIYDYKVKYDEYIVLRQERREQQLRAYENQQKQIEDTEAFIERFRYKATKAVQVQSRMKQLEKIERIEVDEVDNSALRLKFVCSSRSGNYPVICEDVKKAYGAHVVFHDVNLTINRGEKVAFVGKNGEGKSTLVKCIMSEIDYEGKLTLGHNVQIGYFAQNQAQMLDENLTVFDTIDRVAVGDIRLKIRDILGAFMFGGEASDKKVKVLSGGERTRLAMIKLLLEPVNFLILDEPTNHLDMRSKDVLKEAIREFDGTVIIVSHDRDFLDGLATKVYEFGGGVVKEHLGGIYDFLQKKKIENLNELQKANPSSASPANGKKEEGAEEGISENKLSYEAQKELNKKIKKLERLVADCEAAIEQTESAIAILEEKMATPDGASDMSLYEQHQKLKQQLDHTVEEWERVSMELEEMNEK

SEQ ID NO: 8200 - protein, 199 aa, B.fragilis
PMTVSKTKAKLVDVARQLFAKMGVENTTMNDIALASKKGRRTLYTYFKSKDEIYLAVVESELDILSDMMKRVADKDISPDKKIIEMIYTRLDAVKEVVYRNGTLRANFFRDIWRVEKVRKRFDAKEMQLFKSVLKEGQDKGVFHVDDVEMTAALVHYCVKGIEVPYIRGHIGANLDMETRKRYVANIVFGALHRTEINQ

SEQ ID NO: 8201 - protein, 165 aa, B.fragilis
LLFLSRKSKREFINKNRTMRTSVKFILMFVLLMLSFSISGNALNITECSHKSVNSCQVSASSLDTNYSYRYGSDITGFDKSQTLSVSDVELGFKPVSETYSSNNLRLRRILEDSDLFKDTMRKWCLVRENLLVLDQSKSYYSDKDPHYASISCHYYIFALRRILI

SEQ ID NO: 8202 - protein, 1518 aa, B.fragilis
ETSFMKRKWIKWVSWILLTPLILFVILMVLLYIPPVQNFLRKEAAAYASEATGMQINVRRIDLRFPLNLLVRGVEVIQAPDTLLSLESLNVHVQALPLFRGKVEVDDISLQQVAVNSANLIDGMRLKGVLGSFRLESHGVDLPNEIAIINRAELSDTHVQLLLNDTTATPKDTAQSEVRWKVDLRHLKLKNVSFSMQLPADSMRLAAHVGEAQVNDAEADLKNLHYGLRSFLVSGTSVNYDVGTAEPAEGFDPSHIALRDIRIGLDSMYYRGRNMNAVIREFSMNDRSGLSVNSLTGRVFANDTIIQVPSLKLLTPHSEMDLTAQTYWELVNIPTTGRLTARFNAMIGKQDVLLLAGGLPDSFKEAYPFRPLVIRAGTEGNLKEMQITRFSAELPGAFSLSGGGELLNLTDSLERSAIIDLRMQTQNLNFLTALGGTRPDSLLVIPNQMSLVAKARMKGPQYMAQLLLKEGEGMLNLDAAYNGSTEAYRADLKVDALQLYHFLPKDSIYELTTSVAAVGRGIDFTSYRTTASLKASLQSLHYGRYQISGIEVTGDVKNALATARLVSDNRLLKMNANAEYHLAKPYMDGKLDMDVTQLDLYELGIAPKPLKYPLAFNFTAEARRDRIFTHLTAGDMKLNLSARSSLDKLIKQSAHFADVLVKQIDKKELDHGELREALPTAIFSMSAGKENPLAYYLATKDIAFHDVGVKFGTAPDWGINGKASIHALKMDTLQLDTIYFTVKQDTTRMSLHGGVINGPKNPQIVFKSSFAGEIRNDDAELTLRYENAKGETGVLFGVNVRPLVEGNGKGDGLAFTLIPENPIIAFRKFHFVDHHNWIYLHKNMRLYANVDMADDEDMGFRIKSNRSDTVSLQNIDVELQRIRLSEISEVLPYLPDLSGLFSAEANYVQTATSLQVSAEANIDELTYERQRIGDVALGVTWLPGERGKHYISTYLTHEGEEILMADGSLHPSVTGKDSIEVNAIMEHFPLKIANAFVPDQVVTLSGDMDGGLHITGDTDRPLVNGDLVLDSVSVFARQAGARFTFDNRPVQIKNSRLTFDKFAIFTTGKNPFTIDGTVDFRNLTDPRVNLSMLAENYMLLNAPRTKESLVYGKVFVDFNATVRGPINALVMRGNMNLLGNTDVTYVLMDSPLTVQDRLGDLVTFTSFSDTTTVQKEEAPVVSLGGLDMIMTVQIDPGVRLKADLSADRSSRVELQGGGNLSMQYTPQGDLSLSGRYTLTGGMMKYALPVIPLKEFNINNGSYVEWTGNPMDPMLNLKATERLRASVGSENGQSRMVNFDVSIVVKNRLDNLSLAFEIDAPDDAEVQNQLASMSADERGKQAIAMLATGLYLANSGSSGGGGLNMGSALNSILSSQINALAGNLKNASFSMGVEDHDAADAGGKRTDYSFRYSQRFFNDRFQIVLGGKVSTGAQATNDVESFIDNISLEYRLDTSGTRYIRLFHNKNYESVLEGEITETGIGLVLRKRIDRLGELFIFRKKKKTLPETQKAPSDGEAHQ

SEQ ID NO: 8203 - protein, 76 aa, B.fragilis
  UNSURE (20),(25): Identity of amino acid sequences at the above locations are unknown.
RSFFTYLYYKYLTVLKFDLXLTGLXIIFSKEPLLFKILAPFQKAGAKGKGVNFKPAKVFGKFFFKVPGFNFQALLG

SEQ ID NO: 8204 - protein, 301 aa, B.fragilis
ATKVRGFEVKSYICRLKLNKSVMKQNFWILLIILACSAVACKSGQKKDGNMEKETVLKIETSMGDIKVKLYNETPKHRDNFIKLAKDGTYNGTLFHRVIKDFMVQAGDPESKNAPKGKMLGSGDVGYTVPAEFVYPKYFHKKGALSAARQGDEVNPKKESSGCQFYIVTGKVFNDSTLLNMEQQKNQNKVTEAFNALAQKHMKEIYKMRKANDQDGLYALQDTLFIQAEAEAAKQPDFHFTPEQIKAYTTVGGTPHLDGEYTVFGEVVEGMDIVDKIQQVKTDRSDRPEEDVKIINVSVIE

SEQ ID NO: 8205 - protein, 128 aa, B.fragilis
TLSLKHSQSVFVLTKRFFLLYKRLIKLKKSILEKVLLTSPPIKQIIQSSETSYIKPIHSLESPLLQGSVPPRDAEIPTSSNNRYIGQEKAIGFPIAISIKKVLSGGALPFLRPLYKTSHPLRSFDRRG

SEQ ID NO: 8206 - protein, 333 aa, B.fragilis
ENSSYFVLHSSFYFVLLQRYLMRHITNLLIFTVMKPTLFVLAAGMGSRYGGLKQLDGLGPNGETIMDYSIYDAIRGGFGKVVFVIRKDFEQDFREKILSKYENHIPVELVFQALDNLPEGFTCPADRVKPWGTNHAVLMGKDVIKEPFAVINADDFYGRDSFAVLGAELSQMDGKKNDYCMVGYRVGNTLSESGSVARGVCETNAEGYLTTVVERTAIERIDGKVSFKDENGEMQTIGDNTPVSMNMWGFTPDYFAYSEEYFKEFLKENEGNLKSEYFIPLMVNKLVNEGTARVKVLDTTSKWFGVTYAADRQGVVDKIQALVDAGEYPDKLF

SEQ ID NO: 8207 - protein, 256 aa, B.fragilis
QIMKTELKGWLADNTVTTDNKEDKILVLESAGNLTLSDVLDEMKKEDTGLRAETLKHAVDLFQRTVSELVLNGYSVNTGLFRAVPQFRGVIDGGVWNSEKNSIYVSFNQDKDLRETIARTGVKILGAKGDSAYFIGGEDAATRATDGSATAGRNYRLQGKNIKVTGTDPAVGIVLIDEKGTETKLPMDMIAVNNPSEVLVLLPADLKDGIYELRLTTQYCHSSQTMLKTPRTVSRFINIGASQGSGDDDIVDDPTA

SEQ ID NO: 8208 - protein, 726 aa, B.fragilis
RLKWHYNSAYDAVNRLATFADIDLVYAHNDVMALAARDVIMKRDSVSGKRIRFIGIDGVYGDGAGLQAVADEKLEASFQYPTGGAISIQVAMQIINGEKVKKNYVLNTAIINRGNAKTILAQSEQLNHYQKRINRQKQEEDNLLSRFKFLRNSTILILALMLLIIPLLGYVMYMNLRVKNKNKELHDKNQLVEAQKEELAVKNSQIENISNQKLQFFTNISHEIRTPLTLILGPVNKLIKNSKLDPSIQEDVALMKRNVDRLYRIVNQILDFRRIDNDKMKLILRQVDLIGMVREVFDYFTGIAEEKQIHYRFSTNIDELNIYIDVNKIEQVLVNIISNAFKYSDSGGDISVRITGEAETVLLEVEDHGRGISKESMEHLFERFYTGNKTFGTVGFGIGLNLSKEYVDLHDGEIRAESQPGEYTLFSVRLYKDIAHYTHEYILEETDRFNLSYHDMEVDTTVVNEMLSKTYDYHVLVVEDDPDVRYSLRKELSANFQVEVAGNGNEALDLLGQGDAFHLILSDVLMPGMNGFQLVNRVKNDLAFSHIPIILLTALSEDSQRIYGIAEGADEYIPKPFNIDFLKIRIINMISERQKMKEAYMKNLRAGTMDNVEVCKLMKVDELFRDKLLSIVDTQYENSDFSIEDLSEHLGLSRVHLYRKMKTLFGVSPTDYLRNYRLNKAMLLLKARQYNISEIAYMTGFTSPAYFTKCFRTLYGVTPTEAMVAN

SEQ ID NO: 8209 - protein, 536 aa, B.fragilis
YMNRTFIMRECLGKALWLCFCLSIAGCAEDDRMTPLSADSGDTADELIPIHISLTGDNDYHSSSFNNASTRSHSPLIAEWVGVKAFSPTRTGEQPDYDGPRIASMELTEDTLPRVSTRATVPAGVYFRLIVFRKSGNNYVFQSVADYASNGTGTPVLKQGKLLTRSGTIRMVGYSFNTATAADLGTMLSTYAYNSSTVSIPNMSKDFMTFDSGDITNVNSLSHNLPVSFNQKLCKLTITISPTGFPSNTITNCTGVYVKQGGNSTSWKIGPSTNVVATNTNNTAAFSPSTALSTTIRMVPFAGARTITVHFNTLTVGGRIVNNNTEITSTQSVQLKEGKSYTLKIQFKKGPGINVLESDINLTGNGCTAQDKKDLAKLIWADGNLKSTGNSNYVWTTSTDRGYYYTWYSTYTGNTSQNNTDPCSKLNVSTYGTGWRTPSRNELTKLSRCTNKAKVNNGMWFMNSSKGLFLPLAGHTPSASGASTGGNAVVNGNRDGNYWCTEKYYRFLFGTNGHTVSDAASGAFGCSVRCVKGTKQ

SEQ ID NO: 8210 - protein, 73 aa, B.fragilis
VCVLQSDMTVLNTQWCFKKRTSDATKIRRFFHLCKFFYIVLIISHLSILLAFSAESKNSVSKDVRLLKHRLKN

SEQ ID NO: 8211 - protein, 109 aa, B.fragilis; identical to SEQ ID NO: 6792

SEQ ID NO: 8212 - protein, 124 aa, B.fragilis
PTLSTTQITTLMLTQFLNLLATIISVISLLIVTYGALIAIISFIINELKRVTGAYTPTNIRKLRAVFGTYLLLGLEFLIASDILKTVLEPTMNELIILGGIVVVRTILSVFLNKEIKELETENN

SEQ ID NO: 8213 - protein, 431 aa, B.fragilis; identical to SEQ ID NO: 6067

SEQ ID NO: 8214 - protein, 76 aa, B.fragilis
NVEHMAKVINRDVPIAEENTTLTGQPATNMYDDWSEEMEDRADNVYDDTKKKSAGNKKSKEKKLKEIDEVVKEDLE

SEQ ID NO: 8215 - protein, 687 aa, B.fragilis
HHKHINNSVSTSWLFGILLETLFVKTRTRMIRHYFKIAFRNLLKYKTQSIISIIGLAVGITCFALATLWIRYEMTYDTFHRRADDIYLVRAQLTITDGTLSNSMPYPAIEYLRKNISEIEDICGISPFKTNLRFKDKGGDLLAIEVDSAFIRMFDVRILQGNVNFLKKKSNEIAITEAVAKEWFGNESPLGKEIELGSRPCKVCAVVSGWSQHSNLSYGALLPARHHPSWQSNSEQIFVRILPDTDKSALQKRISSLDASSQEKESTLGKLNFTPITSLRYSDYLQKDEIVISFNYIRYFAMAGVLVIVCSLFNYLTLFVSRLRMRGRELGLRKVCGSTNRSLFALLSVEYLIVLLAGSLLGMAFIEACLPHFIELAQISEATPLYTEVIIYILAVIVLSFGISQIPLYYFRSRTLQSSIRNKKGSPQRGIFRRLGLIAQLIISLGFIFCTTIMMKQLYYLKNTDLGIERHNIGNVAVWMKGDINEWSSKIANLPMVTEALPPHYFPIVPTGPMMYTDINGWDGLNETTDETYSVGLIPSGKEFFDFYGLQLTEGEWLSEKNSPGDVIINETAALTFGWRNPVGKQFYSEYEHNRTYYTVVGVVKDFSYLPPTIAPRPLAFVRTEEQKYLWSRASILFKFTEGSWEACKDTIRKMKEEDFPSSFLRLYNEEEEYNKPKIRNYHPIHD

SEQ ID NO: 8216 - protein, 83 aa, B.fragilis
VPEHQIVAQDFAMSEFSLILVLQKENKQNSNMTWQKYKLNLRNSHLLEEFFQSWRNLTPCFHPLSTQHWVRDAAVSSDISSAR

SEQ ID NO: 8217 - protein, 837 aa, B.fragilis
FSLNILISKRLKFFQTLCYSVVNQTQNHTNMKTIRLAWKALARFRTYTFINILGLALSLACVLIILRYIHQEVTVNHFCKDLENTYLLYIEYEDGRRTISSNEDRNNDPNFIDPLNDPSVLKSTRWINFPEDRITVGKQIYNVKTVVTDSVFLQILPYPSVSGISSLKSPNDAIITRRLAERLFGKENPIGKTMTYSTGDIVTVTGVIGEPTTKSFLDFDLIISERLQHSWSRLSNSLVQLIPGTDFKKLNVKNEKFMKLRCHMDAPTRLQFFPLKDFYFDKTVRVYNNNIRKGNYNNILVLAVVTIALLIIGLFNFINIYTVMMLKRAREFGVKKVYGAGAKDVFAQIFTENFILTGMALCISWCIIEITGGMMEHVLRIPQTSNTEFSATLSVGILILLPLLTSIYPFIRYNYVSPSVSIRSVNAGGHSIVSRVLFLFVQYIITFVLIIVSLFFTKQVRFMLSADLNYTTKDIIQCQLYAERSSYDINISDEEWERRKQREKSNLAYIKEEMDHSPLFIRWEYGENPNQLDDNYINVRNAQRDEFKQVIYSSLSNKYIELFGFQLKEGRLWNDSVDQWTDYKMIINESAKSLLEIDNIETALIQPERRLWWSLSKSEEMKKNPPYQVIGVIKDFKIGHLSKTTPPLFIVYEDPRGSYRDRLMAQIVPGKKQEAIAFLKKLRDEILGEGEFEYSFLEDEIATMYQEDKRTAEIYSLFSIIAILISCLGLFGLSMFDIRQRYREIALRKVNGATLKEIYPLLLKKYSIILGMAFIISAPLSWYIISKYLEGFANKAPISWWLFAIAAIVTAFISLATLIWQIRKAANINPAKVLKGE

SEQ ID NO: 8218 - protein, 85 aa, B.fragilis
ETSKSQPILFSYDTAHSSLEVTSTVCPVPTFTSDSEDLFTERADAPAAHLNWHLTIFPALSVTSTLGANGVGNGLRAISSLMENA

SEQ ID NO: 8219 - protein, 148 aa, B.fragilis
NYIDMKLIIYNSRLAKRMLFPGYSTIMLFGIILTKRRKEECPPALIRHEQIHQKQYFECFILPVLPAILFTPWMLTLCPLSFYILYLAEWFISFVWYFWSQGMTDPGRAGHRAYMSSAMEMEAKVKEVEAGYLERRKHFAFMRYYDKI

SEQ ID NO: 8220 - protein, 456 aa, B.fragilis
YNMDQLGKILIVGDNEDVLFALNLLLEPYTEKIKVATTPDRIEHFMTTFGPDIILLDMNFSRDAISGQEGFESLEQILKIDPQAIVIFMTAYADTDKAVRAIKAGATDFIPKPWEKEKLLATLSSGMKLRQSRHEVNMLKEQVEVLSGQGGPENEIIGESEAMQEVFSTINKLSETDANILILGENGTGKDVIARLLYRCSPRYGKPFVTIDLGSIPEQLFESELFGYEKGAFTDARKAKAGRMEVATGGTLFLDEIGNLSLPMQSKLLTAIEKRQISRLGSTQSVPIDVRLICATNADIRAMVDEGNFRQDLLYRINTIEIHIPPLRERGNDVILLAEFFLERYARKYKKEMHGLTREAKNKLLKYNWPGNVRELQHTIERAVILGDGSLLKPENFLFHSSVRQKKEEEVLNLELLERQAVEKAMRLSEGNITRAAEYLGITRFALYRKLEKLGL

SEQ ID NO: 8221 - protein, 495 aa, B.fragilis
KKKCTMNLKTILIIAGCSYIFPATAQERTMELSLDETVKLAKLQSPDAQTARHSFRSAYWNYKYYRANYLPALSLTSDPNLNRAINKVTLGDGTVKFVEQNMLSTDLTLNLTQNIPWTGGSLFVETAAQRMDIFSDHTTAWQTSPINIGYRQSLFGYNSLKWDRRIEPVRYREAKKSYVETLELVATRATQKFFNLATAQSNYETATTNYANADTLYQYAQGRYNIGTITENEMLQLELNKLTEETNRMNARIEMDNCMQELRSYLGIQSDEELKVKINDHVPDFSVELHEALLLANENSPEIQNMIRRKLESESNVSYARANAGLKADIYLRFGLTQTADKLGSAYKRPLDQQYVSLSVALPILDWGRGKGKVRVARSNRDLVYTQVEQDKTDFELNIRKLVKQFNLQAQRVRIAARTDETAQRRSDVARKLYLLGKSTILDLNASITEKDQARRNYITALYNYWSLYYTLRSLTLFDFEGKTPLTENYDLLID

SEQ ID NO: 8222 - protein, 153 aa, B.fragilis
HDCRIPRKQHAFCKPAVINNKFHVDVILMVAAKFAYSFQGVKDILVLMELGKYPGRGVKAKRIKTVEINHLINYKYGKSKLVQCKPHVGQERWRFDNQCGCSHRTCSTKYSSYRNSGKRNETLSQYSGISGRCRGIHNHGYKQTGPSLFRRSR

SEQ ID NO: 8223 - protein, 74 aa, B.fragilis
HDCRIPRKQHAFCKPAVINNKFHVDVILMVAAKFAYSFQGVKDILVLMELGKHLGRGVKAKRIKNSRNHLINYD

SEQ ID NO: 8224 - protein, 212 aa, B.fragilis
ITISMAKASWCNVSPMSGSENGTLTISAAAHAGREARSTTVTVTAKNGTKPSASIAVSQAGVGVQLTMDTSKPDLPGEGGSVTINGNSNSPTLKISVPLINFPGVTASAKFNAPGITDKVLAASETVTIPGDPGANGSYAFSIKLEIARNPLPTPLAPNVDVTDSAGKMVRCQFKWAAGASALSVNKSSLSLVNVGTGQTVDVTSNDEWAVS

SEQ ID NO: 8225 - protein, 81 aa, B.fragilis
LKHSEPTICNGVYIIINKRKEIGLMNTEKEKTSSEEQKKAEKVLKDKVPVQQTGTYSEATKKEVRDAVKELNPDMSGLDRG

SEQ ID NO: 8226 - protein, 434 aa, B.fragilis
PADRLTGIINCKSKKQNNMDIKIEKKPWYIRYKFYIAGGIAFVAFLVYVIILSAGPRKLRIESENIQIAEVKDDKFMEYVDVEGLIQPILTIKVNTREAGSVERIIAEEGSLLQKGDTILTLSNPDLLRSIEDQRDDWEKQRITYQEKEIEMEQKSLSLKQQTLETNYELARLKKSFTLDKEEFRMGIKSKAQLEVSEDEYNYKVKNAELQREGLRHDSAVTIIRKDLIRTDMERERKKYERATERLGNLVVKAPISGQLSFVKVTPGQQVGSSESIAEIKVLDQYKIHTSLSEYYIDRITTGLPATVNYQGKKYPLRITKVVPEVKDRMFDVDLVFTGEMPDNVRVGKSFRVQIELGQPEQAIVIPRGNFYQATGGQWIYKANASRTKAVRTPITIGRQNPQQYEITGGLEPGDYVVTTGYDTFGEAEELILK

SEQ ID NO: 8227 - protein, 429 aa, B.fragilis
KTGLMKRYSISVVLHILLLVVLSIGGYLLFCYELWFSTLIVGILLIATGVHLYSIQMKLAGMMRRLTDCIRFNDMTQNFQPPFKSKMMVELADELSQTLRLFRGRLLEEEIKHQYYENLLNKVDTAVVVTDRSGRVEWMNRAAVALVGQESRLPQEWLTTSWNETQVVRIRQQGASVEMAVSCTLFAAQNKERLLVSLKNIHSVLERNEMEAWQKLIRVLTHEIMNSITPIISLSETLSERGIPERLSEKEYGVMLQAMQTIHRRSKGLLGFVENYRRLTRIPTPARTLVAVDELFSDLRKLFPDSFIHFAATHRGATLYIDRAQIEQVLINLIKNAKESCGQNTAPQIEVELEQVPGKVCSLTVRDNGEGILPEVIDKVFVPFFTTKPSGSGIGLSLCKQIMNLHGGTITVSSEIGKGSCFTLMFPGR

SEQ ID NO: 8228 - protein, 417 aa, B.fragilis
VFIMASIKLYFDKRVNRKDGKFPLKINVTHKRQQALINLGVLLSPDQWDSTKGKVINGPNKSFLNGYISQRVHCAETELLNLRIAGKLDLMTGKQFKEHLQRILLRGKLEEKQEETGCSFVQYYTRFVEGKKNPQTKAVYQYTLDRICRFVDVPDKFRFEDVTYAWLKSFEIHLSETSKVNSISIHMRNIRAVFNDALNTETISCYPFRRFKIKQEATAKRALTPEELVTLRDYPCEEHQKQYVDIFMLIFYLVGINTVDLCRLEKIRNGRIEYRRAKTKKIYNIKVEPEAAEIIERYKGSKYLLNILERYKNYKDYAHRLNENLQEIGSVELVEKVINGKRRRVKKRFPLFPELTVYWARHTWATIAHKIGVSKDVISLALGHEFGCKTTSIYIDYDMEKVDKANRQVLDYLENLK

SEQ ID NO: 8229 - protein, 210 aa, B.fragilis
ITSMAKASWCNVSPMSGKRDGVLTISAGAHTGRVARNTVVTVTAANGTRPSASIAVSQAGAGVSTTMDTSKPDLPSSGGVVNINGTSNSSKLKWTCTARVMGVDMPIDGNYVKVAVNGGNIGNNVAIPGDPGASGRFNFVATLTFPASMFPVDAVVTFRLTDDTNSAKQCTFTWKAGASSLSVNKSSLSLVNGGTGQTVNVTSNDDWNVS

SEQ ID NO: 8230 - protein, 125 aa, B.fragilis
IKLVLIIHTKNVIMKKVLVALTMVMGMGSAVAFAQEPVKLPAMEQNQQTSQDKFTKITVKELPQVVKSTLSKDYEGTIVKEAFVAEKENGKVYKIIVTAIKEDQSTEEITVLLNEKGEPVNEKDC

SEQ ID NO: 8231 - protein, 229 aa, B.fragilis
NLPSKPNLPPSVKEQADDEAIRVFTENLRQLLLAPPLGQKRVMGIDPGFRTGCKVVCLDAQGNLVHNENIYPHPPVDKKTEAASKLRKMIEAYKIEAIAIGNGTASRETENFVTHQQFDRPVQVFVVSEQGASIYSASKTARDEFPDYDVTVRGAVSIARRLMDPLAELVKIAPKPIGVGQYQHDVDQTKLKKSLDQTVENCGMSETTKGSVIKKRILAIFLRHYSANG

SEQ ID NO: 8232 - protein, 982 aa, B.fragilis
FETSNLMKQNTFIYAAIAFFVCSSCTSGKYSPVDYVDPFIGTGFHGHTYPGATVPFGAVQLSPDTRAGNWDACAGYHYDDTTLKGFSHTHLSGTGCIDLGDILFRPTTLKPDLTAESICRPANFSHKDERASAGYYSVILKGEGIKAELTATTHTGMHRYTFPSGKPVTIIVDLAHLLDNEYIYEAELERTTSNEIVGMRRTRGWTDNQYVYFAAQFSEPFQTVEFVQDKKIVSAETKQVGTDLQAILTFADKDGEPIIAKVGLSLVSVDNARKNLAEEVKDFNFDAVCAAARNDWEQALSSITVEGGGTDDLKNFYTAIYHAMVVPNVVSDVNGEYRRHNMQIGQLPKGKMQYSTFSLWDTFRAWNPLMTLIDTALVNNMVNSYLDIYDASGELPIWPLSAAETGTMIGYHSVSVIADAYLKGIRGFDAEKALDAMKVSSEKNKKGADYYIKYGFIPSNIKKESISCLLEFAYDDWCIARMAQEMGKEDVYRKYIERSQNYINVFDGSTKFFRGKRMDGNWETSFNPFEVGRSYTEATAWQYRFSVPYDVNGMVQLFGGKEKFITALDSIFIADPNVHGDLADITGLIGQYAHGNEPSHHIAYLYDYVGQPWKTQEMTRHLLDEMYQPTPGGISGNEDCGQMSAWYILSGLGIYSVCPGSNEFALTTPLFEKAVLKLANGKRLTLLANDPKKNIYIHKVELNGKQIDTNFITYAQLMEGGELRFTLSDKPDKSRGISEEASPYSYTKEKVVSIPYVDRDLNLFMDKVTVALATTTEGAELRYTLDGTEQTEKSLLYDKPFRVDMVTLIKAKGFKQGFRPSRTLSIAATIAELKGSLPVHPSRNGTSYKYFEGTYQKVADIEKTPLLEVGVLPEPSIKEAKQKDHFGYIFSGLINVPEDGVYIFQTRSDDGSVLYIGNELVVNNDGAHAAIPDTGYIALEKGFHPYILYYFEDYEGEHLSWFWKLPSAKELAPIPTSALFVK

SEQ ID NO: 8233 - protein, 60 aa, B.fragilis
SMRSTFKVLFYLKRNAPKKNGLVPVMYHFSIYDNNTKLYSREQSRKEACAIDIRFLLNKK

SEQ ID NO: 8234 - protein, 104 aa, B.fragilis
KRLSMKRNMSRRHFLKTGGLALAAMAMCPPLSFASSEMPVQKYISLRPPVGKRHFVSKAVEATIEQTRPKIKDEKLRWMFENCFPNTLDTTVRYKMKAGRIHSS

SEQ ID NO: 8235 - protein, 1054 aa, B.fragilis
TLNFECMKQVNLRIYQTILTLLVGLFLSAGAYAQQISVRGIVKDQMGEPVIGANVLVKGTSNGVITDIDGKFALSAAKNDILIISFVGFMSQEIPVTGKDLMVTLKEDTGLLDEVVVLGYGANARKQDLSAAVGVLSNTDDLTVRPVSSTESLLQGQLAGVTVQSNGGDPTSTPSIVIRGQGSQNGDNVLWVVDGVPGAPIASMSDIESIVVLKDAASAAIYGAQSGAGGVILVTTKKAKAGIPTLSYEGTYGIRQATNLPEPLNAEEELEMRKRSYANANVTLPDGWNIEKNPWIGTTRTNWMDEIFRTAFYQRHNIALNVGTDNYSSRLSFSFDNDEGVLINTYNKNYAIRYNGKFDLNKWVSISEDLVWKNTENRSKDTNDAYTGPVLSAIYMPASATVYNPLDGTWGGTTTEDPEYIAKYGSNFAGAHGDAVNPVRLLRAENRFNRTSDVWSTTSLQIANIIQGLKFTSRFTYNLKTNNYKNFRPIQDEPGKPNNSNSLDVTNYRTDAWKTENTLTYDNSFGNHTVGALFSTTADHYNVRGLKVNGKNFADESPYLQYLAYAGTTSATDYLTGPDANVSLVARLAYSYDDRYFVTASWRRDYAGRLPKENNFGDFPAATLAWKISNEKFFKKSDFIGMLKLRASWGRVGNLGSIDYNYKSLLLGTSYWQEQAQYGVINNATWNNFVYNSTAMNRNLTWETSEQWDLGLDVELFKNRLALSFDYFDKRTFNLIQKQTMNWPSSIGLDPLLINQGEIRNRGIEIQANWNDRVNKDFSYFVSGNFSYLKNCVSDIGVKNADGSPGVWTDSDSKFRNIPYTRQTAEGEPLNSYYLIKTDGIFQSDAEAAAYVDKNGKRIQPNAVAGDLKFIDYNNDGKIDDKDRQYCGSATPKITYSFSFGATYKKFSFSAMFQGVGGAQAFYAAKSVILSDADGNFNRVKDILNAWSPTNTSSNIPRLSMNDPNSNFSTASDWYLESASYLRLKNLTLSYDLTDVLQKWSHLRERNSRMSVFFSGENLFTITDYSGMDPECGGWDAMKYPVSRVFSFGVKLTY

SEQ ID NO: 8236 - protein, 61 aa, B.fragilis
FYYYHSLINLNYVYYCINFSFFLSVNNVGTVASGIYNVMPQCPSMVNPPTLSGIKFSVAAL

SEQ ID NO: 8237 - protein, 78 aa, B.fragilis
YFFHICRLFDNYAALSYNERENDFINIISIYNTVSYFISHLKMFLSFFIFRNKEKVYECNTLINNTLLNIDSETLSET

SEQ ID NO: 8238 - protein, 250 aa, B.fragilis
CIINQCITFIHFFFVSENKKTQKHFQMGYEVTYCIINAYNIYEVILPFIIRKSRIIIKQTTNMKKILCIWVLTVTFLGAFPALADAQQWGLTANGLYWATATPNIGVEYAFHSKMSIAGLVQYNPFTYAKNRKMKHLAGQLEYRYWLSDVFKGHYLGVHATGGIFNFGNLPLGILKDYRLEGQLYGGGLTYGYQWIISNRVNIGVDIGLGYLYVDYDKFYCPTCGERVDHYRTNYLGPTKVGVSIIYLLK

SEQ ID NO: 8239 - protein, 391 aa, B.fragilis
ERDNLVKVMITMKNILRNFVFIVWAVALLPVNVSAQNRRDKEQTYVLEQPYEVTKITPSQGKKIKNVILMIGDGMSLMHVYSAWTANRGKLFLDNCQAVGLSKTYCADKLITDSGAGGTAIASGQKTNYHYVGVDTLGHPLKSLVDFAAAKGKSTGIAVTCRLWDATPADFCCHNKDRDAESEIVTDYVNCNADYVFGGGAKLFENREDGRDLFKELREKGFRTPRSWDELAGIKSGKVFAVPYPVDTPLPAERGDLLARASLKGIDLLNQNKNGFFMMIEGSQLDDYGHFNDLDLLMQETHDFDRTIGAIYEWAAKDGETLVVVTADHETGGLTLVDGDLKEGKIVCKFSTGGHSGVMVPVYAFGPGAQEFTGIYENTAIFDKIKKLLDL

SEQ ID NO: 8240 - protein, 98 aa, B.fragilis
KPLNGYAMKLSIDLGGTNVRIAQVENGICLNKMSVPCLAQQDASAVLDQLFQLITGMMNVQVDGIGIGVPSIVDVEKGIVYNVANISSWKKIHLKDIL

SEQ ID NO: 8241 - protein, 407 aa, B.fragilis
TKLKLFLSFILILPDTMIRLILLTDFTESFSYNLLKGVLAYSKKHEPWVVCRMPPSYKLTYGIEGVLKWAKAWQADAIIGRFDNDDNVELFRKNGIIAIAQDYKSRFSNIPNITGDYHKTGRMAAEFFLSKGFRNFAFYGYRDTVWSQERCEGFYECIAEHGFGNNFYSYQEQSLDDLWFYEAPPLLTWLKSLPQPTALMACDDNQGNRITEICKVNNIRVPDKIAILGVDNDEIICNLSDPPLSSISQNIVRGGFEAAELIEHLLNDEECSYQDVVLQPVNIVNRLSTDFYSTTNTHIHTALKYIHRNLANDITVSDIVKQVPLSRRLLEIRFKEVTKQSIHKYILNLRIERFAQLLLASDAPIADVAEQVGINNLKNLSRQFKTLKNVSPYEYRKEHRMMSNDNY

SEQ ID NO: 8242 - protein, 135 aa, B.fragilis
QRSKIILLIFSSIVTNLSSSNPTTSRGSSATPIYRSPPASLANATTVLAKSECSGNSALNSNLRPSDWFSISFMFILLLFCFVINLWQVIENLLDDKDRKRKHSFRSIFNVIFYLVKTGCQWRMLPCDFALWNTV

SEQ ID NO: 8243 - protein, 291 aa, B.fragilis
KNMNSKYLSLPKTKKYIQKKYLQFKEIRNPKRQTIYFVYYGTVGCFSIGIIADLCVYLIRKDLLLALCNILSLGLFLLFTYLLIRKKKQITFLLKCTFYTIQSNILISMYCRIYLPPEETGFFLSQDLMIGMVTCGLASISVSRHTVMILSFAPILLYMFIGVYTSSELYLMSLPSLAVAYIFPPIMLARLQEILRTMQRQKARMTSELKLWAAFNALHLQPSSKEIQLCCLILENKTTEEIAALQYIATSTVRSNRSRLRQKLQLNQETDLQTFLSELIKKDFDYLESPD

SEQ ID NO: 8244 - protein, 85 aa, B.fragilis
KISEQDESLFADAFRIFAELSWADIYNSEGLDYKEYTNKQKDSFAIFRSKKIFKFRITQKYRCFGEVVNGVFHVLMFDLTHKLSD

SEQ ID NO: 8245 - protein, 397 aa, B.fragilis
RKNDKAMKNMEKSYKRILLLGIGFILCGTLAAQEQKQDSTEGKNNIKASEYLMPKRKGAEKFHSKRGSEHLFFSVGSGIGYLFNVGGGQTAHGPRASFMAGNWLTPVIGLRAGGEYTQWKQGNTNMHLAGANVDYLINISAFAARYNPKRVFEVIGALGLSYQATIVKDQKTIHSYGLRAGLQGKLNVSSAFNLFIEPQLALYPDRVDNQSSWKRYNLAGSLMAGITYKPAGYATLTFLKGGFASLAAGTGNTGNVLFDTEFALGKWFDKFNGMRISAGSSTAFLDNEDSGSNRDFNISLNIDYLCSLTRLFSDRDSHVFNLIVAGGIGSYFPGAESSSSIILNGRIGLQGEIRLSAHSGLWLEPRINIFKDRSYRADLQEPIRGTVGLMVGTTYKF

SEQ ID NO: 8246 - protein, 143 aa, B.fragilis
NIFLQKSSCDGLLPGSRLHRLEDNTIALLTFGKKDGKEAMFFFRMNPNTTGAKNRAKRIAACIRNFDRKCEEQLFSRRWGISFVSATGLHSGIPLVFANKVNKPVADYLKENRKRNCGIVFIDFIESSGGQKLVEYLIGGNIY

SEQ ID NO: 8247 - protein, 184 aa, B.fragilis
SGADGKSAPVDIFFLSEREEYETKMKKLLPILLGVTLLLNSCIKDDMDACAGYMHIYFSYIYGGANRFFETVSTPTQLHFYKQKHKYRELEIAVDEIGLTEPYRFLKNFDDTDSLELIAWTQDEAIDYVDTPDTPIGEGYVKLKEITDGSGICRPVDDLLYGRIAIDAGLRENRSSPRGWKDQQ

SEQ ID NO: 8248 - protein, 565 aa, B.fragilis
KYKLFELISIIKFFSNMKLNKLFTFTLAALAMAACSNDDEPGIDKGGQKGELIDAISIAFTSSSAPATRADKGEIEGVGTENNVYVAYLFAKENDPQHEGAKVGDWTVKRVAGDANTEDKDVAAAIGEGDVATPGTKKNMCTFNGVRQGDSVYVVVNDPQMTLATAQTLAHQGDKSEAAIRAYISNLSKSYLNELTVTKDGTQGKKYIMAGVSAIPTNPNIPNGSTVKVSIPLNRELAKVFFNASVTTNPVYEAYGKMAIKDAEWENPTGTKDPDGIVVVRIPRRVSPFTAQARDWYFPQSADATAKDWDVEGWLKAFAGEKESAPGTAEVAGTTSALNKGEYNADAKEYRLTWVVGEKALADGATPAAASMVYVKSDKLYSPYFYVTPNYADNAGCATVVVTQATYIGAHTLLEPTITEQMLKEALDDSDFQTATSTDGSVTYDKLAANFWDTGANVTALVTFLEKDATYKLALRGETEQAKKEAAITIKPNDKRYYRADVANYSDDETTSMKITERNTFYHITGTITTLGAKSIEDAINSDNIDMLVQVVVKPWKYVVNNINM

SEQ ID NO: 8249 - protein, 391 aa, B.fragilis
NEGRPDTFVITGDIDAMWLRDSSAQVWPYLPLMKDDKELQLLIAGLINRQAECIRIDPYANAFNDGPLGSYWETDHTQHMVKELHERKWEIDSLCYPIRLAYHYWLLTKDISAFDADWHETMKLVVQTFKEQQRKQGLGPYSFTRDCDRPTDSQINNGWGAPVKPVGLIVSSFRPSDDATQYGFLIPSNMFAVVSLRQLAEIEREVYDNLPFAEECTALADEVDAAIRRYGTFNHPVCGRIYAFEVDGFGNALCMDDANVPCLLAAPYLGYCSFKDAVYRNTRKMIWSENNPYFFKGKAGEGVGGPHVGLNYIWPMSIIMKAFTTDAPEEIRSCLKQLRDTDGGTGFMHESFNSENAADFTRSWFAWTNTLFGELILKIIREYPGLLSQAL

SEQ ID NO: 8250 - protein, 62 aa, B.fragilis
EVTRENPVLSAAFQGEKRLLSIIYRLAADKKLTSYKQRINFLPAKNELFATTLFTSYGQKSE

SEQ ID NO: 8251 - protein, 207 aa, B.fragilis
TEVSAFMNTFNLKLDFPNLLWEIAGYNFPSLFGKRAILFIFIAISFQVSAQRMAIKTNTLEWLAASPNLGVEFPLNDWMTAEISASANPWKITDKLFYRHGRIQAEAKYWLRNLLARHYIGITGFYSMFDVGINRRAYYGDAAAAGVTYGYNWILSRRWNLEVSGGVGVARYRLVRYQPGSTHDEPNESGWAPIPVKLSVSFIYIAK

SEQ ID NO: 8252 - protein, 376 aa, B.fragilis
SRGGQAMNIKQVIFINISFFISLTVLAADRPTQPVRTEVYRLERLDSVLLVDLAVDLTGVHLAPDCTVYLFPLLASENTGDSLSLPPIVLNGPQSDLMYRRRRALGTTSGLEKITPYTVLREGDHALPRIHYRTEVPYAAWMDDVKVWMRDTNCNCDARLVPFAMHTEHIPPLVVERVDTIVIHDTIRLASVASGQSTVASDIPLRKKVTRIQAGYEADIYFPTNEMRILPDHELNRASWMHFVNQVDSIEQDNRNSISGVTVTGYSSPEGYTSNNERLAEKRAKALQAFLENKYGERMEVAVEWVGEDWKQFEKDIEVSDLPERNEILSILRTVSDSNQRKSRLKALNKGKTFEILLREYFPKLRRVSCRIRYVK

SEQ ID NO: 8253 - protein, 193 aa, B.fragilis
KRFMVPVAINNDSNCFTLGKSMFGEGKPYAHMVGVTIGTGIGAGVIINHRLYCGQYMGAGEIGSLPYLDSDFEHYCSSSFFKRHDTTGVVVAEKAERGDGAALEIWREFGTHLGNLMKVILFSYAPQAIILGGSIVSAFHFFKDTMKDAMQDFPYKILLDNVKIITSYLKDASLLGASALFEKQYLPISIIDN

SEQ ID NO: 8254 - protein, 381 aa, B.fragilis
NKNMKRMYYIGYMLCLLLAGCVVGEEADGLLEQRLSDRTLLVYMGGDNDLADETDEKLSALTEAWDRFPGHLLIYQDKKGADSTRLLEVCLDEQGEKVTKILAKYKQENSAGASVFARVVNEAMARYPSVDPGLIVFSHTSGWLPSGTAVVPAGITRSVIKDNHYEMSLQDFASAIPDGQFNFILFEGCFMAGLEVAYELKDKTQYIVGSSAEMLSPGFTPVYQQMFPLLYKKEADLPAVAAAYYDYYNSMEGDNRSATISVIQTSGLEMLKVQLRAAESRVERWEWIDRSGLQAFDRLSDGRHLFYDASAYIKRIGSVEESAAFDEALEQVIIYKAATENFMPESVGGFTIDGHCGMTLYIPDATVPTLLTERKKLKLMQ

SEQ ID NO: 8255 - protein, 61 aa, B.fragilis
SGCIVFTQYCFLFAQKSFFFVTHTLFFSFVIEVVYCIYMQKENVFESLNNMLFTFLPIGSE

SEQ ID NO: 8256 - protein, 481 aa, B.fragilis
KNGIAHLQHPEKGRCCKNATLIFRLSSGRRLHLSYPLWREMQTKCIRLFKIVKLGSCQHIDSRCCFTFVNQLKVKKKMTSITPRLNRSREGRDGSYPLVIQIIRHRKKREIYTPYRFWEAEFNTRLEMVENVGGNRRRLLIVREANEYLIYIKKELEAICRSLEADKGSAYTVDDIVNVYNYHNDLSQVLVYADSVIAGLENKGRQGTAANYRSARRAFEMFLDGRPFSFEELTPEVLDRFVTFLRERGNRPNTVSFYLRQWRAIYNRACADHVVFSDQKPFRRLNLKEEVTSKRAISREKIAQIECVDLTACHADMQLARDLFLFSFYTRGMSFVDMCYLNKENLQGNYLRYKRQKTGQELQIRIEKDLRVLIDRYASPLSDYLLPMLRNGDRYQDYRRRQRRLNKLIRELGDRLQLDMPLTFYVARHSWATLAHENDVPVSVISDCMGHTSEKTTRIYLDRIDTKRLDRANRLVINSLR

SEQ ID NO: 8257 - protein, 290 aa, B.fragilis
HNAMEKIILLVLPFFAASCGLVKQQASAPEPVNVMSFNIRYDNPEDSLDNWRYRKDRVANAIHFYDVDILGTQEVLHNQLEDLKLRLPEYGVVGVGREDGKEKGEYSALWYKKDRFNVLDSGYFWLSETPEVAGSKGWDGACERIASWVKLQDKVSDKEYFALNTHLDHVGGMARREGISLMLDRVNELSDGLPVIVTGDFNSEPESDVIKHVTDSANPEHLTDARQASSIVYGPSWSFHDFGKIPYNKRPLIDYVFVRNGLKVLRYGILAETENNGFLSDHTPVLVTVE

SEQ ID NO: 8258 - protein, 389 aa, B.fragilis
TKTIFPMLKHILFTCFFFFTAIPLLKAQGCGNDEKYHLPYKNTYVKEPLVAENEYRIAKPETVEPKSFEEARQILPNPIWAGHEKELEMYWRAWEIAVGNIRAPQQGSGFVSSYLDTAYNGNIFMWDSSFILMFARYGTRFFPFQRTLDNFYAKQHPDGFICREIKADGADCFERYDPVSTGPNLMPWCEMVYYYQFGDTERLHKIFPVLCAYYKWLKLNRTWRNGTYWSSGWGTGMDNMPRVPEGYSPIYSHGHMIWLDTNLQQLFTANLLLEMGFYLERWQEIEEFEDEAKMLGKYIHDNLWDEKTGFLYDQYADGTLCKTKGIGAYWTLLTDVLDDKQLDRMVKELDNPATFIGNFVFPLCRQIILSIKRTGVIGKVAYGRVPTIW

SEQ ID NO: 8259 - protein, 715 aa, B.fragilis
PNKITLMNIKRFLLLGIMALYAIIPAWGQAQKVEIRGSVIDDEGEPAISIVIRDQNEKGDVYGITDLDGKFKIMADPNTTLHFSGFAYASKTVKLKGKTTINVVISYEASMIDEVVITAKKVVDKLLPEPTDIEIVGNQYIIHPKVKIPKEMYKPNTRIVVQPMLVNITRKTQSLFRPAVVTGKEYAITLERMMEFDLSRDPLAAFQEKTQKIDKNEVIAYVDSLYMDNPDDECRCDIYMYLVEYKKLAYKDTVVIAKGTVNPMRFFTYQADGMKIRDEKYIPKPQKQQRGDRGEVKLNFLINSATIDEKDPNNQRELEKMRLRLQEIETDPNSEFLSFSVKGVSSPEGPYQSNLKLAQKRTDSTLKRIFGFLNGGTINAIKDSTYTEGVVASWEEVAELMERDSLPTDKLREIINCYPDNMASQYSRILRLPEYRNVILTTYLPRLRRVEYSFNYSVMRLLNDEEIRIMYKQDYKKLVPYEFWRIYLDADNDSTREVICRQALEQYPKFMIMANELAALLIEQKKADSKLLEPFVSRSAPTELLCNQVIALMDERAYNRADSIIDFLPDNDMTQDVRAIVGAYNGHFEDAYERFGTQGGINEVVLLMAMKQNEEAWEKAQELPDEPLSYYLRAACANRLDKVSEAYAFIKRAMNEDPSLKEIAQIDGDVTDLLQQLEDEKKELKEKAEKTKEKNETEDTETEESGLNEEKTIKQ

SEQ ID NO: 8260 - protein, 487 aa, B.fragilis
YQRIMKKLIIFLFVLSGCVPAVVFAQQQFSFKDGKFKIAQFTDLHWTPRSLACTETEATICAVLKAEHPDIAILSGDVVTEDPAIDGWKSVIRIFDEAKVPFVVTMGNHDAEHMAKDDIYDLLLESPYYAGAKGPEGIMGCGNCVIPVYGSRNREKVEALLYCMDSNDYQPDKLYGPYDWIHFDQIAWYRKQSARFTKENNGNPVPALAFFHIPLLEYNEIAGDGKTFGNNREGEVASANINSGMFASFIDMKDVMGVFAGHDHDNDYLGINKGIVLGYGRVTGADAYGELTRGARIIELYEGKFRFDTWITTPSGREATYYYPSGLNSEEERTADYLPAVKNVSSPKQGVAYTYYEGKCKRVAGIASCLKVKEGVMKNISIKEAAVANHFAYDFHTLIQIPEKGIYRFYTFSDDGSMLYIDGKLVVDNDGGHSARRAEGKIALEKGFHELHLLYFEDYMGQELEVGFSGLDFPEVPLQDEMLFLPN

SEQ ID NO: 8261 - protein, 189 aa, B.fragilis
SGNVYRKFRIPSLSADHPKYKENGRYWQGGIWPGTNYMVMQGLVKKGYHKLAREIALNHYAEVLEVYKNTGTFWEYYSPEKAEPGFMARKEFVGWTGLPPIAELIEFIIGIRGDYVNQQIIWDMNLTETNGIERYPFGSEGIINLKAEARRSANDEPRIAVDTNIGFELLVLYGGKEKKVNVTPGKHTY

SEQ ID NO: 8262 - protein, 180 aa, B.fragilis
STVVFFLLEKRLKVPDFLWLLLNFDWRKSVKMFLFYADLFNVVFVLCAFCCLYCNMYFVFVSFCILLMLIYGLFSSFPVSRAGKTNSIAGKIYNLTIVRFLLRPFIESISQSLLIKDAAGMYSYIPKQAQVRIRFMSFYNVYTFLICHMGREMSFSPCPGCSETRLCDITWFPCPLGEAG

SEQ ID NO: 8263 - protein, 63 aa, B.fragilis
QAPVQMPVVSLGRMMQRKMAKLIKLFFPWHYVINYFTNKAEVGIGANSFAEGSFQNQLKCSPS

SEQ ID NO: 8264 - protein, 551 aa, B.fragilis
TNLLIKTVMKKYIPLLALSALTFCSCSDFLNVQPEGNPATTSYFLNDEQAIDAIDGLYAPIHQEKGFGRELFWEQGAACDIVWAKSRGFNSLATFNYNGDESPISGGFDLFYQNMARSNWIIKQLLAKEKKGGLSDVEHRSLGEAFFMRGMAHFWIAYRYGTKDQGVPFVRYEDFEGDYDNSIPPQQASVIDNYKFIIEDMDNAISYLPKFEEYSDDDKGRAHKAAAVAYKAKVYAYWATWDETQWNNVIAMVNSLETDYGRGLADTFAEVFSSEFTDFWNKEYIWSIPSNGGSTGGGVEFPGVILEDKAWGVYNGWGHIKPSYDIYEEMAKDGAGNDRLVRSILEYNQEFEFFGEKRKFYTDTNLDVGFQINKYMDPFKHKDADTKGYVNTNGNWPTARVNFPLIRFAEMLLFRAEAYLMTDQPGKAKEDLNRIRRRSNLKELIDMPTMADLYHERRCELAFEYTDHLFDLKRWHRSSNVVIKELAAKELNAHPRIRKYADRSNPESTFTIEPYADYLNKTPYQDYMMVFPYPAEQITKSNGKLIQNDGY

SEQ ID NO: 8265 - protein, 261 aa, B.fragilis
MFSLCTRLPCASRQTTLQPVRKPGSIPITRFCPKGGARSSWRRFSVKTRIASSSACSFTEGGKFGFDGRFQQTAVGIRADDSLAGKEITHCITGTFVFAHLGVHLHWSDLLLSGLFFAMVAIVEETMMRGYVLGRLLRTRLNKFISLLISSLLFALLHLMNPNVAFLPMLNLVLGGLLLGASYLYTRNLWFPVSLHFFWNWIQGPVLGYEVSGNRFCETLFSLRLPANNLINGGAFGFEGSLVCTVLATLFTLFIIWWFEQ

SEQ ID NO: 8266 - protein, 532 aa, B.fragilis
KITLKIERKECFRLRSLSSKRFSITCHKFITKQNSRSMNIKEILNQSEGRRLEFKAELPEHSDLAKTVVAFANDAGGDLYIGVADDPREVVGLDEDKLVTIEEKISNIIFDRCYPAILPEIKFISEENKHLIQVTVFRGSTPPYYLKEKGKLQGTFIRVGSANRLADEAIISELERRRRNISFDSEVIPDKPVNDLNIDGFKAIFKEKTGEELSDQALRKLDLVKDMQGAEYPTNALILFSDDPLRNSLFHYAKVECARFKGVSIDDFIDQKSITTNIATQAEEAYNFVLRHINKGASVEGVYTVSRWEYPVKAIREAIRNAVVHRDYSLTGKDVKIAIYDDMVEITSPGLLPPSIDYAAMESRQSDARNKVIAPVFKRLGIIDQWGNGLKLIADEMKEYPNIELRWREVGLSFQVQFVRLDYVLNAERIKDIQQELQQELQQELQQELQQELRKATLYSEVLRCIVSNALSRQDISLALGQKKVSGQLNKVIQKLIANNLIERTIPEKPNHPAQKFRLTERGQLFLGLLAK

SEQ ID NO: 8267 - protein, 74 aa, B.fragilis
VASSRKGNKNLKHWRYWIFQALLYTCTEKLKVLVNGVLLRCDADYLFIRNTGEGYIWDETPIFIRIMPQSWQQK

SEQ ID NO: 8268 - protein, 68 aa, B.fragilis
ESRFVNELGNGTSRLTIPVNDLMNYYVEYFHISKQNGLVEYCNKAIVTLQQKLDKEKDNFNKRINSLL

SEQ ID NO: 8269 - protein, 77 aa, B.fragilis
YGKPARGRSGQQRHQRHQVGGKQEYPEGKGDNQDQLPHTAQTVERVRKERACRGCPMTADAARLLKEFDQIKNLKTM

SEQ ID NO: 8270 - protein, 536 aa, B.fragilis
NLKTHKEVTSNKSKTLDFVISKTMKIFRYILLASLTCTLFSCGPDELIPESVPPVVNPGDKDEPGEEPEEPEEPAKIQLGITASLQNMQQTRGIIEAFAPGHEMGVFVGTSQTDEAAGIKNASYLFDGKVWNAGQDVPVEADADVVAYLPYNREVTDFKSVPFDLADQNDILYGAAKVTKDVPTASLMMQHAMTLVRMRLMKNEYMGTGLVSDMTFAGVLTSGTVDALTGAVTKDYNHGRGSVKVGGNYMLNDENPVIVDAIMIPRAAYDEQASVSFVIDGQKHTYAFPVQHEWKAGMKYTYTLKMTGNYNAPVNKEQVDIDVEYWGQYGKTDDIVLNPNPEDYEFTIWPNYTAYGYDCYQNEGKVFGTFYYPWCGTSEGELRFVFMKQGMNEIVEKFQPIDIKTNGGWDGKRIQCYITSVPGTYQLVPLFRRKGETMWCRAADYDHGSTDWEWLYEVKAPAPDDLPALRMMEVEGQGYTSILVYPVPDETSWNLVYTLSNKGEKALRGEIKAVWEREFKLKSNSYRPSDKKKGAI

SEQ ID NO: 8271 - protein, 62 aa, B.fragilis
EGETIDVFMYVSDYLSLCIFPCVFFALKIYDKLSKKQKNGKQYSDREQGKIITGSSNPLFPK

SEQ ID NO: 8272 - protein, 66 aa, B.fragilis
METAFAGYGMNPDAKAAALPEPVFQGTGERNPVGYSVPGEYIPVAFQCLQTFASLQCLVEQFLSVV

SEQ ID NO: 8273 - protein, 107 aa, B.fragilis
PANAVSIQVLTWAWSWQPPVYATARGTVSFARRKGGYERCVIIRHSYGFETLYAHLAAYYTTEGQKVDRGAVIAFAGSTGKSTGYHLHYEIRKNGKPIKPYWYGYDD

SEQ ID NO: 8274 - protein, 138 aa, B.fragilis
SGRAVREKSPRPVKKQRQSLINIQMRITARPGAKTLVAECAFYLYMNDWLCKDKKIFAMTLFEILNFNREVLERLAGMGFKPDDYKYIDLYKEYERMRCQGDKVTYCVAVLSNRHGVSERKIYEILGRFKKECTFHAV

SEQ ID NO: 8275 - protein, 108 aa, B.fragilis
KGGQSGADEMPVPGGEVFYRVSEAVGTGGGIMTTLSVISYIERINRVYRLIRMERTGSLDELASLLRVSRRTINNYLEELRLMGAEIKFSRRQNPILFQEQIRIARDG

SEQ ID NO: 8276 - protein, 412 aa, B.fragilis
TTTKNKKYTMETIQEIIDTIKQWPATIWWVMGALFIISWFWDTPPRKKRNKDKMTDDKNNDLKSSNMTDKKEFKGNLMKEGIFVWVVFAPDGKAGLYMDGEKHLENGTYAYGNRLSTDVSSFHEICNLDNKPVYLHFPEHGISVRYRIRLRYSRTDDAGIERSEHEPETCLPAWIVRGKTGQTGLYLQKWHEEKCFIPDMSGLPGLPDLQPDGIPVRIEMLIRKAYPFFDLVKPASWRSWGISSNPASLKGNFFVNPGEGNLTGEGVVMWTVFTGDGKAALYMDDRWHLENGILAYGERLSHDVPVLHKIFNLEEMLLFRHFPKRGVPQRIRMQLRFPGTGEACKERPDCNRGTYFLPAWVVPEESGRISLYLQEQLSGECDIQDISRLPGAPKLQPNGVPVRVEILLQQEG

SEQ ID NO: 8277 - protein, 62 aa, B.fragilis
RILKLCDMIQEIIDMIKELSGSDILCLSFYCGFILILSHRSNEKASVYGEEKVPDNSPEPEK

SEQ ID NO: 8278 - protein, 135 aa, B.fragilis
SRQNIKEDSPMKLLLALLLSCLPFNGSNDGKELLDKALERCERLETLESYRDILSRYGVSDRIPLTCPLKDRFRKSSGFGIRIHPITGKRSFHSGIDMGVELAAPGLRHRSGNGFFREKERGVRKMCHYTPFLWL

SEQ ID NO: 8279 - protein, 69 aa, B.fragilis
KRCDMETIWEKVDYLGRILCCIIMGIAYILIMIAPLYASRHEQSGQRSDEKAFVDEEEKVPDNGPEPEK

SEQ ID NO: 8280 - protein, 297 aa, B.fragilis
EFCCPEIQTHILHDKMIMKKEKTYSRAPLPFVGQKRMFVSEFKKILKHFDDKTIFVDLFGGSGLLSHITKRERPDAVVIYNDHDNYRGRLENIGRTNTLLGDLRKIVGIYPHNQKITGKMREAFLERIRLEETTGFVDYLTLSTSLLFSGKYAQNMEELEHLCFYNKIRQADYRCDGYLDGLEVVCYDYKELAETYRVLPGVVFLVDPPYMGTDISTYRMDWKLGDYLDVLPVLKGHPFVYFTSSKSPILDFCKWMEEHPGTGNPFKGTGRSAITARMNYNSSYTDIMLYNNMACTA

SEQ ID NO: 8281 - protein, 271 aa, B.fragilis
SRRCKRMKTITTACVNHKGGVAKTTSLLNLAAGIARMHKKRVCIIDADPQANTTMAAFGEEMASLPREVLLESALQDCMQDTPPKLKPQKWLEKVDILPASLDLAATEVIMYTTPGREFLFREIVKGLEEKYDHILIDCPPSLGIITQNALMASDYVIIPTDGNYFAMKGIEKIHYIIGLLKRKLGAEVRILGYFMTKYNARRKLDVDIRESLVRSLGDGVFETVIRSNVALGEAQYKAQSIFDYAPSSNGADDYRELVKEFLGRIKKINK

SEQ ID NO: 8282 - protein, 332 aa, B.fragilis
PAIRALMTREGKSRTAILAGLAIVVVLLVWVIIASLPDSGSKEPETGEVILRTRIKESFTLDDMLQKVGKENTSKSASLSGFDPVTEEPADTAGNEREIRRIQELIRDNERELGAGITVPVQQPVASGGKEKPALQEKKEEEVRPGQRKAVDSVPRAPARRGFNTVRLVRQEERNAIKAFVHSTQTVMVGSTLKMQLAENCLTDDGQRIRKGTPVFGEVTGINGERVLVKITSVNLGGNILPFDKQVYSEDAIQGIYVPGNVKAETAQEAGAAGISGANTNISGGFDMGSQLVAGAANSVINATKSAASKNIRKVKVTIKTNYRILLRQSKE

SEQ ID NO: 8283 - protein, 97 aa, B.fragilis; identical to SEQ ID NO: 6703

SEQ ID NO: 8284 - protein, 207 aa, B.fragilis
NMKRILTLILSFCCLLSFVSCEKKEIADTFEANIRKLHGDYRLTDIHWPGLAVDLNHDGIGHWALLYEFQNKIGYYEPDYTASVSDGMVFSHDETWARPATAFNLTIPCPRYIVSEGKWVCSGIHGIQVTLRADVDSFSLQSNCSRIFPAYNDRDDVFLANIKDISLVVLSYDAASFRIGVHCTLPYDRPDGTQELNENYLYYEYSR

SEQ ID NO: 8285 - protein, 260 aa, B.fragilis
EKKSSCSLIFPAGITYVDYGSTNVEVDKPEGVDNILAVKAVQPYKEDTNISVVLEGGKFYTFDLRYVPAPERFSFVIDKEDTQRVAILDEKERSYGQKERIREAIAKRTPLDLGLKDKNSGVEFEVGNIFIDGDILLLRMTLINRTQIGYTTDFMRFYIQDAKIRKKTAVQQLEQNILFTFDYPEEVPAHESRTFTVAMNKFTIPDKKRLIIEIQEKNGGRHFLYKLKNKSLLTAEEVFRSRKQQETEDEADKILRRIAR

SEQ ID NO: 8286 - protein, 134 aa, B.fragilis
VDMRLKPIYITTLLLLFFLSGRAQKIEELTAVPLQIGYEKTLHLIFPTEVKYYSIGGDYVIGEKVVNCPGIIRLKAAEENFPGETTLSVVTADTKFYSYSISYNAHPAQSYVRIGGEAPAPEYAAGRKRKAAVH

SEQ ID NO: 8287 - protein, 117 aa, B.fragilis
NHTGMAMTIEQEIEQLVLKCIALDGLKACPKDLAFLEKYGLKNLYFFSLEYAMEGTDATVLDSKAKGLIRWYLYSTDFPLLRQKYEREGKAELMKCLYLEERYFTEFLKLSGQEEGL

SEQ ID NO: 8288 - protein, 64 aa, B.fragilis
SFWGKRGIEKESVPRVQVGGIVWVESHIVNGKFIASKLGVKLTPPNNPGIPHKRRGSIACIQMP

SEQ ID NO: 8289 - protein, 65 aa, B.fragilis
QAGGFFLELLFPIKIPWKFLLSYGSISLKTARYNTWLQFYCAVAFPMKEIRYLTKYSTLKSILLI

SEQ ID NO: 8290 - protein, 393 aa, B.fragilis
QKSMIHPLLTTIKKRFIMKKVRFLLLAAMVAMFTGCQKEVVEQELDNNKPTPTGDTRIIIEGEGMIGPATRSSDGKVEFEGGYATGAGLYDGKKAVPVEAHPDAGYEVNYFYGGPENQPKKYDYAQSGTSAFNVYLEGQDHTFHCGFKEKKRDLTVNAGTGGSVSPSGTNSYRVEKPISITATPDSGYEFAGWTVTQGDVTIENPGSPATTATLHNDNSTITANFKSGAELVFTVRASANKIVPMPTLGSGPYTVDYGDGKVAHEVNLRAPGYTQYPGSYHTYSADGEYTVTIKGPAATAFSFRGTRNSDLQYINPCPAKSILKNTIDISCVTSLEDAFSGMKSLESIECDLLESCKGRVTTCANIFDQCTNLHTIYNGLFEGFDKCTDFSLA

SEQ ID NO: 8291 - protein, 141 aa, B.fragilis
ELVLLVIGTEEETGRIFRKARSGMDGGTLTQNPYFPDVIAIDNAQDGGEPDMVLLTVGAYVDDLFKLRLVDNAELQRIAIGTVRLVFGKNGICVRLVDQEQGTGTVFLKGKACLACSRNMPFLLECDFQEVSVQEALADCP

SEQ ID NO: 8292 - protein, 120 aa, B.fragilis
REVFHISGKDVIQEQFSKQEDTFSIALQFSKTLPGTVVTWDCRKVPLKKVAFTHFANKRSGTVLMFSSSKVEANSCAFTQSSNNPAGIDKILGIAEKVELNFTAEVHPLNVFAGIELRAA

SEQ ID NO: 8293 - protein, 230 aa, B.fragilis
QKRSHFHSVIIIFTYICNQTKISYTQTRIPNLLIMKKLLLTTLLIFGTAIVHGQDKMQFSIIGGYEHFKKENPHNQTAGYGLGCEFKYYFYNRLYALANFHAGIYNEFTPRTAMAEIGEVDFSMHWRTREYKGGAGMGIDLLKTQRHNIYTQATFGLAKLKQSVPVIHSYRPTVEMGTKNTYLLRYATSISIGYDYRVSKSFSIGLNYTGWWVADVAYRNTLNAKIGYNF

SEQ ID NO: 8294 - protein, 177 aa, B.fragilis
FLYPVSPDTPLFIYKITLMKIKVGFGFDVHQLVEGRELWLGGILLEHEKGLLGHSDADVLVHAICDALLGAANMRDIGYHFPDNAGEYKNIDSKILLKKTVELIAAKGYQIGNIDATICAERPKLKAHIPSMQQVLAEVMGIDADDISIKATTTEKLGFTGREEGISAYATVLINRV

SEQ ID NO: 8295 - protein, 261 aa, B.fragilis
GKMPMLILLSCAKTMSDVSKTKTPLTTFPGFRKEAAEVALQMSQFSVEELERLLKVNPKIAVENYRRYQAFHSEGTRELPALLAYTGIVFKRVHPQDFSEEDFCYAQDHLRLTSFCYGLLRPLDMIRPYRLEGDVRLPEPGNRTMFDYWKPILTDRFIADIKKAGGVLCNLASDEMRGLFDWKRVEKEVRVITPEFHVWKNGKLATVVVYTKMSRGELTRYILKNRIESVEQLKTFAWEGFEFNEQLSDETKYVFTNGKTE

SEQ ID NO: 8296 - protein, 477 aa, B.fragilis
GQKFNFYSNKKMSTENEEWREDSKSENTDAGRDGNRSFNREGGYSRPSYNREGGDRPYRPRFNSNSEDRPQRSYGDRPQRPSYNREGGDRPYRPRFNSEGGDRPQRSYGDRPQRPSYNREGGDRPYRPRFNSEGGDRPQRSYGDRPQRPSYNREGGDRPYRPRFNSEGGDRPQRSYGDRPQRPSYNREGGDRPYRPRYNNDNRSQGFSRPIRRTGDYDPNAKYSKKKQIEYKEQFVDPNEPIRLNKFLANAGVCSRREADEFITAGVVSVNGEVVTELGTKIKRADVVKFHDETVSIERKVYVLLNKPKDCVTTSDDPQARLTVMDLVKGACAERIYPVGRLDRNTTGVLLLTNDGDLASKLTHPKYLKKKIYHVYLDKNLTKADMDQIAAGIQLEDGEIHADAISYSDEVKRDQVGIEIHSGKNRIVRRIFESLGYKVVKLDRVFFAGLTKKGLRRGEWRYLTEQEVNFLRMGSFE

SEQ ID NO: 8297 - protein, 208 aa, B.fragilis
KIRLGTTYSLDHPEKFLSEKAIARRQRQQLPVDSTDLPVCRRYVDAIRDRGVKIVAMGKWDNFVTVSCNDSAVIGEIAALPFVRATEKIWVAPSKPAAEDKRDSLANSPLKSENYYSPALRQIEISYGEKLHEAGFKGQGMTIAVIDAGYHNVDKIEAMKNIRILSTKDFVKPGSDIYAKGSHGMAVLSCMAMNDPYLMVGTGPEASY

SEQ ID NO: 8298 - protein, 337 aa, B.fragilis
IVKTVNKMTSQKSQNSNMLLAFLTLLGVIVLVAVVGFFMLRKGPEIIQGQAEVTEYRVSSKVPGRILEFRVKEGQKVQAGDTLAILEAPDVIAKMEQARAAEAAAQAQNEKAIKGARQEQIQAAYEMWQKAIAGVDIAEKSYKRVKNLFDQGVMPAQKLDEVTAQRNAAIATEKAAKAQYTMAKNGAEREDKMAAAALVDRAKGAVAEVESYLKETYLIAQAAGEVSEIFPKVGELVGTGAPIMNIAIMDDMWVTFNVREDLLKNLTMGSEFDAIVPALDNQTIRLKVHYMKDLGTYAAWKATKTTGQFDLKTFEVKATPLEKVTNLRPGMSVIIKK

SEQ ID NO: 8299 - protein, 185 aa, B.fragilis
IEMTEIEKMRSGELADMSAPELQVRFEHAKKLLARMRCLSTYDETYRGLLEELIPDLPATSVICPPFHCDHGDGIRLGEHVFVNANCTFLDGAFITIGSHTLIGPCVQIYTPHHPMDYLERRNPKEYAYPVTIGEDCWIGGGAVVCPGVTIGDRCVIGAGSVVTKDIPDDCVAVGNPARVIRCRM

SEQ ID NO: 8300 - protein, 138 aa, B.fragilis
DSSYSIERCGSMTLEEILQIEAQNVDCIFLYQEEGAWYAYEHSAFYCYSLLGILDIDWLPCPDGVSSGQKTIRVRVSEPDKFLCTPLLRLMRKRKTEYVVLCKISCGGFYYWREQQQMKFRVLQERESSCTKINEHAE

SEQ ID NO: 8301 - protein, 478 aa, B.fragilis
SLLYKLSLPLCLITQEKELILQPDNYLNDNMKLDLLTAISPIDGRYRGKAEALAAYFSEYALIKYRVQVEVEYFITLCELPLPQLKGIDKSVFESLRNIYRNFTEADAQRIKDIESVTNHDVKAVEYFLKEEFDKLGGLEEYKEFIHFGLTSQDINNTSIPLSIKEALEQVYYPLIEELIAQLKTYATEWESIPMLAKTHGQPASPTRLGKEIMVFVYRLERQLATLKACPVTAKFGGATGNYNAHHVAYPEYDWKAFGNQFVAEKLGLEREEYTTQISNYDNLSAIFDAMKRINTVMIDMNRDFWQYISMEYFKQKIKAGEVGSSAMPHKVNPIDFENAEGNLGIANAILEHLAVKLPVSRLQRDLTDSTVLRNVGTPFGHIVIAIQSSLKGLRKLLLNETAIYRDLDNCWSVVAEAIQTILRREAYPHPYEALKALTRTNQAITETSIKEFIEGLDVNEEIKKELRVITPHSYTGI

SEQ ID NO: 8302 - protein, 642 aa, B.fragilis
PENHFNKNNMKKITFIAILLLCICSLTKAKEKVIEQPPFIAWTSTSIQVDKVVLSDTATVLYIKAFYHPKQWIRISGQSFLKDNNGETYTLRSGIGIKPDTEFWMPESGEGEFRLVFPPIPASATSIDFSEGDNVQGAFKIWGIQLKGKALPELLLPQEAIVHKIDINDELPEPKIEYKDATIKGRILDYRPGLVSKIVPIIFDPVKGAYESEEVKINNDGTFVTRVKVPTTTSAAIRLFGKMITFYAVPGEESSVIINTRELCRQQSKFHKDDKPYGEAVYFGGTLAGLSQEYSNCTLKTSILNDYRQLFKDVAGMDAGAYKDFIYGKRANLLASIEKAPISKALKAVLGNQVDAEAAQAISLTEMVIKQAYTMEHKMSKEEAREYFNTAQIELPENYYANAFRPLASINTMAALYNSKLSELIPYYLRRRTDELTKAWGTDKGIYFDINKAGELYSSIKEFTPLTAEQEVILATLPPACQNEVRDANNQLLKTLEANKKKTGFTINEVGDVSNEELFSSIISKYRGKVILVDFWATWCGPCRMANKAMLPLKEELKGKDIVYLYITGETSPLKTWENMIPDIHGEHFRLTDAQWSFLGDKFDIRGVPTYLIIDREGNVKHQKTGFPGVAQIKEELMKVYD

SEQ ID NO: 8303 - protein, 344 aa, B.fragilis
LITNDMKEIDWANLSFGYMKTDYNVRINFRNGAWGELEISSSEVLNLHMAATCLHYGQEAFEGLKAFRGKDGKVRIFRLEENAARLQSTCQGIMMAELPTERFKEAILKVVKLNERFIPPYESGASLYIRPLLIGTSAQVGVHPADEYMFVVFVTPVGPYFKGGFSTNPYVIIREYDRAAPHGTGIYKVGGNYAASLRANKKAHDLGYSCEFYLDAKDKKYIDECGAANFFGIKDNTYITPKSTSILPSITNKSLMQLAEDMGMKVERRPVPEEELSTFEEAGACGTAAVISPIERIDDLENGKSYVISKDGKPGPVCEKLYNKLRGIQYGDEPDTHGWVTIVE

SEQ ID NO: 8304 - protein, 268 aa, B.fragilis
MNYKITTLAENSVYGKGLQGEHGLSLLVEAGEHKVLFDTGASDLFLRNARLLGLDLSDVEYVVLSHGHRDHTGGLYAFLKMNSVAKVVCKREVFRKKFKNERENGMLHPEALDKSRFWLVDETTEIVPGVFAFPDVKVVDRNDTHFEHFFTEIEGEMRPDTFEDELALVLKGEKSLSVLSACSHRGITNIIRAVQNAFPGLGLKLVMGGFHIHNAEEEKFNVISAFLGMKLPKRLGVCHCTGIDKYALFRQQFNDRVFYNYTGWVETI

SEQ ID NO: 8305 - protein, 282 aa, B.fragilis
RKNKMSRTNFDTLLEAGCHFGHLKRKWNPAMAPYIFMERNGIHIIDLHKTVAKVDEAAEALKQIAKSGKKVLFVATKKQAKQVVAEKAASVNMPYVIERWPGGMLTNFPTIRKAVKKMTTIDKLTADGTYSNLSKREILQISRQRAKLDKTLGSIADLTRLPSALFVIDVMKENIAVREANRLGIPVFGIVDTNSDPTNIDFVIPANDDATKSVEVILDACCAAMIEGLEERKAEKIDMEAAGEAPANKGKKKSAKARLDKSDEEAINAAKAAAFLKEDEEA

SEQ ID NO: 8306 - protein, 93 aa, B.fragilis
QKNNRKPMNAVAELLPAFPQGHTSIYLKCYYIVLSFNSTTKGIEQKREIKKIAKSICLLQKESVYLKYKKTQIWQTPNYREYPKLNKLCCMPN

SEQ ID NO: 8307 - protein, 239 aa, B.fragilis
HITKMKKQIIHRWMLMAVFCLGASLIGINAQEKDWANLQRYAQQNAELPKPDKNEKRVVFMGNSITEGWVNTHPDFFKSNGYIGRGIGGQTSYQFLVRFREDVINLSPALVVINAATNDIAENTGAYHEDRTFGNIVSMVELAKANHIKVILTTTLPAAAFGWNPAIKDAPQKIASLNARLKAYAQTNKIPFVDYYSSMVSGSNKALNPAYTKDGVHPTSEGYDVMENLIQQAINKTLR

SEQ ID NO: 8308 - protein, 160 aa, B.fragilis
HLKNKLRVDTLSYKTISANKATVTKEWVIVDATDQTLGRLGAKVAKLLRGKYKPNFTPHVDCGDNVIIINADKVKLSGNKWNDRVYLSYTGYPGGQREMTPARLIAKPNGEDRLLRKVVKGMLPKNRLGAKLLSNMYVYAGSEHKHDAQNPKAIDINSLK

SEQ ID NO: 8309 - protein, 252 aa, B.fragilis
MGKNKLEKFADMASYPHVFEYPYSAVDNVPFDMKGKWHKEFFKNDNPIVLELGCGRGEYTVGLGRMFPDKNFIAVDIKGARMWTGATESLQAGMKNVAFLRTNIEIIDRFFAEGEVSEIWLTFSDPQMKKATKRLTSTYFMERYRKFLVSNGIIHLKTDSNFMFTYTEYMIEENGLPVEFITEDLYHSDLVDDILGIKTYYEQQWLDRGLSIKYIKFLLPQEGELREPDIEIELDSYRSYNRSKRSGLQTSK

SEQ ID NO: 8310 - protein, 486 aa, B.fragilis
DAMKKLLFLFFLLTTPFSLKSQGILSLDSCRALAIANNKELLISGEKINAAHYQKKAAFTNYLPNFSATGAYMRNQKEFSLLNNDQKAALSGLGTSVSGPLQQAAQVIGQLHPELAPMLSQLGGAIVPALNEAGTAIVDAFRTDTRNVYAGAITLTQPLYMGGKIRAYNKITKYAEELARQQHNSGMQEVILSTDQAYWQVISLVNKKKLAESYLKLLQKLDSDVEKMIAEGVATKADGLSVRVKVNEAEMTLTKVEDGLSLSRMLLCQLCGIDLSTPIVLADEQVDDLPLIPATTNFEIETAYANRPEIRSLELAAKIYQQKINVTRSEHLPSVALMGNYMVTNPSVFNSFENKFKGMWNVGVMVQLPIWHWGEGIYKVKAAKAEARIAQYQLEDAKEKIELQVNQSAFKVNEAAKKLAMAKKNLEKADENLRYATLGFEEGVIAPSNVLEAHTAWLSAQSEKIDAQIDVKLTEIYLQKSLGTLK

SEQ ID NO: 8311 - protein, 420 aa, B.fragilis
IRALMKDISLKDKITQGINDLFYIWKREFRTTFRDQGVLIFFVLVPLVYPLIYSFIYTNEVVREVPAVVVDDSHSSLSREYLRKVDATPDIQIVAYCADMEEAKQMLKDRLAYGIIYIPKDFSSDIAQGKQTQVSIYCDMSGLLYYKSMLLANTAVSLDMNEDIKIARSGNTTDRQDEITAYPIEYEDVAMFNPTNGFAAFLIPAVLILIIQQTLLLGIGLSAGTARENNRFKDLVPINRHYNGTLRIVLGKGLSYFMVYALVSVYVLCAVPRMFSLNQIGQPGTLALFILPYLMACIFFAMTASIAIRNRETCMLIFVFTSVPLLFISGISWPGAAIPPFWKYFSYIFPSTFGINGFVRINNMGATLSEIPFEYKALWIQTGFYFLTTCWVYRWQIIKSRKHVIDKYKEMKNRGKEFFS

SEQ ID NO: 8312 - protein, 681 aa, B.fragilis
LLLETKIISTFEASISSCRRCKQSTYNNKTHVMKRKMMSLLLALAVISGSSVYAKVIDVMSPNGAIKVSVDIKDRIYYSVSYDNDQLLKDCYLNLQLQNETLGTNPHLRSTKRGTIDESVKREIPFKNAIVRNHCNTLRMNFSGNYAVEFRVFDNGIAYRFVTDNKGDNIVMGEDFAINFPANYKAHLSQPDGFKTSYECPYTHVDTEKYAATDRMSYLPVLIETDKAYKILISEADLSDYPCMFLKSTGKNGMQSIFPKAPLAFGEDGDRSLKITEEADYIAKTDGKRSFPWRMMVISKEDKELIENEMVYNLSAPCVLEDYSWIKPGQVSWEWWHDARLYGVDFRSGFNMDSYKYYIDFASKFGIPYIIMDEGWAKNTRDPFTPNPTINLTELIKYGKDRNVKIVLWLPWLTVENHFDLFKTFADWGIAGVKIDFMDRSDQWMVNYYERVAKEAAKHKLFVDFHGAFKPAGLERKYPNVLSYEGVLGMEQGGNCKPENSIYLPFMRNAVGPMDFTPGSMISAQPEDNRSTRANAMGSGTRAFQMALFIIFESGLQMLADNPVYYYRELPCTEFITSVPVTWDETKVLYAKVGEAVVVAKRKGEQWFIGGITGNQPQNIEIDLGFIPAGQSFTLTSFEDGINADRQAMDYKKKESTVNNQTRMTLKMVRNGGWAGTIKMK

SEQ ID NO: 8313 - protein, 460 aa, B.fragilis
FIVDHSSFKNRSSFHSALKLHQHRCFHCFHFCLRGFIQLFKDNNLIFTLLQPYTRNIECLLRTYFPVTSDINTVHKNDTLSPAFHIHKCISDFIQRKSPLIKHRTAFQLSHFRRYIFMCISFQFGQIGHFVHRQLIHIPSTDNFLPGYLNRANNSLGIMYDLATIINASHIFNQNLQSSIKRHLYLHGVGLGIPIQHSYLFTIHINNGIVTQPRNFKCSANRLIEMTSIQYISIPLIQLFKSQGSIRRHGLLFFCKSKYIRNFIQLNRRYFDNRIRSRSFRNCIFNIFLDHIANRIILWSYPACLANRSIIIITGHIRLNITLLIIISTTRKTKIRTSMHHIEVERNIILQILLGLTSNPGSSYLRERLCPMRQPTRIKFCNHIRTFAVVILINHFFQILNITFAIRRRQSSRSSPTLKKPTAIRSKQRYIKSCISQLLLDFSIVSAMFFQRYILTLGNV

SEQ ID NO: 8314 - protein, 224 aa, B.fragilis
KQNEVTMNNQIQHKDSTKVPEPTLRRLPWYLSNVKLLKQKGERYVSSTQISKEINIDASQIAKDLSYVNISGRTRVGYEVDALIAVLEDFLGFTNMHKAFLFGVGSLGGALLRDSGLSHFGLEIVAAFDVNPSLVGTTLNGIPIFHSDDFQKKMQEYGVHIGVLTVPIEIAQCITDTMVAGGIKAVWNFTPFRIRVPEDIVVQNTSLYAHLAVMFNRLNFNEIE

SEQ ID NO: 8315 - protein, 290 aa, B.fragilis
EDSDMANPKLPGIPEAEQALLYAKLNEYNRGRMSYKEAGAYFVVLPRPGHPTYSVWIYSPTLEKNRLLFIHELSADINESLRMASTLFFFSRRCLLIVEYNEKRMQSNGDDIISFGRYRGHYLHEILKVDPAYLSWIAYKYTPKIPKQERFVAIAQVYHSVHLDIMQRKARQKREAGRFLGNEGEKLEGLNLKVVRVRLEDDPYKTRVMGTSVQFFVRQIVTLTDPSGNLVVLRISSKTPSPVSCQLPALEHEVRPGEIVHIASARIARTYESYGSKYTRLSHVKFLIGT

SEQ ID NO: 8316 - protein, 166 aa, B.fragilis
NRTDMKKLYFFTMLAAMLFAVTNVMAQKANFKPANLKGIWQLCHYVSESPDAPGVLKPSNTFKVLSDDGRIVNFTIRPGADAIITGYGSYEQLSDHTYAESIEKNIHLPMLDNQDNVLTFELVDDKVLHLKYFIEKDLNGNELNCWYKETWKRIEMPDKFPEDIVR

SEQ ID NO: 8317 - protein, 411 aa, B.fragilis
DMQDTLSLYELNALVRRSLEQCLPDEYWVQAELSDVRTNSTGHCYLEFVQKDPRSNNLIAKARGTIWANIYRLLKPYFEESTGQLFTSGIKVLVKVTVAFHELYGYSLTVQDIDPTYTLGDMARRRREILRQLEEEGVLTLNKELEMPLLPQRIAVISSATAAGYGDFCHQLQHNPRGFYFRTELFPALMQGNQVEESVLAALDAVNARVDEFDVVVIIRGGGATSDLSGFDTYLLAAACAQFPLPVITGIGHERDDTVLDSVAHTRVKTPTAAAELLIDRMEEAADRLGALAEELHTRVFYRLEQERRRLALLQARIPSQVMRKLSESRIKLQMAKSNLSHAAETLLARQHHRLELLQNRIADASPQKLLKRGYSITLKDGKAVKSAACLQSGDELITRLYKGEVKSRVE

SEQ ID NO: 8318 - protein, 335 aa, B.fragilis
NIKDIMAVTMADITKLRKMTGAGMMDCKNALTDAEGDFDKAMKIIREKGQAVAAKRSDREASEGCVLVKVEEGFGAIIALKCETDFVAQNADFVKLTQDILDAAVANKCKTLEEVLALPMGDATVAQAVTDRTGITGEKMELDGYMVLEGATIAAYNHMNRNGLCTMVAFNKKVDEQLAKQVAMQVAAMNPIAVDEDGVSEEVKQKEIEVAVEKTKVEQVQKAVEAALKKANINPAHVDSEDHMESNMAKGWITAEDVAKAKEIIATVSAEKAANMPEQMIQNIAKGRLAKFLKEVCLLNQEDIMDAKKIVREVLKEADPELKVVDFKRFTLRAE

SEQ ID NO: 8319 - protein, 272 aa, B.fragilis
RYGESYSTGYKQDFTITIFKKEIMKPFISFCLLLCICLGKLYAQGVNIVYIGNSITQGALLKTPATEAPPVQASQYIEQATKQSVAFRNCGVSGATTLNFLPIAERQFPNVKSAAQELSQRKGTLLFSIMLGTNDSACNGPFGSPVEPVSYYTNMKTIIDELLSLYPECKVVIHQPIWYSPNTYNSAMYLAAGLKRLKSYTPMIHKLVDHYSQANPNQVFLGDTAASDFFRNNYQSYFTPENGNAGTFYLHPNKEGAGILGKYWAEAILKAI

SEQ ID NO: 8320 - protein, 130 aa, B.fragilis
DIMEVVNALGRRKRAIARVFVSEGTGKITINKRDLAEYFPSTILQYVVKQPLNKLGVAEKYDIKVNLCGGGFTGQSQALRLAIARALVKINAEDKPALRSEGFMTRDPRSVERKKPGQPKARRRFQFSKR

SEQ ID NO: 8321 - protein, 98 aa, B.fragilis
MLLLKIFFTTYQPSPDKGRLTCYELISYPFEIIIGLQKYGFSLNWQTISVFFWIYPVDNEPQAICRKQRPTRQKKTAGNKPHTINATIHNRQLATCSP

SEQ ID NO: 8322 - protein, 81 aa, B.fragilis
IYTCVSLRKCREEFGDCIHRFPIVLLLLVTAFRAQKVIKVGVWVTAPFLRIGKPGVMERENSAFKDGKPGSGGGRAGLWGK

SEQ ID NO: 8323 - protein, 400 aa, B.fragilis
HEVCYAPCSFKVCILTCPIDCILPGILYICILRKKRMNMKESKKRVLVGMSGGIDSTATCLMLQEQGYEIVGVTMRVWGDEPQDARELAARMGIEHYVADERVPFKDTIVKNFIDEYRQGRTPNPCVMCNPLFKFRMLIEWADKLGCDWIATGHYSRLEERNGHIYIVAGDDDKKDQSYFLWRLGQDVLRRCIFPLGNYTKQTVRDYLREKGYEAKSKEGESMEVCFIKGDYRDFLREQCPELDAEVGPGWFVSSEGVKLGQHKGFPYYTIGQRKGLEIALGKPAYVLKINPQKNTVMLGDAGQLRAEYMVAEQDNIVDEDELFACPDLAVRIRYRSRPIPCRVKRLEDGRLLVRFLAEASAIAPGQSAVFYEGRRVLGGAFIASQRGIGLVIEQNKDWK

SEQ ID NO: 8324 - protein, 68 aa, B.fragilis
QTSCHGNVSYISMNRTLVERCFCLSVNLISEPPYISVFRADGKLRKKKRPTRNQPIILLAANRTITIQ

SEQ ID NO: 8325 - protein, 337 aa, B.fragilis
YNIRIEGMKVSFSMIFEKATDPFIKSVIKAAETAILSHVGKEVEIVGNISVKTVQAARPEVGKLLPHVKNIIGISSGKGGVGKSTVSANLAVALAKLGYKVGLLDADVFGPSMPKMFQVEDARPYAEKIDGRDMIIPVEKYGVKLLSIGFFVDPDQATLWRGGMASNALKQLIGDAAWGDLDYFLIDLPPGTSDIHLTVVQTLALTGAVVVSTPQAVALADARKGINMFTNDKVNVPILGLVENMAWFTPAELPENKYYLFGKEGAKKLAEEMNVPLLGQIPIVQSICEGGDKGTPVALDENTVTGRAFLALAASVVRQVDKRNVEMAPTKIVELHK

SEQ ID NO: 8326 - protein, 861 aa, B.fragilis
LKNRKTMNWGIHDRRGWMAVVLLLCAYPFSAQNTGQITLELRNKPLPAVLKLIEKAGEKHIIFSYNETETYHVTASIHQRNESEALSIVLKSTPFIYKERENYFVIQKGSIDKRLITIRGSVIDENNEPLVCANVLLLDKADSAFVNGVVTNQDGSFRIPGEEGRDYLLKTSYIGYQTKIQPCGAMNKVCLFSDTQLMKEVVISVDHPLIVHKDNGLLANVVGTPLAKMGSAAEMISHLPFVTGGVGEYMVLGHGVPVIYINGRKIRDQGELERLRADDILSAEVITTPGVEYGSDVSSVIRIRTIRRRGQGISSGFRGVFSQGHDYNASENLYLNYRTGGLDLFVKGDLKHGNYYQESILNQETDASSRWEVKGGATSFHKAVYFSGEVGFNYELDDKNSLGARYMPGANVGSVNRTNLGNNFVYKDGEKIEEISSLQHAHTYPTWTHSVNGYYNGVFGQWNVDFNADYLLGKNNSTNEVFNNDDKAAQSENEVRNYLYAMRMVVKRSFRKGTLSFGTEETFTNRHDVFVQSGFSDNADDHIKQSIYSVFADYSLHLDKFNVAVGLRYEHQKTDYYEYGVHQDEQSPVYNDIVPVALVGYEDKGWHASLSYRLIRNNPDYHMLSSSITYSSKYMYRSGDPLLVPQKHHVFILDAGSRWAFVNLFFDRTLDLYTRFLKPYNDETHPGVLLFTMASIPTTDTYGMNLNVSPKIGCWQPQLNGGMYFYDADVRSLGITRHWNEPQFYFELDNSFTFPDGWFLNVNGNISTAAKQSYSLIHREGTVNARLSKSFLEDALMITLTADDIFHTRYHYMDGYGVRSHILTRSYNDNQRFGIQISYKFNATKSKYKGTGAGQSEKQRL

SEQ ID NO: 8327 - protein, 188 aa, B.fragilis
FCWLMAKLTIFRFRGHISREERFRQLFVEIYPRLLRYAIQLMSDREEAKDIVGEVMEEAWKCFDRLEAETQNAYFYTATRNTCLNRLKHLRVEQQHLDTLREVTRMDVNTGYRQHEAQLQQAETIACSLSEPTRTILRLCYWEKLTYRQVAERLEISPDTVKKHISKALRILRNEMNGKEETNGTERG

SEQ ID NO: 8328 - protein, 153 aa, B.fragilis
CPARRRKWRIKESYLVCSAGNSGASSWKKITTPGDAENVLTVGAIDRRGVLASFSSIGNTADNRVKPDVVAVGLNSDVMGTNGNLRKASGTSFASPILCGMVTCLWQACPQLTAKEIIELVRQSGDRVDFPDNIYGYGVPDLWKAYQSVSKKK

SEQ ID NO: 8329 - protein, 80 aa, B.fragilis
VLRSEDETSEHLVEQDYLAAAVEFADSVGVDVVNTSLGYFTFDDSTKNYKYRDLDGHHALMSRQASKMADKGIVLGVQCR

SEQ ID NO: 8330 - protein, 590 aa, B.fragilis
ERTRKIIANTLKNMTPELAYFLKINIAIALFYAFYRLFFYRDTFFQWRRTALLCFLVISPLYPVLNIQEWIRSHEPMVAMVDLYATIVLPEIEITPEVRAADWQSIILSTVNIIYWSGVTLLLVRFFAQLASILRLRLRCRKDQIEGIPVYLLDKESGPFSFFHWIFIYPQAHPQNELSEILTHEGTHARQRHSIDVIISELMCIACWFNPFMWLMKREVRNNLEYMADNRVLEAGHDSKSYQYHLLGLAHQKSAITLSNSFNVLPLKNRITMMNKKRTKEIGRTKYLLFIPLALALMIVSNIEAVARTTKSIAQEVMQTVEEQIEPENAVAVKESTSSPQAANHISQPQESGIAEQPAQEESQEQIVFEVVEKMPEFPGGVRNMNHFINSHLRYPVIAQENGTQGQVIAQFVIQADGTLSDLKIVKSVDPLLDAEAMRVIKEMPKWQPGKQRGIAVATRVTVPIRFRLMDSDSAPSTDSNKNQENTIFDVVERAPEFPGGMEACLKYMYKNIKYPAVAMEAGIQGQVVIQIVIDKDGKIHDPKIVRGVSPELNAEAVRVISNMPQWIPGKQKGKNVATRFTLPVRFRLA

SEQ ID NO: 8331 - protein, 319 aa, B.fragilis
TERRKQMEQREDNKNDIASCRLKNLFGEALGDLSSVEETETAWQAFASRRRQERVRTLVFGFAAVASVALLLFWGFSQENFLSQEVEVFASVNSPDKLVMTEDKGIIAVRTPPATTITIHLPDSTEVLLNANSRLEYPKAFTGDLRRVMLEGAARFNVQRDTLHPFIVETGSLQTRVLGTVFDVDSYGCGTTSKVVLYEGSVQVSDKANTKACKIKPGEQVYLDRVGDICISQADICMQKSWTEGLFIFDNVTLRYVMQEIGAWYNTNIVFRSHPLLEERIYFSASRHLPVGEILNVLNDLQIARFIVEGDKIVVSPLS

SEQ ID NO: 8332 - protein, 526 aa, B.fragilis
RLYGKIDVAVSVTLPQPESVNTLTRAGGPYTDTDIKNADLLIFDKDAKFMERVKVDNDRLVVTGTGINFTVRLDATSERRIIHLVANGRSADGTSDRLNFGGITPGMAENAAISSLQTASLEHVDEGESTLLNHVMPLVMWGRFALNGINIVTKAEGVKLLRSTACIQVKKGNGGGNTGLGDFVIEGITVHQGACHGFLAPTDCTGEVNTPVVANPVTGGTYLDYRKGWVNGAEPSLYIYERNCSASDYMGVVIAARYKGKKGYYKVVMNGNDGSPLNIVRNHRYIVTVVGVNGPGYESPDIAVASAPSNALKVELTDEDTDLPCIVADGQYRMASSNNVFSLYGKTGVTTSATGVDICTVYSSRGIQPVLTLPDDCNWLTNLSAQALGSNKYKITGDFTSAANDAVATTLTMTCDNLSQPVRVSWNPIISDQKDIDSFVLDLVGSTDRNWTVRVLNPTSPGWLFLHPSAASPGALPGDGMVSELSSKYSSHAYLHVAFGANRRGTVQMTSASGGETVARKIVVIQ

SEQ ID NO: 8333 - protein, 431 aa, B.fragilis
TFSGIPHACKPPSLHCSSSERHKAPLYGHDVREITPHIPHRSDRVPTGGHSGETDPKHRYRTALCVPPLQQAGKAHALPVIPYRKHCFPRGLLFCSSFIERLFNNSHPSVSIGFVTILDATQFIIKLLTNRSRLSIFRNHIRLAILKVVNTFDRTDNGSSTTSSRFFESAQLFFGYRTALYFHAHIFRQLHQALIGDGRKDGSRLRSDVGIVFNTKEVGRTTFVNVFFIFCVQIELAGITQVVSLLIGAQTGCIVSTDFVDTGSVRRSTVVLADNDIRIGREATLEIRTDRCDKYNKHIFICRMDTHLGTGSDKQRANVKRSSTLVRRNKAFVQFYHFQDSFLETFRRQFSHHDALTGGLQTRSILLQTENTHFAVFTTESFQTLEGFLTIMQASGSHVQVQHLATAYFEFAPCAVTEIDSHIVVCLHITE

SEQ ID NO: 8334 - protein, 301 aa, B.fragilis
CVLGGIVLFCSVLFLYLRKKYESIKKDASVLIAGLVVASCANDLDGFISIPDNATGVQQISTRSSSDNLKIVYHGKVYETLYTIIDDSIYSYQNSEVKDLMDNLSETRPNLRTFIHGNGVIEYFDDENDFNLNKERIMSEYEKESLSTSLSERWFPTDNVPQLAPIDPENNEVEIYLYEDPYYLGDLFSLQRNRSDSDYNELSKVWNFGGQILSMIVHTIGFGGVFTFYERMGCQGKGITLVLTAGQYINLCSELSADAMRGISYGSIAMSDLRSLHWSGIAGNWNNRICCIKVDRYIGMM

SEQ ID NO: 8335 - protein, 347 aa, B.fragilis
WTRGYRPICPLGAVDLDNSASSRNILRNLDAFGQTAVVARYSSVNEARTAMQEGKIYGFFYIPKGMSADAQSQRQPKLSFYTNNSYLIAGSLLFKDMKMMSELASGAAARSVLYAKGATEDQAMGYLQPIVIDTHPIQNPWLNYSVYLCNTLVPGVLMLLIFMVTVFSIGVEIKDRTAREWLRLSNNSIYIALAGKLLPQTVVFFIMGIFYNVYLYGYLHFPCNSGILPMLLATLCLVLASQCCGILMIGTLPTLRLGLSFASLWGVISFSISGFSFPVMAMNPVLQALSNLFPLRHYFLIYVDQALNGYSMAYSWSNYMALLIFMLLPFFVVHRLKEALIYYKYVP

SEQ ID NO: 8336 - protein, 73 aa, B.fragilis
NSNMPAKKKETYSQAIERLEKIVRQIDSNELEIDELSEKIKEANEIIAFCTGKLTKADQEIEKLLQEKRLSEE

SEQ ID NO: 8337 - protein, 470 aa, B.fragilis
NSCMEKISRTKIVDLMKREDFGAMVNVKGWVRTRRGSKQVNFIALNDGSTINNVQVVVDLANFDEEMLKQITTGACLSVNGVLTESVGAGQKAEVQAREIEVLGTCDNTYPLQKKGHSMEFLREIAHLRPRTNTFGAVFRIRHNMAIAIHKFFHEKGFFYFHTPIITASDCEGAGQMFQVTTMNLYDLKKDENGSIVYDDDFFGKQASLTVSGQLEGELAATALGAIYTFGPTFRAENSNTPRHLAEFWMIEPEVAFNEIQENMDLAEEFIKYCVRWALDNCADDVKFLNDMFDKGLIERLEGVLKEDFVRLPYTEGIKILEEAVAKGHKFEFPVYWGVDLASEHERYLVEDHFKRPVILTDYPKEIKAFYMKQNEDGKTVRAMDVLFPKIGEIIGGSERESDYNKLMTRIEEMHIPMKDMWWYLDTRKFGTCPHSGFGLGFERLLLFVTGMSNIRDVIPFPRTPRNADF

SEQ ID NO: 8338 - protein, 124 aa, B.fragilis
IYSMEKLTMQEEEVMIYIWELESCYVKDIVAKFEQPTPPYTTVASIVKNLERKKYVKAQRVGNTYLYTPSIKESEYKRSFMSGVVRNYFENSYKEMVSFFAKDQKISTNDLKEIIDMIEKGQEK

SEQ ID NO: 8339 - protein, 746 aa, B.fragilis
KTNILPKMKIKRLYLLGAWLLLGVSASAQITSIQPQPQQVLSQARNLSLPDTYLIVGDTEANTHAVSALKTLLAGKHSDKNGFRIYIGEKGDKAIRKFARQIPNHKEGYYLAINDKEIVLAGQDERGTFYALQTLAQLLNDNQLPVVEIKDYPSVRFRGVVEGFYGTPWSHEARLRQLKFYGENKMNTYIYGPKDDPYHSSPNWRLPYPEKEALQLQELVKVANENEVDFVWAIHPGQDIKWNQEDRDLLLAKFEKMYDLGVRSFAVFFDDISGEGTNPNKQAELLNYIDEKFVKVKPDVTPLVMCPTEYNKSWSNPKGNYLTTLGEKLNPSIQIMWTGDRVISDITKDGIAWINARIKRPAYIWWNFPVSDYVRDHLLLGPVYGNDTQIADQMSGFVTNPMEHAEASKIAIYSVAGYAWNPEKYNSEQTWKDAIRTILPSAADELEFFAAHNSDLGPNGHKYRRDESVELQPLSQRFLDSYLKNGSYTEADFNALEATFGKMVESGDILMTNTGNRPLIVEMMPWLRQFKLLGETGQEVLAMAKAYKKGDNSLFIRKYRHVKALQQQMFQVDQTYNQNPYQPGVKTATKVIKPLIDQTFTTVTERYNKEHGTQLDAATDYMPHKLVSDVEQLRNQPLQIKTNRVLVSPANEVIKWGAGCTLTIELDQAYPGENLDIDFGKPDVAAWGQLEISADGKEWQKVDFKQEKNRITLNLKQTPVKAVRFSNVGNAEQEVYLRRFMITLDK

SEQ ID NO: 8340 - protein, 119 aa, B.fragilis
TGKMKNSDWKDRLNVVYSTNPDYNYEMDDDEEQVTLEPSQQNLRVQLDRKNRGGKVVTLITGFVGTENDLKDLGKLLKTKCGVGGSAKDGEIIVQGDFKQKIVELLKKEGYTKTKAVGG

SEQ ID NO: 8341 - protein, 205 aa, B.fragilis
SMKIIAVGMNYARHNEELGHTLENKEPVIFMKPDSAILKDGKPFFIPDFSNEVHYETELVVRINRLGKNIASRFAHRYYDAVTVGIDFTARDLQRRFREAGNPWELCKGFDSSAAIGTFVPVEQLADVQNLHFHLDIDGKTVQQGHTADMLFRVDDIIAYVSRFVTLKIGDLLFTGTPVGVGPVSIGQHLEGYLETEKLLDFYIR

SEQ ID NO: 8342 - protein, 93 aa, B.fragilis
KYEMKKLALIALVFVALGASAQQDTLKYRISLKDKVGNHLFTGSSREILVGKSHRPPPASAVACRLYRSAGLPSVCGCHPRQGSEDCGYGKMG

SEQ ID NO: 8343 - protein, 643 aa, B.fragilis
FISLLCFINKPINTTMRTKSIFLLLLLAVMPLCVFSQSKSTFEIKNGHFYRNGKITPVLSGEMHYARIPHQYWRHRLQMMKGMGLNTVATYVFWNLHEPEPGKWDFTGDKNLAEFIKTAGEEGMMVILRPGPYVCAEWEFGGYPWWLQNVKGMEIRRDNPEFLKYTKAYIDRLYKEVGSLQCTKGGPIVMVQCENEFGSYVAQRKDIPLEEHRAYNAKIKQQLADAGFNVPLFTSDGSWLFEGGATPGALPTANGESDIENLKKVVDQYHDGKGPYMVAEFYPGWLSHWAEPFPQIGASGIARQTEKYLQNDVSFNFYMVHGGTNFGFTSGANYDKKRDIQPDMTSYDYDAPISEAGWVTPKYDSIRNVIKKYVKYTIPEAPAPNPVIEIPSIQLNKVADVLAFAEKQKPVSSDTPLTFEQLNQGYGYVLYTRHFNQPISGTLEIPGLRDYAVVYVDGEQVGVLNRNTKTYSMEIEVPFNATLQILVENMGRINYGSEIVHNTKGIISPVQIAGKEIVGGWDMYQLPMDEMPDLTKLKADTHKNVPSEVAKLKGCPVLYEGTFTLDKVGDTFMDMESWGKGIVFVNGVNIGRYWKVGPQQTLYVPGVWLKKGENKIVIFEQLNETPQTEVKTVKTPVLMKLKG

SEQ ID NO: 8344 - protein, 64 aa, B.fragilis
KCPFLISNVDFDCENTHNGMTANNKSKKIDFVRMVVLIGLLMKQSKEINHFPAKFPFVFFKKIT

SEQ ID NO: 8345 - protein, 105 aa, B.fragilis
LQRSHAFLYTKDSFEGTGRDRRKEKSMKAARNSGICMKLDDFTGVLSLEHLDVNTMVYLYSEQGELIGKIHSTKSSATFTLPQKGMYVLVIHCLSYPVEVRRVIY

SEQ ID NO: 8346 - protein, 331 aa, B.fragilis
DMVSAITKTLRTNNKTVYVSLLSILTFFLMLDYIPGLQAFSTWVTPPLALFLGLAFALTCGQAHPKFNKKTSKYLLQYSVVGLGFGMNLHSALASGKEGMEFTIVSVIGTLILGWFIGRKFLKVDRNTSYLISSGTAICGGSAIAAVGPVVKANDSEMSVALATIFILNALALFIFPVIGHALNMSQHEFGTWAAIAIHDTSSVVGAGAAYGEEALKVATTIKLTRALWIIPMAFATSFIFKSKGQKISIPWFIFFFVLAMIVNTYLLGSVPELGAAINGLARKTLTITMFFIGASLSLDVVKSVGIKPLIQGVLLWVVISLSTLAYIYWF

SEQ ID NO: 8347 - protein, 143 aa, B.fragilis
KKYPILKPIINRPNNMEDFKKKIGTDMNDKEIVFSKSIKAGKRIYYLDVKKNRKDEMFLAITESKKVVMGEGDDSQVSFEKHKIFLYKEDFGKFMAGLEQAINFINQNQEYTEDSESEEKVEPESEPETTVLDSEIKIDIDFE

SEQ ID NO: 8348 - protein, 140 aa, B.fragilis
YTMLKTILSISGKPGLYKLISQGKNMLIVETIDAAKKRFPAYGNEKIISLADIAMYTNDSEVPLRDVLRSIKEKENAAIASIDVKKATSEQLREYLAEVLPDFDRDRVYTNDIKKLILWYNILVSNGITDFGEETAVEAE

SEQ ID NO: 8349 - protein, 274 aa, B.fragilis
SFQPRGEDFLGYRPGVYVIGDKIVYIENSDGNTNVRFHQADTHKRFFALLESQNIRVNRFRADCGSCSKEIVSEIEKHCKHFYIRANRCSSLYNDIFALRGWKTEEINGIQFELNSILVEKWEGKCYRLVIQRQRRNSGDLDLWEGEYTYRCILTNDYKSSTRDIVEFYNLRGGKERIFDDMNNGFGWSRLPKSFMAENTVFLLLTALIHNFYKTIMSRLDTKAFGLKKTSRIKAFVFRFISVPAKWIMTARQYVLNIYTENRAYAKPFKTEFG

SEQ ID NO: 8350 - protein, 868 aa, B.fragilis
ERRTNDMNFNNFTIKSQEAVQEAINLAQSRGQQAIETAHILYGVMKVGENVTNFIFQKLGLNGQQISLVLDKQIDSFPKVSGGEPYLSREANEVFQKATQYSKEMGDEFVSLEHLLLALLTVKSTVSTILKDAGMTEKELRGAISELRKGEKVTSQSSEDNYQSLEKYAINLNEAARSGKLDPVIGRDEEIRRVLQILSRRTKNNPILIGEPGTGKTAIVEGLAHRILRGDVPENLKNKQVYSLDMGALVAGAKYKGEFEERLKSVVNEVKKSEGNIILFIDEIHTLVGAGKGEGAMDAANILKPALARGELRSIGATTLDEYQKYFEKDKALERRFQIVQVDEPDNLSTISILRGLKERYENHHHVRIKDDAIIAAVELSSRYITDRFLPDKAIDLMDEAAAKLRMEVDSVPEGLDEISRKIKQLEIEREAIKRENDEPKLQTIGKELAELKEQEKSYKAKWQSEKSLMDIIQQNKVEIENLKFEADKAEREGNYGKVAEIRYGKLQELHKEIEDTQKKLHEMQGDTAMIKEEVDAEDIADVVSRWTGIPVSKMMQSEKDKLLHLEEELHQRVIGQDEAIAAVSDAVRRSRAGLQDPKRPIGSFIFLGTTGVGKTELAKALAEFLFDDETMMTRIDMSEYQEKHSVSRLVGAPPGYVGYDEGGQLTEAIRRKPYSVVLFDEIEKAHPDVFNILLQVLDDGRLTDNKGRVVNFKNTIIIMTSNMGSSYIQSQMEKLNGANNEEVVEETKKEVMNMLKKTIRPEFLNRIDETIMFLPLTEKDIKQIVLLQIKSVQKMLAGNGVELELTDAALDFLSQVGYDPEFGARPVKRAIQRYLLNDLSKKLLAQEVDRSKAIIVDAQGDGLVFRN

SEQ ID NO: 8351 - protein, 92 aa, B.fragilis
AVLAGLYEICIEYFRELICRIQGFLIIFVAIRRNLKSQCYEEYYTKRTKAFLRYYSVLEIWTISLFRNNVTNAHALLYMQIYSIERGLLYII

SEQ ID NO: 8352 - protein, 431 aa, B.fragilis; identical to SEQ ID NO: 6067

SEQ ID NO: 8353 - protein, 189 aa, B.fragilis
INKACLGTKYSMEIWNCNQHNNMPNPKVSQSAYLLLEESSKMNVGDKAPELLGINEKGEEVRLNNYKGRKIVLYFYPKDNTSGCTAQACSLRDNYAELRKAGYEVIGVSVDNEKSHQKFIEKNNLPFTLIADTDKKLVEQFGVWGEKKLYGRAYMGTLRTTFLINEEGVIERIIGPKEVKTKEHASQIL

SEQ ID NO: 8354 - protein, 407 aa, B.fragilis
ILNLKFLIKEMGRVLIIGAGGVGTVVAHKVAQNADVFTDIMIASRTKSKCDDIVKAIGNPNIKTAQVDADNVDELVALFNDFKPEMVINVALPYQDLTIMEACLKAGVNYLDTANYEPKDEAHFEYSWQWAYHERFKEAGLTAILGCGFDPGVSGIYTAYAAKHYFDEIQYLDIVDCNAGNHHKAFATNFNPEINIREITQNGRYYENGQWVTTGPLEIHKDLTYPNIGPRDSYLLYHEELESLVKNFPTIKRARFWMTFGQEYLTHLRVIQNIGMARIDEIDYNGQKIVPLQFLKAVLPNPQDLGENYEGETSIGCRIRGLKDGKERTYYVYNNCSHEEAYKETGMQGVSYTTGVPAMIGAMMFFKGEWKRPGVNNVEEFNPDPFMEQLNKQGLPWHEVFDGNLEL

SEQ ID NO: 8355 - protein, 105 aa, B.fragilis
HVHYLFLGFFHYFLVVGAVQFFHLALYVAAAHIGGHNDDCIFKVYHTAFVICQPSVIEYLQQDIKYIRMCFLDFIKQYYRIGFATDRLCQLSAFVISYISRRRSN

SEQ ID NO: 8356 - protein, 243 aa, B.fragilis
EMNLEEVLNYRRSVRVFDKTKPLDPEKVKHCLELATLAPNSSNMQLWEFYQVIQPELLAKISKACLDQTATSTASEVVVFVTRQDLYRSRAKFVLDFERGNVRRNSPKERQEKRIKDRELYYGKLMPFLYARFFRILGLLRSVLAKAIGLFRPIVREVSESDMRVVVHKSCALAAQTFMIAMANEGYDTCPLEGFDSKQMKKLLKLPHGAEVNMVIACGIRDGNKGIWGERGRVPFDEVYHRV

SEQ ID NO: 8357 - protein, 210 aa, B.fragilis
NNSLLMAIKIGITGGIGSGKSVVSHLLEVMGVPVYISDEESKKVVATDPVIRKELCDLVGEEVFSGGKLNKTLLATYLFASSTHASQVNGIIHPRVKEHFRQWSSHKECLDIIGMESAILIESGFADEVDCIVMVYAPLELRVERAVRRDNASCEQIMQRIRSQMSDEEKCERASFVIINDGEKPLIPQILELIAFLYQKIHYLCSAKNN

SEQ ID NO: 8358 - protein, 83 aa, B.fragilis; identical to SEQ ID NO: 6082

SEQ ID NO: 8359 - protein, 116 aa, B.fragilis
KTNKTDYFMNLLTVFFQAPAAGPDGSLMWIMLIAMFVIMYFFMIRPQNKKQKEIANFRKSLQVNQNVITAGGIHGVIKEINDDYIVLEIASNVKIKIDKNSIFADASAANSQSATK

SEQ ID NO: 8360 - protein, 178 aa, B.fragilis
TFGNSRRNRQKLLFGRYRHHDESVQQKIIIHFSIHNQMPEARIDKWMWAVRIFKTRTIAAEACKKGRISINGSFVKAARMIKPGDVIQVKKPPITYSFKVLQAIEKRVGAKLVSEMMENVTTPDQYELLEMSKISGFIDRARGTGRPTKKDRRSIEEFTTPEFMDDFDFDFDFEEDNE

SEQ ID NO: 8361 - protein, 423 aa, B.fragilis
SLMNQKRNQTKVVNVFTVFMVMLILYFIVGLFTVINQQFQIPLQTAMLPHDGNITNALVTMLNFSWFLAYPLSEGFGTRWLEKYGYRKTSYLALLILIAGLAIYEAAVLFHIYTPMQVSIIGNHISVGFFIFLIGSFVIGVAATILQVVLNLYLTVCRIGKTTALQRQMIGGTSNSIGMAIAPLVISYLIFHGTPLHDIVTKQFIIPLIILILIMLIITLLVGKTQMPSIDNVRQAPGEKFDKSVWSFRNLKLGVWGIFFYVGIEVAVGANVNMYASELGGSFASNATHMAALYWGLLLLGRFLGSFIKQVPSEKQLVIASIGAIVLLVLAMLTANPWILTLIGFFHSIMWPAIFTLATDQLGKYTTKASGVLTMGVIGGGIIPLLQGIFADVMGGNWLWTWLLVIAGEAYILYYGLNGYKQH

SEQ ID NO: 8362 - protein, 229 aa, B.fragilis
TIMKTMKFILACVLLLSPLLCQAQKNLFNKYNDMKGVSSVYISKAMMELNPNLFMKDLYIGKVAEHLNSVQVLSTHDNKVREEMAKDIRSLVQSSKYELLMKQKSTVSGSEVYVNRKGSKVKELIMVMNGASSLKFVYMEGDMTTDDIKKLMLYQSTSQNFIISGDLFYANNKPVTYFKKGNSDNQKDMAELSGTYNLNSIDTNYKEELSTLNDKLKRIDQGLKNMNIK

SEQ ID NO: 8363 - protein, 189 aa, B.fragilis
KDMKYLIVGLGNIGPEYHETRHNIGFMVLDALARANNLSFTDGRYGFTTTLSVKGRQMILLKPSTFMNLSGNAVRYWMQKENIPLENVLIIVDDLALPFGTLRLKSKGSDAGHNGLKHIATILGTQNYARLRFGIGNDFPRGGQIDFVLGHFTDEDWKTMDERLETAGEIAKSFCLAGIDITMNQFNKK

SEQ ID NO: 8364 - protein, 361 aa, B.fragilis
RPKNTLHKFYKSIIMAKKEDELNFETDNNKMASSEKLKALQAAMDKIEKSFGKGSIMKMGEEVVEQVEVIPTGSIALNAALGVGGYPRGRIIEIYGPESSGKTTLAIHAIAEAQKAGGIAAFIDAEHAFDRFYAAKLGVDVDNLFISQPDNGEQALEIAEQLIRSSAIDIIVVDSVAALTPKAEIEGDMGDNKVGLQARLMSQALRKLTSAVSKTRTTCIFINQLREKIGVMFGNPETTTGGNALKFYASVRLDIRGSQQIKDGEEVIGKQTKVKVVKNKVAPPFRKAEFDIMFGEGISHSGEIIDLGADLGIIKKSGSWYSYNDTKLGQGRDAAKQCIADNPELAEELEGLIFEKLREHK

SEQ ID NO: 8365 - protein, 199 aa, B.fragilis
LLRNYDMDEKIKFPSNVVLIDAAFLNLVVTDLKKYFEKTLMRELQEIDLSELVTYIVLDAGMAVGDNQIQILMVYDKDSAQLSNCRPSDLSAELNGVAFKSQFGEFSFASVPCEEMVSREELYLDLLSIVLDSADVERLILVSFNEEYGDKVMERLKGVKNKETIQFRMNEPEESIEGYQWEMLAYPVMQALGIRGEEL

SEQ ID NO: 8366 - protein, 234 aa, B.fragilis
YIMDALKMLIVVTGTDMYADGNLQTGLWLSELTHIYHCAEEAGYEITVASPKGGNVPVDPESLKPMMLDKLSKDYWDDLEFRRELQHAKSLAEVSGQLFDCVYLAGGHGAMYDFPDDTVLQAIIEKHYESDKAVAAICHGVSGLLNVKLSGGEYLIKDKKITGFSWFEESLAGRKKEVPFDLEAALEKRGADYEKALIPMTSKVVVDCNLITGQNPFSSKEMAEVVMRQLSREK

SEQ ID NO: 8367 - protein, 287 aa, B.fragilis
FGKCINFMLFFYIFAPIFNLNSMTMKKVLLSICMVSAVFAMSSCGSTKEAASLSSLNGEWNIIEVNGSAIVPAENQELPFIGFDTATGKVYGNSGCNRMMGSIDLNSKPGTIDMSRLGSTRMACPDMTTEQNVLNALGQVKSYKKLGKHNMALCNASNRPVVVLQKKASDVKLSALNGEWKIEEVNGEAIPSGMEKQPFINFDVKKKSIHGNAGCNLINGGFETDKENPRSISFPNVISTMMACPDMEVEGKVMKAINEVKSFDVLSGGGIGFYSADGTLVMVLVKK

SEQ ID NO: 8368 - protein, 196 aa, B.fragilis
TSVCYCHGQEKRYVKNLINGIIMKVEEIERLLAEFYEGTTTESQEEVLRNYFRTTEVPGHLLKDKEIFLNLCPDADQDIEVPAHLEDKLNLLIDEMAEKEQHFFRPNNSKNSWRWIGGVAATILLLIGIGYGIDNLSKNVCPPTPQDTFSDPEEAYRMLQATLLEISANLNYGLNEVKESQIDMRKIHQEVRNEIK

SEQ ID NO: 8369 - protein, 261 aa, B.fragilis
KKYRMKIKRLLVLAVLPMLCLAVNAQNSSKDNTPKKGDFTVAATVGYNSYTSVTAPSGLLTDYEVRALSTNWADKKLMVGFEGGWFFKDQWKLNLGGGVSFTNNPGYPAVPGTIDDSNKNNSADENMGEIPNYRAVADAQSFAYNVSAGVDRYFNIKRVPNLMWYTGIRVGFAYGENEMKYDEETSMGKSIAESWNLRGALTIGVDYFVLPALYIGAQIDPFAYTYNKTTYNPQAGLGDLSADSHNYSVLAAPTFKIGFKF

SEQ ID NO: 8370 - protein, 71 aa, B.fragilis
HANSILKSFKYFRLRFCYDIRQQSFIVIKISSKYKMRELYYRKIYTFLSYLFPLDYKKALLRILKIQNDRL

SEQ ID NO: 8371 - protein, 340 aa, B.fragilis
IKPMFERRNIKYIYLKLSRKIKDFLLSDKSREFLIFLFFFFIAGGFWLLQTLNNDYEAEFSIPVRLKGVPNHVVLTSEPPSELRIKVKDKGTVLLNYMLGKSFFPVNIDFSESKVPDNHVKIYTSELEKKIAGQLNVSTRLLSVKPDTLEYIYSTGKSKLVPVKLEGKVVAGRQYYISDTIYSPDSVLVYAPVAILDTITAAYTQKVNFENVMDTLKQRIALAGVKGAKFVPGAIDLTLPVDIYTEKTVEVLLRGINFPADKVLRAFPSKVQVTFQVGLSRFREVNASDFVVNVSYEELLKLGTDKYTVKLKSLPRGVSHVRIHPEQVDFLIEQLSSDGN

SEQ ID NO: 8372 - protein, 113 aa, B.fragilis
KYIFFAKDLHLTYSFFAFFVTKFLLLRLKDINIDKNEHMDTESFKREFLPYHRKLYCVAYRLLENAADAEDLVQEAYLKLWDKREGLSVISNPEAFSVTLVKPKIRNYHPIHD

SEQ ID NO: 8373 - protein, 198 aa, B.fragilis
QNIIMKRRLRTLLLLLLIATRTLLAQNSHFASSSSPGSLSPDEETDFITTHFPLKQLCKWTPGMKFMFIPDSSDEFVPILCKYEDGKEVDNDLLKSKTLEYTGSEETVHETYIGKIYTSRFIFQCEDHKYYYEMKDVKLNDLCDQNPYASIPALVYLQDVNKAKELLIGKTLYTRTTIAKTDDANSYSGYREVNIAKG

SEQ ID NO: 8374 - protein, 280 aa, B.fragilis
KMTIDNQTGLVLEGGGMRGVFTCGVLDYLMDHDIRFPYTIGVSAGACNGLSYMSRQRGRAKYSNIDLLEKYHYIGLKHLLKKRNILDFDLLFTEFPEHILPYDYQAYFDSPERYVMVTTNCLTGEADYFEEKKDKNRVIDIVRASSSLPFVCPIAYVDGIPMLDGGIVDSIPLQRAIHDGYRNNVVVLTRNHGYRKENKDIRIPPFVYRKYPKMREALSRRCAVYNEQLEMVERMEEEGDILVIRPQKPVVVDRIERDIQKLTDLYEEGYECAKRQLETL

SEQ ID NO: 8375 - protein, 221 aa, B.fragilis
PVKITTIDVGNKSFPVKITFIDRKGVSYYINVAMSRTNSGMEPADFQAEKRINYFPNAFSFTNPDVKTRESIQSKYIGQSVYPQKTIRVKQTELLRYTPLHIKDVQPEKAGTSATLLLTDIHGNTYQVKVDLKYDPILKNEDFIEDLFGFSDIRKKYPNISESNWLMLAKGEVKPGMTTEECKLAIGEPIEIRVRTDSRFETWLYRGKILEFENGILLRAK

SEQ ID NO: 8376 - protein, 114 aa, B.fragilis
CCGIKVKNMCFDLLRSGKYVLSRQSVELSAAQDVFQPDNLEAREGVRQIKDIIAHLPEQQQRIINMRDIKGCSYEEIEQVTGLNSINVRVLLSRARKKIREEFNKWNNYESRRN

SEQ ID NO: 8377 - protein, 542 aa, B.fragilis
KIEIMKKKLMMVAVLLGALSLGACVDNNESASVEAVRNAKAKQLESVANMNNANADAKKAITAAEVAIKEAEAAYQKAQAELAQAHADQQKILLEKAQAALEAELEAAKINAEAELNNAKAALESAKAALIAALDQVDQANKTRITTLLGKANGLLATINADRQSLIDAKDQLARLKAGLVSVELSNQQTIAGEEKNKAVAQALIAEYEKYSTKDKADAEKAAQEANAKLTALGQTRDEKNTADRNAQQAYWEAYRNLNGSLYVRTLQQAGPSYYDTEDIRGEVVNYTNDDSTTGTVYPSSYTKYIPNLDRINEAITNQTRYLSVSKAALADANKALTDAKASDTYKSLAKAVTDAQKKFDDAKTEADKNTALSELGIAEGNLSAYIQPLEDAVDSATARVEKGENSLKEYNDALAAVSGDNATAYANLLTAMDNAVKARVETLIAYYKADHNYSVQNTLAYTLQTIADGLADYDQLILVQKQAIAAADENIANAASVVSKEQAIANQEKTIADLENSLAVNEPIYNDYLAQIKALVGDSAE

SEQ ID NO: 8378 - protein, 302 aa, B.fragilis
AFIFMSDFRLKVFLSVAKNLSFTKASQELFVSQPAITKHIQELETCYQVRLFDRQGNKISLTEAGKLLQEHSEKILEDYKRLEYEMHLLHNEYIGDLKLGASTTISQYVLPPLLANFIAKFPQVNLSLLNGNSREIEAALQEHRIDLGLVEGICRLPNLRYTTFLQDELVAVVHTGSKLSLPDEITPEDLSRIPLVLRERGSGTLDVFERALSEHNMKLSSLNVLLYLGSTESIKLFLEHTDCIGIVSIRSISRELLSGTFRVIEIKGMPMLREFCFAQPQGQESGLSQVLMQFAMHHNKKL

SEQ ID NO: 8379 - protein, 338 aa, B.fragilis
NTALKNVIYLCKLIKNVYFCNSLITVLIKIMINRVLIRLKIIQIVYAYYQNGSKNLDSAEKELFFSLSKAYDLYNYLLMLMIALTEYAQKRIDTAKAKLAPTKEELYPNMKFVENKFVAQLEVNKQLSEFIANQKRTWANDQDFIKELYEKIIASDIYKEYMASSDKSYEADRELWRKLYKTFVFNNDSLDQVLEDQSLYWNDDKEIVDTFVLKTIKRFEEKQGANQPLLPEFKDDEDQEFARRLFRRAILNADYYRHLISENTKNWDLDRVAFMDVIIMQCALAEILSFPNIPVSVSLNEYVEIAKLYSTVKSGSFINGTLDGIVNQLKKEGKLTKN

SEQ ID NO: 8380 - protein, 202 aa, B.fragilis
HKKFQEMRSIEVKGTARTIAERSSEQARALKEIRNNGGVPCVLYGGEEVVHFTVTNEGLRNLVYTPHIYVVDLVIDGKKVNAILKDIQFHPVKDTILHVDFYQIDEAKPIVMEVPVQLEGLAEGVKAGGKLALQMRKLKVKALYNIIPEKLTINVSHLGLGKTVKVGELSYEGLELLNAKEAVVCAVKLTRAARGAAAAAGK

SEQ ID NO: 8381 - protein, 108 aa, B.fragilis
QEEFCYKESEKRISKMKIFGEKDVLLMTELKIDTMSQNETTKLDIIVEVLGEREPEIRRLVILDDRLRMFAESNDENGPGIPIELVAEWATLLNKYYPLALEKRNMMN

SEQ ID NO: 8382 - protein, 195 aa, B.fragilis
ISKSMKPNRTKEDILLLSQLQQGDKKAFNTLFRRYYPILCAYAHRFVDLEDAEEIVQDVMLWLWENREILLIESSLSQYLLKMIYHRSLNRIAQKEVKYRADTLFYEKSQAMIYDVDFYQIEELTKRIHTAIVELPESYREAFIMHRFRDMSYKEIAQTLNTSTKTVDYRIQQALKLLRKELKEFLSFALIFLAA

SEQ ID NO: 8383 - protein, 132 aa, B.fragilis
LSGPVQPRGEDNGTVVRWDCSVLLENAGFKDAYRTKYPNPVTHPGFTFPSDNEGVPVQKLSWAPDADERDRIDFIYFMPDRKLKLKDVSVVGPSKSIVRSERVEESGKDSFITPLGVWPTDHKAVMATFSLR

SEQ ID NO: 8384 - protein, 612 aa, B.fragilis
  UNSURE (596),(603),(604),(608),(610): Identity of amino acid sequences at the above locations are unknown.
KSKPCELVWRQAEINYFLTLSQYKIMQNYFSIQLLRVVKSSLWLTSKKIPKTMRLFILFLICSMSFVHATDSFAQKVEISIDAQNQTVEKVLKEIEKQSGFGFFFNNKHVNLKRVVSVSVDKSNIFKVLDKIFEGTDVKYSVLDKKIILSTEMTSKQQQAVKISGKVVDVNGEPVIGASIVEKGTTNGTVTNLQGDFSLSVSSDKAVIEISYIGYQPQELKVIAGKPLNVTMKEDAQALEEVVVVGYGSQKKVNVIGSIAAVDSKKLESRTAPSVSNMLTGQLSGVTITQSSGNPGQDQGTIRVRGVGSFGATPDPLVLVDGLPGSLNDLNPADIESISILKDASSAAIYGSRAANGVVLVKTKGGQKGKVTVSYNGYVGFNQATELPEMCDSWEYAELYNKAMGKEVYSAEEIQKYKDGSDPYNYPNEHYLDKLLGNKGLQTGHELTVNGGNDKTQYMVSFGYVKQNGLMEHNHYDRYNGRVNLTTELAKKLTLTTRLGGVVSKRSEPSTPGGMDSAGFKAFSSNALRFPGLWATKLEDGSYGLGPKVLGTPLAWLDSGSFYHENFHKFRSNVELAFTPVKGLTLKASSPRGWSXRSALSFXXSYPXGXSI

SEQ ID NO: 8385 - protein, 385 aa, B.fragilis
FGEYRGYCRQVFISLLLNFYLRYLNVILMNRKNYLLAFILCVQTLFVSAQVYPVRAKLTDEKSFSMILLPDPYSYTMVDAHYALFELQTAWVANSIESLNIKGVLCTGDLVEQNEIRIPDGVNGNQTSEEQWRAASRAFERLDGKLPYVICTGNHDYGYQKAENRLCHFPDYFPAERNSCWRKSLVAVGNNYQGIPTLENAAYEFITDTWGKILVVSLEFAPRDEALAWAKKVVDAPRYKDHKVILLTHSYLAWTGKVIESENYKVTPANYGKAIWDKLVYPAKNICMVICGHECEIADYKDNVSFRIDKNASGKNVPQMMFNAQTADKQWFGNGGDGWLRIMEFMPDGKTIKIKTFSPLFALSPLTCDKSWRTDSYDQFDITIE

SEQ ID NO: 8386 - protein, 338 aa, B.fragilis
ITNMNYEDIDHLLPRYCEGLATEEECRQVESWMEESEDNRKIVDQINTLYIAVDTVNVMRKVDTEKALKKVSSRMIVRKTTWWEWMQRVAAILFIPLSVAFLVQYMHNGKSAVCQMMEIKTNPGMTTSVVLPDSTVVYLNSESSLRYPSVFEGDIRNVELKGEAYFAVAKDLKKKFVVSAPHSSQIEVLGTHFNVEAYEDEPDVSTTLVEGQVCFHFSDKDYLAKKVVMKPGQRLVYSSTNGDVQLYATSCLSETAWKDGKIIFNNTPLDVALRMLEKRFNVTFKLKNARLKTNAFTGTFTEQRLERILEYFKISSKIQWRYLESPDIRDERSIIEVY

SEQ ID NO: 8387 - protein, 96 aa, B.fragilis
RKSRSMGKSGSSSNRSVTISSQKEDIYQGRDFADLEPGEFIGSATRANVRYFKVMLGEFKEKDEKPLPDVRVLEPGEISGNFARILEEVRSLFPCE

SEQ ID NO: 8388 - protein, 101 aa, B.fragilis
APVIGMLMSISTRQFTMQNKVPFVYFLDEMTTVNIKSFESLLSVMRENKVAFVLLTQSGSKLENLYGKLDRSSVEANFGIQFFGRTKDVEALKYYPQMFGK

SEQ ID NO: 8389 - protein, 216 aa, B.fragilis
ALSVPSSPVVKTAQMKKFTRECMDEYARNFYREKIKSGDDLVWYGRVETERHYKNDDPEVKAGRAKAGDKKPGLQLHVHVIVSRMDRTQTVSLSPLSKSRGNRQVLEGREVVVGFDRSQWSSRCASRFNQSYDYFPNYYSRDESLRKYSENWQAKNELKNEAVSKLKQEVLKGELKEERRLYANTFRIYRFVVNPKKAIIQELKRLGTDLLSGRDL

SEQ ID NO: 8390 - protein, 439 aa, B.fragilis
YIMSKIQLRQVYRDQLYNYRPTWILRWGITIFFVFLLLVISVSGFIRYPDIVPATVEITTINPPANLISKVNGKIEIIFTEEGESITKGQVLAILESPAQWKDMKILDHYITVLENTIGKDSLSVIPEPDFLRNDLELGEVQGRYADLKLNYTELYNFLHSGLFEEEVLSLQEKKQAQKQLLVQENRKRELLKTQIRLADKEYQRDSILFVKEVISESEIEQRHQNRLQFQSSLVDMEVNILNIKSSLKQLRSDLKKIELKHNTDRQELTNKLLQSTHLLKAQTETWKQNYLITTPIDGKVSFTTYWSKNQNVKSGELIFSVVPIDSMTTKARLQFPIQNSGKIKEGQQVNIKLQNYPYQEFGMLVGHLSKISEVPNELLYSADVVLDKGLITSYGKRLPKVQQLKGDAEILTDDLSLLMRFFNPLRAIFDHRLRKHNQ

SEQ ID NO: 8391 - protein, 441 aa, B.fragilis
LCMSMNKQMHISNGNKRILQIAVPSIISNITVPLLGLVDVTIVGHLGSAAYIGAIAVGGMLFNIIYWIFGFLRMGTSGMTSQAFGQRNLEEVTKLLLRSVGVGLFIALCLMTLQYPIQKAAFAFIQTSDEVERLATLYFRICIWGAPAMLGLYGFAGWFIGMQNSRFPMYIAITQNIVNILASLCFVFLFGMKVEGVALGTLIAQYAGFLMALLLWLRYYKQLRKRVHWRGIWQKQAMYRFFQVNRDIFLRTLCLVAVTMFFTSAGAAQGEVVLAVNTLLMQLFTLFSYIMDGFAYAGEALAGRYIGAGNRMELHRTVRQLFGWGVGLSAGFTLLYGIGGQSFLGLLTNESSVIQEADTYFYWVLAIPLAGFSAFLWDGIFIGATATRQMLFSMFIASASFFLTYYIFQEVMGNHALWMAFIIYLSLRGLVQAFLAKKIVH

SEQ ID NO: 8392 - protein, 115 aa, B.fragilis
KYLFMGLEDDFLLNDADDEKTIEFIRNYLPQELKEKFSEDELYYFLDLIDEYYSESGILDVQPDADGYVDIDLEQVVEFIVKEAKKDEVGEYDPEDILFVVQGEMEYGNFLGQVE

SEQ ID NO: 8393 - protein, 418 aa, B.fragilis
LLLLDTIDSVLIIISLDYYIIHNIELTLNINKMKKINAALVISLFVMTGCGGNKQLTDDCITVDVSADYPKKELILQDFMDVEYVPLETTDDFITQGIVKATGKKILLVANRIMDGNIFVFDRATGKGLRKINRLGQSGEEYSHITSIVLDEDNNEMFVVDYPARKILVYDLYGEFNRSLPFPDTCYYEFLSDYDRDHLIGYKSYLPLIETDESCHVLISKKDGSVTRKIQIPFKELETPVVTKDEAIVTPVFFLITPHDSNCLLTKTSSDTIYNYLPDGTLSPFIVRTPSIHSMDPKVFLFPTIITDRYYFMQTLDKKFNFEKGRGFPTNDLVYDKQEKAIFQYTVYNDDFSNKHRVALGQQPEKSVDEEIVTCRALNASDLVEANEKGELKGKLKEIAAGLNEESNSVIMLIKRKK

SEQ ID NO: 8394 - protein, 103 aa, B.fragilis
AADPRCPTIVTSTSPNNGTVILEIIEGTAICRIRLFPLLMCICLFIDMQSYMKNREYENDVNNHVIILVRNVLDTGINIIFVCILKDILQTINKHRSEVALSI

SEQ ID NO: 8395 - protein, 261 aa, B.fragilis
RNLPKNYVPNMMPYPESFPVPLIHIAKADSTNGYLNALCEKEKVSELTTVVADFQTAGRGQRGNSWESEDGKNLMFSFVLYPTFLEARKQFLLSQIASLAVKETLDLYIGDVSIKWPNDIYWKDKKICGMLIENDLMGIHISQSIAGVGININQKEFHSSAPNPISIIQITHRESDRMEILAQVLQRIKEYYKILQEGDIEFITDRYQAALFRKEGIHFYKDSEGTFNAGIVGVEADGHLVLQDETGKIRRYLFKEVQYIL

SEQ ID NO: 8396 - protein, 105 aa, B.fragilis
KMALEITDNNFKEILAEGSPVVIDFWAPWCGPCKMVGPIIDELAKEYEGKVIMGKCDVDENSDLPAEFGIRNIPTVLFFKNGELVDKQVGAVGKPAFVEKVEKLL

SEQ ID NO: 8397 - protein, 443 aa, B.fragilis
SGSTQIIMFLTKRFYILVLVVILLLGGGYLFGSLFIIGQLGLLALLLALAFDGYLLYRTKGIQAFRQCAGRFSNGDDNEVSLRIESRYSYPVRLIVIDEVPVIFQQRNVHFELSLLPNEGKTLTYRLRPTRRGEYGFGFIRVFTTTRIGLISRRATCGRPETVKVYPSYLMLHRYELLAMSDNLTELGIKRIRRAGHQTEFEQIKEYVKGDDYRTINWKASARRHQLMVNVYQDERSQQIYSVIDKGRVMQQAFRGMTLLDYAINASLVLSYVAMRKDDKAGLVTFNEYFDTFVPASKQVGQMQTLLENLYKQETTFGETDFSALCGHLGKHVNKRSFLVLYTNFSNMTSLNRQLVYLQQLARQHRVLVVFFEDADLKEYIAGKSVTTEEYYRHVIAEKFAFEKRLIVSTLKQHGIYSLLTTPDKLSIDVINKYLEMKSRQLL

SEQ ID NO: 8398 - protein, 288 aa, B.fragilis
SINTHNMEWPKSKNNKMEELLERMSQFEANLAQLISTGIPNHTPSPATDEATSSPNEQEQLSPEQEEEMKLKIQELQQKEEELNLRAEKLDKLAKELEERQQNLENRNPNDERSIEPATHPDHSFPSQIGDQINALKKLLEDSSYKDKIIKDLHEELQSHNRDLHAEIVKPLLKNMIKMHERLTKTYKFYENTEAKSSPETYTRLLREVENCKLHIQDILEDEYDLEYFEPTIGSAYSPKEQTAIRTVITDTPEQAGTIKEFHYGGFRNTTTNKIFQPSTVTVYKKSE

SEQ ID NO: 8399 - protein, 240 aa, B.fragilis
YQLTTDRLMNISELSIRRPVLSTVLTIIILLFGLIGYNYLGVREYPSVDNPIISVSCSYPGANADVIENQITEPLEQNINGIPGIRSLSSVSQQGQSRITVEFELSVDLETAANDVRDKVSRAQRYLPRDCDPPTVSKADADATPILMVALQSDKRSLLELSEIADLTVKEQLQTISDVSSVSIWGEKRYSMRLWLDPIKMSGYGITPIDVKNAVDKENVELPSGSIEGNPPELSIRTWD

SEQ ID NO: 8400 - protein, 662 aa, B.fragilis
PTETDMKKSRCIKSYIWVAFLLNTLILFGCIQPNNSRYPDKIHEVLKLSHNNRKEIEKALDFFINQKDSLKIRSIFFLVGNMADKYSLTPANEQDPFHSIILNNHIKEKEAWDPGKSRLGMALDSVYKTCTDPPRPKIVRDIEVITGNFLINNVEEAIKIWHRTKKFTECSFDDFCEYILPYRIGNESLSAWREQACQKFSYLLDSISDPLELTKAIVQVSGIYYNAGMSKYPFFPTFSELDQLHWGSCDHLAAYLTFSLRAIGIPSTIDVVPAWANRGGGHAWNVVMNKDGKFVDVGFNGEGHNSISYKIPKIYRTGYSSNKGGIGYLDPLWKDVTGEYPMPISDIALSGSDSDMKGDVLLLCIFNNKDWIPVAVSATENKKTMTFGNVARGIPFGDNKIAGYQNEGKGIVYLPASVRNGVMVPFATPFILKENGDVHKLTPDHSALRSISLYRKYPKYGHISVYAARMADGCFEISNQTDFPTPKRIYTIKEPPKHAMAEVNLHAPATCRYIRYKAPDQSWVNISELQCYSPEGKLSGTPFASDKNKSPEELAKICDGNIDTFYAGEVRNAYVGIDFGKEVEIDRIIYSPRTDGNDVIPGEEYELFYWENRWVSLGRKKADSFRLQYDSVPDNSLLWLHNRTKGVEERIFTYMNNEQIWW

SEQ ID NO: 8401 - protein, 931 aa, B.fragilis
MDKTLLKLEIGKWNEACRFLKSKQTELSTAEWTAIETLADYWRKKFDPDATSECMDLISTLEQSDKLHSNNKEIIVWSKEFRTIARKYYTKDETTFLVFQNALKELYQSSAPRSSAPLQTPVNSESQNIILKQNAKKWVSTYSQLYENQNELDRDEWNAVRFLANFWKNGTFNETSRKECEQYISILIASDKLHSNNKNIITWSKDFRGIAKTYYTKDSKTFEGFKKFMTKYTRENPIQERTPQERIPQTPPRQTSPSIEITGLVIANTDEKGDPIPSNQAELDTRSCYLQPRIDYRVLRGGSSVDIWYKLYAPDRTLMTASNSKSGYTWYGNVPLTGSRSAYPLNGFGSMSGNVFSAGQWIIEFFENDLQIATYTFTIKQHRTSTPPPQSRVTPPPPPRTPSNRRTSTVSPKKGHGGLWSFLIIAAIIGFCGYQYWYKPMTIDRDAERTYVYVSSLLQRSDKNANVEYNRIQSLPYGSELITYQKEGDGWSYIRANEKKGYVSTNYTLSKTDFELLNNLWGSKEAMEGAPTAKCRLALVDFIKKNNYKTGTGQWQLFAQPIEVKPNAVLYPRLANGYTKFTEFAFVLSNSSTHEGVLAIYSFADDETPVFIYQEQTTENAKIKDVRYYPWKTDKYKVIYATPNAMVSRSPQLPTNQQPSKAKSENGLKITKALFGNTDKSYNILTQFGTQLPTTTQYLSPRIFYENPAGKSSVVIKYKIITPQGNLMTGTGSPSGYTNEQKVTLNRSGYINLAGWGNTTGDAYTSGTYRIEFWSEGELLYSTGVQIQGNSEKAVTVSSNPVECPIKIRTMLFANSNDKGTILEDYGKPLYGNKLQYLKPKIIYSSLNGARNITLYAKIYRPNGVLIANKNSPNGYTYKHGMYTPAVGADNNVSYLTSWGSPECDVYSPGTYQYEIWYEGSKIFSCQVIVH

SEQ ID NO: 8402 - protein, 441 aa, B.fragilis
GTAAVCHCLRCNSHSVCLGYYETLYSAIMEVLYEIYLSIRQNKIRTFLSGFGISWGILILVVLLGTGKGFQNSVMDIFSIFAQKSMYVYGGATSMKYKNIREGEQLHFDLHFLNRIKKQFPGIKAISPEITGPYSQVMNKAKSGLFKIIGINENYMGIKILKINEDGRYFNKGDDENTRNVTIIGENVSTTLFNNQKALGKSINIAGIDFKVIGVLKNDDIFSASEINSVYVPFSSYINCIDNKTPLRAFCLYLNKEVDSKRFENELRAFIANKYQFAYPDKQALQIINFETQTSAFEGLFDGLKMFIWIVGICFLISGIVGVSNIMFVVIKERSSEIGIRKAVGATPKSILVLMLTESVIITVISGIIGLISGAGILEIINWLLESARHATMIKHVEIDINVAVLALVILILSGVIAGAFPAMKASVIQPIDAIRNENIG

SEQ ID NO: 8403 - protein, 245 aa, B.fragilis
SEMAESTIITGQFVRISQVPASLGERILARIIDYFLLFIYILATSYILGKLNIHAFSGSTFFLLFLFIYLPVLCYSLLCEVFNQGQSAGKKLMNIRVVKADGTTPSLSAYLLRWLLYGIDVTITGGLGVLVILLTKNSQRLGDLAAGTMVIKEKNYRKIQVSLDEFDYLTKGYHPSFPSAADLSLEQINVISKALELHHKDRTRHIAQLAPKVRALLSVDQTNINDEKFLQTVVRDYQYYALEEI

SEQ ID NO: 8404 - protein, 602 aa, B.fragilis
NKPAMKNKVLKITAALLFLLPHAGLDNNRFPVMLFLFYICSFVFFATTWSGMKEDWSRNSRTCFIVSGIVLSLFLRYVSGNIYGTYRLYTMAVLWILFFSFYAAQSLPGKNRRFLAWVVIATVAVETVLGIAQSIGLLENSDPQFIIGGSMTNPGAYAGYLGVTTPLILSLLVSYKKNKRFENICYILGGLFILVCYLLILSRSRGAWIACGAGCLCVLCYRYARFLRGTNYWSKKAIRTPTIILSAVLIIASGFFVFKMKEDSALGRILVWKVTLSTPHPHASLLWGNGIGYFESQYGKWQADYFREKEGTEKERHIAGYVTTAYNEFLELGLEQGIIVTACIAALLVMATGTGWKNLSTIELGAKASIVSITILMFCSYPLKVLPTTLYLMFCLSVALYGKKRLLSTGHRMISNGVRSLAGPLICVFALAGMINAYGYYFCHRGQQRVMRHDLKGGIEMYKKAQGILRKDGIFHFYLGSAYFLSAEYQKAIEELSVSCTQCSNPSSFILLGNAYRENGDTAKAIDAYTTAVYIQPSKLYPKYLLAKLYEAAGDYGSAGEWASKILATDEKVPTTAAKEIKEEMRLLLKQVVIKTKKDDYK

SEQ ID NO: 8405 - protein, 236 aa, B.fragilis
SMEAKVKILFIDDDITFGRICTIILQEKGYEVFYQTTLNGAKACIAEAHPDIIVLDVEIGNQNGIEVAPEITVIAPNVPVLFISSHTESHWVVQALEAGAVAYLKKPFHAEELIAYVERFAVQRPSQLRIGSLSLDTETRILFADDSTVIKHLSESEYKLVRLLLIHKNHIVGRGQIEMELWGNTEGNEQSTNNLIFKIRKYLVADPDIALETIPRSGYRLSVKLEKQKRRVSDCF

SEQ ID NO: 8406 - protein, 251 aa, B.fragilis
NWVYLQTKLKKYMKKIYLFLSFLIVILAYPLISLLTVLIIGNLVQNTTPWIRPMTLFSLATFILIFRKNIRCHSSFNRSLSLKTILSVCILTISMCIAIGMITPIPQNISLAKQELLNFPRFIYSLFLIPILEELCFRIIIINKFKGKMNQWIIITGTALLFGIIHTSSIYTMISMACFGFILAYLYVKSENGFLLILVHSLYSISVYCSYSVFWSITSRVLNYVYSPIYYIIVAISIMYIIYFFLKKKYV

SEQ ID NO: 8407 - protein, 365 aa, B.fragilis
KRKYRIMKTFKIILICIFSATLAFVAFRSSLRGTKAIYETTQPQYREIKEEINISGNVFPMKEIEIKSQISGVLDKINVSIGDKVRIGDPVASIMLVPNASDMERLEYNLNTAQIEYKARLEDYKREHKLYSKNLVAQAEMDSYTQAYELSKEKLASAQNQLNILKEGRISPETASNIVRSSISGVIIDTPLETGASVIERNNFNPGTTIAVVAEMSRFRFKALVPEKYLKDIALQDTISLLFNAYDNLRTRAVVTKISSKGNAENGIMKYMLEAEFPVSENMPVIRSGYSATANMVIKQKKHTLSIDEKYVLYENDSTYLYLLDTVTQQKTKQIINIGISDGNYVEVIKGISLKDKIVTNSTDK

SEQ ID NO: 8408 - protein, 353 aa, B.fragilis
WPDLSKVLSRVIPNYPMFCGWASFYCHCHLLSITIFIYQTEKLMESQKPKIALYVKRPFGDKLNATMDFIKENWKPMLKFCTYLILPLCLIQAISMNGIMGGAMGIAAAKEAGTNSLAAIGMQFWVNYGLMFLCYLVGSILLTSIIYGLMQVYNQREERLAGVTFADLKPFLFKNIRRLLVMVLFCIGLTIVVGIVMGILVVASPFTLLLTIPLLIACAVPLALFTPIYLFEEIGILAAFWKTFRLGFATWGGVFLVSLVMGLISSVLQGVTTTPWYIATIVKYFFMLSDTQNELTISAGYSFMVYLLAIVQTFGAYLSMIFSLIGMVYQYGHASEVVDSISVESEIDKFEQL

SEQ ID NO: 8409 - protein, 96 aa, B.fragilis
PMFHILGFLFIIVIAVIIIGLALVGSVLRAVFGLGKRSPSSGSDRNGPNNNSGSRRYYHQTQANDKEEIITGTGAKHKKLFDDNEGEYVDYEEIKE

SEQ ID NO: 8410 - protein, 242 aa, B.fragilis
TNNQNRMAKYKRVLLKLSGESLMGEKQYGIDEKRLAEYAAQIKEIHEQGVQIGIVIGGGNIFRGLSGANKGFDRVKGDQMGMLATVINSLALSSALVAAGVKARVLTAVRMEPIGEFYSKWKAIECMENGEIVIMSAGTGNPFFTTDTGSSLRGIEIEADVMLKGTRVDGIYTADPEKDPTATKFHDITYDEVLKRGLKVMDLTATCMCKENNLPIVVFDMDTVGNLKKVITGEEIGTLVHN

SEQ ID NO: 8411 - protein, 469 aa, B.fragilis
TAGQPKVVLLILALAGNGLGSHHIRPTALTGKVSVRMIYRHHRAKVGTVECTVDLCCLVTVVTSVRSIPVSVVVDGLQPHLQPIGDVRSQVQVDIETAVLIVVMFQCSPLVEETYRTVIGGLARTSVERQGVLLHQGVVFDGFIYPVGVAAIQILVGIGRIDEYRQIVFRVGIIGIDMIHIVLIVVIASTRVAVGQIMEIGKCPRIHILRFACRRIDRPVGRERDLGFLVFTFLGGNQHDTIGCLCSVNRSRSRILQYRYAFHIGRIDHVGIHLHTIDQYQRSGRVYRCSTTNVEPVSFARRTVVGGNVQVTDRRLQSLAKIGDRATLQCLCRNTGYGSGEVGFLLCTITHHHDFVQGFAVLFQGDLQTGLCGNGHDLCFHSNKGDLKLLSLFRFNREVTIHIGDCSTSGSTLYQYRSPGKRRTRNVKNTTGYFLFLLFYLHHSGRCCIVAVRSKARLKSHTRKKDKHP

SEQ ID NO: 8412 - protein, 207 aa, B.fragilis
MTLQADTLVCDTARVAFWQSNPDYDYNRELMTPEIDIYGWLSMQLSKLLRAIFGSRFAEEYSGIILIIIAILILLLILWFLYKKRPELFMRSRRGPVNYSVHEDTIYGVDFDAEIRRAIDRKDYREAIRLLYLQTLKLLSDDGRIDWQLYKTPTEYIYEVKQEILRTPFRNLTHGFLRVRYGNFPASESLFEELAALQTQIRKGGDV

SEQ ID NO: 8413 - protein, 85 aa, B.fragilis
LLFLKEVNVLMIKPEYLSEKIRKFAYKYPIYVFHSSIRTISKKDRVIKREIKISFSCKNANKQIYLHNYFSLRTRDKIYPYNQKT

SEQ ID NO: 8414 - protein, 165 aa, B.fragilis
LYTKHNTMKKKIIRYLIVSHLTFILSIGGMAVAFYYYHTAQMAQIKNANILLISKDEMKLRLIDYKGQELFTADIACGKNYGNKEKQGDLKTPEGTFKIIDIQDASKWKHDFGDGKGEIEGAYGNHFIRLETPGHKGNWDSWHPRPIIYWDPERPEDAFESKIQN

SEQ ID NO: 8415 - protein, 190 aa, B.fragilis
ILNKMVDVKTIIEESQEKMDMAVMYLEEALAHIRAGKASTRLLDGIRVDSYGSMVPISNVAAVTTPDARSITIKPWDKSMFRVIEKAIIDSDLGIMPENNGEIIRIGIPPLTEERRKQLAKQCKAEGETAKVSIRNARRDGIDALKKAVKDGLAEDEQKNAEAKLQKVHDKYIAKIEEMLAEKDKEIMTV

SEQ ID NO: 8416 - protein, 433 aa, B.fragilis
QNNNFIITENQETLLIMKILFSLDVSNQRQVDFCNRILKILDNKDDSNDITLICKSQNHLSDYLYIPPSSHIKTEEAEIILTYGKTGLSHISQFARKSNIPIIHFINTEYLKDEYLSEDQQVEKIILCDCFNQLLESFFQKDKMFVLPYFSIPVVTKNVEIRNKNSPKLLIAIAHPNLKNSPVYYISNLLNILSDYRITILYNGDPLIPIFNSNITLINVKESNIEKVILSNDIIIGDGISIYTGIMLGKPCIVIGEQGYGGLITPQNLSQQFANKFQGRIGGSLNEYIPLNLIMNDIQYVQNTEKSKNIDCIIIKNKKLLDNEYRQTQQSLNDLILEVAANHKQLYTFPMEIHLRLSDAFHLIKFSDTKFVLAYTANNKVHSSFGKEEAEIIALFKRSCLIKDAINMSPYKKEPKIFVEFIQMLFNEKILIA

SEQ ID NO: 8417 - protein, 361 aa, B.fragilis
DMDKKVKWGIVILVGAGLIGWGIYSRLPKANEELAAADKVMTGKQINKRVLNVNAKIIKPQLLTDQIQISGSLMPDEEVDLSFETSGKIVEINFDEGTTVKKGQLLAKVNDRQLQAQLQRLVAQLKLAEDRVFRQNALLERDAVSKEAYEQVKTELATLNADIDLVKANIAMTELRAPFDGVIGLRQVSVGSYASPTTIVAKLTKIIPLKIEFSVPERYASQVKKGTNLNFELEGKLSSFPAKVYATESRIDQSTRTLTVRALYANSNGAILPGRYASIQLKKEEIPNAIAIPSESIVPEMGKDKVFLYKSGKAEPVEITAGIRTEAEVQVIKGLQMGDTIITSGTLQLRTGLPVTLDNIN

SEQ ID NO: 8418 - protein, 67 aa, B.fragilis
FITKIFCIKIEAIIDNNIRMADNGKYCIGITYIDRMIEIGLSIFNSILFLLVVKLIIDPDKLFFCKI

SEQ ID NO: 8419 - protein, 66 aa, B.fragilis
CSCLPSFHILWMDLPMQARHLPVVISAPVIVWSFTVPSDSYSDGVSDYQPGSPFFTVLVDNHFWDY

SEQ ID NO: 8420 - protein, 116 aa, B.fragilis
YFNNMKKLNINKLSEYPVVNIEEQTSLKGGVSQDEFFRMLENNTWQGGYVDGYGYAAPAVTIYGTSWNETGRWDIDGCPACGNGLGYDQTKPKPEHDIVTIWTHFFCHKHIYYGSK

SEQ ID NO: 8421 - protein, 186 aa, B.fragilis
MVNKYFFIAAFLFWLLPAIVRLCVIDISEIAISHTTTFEINSPANKTLYFLYNKDKHSAFITILKNNMQGCILNVLGGGLLGIGTLFNLLLNGFCFADVCCRTYKLGMSITDIFALTLPHSFELIGFWISGGIGLYIAWNIILFMYTDKMPTFKFYKNIGINLLIIFIIILSAAYIETYVSINMLT

SEQ ID NO: 8422 - protein, 270 aa, B.fragilis
KSSKHLQVEMTYVDNFLKFIFVSSCRHCNFMASNYQPITMQDFVHLHVHTQYSLLDGQASVSALVDKAMKDGMKGIAVTDHGNMCAIKEFTNYVNKKNGGPKGEIKDLKKRIAAIEAGEVECADKDAEIADCKAKIADAEGRLFKPIIGCEMYVARRTMDKKEGKPDQSGYHLIVLAKNEKGYHNLIKLVSRAWTKGYYMRPRTDRNELEKYHEGLIICSACLGGEVPKKITQGLLAEAEEAIQWYKNLFGDDYYLEMQRHKATGPKAKS

SEQ ID NO: 8423 - protein, 418 aa, B.fragilis
IGIKWLKYLRPLSLTSGIWLTKRIIKNEMKTKLTNCVKTVLLSFMLGVLFACCQGAASSGNAGKNASRVRIASNDSAKLVPDKALNDASCVLAGLPVDKASGKLYALTRTKEWKNHARYMDQIWNVFRQTAPRLVAFSQTELEDINTRCHTLFYPFGGPDFLFANAFFPEMDTYVLIGLEPAGTAPKVKHPSAETYRLYQNAVSNVLNLSFFNDMDKELANDTIDGVVPIYSLLMARGNRKIVSIQEVWLSETGDLFERKEGDTIRNTCSAGMEVRFFRPGASRLQTLYYFCTDISNEGLQANRPLQAFMDRFDAETTATFVKSASYLMHEPAFSRIRETILQKSSAVVQDDSSIPLSCFDPEVWSVTLYGTFYKPISTFSQYLQPQLRDAYQLGDPKPLNFRIGYARQSNLQVARRK

SEQ ID NO: 8424 - protein, 220 aa, B.fragilis
ILQKHRHQFIDHFHNYSFSCLHRNLCINKYVNMKRIINTLEKMPKWYGFLTILLYSLLLAEFLITTNHLVNNNNLETDRLFVILARMSYIIIVLSAIVIWLISTFLFHLTAILFNGYAPFKHLLYISSYFYIIPAISVFISIFLLNQKTEYSTSNAVTTLQNNYSLGLPIMLVNYSFIPYYLLCMILIHHLYKVRLRYAIASVVIPILSVWAITKLFTLL

SEQ ID NO: 8425 - protein, 105 aa, B.fragilis
HSKKLILANSSFKRSLLFYIHYRIFTQFIYIQFFHIVKILVRRWLFLDFFVKQYFLLFDLLGGMVCQGNHGRYKHNFCLNLHCNVLFLLAVFTCLVILILLFISL

SEQ ID NO: 8426 - protein, 101 aa, B.fragilis
ISKKVKTNKKAILGMLVAIVISLGVMGGINENKCDYNLQEATVAMTYAAGTGEYGPEASGKLAVGALAMGKVTETLGTCAVGLGWCPAGWIAGVGAAAAGL

SEQ ID NO: 8427 - protein, 740 aa, B.fragilis
KRKNHLQISKKKIQRTTMRINFPSYIQHDQMDCGPACLKIIAQNYGKRFSLKYLRDRCYATREGVSLFDIGRAAEEIGFRTLAIKVTFEDLIEKMPLPLIVHWKQSHFVVVHKITNRKVYISDPAQGLTHYNHKEFREAWEMCNGLGTIMILETTPEFHNMNEMETRASFSHFMKYLKPHHRYLGQVIVGMVAGILIGLLSPFISQSIVDFGIGSGNIQFVNTMLIAGMILAFSSMASDFIQSRLMLYVSERINMGMVSDFLRKTMSLPITFFERKMVSDLLTRIDDHGRIQSFIMSTFLGIFINILLFVIYSLLMLYYESNMFLVFMIGNTVYTGWIFLFLKQRKKLDNQLFGCRATNQNDLLELLENVNEIKINNIANKRRWKWELSRFKIYGLRVKNMNLDQIEATGASFIIHLQGLFITYIAALNVIEGTMTLGMMMAAQYILGQLNAPIKSMIGYVHSLQFARISLKRVNEVIWEEEPEISESKVSIPIEKGVKVKDLDFYYNPNLNKVLDNINLEIPEGKITAIVGESGSGKTTLLKLLLRFYKPTNGEIEVGGVPLDNIDLYRWRNSCGAVLQDGKLFNDTILYNITLEDEEMNVNQKQLVKAIQLANAENFINARPLKLYTPLGTNGSGLSQGQKQRILIARAIYKNPDFIFLDEATNSLDTNNEKQISKNLETILEGKTAIVIAHRLSTVKNAHNIVVMEKGKIVEQGTHQELINLKGIYYDLISSQLEIG

SEQ ID NO: 8428 - protein, 445 aa, B.fragilis
LNEKHMRQFILIMICILLQVIHVHAGSKDITWKWDYSEADDIFIDLLGKAATGFMETNTPNCYGGKLVVKLPEGLHFKQTEAPAFLLIGNAEEIAFNVDVNDSMAILSLKTSSVQTVPSEAINITLNPKAIKGKLRKGMNTTGRLSFHPSEIPTVFKSPITGRTYHLVFNDEFDDGVIDTLKWDTRSRRSPFTRRGMYQEKPYYVLCHEDWTKELHGELRLEVSKYSTQNNVVMTGGILSLGRFMARYGYYETKASFRDCIGEGYWPAFWIHFDEADKYGKGTEIDVFEYIPKDKQIFQTLHWYKKQAMEEQQSEVQHAALDYDKSGQFKEHRSSTEYFVLDEAQSKEHTFAVEWTPEELIFYTDGKVTRRVNRKDDPKQVPSAYQMVYFSCSAGEWGGNVMENQVPAYVYFDYCRCYQESDQDAIYTVKGNGMKVSASRRVGKL

SEQ ID NO: 8429 - protein, 149 aa, B.fragilis
ICRNNMSGRPIHIHVLSPDRPINIKIFFMAEHNLLGKAGEDAAVDYLERHDYVIRHRNWRKGHFELDIVAAKNGELIIVEVKTRSDTDFALPQDAVTPQKIRRTVIAADTYIKLFQIDEPVRFDIITVIGKTGNFRIEHIKEAFYPPLF

SEQ ID NO: 8430 - protein, 120 aa, B.fragilis
SFMNIESAREYCLRKKAVTECFPFDEYSLVMKVMDKMFALIDLEGANTISLKCDPDYAIELREHYSAIEGAYHFHKKYWNQVYFDRDADDKLIKQLIDHSYDEVMKKFTKKLRTEYDALP

SEQ ID NO: 8431 - protein, 232 aa, B.fragilis
IKMKKMKTLTLFLSLLFSFPFVLSAQMVGETLQKVSAALDNRQWDQAVTLFRQAVNTNVEKAEMFYWTGVDKSLEVSSRMGRELAAYYKKSRSYDKAYLFYKELLQKSPNDVNCLVSCAEMEVCRGRESEALETYRKVLSLDADNLAANIFIGNYLYLKAEREKKQLEADYKKISAPTRMQYARYRDGLSRVMSTGYGKAREYLQKVISQFPSTEAQKTLERIKLIEKEVNR

SEQ ID NO: 8432 - protein, 690 aa, B.fragilis
  UNSURE (45),(434),(449),(679),(683),(684),(685),(686),(687): Identity of amino acid sequences at the above locations are unknown.
YRRKSTRTFHPYLGLMHTAEEFNNLIVKEEKRPHHPFSVISDEPXWGPADIKSYMKMNGVPMVGIVVIPQRGANHIKIADAVYERMEKMQKDLPEDVKYSYGFDNTKFIRASISEVKETVYVAFILVIIIIFLFLRDWRVTLVPCIVIPVSLIGAFFVMYLADFSINVLSMLAVVLAVGLVVDDAIVMTENIYVRIEKGMPPKEAGIEGAKEIFFAVISTTITLVAVFFPIVFMEGMTGRLFREFSIVISGSVIISSFAALTFTPMLATKLLVKREKQNWFYLKTEPFFEGMSRLYSRSLAVFLHKRWIALPFVAITIGIIAFLWNYIPAEMAPLEDRSQISINTRGAEGVTYEYIRDYTEDINDLVDSIVPDAESVTARVSSGSGNVRITLKDMKDRDYTQMDVAEKLSAAVQTKTMARSFVQQSSSFGGRRXGMPVQYVLQATNIEXLQEVLPKFMAKVYENPVFQMADVDLKFSKPEARININRDKASIMGVSTRNIAQTLQYGLSGQRMGYFYMNGKQYEILGEINRQQRNTPANLKSIYIRSDKGDMVQLDNLIELTGGIAPPKLYRYNRFVSATVSAGLAEGKTIGQGLDEMDKIAKETLDDTFRTALTGDSKEYRESSSSLMFAFILAIVLIYLILAAQFESFKDPLIIMLTVPLAIAGALVFTTGLEGSDXCSCXXXXXRSI

SEQ ID NO: 8433 - protein, 186 aa, B.fragilis
AMRKNFSTILIVGAALLVASCVQQKGSFSPVDYVNPLMGTESTYAFSHGNTYPAVAVPWGMNFWSPQTGENGSGWMYTYTDSLIRGFRQTHQPSPWINDYGTFSVMPLSGVLKMDHKERGVPFSHTQEEAAPYSYSVTFADGLRTELSATSRGAVFEVTFPQDSAQYIVVDAYNGGSALTIDRENR

SEQ ID NO: 8434 - protein, 525 aa, B.fragilis
KNTDSMNVNKPTTEKKLIDLNNDIIHNFDVSIVMSFYKRYTEFKKVLPHNAPYLQRNGIEVIIVLDDPDEKSELLMLLQNYPFINWKLIINERKHAPRNHASVLNVGLKHATKKYILQIDPEVEFLTDIIWQMRDAIEKYPMHYILAMMAYVPYEQELTENNIKELDFIPWGNLMVERNHLYKLHGYDETFITWGGEDNNMRARLDMSGIKKFILPEAKTIHREKNYDPNERSKRINKHSISDWRKMNYPSEAIANKDIWGSEFNKVIYDWQDNQYAKDLCYTYLQQFIGFEIRHPAAFRKRHKKIVLCQAYNEEKLIEGFLTNMASYFDGIILLDDESTDRTWDLAIHDKILLKVKKKRSGFNDLENRNILLDLSAFFQSEWFCFMDIDERFDERFTNFSEFENNKEIHVVSFRGVYLWNDEQSYKGDIPNSNKGILTVYRMFRPIGHTHINTHKKLHFIATPYFTNTWQSNILFKDYGSMKENDRIRKYERYIQEDQQKDMSSGYDYLLNSENLYQLDKIEEY

SEQ ID NO: 8435 - protein, 74 aa, B.fragilis
ENYDIFATKTKKCLTGNDRIDYDCHTLEEIGLTLLKNSHSLFFSVFLISQKAYIRSSVSFQVRCRDRQQGIFVS

SEQ ID NO: 8436 - protein, 155 aa, B.fragilis
DRKEPFQKETINQHTSMEIKIQSLEQIHEAAREFISAMGDNTVFALYGKMGAGKTTFVKALCEELGVSDVITSPTFAIVNEYRSDENGELIYHFDFYRIKKLSEVYDMGYEDYFYSGALCFIEWPELVEELLPGDAVKVTIEELEDGTRKIVIND

SEQ ID NO: 8437 - protein, 531 aa, B.fragilis
ITMDNTRSVYGIDLGTTYSCIAQVDKFDQAIVLRNFEGDATTPSAVYFEDMDHVVVGKEAKGMLATEPTKTAVFIKRHIGVDDSFDKNTNEFPYHYDPTEISAFILKKLVKDANDLGDNPEPIKDVVITCPAYFGTKERMQTKQAGEIAGLNVLSIINEPTAAAISYGVKTDQKKTVLVYDLGGGTFDVTLINVNGGAIKVIATGGDHHLGGVDWDTALAEYMLAAFNEQNNTSYSFEDRLDLKYELLLLAEDKKKVLTAKQTAKATYQYEGNSARIEISRELFNSLTERKLDETIDATKKVIAIAKEKGYNNIDEILLVGGSSRMPQIKERVDKEFNCDAKLTDPDECVAKGAAIYAMNAAYSQAVRDYEEGESDDKPAPLRGDRTTVVNVTSKTYGTDVIIEGQSMVQNLIFANSSLPTKRIETFTTSIPNQRGVSVKVFESDFTNMETESIVEERFCTLIDDHTLKLSKDWPQGTQISVTYQIDQEGILHGLAYVENDKLEFDLKITGVKCEEELRKSKAIIDKASVE

SEQ ID NO: 8438 - protein, 417 aa, B.fragilis
KHPDIKGIGIHGTHDPLSIGTRSDPRMHSNQKFRIRAISIFNPSANNCYHHALCKRHKNPVNNKPMKTFKRFLFICIGLFIIVLSTQALEKYEVTANTFLNIRSHGSTNAPVIGTINHGGIVNVESIDGEWAKVSFNGGYGYVSTTYIRPVTPTPPAKAPTNTLSDWFRQTNYDCRPLVYIILGLSIVLFILRMRRGESTPLEDSEHTINLSLFITVCLLELFYVFSMGANSIWFCTPDKIGWLWTIINFFIFGAVVFNQWMCFFNTLNDVQYNSYATFNWTWGIYTWGICIIGAIICGFFFVGFLPVVGIGFLVGQSVQTGIIFNKVLPKGGWKHACICTLTYLIGSTATVLIVAHFLILLLIVLIALFLLSLLGKSSSSSGGKRCSNCSHLSGSSCNLSGRYISSPSTTYCDNYQ

SEQ ID NO: 8439 - protein, 1072 aa, B.fragilis
LRDCWRKQKKPSNGIRTCLETIIIWKCSAIKRQGLKPNHEAYPLQVNVNKHLIEYSKKYNVKLICTNDVHFVNEEHAEAHDRLICLSTGKDLDDPNRMYYTKQEWMKTKAEMNELFADVPEALSNTLEILDKVEYYSIDHAPIMPTFAIPEDFGTEEGYRQKYTEKDLFDEFTQDENGNVVLSEEAAKDKIKRLGGYDKLYRIKLEADYLKKLTFDGAKKFYGDPLSPEVKERLVFELHIMKTMGFPGYFLIVQDFIAAGRNMGVSIGPGRGSAAGSAVAYCLQITKIDPIKYDLLFERFLNPDRISLPDIDIDFDDDGRGEVLRWVTEKYGQEKVAHIITYGTMATKLAIKDVARVQKLPLAESDRLAKLVPDKIPDKKLNLKNAIEYVPELQAAEASPDPLVRDTMKYAKMLEGNVRGTGVHACGTIICRDDITDWVPVSTADDKETGEKMLVTQYEGSVIEDTGLIKMDFLGLKTLSIIKEAVENIRLSKGMELDIDSISIEDPATYKLYSDGRTIGTFQFESAGMQKYLRELQPSTFEDLIAMNALYRPGPMDYIPDFIDRKHGRKPIEYDIPVMEKYLKDTYGITVYQEQVMLLSRLLADFTRGESDALRKAMGKKLRDKLDHMKPKFVEGGRKNGHDPKVLEKIWADWEKFASYAFNKSHATCYSWVAYQTAYLKANYPAEYMAAVMSRSLSNITDITKLMDECKMMGVQTLGPDVNESNLKFTVNRNGNIRFGLGAVKGVGEAAVQSIMEERKENGPFKGIFDFVQRVNLNACNKKNMECLALAGGFDSFPELKREQYFAVNSKGETFLETLMRYGNRYQADKAAAVNSLFGGDNVIDIATPEILPAERWNDLERLNKERELVGIYLSAHPLDEYAIVLEHVCNTHMSELDDKSALAGREITMGGIVTSVRRGISKNGNPYGIAKIEDYSGSAEIPFFGNDWVTFQGYLGEGTFLFIKARCQPKQWRPDELDVKITSMELLPDVKEQLIEKITILIPLAELNSALVAELASLTKEHTGNTELYFKVTDTEGKMYVDLISRPVKLSVGRELISYLKERPELAFHIN

SEQ ID NO: 8440 - protein, 273 aa, B.fragilis
LLNRMNLLQYTFFQHALLGSLLASIACGIIGTYIVTRRLVFISGGITHASFGGIGLGLYAGISPILSAAVFSVLSAFGVEWLSKRKDMREDSAIAMFWTLGMALGIMFSFLSPGFAPDLSAYLFGNILTITQTDLLLLGILAILLILFFTLFIHPIIYVAFDREFARSQGIPVVVLEYILMMFIALTIVSCLRMVGIVLAISLLTIPQMTANLFTNKFKRIIWLSIAIGYLSCLGGLLISYRLNVPSGASIIFFSILIYIACKIGKSLFRKKQ

SEQ ID NO: 8441 - protein, 86 aa, B.fragilis
ESTRIPSSKRVLAFPARMCASASSRYITAISIFSCDSSIIVFTSTILLSIYKIGTLIHFENKSRLFFDYLQLSIERNALPDVSLSK

SEQ ID NO: 8442 - protein, 149 aa, B.fragilis
GVRRMLDDSYFMKQALIEAVKAGERGEVPVGAVVVCKERIIARAHNLTETLNDVTAHAEMQAITAAANVLGGKYLNECTLYVTVEPCVMCAGAIAWAQTGKLVFGAEDDKRGYQRYAPQALHPKTVVVKGILADECAGLMKDFFAAKRR

SEQ ID NO: 8443 - protein, 430 aa, B.fragilis
RAGSSANSNQEGRGCMRSSRWFIIGIVLFLLIMFVVESHLPKKFVWNPTFAQHDHQPLGCAVFDDVLKSSLPDGYSLSRKTFYQFAADSDSCQSILVITQHVNLVEADLNALLDLAQRGNKILIAASSFSTSLSDTLGFDNSYAYFNPRRMKEYAGNLLERDSVCWIGDSAVYDKRTFRFYPHLCGIYFTKYDSLSLPLATKRIDSMQMFNDSLPDCFPPVALSRPVGSGEIVLVTTPLLFTNYGMLDGDNAAYLFRLLSHLKGLPVVRTEAYGAGAQVEVSPFRYFLSQRPLRWALYLTMLVLVLFMVFTARRRQRAIPVIREPANRNLEFAELIGTLYYQKKNHADLVRKKFIYFDESLRRNIQVDVEDDSDDNALSRRISRKTGTDEEKVRNLFRKLRPVIRGQQEVGETLMKDLIDGMNEIEKPQP

SEQ ID NO: 8444 - protein, 88 aa, B.fragilis
NYRSKSKFAKNMRKRDKKCNKATPDEPKRERRMSILLSEDEQQIVDRYLDKYKITNKSRWLRETILMFIHKNMEEDYPTLFGEHDMRR

SEQ ID NO: 8445 - protein, 84 aa, B.fragilis
LGTRLHAVEELAAVQESLQVMFTVKVAPSLLMFSKVDWDNSSVASEVESSQLLKPISTKSITNKYSVFIKECFFIKNTGSKIMV

SEQ ID NO: 8446 - protein, 65 aa, B.fragilis
RRQGNSPANRYIGKALLNESEFTRNYLTHRELTSGGELVLWMDSVPDSRRGTQKEDLPYSYSNGH

SEQ ID NO: 8447 - protein, 92 aa, B.fragilis
GTGGRNKKNSDQRLIIRRMAPQYFVQGIFATAGLIALLASILNWNWFFTAQNAQLIVRNVGRGRARLFYGLLGVIMIGMAVFFFLNTQPVSE

SEQ ID NO: 8448 - protein, 311 aa, B.fragilis
NMKGLVIKNTGSWYQVKTDDGQLVECKIKGNFRLKGIRSTNPVAVGDRVQIILNQEGTAFISEIEDRKNYIIRRSSNLSKQSHILAANLDQCMLVVTVNYPETSTTFIDRFLASAEAYRVPVKILFNKVDAYDEDELHYLDSLITLYTQIGYPCFKISALTGEGVDAIREELKGRVTLFSGHSGVGKSTLINALVPGLEVKTAEISAYHNKGMHTTTFSEMFPVPGDGYIIDTPGIKGFGTFDMEEEEIGHYFPEIFKTSANCKYGNCTHRQEPGCAVRKAVEEHYISESRYTSYLSMLEDKEEGKYRAAY

SEQ ID NO: 8449 - protein, 1065 aa, B.fragilis
FIIIMRERKLVERAVRISGMFVLLSGMGLQPCLASHSYNAAPAGVVQVEQQKQKITGCVLDVTGSPLPGASVLVKGAPGRGAITDMDGNFSVEAEQGEQLEISFIGMETQVVTVSAKTRLQITLKEDSKTLDEVVVVGYGTQKKANLTGAVASVSAETLESRPITNLSQGLQPPIGNLNISADNGAPGKGYGFNVRGTTSINSSGPLVLVDGVQMDPNMINPADVESVSVLKDAASASIYGTQAAYGVVLITTKKGKDEKAKISFSSNWSINSPTRKPEYMDSWTFANFHNLTNRNSGGGDYYDKNYMDHIYAYYTDPKHNLPVFIDPSNPNKYLYCGNTDWIDETIKDNTLMQQYTLSLNGGSGKTAYYGSIGFLDQGGTLKHYDDKYRRFNVNLNLTSDVTNWLQVRLKTVYNNTYRDAPYGSNNSDETAQINSAFYGADLRPMMPVYHPDGNFSGQGSWTNMVATQSISGERKNKENDLWLTGGLKITPLKDWTINVDYTYNMYILSKKQHGKEILEHTANPDIVTVFPHTTPSRVKFTTDDNYYQTFNAYTDYSKSLGKHNIKLLLGYNYETKSYRWFNAERENLISNDLAGLGQAYGEKYNGSGQHSWATMGYFARINYNYDERYLLELNGRYDGSSKFPKDKRFVFFPSVSAAWRISSEAFFEPAKKIVDELKIRASYGSLGNQSVGGDYPYIATMGTNGEMGYLVDGKKIASVSPGGIVSPYLTWETVRQIDLGLDWALLNSRLYGTFDWYMRKTLDMVTNGTPLPAVLGTGAPQANTADLKTTGWELSMGWRDRVNKDFSYDVSFVLSDYQAEITKFNNPQNLLSTHYVGKKWGEIWGLVTEGLFQSAEEVSAHADQSEIYGGGWYPGDVKYKDLNGDGKINKGKNTLDDPGDQKIIGNSEPRYSYGIKGGLQWRDFDFDVFFQGIGKKDVVLGGNQFWGFGNEWHVPFKHALDSWTEDNRNAYFPRSTYDNVTGNRETQTRYLQNAAYLRLKSITLGYSLPKALLAKWKIDHVRFYVSGQNLLTFDHLFDIYDPETVSLSTYPLTKSVSFGLNITL

SEQ ID NO: 8450 - protein, 143 aa, B.fragilis
FVIMWILIVGLVLLAIVAMIAGYIRNKRLQKKIDNGELDSFPEVKEVDVECCGQHEVCERDSLLAAVSKQIEYYDDEELDTFIGRAPEDYTPEEADKFRDVFYTMQDTDVAGWVRSLQLRGISLPDEIKDEVFLVVGERRIHP

SEQ ID NO: 8451 - protein, 73 aa, B.fragilis
WADYRWYVFSAMGFYPVCPGVPEYAMGSPLFPKLTLHLPGRKELHCEGGKAIARRTGISGKPCSMKVNLPVTT

SEQ ID NO: 8452 - protein, 66 aa, B.fragilis
LIAISEISITHSRTMAGNNQNKKAAMKKYLLTIYKLLLKYLLMLICIVKWDSLLISIICLCLPFFC

SEQ ID NO: 8453 - protein, 240 aa, B.fragilis
RTDMVVTKIKISAMILTCMLYNALNTCARSVDISHKGCKYSIDLPSGWDTIPHDTLKKIFPRLDLDMGLYPVSQKEYFTGNYALVGFMPVLQSLHSYSFDRIVSDMKEMNDRTKNTWNNDSISTRLDSIVPVNSSPNYRINNYLTIRRDSILLKGCQSLYVSKFGYITLMLYQKGNDALPIDSLLGKFNDSGCLKVDQEYRYTPPQKEGLSFTHFLYALGIGGIVYLLIAFFPKRKTNRQ

SEQ ID NO: 8454 - protein, 451 aa, B.fragilis
TIIFDPVFFIKKHSFMKTEYLFVILLVLIGFSSCEDSTSDATLELSQSTFENISSDGATLTVNITCSDSWTAASSSTACNLVPNQGTSNQSLSIVVEANLDEAERNMTVVVTSGGIKKTISISQQGRSTTAGEYHYNLPVIFHVLYKDKNNPLQYVKQDRLAKILDTVNKLYKDKTKSVDMNLTFTLATTDEDGKPLSTPGVKYVLWEESYPIDCDVFMNDETGKYVKYIWEPNNYINVMVYNFKDDESTNSTTLGIAHIPFSTVGSNYLEGLSKTQKSYLEKQNLKFPYSVSINSLFINDQSTSTQYSTADITVTLAHELGHYLGLHHAFSENDEGIYDGCFDSDYCDDTPTYNKVEYDADYAYTAKNDPANFTFDYLVKRENCKTNQTFTSTNIMDYSVSYSDRFTNDQRSRIRHVLTYSPLIPGPKQGQTQTRSVVEGPIDLPIRTAR

SEQ ID NO: 8455 - protein, 339 aa, B.fragilis
NRNIPIMKRKHLITVLMWCVATTLCAQTPVEKGLKSINRQATEAYIGFLADDELQGREAGFHGSRVAARYIASLLKEMGIRPLGESYYQPFDAYRKERQQKGRLEVHPDSIAKLKQVVHQKLSMNNVLGMIPGKKTNEYVIVGAHFDHLGIDPALDGDQIYNGADDNASGVSAVLQIAKAFVVSGQQPERNVIFAFWDGEEKGLLGSKYFVQECPFINQVKGYLNFDMIGRNNQPQNPKHVVYFYTEANPAFGRWLKEDIKKYGLQLEPNYRPWDKPVGVSDNGSFAKAGIPIIWYHTDGHPDYHQPSDHADRLNWDKVVEISKASFLNVWNLANEKDY

SEQ ID NO: 8456 - protein, 239 aa, B.fragilis
ETIMANAITRHIPNTVTCLNLFSGCIAGVMAFEAKYELAFIFIILSAVFDFFDGMLARLLHAYSPIGKELDSLADDVSFGVAPSLLVFSFLKEPGLIYPDFLAGLRDYIPYLAFLISIFSALRLANFNVDERQTSSFIGLPVPANALYWGALIVGGKDFLLAHCNVIYLIIMVMLFSWLLVAEIPMFSLKFKNLSWKDNKVSFIFLIVCIPLLLFLGISGFSAVIVWYIILSLLTRKNK

SEQ ID NO: 8457 - protein, 231 aa, B.fragilis
IAQMGRLKKLKKIRIHREGTHILWGSFFLLLIINLALYWGIDCKIPFYLVALVSIVVYLLMVNFFRCPIRLFGQDTEKIVVAPADGKIVVIEEVDEHEYFHDRRIMVSIFMSILNVHANWYPVDGVVKKVTHDNGKFMKAWLPKASTENERSMIVIETPEGVEVMARQIAGAMARRIVTYAEPGEECYIDEHLGFIKFGSRVDVYLPLGTEICVSMGQLTTGNQTVIAKLK

SEQ ID NO: 8458 - protein, 503 aa, B.fragilis
TGRIGSVTGVARNHNGGVPDNSANYFRIEFSHPIAEEGVYDGDTLMRHRPTLESDYTCAYLRFNVPAGEKLTVRTASSFISPAQALVNFSREVGGKSLAQVREEARKQWNSYLGRIEAEGGSEEQLRTFYSCLYRTLLFPREFYEFDAQGKPVYYSPYNGKIQDGYMYTDNGFWDTFRAVHPLFTLLYPEVSERVTQSILNAYDESGFMPEWASPGHRECMIGNNSISLLTDAWMKGIRTICPEKALEAMIHQTEGRHPGISSVERDGFGYYDRLSYVPYPEVHEATAKTLEYAYADWCVARFADSIGRKEIADTYYRKALNYRNLYYPDYGFMWAKDANGKWRDAFDATEWGGPFTEGSSWHWTWSVLHDPEGLSRLMGGHTAMEARLDSMFTAPNTYNYGTYGFVIHEIAEMVALDMGQYAHGNQPVQHAIYLYDYIGRPWKTQKHVREVMDKLYHSGSKGYCGDEDNGQTTAGMSFPPWDSIRFVPVFRSMPWDLRSSRN

SEQ ID NO: 8459 - protein, 303 aa, B.fragilis
KTRIAFRKVGQERTVDLVLTAILANGHVLIEGVPGVAKTLLARLTARLIDADFSRVQFTPDLMPSDVLGTTVFNMKTNEFDFHRGPVFANIILVDEINRAPAKTQSALFEVMEERQASIDGTTYRMGELYTILATQNPVEQEGTYKLPEAQLDRFLMKITMDYPSLDEEINILERHHTNAALVKLEEIQPVITREELLSLRRLTEKVFVDRTLLQYIALIAQQTRTSKAVYLGASPRASVAMLQASKAYALLQGRDFVTPEDIKFVAPYVLQHRLILTAEAKMEGYSPVKVTQRLIDKVEVPK

SEQ ID NO: 8460 - protein, 339 aa, B.fragilis
FSYFCFRFRTKLIRSRTGWMKEVTFIRRNIEKWKETEKVVEQADKLTPDRLADAYTELTADLAFAQTHYPSSRITIYLNNLASALHNVIYRNKKEKWTRIFTFWTQEVPQTMYHARKELLVSVLIFWASVLVGIVSAANDDNFVRLILGNGYVDMTLDNIARGEPMAVYNGSEEVPMFLGITLNNIMVSFNVFAMGLLTSFGTGWLLFNNGVMLGAFQTFFFKHGLLGESMLAIWLHGTLEIWAIIVAGAAGLALGNGWLFPGTYSRKESFMRGAKKGLKIIVGTVPIFIMAGFIEGFITRHTELPDVLRLGIILLSLSFIIYYYIYLPNRKTHGITKT

SEQ ID NO: 8461 - protein, 892 aa, B.fragilis
FFVFLLHYETDDAFIEEQYMRRLGCLFAIGMMWLCIVDCFSQGLLFYGNEKRISERATYSVLREGHERTFTNAFRISFDYLVRNVESPGYILYLEDRDAGKTYSFTYLHKPGDRCSFSFNEDGKRIFCTFELDKEDYDHRWLPVSIALDIPADCARITIGKRSKEISNLGLEPTGFSPHIYFGKCEYILDVASYAIRNLSLTDGEEIMIFPLNESSGEDVHDSRGHVVGQVTNPVWLINQSYYWKELFTDYSSTPSGLNFDKTHQNILFFNQDSLSAFDLYTHELSKTPYKTPLPVQLRLGMNFLDEASRELYTYEVADSHGDAMVAALDLTTKEWRPASSDYLCQQLHHHCGFFHPGERKFFLFGGYGSRRYSNTFLAYDLNTCRWDTLAFSGDRVIPRYFSGMAVSNDYKRVYLYGGMGNEAGDQNVGRNYLYDLYRIDMQTRSAQKLWEAKAPAANPVGPRNMILSADEKHLFLLGYPEYLPNSTLQLYRLSVRDGECEAVGDSIPIVSEEIATNANLYFNEELNEFYCSVQEFEKHGQVTTRLYSLSAPPVTLDDVEYYSRRRNALNAGLLGAVVGGVLLLAACVWGIMHHKRRRDRTSAETASAGVRPEEVSDIPEVPAVESPEVKEEEVEKEPSEWEELPAVLPPDKNAIFLFGMFTILDNAGRDITYMLSPKLRTIFLYILLNSVGKRGVLSSDMNQIFWPDKSGSNVKNLKGVSMNHVRKILQDVDGIELVYRNGYFCMVFGEEFYCDYIRLMNLTSPEKKKKETPGAIRAEWLEILLRGKFIPAAESDLFDYYKQKVETLIHSLLPGQLELAYGDARFSIVIRLCNILFIADPLSDLALAYTVCTLRKQNNQEEAIRRYAAFTKDYRRVMNEEYGIAFADIKV

SEQ ID NO: 8462 - protein, 474 aa, B.fragilis
NYEFFVILKTSLIFVKKEITRLNSMRKELLFTVFVSVAFIFLQAFWIVRMYQRYEEQYTEQVNKAFLDAIGKEVELRIRYVEEFKTPILIKPTGCVSEKERTGYKGDTIDLVLLKQNDIVRNVSEFLAQLEQDELLSSRVSPVLPVIDSLLREELSGLKIDHYLSLYDKEGKMVDSLGNTSLRGERRVIKVREAIGTKGLLFMQIESKLPYDAILSKMFYSLLVFALIIMFVVGCLIHQLRVIRQKDELLERREVSVNGIVHDLKSPLNALVTLTGWLMETESDLRKKELMAEVIKRAGHQTAQIESILVCARGAAQPIVLNKTEINPEEIVQAAIDDICVELKAKPHSIEVINEASGLTCLGDRGYLENVMKNLIENALKYADDGVKIQIEITRISQGIQIKVKDNGWGIAPKYQKKLFNQYYQVPREALRMRKGYGIGLAYVRHIIRAHGGKIQFKSRENEGSVFTFYIPEK

SEQ ID NO: 8463 - protein, 213 aa, B.fragilis
RCSSNGRVSLRSAWWRWPCILPRWLEMVEEAIGWKGLTCAANLFYAYTRECYDDVDEARITPYTLLSPLEISVGVVDTAWFWKAYNALGRERYEKVFAASKAVTESSGVYSRFRKYTDALVGKYTIAQLESLVMDNRNKDWVRAYPLAPFAGKARKKEVDARLRFLKAFWLSSDTLSGRHTAEKEAVQVALDNLTGNSGLGNLDTRWFKKKVW

SEQ ID NO: 8464 - protein, 98 aa, B.fragilis
NHIPRKPAWRTTPSTSRVRGMPEHWVGYCYAWGYADNHPNNTEYSQFKIDWAVDKDGKPVHLDGIDFVKIYTAVNQNCGWLGEASTEIQAVEDLHYKK

SEQ ID NO: 8465 - protein, 524 aa, B.fragilis
LNNPNKTLIYRLVSCLCCTFAVQYLDVFQTHVRMKRRNYFIFSCLMLMAPAAVQAQFDKGLNYKIETSATVSGGHNTPFWLVANKHGLSSIRKNNAYLDAGIFRDLEKDKKFSYAFGLEMVGASRFTSKFFIQQAYVDLRYRGMEISVGSKERGNEMKNDQLSSGSMTFSTNARPIPQVRVSIPEYIPFPWTKNWLHIKGHVAYGMFTDEKFQERFTAGRSKYTKETLFHSKAAFLKVENLQKSPVSVELGIEMAAQFGGDCYYPDGTVLRTPDSWKDFFRIFFPSNGDSGASESDQINILGNHVGSYSAAVGYHFPTWKIKAYWEHFFEDRSGMTLTYGMWRDCLAGLEVTLPENPFVKTIVGEFLYTKHQSGAFHYFATPAIDHSFTGADNYYNNSQYAGWEHWGQGIGNPLVTSPIYNKDGNLAFESNRVKGFHIGLNGSPTPEIDYRILVSVAKHWGTYGSPYRNIRRNQNGLLEVTYKPEQIRGWSFTLAGAVDGGNMLGESWGGMLTIRKTGLIGKKK

SEQ ID NO: 8466 - protein, 118 aa, B.fragilis
YSFYLCSALVCILRVPGMQLKGNQVQILNSPAAVSFTSDCCKQPPLATGKRFLGRRLSTETSQKTCLCIFFIAFEEKALSLMSRNYSIRHFIHHSDSEKVSYDNKLCQVYLVCPAEVS

SEQ ID NO: 8467 - protein, 597 aa, B.fragilis
NITYMNLPVTQKHFLSFSRKLFLSVISLFLVFAACFMAYQYQREKEYKVELLNIQLQDCNNLLYEKLYDHPQDMTEVISDYLQHNVLKDLRITVVNLDGKVLFDSQEQNVEQLGNHLDREEVQKALYNGVGFDVRRTSETTGVPYFYSATLYKDYIIRSALPYSVSLINNLKADPHYIWFTVIVTLLLMIIFYKFTNKLGTSISQLREFAMRADRNEPIEMAMQSAFPHNELGEISQHIIQIYKRLHETKEALYIEREKLITHLQISHEGLGVFNKDKKEILVNNLFTQYSNLISDSNLETAEEVFNISELKEITDFINKAPKRPVGKEEKRMSITINKNGKTFIVECIIFQDMSFEISINDVTQEEEQIRLKRQLTQNIAHELKTPVSSIQGYLETIVNNENLPKEKMNVFLERCYAQSNRLSRLLRDISVLTRMDEAANMIDMEKMDISVLVTNIVNEVSLELEEKHITVVNSLKKEIQIRGNYSLLYSIFRNLMDNAIAYAGNNIQIHINCFREDEKFYYFSFADTGVGVSPEHLNRLFERFYRVDKGRSRKLGGTGLGLAIVKNAVILHGGNISAKNSQGGGLEFVFTLAKER

SEQ ID NO: 8468 - protein, 323 aa, B.fragilis
KYYLCPISKQKIMMNNVKYLSFALILAFSACKSGSASSQEPSEKQDTVKIFNLPQIPVVLNTVEQRTDYMVKHYWDRFDFSDTTYINQAEVPEQAWVDYCDLLEHVPLPVAQTAMKETFNRAEKNRKMLHFFEELADKYLYDPNSPMRNEEFYIPVLEALIASPALDETAKIRPQARLELAQKNRLGTKALNFTYTLDSGAKGTLYQFPAEYTLLFINNPGCHACAEMIEGLKASPVINGFTAAKKLKVLSIYPDEELDEWKKHRNDFAKEWTNGYDKELVIKNKNLYDLRAIPTLYLLDKNKTVLLKDATLQKVEQYLAERG

SEQ ID NO: 8469 - protein, 632 aa, B.fragilis
YTNHLLSHSIIMTPYLQVDNLTKSFGDLVLFENISFGIAEGQRIGLIAKNGTGKTTLLNILSGKEGYDSGNIVFRRDLRVDYLEQDPQYPEELTVLEACFHHGNSTVELIKEYERCMETEGHPGLDDLLVRMDHEKAWEYEQKAKQILSQLKIRNFDQQVKHLSGGQLKRVALANALITEPDLLILDEPTNHLDLDMTEWLEEYLRRTNLSLLMVTHDRYFLDRVCSEIIEIDNRQVYQYKGNYSYYLEKRQERIEAKSVEIERANNLYRTELDWMRRMPQARGHKARYREDAFYELEKVAKQRFNNDNVKLEVKASYIGSKIFEADHLYKSFGDLKILEDFSYIFARYEKMGIVGNNGTGKSTFIKILMGQVQPDSGTLDIGETVRFGYYSQDGLQFDEQMKVIDVVQDIAEVIELGNGKKLTASQFLQHFLFTPETQHSYVYKLSGGERRRLYLCTVLMRNPNFLVLDEPTNDLDIITLNVLEEYLQNFKGCVIVVSHDRYFMDKVVDHLLVFNGQGDIRDFPGNYSDYRDWKEAKSQKEKEAEKPQEEKTARVRLNEKRKMSFKEKREFEQLEKEIAELETEKLQIEELLCSGTLSVDELTEKSKRLPEVNDLIDEKTMRWLELSEIES

SEQ ID NO: 8470 - protein, 284 aa, B.fragilis
GYQHSESNMIQGKKFISPGTWFSMIYPSDWSEFEDGEGSFLFYNPEHWTGNFRISAYKEDAAAPGGMNYGKDSVRQELKENPSASLVKVGHLECAYSKEMFEEEGTYYTSHLWVTGIDNVAFECSFTVPKGEHVDEAEKIISSLEIRKDGQKYPAEIIPIRLSEIYQVNEAYEWVTDTVKTQLKKDFQGLEEDLQKIQDVIDSGVLSPKKKEPWLAFGIAICTILANEVEGMEWMTLVDGNREVPVLRYEGSEQLIDPMKLLWSRVKAGEACEVAEAYKQALIH

SEQ ID NO: 8471 - protein, 129 aa, B.fragilis
EEMKKGILLLFVVLMGFTSCGKKFGHRYLDGMWQMQRIEYKDGNIDTPLDTYFSFQMDIIHLRKLGNSEFYGKYVYENDSMHIQVLDATAEQMKVFGMDGRVQDFAVEKLNSNKLVLQSDYARLEFRKY

SEQ ID NO: 8472 - protein, 582 aa, B.fragilis
DTKDTPDIESVIIKRISNMKTTSFNNGRSNSSSLFRRGIGGVSFFFLLFLLLFASCDDLEDTDTPSGGDGGMPVETGTAELYILSEGLFNLNNSSLALYSFKNNQLNTDYFRSINRRGLGDTANDMGIYGSKLYIVVNVSSQIEVVDLQSGKSVKQIPMLSENGSSRQPRNIAFDGGKAYVCSFDGTVARIDTASLSIDALTRAGRNPDGICVQNGKLYVSNSGGLDWEGIGVDRTVSVIDIPSFTEIKKIEVGPNPGDIQAGPDGSVYVATHGENIEAGDYHFVQIDGHTDQVVRTFDEKVLSFTIHDNMAYLYNYDYRTQDSQIKVFNLKAGKTERENFITDGTTIRTPYSISVNPYSGNVYITDAYDYKVKGDVLCFSPQGQLIFKLPNVGINSNTVLFRNKASQGNPDENPADAEAGAFANKVLEYNPAPSQYMNTSYTAYEEGFTGIQVLARATELLQDRTTCLFTLGGFGGNITVGFDHTIPNVPGEYDFKIYGNAYYDMYGTLLDKPGGNSEPGIVLVSKDTNGNGLPDDEWYELAGSEYNSPATIRNYEIIYYPSPSADGDVKWKDNQGKEGYI

SEQ ID NO: 8473 - protein, 413 aa, B.fragilis
IETCEPDRCRPSSPVVKTTAVFLANVEKTQFPIPVSGGGTNYADVLTNYQTTRANARIVLPGAEFTDTSEFYLANVSFSDTSAQPYVLLQRIISMLNLRRVFVDAQTALNSLTNNIVTQVGYKNIIRTTVQGILPGLLKTAMNLGPVGNLVYDVVGGLDAAVNLVVAALVEPVVDALYAQLLQGLVNQIGLTLSGNATQNGALGALGDLLNPWRGSDAAYALVTINNFPKTMDLDLNVKDFYTGNHRFRYGFTPTPGTTNSEKDILIRGFHGLYDVREIHVAKPGLISGLLVDDVIDGPLLLNGVFVNITDPIQATVNTNYRYRSNYSFVSLGLKSYAQQSDGNHSLTLSVQLKNIANLDGILGGIPVLGPVLNGTVRLLIGNITVTVPVNLPLLGTDNLTLSGSWSTPPVQY

SEQ ID NO: 8474 - protein, 702 aa, B.fragilis
TLPSLFSVSGRSELVRTFYQQKTKMNILRLPKLLYSCVAFCCCQALTVSLSAQQQKADTARTYSIPEVTVAEAYHTSEVRAMAPTQVFSKEELKSLNVLQVSDAVKHFAGVTVKDYGGIGGLKTVSLRSLGAEHTAVGYDGITISDCQTGQIDIGRFSLDNVDRLSLSNGQSDNIFQPARFFASAGILNIQTLTPQFKDNRRTNLSASFKTGSWGLVNPSLLLEQKLSRKWVLSANGEWMSADGHYPFTLHYGEDNDLTSREKRKNTEVKNLRAEAGLFGNFSDTEQWRLKAYYYQSSRGLPNATTYYYDYSSQHLWDKNVFVQSQYKKEFSRQWVFQTSAKWNWSYQRYLDPDYKGSEGKTENSYYQQEYYLSASALYRVLSNLSFSLSTDASINRLNANLKDFAYPTRYSWLTAFAGKYVNDWLTASASVLATVINEEVRQGSAAANRRKLSPYVSASFKPFASEEFRIRLFYKDIFRLPSFNDLYYGQVGNTNLKPESTTQYNLGLTYSRSINELIPYVSVTADAYYNKVKDKIIAIPTKNLFIWSMVNLGKVDIKGIDIAGNISLQPWEKLRVNLSGNYTYQRALDMTEPGGKTYKQQIAYTPRVSGSGQAGIETPWVNLSYSFLFSGKRYMLGQNLRENRLDSYSDHSVSVSRDLRIRNVNTSLTVEVLNLLDKNYEIVKNFPMPGRSVRVTMKVRY

SEQ ID NO: 8475 - protein, 483 aa, B.fragilis
SLYGDTGGGRFTLQEIIISLIYIFNFCNMKKINALITKMCFIALCALPIIISSCNDDDDKYYYPTNFENLSLPNDTIIAKGEDLTLKPTLNLINPKIYSWKIDGKEVSNEVNYTFSTSVGGKHEIIFEAQDSKGNTDKAQITVDVFAYYGGFYVINEGWAGHDPASVNYYKDGKWNFNIVESLGQTGTVGVIQDSYMYIVAKDAPYLTQIELANFNITKQLSTEIEEQLDYGQANSFCTINETTGILTASRGAYKINLNPLSIGNMLPQLNSESANGNGCKDILKSGDYVFVNNMDTIKIYKSSDLSFVKKLTALMKTGFAQTKDGNIWAANGQSLIKIDPKTLDETTVELPDNINVFYNQWAYTPTGLCASTTENALYIVNTTVVPGAYGDSYYGKNIYKYNTESKIAQEFFKAPSKIQSIYGAGIQVNPQNGDVYLIYTEDGYGAHYLNTNIYVADGQSGTQKQIIDYTGKYWFPSSIVFK

SEQ ID NO: 8476 - protein, 239 aa, B.fragilis
LCSITLTKNTMNDYRILVVDDEEDLCEILKFNLENEGYEVDTANSAEEALKMNISSYHLLLLDVMMGEISGFKMANLLKKDKKTAQVPIIFITAKDTENDTVTGFNLGADDYISKPFSLREVIARVKAVLRRTATSDTEKAPEQLCYQSLVIDITKKKVSIDGEEVPLTKKEFEILFLLLQNKGRVFSREDILSRIWSDEVYVLDRTIDVNITRLRKKIGTYGKRIVTRLGYGYCFETE

SEQ ID NO: 8477 - protein, 400 aa, B.fragilis
NIKMIKIDFKQRKREVLWTVVALFFIAIGVSVFKFSSATSGFEITDELGGNIFPSAILSVATTDAQVIQPADSIYLGNPKSCIAIKVKSRSAYSRVRIDVAETPFFSRSVSEFVLNKPRTEYTIYPDIIWNYEALKNNNQAEPISVAVTVEMNGEDLGQRVRTFSVRSVNECLLGYVTNGTKFHDTGIFFAAYVNEENPMIDQLLREALNTRIVNRFLGYQNPAPGAVDKQVYALWNVLQKRKFRYSSVSNTSLSSNVVYSQRVRTFDDALESSQINCVDGSVLFASLLRAINIEPILVRTPGHMFVGYYTDNSHKDMNFLETTMIGDVDLDDFFPDEQLDSTMVGKSQNQMSLLTFEKSKQYANKKYKENEKGIHSGKLNYMFLEISKDVRRKIQPIGK

SEQ ID NO: 8478 - protein, 270 aa, B.fragilis
RNRIMNLTNYHSHTLYCDGRAGMEDFIRFAISRGFTSYGISSHAPLPFPTHWTMEWDRMDDYLDEFTRMKEKYASEIELAVGLEIDYLNEDSNPSVRRFQELPLDYRIGSVHLLYNDRDEVVDIDVCAEVFRDIVDQHFGGDLDRVIHLYYDRLLRMVELGGFDILGHADKMHHNAACYRPGLLDESWYDALIHDYFSAVAAKGYIVEINTKALHHLNTFFPNERYFPLLKELGVRVQVNSDSHYPERINSGRPEAVFSTARKDQRRCRE

SEQ ID NO: 8479 - protein, 472 aa, B.fragilis
YFYSIFVLSHENVRHTTSKLNMENKKGQPTTEAIFRGIQSGKVLELFDKLQYQIAIHGDLTYSDPWGEVHRFRDQFESAKRDSDSPTAIGRYPFADVWIQFYEMEVKDYSLLLEMCLMASHSRTSVWRKGFGTLLDKLYGKIPLVEYEQALEHLEHPYALSEILWALEWDYRDQEVYLKFSHYILLHLLPLLTPRNITFLYSVREWFGSTSDHRVVLVHCYWIDCWLKHPKRLLTDDEFTADFKIRYELYRLCNFLSYKEEPYPLEFPIRAVDFGRACQMGLLSEDTLMVELMDRPLSPVLIEEAVDFFYKKDQKEKRLYTDCRDYDFSRFKKVLEKVTERILDIELERGEACTDVTSLARKLDGVTGAELMIRLLSLMGKEKFIRLDKWYYDTGESRTGMFCHLMLHCAPSPTDTPDWLKMLVERAGITPKRLVEMAVYSPPLAGDGRRGYRMERPDLCGKFVLCLHKGVL

SEQ ID NO: 8480 - protein, 409 aa, B.fragilis
PQNSYFMSSTQKNFALPLAFIGIMFFAIGFALGINSVLIPVLQGSLGITSAESYLIIAATFVPFLIFGYPASMTIKAIGYKHTMALSFAMFAVAFGLYIPSASQESFPLFLVASFVSGTANAFLQASVNPYITILGPLDSAAKRISIMGICNKLAWPIPPLFLAFLIGKEVSDITVSDLFTPFYVIIAAFIILGIISLMAPLPEVKAAGEDDSEGGAEACPYAASKTSVWQFPHLLLGCLALFLYVGVETVSLGTLVDYANSLHLENAAAYAWIAPIGIVIGYICGIIFIPKYINQATALKICSILAIAGSILVVLTPADISIYFIAFIALGCSLMWPALWPLAMADLGKFTKAGSSLLIMAMAGGAVIPTLFGYIKDIAGAQNAYWICLPCFLFILYYGMAGYKIRTK

SEQ ID NO: 8481 - protein, 301 aa, B.fragilis
  UNSURE (31),(32),(33),(34),(35),(36),(37),(38),(39),(40),(41),(42),(43),(44),(45),(46),(47),(48),(49),(50),(51),(52),(53),(54),(55),(57),(58),(59),(60),(63),(66),(68),(80),(92),(107),(116),(121),(131),(147),(166),(171),(184),(212),(252),(293): Identity of amino acid sequences at the above locations are unknown.
AYTFIFKVSYRFLCTLCTGSIDFRSADMGVXXXXXXXXXXXXXXXXXXXXXXXXXPXXXXLPXPFXLXLPPLLFLSSFSXLFFFFPFPPFFXLFFFLPFPLSSPFFXPFPFLFLFXPFFPXPLLFSFFPFXSLPSFLSSPFSPYPSXFFLFLFPPLFPSPSPSLPXFLLPXSPFFPFFPFLPFXSSFFFFPFFPLFLFFLSPFPFFFSFSLXFPFFPLLFFSLPFLFLLLFSSFLSSFFFPPFPFPLPPLLXLFLPLFSFSFSLFFLSSLSFFLSFPFSLLLSSSFSFLSFSXLFFFPSLP

SEQ ID NO: 8482 - protein, 254 aa, B.fragilis
TLLPDSLDIGRQSTQITFIEIKNSLSLPKIPQMKYTVYLFDFDYTLADSSRGIVTCFRSVLERHGYTGITDDMIKRTIGKTLEESFSILTGITDADQLESFRQEYSKEADIYMNANTILFPDTLPTLTHLKKQGIRIGIISTKYRFRILSFLRNHMPDDWFDIIIGGEDVTHHKPDPEGLLLAIDRLKACPEEVLYIGDSTVDAGTAAAAGVSFTGVTSGMTTAQEFQAYPYDRIISTLGQLISVPEDKSGCPL

SEQ ID NO: 8483 - protein, 144 aa, B.fragilis
KYMPINYVVRKKKDQSGNEVKELYYAVPSAIQNKGVSEKQLAEDLHDNSSLSAGDVLSVLEQLPKAIARHMKEGRTVTIRGLGTFYPALSSEGCETPEECTPNKVRLTRICFRADTAFTYDVKHCEFESMQLRFTKRPKPGKEE

SEQ ID NO: 8484 - protein, 140 aa, B.fragilis
WRWPVNTGWFIRDMPMILPFRVIICRKMKFWYESTGLFGKKGFTMNVKKTRFLSEHKRKIITGVSVSSGKKMTLPKVKKREIRKNVHYVLTKGLVGHQEHIGSTDPVYLKRLLGSLCYWRSIEPDNRYVSDSITALKRLM

SEQ ID NO: 8485 - protein, 187 aa, B.fragilis
FEYTAIDPPVKTIGSIPIIINLKEKGKDVNATKATVISFALMIGFFYAGDFMLKLFHVDIESFAVAGAFVIFLMSLEMILDVEIFKNQGPIKEATLVPLVFPLLAGAGAFTTLLSLRAEYASINIVIALILNMLWVYFVVSMTGRVERFLGKGGIYIIRKFFGIILLAISVRLFTANITLLIAALQK

SEQ ID NO: 8486 - protein, 430 aa, B.fragilis
TGTTGNTSIKVMNIKNRLIIMNFLQFFVWGSWLISLGGYMERGLHFEGGQIGAIFATMGIASIIMPGITGIIADKWFNAERLYGICHLLGAGCLFYASTATDYNQMYWAMLLNLMVYMPTLSLANTVSYNALEQYKCDLVKDFPPIRVWGTIGFICAMWAVDLTGFKNSSAQLYVGASSALLLGLYSFTLPPCPPAKNQSKTLLSSFGLDALSLFKRKKMAIFFFFSMLLGAALQITNTYGDAFLGSFAKIPEFADSFGVKHSVILLSISQMSETLFILAIPFFLKHFGIKRVMLISMFAWVFRFGLFGFGDPGSGIWMLILSMIVYGMAFDFFNISGSLFVELETKPETRASAQGLFFIMTNGLGAVIGGYASGAVVDAFSVYENGMLASRNWPAIWFIFAAYALAIGILFAIVFRYKHQPGELKKVNN

SEQ ID NO: 8487 - protein, 239 aa, B.fragilis
HSFATDMVKMNLSEINVPERIAEMWAPLNAEQREFLANNFTLQNYKKNETIYCEGESPTYLMCLLSGKVKIYKDGVGGRSQIIRMIKPTEYFGYRAYFAKEDYVTAASAFEPSTICLIPMSAIMTLVSQNNDLGMFFIRQLSIDLGIADERTVNLTQKHIRGRLAESLLFLKESYGLEEDGSTLSIYLSREDLANLSNMTTSNAIRTLSNFATERLITIDGRKIKIIDEEKLKKISKIG

SEQ ID NO: 8488 - protein, 251 aa, B.fragilis
PVLASSKAKRWLCELPEKIVNITDKLGIPYVFKGSYRKANRSRLDSFMGIGDEKALKVLEKVHNTFGVPTVTDIHAADEAAMAADYVDILQIPAFLCRQTDLLVAAAQTGKTINIKKGQFLSPLAMQFAADKVIEAGNKNVMLTERGTTFGYQDLVIDYRGIPEMQSFGYPVILDVTHSLQQPNQTNGVTGGMPQLIETVAKAGIAVGADGLFIETHENPAVAKSDGANMLKLDRLEGLLTKLVKIREAIM

SEQ ID NO: 8489 - protein, 328 aa, B.fragilis
EFNACFSLPFSYLCNVINKDMTMPDYDLIAILGPTASGKTPFAAALAAELNTEIISADSRQIYRGMDLGTGKDLEDYTINGRQIPYHLIDIADPGYKYNVFEYQRDFLTAYETIKQKGCLPVLCGGTGLYLESVLKGYRLIPVPENQELRVRLAEKSLEELTAILSSYKTLHNSTDVDTVKRAIRAIEIEEYYAKTPIEEREFPQLNSLIIGVDIDRELRREKITRRLKQRLDDGMVEEVRRLLAEGIQPDDLIYYGLEYKYLTLYAIGKMTYDEMFTGLETAIHQFAKRQMTWFRGMERRGFTIHWVDASLPMEEKINFVKQKLKEF

SEQ ID NO: 8490 - protein, 943 aa, B.fragilis
NSIAMKHLFRGLLLVAVILCCNFQQAFAQQMPPIPIDKNVRIGKLDNGLTYYIRKNNLPANRADFYIAQKVGSIQEEENQRGLAHFLEHMCFNGTTHFPGDALKQYLERIGVKFGENLNAYTAIDETVYNISNVPVKTPGAVDSCLLILHDWSNDLTLDPKEIDKERGVINEEWRTRMSAMMRMQEKLLPMMYPGDKYAHSFPIGTMDVVMNFKPQTLRDYYEKWYRPDLQGIVIVGDIDVDAVEAKIKTMFADIPAQPNAAERIYYPVADNKEPIICILKDKEQPHVQVLLFNKHEAVPDNQKGNVDYLIQQYAKNLISIMLNARLNELVQTANPPYIYAGADDSNFFVAKTKDAFLGIVVCKEDSIENGIAAMLRELERARQFGFTETEYNRARAEYLRQLESSYNERDKQKNEKYVNEYVRHFLDNEPIPGIENEYTIINQIAPNIPVAAINQLMKGLITDDNQALALFAPEKEDLKLPSEAAIAKLLKDAKTEKLTAYVDKVSDEPLMAEAPKGGKIVSESKDDIFGATTLTLSNGVKVIIKKTDFKADEIRMKGVSLGGSSVFPDSEIININGLDAVGVGGLGNFSAVNLEKVLAGKKASVSYDIANKTESVSGSCSPKDFETMMQLTYLTFTAPRRDDDAFASYKNRNKAALKNQELNPNVAFSDSIQAGIYMKHPRIIRIKADMVDQMDYDKILSMYQDRFKDASDFTFIFVGNVDVEKMKPVIAEYLGALPAVNRKETFKDNKIEMRQGIYKNEFTKQQETPKASVFAFYNGDCKYDLRNNLLLSMTSQILDLVYTEKVREDEGGTYGVYVGGTLQKYPKEKAILQIIFDTAPEKKEKLMKIIFGEIDNITKTGPSEANLNKVKEYMLKKHTEDLKENSYWLGSIDEYLYTGMNRMNDYEKIVNSITVNDIRKFADDLFKQKNEVEVTMVSPEKK

SEQ ID NO: 8491 - protein, 91 aa, B.fragilis
EEMAHKKGVGSSKNGRESQSKRLGVKIFGGEACKAGNIIVRQRGTEFHPGENIGMGKDHTLFALVDGTVNFKVGREDRRYVSIIPAEATEA

SEQ ID NO: 8492 - protein, 370 aa, B.fragilis
NIGAGICTFVPRKEEEAMKNRKRIIRYSVLGTLIALVWLTQMLPALGEGYARTAYPVISYILSGFSNIIPFALGDLFIALSIGGMIAYPFYARIRLKLSWKKILRRDVEYLLWIYVWFYLAWGLNYSQKNFYERTGIPYTAYTPEIFNEFVDNYISKLNESYVPVNRIDKEVIRKEAVRQYNLISDTLGIHRPTHSRPRVKTMMFTPLISMVGVTGSMGPFFCEFTLNGDLLPPQYPATYTHELAHLLGITSEAEANFYAYQVCTRSVNKEIRFSGYFSILGHVLANARQLMTEEEYKKLFGSIRPEIIELARKDQEYWMAKYSPLIGDIQDWIYDLYLKGNKIESGRKNYSEVIGLLISYNEWKKESNK

SEQ ID NO: 8493 - protein, 340 aa, B.fragilis
TIIYHIKKKYRKLMQKKTKESPKQQDDLSLKNKHLTIHKELYRQRTCFNARFFLYLCRIFTRTIVIMTKANKVLFITQEITPYVSESEMANIGRHLPQAIQEKGREIRTFMPKWGNINERRNQLHEVIRLSGMNLIIDDTDHPLIIKVASIQSARMQVYFIDNDDYFQNRLQTADENGVEYDDNDSRAIFYARGVLETVKKLRWCPDVIHCHGWMTALAPLYIKKAYKDEPSFRDAKVVFSVYEDDFKGTFTNALASNLMLKGINKKDVATLKDPVDYVTLCKLAVDYSDGIVQNSEHVNEDVMNYARQSGKLVLDYQAPDALADACNSFYDQVWEAEQK

SEQ ID NO: 8494 - protein, 88 aa, B.fragilis
VFLHNNLKACYFDNEGVATELCPVFEGTISADSKTFCTLLIRKMNFDLPSSTLRFSRERKRNGLTYGVMYLLSYLFMPIKAFCFPSYL

SEQ ID NO: 8495 - protein, 195 aa, B.fragilis
ESEQLTMDKKVELQVLNISNSQAQVGAYAMVLGEVDGERQLPIIIGPAEAQATAICLKGIKAPRPLTHDLFYSCLNVLGATLLRVLIYKAKEGVFYSYIYFKKDEEIIRIDARTSDAVALAVRADCPIFIYESILERECIRLTDGDERPDTPEEDENSRTEPVSIISLEEALNKAIQEENYELAARLRDEINRHK

SEQ ID NO: 8496 - protein, 398 aa, B.fragilis
KQHNKFMHKVYLKPGKEDSLKRFHPWIFSGAIAHFDGEPEEGEVVEVYTSKKEFIAKGHFQIGSIAVRVLSFKQEEINHDFWKHKLEVAYDMRRSIGIATNPTNNTYRLVHGEGDNLPGLVIDVYARTAVMQAHSAGMHVDRMAIAEALSEVMGDQIENIYYKSETTLPFKADLFPENGFLKGGSSDNIAQEYGLKFHVDWLKGQKTGFFVDQRENRALLERYAKGRSVLNMFCYTGGFSFYAMRGGAKQVHSVDSSAKAIDLTNKNVELNFPGDTRHAAFAEDAFKYLDRMGDQYDLIILDPPAFAKHKDALRNALQGYRKLNAKAFEKIKPGGILFTFSCSQVVTKDNFRTAVFTAAAMSGRSVRILHQLTQPADHPVNIYHPEGEYLKGLVLYVE

SEQ ID NO: 8497 - protein, 763 aa, B.fragilis
IMNKIISKEHFSEKVFKLVIEAPLIAKSRKAGHFVIVRVGEKGERMPLTIAAADPKAGTITLVVQEVGLSSTRLCELNEGDYITDVVGPLGQATHIENFGTVVCAGGGVGVAPMLPIVQALKAAGNRVITVLAGRSKELIILEKEMRESSDEVIIMTDDGSYGRKGLVTEGVEEVIKREKVNKCFAIGPAIMMKFVCLLTKKYEIPTEVSLNTIMVDGTGMCGACRITIGGKTKFVCVDGPEFDGHQVDFDEMLKRMGAFKTIEREELHKLDECEATKVIDENGRTAPWREALRKAIKAKDRANIERCQMNELDPEYRSHSRKEEVNQGLTKEQAVTEAQRCLDCANPGCMTGCPVGIDIPRFIKNIERGEFLEAAKTLKETSALPAVCGRVCPQEKQCESKCIHLKMGKEAVAIGHLERFAADYERESGQISVPEVGEKNGIKVAVIGSGPAGLSFAGDMAKYGYDVTVFEALHEIGGVLKYGIPEFRLPNKIVDVEIENLAKMGVTFIKDCIVGKTISVEQLEEEGFKGIFVASGAGLPNFMNIPGENSINIMSSNEYLTRVNLMDAASPDSDTPVAFGKNVAVIGGGNTAMDSVRTAKRLGAERAMIIYRRSEEEMPARLEEVKHAKEEGIEFLTLHNPIEYLADEQGRVKQVILQKMELGEPDASGRRSPVPIPGATETVDIDLAIVSVGVSPNPIVPSSIKGLELGRKGTITVNDQMQSSIPTIYAGGDIVRGGATVILAMGDGRRAAAAMNEQLSSK

SEQ ID NO: 8498 - protein, 507 aa, B.fragilis
TKINKNLDTTIMKAKYVWVALLALTFFGCDDNTGTIGWDMLPDSDQNINGRYTTYELTTNSDLSGPVFAKTSVGYVGKFTDKEFGEYEASFLAQLNSPDGISFPSVYDPETNPKGVMAGDSIHTAELILYYKSYFGDSINPCRMTVYELDENLTQNYYTDIDPLKYYNPNNLLARKAYTAVDQSLSDSIRNSDDFYPNVRLTSEEITKLGKRIYRLNRDHPEYFKTSEAFINNVFKGIYAKNDYGNGTILYVDQINLNVVIRCHEKDSLGNNLKKKNGADSLYYTTRTFATTKEVIQANKFVNSEKLNEIAKKTDCTYLKSPAGIFTQATLPINKIYEELSHDTINAVKLTFNSYNQPDNGKFSMKAPTYVLLLREKERQSFFEENKLTDNITSYLAVHNAIISNKPTTNQYVFTNLTRLINACVNEKQEAKKKAGDSWNEAAWEAANPDWNKVVLIPVLVQYDSSSNKNMISIQHDLQPGYVKLEGGPDGTKLKLEVTYTNFNGKQ

SEQ ID NO: 8499 - protein, 305 aa, B.fragilis
KMEKFELHILGCGSALPTTRHFATSQVVNLRDKLFMIDCGERAQMQLRKSRLKFSRLNHIFISHLHGDHCFGLMGLISTFGLLGRTAELHIHSPKGLEELLTPMLNFFCHTLAYKVIFHEFDTRQTSVVYEDRSMTVTTIPLQHRIPCCGFLFAEKARPNHIIRDMVDFYKVPVYELNRIKNGSDYVTPEGEVIANTRLTRPSDPPRKYAYCSDTIFRPEIVEQLSGVDLLFHEATFAESELARAKETYHTTAAQAARIALEAGVRQLVIGHFSARYEDESILLKEASAVFPNTILAKENLCISL

SEQ ID NO: 8500 - protein, 159 aa, B.fragilis
SEMKKLIILLIIVCGFTPALRAVGSPNQHLSPKEFRAKQQAFITEKAGLTQEEAAKFFPVYFELQDRKKQLNDEAWKLLRSGKDEKTTDTQYGEILEGVYDARIASDRLDKTYFEKFKKILSCKKIYLVQRAEMRFHRELLKGVRDNKGGNERPQGKRK

SEQ ID NO: 8501 - protein, 232 aa, B.fragilis
NLKKYANMRPEIRQILLTMVLPLFLIFILYMIKVLEIGMDWDFISLGVYPLSKKGMFGIFTHPLIHSSFKHLLTNTLPLFFLSWCLFYFYRSIAPSIFLIIWIGCGAITFLIGKPAWHIGASGIIYGLAFFLFFSGLLRKYIPLIAISLLVTFLYGGLIWNMLPYFTPSGISWEGHLSGAIIGTICAFSFMGYGPQKPDPFANEQEEESVSATDETDNIEMDKEEEHEIDAE

SEQ ID NO: 8502 - protein, 263 aa, B.fragilis
RGEKGKRRERRKKEKKRRRKEEEKKGKKEKKRERKEKRERKKKRKGGEKEKEEGEEERGKGERRRRKGKRKREEGKGREGKRKEEGKKGRKEKRRKKKERERGKKEKGGKKEKKRKKKRKEEKGRKEKKEKREEGKKGEKGREREREEGREKGRRRRDKEKKERKGRKEGKRKGRRRKGGEKERKERKGREKERGKKKEKKGERGGKKRGRKRGGRGKRKRGKRRKREREGGGGEGRRGRGGKKRGGKKKKKKRKKKKKKKKK

SEQ ID NO: 8503 - protein, 406 aa, B.fragilis
QNIEIMNNLVWKLLRQHISIGQLTGFFFANLFGMVIVLLSAQFYKDVVPIFTEGDSFMKKDYMTATKKISTLGSFAGKSNTFSSEEIEELKKQPFTRSVGAFTPSQFKVSAGLGMQEAGIHLSTEMFFEAVPDKFVDVSLDKWHFDENTHTIPIIIPRNYLNLYNFGFAQSRSLPKLSEGLMSLIQMDILMRGNGRVEQYKGNIVGFSNRLNTILVPQSFMNWANQNFAPDSQPDPSRLIIEVDNPADASIAKYFQQKGYETEDGKLDAGKTTYFLRLIVGIVLAVGLFISILSFYILMLSIFLLLQKNTVKLESLLLIGYSPSRVALPYQILTLGLNIVVLLLSVGIVSWARTSYLTTLNLLFPQMSVGSLWPTFAIGIFLFLLVSSINVIILKKKMLSIWIHKA

SEQ ID NO: 8504 - protein, 389 aa, B.fragilis
TITEMKQTKTILAVILLVVLVGCGENIQSNNDLIIVDVSKSYPKKELILQDFMDVEYVALETTDEFLTQGLVQDVGKEYILATNRNNDGDIFIFDRKTGKGVRKINRRGQGAEEYARINEIILDENNGEIFVKSPGNKILVYDLYGKFKRCLSLDREVSSIFDYDKDNLICYDMSDYHSKGEDRTKSYHIILSKQDGSITRDIFIPFKTIDTPIVNDGDRFIANYSYQIRLSNGKCTLMDTSADTLYNYASDGTLSPFVVRTPSAHTMEPEVFLYMGIHTDRYYFMEAVKNVFNFEKGNGFYADELVYDKEEKAVFQVTIYNDDYVDKRTVAMTAKPINREIEDVTSLNAARLVEIYKKDQLKDGKLKEIASRLNEEDNPVIMLVKQKK

SEQ ID NO: 8505 - protein, 176 aa, B.fragilis
KKNECMKKYLFNLLLFTVLVIGLSGCRTSAPKLDYKKLARASVRLGVDIGMEDNHKLYLEAAEWIGTPYRGGGETKRGTDCSGMTCQIYKKVYHIKLQRSTDGQKKESSKVARRNLREGDLVFFSSRKSRRKVAHVGIYLKDGKFVHASTSQGVIVSSLNEPYYRTHWISGGRVRK

SEQ ID NO: 8506 - protein, 466 aa, B.fragilis
NNIDMRTICLYFEIHQIIHLKRYRFFDIGADHYYYDDYANETGINEVAERSYIPALNTLIEMVKNSGGAFKVALSISGVALEQLEIHAPAVIDLLHILNDTGCCEFLAEPYSHGLSSLANEDCFREEVMRQSEKMKQMFGKAPKVFRNSSLIYSDEIGATVASMGFKGMLTEGAKHVLGWKSPHYVYHCNQAPSLKLLLRDFKLSDDISLRFSNSDWSEYPLFADKFIGWIDALPQEEQVINIFMELKALGMAQPLSSNILEFLKALPYCAKEKGITFSTPSEIISKLKSVSQLDVPYPMSWVDEERDTSSWLGNVLQREAFSKLYSVAERVHLCDDRRIKQDWDYLQASNNFRFMTTKNTGVWLNRGIYDSPYDAFTNYMNILGDFIKRVNSLYPEDIDNEELNSLLTTIKNQGEEIAELHKEVDKLQAKAEKAAKTVKAEPKAAPKKAAAKKPAAKKATAKKED

SEQ ID NO: 8507 - protein, 61 aa, B.fragilis
GLTDACKNAFAVPLTKEATRKRGKLSWLADGMYKPKATANMANESAMVCLYPIALIVIEAG

SEQ ID NO: 8508 - protein, 121 aa, B.fragilis
VIKDHPTELTYIYLYKMYAIVEINGQQFKAEAGQKLFVHHIQNAENGATVEFDKVLLVDKDGNVTVGAPTVDGAKVVCQIVSSLVKGDKVLVFHKKRRKGHRKLNGHRQQFTELTITEVVA

SEQ ID NO: 8509 - protein, 158 aa, B.fragilis
KGREGKKKRKEKERKEKEEERRREKGKERKKEREERKKREKEKEKRGRKRKRRGGRGKGKGGKKKEERKEEKRRRKRKGREKKRRGKKGKEREKEKKKGKGERKKRKRGKKGKKKKEEEKGRKGKKGKKGEEGRRKKGREGEGEGKRGGKRKRKKEEG

SEQ ID NO: 8510 - protein, 599 aa, B.fragilis
LLMENLKNVAPIEDFNWDAYENGESFAGASHEELEKAYDGTLNKVNDREVVDGTVIAMNKREVVVNIGYKSDGIIPLNEFRYNPDLKVGDTVEVYIENQEDKKGQLVLSHRKARATRSWDRVNAALENEEIIKGYIKCRTKGGMIVDVFGIEAFLPGSQIDVKPIRDYDVFVGKTMEFKVVKINQEFKNVVVSHKALIEAELEQQKKEIIGKLEKGQVLEGTVKNITSYGVFIDLGGVDGLIHITDLSWGRVSDPKEVVELDQKLNVVILDFDDEKKRIALGLKQLTPHPWDALDPNLQVGDKVKGKVVVMADYGAFIEIAPGVEGLIHVSEMSWSQHLRSAQDFMKVGDEVEAVVLTLDREERKMSLGIKQLKQDPWETIEEKYPVGSKHTAKVRNFTNFGVFVEIEEGVDGLIHISDLSWTKKVKHPSEFTQIGADIEVQVLEIDKENRRLSLGHKQLEENPWDVFETVFTVGSVHEGTIIEMLDKGAVVALPYGVEGFATPKHLVKEDGSQAQMDEKLEFKVIEFNKDAKRIILSHSRIFEDVAKAEERAEKKAASNAKKSSKREETPAIQNQAASTTLGDIDALAALKEQLEGKK

SEQ ID NO: 8511 - protein, 646 aa, B.fragilis
SYLCFRSKETNIQMKQTPFRCLCLLLILLGAVHSRLSAHADKTREDVLFLNSINFNLPWAKDVFWYTHQALQKKNISVKAESLSVPALCNRKEAAAVVEQLRRKYDVPPRLIVFIGDPGWIVCRELFDDVWKDVPVIITNARDRLPATLDILLSHEELTESNTVPAYEWRKGYNVTTLGQVYYVKETIGLMRQLMPDMKRLAFISDDRYISEAVRGDVEQAMTGSFPELAFEQLSTRNISTEMLLDTLKSYDKTTGLIYYSWFETHNQDDNNYLFDHIQEIITRFVHSPLFLLAPEDLSNNTFAGGYYVSVESFGDSLLQLIHRVLEGEFPRDIPPALGGKPAAYLCYPALQSYDIPVSLYPKEAVYINLPVSFFEQYKKEILMTVVLLLVVVSAVGYYIHILKRAHQRMKEAQLKAEEANQLKSAFLANMSHEIRTPLNAIVGFSNLLSMVEDKEEMLEYAGIIETNTELLLQLINDILDMSKIESGMYDFHVTQVDANQLMSEVEQVARLRIRTDEVSLSFAERLPQCVFHTDKNRLIQVLTNLVVNAIKFTSQGEIQIGYRLQDAHTLYFYVSDTGCGMSVEQCEHVFERFVKYNTFIQGTGLGLSICKMIIEKLGGEIGVQSESGKGSVFWFTLPYRASASL

SEQ ID NO: 8512 - protein, 218 aa, B.fragilis
SSTCMDSIHLQQTLPQVFADRNSITSDVWHRNLVFHKGKSYLIEAASGTGKSSLCSYIYGYRNDYQGIINFDETNIKAYPVKQWVEIRKHSLSMLFQDLRIFTELTAIENIRLKNNLTGYKTRKEVLSLFEALGLSDKLNVKAGKLSFGQQQRVAFIRSLCQPFDFIFLDEPISHLDDNNARIMGELVMEEASKQGAGIIVTSIGKHIELTYDRILKL

SEQ ID NO: 8513 - protein, 740 aa, B.fragilis
YLRCNILIWCFWLFSLCFVQKGVANVVLDPQTNRPISADSILNNVMTFAPFYEKLVTDYRADLYIKGTMDIKRKNFILRYVPSMFRLQKGVRQYMVETYSDLHFTAPNIYDQKVKASMGTVHNSRGVPGMLEYFNINLYSSTLLYDRLLSPLAKNGRKYYKYLIDSIMGGTDNRQYKIRFIPRSKSDQLVGGYMIVSSDVWSVREIRFSGRSELLLFSCLIKMGSVGKDDEFLPVSYNVEGQFNFLGNRINGVYVASLNYHDIVLEENQNKWKEKVRARIKGKSKYDLSDSYNLQCETTSFHTDSAYFETLRPIPLSEAERRLYKEDALRKDTIQRNIKPKSKSQVFWGQVGDVLISDYKLNLSNLGSVKCSPLINPFLLSYSGSNGLSYRQSFKYNRLFKHDRLLRVVPKLGYNFTRKEFYWSVNTEFNYLPEKMGAVHIDFGNGNRIYSSDVLDDLKAIPDSVFDFNQIHLDYFYDLYFNFRHSIEIINGLELSVGLSTHRRKAVKSSKLVPLTKSRETLNEDIQNKIRNTYLSFAPRVRLEWTPCLYYYMNGHRKINLRSKYPTFSIDWERGIKGVFGSTGQYERLEFDLQHHIPLGLMRNIYYRFGFGMFTNQKEMYFVDFNNFTRSNLPEGWNDEIGGVFQLLDRRWYNASRKYIRGHFTYEAPFLLLKHLIKYTRYVQNERLYASILSVPHLQPYVELGYGIGTHIFDFGVFVGSENWKYTEVGCKFTFELFNR

SEQ ID NO: 8514 - protein, 320 aa, B.fragilis
NINRSMETERIKCLIIGSGPAGYTAAIYAGRANLSPVLYEGIQPGGQLTTTTDVENFPGYPQGISGPQLMEDLRTQAERFGADIRFGIATASDLGQAPYKITIDGEKVIEADSLIIATGATAKYLGLDDEKKYAGMGVSACATCDGFFYRKKVVAVVGGGDTACEEAIYLAGLASKVYLVVRKPYLRASKIMQERVRKHDKIEVLFEHNVVGLFGENGVEGMNLVKRWEEPDEERYSLPIDGFFLAIGHKPNSDIFKPYLDTDEVGYITTDGDSPRTKVPGVFAAGDVADPHYRQAITAAGSGCKAAIEAERYLSEKGLI

SEQ ID NO: 8515 - protein, 237 aa, B.fragilis
CKSSKKKNFIGLPTTFSYLCVSIQADMKKESQVIFDKNVIEFVTVAAEFCAFLERAESMKRSTFVDTTLKILPLLYLKASMLPKCEMIGDESPETYVTEEIYEVLRINLASILAEKDDYLEVFLPDMAYSDEPIKKNISEDLADIYQDIKDFIFVFQLGLNETMNDSLAICQENFGLLWGQKLVNTMRALHDVKYSPKARGEDEEEEEYEPENNEDCHCEDDDCHCHDHGCHCHDDE

SEQ ID NO: 8516 - protein, 302 aa, B.fragilis
GERREKEEKGERKKRKGGGKKKRKRERKKKRERGKKKERERKREKGEKKKKKRGKRKGERGKEEGGKERGKEKKEKEGKGKEKKREKREGKRKGEKKRKGREEKKKKGEKRKKKERRRERKKREERKKRRRGKKEKRERRGGRGKERREEKKEEGGGIRRKRRGKEGRKGKEREEGEKEGKRKERKEKEEKRKGEKKRRRKGKGEEKKEEEKGGEGEKEKEGREGREKEKGGEEKGEGEGEGRREGGKRRKRRERKKKKKKKNNKKKKEKKHPHVSTPKVYASRTESTEKTITNLKDKSICL

SEQ ID NO: 8517 - protein, 176 aa, B.fragilis
RDVGDIRHFSRSFESFLPSCREKNREVFGRGQLNLLICTMSKKKRGEERMKEEDNILKKVGKKNSFKVPEGYFENLTSEVMGKLPEKEGPAFEEVKQPTMWIRMKPLLYMAAMFIGAALIIRVASSNHQPTTAGDHLTANEAATEVVSDEYIDVALDRSMLDDYSLYVYLSDATAE

SEQ ID NO: 8518 - protein, 74 aa, B.fragilis
GSNGLYIPTLKKQIINHTFAGLFLTFSHLYNRSKSFGIDRFLFYRPFILCFFRFSFPIFLFSFPFIPCFFHSVN

SEQ ID NO: 8519 - protein, 133 aa, B.fragilis
GEKGEERKEGREKKGKKEKRRGKGKKGKKRKRKGKGKKKGEERGKGRKKKRKKKGGKGKKKKREEKEERKRRGGRRREKGKGREEERGEKEEKEEKEKKKKKKKITKKKKKKNTPMSALLKSMLPVQRVQRKR

SEQ ID NO: 8520 - protein, 431 aa, B.fragilis
FIGGGTKMKVLMFGWEFPPHILGGLGTASYGLTKGMSQQEDMEITFCIPKPWGDEDQSFLRIIGMNSTPIVWRDVDWEYVKGRVGSYMDPQLYFDLRDHIYADFNYLNANDLGCIEFSGRYPDNLHEEINNYSIVAGVIARQQEFEIIHSHDWLTYPAGIHAKQVSGKPLVIHVHATDFDRSRGNVNPTVYAIEKNGMDHADHIMCVSELTRQTVIHKYFQDPKKVSTVHNAVSPLSQEIQDIVPNKNPKEKVVTFLGRITMQKGPEYFVEAAAMVLQRTRNVRFVMAGSGDMMDQMIRLAAERGIADRFHFPGFMKGKQVYEVLKASDVYIMPSVSEPFGISPLEAMQCSVPSIISKQSGCAEILEKCIKTDYWDIHAMADAIYSICTYPAMYEYLRDEGKKEVDEIKWENVGYKVRGIYDEVIKNYGKQ

SEQ ID NO: 8521 - protein, 819 aa, B.fragilis
HTFITMKKGITLFLLSLLFITPGCKQSKETIVNEYNIVPLPNQMIPQQGRFEISKKVRVITTACTPDVQIIADSLINRLKLTSGITIKQTFENVTDEPVIRFVPQDGMPEEGYKLSVTPQNITLTASTPKGFFYAVQTLYQLLPPVVYGNQKVKNAEWSVPAVEIEDAPRFAYRGLMLDVCRHFSPVEYIYKFIDMLAMHKMNTFHWHLTDDQGWRIEIKKYPKLTEIGSKRKETLVDYYYVNYPQVFDGKEHGGYYTQEQIRAIVDYAASKFITVIPEIEMPGHAIAAIASYPELSCTPDSTCDVTGTWGVFEQVFCPSDTTFQFLEGVMDEVMDLFPSKYIHIGGDECPKTAWINSEYCQSLIKQLGLKDDVTPNVIDGKKHTKEEKLQSYFITRMEKYLNSKGRNIIGWDEILEGGLAPNATVMSWRGVEGGLNAAKAGHNAIMTPNPYAYLDQYQEEPEIAPVTIGGYNTLKKTYSYNPVPDDANELVKKHIIGVQGNIWTEYMPGNDNRDYQAFPRAVAIAETGWTLNANKNWNNFCQRMVEDFRRMDVKNVKACRNFFDVNINTHVDETNTLKVVLESFYPNAEIHYTTNGSVPTVESAIYNQPFALSGEMDVKAAAFKDGKMLGKVSGKKLYGNLISGKSFTVTPPIGAAKGDILGENDVLGTDISTFGLTNGKRGNIASMTPWSGFRMNDACNKLVFIVEFEQPTTVSKVVFGSLYNPASVILPPSVATVETSSDGRKYDKMAEASFKRNYPERGRKAFTDTLGFAPKEVKYIKITLQNGGTLRNGIDFVKDPNEKDVVQANIYLDEIEVY

SEQ ID NO: 8522 - protein, 85 aa, B.fragilis
YTPIFIGVFCKINMFFLCTPLFVCGRKNFFVYFTYPEITIKYEFISRIIGFFLYLPSIRRLVFEVQYINMVFLVILALFCSKGSG

SEQ ID NO: 8523 - protein, 649 aa, B.fragilis
CTTMSYLHFDKTLMINLEESLPREILRTNKSGAYHCTTIVDCNTRKYHGLLVIPVPNLDDENHVLLSSLDETVIQHGAEFNLGLHKYQGNHFSPNGHKYIREFDCEHIPATTYRVGGVILRKEKIFVHHENRILIRYTLVDAHSATTLRFRPFLAFRSVREYTHENSQASRDYQLVENGIKTCMYPGYPELFMQLNKKNEFHYEPNWYRGIEYPKEQERGYDFNEDLYVPGYFEVDIKKGESIIFSAGISEISPRRLKQTFEAEVADRTPRDSFYHCLKNSAHQFHNKQEEDHYILAGYPWFKCRARDMFVSLPGLTLAVDEIGEFEDVMETARKAINNYIKGEPIGCKIYEMDDPDVLLWAVWALQQYAKETSREQCRAKYGSLLEEIIDFIRQRKHDNLFLHENGLLYANGADRAITWMNSTVNGRPVIPRTGYIVEINALWYNALRFIADLVREGGNGLLADSLDAQAEVTGKSFVEVFRNEYGYLLDYVDGNMMDWSVRPNMIFTVAFDYSPLDRVQKKQVLDIVTKELLTPKGLRTLSPKSGGYNPNYVGPQIQRDYAYHQGTAWPWLMGFYMEAYLRIYKMSGISFVERQLIGLEDEMTSHCVGSLPELFDGNPPFKGRGAVSFAMNVAEILRILKLLSKYNL

SEQ ID NO: 8524 - protein, 745 aa, B.fragilis
KKHIILCPTTNKRDTIMSKMRFFALQELSNRKPLEITTPSNKLSDYYASHVFDRKKMQEYLPKEAYKAVVDATEKGTPISREMADLIANGMKSWAKSLNVTHYTHWFQPLTDGTAEKHDGFIEFGEDGEVIERFSGKLLIQQEPDASSFPNGGIRNTFEARGYTAWDVSSPAFVVDTTLCIPTIFISYTGEALDYKTPLLKALAAVDKAATEVCQLFDKNITRVFTNLGWEQEYFLVDTSLYNARPDLRLTGRTLMGHSSAKDQQLEDHYFGSIPPRVTAFMKELEIECHKLGIPVKTRHNEVAPNQFELAPIFENCNLANDHNQLVMDLMKRIARKHHFAVLFHEKPYNGVNGSGKHNNWSLCTDTGINLFAPGKNPKGNMLFLTFLVNVLMMVHKNQDLLRASIMSAGNSHRLGANEAPPAILSIFLGSQLSATLDEIVRQVTNSKMTPEEKTTLKLGIGRIPEILLDTTDRNRTSPFAFTGNRFEFRAAGSSANCAAAMIAINAAMANQLNEFKASVDKLMEEGIGKDEAIFRILKENIIASEPIRFEGDGYSEEWKQEAARRGLTNICHVPEALMHYMDNQSRAVLIGERIFNETELACRLEVELEKYTMKVQIESRVLGDLAINHIVPIAVSYQNRLLENLCRMKEIFSEEEYEVMSADRKELIKEISHRVSAIKVLVRDMTEARKVANHKENFKEKAFAYEETVRPYLESIRDHIDHLEMEIDDEIWPLPKYRELLFTK

SEQ ID NO: 8525 - protein, 238 aa, B.fragilis
KKNMITIHNLRKNFGTQTAVDIENYTINQGEMVGLVGNNGAGKTTLFRLMLDLLKADTGEIIINDIHVNQSEDWKSFTGAFIDDGFLISYLTPEEYFYFIGKMYGLKKEEVDERLIPFERFMNGEVLGQKKFIRNFSAGNKQKIGIVSAMLHYPKLIILDEPFNFLDPSSQSVIKHLLKKYNEEHNATVIISSHNLNHTVDVCPRIAVLEHGVIIRDLVNENNSAEKELEDYFNVEEE

SEQ ID NO: 8526 - protein, 427 aa, B.fragilis
SIDMLTIKQITENTDAVIRGLEKKHFKGAKETIAQVIEVNDKRRNTQNQLDKNLAEVNSLSKTIGQLMKEGKKEEAEVAKARVAEIKESNKTLQADMDQAANDMLNLLYTIPNIPYDSVPEGVGAEDNVVEKMGGMETQLPTDALPHWELAKKYDLIDFDLGVKITGAGFPVYKGKGAQLQRALINFFLDEARKSGYTEIMPPTVVNAASGYGTGQLPDKEGQMYHCEVDDLYLIPTAEVPVTNIYRDVILDEKQLPIKNCAYTQCFRREAGSYGKDVRGLNRLHEFSKVELVRIDKPEHSRQSHQEMLDHVEGLLQKLELPYRILRLCGGDMSFTAALCFDFEVYSEAQKRWLEVSSVSNFDTYQANRLKCRYRSGEKKTELCHTLNGSALALPRIVAALLENHQTPEGIRIPKALVPYCGFDMID

SEQ ID NO: 8527 - protein, 232 aa, B.fragilis
IKDMHVFYTPDIQTSTELPEEEAQHCVRVLRLTAGDEISLTDGKGNFYRAEISVATHKRCLVNIKETIYQEPLWDGHLHIAMAPTKNMDRNEWFAEKATEIGFDELTFLNCRFSERKVIKTERIEKILVSAIKQSLKARLPRLNEMTDFCTFIEKDFKGQKFIAHCYEGEKPLLKDVLTKGEDALVLIGPEGDFSEEEVKKAIEKGFVPISLGKSRLRTETAALVACHTMNM

SEQ ID NO: 8528 - protein, 496 aa, B.fragilis
NGTMLFNELRLHGKLAAKRHPMYEKNKIGKYIMYASFIFWGAYFIFIGIGLAKAISTEVPNMEAYHILNSGLIFALALDFVIRFPFQKTPTQEVKPYLLLPVKRSRILDFLLLRHGLSSFNLIWLFLFVPFAALTVFPFYGISGVLTYSIGIWLLMVFNGYWYLLCRTLINEHIWWVLLPIVVYSGIAIAIFIPQTGFISNFFMNLGEGYIEGNLLAYLGTLAATVLVWCINRKVMTGLIYNEINKVEDTKVKTVSEYRFLERFGEVGEYMRLELKMLLRNKRCKASLRSVAMLVIIFSIILSFSSTYDHMKSFVQVYSFLGFGMVILIQLMGFEGNYIDGLMTRKESIKSLLTAKYYIYSLAEIIPLILLIPAFVMGKASLLGAVALIFLTTGPVYCILFQLAVYNHKTVPLNESITGKQSMNTGMQMLISFGLFIVPTTLYGTLPMLLGQTWAYIVILIIGLGFTLTSPMWINNVYVRFMQRRYENMEGFRDSK

SEQ ID NO: 8529 - protein, 264 aa, B.fragilis
IINMHTREEQMEAFGRFLDILDELRVKCPWDRKQTNESLRPNTIEETYELCDALMRNDKKDICKELGDVLLHVAFYAKIGSETGDFDMKDVCDKLCEKLIFRHPHVFGEVKAETAGQVSENWEQLKLKEKDGNKSVLSGVPAALPSLIKAYRIQDKARNVGFDWEEREQVWDKVKEEIAEFQVEVANMDKDKAEAEFGDVMFSLINAARLYKINPDNALERTNQKFIRRFNYLEDHTIKEGKNLKDMSLDEMDAIWNEAKKKGL

SEQ ID NO: 8530 - protein, 216 aa, B.fragilis
VYTMKQIIISIWIALLTLPVFAQQQMQAKVVLDKTAATFEKAGGICAEFNVTVFNKSRMAGQSAGVIELKGEKFVLKTDDGITWFDGKTQWSYLRSSDEVNISNPTGTELQGLNPYALLQIYRHGFDYKIGSLKNFGGKPVYEVVLTATDKKRDLSRIVLYVSKDTYQPLFIMMEQRDKSRSEITVTGYQTGLKYADGMFVFDKKQYPHAEVIDLR

SEQ ID NO: 8531 - protein, 884 aa, B.fragilis
TNKIDRYNMELASKYNPADVEGKWYQYWLDHKLFSSKPDGREPYTIVIPPPNVTGVLHMGHMLNNTIQDILVRRARMEGKNACWVPGTDHASIATEAKVVNKLAAQGIKKTDLSRDEFLKHAWAWTDEHGGIILKQLRKLGASCDWDRTAFTMDEKRSESVLKVFVDLYNKGLIYRGVRMVNWDPKALTALSDEEVIYKEEHGKLFYLRYKIEGEDGYAVVATTRPETIMGDTAMCINPNDPKNQHLKGKKVIVPLVGRVIPVIEDDYVDIEFGTGCLKVTPAHDVNDYMLGEKYNLPSIDIFNDNGTISEAAGMYIGMDRFDVRKQIEKDLEAAGLLEKTEAYTNKVGYSERTNVVIEPKLSMQWFLKMEHLAQIALEPVMKDDIKFYPAKYKNTYRHWMENIKDWCISRQLWWGHRIPAYFLPEGGYVVAVTDEEALKLAREKTGNPNLKMTDLRQDEDCLDTWFSSWLWPISLFDGINNPGNEEINYYYPTSDLVTGPDIIFFWVARMIMAGYEYEGKMPFKNVYFTGIVRDKLGRKMSKSLGNSPDPLELIEKYGADGVRMGMMLSAPAGNDILFDDALCEQGRNFCNKIWNAFRLVKGWENGMGTIDIPADAHLAVQWFDQRLDAAAVEVADLFSKYRLSEALMLIYKLFWDEFSSWLLEIVKPAYGQPVNGFIYSMTLSAFERLLAMLHPFMPFITEELWQQLREREPGASLMVQPLGEPGEVNEEFLQQFETAKEIISSVRTIRLQKNIALKEPLELQVVGANPVEKMNPVIRKMCNLSAIEVVDAKADGASSFMIGTTEFAVPLGNMIDVDAEIARMEAELKHKEGFLQGVLKKLSNEKFVNNAPAAVIEMERKKQADAESIIQSLKESIASLKNV

SEQ ID NO: 8532 - protein, 317 aa, B.fragilis
KYEIINIISMSVEPGKWGVIYNPKAGTRKVQKRWKEIKEYMDSKGVSYDYVQSEGFGSVERLAGILANNGYRTIVVVGGDGALNDAINGIMSSNAEKKEEIAIGIIPNGIGNDFARYWELNLEYKQAVDWIINNRQKKIDVGYCNFYDGEKHQRRYFLNAVNIGLGARIVKITDQTKRFWGVKFLSYLAALFLLIFERKLYRSHLKINDEHIRGRIMTVCVGSATGYGQTPSAVPYNGWLDVSVIYRPEFLQILSGLWMLIQGRILNHKVVKSYRTRKVKVLRAQNAAVDLDGRLLPRHFPIEIGIIPEATTLIIPN

SEQ ID NO: 8533 - protein, 526 aa, B.fragilis
FTEIKKIVIMVKRMISQLSVLAVLIVFMAACSKKAEYIHVIPADASAVASINLNSLADKAGLNDKQNEGMKQKMMEALKSGMNAAAFQQLEKIMKNPSQSGIDVKAPVFVFTSKTFISPTIVAKVSNIEDLRASLDLMAKEGICQPMAEEEGYSFTSLQKNNLLVFNENAAVLTEAYGTSQMDVAKQTISTLLKQTEENSIASNGSFRKMQDQKGDINFFASMDAVPKMYTQQISLGLSSQIDLSEVKAVGNLNFEKGKIALQIETYSDNAETDALLKKQAQAVKKLNTTFLQNFPESTLAFLNIGVNGAAFYDLLFNNEEFRRNVSLAKADEVKSLFASFDGDISIGLINVTLNSVPTFAAYADAKDGNALKALYDNKKQLKLGKNEDIIQLGENEYVYKSRATNVFFGIRNKQMYATNDELLYKSISKPVEKSIKDAGYVSDMKGKNVFFVINMDAILDLPVVKMMAGFGGEEYQTYYKLASKISYIEAFSDSEGKTETAILLKNKDDNALKQIVDFAKQFAGM

SEQ ID NO: 8534 - protein, 191 aa, B.fragilis
HIRITNEPMNPYNEREVLALLQDERTQKQGFERIVSQYSEQLYWQIRRMVLSHDDANDLLQNTFIKAWINIDYFRAEAKLSTWLYRIALNECITFLNKQRAMNTVAIDDPEADVTQKLESDPYFSGDRAELLLQKALLTLPEKQRMVFNLKYYQEMKYEEMSEIFGTSVGALKASYHHAVKKIEKFLEEAN

SEQ ID NO: 8535 - protein, 218 aa, B.fragilis
KNMILKRTISKEEVKEMPKAAFPGRIHVIQTESEAQKAVAYLQSQAILGIDSETRPSFTKGHSHKVALLQISSDECCFLFRLNMTGLTQPIIELLEDPKVIKVGLSLKDDFMMLHKRAPFNQQACIELQEYVRPFGIQDKSLQKIYGILFSEKISKSQRLSNWEADVLTDAQKQYAATDAWACLNIYHLLEELKRTGNYELAPEEEATEKVKVGSDQQ

SEQ ID NO: 8536 - protein, 287 aa, B.fragilis
CIRMELLLGIVIVVTCWMVVRIIRSSKNQEGYKRWRAGNYASENPYAKEKASGPLSQGLFSKRVRTTGARRFDDGAIRWCANLLATEESRLREVLDYIPRQYTCFHVRKRSGGFRYISAPAGDFRSMQQTIYHRILLLANIHPAVTGFCPGKSVSDNARVHLGRKNVLKVDLHDFFPSIRSPRVRAAFREMGYSRPIAKVLAELCCLRCFLPQGAPTSPALSNIIAYPMDKKMMALAGEYGLVYTRYADDLTFSGDYLPKDEVLVRIHRIIREEGFHDERQKDPLLV

SEQ ID NO: 8537 - protein, 838 aa, B.fragilis
SYSLRFIIHMAKKKSDKEAEQKPASTKKYVAFFRNETIHFVIGLVLVIFSVYLLLAFTSFFFTGAADQSIIDSGNAQDLAAVNNHVKNYAGSRGAQLASYLINDCFGISSFFILIYLAVAGLKLMRVRVVRLWKWFIGCSLLLIWFSVFLGFVFMDHYQDSFIYLGGLHGYNISNWLISQVGIPGVWLILLATGICFLIYMSARTIIWLRKLFSLSFLKRKQKEELAEVTQAPQSHEYDNPKPQEVEFDVNRTFRQEVPVKKVETTVVSETPVESSTEMPVTPEDRDVTSDGDVTMTFEQTAPDPVPPFRAASADKEPEFEIEPAADDENYQGAETEPYNPKLDLENYHFPTIDLMKHYENSEPTINMEEQNANKDRIINTLRSFGIEISTIKATVGPTVTLYEITPEQGVRISKIRGLEDDIALSLSALGIRIIAPIPGKGTIGIEVPNSNPKIVSGQSIIGSKKFQESTYDLPIALGKTITNEVFMVDLCKMPHVLVAGATGQGKSVGLNAIITSLLYKKHPAELKFVLVDPKKVEFSIYSVIEHHFLAKLPDGEDAIITDVTKVVQTLNSVCVEMDSRYDLLKMAHVRNIKEYNEKFINRRLNPEKGHKFMPYIVVVIDEFGDLIMTAGKEIELPIARIAQLARAVGIHMIIATQRPTTNIITGTIKANFPARIAFRVSAMMDSRTILDRPGANQLIGRGDMLFLQGADPVRVQCAFIDTPEVEEITKYISRQQGYPTAFFLPEYVSEDSGSDLGEVDMGRLDPLFEEAARLIVIHQQGSTSLIQRKFSIGYNRAGRLMDQLEKAGIVGPSQGSKARDVLCVDENDLEMRLNNIQ

SEQ ID NO: 8538 - protein, 134 aa, B.fragilis
LIILNTKNLKLKKDEPLMMIEVLKSKIHCARVTEANLNYMGSITIDENLLDAANMIAGEKVYIADNNNGERFETYIIKGERGSGKICLNGAAARKVQPDDIVIIMSYALMDFEEAKSFKPTVIFPDPATNSVVK

SEQ ID NO: 8539 - protein, 310 aa, B.fragilis
FTIFLLYMVNYGLFCTVFRTTKNHKPIKMKVIHTIKDLQAELSVLKAQGKKVGLVPTMGALHAGHASLVKRSVNENEVTVVSVFVNPTQFNDKNDLVKYPRTLDADCKLLEACGATYAFAPSVEEMYPEPDTRQFSYAPLDTVMEGAFRPGHFNGVCQIVSKLFEAVKPHRAYFGEKDFQQLAIIREMVRQMQFDLEIVGCPIVREEDGLALSSRNARLSAEERENALKISQTLFKSRTFAATHTVSETLKFVEDAIAAVPGLRLEYFEIVDGNTLQKVDNWNQTSYVVGCITVFCGDVRLIDNIKYKES

SEQ ID NO: 8540 - protein, 288 aa, B.fragilis
NRLSLLRSIICNMCNLSDESKQFEMTPPSSNLSSLFPTGRAVRNPLGKVYFVVILKGKAMVRIDGKSMLLPERTFLFLPPGHLLLRLSCTQDFLFQYLSFSFDFLSDFPLLLKADISNQVTNAPCLPMSPEDFSLIKMYYHFIYHRYSDAECPSEVIKGMLFSLVLEVCRMYSGRNISVEMSRQDKLVDGFFSLLHKYCTQERMAAFYASRLCISDKYLMRSIKKQTGQTFHYWMADFILREAKLMLRSTDLSVTEIADKLSFPNSSSFARFFRKYTGFSPVQFRNEA

SEQ ID NO: 8541 - protein, 323 aa, B.fragilis
KTVSLHPEKMNIIMNINSKAKGFVCGAVAAATYGMNPLFTLPLYKEGMSVDSVLFYRYGFAVLILGILMKVQGQSFALKKNEVLPLIVGGLLFSASSLLLFLSYKHMDAGIASTILFVYPVMVALIMFLFFHEKVSLLTVFCILLALSGIGLLYKGEGGETLSLVGMLLVILSSLSYAVYIVGVNHSTLKLMSTAKLTFYALLFGLSIYIVRLNFCSDLQAVPSLPAWGNILAMAFLPTVISLVCTAVSIHTIGSTSTAILGALEPVTALFFGVMIFGERLTPRLMLGILMILVAVTFIVVGKPLMTFLKEEVAGGMKRKLTR

SEQ ID NO: 8542 - protein, 269 aa, B.fragilis
SMQSFRVIKPTAALVPYVRHYWVLSDDALAPVSERTLPVGCVQMVFHRGRQLFSLTEGRLQPSSFISGQAFGYSDVESTGMLEMIVVVFQPFAAKAFLHMPVSEFRGMNVNTEETGDPLLVDLGRRIADMPDRVACIRLIEEFLLSRLYAFPEYNLKRVSTVWEAVNLHPHIRTAQLADVACLSNKQFGRVFAEYVGATPKEFLRIVRIQRALYTLQCQPGISFAQLAYECGFFDQSHMIKEFKLFSGYTPAEYLAVCAPYSDYFSVEE

SEQ ID NO: 8543 - protein, 165 aa, B.fragilis
EIRSMKQQETNPDSLIENYLPADYYDSFSKELHNKNAISTDEFADIVFNQLPSWIIRLLKVRNCIVKPFGLNTNRRITDMECERNQHEIIFGMSDKHLTFYVSLWCKVSEANSQTLRITTIVKYHNRLGKLYFFVVRPFHKVIIRSLLERVEKRYKLISLEREAS

SEQ ID NO: 8544 - protein, 291 aa, B.fragilis
KIDPNSFSYLCVLWRHKSDNYKAANDRNTEKQKSAYRMNTPLQPYRIGNSTLLSNRKTTAFLCSRQVPENKIPPIYNWINQLSPEKDCILCGNHSRMEQEVFNILLEKKIPVILALAEGMKKEWDNKVKLALEENRMLIVTTCDDKIHRINHQSAYDRNETILSLADDIIIGYCTPGGNIDRQTKGKTNITYLQKSDYLSTELIFTDKVADSDVMIYRTSTKKGKIFLDIKQESSGQEYLKITQSKPQGNSAFHRETIFIDKNEVLQFKEELEKVIDYWKISTIKKNQTPI

SEQ ID NO: 8545 - protein, 430 aa, B.fragilis
RQVPTIPRIDMVYDAFKAYVIGGKAPDTISEVVKDIYTYSGYYVNMVLHKEPDKLLCGAFKRISQLRVDVSYPFLLPLYNDYVNEVISRDEFYEALCLVENYVFRRAICGIPTNSLNKTFATLYKSFDKANYMDGLKAAFLLLDSYKRFPNDTEFTTFLQTKDVYNFRNRNYLLNRLENFQRKEMVNISDYTIEHVMPQNPNLSHEWQEMLGEGWVEVQGKYLHTLGNLTLTGYNSELSDRPFQEKKSMEGGFDDSPIRLNSYLRRISSWNEEQILVRAGQLAEKAKEIWRFPLLSPETLEVYRSAERDPAEYTLEHYEYLKGDILTLFQALRRRIMNIDPSVKEELKKLYIAFKAYTNFVDVVPQKSRLRLSLNVAFADILDPKGLCKDVSNLGRWGNGDVEVGISNMNELDDIMELIQQAFDKQMEAN

SEQ ID NO: 8546 - protein, 283 aa, B.fragilis
ILSPMIEAPEARLLCEQLNKTVCGKRITDVFAQYTPHKFAWFYGKPEECAERLVGKTIDRACPQGGMVELTAGDTMLVLTDGVNLRYFEPGAKLPSKHQLLVAFDDESCLLASVRMYGALLCFTQGHFDAPLAAYYETARTKPQVMTDAFDKEYFLGLVNAPEAQKKPAKAFLATEQTIPGLGNGVLQDILYHAHIHPKTKIDKLGAKEKEKMYEQVKETLQDIYHLGGRSTETDLFGVPGQYVASLSKDTAGHVCPKCGETIVKENYLGGSIYYCRGCQVMK

SEQ ID NO: 8547 - protein, 338 aa, B.fragilis
ISSPRVKTFSWELDLWGNLRWARSASIAEYLQSVEAQRALRMTIIAEVAQAYYELVALDTELDIVRQTLKAREEGMRLARIRFEGGLTSETSYRQSQVELARTATLVPDLERKISLKENDIAFLAGEYPNKITRSRLLQEFNFPQELPVGLPSGLLERRPDIRQAEQKLIAANARVGVAYTNMFPRISLTGRVGSESTALSELLKSPYSIMEGALLTPIFGWGKNRAALKAKKAAYEAEVHSYEKAVLTAFKETRNSIVNFNKIKEVYDLRAKLERSAKSYVDLAQLQYINGVTNYLDVLDAQRGYFDAQIGLSNAIRDELIAVVQVYKALGGGWQVQ

SEQ ID NO: 8548 - protein, 560 aa, B.fragilis
VRITNTFKYKIKKMTKSALQIARAAYQPKLPKALKGSVKAVEGAATQSVADQEAIQKLFPNTYGMPLIKFEEGEAIQLPAMNVGVILSGGQAPGGHNVISGLFDGIKTLNKDNKLYGFILGPGGLVDHNYMELTADIIDEYRNTGGFDIIGSGRTKLETPEQFEKGLEIINKLGIKALVIIGGDDSNTNACVLAEYYAAKNAGVQVIGCPKTIDGDLKNEMIETSFGFDTACKVYSEVIGNIQRDCNSARKYWHFIKLMGRSASHIALECALQVQPNVCIISEEVEAKDMSLDDVVTYIAKIVADRAAQGNNFGTVLIPEGLVEFIPAMKRLIAELNDFLAANAVEFANIKRSRQREYIISKLSKENAEIYASLPEGVARQLSLDRDPHGNVQVSLIETEKLLSEMVGTKLAQWKEEGKYVGKFAAQHHFFGYEGRCAAPSNYDADYCYSLGYTASMLIANGKTGYMSSVRNTTAPAAEWIAGGVPITMMMNMERRHGEMKPVIQKALVKLDGKPFLTFAAKRDQWALNTDYVYPGPIQYFGPTEVCDQPTKTLQLEQAK

SEQ ID NO: 8549 - protein, 968 aa, B.fragilis
KGNTSEVFYENKICISFVLFILCLIYPNNMKKHLILMISAAIIPLLLYACSAEEERALTSTTLEVAQSAIDFKSDAGTRDIAIVTNADHWTARSDKDWCSVAVNESTLTVNVSGYDGKETREAVIKVTADGLAETVNVRQLGSEPAILISQQIFTVEASGSDIAFDVTTNVSVTITLPEWIKEKPAGTRASEMVTTTHNYIVTANPEDSERTGNITVKEVGGELEALVSVTQKGLGEYESGNLEGIKDDIKVPVESGEASSFQGGSNIDKSFDGDMSTIYHSNWNNAGDHYFPITLTYNFAAGSDMDYLIYYPRTSGPNGNFKEVEIRVKSNANTRGTDEWNTVMTKNFGGTNAAVRVNFPKAQIGVTSVQFIVKSGSGDGQGFAACAEMEFYKKNPDAFDPLTLFTDGTCSELKPGLTDEEIENCPYSFYKNIAYYMKQGKYPAEFRIQEYKAWPHPDAQSETHKTSPYSLRDNPTGISVKDGEQLMIFVGDTHGQTVSAVIQNLDVPGGDGFGGTSYPLSEGANKITARNKGLMYILYHTPDYETAQPVKIHIASGQVNGYFDVAKHQASDWNKLLSNAVDKYFDVVGHYAHLTFPTERFRTHTPDGKALIDAYDQIVNSEMELMGLYKYNKLFKNRMYLHVMYTSYMYATSYHTAYNDGTLAELCNVDKLKTSACWGPAHEIGHCNQTRPGLKWLGTTEVTNNIMSEYIQTTIFGQPSRLQTEDMGDGSRNRYSKAWTQIIAAGAPHGNFGSDSDVFCKLVPFWQLELYFGKVLGRTPLQQSDKGGFYPDVYEYIRTHDNLRTAGEQQTEFVYICSLIAKANLLDFFTKWGFLTPVDITVDDYGTGKLTVTQARIDEIRSRVEALGYPKPDVALEYITDNSVELYKDKPGIVAGTATRSGSTFTMTNWKNVAAYEVVDETGKKVCISDGLLAPSGTATFTMKTAWKDGFKVYAVSATGARTAVTF

SEQ ID NO: 8550 - protein, 176 aa, B.fragilis
TIKTIYSELTLLTGKQYTIMNLLIISNADSCRSRIAQALLSSFGKGMKVYSAGTMPAAEIHPLVLKLIKETGIEPNTQPPHSIREYTNENWDHIIVLSGTADDIRNLFRKEVKHWYHLPFEDLFSTAAPSEAELWDRLIRLKEDIQRKMYELYRDDLREQLLPRCSCGANDFCRCE

SEQ ID NO: 8551 - protein, 62 aa, B.fragilis
KRLTDSAEQAKRVRSAMELQKQGCKLRALRLLCGIPVENKIIIFFHNSEKNTKFATLLSSNY

SEQ ID NO: 8552 - protein, 395 aa, B.fragilis
PFYLSESIDSLTNAFFETMSGFTTTGATILDDIESLSHGMLFWRSLTQWIGGLGIVFFTIAVLPVFTSGGVQLFSAESTGVTHDRTHPKINVMAKWLWTVYLILTLAETILLMLGGMSLFDAVCQSFATTATGGYSTKQASISYWNSPFIEYVVAIFMLLSGVNFALFLMCLRGKVSRLLRDEELRWFLGSVAILTFLITFALVFQNHYDWETAFRKSLFQVATAHTSCGFATDDYNLWPAFTWLLLLIAMLSGGCTGSTSGGIKNMRLLIIARSIRNEFKHLLHPNAVLPVRVNKQSVSPSIVSTVGMFFAFYLIIVILGWAVLLFLGVGFSESIGTVISSIGNVGPGLGSCGPAYSWNGLPDAAKWVLSFLMLIGRLELFSVLLLFYPGFWKS

SEQ ID NO: 8553 - protein, 250 aa, B.fragilis
LLYFLCDIALVPLELWYIAASVALVLIVGGLWMHLNEGSTPMDKYIEITAQKSRMYLLPDSSKVWMQPGSSIRFAEDFKKHRNVWLKGNSLFEVHKNMGRKFRVYIDKAFIEVKGTCFLIKQNNPSANEITLFNGSIEFNVESTQHKIEMKPLQELVYNPADAGTQLRQIENIEWQNGRYNFTQFNLEHLTRIINQMYGSRIIISDKVNKNCAFTGSIRYDESLEDVIDKICFSLNLRKKEINHEIIIYN

SEQ ID NO: 8554 - protein, 316 aa, B.fragilis
SMKASSNNLLSIIKGPRQFVIPIYQRTYSWQLVQCNQLLNDILRISNDSAVQGHFIGSIVYFQESIHTVSDVPKLLVIDGQQRLTTVSLLIAAIADFIKENAVEIDTSFTKLQNYYLINPEEDNELRYKLLLTRRDKDTYINLLKGIPRSEGMSQRIIENYDFFKSKINKENVVAIYSGVQRLFVVDVALEKEKDNPQLIFESMNSTGLDLSQADLIRNYVLMGQEVHLQTSLYESYWYPMEQGYGSEYAALFNSFMRDYLSVKTGTYHSSYRYGVRCFQGLCDRGKSSRYYQRSSQRHLYLFRILRQHGSSQRAG

SEQ ID NO: 8555 - protein, 431 aa, B.fragilis; identical to SEQ ID NO: 6067

SEQ ID NO: 8556 - protein, 134 aa, B.fragilis
LPAYSIHLINIKNMEKFIAFFEIPAADFHRAVGFYETVLDIKLAVSEYEEEKMACFMEQGEAVGAVSWAPDFLPSERGTLIHFYCEEIGKSLERVLQKGGKVITPETEIDAEGRGHFAVFADSEGNHIGLYSDK

SEQ ID NO: 8557 - protein, 256 aa, B.fragilis
NRKYIVVLAKRIIPCLDIKDGQTVKGTNFVNLRQAGDPVELGRAYSEQGADELVFLDITASHEGRKTFAELVRRIAANISIPFTVGGGINELSDVDRLLNAGADKISINSSAIRHPQLIDDIAKHFGSQVCVLAVDAKQTENGWKCYLNGGRIETDKELTAWTKEAQERGAGEVLFTSMNHDGVKTGYANEALAELASQLSIPVIASGGAGRMEHFRDAFTLGKADAALAASVFHFGEIKIPELKSYLCGQGITVR

SEQ ID NO: 8558 - protein, 186 aa, B.fragilis
LLKQMQEKEIVRKLKHGDQEAFAFLYNHYWKQVYNFTRLYFTASMDIEEIVQEVFVKVWESHHFLDENKSFEGYLFIITRNVIFNHSRRYYKETALKITAIQAVEESYDMEGELDAADLKKYIDELVMQLPPRQREVFRMSRELHMSNREIAEHFSITEKAIERHINLALKFLKKNLNLFMLFMAA

SEQ ID NO: 8559 - protein, 83 aa, B.fragilis; identical to SEQ ID NO: 6082

SEQ ID NO: 8560 - protein, 194 aa, B.fragilis
NEFKTITVMIKQTAEIFEILSKGGFISSDSTNPNIRQLYTVIEDNQSELYDFFAAINFVLESGNEYYYFSRRENKVDLERKLEIAVRWIDVLDFIKTYDAAFSSGFRFQPADMVVKVGTDLELKEKLTGLKKLTGREKHEEMIDKIVNDLKRDGFIELENEITSTYKVVAAFGYLEELVACINIPEEIQNEIPE

SEQ ID NO: 8561 - protein, 205 aa, B.fragilis
YNYKNKRIMKQEVLFIILNEYADWESAFVAASLHSGLMPGSEIKYIVKTVAPTLDAVCSLGGFRTLPDYSFDNLPSDYTALVLIGGMQWQSAEAERVFPIVQDAFEKGKVIGGICNAASFLCAHGFLNKVKHTGNTLAVLKQWGGERYTNEDGYLEKQAVGDKNIVTANGTGYLEFTRELLLALKADTQEKIEAFYDFSKNGLVR

SEQ ID NO: 8562 - protein, 1126 aa, B.fragilis
SMNKFLFSCQKRCLKYIVMALLLYPLSALAAQGQIVVKGQSLTIPQAIRLIEKSSQYTFFYNANDLKNTTLKSIDCKGSIDDVLNEVFKGSNISYVIKGNEVILKVEKTESTQQKKAKIIGIVTDSKTGEPIIGATVQLLGTTTGVITDVDGKFELAAFPKNEIQISYIGYVTKKVKVGSQKVMSITLAEDAQQLDEVVVTAFGTGQKKETITGSIQSVRPSDLLVPSANLSSSFAGRLSGVIAYQRSGEPGQNSADFFIRGVATMNGATSPLIILDGVEVSKADLNSLDPEVIESFSVLKDATASAMYGTRGANGVLIVKTKSGSDLDRPIIGVRLEGYVNTPTKKPEIVDGPTYMRLYNEAVTNQGTGAVLYSDEKINGTIHNLNPYIYPNVDWYKEVFKDATFNQKANFNVRGGTSKITYFMNVNMNHETGMLKDRSSDFFSYKNNIDYMKYAFQNNVDFHLSKSSTISLHLNVQLNDMHGPLTTKDGNGVGDIFSAIMGTNPVDFPVMFPQGSNTWYHWGGILAGNYQPLNPVALSSAGYKDTFESTVVANVNWDQKLDFITKGLSFRALVSFKNWSYNQKFRLQGYNSYQLSDYKQNEDGSYDFTNTPIGEPSNHTMDAFFGTNGDRRFYIQGYLNYERSFGSHNVSGMLLYNQDDYNTNVNSSLIASLPKRKMGVAARLSYDYDHRYMLEVNAGYNGSESFAKGHRWGLFPSISLGWNISEEKFWKPIKPVISNFKVRGSYGLVGNDQIGSDRFAYLAIVNLTESPSYTTGYGGSTTSLSGPTYNRFQNNELTWEVGNKLNVGVDLQLFNSLNITVDGFREIRDNIFQQKNSIPNYLGTASTKIYGNFAKVKNTGFDLALDYGKQLNRNFSIQMKGTFTYAHNEVLKYDEAAGLRPALSQVGKSLNSIWGYVADGLYIDEADIANNPQSTIGNIAIAPGDVKYVDQPDASGNYDGKITSDDRVVLGYPTIPEIIYGFGPSITWKNWDFSFFFQGQARVSFMMSGFEPFGTQSKNNVLKWISDDHWSKDNQNPNARYPRLTQYNNNNNTASSSYWAANASFLKLQNAENRYRFKWARIYVNGSNLLTFSPFKLWDPEMGGGAGMKYPTQRTYNVGIQLTFK

SEQ ID NO: 8563 - protein, 102 aa, B.fragilis
QRLKLSKNRIDQEKRVVELMIRLYCRKKEKNVTLCPRCEELLHYAHARLDHCPFGEKKKACKQCSIHCYKPAMREQMRRVMRFSGPRMLIYAPWEAIKHLLG

SEQ ID NO: 8564 - protein, 89 aa, B.fragilis
HKINLNIIIKMNKSNKETNLIKKLLADQLDKKERKKLYYSNLIEKQMRKQWKENKNTPVENEIGNKIWDKIENQCIKVHKRIVPLELIQ

SEQ ID NO: 8565 - protein, 96 aa, B.fragilis
PIKNRKRMEQKFCQSCGMPLNPEVLGTEKDGSKNEEYCTYCYADGHFTVECTMDEMINQCAQFVDEFNKGSEVKMTKEEAIANMKQFFPMLKRWKQ

SEQ ID NO: 8566 - protein, 287 aa, B.fragilis
KSMKSSRNTSTSGKPASGRRTPARKTKAKKKTTRTMPVWMRNTLALIVVGVFSLTFYYFVIRPYSYRWKECYGRKEYGVCIPCGYEVHGIDISHYQGNIDWKELKQNRETDFPLHFIFMKATEGGDHGDDTFKDNFEQARRYGFIRGAYHFFTPRTDALKQADFFIRTVKLDSGDLPPVLDVELTGKRPKKELQQNIKKWLDRVEAHYGVKPILYTSYKFKTRYLDDSLFNAYPYWIAHYYVDSVRYEGKWHFWQHTDIGSVPGIHHDVDLNVFNGSLEELRKMTMR

SEQ ID NO: 8567 - protein, 137 aa, B.fragilis
YTMKSLNERAADLLQGCETVILSSVNQEGYPRPVPLSKIASEGISEIWMATGEHSVKTKDFRSNPKAGLCFYEQGNSVALTGEIEVVTDAGLKQKYWQDWFIAHFPKGPTDPEYVLLKFRSEHATFWIDGQFVHRNI

SEQ ID NO: 8568 - protein, 302 aa, B.fragilis
REMKMKKILLGLCVILGLINMIGCSSDEKYPMPTSIDQNSLSAEAKAGAIKLKWTVPADSNYYYVKVTYTLPEDGKKCMRLASVNSDTMLVDNLLHRYGDINFTLQPCNRAGEASQSCSIMAQALPALKQIKTDRNPITLSAKQLYTDDQESSEGPIANLVDGRNDTYFHMSWSSPTPFPHYIVVDLGEENALSTFLFSYVCRDNNNKDNPKEMDILGSNTFDGKNYDESQTTLLASLSNLPNTKAASYESDIIKAGASYRYLWFKVKSSTSGSNWIALAELGLSKVIVKTYDPETGETTIE

SEQ ID NO: 8569 - protein, 360 aa, B.fragilis
KESDSYMMTLNDFENYVPCKIWARGEEYYECDAVKDLEETEPGEWIATVEGTEDYEVEISLEGKKIIHWSCDCPYEGDICKHVVATVLAIRNNRSGQKRFLSAREAKLMEKQQATLKDKKVEDILAFVPSDQLSDFVLEYASKHTECKQALLEKFLPKPQANGKSPKNYGNDIRKCFNDSYVETKGRYGGYYEPTMDWNKVGCELNKYLKKAKLLVEQHCFEDAAAIATGILRAIGENYIEEDLVYHNEFEANFYCECSGELLLEIIYRPEITGSQKIMILNEVRQIEKLDTYREYDVYDIDLLLSQITIATQTQEEALTYINQLIEERKSSWELYKLIEKKINISLIPQHYNLTLFISS

SEQ ID NO: 8570 - protein, 88 aa, B.fragilis
KMEEYEVIHRPERNRFELEKNGMTAFVEYEVEDGALDIMHTIVPPPLEGKGIAAALVEATYKYASAQGLKPKATCSYAVAWLKRHPAE

SEQ ID NO: 8571 - protein, 73 aa, B.fragilis
KVRENTPTTISARVLRIQTGMVRVVFFFAFVFRAGVRRPEAGLPEVEVFREDFIDFYSYLEFDSPQITRIFTD

SEQ ID NO: 8572 - protein, 234 aa, B.fragilis
RLMDETLIHYTDVEIHQQELCVLSEVNLQLHKGEFVYLVGKVGSGKTSLLKTLYGELDVTAGEAEVLGYRMTSIKRKHIPQLRRKLGIVFQDFQLLTDRTVNDNLEFVLRATGWKNKQEIKERIAEVLNLVGMENKGYKLPNELSGGEQQRIVIARAMLNSPEIILADEPTGNLDVETGKAIVELLHNICQTGSLVVMTTHNLQLVAEYPGQVYRCAEHRIVNVTDEFVKKENN

SEQ ID NO: 8573 - protein, 69 aa, B.fragilis
RIAEELMEILSAPALSRRSTSLNSLIPPPTVNGILILAAIRRTSSAKVLRPSWLAVMSRKTNSSAPCSL

SEQ ID NO: 8574 - protein, 128 aa, B.fragilis
LFTCTFSFRFGTILAICLSQKKSCVMEEYLSADIYVSKRNNSLINGKMIGRVLGILLFIEAGMFVLCSGISVVYGESDYKYFLYTAGINLLSGALLVFYGRGAENRLSRRDGYCIETLSWVFFTLFGM

SEQ ID NO: 8575 - protein, 257 aa, B.fragilis
KWTCEIATYSSSIRDNMKKGFTILLFLFSLAEVYAQTEFTTCLFDSSRNRIVPVAIYQPRKETPKTRVIIFNHGYDGNKNDKSNRSYSYLTRFLAEKGYYVISIQHELSDDPLLAMEGNFMETRMPNWKRGEENILFTIREFKKLKPNLQWEKLCVIGHSNGGDITMLTATDHPELIMKAISMDHRRMIIPRTQKPRIYTLRGCDYDADPDVVPTSEEQKKFRIEVVRLDGVTHSNMGENGSAEQHDLINRHIYILK

SEQ ID NO: 8576 - protein, 61 aa, B.fragilis
SIPRIGWATRSQSRSHITDTGDHRTDGLGKADTQEQENCPTKNDDDKIKSKKHTHSRHNRR

SEQ ID NO: 8577 - protein, 65 aa, B.fragilis
VKLRALILRYKESVLIRVIRGEPKNGSFSEQASIRTVYSAGCRFSHATAYEHVALGFNPCAEAYL

SEQ ID NO: 8578 - protein, 274 aa, B.fragilis
SMYREYQPCGLLAPYVDKIWEFKGSPEYGMRINVLPDGCTDLIFALGGITQPVGNEGRIMPSCRSFFVGPMKRYSELVAYTETVHMVGIRFHPCGLFRFMDLPVQELGGQRISSADLGIKLFDDSFTERLYELPDLRSRIQCIETVLVRSMHKHDVVDKQIVFAVNHIHLYHGQREIRLLAEDTCLCQRHLERRFKLFTGFTPKEYSRIVKFRQAIDLLKNTTEANNLLSVAVNAGYYDVSHFLKEVKTLSGGTAESFLSPTLPQEGLLTYIEK

SEQ ID NO: 8579 - protein, 244 aa, B.fragilis
IENRQMIELIPAIDIIDGKCVRLSQGDYGSKKVYNENPVEVAKEFEANGIRRLHVVDLDGAASHHVVNYRTLDLIASRTSLIIDFGGGLKSDEDLIIAFENGAQMVTGGSIAVRNPDLFCRWIDRYGSGKIILGADVKDRRIAVNGWKDESTCELFPFLKDYTQKGIEKVICTDISCDGMLAGPSLDLYKEILAEHPTLYLIASGGVSSIADIEALHEAGVPAVIFGKALYEGRITLKELQAFL

SEQ ID NO: 8580 - protein, 60 aa, B.fragilis
TLPRGLRTALPVGKSDERLLLGGVISNCFDSSDRLHILHIIDLSKDKRFYRNNDLLLVTI

SEQ ID NO: 8581 - protein, 639 aa, B.fragilis
YILMKIIYKLLFLFLLTIGYSSCDFLDIVPDEITTEADAFKDRNAAKNFVYSCYGYLPQSNVASGSLDLLTGDEVITAFEHETFASFPKGNYTASSPVISYWNTFFQGLRQCYIFLENVDKVPDLTESVKTDYIAQVKFLIAYYHYQLARCYGPIILIKELPDVNASQAEYLPRTSYDECVDWICNLLDEAASSLPAIRTNKEDYGLATSVGAKAVKAKMLLYAASPLFNGNSSFYSNFTDKSGSQLMPLTYDPNKWVKAKTAIKEAIDLAEQNGHALYVKQDYKIGNEDANPYPAAGPVRCLRTSLVDWDSRNPEVLLAETRSEGSYGIQNKSLPFVTDGWAWNGVGPTWTMLNRFYTKNGLPWDEDPEYKDKDKLKIVNVDASHADEAHEGSKTLLFNLDREPRFYAWVAFQGGYYEVMNGSTNPAYVMSNGKKDNSDSRLICDFVLGGNCSRGTATVQRPGNYTPSGYLNKKGVDPNTVVSTNATKLNQYPWPIIRLADLYLAYAEACVETNDLETAKQYLNKVRERAGIPTVETAWSGVAALDQTKLRQIVRQERMNELYLENQNFWDMRRWLLAGQYFNVKAKGLNIAATTIEDYAIVKTIDFERKFEAPTQYLLPIPSADINRNEKLVNNPGY

SEQ ID NO: 8582 - protein, 395 aa, B.fragilis
SNNITMTKRIGNSRLYILIFIGIVSAFGPFVTDFYLPALPVLSEYFDTTASLVQLSLTFSMVGLAVGQLIIGPLSDKYGRKLPLMVSLVIFCISTVGCLYSPEIHGFIFARLLQGLSGAGGVVISKSIAIDLYQGKELTRFFAMLSSVQGLAPVCAPVLGGILLGAMDWKGIFWILLAIGILLIVALSAFKESLEIKKRQKGNVFSTFKYYLPVLRNRQFMRYVLIQAFAMGVMFTYIAASPFIFQNHFGTSPFAYSLCFGVNALGIMLGSLAVSRFKDATAALRFGVAGFTTMSLPVAAALIFSPSVWIVEGTLFFLLAFLGLILPGSTTLALDMERKNSGNASALLGFLMFVFGGLLSPLTGIGNMLYSTGIIIVACCVGTWFFTYKATSSAR

SEQ ID NO: 8583 - protein, 105 aa, B.fragilis
LKNMYLCRQIKKRQPLELLILYLVIVNTVSFVMYGIDKRNASRKRWRTPEVHLLGIAVAGGSLGAWAGMYTFRHKTRHLKFKYGIPVIGVLQVGMAICLLLSEFT

SEQ ID NO: 8584 - protein, 81 aa, B.fragilis
SISIIKIHREDIWISIKYLRHLIELLVLASKTKDVSFVIRQKEETQGNTVEIYSITLLKDIHTNRTDYAILLNVPDTVIAY

SEQ ID NO: 8585 - protein, 247 aa, B.fragilis
LRILGILRSLRREEEVQATIDTYLYLPEIRKHEVQRFIANRQYDSAILLLDEGIRIAQKNRYLGTIRDWLEQKLSIYEETNQTVNIIDLCQQLFISGNGDITYYHKLKKLIATNEWKKFLSGLMKQITFSGHGYSGQCNKMDIYVEEKDYENLLKMLSDHHSSLDMLMHYSHHLDNNYSTEIMQLFTEQINRYAEMNIGRNHYEYIEQVLKEMKKLKDGKKTVEDIVKKFRIAYKRRPAMMETLSKF

SEQ ID NO: 8586 - protein, 206 aa, B.fragilis
IRTMDLDFDKMNGLVPAIIQDNDTRKVLMLGFMNKEAYEKTVETGKVTFFSRTKNRLWTKGEESGNFLNVVSIKEDCDKDTLLIQVNPVGPVCHTGTDTCWGEKNEEPVMFLKLLQDFIDRRHEEMPEKSYTTSLFQSGINKIAQKVGEEAVETVIEATNGTDDRLIYEGSDLIYHLIVLLTSKGYRIEDLARELQIRHSDSWTKH

SEQ ID NO: 8587 - protein, 407 aa, B.fragilis
PLYMTTFHSIDELLKMMSREQLLLKQMFGKRKQQSFRREYALELTEYKLQRIQSLIDHGVLRENGSFLEMEDIYLHFFEQVLEINEEINTSFVNEHISYLKDTISYYQQENHEKRKTTYLRTIKRILRNIALTTLRNVIDLKRNIDSTFKNEPNYQIKKKKLVRLDEKRRDIEALIRVSEELLVTEEDRFFRRVPDDELVLVVANVRIQLNECFHNLIEIQKQIISYLNRIEYQNKIRVKIRQLKYLKDQFELEERTDICRVLMQKDSVWFEPAPAYPLRLSVEYLRNDDEVLESIRKVIATVGKRAILARNVADSIAEESLETHISEEAYINLEEVKKRFMQADGDLFSFVAAYPFTQEVSFDERITFYCQIVSQFYEELRITDEYGRMDGVEYALIYPERTGEIV

SEQ ID NO: 8588 - protein, 68 aa, B.fragilis
LNIIETELNDYPQFKKKVSFHDKTTKLKKELKTLIKTWDKYTKDLRIFLFVDDIDRYSEKKIIQSIDS

SEQ ID NO: 8589 - protein, 199 aa, B.fragilis
NIKMKVAVIKYNAGNIRSVDYALKRLGVEAVITSDKEVLKAADKVIFPGVGEAETTMLHLKESGMDRFIKELRQPVLGICLGMQLMCRFSEEGNVDCLGIFDTDVKRFAPRKHEEKVPHMGWNTISCLKSDLFKGFTRDEFVYFVHSYYVPVSEFTAAETDYIRPFSAALHKDNFYATQFHPEKSGEAGERIIKNFLEL

SEQ ID NO: 8590 - protein, 390 aa, B.fragilis
LFKMKTVFPIHKFRELPTPFYYYDTKVLRDTLACVNREVARYDNFSVHYAVKANANPKVLTIIRESGLGADCVSGGEIRAAIKAGFPAGKIVFAGVGKADWEIDLGLDYDIFCFNVESVPELEVINELAAAKGKVANVAFRINPNVGAHTHANITTGLAENKFGISMHDMDKVIDVALELKHVKFIGLHFHIGSQILDMGDFIALCNRVNELQDKLEARHILVEHINVGGGLGIDYDHPNRQPIPDLADISRTYDEPLKFRPHQTLHFELGRAITGQCGSLISKVLYVKQGTNKQFAILDAGMTDLIRPALYQAHHKMENLTSEDPVVETYDVVGPICESSDVFGKAVDLNKVKRGDLIALRSAGAYGEIMASGYNCRELPKGYISEELV

SEQ ID NO: 8591 - protein, 377 aa, B.fragilis
RKKIINIHTNFNTVTKMKVLKFGGTSVGSAQRMKEVAKLITDGERKIVVLSAMSGTTNTLVEISDYLYKKNPEGANEIINKLEAKYKQHVDELYATEEYKQKGLEVIKSHFDYIRSYTKDLFTLFEEKVVLAQGELISTAMVNYYLQECGVKSVLLPALEYMRTDKNAEPDPVYIKDKLQAQLDLYPDAEIYITQGFICRNAYGEIDNLQRGGSDYTASLVGAAIHASEIQIWTDIDGMHNNDPRIVDKTAPVRQLHFEEAAELAYFGAKILHPTCIQPAKYANIPVRLLNTMDPHAPGTLISNDTEKGKIKAVAAKGNITAIKIKSSRMLLAHGFLRKVFEIFESYQTSIDMICTSEVEFPYLSITPSISTRSWMT

SEQ ID NO: 8592 - protein, 446 aa, B.fragilis
KKEIQMNIAISGASGFIGKHLTEYLTEVGHRVIPLGRPMFREGTSGHLIQALSHCDVIINLAGAPIGKRWTPEYKKELYDSRIKVTHCIIRAMDAVKTKPRLMISASAVGYYPEEGTFDEYTNTRGSGFLAELCYAWEKEARRCPSQTRLVITRFGIVLSPDGGAMEQMLRPLRITRVAGVIGPGTQPFPWIAIQDLCRAMEFIISHEEASGVFNLVTPQQVSQYAFTQAMAARYHAWMKAVVPRWFFRMRYGEAASFLASGQNVRPTRLLEAGFRFAKPTIEDFFEGTDHAAVDRLDLHRYMGTWYEIARFDHRFERGLSEVTATYTLMPDGTVRVENRGCKHKKPYDVCKTAEGRAKIPDPSQPGKLKVSFFLSFYSDYYVLELDQDEYNYALIGSSSDKYLWILSRAPILPEEIKKKLLDAATRRGYDVKKLIWVEQREKKIM

SEQ ID NO: 8593 - protein, 320 aa, B.fragilis
SGPICRPEDSPYLCHMAERNELHKRNRHNGQYDFSRLTEEYPPLKKFIVLNAYGTTSIDFFNPRAVKALNKALLISYYGIRYWDIPKNYLCPPIPGRADYIHYIADLIQPDISDESTGLKTAVPNTRQYRCLDIGVGANCIYPIIGQTEYGWTFVGSDIDPVSIDNARKIVTCNPALAHKIELRLQQDSRKIFEGIIAPNEYFDVTLCNPPFHSSKEEAEDGTLRKLSSLKGQKVTKARLNFGGNANELWCEGGELRFLLTMIEESRNYRKNCGWFTSLVSKEKNLGKLTAKLKSTDIAEHRIIEMHQGTKTSRILAWRF

SEQ ID NO: 8594 - protein, 303 aa, B.fragilis
QDRITALSVKPATFVPEPNGTKTMKSDTEEKYLQQVNRVIDYINSHLNEPLRVETLAREVCLSEYHFHRIMRAYLHEPLATYIARQRVERAVMYLQMKNIRLAQVAEMVGYETPQSLSKAFKQFFGISPTAYRKRRAERYEEFSTLKKESLKPEILTEPELKLVYIRIIGRYGEEEPYIEAWRKLRDFLQINGLLTPSTRWIGISFDDPTVTKTEQCRFYACATVEHDVSPQGAFGMKTIPQGRYAVYTLRGSYSGLQEMYDRIYSHPLPTAFRDATSFEEYLNCEPDMEEKDYVTRIYIPIE

SEQ ID NO: 8595 - protein, 256 aa, B.fragilis
RPLVPSLNDYRIGYSLFPEIIDLSNYKWVVFYSQELVGSIGKRWFSCSIEVYCCLFCRVGGEYSFYKLIFVFQYFGHLRLYSCRIYVSTTHKGKKKNWDLSFIAFHFLFLLLFLHPLSSKPNTAVIMKSIEVVAAVIRSGGKYLCVQRGRTKFSYTSFRYEFPGGKVEKGESLQEALQREIMEEMDYTIEVGEKLLTVHHIYPDFEITMHAFLCHPIGEQYVLKEHIAAQWLFPGEMVTLDWAEADKPVVKKISEQ

SEQ ID NO: 8596 - protein, 319 aa, B.fragilis
AICFTLPVSLSWLAVLGHGSLLIKQPHPPASRLLQDKIWKIQLIHFPHSVPCLIFISYLCLKPLDMNSDMKRAIIIGATSGIGREVAKQLLLQGWRLGIAGRRLPALEALQSSAPDLIEIAVLDVTQPDATPKLNNLIRRVGGMDLFLLSSGIGYQNMELNPDIELDTARTNVEGFMRMADTAFHHFREHGGGQLAVISSIAGTKGLGVAPAYSATKRFQNTYIDALEQLAGMQKLNIRFTDMRPGFVSTDLLNDGKHYPLLMRPEKVAKRIVRALNRQPTGSGDRLALCHYRLFMVNDSAPDMETITHTDRTETDRKK

SEQ ID NO: 8597 - protein, 572 aa, B.fragilis
ISLFYMKRLSTLCLLAAGFFIPGQAHQARPTVLDSVYAPLKVATPPSDAYIGLSLLDNGEIRHYNYGEQAVAGTVYLSSTDHGLTWKRVNRPKEMPFADCQSPVSKEYIRLVDMGAMGVYCIRTSGGLTGGRTLTKVADRNSIMIKPPVFIRNGKRIVVAAHGGVTPKGCYTYFSDDDGLTWKCSNTVTSPDHQGGGFHKGIRWNHGAVEPTVVELKDGTLWMLMRTSQDFHYQAFSKDGGQTWGESEPSPFYGTITMPTLGRLADGRLLLFWCNTTPLPEKEGTDGVWDDVFTNRDVTHVAVSDDDGKTWKGFRELYMNPMRNDIDYAVHGGGIDRGVHQAQFVEVAPGKVLASIGQHPLHRAMMMFDVNWLYEKSRFNDFTDSLSQWSTFNYMNGIKGHCAYNRIQGCMLEPHPRKEGRQVLHLTYRPDASLVADTRGAVWNFPAMKKGTFTVSLRIPEGSHSVSLLLNDRWMNPSDTVARYQSMYELPLTRKQLGVKDDRWHEVSLEWDLLQKHPQARVRVDGRLRPLRLPLKNKSQNGISYVHFIAPPAEANPGVYLEWVRAEADGAI

SEQ ID NO: 8598 - protein, 1242 aa, B.fragilis
WRLSAIWKSWSLALTYQKRYRMRYLNKIIFINSARIQYAEIQIDGNVHFIGTQGVGKSTALRALLFFYNADKTKLGISKEKKSFDEYYFPYVNSYIIYEVVVDDASYCVLAFRSQGRVCFRFLGTGYKKEYFISPEGKAYEEWDQIRDALGSFVYKSRRIETYEEYRDIIFGNGRGLPPEFRKFAITESRQYQNIPRTIQNVFLNSKLDAEFIKQTIIMSLNEEDVRIDLGQYAHHLRRFDEEVTDISKWFRKNKNGEVTVRRQADRVIELYREMHYLEQQARTLAGELNYAFRTAREVLPSLQKQKEELLKEVAKEKRQLEELSGKFQSERDRLLGVVKVQNENLKTARERKERYESQDIHHVRERVNAESEAVLHKQMLEEQLTMLTARFDDINSQYKLLKEQAASAFERFRNGKNAELNTLHLRAIERKEAIRKEFDKILKEVREQEVGKLTLLREQTEKKKEGIYQLKMEREKCLHRTLHEEELQACRTERAALEKENHEYRLKQKEAEQQMELVRRRWELDQTACEQQFTARQKDIEQQITLAKERVAEIDRLLDNRQGSFYEWLSQNCQGWEDTIGKVVDEKQVLFSKELKPQSVPDAGQDSFYGIKLDLSAIRKEVKSVQEYAADQEIAGKEVSEWQQQLEKLGEEKEKELALIRKRHQATLSTCKEDVAQSTYCMEQNDKRIRLLKADEIRWEQKAGEEKRVLLEQLDKQLAEATRSLQGTVAELEQFNHLLETRVRQKEKERNQRMQEEDALIRNKQEEIHLSIASEKQKTDELLATMDKDLLHELSGKEWIRSVSLLLRNEVARTEQELVFIDQHRRLVYDYEKDKREFFDRMDEFRNEKQLAEKELEGEKEKFRLKEEELNLKMTGLNKQLAETNTRLKHLDEDIRETENFKTLNICPPVLQTGVETENAKRCKKVIEELTQNHYRQIEQEKDFREAVGRFSGNFSEQNTFNFRTRLTKREEFMTFAADLKEFIDNDKIIDFERRSNEAYTDLIHRIGKETTDMLSKEGLIRKTISDINSDFVERNFAGVIKSIALQIVPSGNRIMQHFVTIKEFCDRNQPGAPGMFSLFGQEDFVERNRQAVSLLQSLVKELALNKEKELTLSDTFELQFRIVENDNDSGWVEKLANVGSDGTDILVKAMINIMLLNVFKEKASHQFNDFKLHCMMDEIGKLHPNNIKGILDFANNRNIILVNSSPTSYRASDYKYTYILNKDKRNITSVTRLIKQEVRE

SEQ ID NO: 8599 - protein, 68 aa, B.fragilis
GRVSVSVDNTKHLNEILDDLKKYGTVTVDKDMCIICVVGDLEWENVGFEAKALDAMRDITVRMISFGG

SEQ ID NO: 8600 - protein, 111 aa, B.fragilis
TSSPTSLKKEVSMEIRIQSIHFDATEQLQAFIQKKVSKLEKYYEDIKKVEVSLKVVKPEAAENKEAGITVLVPNNDFHASKICDTFEEAVDLCVEALEKQLVKYKEKQRNK

SEQ ID NO: 8601 - protein, 174 aa, B.fragilis
NRVTMRKEDKNTIIEQIAATVQEYGHFYLVDTTAMNAAATSELRRACFKADIKLMVVKNTLLHKALESIEGDFSPLYDSLKGTTAVMFCNVANAPAKLIKDKSKDGIPGLKAAYAEESFYVGADQLDALVAIKSKNEVIADIVALLQSPAKNVISALQSGGNTLHGVLKTLGER

SEQ ID NO: 8602 - protein, 196 aa, B.fragilis
LSPYWLQNSYLCKSAAEFEISIKQQSMALIKSVRGFTPEFGENCFLADNATIIGDVKMGQNCSIWFNTVLRGDVNSIRMGDGVNIQDGSVLHTLYEKSTIEIGNYVSVGHNVTIHGATVKDYALIGMGSTLLDHAVIGEGAIVAAGSLVLSNTIIEPGSIWGGVPAKFIKKVDPEQAKELNQKIAHNYLMYSDWYK

SEQ ID NO: 8603 - protein, 593 aa, B.fragilis
CMKQSISERIHALRMWFKPNIQAFIIPSTDPHLSEYVAPHWKSREWISGFTGSAGTVVITEKKAGLWTDSRYFLQAAEQLQGSGIDLYKEMLPETPSITKFLSDELQPGESVGIDGKMFSVEQVESMQAELSAKNIQIVFCPDPMDELWENRPPMPESPAFVYDIKYAGKSCSEKIAAIRTELKKKSAESVMLSALDEIAWTLNLRGNDVHCNPVVVSYLLITEKKAVLFIAPEKVTEEVRNYLEKQQIEIQNYSDTEIYLSDLNSSSILMNPAKTNYSVFSSVNPQCRIIRGEAPVALLKAIRNEQEIKGIHAAMQRDGVALVKFLRWLESAVPSGTETELSIDRKLHAFRATQDLYVGESFDTIAGYKEHGAIVHYSATEESNATLHPKGFLLLDSGAQYLDGTTDITRTIALGELTTEEKTDYTLVLKGHIALAMAVFPSGTRGAQLDVLARMPLWSHKMNFLHGTGHGVGHFLSVHEGPQSIRMNENPIVLQPGMVTSNEPGVYKGGSHGIRTENLTLVCSAGEGLFGEYLKFETITLCPICKKGIIKELLTADEVDWLNNYHQQVYEKLSPKLNEEEKAWLKEATAVI

SEQ ID NO: 8604 - protein, 399 aa, B.fragilis
ITSKAMAKEKFERTKPHVNIGTIGHVDHGKTTLTAAITTVLAKKGLSELRSFDSIDNAPEEKERGITINTSHVEYETANRHYAHVDCPGHADYVKNMVTGAAQMDGAIIVVAATDGPMPQTREHILLARQVNVPKLVVFMNKCDMVEDAEMLELVEMEMRELLSFYDFDGDNTPIIQGSALGALNGVEKWEDKVMELMEAVDTWIPLPPRDVDKPFLMPVEDVFSITGRGTVATGRIETGVIHVGDEIEILGLGEDKKSVVTGVEMFRKLLDQGEAGDNVGLLLRGVDKNEIKRGMVLCKPGQIKPHSKFKAEVYILKKEEGGRHTPFHNKYRPQFYLRTMDCTGEITLPEGTEMVMPGDNVTITVELIYPVALNIGLRFAIREGGRTVGAGQITEIID

SEQ ID NO: 8605 - protein, 151 aa, B.fragilis
INKKMAKEVAGLIKLQIKGGAANPSPPVGPALGSKGINIMEFCKQFNARTQDKAGKILPVIITYYADKSFDFVIKTPPVAIQLLEVAKVKSGSAEPNRKKVAEITWEQVRTIAQDKMVDLNCFTVEAAMRMVAGTARSMGIAVKGEFPVNN

SEQ ID NO: 8606 - protein, 95 aa, B.fragilis
SRSLRNISTPVTTDFLSSPKPRISISSPTWITPVSIRPVATVPRPVIENTSSTGIKKGLSTSRGGSGIQVSTASISSITLSSHFSTPFNAPRAEP

SEQ ID NO: 8607 - protein, 114 aa, B.fragilis
NYRLKPNINQFPVVISGTDYVQTGVAQLVEHRSPKPGVGSSSLSSRANIYEMKKVVAYIKESYDELVHKVSWPTYSELTNSAVVVLYASLLIALVVFAMDFCFQNFMEKIIYPH

SEQ ID NO: 8608 - protein, 76 aa, B.fragilis
NKARWSIRVHQSGIVHTSIGKVSFTAEQIRDNAKEFISTLNKLKPTAAKGTYIKSIYLSSTMSAGIKIDPKSVEEI

SEQ ID NO: 8609 - protein, 410 aa, B.fragilis
GSGGMFYDLAIGIYDLLVHLAAPFSRKPRKMMKGHWVVYDLLRQQVEKDERYIWFHAASLGEFEQGRPLIESIRERYPDYKILQTFFSPSGYEVRKNYRGADIVCYLPFDKPRNVKKFLDIVNPCMAFFIKYEFWKNYLDELHKRRIPVYSVSSIFRKDQIFFKWYGGTYRNVLKDFDHLFVQNEASKRFLAKIGITRVTVVGDTRFDRVLQIREQAKELPLVEQFKNGAFTFVAGSSWGPDEDLFIEYFNSHPEMKLIIAPHVIDENHLVEIIGKLKRPSVRYTRADEKNVRKADCLIIDCFGLLSSIYRYGEIAYIGGGFGVGIHNTLEAAVYGIPVIFGPKYQKFMEAMQLIEAGGAYSIKDYNELKILLDRLLTDEAFLKKTGTNAGNYVIGNSGATEKVLHMINF

SEQ ID NO: 8610 - protein, 308 aa, B.fragilis
ILFIHSLQNYRCSDIMLTDSFLDYLRYERNYSEKTVLAYGEDISQLREFAQERMEKFDPAEVKPELVREWIVSLMDQGYTSTSVNRKLSSLRSFYKYLLRQGEVSVDPLRKITGPKNKKPLPSFLKESEMNKLLDDTDFGEGFKGCRDRLIIEMFYATGMRLSELIGLDDKDVDFSASLLKVTGKRNKQRLIPFGDELKETMLEYVDIRNEMISGRSDAFFVRENGERLYKNLVYNLVKRNLSKVVTLKKRSPHVLRHTFATTMLNNDAELGAVKELLGHSSLATTEIYTHTTFEELKKVYKQAHPRA

SEQ ID NO: 8611 - protein, 190 aa, B.fragilis
FIHIKKRGITMSEIEKKWYVLRAISGKEAKVKEYLEADIKNSDLGEYVSQVLIPTEKVYQVRNGKKIVKERSYLPGYVLVEAALVGEVSHHLRNTPNVIGFLGGSDKPVPLRQSEVNRILGTVDELQETGEDLNVPYIVGETVKVTFGPFSGFSGIIEEVNSEKKKLKVMVKIFGRKTPLELGFMQVEKE

SEQ ID NO: 8612 - protein, 180 aa, B.fragilis
TSIVMGKLTKNQKLAAGKIEAGKAYSLKEAASLVKEITFTKFDASLDIDVRLGVDPRKANQMVRGVVSLPHGTGKQVRVLVLCTPDAEAAAKEAGADYVGLDEYIEKIKGGWTDIDVIITMPSIMGKIGALGRVLGPRGLMPNPKSGTVTMDVAKAVREVKQGKMVYQSASKRYCSYFNW

SEQ ID NO: 8613 - protein, 89 aa, B.fragilis
IKKVCVILRRNLTAEILNHNIFNNNKMIVVPVKEGENIEKALKKFKRKFEKTGIVKELRSRQQFDKPSVTKRLKKERAVYVQKLQQVED

SEQ ID NO: 8614 - protein, 138 aa, B.fragilis
HILFSKLNIKIIQKMADLKAFAEQLVNLTVKEVNELATILKEEYGIEPAAAAVAVAAGPAAGAAAAEEKSSFDVVLKSAGAAKLQVVKAVKEACGLGLKEAKDMVDGAPSVVKEGLAKDEAESLKKTLEEAGAEVELK

SEQ ID NO: 8615 - protein, 957 aa, B.fragilis
QMSSNTVNQRVNFASTKNPLEYPDFLEVQLKSFQDFLQLDTPPEKRKKEGLYKVFAENFPIADTRNNFVLEFLDYYIDPPRYTIDDCIERGLTYSVPLKAKLKLYCTDPDHEDFDTVIQDVFLGPIPYMTDKATFVINGAERVVVSQLHRSPGVFFGQSVHANGTKLYSARIIPFKGSWIEFATDINNVMYAYIDRKKKLPVTTLLRAIGFENDKDILEIFNLAEDVKVNKTNLKKVVGRKLAARVLKTWIEDFVDEDTGEVVSIERNEVIIDRETVIEPEHIDEIIDSGVQNILIHKEEPNQSDYSIIYNTLQKDPSNSEKEAVLYIYRQLRNADPADDASAREVINNLFFSEKRYDLGDVGRYRINKKLNLTTDMDVRVLTKEDIIEIIKYLIELINSKADVDDIDHLSNRRVRTVGEQLSNQFAVGLARMSRTIRERMNVRDNEVFTPIDLINAKTISSVINSFFGTNALSQFMDQTNPLAEITHKRRMSALGPGGLSRERAGFEVRDVHYTHYGRLCPIETPEGPNIGLISSLCVFAKINDLGFIETPYRKVDNGKVDLSENGLVYLTAEEEEAKIIAQGNAPLNDDGTFIRNKVKSRQDADYPVVEPSEVELMDVAPQQIASIAASLIPFLEHDDANRALMGSNMMRQAVPLLRSEAPIVGTGIERQLVRDSRTQIAAEGDGVIDFVDATTIRILYDRTEDEEFVSFEPALKEYRIPKFRKTNQNMTIDLRPTCNKGDRVTKGQILTEGYSTENGELALGKNLLVAYMPWKGYNYEDAIVLNERVVREDLLTSVHVEEYSLEVRETKRGMEELTSDIPNVSEEATKDLDENGIVRVGARIQPGDILIGKITPKGESDPSPEEKLLRAIFGDKAGDVKDASLKASPSLKGVIIDKKLFSRVIKNRSSKLADKALLPKIDDEFESKVADLKRILVKKLSGHHRGSQEPGSQWAG

SEQ ID NO: 8616 - protein, 595 aa, B.fragilis
KMKTINKLFKGIFFCTLVSVSVSSCDLEVEPPANIAAETYWTSEKDAWYNLNSIYSAAIPGIGIYGDAYSDDVYCQYAHESNAKIFQQDGFSPLYDEGWNFETIRKENLFLQKVGNCEMDESLRERFKAEVRAMRAWTYLGMTMTFGKVPLITEVLDYNSPNIPRDEVSVIRDFIMKELTEAAAILPEKYAGGYPNEKGRITKYACLSLKARAALYFGDYALAESTAKEVMDKGGFSLFKISSLSDAQKKEAEEMSLYIDFAEKGIDKDEFVKGMFNYEALWHTENANPDNPEYIMTRQYAASSWDYQDMTRYTSMRPNQLGGWSSVTPTQNLVDAYWGVDGHSVPQLPTPEERAKAYNQIKADLDAYQKPEGEAKFIAFCQEKIKNGTLKDYKYIQEFRNRDSRMYVSILMPFKSWYESNYGDKFVYEWIKNGNNESKTGFNFRKMLSLENDANGDGQATGDYPCIRYAEILLIYAEAHTQTTGYDAATEAALNQLRDRCGMPDVPSGLSKEEGLKLIQNERRIELAGEGFRGDDMTRYSDDYWKEHMNNVPIMTPDGDTELTMKWSSRMRLKPIPQTAIDLNPLLAGDQNPGY

SEQ ID NO: 8617 - protein, 77 aa, B.fragilis
RLKKGVAVNRIAIKAQVLTGGRGKAGGVKLANNDRDVYQYAQTILEMTIKGYPVTKNFLNEAGNIGSRILHQFYDRP

SEQ ID NO: 8618 - protein, 668 aa, B.fragilis
RGTRIDCLRYSSPRGEDSTSDNDKGGVVYTHLLTIPSTYVARQSNGEWGSYEGGKPAATVNMERNPLRRLEEGGWSNSKTQNTLINLALDIKPVKGLVLTGEMIYKAWDYKSKTYTANKSKIKDFQTGTELNGTDVTNSKMEYSWEENSRLTYNALANYVWSNEKHNVNVLAGVSYEHYKYQKQKSYRLKFPTNGMTDMNGGSSAPDDTYAEGGSNEDKLMSYFGRVNYSFMDRYLLEANIRADASFRFHKDNRWGVFPSFSAGWRISQEGFMQDINWINNLKLRASWGQLGNINDVGQYDYFSSYQQGGNYNFEDAIVSGIVESKPANPTLGWETVTITDIGVDFDIFNGLLNFTADYYNKKTDDILLAYPSPKEIGIGSDFKVSQNIGTVSNKGLELSITHNKTLGDFAYTVGFNMSKNWNKVTNLGANDPIIESPWIKKVGYAIGTFYGYRSDGLLTQEDIDTGNYITDGLVPQAGDIKYVDLDGDGKLTDKDRTYIGCDVPDITYGVNLNLRYKGFELSMFGQGVTGTKVNFSMENAWAFSDYASPRKYHLKRWTVDNPNPNAAYPRIYPRTSKHSTYNQYFSDYWLLNADYFRIKNITFGYSFQKPVLQKLSLEALKLYVAAENPFTIRADHRMEDFDPETASGRGVNTRGTSSIAFGVNLTF

SEQ ID NO: 8619 - protein, 405 aa, B.fragilis
VKHNLKTMKKSILIAVLTASIATSAFAQWKPAGDKIKTKWAEQVNPENVLPEYPRPVMERGEWKNLNGLWNYAITEKGAAPSAYEGQILVPFAIESSLSGVGKKVGPDKELWYQRTFTVPASWKGKKVMLNFGAVDWKADIWVNDIKVGQHTGGFTPFSLDITAALATKGDNKLVVKVWDPTDRGPQPRGKQVNRPEGIWYTAVTGIWQTVWMEPVAERHITNVRTTSDIDRKKLTVDVTTSTSCPSEVVEVKVFDGKQLVATGKGLNGQTIDIQMPADAKLWSPASPTLYSMQIALLSNGKVTDKVDSYTAMRKYSTRRDKDGIVRLQLNNEDVFQFRSSRSKMVARRTVYSFDRRRGGYDIQKTKDFGFNMIRKHVKGEPARWYSHCDKLGIIVWQDLPKWEP

SEQ ID NO: 8620 - protein, 691 aa, B.fragilis
  UNSURE (218): Identity of amino acid sequences at the above locations are unknown.
KHPNMKKMKSLKGGLAGILFTAGLLAASCTSDQSSSAVTIVNRPDCTQTNVNYVGNRLPLKPMNFIKLPVGSIQPEGWLKKYLELQKDGLTGHLNEISAWLGKENNAWLTKGGDHGWEEVPYWLKGYGNLAYILKDQKMIDEAKVWLEGAFASQQPDGYFGPINERNGKRELWAQMIMLWCLQSYYEYSNDQRVIDLMTNYFKWQLSVPDEQFLEDYXENSRGGDNLLSVYWLYNRTGDQFLLELAEKIHRNTADWTRPSALRNWHNVNIAQCFREPATYYMMTGDSAMLKASYNVHNLIRRTFGQVPGGMFGADENARMGSIDPRQGVETCGLVEQMASDELMLCMTGDPLWAEHCEEVAFNSYPAAVMPDFKGLRYITCPNQTVSDSKNHHPGIDNRGPFLAMNPFSSRCCQHNHAQGWPYYAEHLILATPDNGVAAAMYAACKATVKVGDGSEISLHEQTNYPFEETIRFTVNTPKAVSFPFYLRIPSWTEGATIFVNGKKVAANPEAGQYACINREWKDNDQVEIQLPMQLSMRTWQVNKNSVSVDYGPLTMSLKIDEDYVKKDSRATAIGDSKWQEGADASQWPTYEIYAKTPWNYALVLGKNEPLKDFKVVHKEWPADNFPFTVASTPIEVKAIGRKVPSWVIDQYDLCSELPEMDAPKGEKEEITLIPMGAARLRVSAFPNTRE

SEQ ID NO: 8621 - protein, 528 aa, B.fragilis
  UNSURE (65),(517): Identity of amino acid sequences at the above locations are unknown.
LSRLVAAYGDAENTPAILFCHERSTGHPVYDRLFPLSTENVTGKAARQLDFLGRVSWPCKNIQAXYWLYNITGDSFLLDLGKLIHQQSFSFVDMVNRGDLKRINTIHCVNLAQGIKEPVIYYQQEPDKMYLDAVKCAFRDIRQFHGQPQGMYGGDEALHGNNPTQGSELCSAVELMYSLEKMVEITGDIDFADHLERIAFNALPTQISDDFMTKQYFQQANQVMVSRHRRNFDQDHGGTDNCFGLLTGYPCCASNMHQGWPKFTQSLWYATPDGGLAVTAYAPSEVTAKVADGCTVTFSEETYYPMDDKISFTLQSMDKKRKEVNFALQLRIPKWCRQAGISVNGQLLQHAEGGRMAIVNRNWKKGDRVELHLPMEVTASTWYENSVTIERGPLVFALKMEEKWEKKEFEEPWYGPYYYSVTPTEPWNYGLVDFNRNKANEHARVTIHTEKQSSVFPWNKENAPIEIRMKARLVPSWKLYNEMAGPQPYSFCSGGERAGNRNHPEFLWMHYIKNTEXPVVGAFRLRGD

SEQ ID NO: 8622 - protein, 244 aa, B.fragilis
  UNSURE (227): Identity of amino acid sequences at the above locations are unknown.
SINRKTLMKKKNTFTYLLIGLGLCFSSLGSGLRADTPENYTNNRYPLVRKPLMELPLGSIKAKGWLQEMLVRQKNGATGQMDKLYPLVMGERNGWLGGDGDQWERGPYWIDGLLPLAYILDDAQLKAKVQPWIEWALKSQREDGFFGPAKDYPGEAGIQRDNSHDWWPRMVMLKILQQYYSATNDQRVIRFMTDYFRYQLKTLPEKPLGNWTFWAEFPGLAKISRPXTGSIISPVIHSYSISAN

SEQ ID NO: 8623 - protein, 60 aa, B.fragilis
PLGGKKFFHWKWGFKSFFPFHFKAGKKEDLCMNIRLLLIWFGMINHLSIGRLPLPEIPYS

SEQ ID NO: 8624 - protein, 371 aa, B.fragilis
QKAMKTKIYLLFITTLFFCAGCGNKSGGQKQESVSAAKDTYVNPLFPEGADPSALFHNGKYYYTHGTEDKIMLWETSDITDMAHAVCKIVWKPHDPSNSCHLWAPEIHYINDKWYIYYAADGDNADNHQLYVLENSSPDPMEGKFEMKGSIITNPEWNWGIQATTFEHKGVRYLAWSGWPKRRTNAETQCIYIARMKDPWTLDSPRVLISKPEYEWERQWVNPDGSRTAYPIYVNEGPQFFHSKDNKTLILYYAASGSWSPYYCVGMLTADAESDLLDPASWTKSSVPVFQQSLENEVYGPGGLSFVPSPDGTEWYMIYHARQVTNGDTGSPETRNPRIQKIGWDAHGMPDLGIPVRAGVALPKPSGTLLK

SEQ ID NO: 8625 - protein, 740 aa, B.fragilis
YYESMKLNSFPHYLQLDAMDCGPSCLRMIAKYYGKSYSLQTLRARSFITREGVSMLGISDAAESIGFRTSGVRISLEQLKKDVPLPCILHWNQNHFVVCYDIKKKRSGYRFYIADPARQLISYSEEEFKKCWLSTKVNGEEKGAALALEPGPEFQGQGDEEESGSRSLRFFLKYLSPYRKQLIQLILGMLTASLLQLIFPFLTQSLVDVGIRDGNLNFITLILISQLVISVSQLSVEFIRSWIMLHMNTRINISLISDFLAKLMKLPLHYFDTKMIGDIMQRIGDHGRIESFLTGSSISTLFSFVNFFIFAFVLAYYNLGILAIFLVGNSLYICWILVFMKYRRELDIRRFAQAAGEQSSLIQLVTAMQEIKLNNCEKQKRWQWERIQVKLFKISVKGLALGQVQQVGSVFFNQTTNIVISFIAAKSVVEGNMTLGMMMSLTYIIGQLSGPIGSFIGFAQQLQDAKISLERLNEIHGQKDEEQDIASKLTVLPERRDIRIENLSFSYDGADRDYVLNDVNLNIPEHKVTAIVGASGSGKTTLIKLMLGFYTPNKGDIKIGETPLDVVNPHLWRAKSGSVMQDGFILSDTIANNIAVGEEQVDVERFRHAVTVANIRDFIDSLPLGYNTKIGMEGNGISQGQRQRLLIARAVYKNPEFLFFDEATNALDANNEREIMEHLHTFYRGKTVVVVAHRLSTVRDADKIVVLDRGAVAEEGTHRELTEKKGLYYQLVKNQLELGS

SEQ ID NO: 8626 - protein, 203 aa, B.fragilis
KKNKMDAHIEQIAKSLYFSCKQFDIGLFYGKMGRCLFFFDYSRVTELRAFEELAGELLDEVMESVCLGMPVGLSFGWCGIGWGVEYLVRKGFVEDDDNEGRNKIDEKVMEYDVRRLGDYSLATGLEGISWYVLLRLYSGDKGVRIGEKNYLSDLKSACEKALKKGRYEGILLLLDFLNGKRANYPFGEFFSQIPGEAHYIPDM

SEQ ID NO: 8627 - protein, 223 aa, B.fragilis
YVMKDITMLNKPPLDFFGCNFCLVEKHRMAFVLISKCGLTFLENIAIYASAGMIPDTEDQTHFYIARVKPERFLVPVSEMSGYEREHKSYLKVAVWRDPVERLVSAYKYFILERTFNQYMYMCNLYQDCSFERFLSFVEFELGKANPLWQDEHIRRQSDFYTSADVDCIVPLSKLNRFLAERGVDMPEEKANATSVRFELKDEKQIAKIKELYRLDYEIPVGC

SEQ ID NO: 8628 - protein, 239 aa, B.fragilis
PLVKTLAGRECFAGVMCYCTKTRTDIVSGNTLAVHADGQVQSWERRGRELFATGTVVSGSTYFSRVMDCRCYVPMVYNYLYRRDFIEQNGFRFEPGLVHEDELWTPQVLTTAQKITVADIDFYYYRQREGSIMTATAAGRRIASIQLIIEKLLEYSRKHLFEKKYREAKEALYVRLLQIYSTACTLHPDGTYTTLYDRAGEMLRVCEELRRQESLGRWYSEEILNRMKLYYDRLQTMEG

SEQ ID NO: 8629 - protein, 208 aa, B.fragilis
GCCSRRGNPPGTDGKERIVLSVGEESVGIRKLDMEKEHTHKEIELRSEEVQEVMNRVPAWILRSGITVLFVIVVALVAGSYWFKYPDVIAAEVTVSTQDPPAYVVARAAGRLENLYVQNGQEVEPDTNLGTIENTACASDVFSLQERMRKWKQEGYTPESGKGLFLHSETDRWRLGEIQSAYAAFVSTLSEMVRMNELGYYAKKLQSS

SEQ ID NO: 8630 - protein, 255 aa, B.fragilis
RPQLESFESITGKGIKVVYQGDTYWVGSHKLLKDFSASLSDVLAEMMVQYESDGNSIVYFGRGTEVLAVVAIADQIKPTSAEAVKELKRQGIDICMLTGDGQRTALAVSGKLGIDRFVADALPDDKEEFVRELQMQGKTVAMVGDGINDSQALALADVSIAMGKGTDIAMDVAMVTLMTSDLLLLPRAFELSKQTVKLIHQNLFWAFIYNLIGIPIAAGILFPVNGLLLNPMLASAAMAFSSVSVVLNSLSLARK

SEQ ID NO: 8631 - protein, 67 aa, B.fragilis
KKKKKKKKKKKKKKKKKKKKKKKKKKKKKKKKKKKNKKKKKKKKKKKKKKNPQGPLCYSVPSVVSSF

SEQ ID NO: 8632 - protein, 63 aa, B.fragilis
KKKKKKKKKKKKKKKKKKKKKKKKKKKKKKKKKKKIKKKKKKKKKKKKKKTPKDLCVTLCPLW

SEQ ID NO: 8633 - protein, 61 aa, B.fragilis
KKKKKKKKKKKKKKPPRTSVLLCALCGEFVLKGIVIFWPDSVNSARHLHLKMPSLHWQASD

SEQ ID NO: 8634 - protein, 767 aa, B.fragilis
LVSPCAVCGESYLFLIEYKPNKKDKRRNLMKYMLLTGLLLGSLTVQAQVSGTVKDQAGEPIIGANVFWKNISGGVATREDGTFSISKPDKSNHLIVSFIGYENDTIQVNDKKAVLDVVLREGMELSEVQIVSRKLSTLKLRSSVMNEEIITSDELCRAACCNLGESFVTNPSVDVSYSDAATGAKQIKLLGLSGTYVQMLTENIPNYRGAASPYGLGYVPGPWMHSIQVSKGISSVKNGYEALTGQINVEFKKPQLPEADWVSANLFASTTNRYEANADATVKLSKRWSTSLLAHYENETKAHDGNDDGFADIPRIEQYNFWNRWAYMGDHYVFQAGIKALDESRKGGQVSHSGVPAADRYEIDIDTRRYEAFTKNAYIFNKEKNTNLALILSGTLHNQDALYGRKIYNVDQSNAYASLMFETEFTKEHNLSAGFSYNYDGYDQHYRLTNNAETPLTKAFARESVGGAYAQYTFNLDNKFVLMAGLRGDHSSEYGFFVTPRAHIKYNPNDFVHFRLSAGKGYRTNHVLAENNYLMASSRKVSIADHLDQEEAWNYGASISGYIPLFGKTLNLNLEYYYTDFLKQVVVDMDTNPHEVAFYNLDGRSYSQVFQVEATYPFFQGFSLTAAYRWTDAKTTYNHQLMEKPLTGKYKGLVTASYQTPLGLWQFDATWQMNGGGRMPNPYTLADGTSSWDARYKGFSQLSAQVTRYFRRWSIYIGGENLTNFKQKNPIIDAADPWGDRFDSTMIWGPVHGAKGYIGVRFNLARD

SEQ ID NO: 8635 - protein, 190 aa, B.fragilis
IMKTNEVLETIKARRSVRAYDRKQIPADDLNAILEAGAYAPSGMHYETWHFTAVCNTVKLEELNERIKGAFAKSDDKHLRERGHSETYCCYYHAPTLVIVSNEPKQWWAGMDCACAIENMFLAATSLGIASCWINQLGTTCDDPEVRAYLTSLGVPENHKVYGCVALGYKAEGALLKEKTVKAGTITIVE

SEQ ID NO: 8636 - protein, 240 aa, B.fragilis
IEFAKMIRSKMKSTWMLGLLLLLGSCQQKGPASGRAEMKGESDSLSVRHGQENALSVSDEYPEGYVPVPGIRYQANYLTGNPERLDVKAALRNVRPLKLSQLGSQLDFMVFKDVKGGIFRLIPIEEGCLGVGIGGIWLLDGNLKMIRMLFRNDVDITEENGFTNFQTKRYINPDYYEKSSRTLIGVLYDQRDKKNPKSFVRLSLKDLLSASRPLTPDDIHKRAGSSPRGWKNAASSQLKP

SEQ ID NO: 8637 - protein, 305 aa, B.fragilis
YELYLSIVNDYINVEFKEEPLMKKQYVSLLAIILATSGFLFSCGDKMNKNTGALEFDSIQVNETAHLFGDTAKPACNLTINFAYPVKSTDNKLKDSLNSYFIAACFGEGYIGEKPAQVVKEYTEHYVKEYRTDLEPMYAEDEKNKESEGSIGAWYSYYKGIESHVQLYYKNLLVYRINYNEYTGGAHGIYMTTFLNMDLINLRPLKLDDIFTGDYKEALTDLLWNQLMADKKVTTHEALEDMGYGSTGDIAPTENFYLDKDGITFYYNVYDITPYAMGPVEIKIPYEMMEHMLGSNPIIGEMKSK

SEQ ID NO: 8638 - protein, 671 aa, B.fragilis
TIHKLQKTIMKQEEDKFTGLPENAFRELKPGEVYNPLMSPKKTYPEVNLWSVAWGIAMAILFSAAAAYLGLKVGQVFEAAIPIAIIAVGVSGAAKRKNALGENVIIQSIGACSGVIVAGAIFTLPALYILQAKYPDMSVTFMQVFISSLLGGVLGILFLIPFRKYFVSDMHGKYPFPEATATTQVLVSGEKGGSQAKPLLMAGLIGGLYDFIVATFGWWNENFTTRVCGVGEMLADKAKLVFKVNTGAAVLGLGYIVGLKYASIICFGSLAVWWIIVPGMSLFFGDSVLNQWNPDITATVGSMSPEQIFSHYAKSIGIGGIAMAGVIGIIKSWSIIRSAVGLAAKEMGGKSDAEKNIIRTQRDLSMKIIAIGSIITLILVVLFFYFDVMQGNLVHTLVAILLVAGISFLFTTVAANAIAIVGTNPVSGMTLMTLILASVVMVAVGLKGPSGMVASLVMGGVVCTALSMAGGFITDLKIGYWLGSTPAKQEAWKFLGTIVSAATVGGVMIILNKTYGFTSGQLAAPQANAMAAVIEPLMSGVGAPWMLYGIGAVLAIVLTLLKVPALAFALGMFIPLELNIPLVVGGAINWYVTTRSKDASLNTERGEKGTLLASGFIAGGALMGVVSAAMRFGGINLVNDAWLNNTLSQLAALIAYTLLILYFIKASMKVK

SEQ ID NO: 8639 - protein, 953 aa, B.fragilis
IINNMKTDLLACRHIGVNKADAEVMLRKIGVASLDELIDKTIPANIRLKAPLALPAPMTEYEFARHIAELAGKNKLFTTYIGMGWYNTITPAVIQRNVFENPVWYTSYTPYQTEVSQGRLEALMNFQTAVCDLTAMPLANCSLLDEATAAAEAVTMMYGLRSRNQQKAGANVVFIDENIFPQTLAVITTRAIPQGIEIRTGKFRDLEFTDDFFACVLQYPNANGNAEDYREFTEKAHTANCKVAVAADILSLALLTPPGEWGADIVFGTTQRLGTPMFYGGPSAGYFATRDEYKRNMPGRIIGWSKDKYGKLCYRMALQTREQHIKREKATSNICTAQALLATMAGFYTVYHGQEGIRNIASRIHSITVFLEKSIGKLGFKQVNKQYFDTLRFILPDSVSAQQIRTIALSKEVNLRYFDNGDVGLSIDETTDVAAANILLSIFAIAAGKDFQKVDDIPEATIISEELKRQTPYLTHEVFSKYHTETEMMRYIKRLDRKDISLAQSMISLGSCTMKLNAAAEMLPLSCAEFMCMHPLVPEDQAAGYRELIHNLSEELKVITGFAGVSLQPNSGAAGEYAGLRTIRAYLESIGQGHRNKVLIPASAHGTNPASAIQAGFTTVTCACDEHGNVDMDDLRAKAEENKDDLAALMITYPSTHGIFETEIVEICQIIHACGAQVYMDGANMNAQVGLTNPGFIGADVCHLNLHKTFASPHGGGGPGVGPICVAEHLVPFLPGHGLFGNSQNEVSAAPFGSAGILPITYGYIRMMGAEGLTMATKTAILNANYLAACLKDTYGIVYRGANGFVGHEMILECRKVYEETGISENDIAKRLMDYGYHAPTLSFPVHGTLMIEPTESESLSELDNFVLTMLTIWNEIQEVKNGEADKEDNVLINAPHPEYEVVSDQWEHCYTREKAAYPIESVRENKFWVNVARVDNTLGDRKLLPTCYGCFD

SEQ ID NO: 8640 - protein, 737 aa, B.fragilis
IMSNITKKAFPVLNMHCAGCANNVEKTVKKLAGVVDASVNFATNTLSVSYEADKLTPGEIRAAVLAAGYDLIVEEALKEERQEEAQEKHYRLLKRQVIGAWIFVVPMLLFSMVLMHVPFSNEIQLILALPVMIFFGGSFYVNAWRQARLGRSNMDTLVALSTSIAFLFSVFNTFFPEFWYSRGLEPHVYYEAAVVIIAFVLTGKLMEERAKGNTSTAIRKLMGLQPRVARVLREGIEEDILIDQLQTGDLVVVRPGEQIPVDGRLSEGESYVDESMISGEPIPVEKKVGDRVLAGTINQKGAFVIKASGVGSETVLARIIRMVQEAQGSKAPVQRIVDRVTGIFVPVVLCIAVLTFVIWLLVGGTDYFSHALLSAVSVLVIACPCALGLATPTALMVGIGKAASNHILIKDAVALEQMRKVDVVVLDKTGTLTEGHPTVSGWLWAQVQEEHFKNVLLAAELKSEHPLAGAIVSSLQEVEKIVPAQLESFESITGKGIKVVYQGDTYWVGSHKLLKDFSASLSDVLAEMMVQYESDGNSIVYFGRGTEVLAVVAIADQIKPTSAEAVKELKRQGIDICMLTGDGQRTALAVSGKLGIDRFVADALPDDKEEFVRELQMQGKTVAMVGDGINDSQALALADVSIAMGKGTDIAMDVAMVTLMTSDLLLLPRAFELSKQTVKLIHQNLFWAFIYNLIGIPIAAGILFPVNGLLLNPMLASAAMAFSSVSVVLNSLSLARK

SEQ ID NO: 8641 - protein, 214 aa, B.fragilis
FVRKRAVFVRYRTQITQTFSLSLSCQSTYYTMTLKRGKILIADDNEDILFTLKMLLRPIAESISITTDPRELLPILSRTHYDVILLDMNFRNDAVSGREGFHWLEEILKLDSGAVVIFITAYADTEKAVRTIKLGATDFIAKPWQNDKMIATRICGIATQLQPYGSRITEGAERSSDRPLAGTGPNHRRIGRHAGYFPDHPEICRYGRQSVAFR

SEQ ID NO: 8642 - protein, 132 aa, B.fragilis
KMKKILFFITMMVLSIGLAQAQGKAEIKFDKTTHDFGTFSENNPVVSCTFKFTNIGDAPLVIHQAVASCGCTVPEYTQEPIMPGKTGTIKVTYNGTDKYPGHFKKSITLRTNAKTEMIRLFVEGDMTAKDAK

SEQ ID NO: 8643 - protein, 318 aa, B.fragilis
RVAEQHSVSTCGPDSLYPVDSLFHQSIHESKMKTLITSILLFMATGLSAQKPVELPLWPNGAPNDNGLKGEEVMSAPYRLTNVTQPTITVYRPATPNGMTIIMCPGGAYALLAMDHEGHDMAPWFNSLGITYVVLKYRMPNGHCEVPLSDAEQAIRIVRKHAKDWNIRTDRVGIMGASAGGHLASTLATHYSSEDTRPDFQILLYPVITMESGDTHGGSRHNLLGPDATPELTRKFSNEQQVTDHTPQAFITLSSDDEGVPPANGVNYYLALQKHKVPATLHIYPTGGHGWGFYDSFAYKRQWTEELEKWLRDGVRFQ

SEQ ID NO: 8644 - protein, 145 aa, B.fragilis
LDHDMGAGSWSERLYRSQVQSGERLRIKSDRSQNLSILILTFMKTKKMIATLVVALLSVTAVMAKDFRTVVFKVAQMECANCERKVKNNIKFEKGLKNFTTDLKERTVTITYDAEKTNVEKLKEGFRKFKYEAVVIKEAKETDKK

SEQ ID NO: 8645 - protein, 106 aa, B.fragilis
AFTEYAYVFSNYLYMFSYFTSIVRVSEVKRKRLFSGCTPEADKSELTEREPHALITHLFIPIASRHRHYDSLQRHLISKTKSPTRKEGDFIRSVHHWAEIEQSREV

SEQ ID NO: 8646 - protein, 282 aa, B.fragilis
RNGCGTESGSNRYNEGITKTIFIKMKTIRTLLLCTSLLAGTVAAQESSLVLSNGLGFVDTPYKAGTLEVDDTEDLIINCDEVDCTTFVEYALAMALCPQQGDEMQEGDFARNLQRIRYRDGKIDGYTSRLHYISDWINNAVRQGLLEDVTATYSPFKQKLSLSYMSTHPELYKSLKNSPENVAQMAKYEKALSGKEVHYLPKDKLEPDGLPWIKNGDIIALTTNTPGLDVSHMGIAIYIKGQLHLLHASSKEGKVVVGKTALSQMLKDRKSLTGIRVLRMKK

SEQ ID NO: 8647 - protein, 467 aa, B.fragilis
PQKCWESPGHRYTGGSRNTDYNLKQLHDMKQKWARKPLILTAALLICCYTTVWLGMHGFYISLPVSVCLLLYTAYRIYRYILRSTRAMAQFIWSVRYSEFLSSPVQSEESLRSLPAELLNEMNQALDFYKQNLQKKESKLQYFQALANHIDMSVLVYTPSGRIEWMNEAAKRLLDNHNLKSIDELKYFHSELPARLYSLKAGDIAVLQAKKEEETIQLALSGMEFVIQGRPLTVASMKNIHSVLDSQETEAWQKLIRVLTHEIMNSITPVTSLSELLEHQIEDFDGNEEERAEIRRMLQTIRRRGDGLIRFVNSYREVSHLPQPLLKIYTSQELLTGVVRLMYREPNDLHLILPPKGQRLMADKDLIEQVLINLIKNARENDATDIRISAGLSSGERPYIRIEDNGTGIEQEVLDRIFIPFFTTKPTGSGIGLTISRQIIHLHRGTITVSSEPGKGSIFTLLFPGVF

SEQ ID NO: 8648 - protein, 282 aa, B.fragilis
QRCRLSACMIVCRYLIYPRLHHSMPKSRTEDLLVESQTSYYFLFLNHANIHIFFYFFIFVLMKTITTDWELIPYSEAWSRQTEWFDALVHAKQNGESYENRIIFCEHPHVYTLGRSGKENNMLLGEEQLKTIGATLYHIDRGGDITYHGPGQLVCYPILNLEEFGLGLKEYVHLLEEAVIRVCASYGVVAGRLEKATGVWLEGDTSRARKICAIGVRSSHYVTMHGLALNVNTDLRYFSYIHPCGFIDKGVTSLQQELGRSIDMAEVKERLGRELLADLLSK

SEQ ID NO: 8649 - protein, 221 aa, B.fragilis
RFKRSNNIVMKIKRFEFNMFPVNCYVLWDETNEAVVIDPGCFYDEEKQALKNFIVTNNLNIKHLLNTHLHLDHIFGNPFMLREFGLSAEANQADEYWIDEAPKQSRMFGFQLNEAPVPLGKYLHDGDIITFGNTTLEAIHVPGHSPGSLVYYCRADNCMFSGDVLFQGSIGRADLAGGNFDELKEHICSRLFVLPNETIVYPGHGAPTTIGIEKAENPFFR

SEQ ID NO: 8650 - protein, 129 aa, B.fragilis
VLFRIIITPPTVAAETMVPRNFHASCLAGVLPSQYPIFKSVIKPPAMESAVQTTPPITNEATMPEGPFNPTATITTDARINVIRVMPDTGLVPTIAIALAATVVNRNEIPATSRIATSVCTRLPCITSK

SEQ ID NO: 8651 - protein, 296 aa, B.fragilis
KNKRKCVYLRDSKKESNMKFDFPQVDLPCEILAWNDVTEDILNIYKQSCRLKAGIFAICTEGKMTATINLIDYEIKPNDLITLLPGTIIQFRERTEKVRLCFAGFSSECVERINLIKSMVSSFSKITECPIVELQEDIASYLIDYFSLLARVTCDEKLSLPSEMTEVSLRSILTAVGLIYQRYSSKNHNTNRKEEICRELVGLVTEHYTEERRAQFYADKLGISLQHLSTTVKQVTGRNVLDVIAYVVIIDAKAKLKSSNMTIQEIAYSLNFPSASFFGKYFRRYVGMSPLEFRNS

SEQ ID NO: 8652 - protein, 237 aa, B.fragilis
SNFIIKIQIYYNLMNTTEQTSSLPSAGGENGVKLLLKYFPDLTEEQRKQFAALYELYIDWNSKINVISRKDIENLYEHHVLHSLGIARVIRFRAGSSVMDLGTGGGFPGIPLAILFPDTKFHLVDSIGKKVRVATEVANAIGLKNVTFRHARAEEEKQTFDFVVSRAVMPLADLIKIIRKNISPKQQNALPNGLICLKGGELEHEAMPFKHKTSMHNLNEDFDEEFFQTKKVVYVTI

SEQ ID NO: 8653 - protein, 134 aa, B.fragilis
YTTLIPFPVILSKLSNWAGTIFSTSCREETMAPASGCSDLSSAASRTFLKCSSCTWAQSHPETVGCPSVNVPVLSSTTTSTLRICSRATASFIRIWLLAALPMPTIRAVGVASPKAHGQAMTSTDTAESKACEK

SEQ ID NO: 8654 - protein, 338 aa, B.fragilis
LQPVSAALQLSFSRTEVESLKEQKEALTDHSPEPARIIGESAAMQAIFQTIRKFADTDANLLLLGENGTGKDLIARYVYEQSPRKGKIYVPIDLGSIPETLFESELFGFEKGAFTDARKKKPGRLEVASGGTLFLNEIGNLSLPLQAKLLSVIEQRKSSRLGSTTSYPVDVRLICATNTDLYTAIDNGLFRQDLLYRINTIEIRIPPLHERGNDLFLLADHFLQRYRKKYKKEVRGISKEARRLMQLYRWPGNVRELEHTIERAVILSGNPMLMPNDFMLRTSPQGQVSEKEKYNLERQERETISEVLRLCAGNITLASEMLGITRTSLYRRIEKHGL

SEQ ID NO: 8655 - protein, 158 aa, B.fragilis
FILVNRQHKKRKKNVAGWLNLLIFATVMKRFRYILAVILSLLIVYVGAGVSVAQYCCSGCETANCCCADKCGFCGKFDFEFHKSCRGEGCTATIYKLDLVKQAFESSVPAPVSLLLCDQVSDLLCALFRDEVLDPPYVIPPPKTSSRHYLALYSTLLI

SEQ ID NO: 8656 - protein, 433 aa, B.fragilis
ENISVSPGKKKQMIEKMKEQDCDKKKSISQGKKHNIFYKMIMSRRAFGITYFVYGATVLSVLAERAEILSSTPSVGSRIFLLLSICFPFAYGTYLLCTKDKNSIKMNEIITSDYFKRVISHKWNIIICLMVIVVCLSFVVIFSDRNWEAPINFNLPSIIVGSVTGYLLGVLIRRVLRRNNTGKKSFKLIFECVGSLCLKVSDQLEESVFTIDWDSSIIPPSIGDDFEIEEFIPGLNWNEKQRLYSIYGHATVIERSFYKKEHVTYISIVLMDSDEIQTMNDQERLLRIKARRKPATATGKRTGGRAGAVMPDKKEDLPPDDLKADLYAELNKEARKADYIPYSPDKLIIGQFGKVMHGKENLIEYVLLSDRFLNRQESFETYFYLLSIPTISCGSFHKETGERSEGCKVIEMEVIDEARARERYRRFLAVWKE

SEQ ID NO: 8657 - protein, 266 aa, B.fragilis
RCRFHTDSINNPNFFYFAAKEVHFKILTHSFATHQMMCIFANHKHITNMKNEVDGRREIASRNTAWANIIARKLTHWGVTPNQISMMSVFFAMVGCLLLIGTVIYPGFNKYVAYILFIVCMQSRLLCNLFDGMVAIEGGKKSANGDLYNDMPDRFADALFIIPVGYVAGGFGIELGWLAALLAVMTAYFRWIGAYKTHQHFFNGPMAKQHRMALLTLTFVVATCTIYSGYDRMVCFIALIIINIGLIATLIHRLYLISHTTNTEIK

SEQ ID NO: 8658 - protein, 221 aa, B.fragilis
SFLSTFAGMKPLTDTDYIHALIAEGEHQQQDFKFEISDARKIAKTLSAFANTDGGRLLIGVKDNGKIAGVRSDEEKYMIEAAAQLYCRPEVDYSMQTFHVEGRSVLVVQIDESEHKPVFAKDENGKSLAYIRIKDENILATPVHLRVWQQSGSPAGELIRYTEREQLLLDLLEENTSLSLNRYCRQAGISRRAAEHLLAKFIRFDIVEPIFENHKFYFRLK

SEQ ID NO: 8659 - protein, 304 aa, B.fragilis
ERISIMTGDYKFRFMPGILSLIFTAVLLSGCIAENTDDCFKGVSLQVKLPADVSGETMKDINLYVFDDKDLLLDILPISRSESVVLDYPGIPVLHCITWCNTGDGAVSASSLKKGDPLSAGFISLKPSAATRAQMSLFNPPADLFYGELILENTSTSNHMEEQELSVSRMVASMNITIRGLELLGESNRGVYSFVVHETASRLDFEGRYGGDPASYAFTPSFEVGKDCTMPTFNLFPVMGSGGIIIDIYHDGKLLRSVSTDSGNRPLVPVVGKTLNVLLNFKLDVDVQVEITGWGEKYIWKEYN

SEQ ID NO: 8660 - protein, 61 aa, B.fragilis
LSPSPAQPACYENVYCNVDDPVPPVCQAVTLIEDVISFGVKVRVIKCDFPTSVVTEMVDSG

SEQ ID NO: 8661 - protein, 302 aa, B.fragilis
AMTSQEANSIPLEDILSRYGYEPSRRYGGYDMYRSPFRCDSSPSFKVFRNENRWYDFGDSSHGRVVDLVMRIHNCSFPQAMKEIEGLGFSSGMIPQPRPVPVTVQKASGMTLLKIIPVENGHLLDYAASRGIDADIVREHCVEVHYCFEKNPREKYALGFANDHGGFELRNSMFKGCATAKDITGLAAGNRSCAVFEGFFDLLSFKQYAKEHPEMPALGKLDLCVLNSTSIVERSKDFLSRYEKVHAFLDNDAPGREALRKMRHFLPKDTVLVNEAERLYPSCNDFNEFLQKIKCPASGREM

SEQ ID NO: 8662 - protein, 326 aa, B.fragilis
SKTFKVIFMEQLSFIESFRTSPFILTEGAIVERLRHEFHISPDKHIAHAALIYDDSHREILASIYRQYLQIATEFRLPLMLMTPTRRANIEQIAASDYRHKNVLADTMAFLSRFRDEASTPVYIGGLAGCRGNAYDGRYYLSVEEAMEFHFPTVRTLVQSGADYLFAGIMPQLTEAIGMANAMAATGLPYIISFMICRDGRLIDGTFIHDAIDAIEKETSTRPLCYMANCVHPDVLHQALLHPRNDTPLVRQRFQGIQANAANLSPEELDGCDHLISSSPEELADRLMTLLWDFPLKICGGCCGTNQQHMHRFAEMLAYRRDNKAW

SEQ ID NO: 8663 - protein, 75 aa, B.fragilis
TVTPESSFLYSGIIAYSICDIAISRELKAAYLCNIRLRQLKEDPKRYEKEFINFSRTADIGNDIGTERRNHYEEV

SEQ ID NO: 8664 - protein, 513 aa, B.fragilis
ITMLVTIVASIACFIVGGILSYVLFKYGLKAKYDNVLKEAETEAEVIKKNKLLEVKEKFLNKKADLEKEVALRNQKIQQAENKLKQREMVLSQRQEEIQRKRAEADAVRENLEAQLGIVDKKKEELDKLQHQEIEKLEALSGLSADEAKERLVESLKEEAKTQAQSYINDIMDDAKLTASKEAKRIVIQSIQRVATETAIENSVTVFHIESDEIKGRIIGREGRNIRALEAATGVEIVVDDTPEAIVLSAFDPVRREIARLALHQLVTDGRIHPARIEEVVAKVRKQVEEEIIETGKRTTIDLGIHGLHPELIRIIGKMKYRSSYGQNLLQHARETANLCAVMASELGLNPKKAKRAGLLHDIGKVPDEEPELPHALLGMKLAEKFKEKPDICNAIGAHHDEIEMTSLLAPIVQVCDAISGARPGARREIVEAYIKRLNDLEQLAMSYPGVTKTYAIQAGRELRVIVGADKIDDKQTENLSGEIAKKIQDEMTYPGQVKITVIRETRAVSFAK

SEQ ID NO: 8665 - protein, 61 aa, B.fragilis
GYFPPSINFIFHICDMFMIRKYTHHLMSCKGMSENFEMNLFCSKIKKVWVVYGICVESASL

SEQ ID NO: 8666 - protein, 251 aa, B.fragilis
FYLPDAGCFHFISVFLQESKERDMQQIKVIAFDADDTLWDNQVFYDKVESEFCHLLAGYGTAEEISSRLFAIEMENMDIYKYGAKPFTLSMVEAAVKISRNRVPAEVIGRIVEMGKELLEMPIRLLGGVTEALETLKDDYKLVVATKGDLLDQERKLQRSGISHYFDHTEIMTDKAPQDYQRLISSLDVAPQSFLMVGNSLKSDVLPVLSLGGHAIHVPAEAMWKHEVISGTEREYLMIHSLAELPAVLRG

SEQ ID NO: 8667 - protein, 1445 aa, B.fragilis
LISFIMSQENPSSQLDVEFIYLPVINYSMQQNRIPVVRLLSIKNNTEHPLADLKVFLTLEPEFASVSPVMVEKLASGEIITITGLNLMLDPSFFIQQTERLSGTIVLVVSDEENVFFQEKYPVDILAFDQWGGIQVLPELLSAFVVPNHPVLTGVLSRASSILKEWSGNSSLDAYQSCNPNRVKLQLAALYEAIKEQHIAYCTPPSSFGDAGQRVRLSDNVLSGKLGTCLDLSLLYASCAEAMGLHPLLVIIQGHAFVGCWLIDGTFPDAVNDDPSLLTKRTADGINEVILLEATCMTDGNNVTFDTAVGMANDKMLAVNDFTCFIDVVRSRFAHILPLPQRVMHGKAWTVGPEVAQIPKSGLYISPVSAPEEIKQYDLDNQDSYVEFTKQLLWERKLLDLSLRNNFLNLRITRNALQVISADIDKMEDAFSDGTEFQILGKPSDWDNPLYDFGLYGTLTESDPMIGLIKQELTQKRLRTYLTEQDLKKSLTYLYRSSRIALEENGANTLYLALGLLRWYETEHSERPRYAPILLLPVEMIRKSVSKGYIIRAREEESMLNITLLEMLRQNFGITISGLDSLPKDENGTDVKRIFSIFRKAVMNEKRWDVEEQAILGTFSFSKFIMWNDIHSNAEELSKNKIVGSLMSGKMEWEVAEVDANAIELDHALTPADIALPVSADSSQLEAVYEAVNEKSFILHGPPGTGKSQTITNIIANALYQGKRVLFVAEKMAALSVVQKRLMNIGLAPFCLELHSNKARKTDVLSQLKESTEIFRYKEPEEFKEESERLFKMRQQINGYVEALHRIYPCGISVYEAITRYSSIDETEEIMIPASLLASLTKEQFNEWNHAVEELIGVGKVSGHSHQHPLTGINIMEYSSQLKEEADKLLKDYMILLQKMEEKMNRCFSNYGIGNKCTEKLLDNFVRFIRILMQLPGMTGNLMLLTDLDENVDKIGRIIEHGRKRDEFCNLLKQSFEDTFLTLPVQQKISEWKDITQSWFLPRLLKQRKFCKELSLFSLQGRVNKEQVLPALQQLLFYQQQKQEVDSSSRWFEDLFGNKSHPGEEQWDDIEVMSKAILQLNRLLVEVVDDPMSIRRVKEKLAEQLSEGYSLFRQMNRELLEGLVYDWECIKQLEKSMLQLLGVSKEVLHACEDDWLAGASRQCEIWARNTDKLKDWYRWLNVSRRFEACGLTSVFAAYTERNLPAERMMNIYLKGFYHSFIEYAIGKEQVLQFFNGELFNDSIRRFRELNTEYQELIKKELYTKLASNIPSFVLAAAQSSEVGILQKCIRSNGRGMSIRKLFDSISNLLSRMCPCMLMSPMSVAQYINVNHDKFDLVVFDEASQMPTCEAVGAIARGNHVVVVGDPKQMPPTNFFTSNSVDEEHIEIEDLESILDDCLALSMPSKYLLWHYRSKHESLIAFSKSQYYDNKLLTFQSRMIWLPKLL

SEQ ID NO: 8668 - protein, 343 aa, B.fragilis
SVTPNCLIYIKAIKMKNYIQRIIRLFATSDPDPKLTGEIHRWLLDQEHAGEKETALHDLWNETEGKVDRTTWDSLASVYTKVGANSGDRHQPRIRFAHYAAAIALLIVSVSVTFQMTKQHFAEAPLIENITPDGRLSSLRLPDGSIVQTNSGSILLYPEKFKGETRTVYLIGEANFKVKKNSGQPFIVRSGTMSVTALGTEFNVAAYPEENEMIATLIHGKIKVECDNGKESYIVTPGQQVTYRKSTGESRLAEANIEDVTAWQKGMYVFRGVTMSEILNELERRYAVTFQYNANLFNDDKFNFRFREKSTLEDILNIMQEVVGGFSHELKGNICYIKPETKK

SEQ ID NO: 8669 - protein, 63 aa, B.fragilis
MPKPHWVILANTLMTVELVMTTFCNSKKVAKVISSTLGLQKVKKSSISVSVALGFDAVVLNPV

SEQ ID NO: 8670 - protein, 289 aa, B.fragilis
LHRPYVACYCPNLLRKRRMKISYHLFLTIEIVMILFIYDKTLDGLLTALFDAYNRKTFPDVLLSKGDTLPLFYDDIFTVITDEEKAGRVWRGLQKKISASALSAITWCWLSELPEVGMLLFRYIRKAIDSPVSIETNFGDPDVLALSKIWKRVDWERLRMLQFVRFQKAVDGTFFAAFEPQHNALPLTVGHFKDRFADQRWLIYDMKRRYGFYYDLHTVEEVTFDDDGQAAHLITGMLDESLMDKDEKLFQQLWKTYFKSITIKERLNPRKHKQDMPVRYWKYITEKQK

SEQ ID NO: 8671 - protein, 373 aa, B.fragilis
IHKFMPRTAKKGFTYYGFDTDHFYDPKVKRLKNKFGMEGWAVFHFIVNEIHRVEGYYMIMDSDGLFDVSDYSRMDEQRIAGIVDYCAELGLFDKGLWRSRQVLTSEEIQNRYMGICKSIHRKPSISDDYLLLNAAAPAATSSPQVAAPCPATHTAPVAEPARTGEKEKDTELMQAIADFKRRLQEPESAAGVVREESGIIRENRPQNKIKENISSPNPSGEGGYTPEREEERNSLSGKLQYLGVDSNIIQWVRLLKSRYPDFPIEKAIRDMEQSNFQLTKENYLYPLIKNYIAKYNAEHGSEERARQQEKILRTRRKTLELLGVPVKDQQEILQLASVAPLVLDTALKETWGNKKIKSPTMFLLSRMRRAVPA

SEQ ID NO: 8672 - protein, 125 aa, B.fragilis
IMDTEILRKKYTLWSNIIDLRSRGLNITRTAKRLGVSRDTVKRLQSLSSDELFRKYQESRRCKLQNYEQAVVSLLFTFPSTSSSRVHDYLKEHYPDFPNVCDKTVRNYVQFIRKKHHLPFRSCRL

SEQ ID NO: 8673 - protein, 303 aa, B.fragilis
YIGTLKSDSWLHRFLHNQPLKHKLYVIIFESDTPAGKAFDVTLIICILLSILLAIIESLQGLPSWLSTPFIVLEYLFTVFFTFEYVTRIYCSPNPRKYIFSFFGIVDLLATLPLYLAFFLPGARYLLIIRAFRIIRVFRIFKLFNFWLEGERLLTSLRESSKKIAVFFLFVVILVVAIGTLMYMIEGTQPNTQFNNIPNSIYWAIVTMTTVGYGDITPATALGKFLSACVMLIGYTIIAVPTGIVSASMMKEYKKLKDLQCPNCHKTGHEENATYCKYCGHKLKNDEIYRQENTATDPDRTTS

SEQ ID NO: 8674 - protein, 149 aa, B.fragilis
LYVTGIGSIGVDTYFRSLKMHMKKFILITLTLLYAVVSSGITINFHYCMGRLADVEWGSASVCASCGEKKMTSHCCKDEAHYVKLAVDQDVNHVPVTNLLPAVTELLPVMYSAFIPLEAESLRRSVASFNFPPWQTDIPLFVHHCTYLI

SEQ ID NO: 8675 - protein, 88 aa, B.fragilis
MRRTSDIPPTTTFPIDPPPMPDMSLPEELPAETPGVPAGAGLPIPPIPDMPLPEESAGGIEATDVTEVDEGAACADEAEKRFSANCSS

SEQ ID NO: 8676 - protein, 68 aa, B.fragilis
KSTTGSTSIYKETGNFGKGKGLLHKRETNALSKGRKRPVEREWQTSPKGKIARPKEGSQPAEEKKPTI

SEQ ID NO: 8677 - protein, 85 aa, B.fragilis
NRRTDADSRWGTYPPEVRFSPPVPYQMFTERKMSVVLFLNDCSRKTKILSFRINKPTQKNETCFACLSTVKKYGRSHAALFYSRL

SEQ ID NO: 8678 - protein, 138 aa, B.fragilis
TVDASRGEWRYRIKDRNPLNNSHMYFIHSIQTYASVNRKGSELQEYVLQLKDSLIKNREFLDDLKEELHCRIGELDAKYPRTQPLHLDAASCREIIQWIIHVKGKPDNLICIISITKVRNLLGEGTGFFPRAKTGGKG

SEQ ID NO: 8679 - protein, 164 aa, B.fragilis
NALAMIKLRFSLLMALLVVAVSVFADNAPAKVQTALKKMYPKADGIAWSQDGGYYCADFMMNGYEKNVWFNAQGQWQMTQTEWGDTDELSATVYNAYASGPYSGWQVEDVTYVEFPKWQPIIVIKVGQQNVDIQYQLFYSSNGTLLRTRNVSYMDDILGPGTFL

SEQ ID NO: 8680 - protein, 61 aa, B.fragilis
NHTAMKTKFVKTTDRKGTYIIEGSSDGQFFNIKRFICQVQKQETEKETQELADFILSKLNS

SEQ ID NO: 8681 - protein, 119 aa, B.fragilis; identical to SEQ ID NO: 7369

SEQ ID NO: 8682 - protein, 63 aa, B.fragilis
SNAASLVILAMIMRFNKGYHLPANVGIKVRNRSLSDINSIKLITKSHKKMKMYPVFCALIAYL

SEQ ID NO: 8683 - protein, 450 aa, B.fragilis
TNNFLYFCVDITFLRQYNRKLNIIMAKQFKPETLCVQAGWTPKKGEPRVLPIYQSTTFKYETSEQMARLFDLEDSGYFYTRLQNPTNDAVAAKIAALEGGVGAMLTSSGQAANFYAIFNICQAGDHFVCSSAIYGGTFNLFGVTMKKLGIDVTFVSPDAGEEEISAAFRPNTKALFGETISNPSLEVLDIEKFARIAHSHGVPLIVDNTFPTPINCRPFEWGADIVVHSTTKYMDGHATSVGGCIVDSGNFDWEAHADKFPGLCTPDESYHGLTYTKAFGKGAYMTKATAQLMRDLGSIQSPQNAFLLNLGLETLHLRMPQHCGNAQKVAEYLAQNDKVAWVNYCGLPGNKYYELAQKYMPNGSCGVISFGLKGGRELSIKFMDSLKLAAIVTHVADARTCVLHPASHTHRQLTDEQLIEAGVRPDLIRLSVGIENADDIIADIEQALNA

SEQ ID NO: 8684 - protein, 227 aa, B.fragilis
KGNLRMMLNFDFVLRLLVAGILGAIIGLDREYRAKEAGYRTHFLVSLGSALIMIVSQYGFQEIIKENSVTLDPSRVAAQVVSGIGFIGAGTIIFQKQIVRGLTTAAGIWATAGIGLAVGAGMYVIGIAAMVLTLIGLEVLSYLFKSIGMKSSMITFSTDNKQVLKGVADRFNSKDYLIVSYQMDTQKHGSIETYQVTMIIKSKRNNDEGHLLSLIQEFPEVTVERIE

SEQ ID NO: 8685 - protein, 91 aa, B.fragilis
HQILMTMSDFNPRPSDKLTASERKELDTSEFGIPQLREFPIHDAAHVRAAEAYFRYAPEEYKAQLARNILAKAHLLGVNVKSPAILEWAEK

SEQ ID NO: 8686 - protein, 478 aa, B.fragilis
APAYPNDSCCRNISITIMSTKHAKAAEKFLENPVMAAWHNETLWMVRAKRDKMSKEVPEWEELRDKACALKLYSNSHLEELLLEFEKNATANGAIVHWAKDAEEYRAIVYEILSSHGVKHFVKSKSMLAEECELNPFLIEKGIDVVESDLGERILQLMNLAPSHIVLPAIHIKREQVGELFEKEMGTEKGNFDPTYLTHAARKNLRNIFLNAEAAMTGANFAVASTGDIVVCTNEGNADMGTSCPTLNIAAFGMEKIVPDMEALGVFTRLLARSATGQPITTYTSQYRNPREGGEYHIIIVDNGRSALLAHPDHIKTLNCIRCGACMNTCPVYRRSGGYSYTYFIPGPIGINLGMAHDPEKYYDNLSACSLCMSCSDVCPAKVDLAEQIYKWRQDLDKIGKANTGKKIMSGGMKVLMDHPTLFNAALWAAPVVNHLPRFMKYNDLDAWGKGRELPKFAGESFNEMWKKNKVQGKEENK

SEQ ID NO: 8687 - protein, 95 aa, B.fragilis
KLLYMSFSGFVFDMIRRNKENRDLLTLRRERMKDLQGKMYRKGTLQNPNVTLEELEKIEKATREKEKAETQYYLRATLIFLTVTAILALILWWIL

SEQ ID NO: 8688 - protein, 150 aa, B.fragilis
VIVHKQLYTNTIAHPPSFWHEACNIIIVSKWLTEKQTSFINLKLTIMKKVLVAVALVMGLGSSVAFAQNAENANAVVATAQAPQDEYTKIEVKDLPAAVTEALGKAYPESTIKEASVTTKEEGKFYKVVVTQKDGTDVTVVLNEKGEEVK

SEQ ID NO: 8689 - protein, 543 aa, B.fragilis
KKTQNVMKKNLLILVALLTSATISAQNGGTIMKKYENQLPQAGRGNVHVAYQGKAIDQMIYDFMEEQGIPGMTLAIVQAPYIPRVAGYGVTDLEKGNLAAAKTLWPIGPISQGYAAVAVMQLYEKGKLDLNDPIGKYLKDIPENWKPISILQLMQHSSGIADYRNEKGFDVSADYRPEQLIETVAAIPLAFEPGTDVKQSATNFLLLTSIIEKAGKMSYHDFVKKYQIDYLGLKQTFFGEDLAKVKQEDVTLTGNVHQTFKKDKDYINPSETTTGYVEKEGRLVAAPAVSPTALKGFSDIWASAENVSHWDIGLAGSALIEKPENRDMVYKPTRLANGKVVPAMAGWQFYNHNGLMDIKGNVSGHSAFLSRFTDASELVCVTLLANKEGVDLTNLGRRIAAAFDSDKMGTGANDNLLYTYESQFSVPETMTRIEQTLHTMGVPVFAKFDHGKNAEEVGLQLRPNQVIVFGSPKVGTKLMQDNPSISIELPLKISVWEDKNGSVWATFPQMRTMAAEYGLEAEPVIGKMQELLEKIVIKGASVY

SEQ ID NO: 8690 - protein, 300 aa, B.fragilis
ISHQTQYDMNKKSSLNNLLYIQEHRSCRNYLEKVENGFKYIEFSHEEVILEKEISWNYLLFVLEGECIINCNQFRERLFQANCMVLLPKTAMVEIKVIAGTRLLSLSFDVPLNVCDKFILQSLTGLCRKLDYNFQSLAIRYPLPPYLEIVTYCLTNKMDCGHFHTLLQQELFFLLRGFYLKEELALLFHPIISAELTFKDFVIGNYFKVSNVNDLISLSNMCKSSFYCKFKEVFGMTAKQWLLKQRNTHILNKVMTSETTVGELMEEFRFESQAHFTHYCKQHFNCTPRELIMKYQVVNQ

SEQ ID NO: 8691 - protein, 63 aa, B.fragilis
LNGQTSGECDIVRRWFTWRAFRSESPLYCPDVIKNKLLRGLLKKSPFPSHIIKKKDVILHAKK

SEQ ID NO: 8692 - protein, 281 aa, B.fragilis
NRFNCKTTQDHLSIHNHYRMAKKHRKESLDALFREKVLLEMLKIAGVGMWTYSTETGRLRYIGFADTIHRHDELQYVDPADYLKLMNGEDLQTVTQFMADIHAGRPPQEGIRYKIHGNGEDFYLENHVVTCQPLGNGFYYLKGYVKNITAQVMEANRLCIEKERTEQADRLRSAFFAHVSRELRGPLNRIEELASQMVHAESVEEREECFHRIQENRRMAMKIADALHAVSQLPVSTYEPYHSPMQLCLIYRDLLMENGYSHNPEDGEQEENANFLSLLFS

SEQ ID NO: 8693 - protein, 519 aa, B.fragilis
NKIKARITMEDINKAYATFAERDRIASLGGGAAKIDIQHESGKMTARERIDMLLDKGTFVELDKLMVHRCTNYGMDRNKIPGDGVVSGYGKIDGRQVFVYAYDFTVYGGSLSASNAKKIVKVQQLALKNGAPIIALNDSGGARIQEGIESLSGYADIFYQNTMASGVIPQISAILGPCAGGACYSPALTDFIFMVKEKSHMFVTGPDVVKTVIHEEVSKEELGGAMTHSSKSGVTHFMANTEEELLMSIRELLSFLPQNNMDEARKQNCTDDVNREDASLNSIVPSDPNVPYDMKEIIERVVDGGYFFEVMQNFAKNIIIGFARMGGRSVGIVANQPAYLAGVLDIDASDKASRFIRFCDCFNIPLITFEDVPGFLPGYTQENNGIIRHGAKIVYAFAEATVPKLTVITRKAYGGAYIVMNSKQTGADVNFAYPSAEIAVMGAEGAVNILFRKADAETKAQELNAYKEKFATPYQAAELGFIDEIILPKQTRKRLIQALEMTENKMQTNPPKKHGNMPL

SEQ ID NO: 8694 - protein, 351 aa, B.fragilis
IKNKKEFKMKRRIKSAQSILWVLLLILSASCSKDEIQIVDQDTSWQMDNKYIEEDIREQLGIDPFTDLVYLGYYGNPYTQLEAINDLVNTTLVGKNELSFKVKVTKPYKEDIKVNLMKEDKLVTDFPEMAEGIPLFPSENCTFEGGVLKAGELETTVKLTIKDVEKLNNLSGYVMAIKLTMEGSHEHLAIARTRSAYFVKLNLSIRLDNIDSSNKKIEGKGFNKEISFKSDIRPDKLGSLNDGNFTANNWYTSNANNYLTIILPEKQSLKGFRLDTNTSPSGSYMLKSCRVMVETPDGNWVNHGVFDRKSMDGIAYISFKKPVECTKVRFENMMAFNGRFSVDVNEVTAFR

SEQ ID NO: 8695 - protein, 1094 aa, B.fragilis
NSFKSMNFYRLKSIFFIIFSCFILQTAAFAQNNVKITIKKKNITLQEALREVEKQSDYLIAFNESKLEKTKRVNLNINAESLDKTLASILSGTGLSYKIKDKYIMIIPQSKVEVESKKLSGIVKDDKGDPLIGVNVSFKGSPTGTVTGLDGRFSILAAKGNIIEFSYVGYTTQYITVGDASSLTVVLEEDAKALDEVVVTALGIKRAEKALSYSVQQVKSDAINDVKDANFVNGLTGKVAGVSINRSSSGIGGATRVVMRGAKSIVGNNNVLYVVDGMPIGNPSKGEINNDYSTPGGGEGISDFNPEDIESLSILTGPAAAALYGSSAANGVILINTKKGQEGKLKISISNNTEFMTPYVMPEFQNRYGNAKGSYKSWGEMLQQPSTFRPKDFFKTGANIMNAANFSVGNKNNQTFVSVATTNSTGIIPNNEYYRYNFTLRNTASMLNDKLHLDLGASYVLQGDQNMLSAGRYFNPLVPLYLFPRGEDFEAVKVYERYDTNRKFPIQEWSYGDQGLNLENPYWIVNREMFVSKKKRYMFYANVKYDILSWLNIAGRIRVDNTNTTSERKLHASTIKLHAQSDKGAYNRSMEEYQQTYADIMLNVNKNFGNFNLTANAGFSYEDHLTTGMGIGGKLFTVPNLFSAYNFDPASGPGSQSHTHTRNNSVFVSTELGYKSMLYLTLTGRQEWASQLVNSDQPTYFYPSVGVSGVISEMVSLPKFISFWKMRASFAEVGGPINYTGLTPGTVTDPMKGGVINPISVYPFPNFKAEQTKSYELGTNLRLFNNKINIDATVYLTDTYNQTFLSSMSPASGYSGFYVQAGKVRNKGIELSLGYNDRFGKVGYATNLTYTANRNKIMKMVHDYKNPSDGSLFSITELTLQDKGGVYLREKDAIGDVYVKGILARGKDGKLIEEEGGYKVDRSQRIKIGSVNPDFSIGWRHNVTWNNITLDLLFNGRFGGIVTSSTQAFLDDYGVSKDTYKARQNGGVWVNGTQYDAEKYYTTIGGEQLMAYYAYKATNIRLQEASLSYTLPGKWFAHVINRLTVSAIGRNLWMIYNKAPFLIQITSSTGTYNRGDVFMPPSLRSVGFSVKIEL

SEQ ID NO: 8696 - protein, 98 aa, B.fragilis
STCFAVRSASEKTAMLVISISRQERITLTAISPRLATKILLIIFISQLNAYTYSRFSTLRTYVHPMKTQYFYDLGLNNDAFFPNPRGENALIHEWQVF

SEQ ID NO: 8697 - protein, 179 aa, B.fragilis
MILNNESNKKKKFEQFFIMTYPKVKAFAWKLLKSEEDAEDIAQDIFAKLWTNPEIWENQETWNSYIYTMVRNHIYNFLKHKSIRQTYQEQCTKEEPAISETDIHDQLYAKESELLIKLTIANMPEQRRKIFRMSRTQEKSNQEIADELDISIRTVERHIYLALIDLKKVLLTLFFFYLG

SEQ ID NO: 8698 - protein, 769 aa, B.fragilis
PLLKRIIMAKITKEAALLYHSQGKPGKIEVVPTKPYSTQTDLSLAYSPGVAEPCLEIEKNPQDAYKYTAKGNLVAVISNGTAVLGLGDIGALSGKPVMEGKGLLFKIYAGIDVFDIEVNEKDPDKFIEAVKAIAPTFGGINLEDIKAPECFEIERRLKEELDIPVMHDDQHGTAIISSAGLVNALQVAGKKIEDVKIVVNGAGASAVSCTKLYVSLGARLENIVMLDSKGVISKARTDLNEQKRYFATDRTDIHTLAEAIKDADVFLGLSKGNTLSQDMVRSMAPMPIVFALANPTPEISYEDAMAARPDVLMATGRSDYPNQINNVIGFPYIFRGALDTQAKAINEEMKIAAVHAIANLAKQPVPDVVNEAYHVNNFTFGPEYFIPKPVDPRLITEVSIAVARAAMESGVARKNIENWDDYKTHLRELMGQESQLTRQLYDTARRNPQRVVFAEGGHPNMLKAAVEAKSEGICHPIILGNEERIEKLAKELDLSLDGIEIINLRHDREAERRERYAHILSQKRAREGATYEEANDKMFERNYFGMMMVETGDADAFITGLYTKYSNTIKVAKEVIGIRPEYKHFGTMHILNSKKGTYFLADTLINRHPDTSTLIDIAKLADQTVRFFNHTPVISMLSYSNFGSDQAGSPLKVHEAVAYMQQEYPELAIDGEMQVNFAMNRELRDSKYPFTRLNGKDVNTLVFPNLSSANAGYQLLQAMDPDTEFIGPIQMGLNKPIHFTDIESSVRDIVNITAVAVIDAIVEKKKANK

SEQ ID NO: 8699 - protein, 317 aa, B.fragilis
LILKTKKDLISWCFSIFLLVLKLNRIQTIMQKLNQQPDICPYFSPEFKVIPQYIIMKEGECMELNNRTTSFFIFILSGEITISFEQYTNRSVLENEMFFLPKNNCFKWKAVTQTVLILTGYNATIFPCTSVRARILYKIKAGVKFDCRGVVMKDEVKVVVNQMKHYLESGINCHHMYILKHKELYLMFKHFYTYEEIIQIFYLILGSNPLFNERVLDNYLKVKTVKELAGLLGYGIKTFEKLFRENFDESPYKWMQKRKALQIQQRLMNPAISLKQIMYEFKFATSSHFNFYCKQHLGAAPMQIRNSNKDDNMSTLP

SEQ ID NO: 8700 - protein, 770 aa, B.fragilis
TSIKRNEVLTKYTYHTMSHLPTLIADLALILMSASIITLLFKWLKQPLVLGYIVAGLLAGPYVRIFPTVGDMENINTWAEIGVVFLLFALGLEFSFKKLMNVGSAAFITATTEVISMLLIGFMVGHLLGWSTMNSVFLGGMLSMSSTTIIIKAFDDLGLRSQRFTGIVFGTLVVEDLIAILMMVILSTMAVSKEFVGEELLMSVLKVAFFLILWFLVGIFILPFFLKKAKRLMNNETLLIVSLGLCLAMVVLATRTGFSAALGAFIMGSILAETVEAEHIEHIIQPVKDLFGAIFFVSVGMLVNPSVLLQYAWPVVIITLVTLVGKSIFSSLGVLLSGEPLKVSVKSGFSLAQIGEFAFIIAGLGASLKVLDPFVPPIIVAVSVITTFTTPYFIRLANPFSEWLYKVLSPRTREFLDRYASGKKTVNHDSDWKRLLKTIVGRVIIYSVLLTAIWLLSVQTVYPTINGMFDSPGRWLSVVMCLLTLLLMTPFLWALVSDKYNSPDVFLKLWNDDNYNHGRLVALILFRVSVAVFFIAGVVISYFSLNYGIGIVIAVAVLGLILLLRENLTQYSHLENHFLTNLNGREEAARNRYPLKSRFNSEFSDKDIELTSVWVSPYSSYIGKSLEELPFRREFGVNVVGIVRGERRIYIPQSDECIYPQDKLIVVGTDGQLQKFRSELDIRQDFPDEKNVRQEVTLHSFTVDEESPLLNKSIAQSRLGKQYDSLIVAIEREDELISMNQSTVFRLGDLVWIVGDREKIRQLLMRKKHV

SEQ ID NO: 8701 - protein, 121 aa, B.fragilis
YRINMKTLFLQYPACSTCQKAKKWLTENNIEYTNRLIVDDNPTVEELKAWIPLSGLPVKKFFNTSGVVYKELKLSSKLPTMTEEEQIALLATNGKLVKRPLVVTERFVLVGFKPEEWEKLK

SEQ ID NO: 8702 - protein, 68 aa, B.fragilis
YKIKYLYYLLIRIEVLEHEIQFFMFQNVHMMTVYSGLKIMLHLIHYYFDFVLHHYSTAIELHAGLYFI

SEQ ID NO: 8703 - protein, 277 aa, B.fragilis
ELTKATKHPIMFGWFNAWQPDGAGKYPRLSLLPDSMDVVSIWGNWHSLSEEKIKELRSVQAKGTKVIIGWIIEDIGDQIKWGRDQWPADDTQAIKEYAQAIVDTINKYGYDGFDYDYEPSYASPFKPGNHCGNLTSCSRDYNKEKEILFMKTMRELLGPDKLFHLNGSIHWLDPRAAQYFDRFVVQSYNGSASSFERWTNDIQNRLNIKPEQLVFTESFQNKPGARSRFPGTYAGYVASKQGNVGGIGVFHINEDAFEDEAYVNIRKAISIMNPPVK

SEQ ID NO: 8704 - protein, 296 aa, B.fragilis
FTKKTYFCRQNKEHDMEKRNPLTLTLDQPFVAGTDDFSPFYNRLHKLNCAIILYCRAGRGTMAIDLKKYEITVNTQVVLLPGAVISLDEKSDDFRVSFFASHIEMFREACIRFEPSFFHFIKEKPCYTLPSEFTAPINGLLHATSAIYADTDHRFRNQIARNHLQSFLLDVYDKVHRLFTHKEIEGGSRPNELFHKFVALVHEYCCSQRDVVFYAGKLCISTKYLTSICRSLTGHSAKKVIDDFTALEIKVLLQSTDLSIQEIADRLNFPDQSYLGRYFKRHEGVSPMEYRAELAG

SEQ ID NO: 8705 - protein, 194 aa, B.fragilis
NSKKVIMLKILVTYAVQGEFTEIKWPDVEVYYVRTGIGKVKSAFHLSEAIQQVKPDIVINQGTAGTINHQVGDVFVCRHFVDRDMHKMTGLGMEYRIDSSELLAARGFCQHWTESATCNTGDSFLTELTDIEGDVVDMEAYAQAFVCRAKEIPFISVKYVSDVIGQNSVKHWEDRLEDARAGLSHFFNVLKESI

SEQ ID NO: 8706 - protein, 394 aa, B.fragilis
QRKKNPMIIRTILDTDLYKFTTSYAYIKLFPYAIGTFSFKDRDGTEYSDEFVERLRTEINQLSHVTLTEKELEYMIKNCRFLPRVYWEWLSSFRFQPEKIEIRLDENRQLHIEVNDYLYKATLYEVPLLAIVSEIKNQSSGNVANLEDILYKLSEKTELSNKHQLLFSEFGTRRRFSFDVQNQVIGHLKQTAHYCIGTSNCHFAMKYGMKPMGTHPHEWFMFHGAQFGYKHANYMALENWVNVYDGDLGIALSDTYTSAIFLSNLSRKQAKLFDGVRCDSGDEFRFIDQLTARYKELGIDPTTKTIVFSNALDFGKALDIQKYCRGKIRCSFGIGTNLTNDTGFKPSNIVMKLSQCKMNMNQEWRECVKLSDDIGKHIGSPEEVRACLYDLRLE

SEQ ID NO: 8707 - protein, 228 aa, B.fragilis
KQKKIMEGINTPFVIDEHTAIVMTDPQNDFLSENGLGWGAFGENIQKNGTVENLRRIFEVAAAKGMLVFISPHYYYKHDHQWLFEGPIEKLMHDTGMFERRGQLTGEGFEGSGADWLDLYKPYINEGTNIIVTAPHKLYGPENNDLILQLRKRGVNKVVVCGMSGNLCAESHLRELQERGFEAAVVFDATASAKLPGMDADTAAFINFTLLAEKVYTTDEFVNEMRQR

SEQ ID NO: 8708 - protein, 182 aa, B.fragilis
FMRKINEIFYSLQGEGYHTGTPAVFIRFSGCNLKCDFCDTRHEEGEMMTDEDIVNEIGKYPAVMVILTGGEPSLWIDDAFIDLLHRAGKYVCIETNGTKPLPAAIDWVTCSPKQGVNLALNRMDEVKVVYGGQNIDVYEQLPAEHFFLQPCSCNNTAETVDCVMRHPKWRLSLQTHKLINIL

SEQ ID NO: 8709 - protein, 366 aa, B.fragilis
KRLKIMKKKFTIFVMLLAGIIYTGHAQGVQWIYQQKQEKKNMKNLSEIYFAGGCFWGTDHFLKQIRGVKSTQVGYANGNIANPTYQQVCTGKTNFAETVKVEYNPQEVPLKLLIDLFFKTIDPTSLNRQGNDKGSQYRIGIYYTDEVDLPTIRTAIDELAKEYSKPIVIEVKPLSNFYKAEEYHQDYLDKNPGGYCHINPALFELAKKANAQAEQPQTNYKKPDDATLRSKLTPEQYAVTQKNATEPAFHNEYWDEKRDGIYVDITTGEPLFISTDKFDSGCGWPSFTKPIEKEVIKEKMDTSHGMIRTEVRSKTGDAHLGHVFTDGPKEKGGLRYCINSASLRFIPKEKMKEEGYGEYLKLLPQK

SEQ ID NO: 8710 - protein, 248 aa, B.fragilis
YIMKVGLFIPCYINAIYPQVGVASYKLLKNLGVDVDYPLDQTCCGQPMANAGFQDESLKMAIRFDDLFRKYDYIVGPSASCVAFVKENHPGILAKEGHQCQSAGKIYDLCAFIHDVIKPTKIPARFPHKVSIHNSCHGVRELFLSAPSELNIPYFNKLRDLLQMVEGIEVFEPSHVDECCGFGGMFAVEEQAVSVCMGRDKIRHHMETGAEYITGADSSCLMHMQGIIEREHLPIRMIHVVEILASQL

SEQ ID NO: 8711 - protein, 405 aa, B.fragilis
NTMKSILLSVISFLLVMNVCGKNDVDMRTYLKKVLGNLGKIESASYHEQSQSWQPGDTVAITNFHRFIKEYTNPSDSTIGASYVCLDAKDTTRFEFGYDGNVRMISYHEHKGIMIDDFTTRSLPFRLVAPPFFCYTRNIIGYALSTGDSITTEWKDLGEAYYFKLVIHEDRQVEFFGKAYYIPKPPFDLGDPTSIYELWISKADGLPYKMRREMSHQISATTCSDVVLNQLSIAGLNLYDYVPQDYEIRKYGEQKKVTQPAATDLIGQKAPDWMLKDMYEKPVALSEFKSKVLLVNLTGIGCGACHASIPFLNGLKGKFNAGEFEVVSIETWGREPHSLRTYADKNQINYSFLCGDEGIVKSYRTYGAAPLFFILDQDRVIRKVIRGYRMGRTDEEITDAIKALL

SEQ ID NO: 8712 - protein, 477 aa, B.fragilis
TSMKKLIISLAAILALSSCGIYSKYKPVTKIPDGLYGHEGTDTPGLTSADPEIQRSDTAANFGNLSWREVFTDPYLRVLIDSALVRNTDLRTAHLRVKEAEATLLSARLSYLPAFSLSPQGTASSFDGGKATQTYSLPVSASWEIDIFGRLTNAKRRAQAVVAQSRDYEQAVQTQLIAAVANNYFTLLMLDAQIEISTATEAAWKESVATTRAMKAAGMVTEAALSQTEATYYNICTTLLDLQEQLNQAENALSLLLADVPHRIPRGRLADQQLPENLSVGVPLQILSNRPDVRSAEQSLAQAFYTTNAARSAFYPSITLSGSAGWTNSAGAMIVNPGKFLATAVASLTQPLFNRGANIAQLRIAKAQQEEARLSFEQTLLNAGSEVNNALVQYQTARDKSAYFNRQVASLENAARSTQLLMKHGNTTYLEVLTAQQTLLNAQLSQVANRFTEIQGVITLYQALGGGRETASGERNS

SEQ ID NO: 8713 - protein, 320 aa, B.fragilis
NKMKDLLDKIFPTLSDELIIVISLIIGLLVTASLILFLVKKIFPKTNISELAARTRSWWIMAGMFIGAVFISYNISYFFLAFLSFIAFRELYSVLGFREADRGALFWGILAIPIQYYLAYLAWYGAFIIFIPVVMFLVLPLRLVLKGDTHGITKSMALLQWILMLSVFGISHLAYLLSLPELPGFSSGGRGLLLFLVFLTEINDVMQFIWGKLLGRHKILPKISPNKTWEGFLGGVISTTVIGYFLGFLTPLSAPNVILVSALIAIAGFSGDVVISAIKRDKGIKDMGNSIPGHGGVFDRIDSLAYTAPVFFHLVYYIAY

SEQ ID NO: 8714 - protein, 443 aa, B.fragilis
KLMKTDLIYGIEDRPPFKDALFAALQHLLAIFVAIITPPLIIASALKLDVEKTGFLVSMSLFASGVSTFIQCRRFGPIGAKLLCIQGTSFSFIGPIIATGLVGGLPLIFGVCMAAAPIEMIISRTFKYMRNIITPLVSGIVVLLIGLSLIKVGIISCGGGYTAMDNGTFASWENLSIAGAVLLSVLFFNRCKNKYLRMSSIVLGLCLGYGLAFVLGKVDMSALNVEMLMSFNIPQPFKYGLDFNVSSFIAIGLVYMITAIEATGDVTANSMISGLKIEGDDYLKRVSGGVMADGFNSFLAGIFNSFPNSIFAQNNGIIQLTGVASRYVGYYIAAMLILLGLFPIVGAVFSLMPDPVLGGATLLMFGTVAAAGIRIVASQNIGRKETLVLAVSLSLGLGVELMPDVLSQAPEAIRSIFSSGITTGGLTAIIANIVIRVKEENEE

SEQ ID NO: 8715 - protein, 252 aa, B.fragilis
NMKNYLFEVCTNSVESCIAAQEGGANRVELCAGIPEGGTTPSYGEIAMAREVLTTTRLHVIIRPRGGDFLCSPVEVKTMLKDIEMARQLGADGVVFGCLTTNGGIDVPVMKQLMEASKGLSVTFHRAFDVCRDASEALEQIIDLGCDRILTSGQQATAELGIPLLKELRERANGRITLLAGCGVNEKNICRIAKETGIQEFHFSARESIKSGMEYKNEAVSMGGTVHISEYERNVTTVKRVKDTIESITSSL

SEQ ID NO: 8716 - protein, 291 aa, B.fragilis
TRRNACIRHAMTSTSFCRKSSARQAGGKCEEPANGTFNRPDLRTDNKTIMKQENDIPDKILERIRKLIRLKESTTSEGEAKAAATHVNRLLKEYNLSLLDVNEKRPETVFEIRESGAISYKDSFGNYWKRDLLRVLCEYNYCRMLRYRGTTDMLIVGTQENIAAVTVLYDYLRTTFRRLADKRHMEYVSIKRGYYRTEKYRKKYIRSYLEGVTPGLRDQFEAMRSTSAEEVRETALVHCHNALIERYLETIGTCSAKVQPRKTKTDYSAYHSGMDDGRSISLHRQINGGNV

SEQ ID NO: 8717 - protein, 200 aa, B.fragilis
SAGKGGKQMSSKEDILASIRKNTKNRYEYPDWQINATVYPDVVAKFCEMSFAVGGEAIVLGEGEDINAVIRRTYPDAGSIASDLEEITCATFNPDLLGRAQDLNGTDIAVVKGEIGVAENAAVWIPQTVKYKALYFIAEKLVIVLDKNRIVSNMHQAYERIKDEKYKFGTFISGPSKTADIEQALVMGAHGARDVLVILK

SEQ ID NO: 8718 - protein, 165 aa, B.fragilis
MAIENTEGYPLISWREIIIKTKYMNTQRQTGTCRSLSGHAQRHGREVRPSYEISTSQFSDMKVRRLTRNYGFGGYSIYRYLVSEALYKGEYFLPWCEETARAVASYWNASLEDITRIVDGCVQVGLFNDELYRKHRVLTSAAIQQDYLKLCGMAYIQEEFALSAS

SEQ ID NO: 8719 - protein, 505 aa, B.fragilis
KQSDMINKKHISLLTLVIFLSLSHFAVSASAQPSVVEVPSVSVQPSVDSLSHYLEQAARSNPQVNADFMLYKASLEKIPQAGAFADPELEIGFFVKPMETLMGKQIADFTLMQMFPWFGTRKAARSEASEMARMAYEQFRDTRNNLWYEVKAQWYQLSSLNEQYHITEANIRLLYQLEQLALNRFSASSAQAAPSSTSVTSVASMPPALSSGSGMSGMGGMGSPAPAGTPGVSAGSSSGRDMSGMGGGSMGNVVVGGMSDVLRIQMERAGLEDNLASLLSARLTVQARFNALLNRPSDASVCVPDSLTQRFYRIDGQLLLDSIFTRNPMLAMLEAEGEAYRAKAKMDRRMSYPMIGIGLQYSVVNKVADPMGMPDMNGKDMVMPMVKVSLPLFRRKYNARQRESHNYRMASELKRDNVQNQLQAEYINVRQQLDDAARKVSLYERQYALSLSTWQLMVREFTAGRQSLTDVIQVERQMLDYKLKKSEAVAAYNTTVAAIEKLIAD

SEQ ID NO: 8720 - protein, 60 aa, B.fragilis
RPSERPFPYRKDREWPPPSLLYLQTYTYINQNQYSSKQPAVASPLTLLRYFNITNTSLAP

SEQ ID NO: 8721 - protein, 78 aa, B.fragilis
RITESESDSLRFVYRIHIKTIRYDKQETYIFTHLGDIPFAESFCRFGFGAAIRCGGAFCFGATLCRQLVPLSGTGGTQ

SEQ ID NO: 8722 - protein, 128 aa, B.fragilis
NSKDTMNKSFFYAICFVVILVVEIIIGIYVRDSFVRPYMGDALVVVLIYCFIRIFIPNGLSQLPLYVLAFACFIEILQYFQLVDVLGISNRILRIALGSTFDLKDMVSYAGGYVFILLAEYFLDKKRK

SEQ ID NO: 8723 - protein, 80 aa, B.fragilis
NNRERNKYISIYRILPLNSSNKLIGFYIQNKIANVPFFTEAPIQYPRVAGCNCAIVNCLCACPHNSKRVFRNILYYIIAI

SEQ ID NO: 8724 - protein, 373 aa, B.fragilis
QIRDGYDRTIVEFLRLNFHPVAIREGYLLINDYLCGSLLDFMMDKTKKVRYVFSVFMVMLMVGIAEWTGEKEIIFPEMAALAVGLWVIDKRVWKVGRWQLIGLMTAGAVAGVCIVRYSTLPLLCNLCLAFAFAACCLLFSRATLIPLISACMLPVLLHTETWIYPSAVFLLSAVLVAGQRLMEKGGLRRETDYVLPGREWKKEIFRWAALLFWVSLVAALSISCGCSYFIIPPLIVTFTEIVNSKAGFRNRPMQVFLFLVTGAALGTAFQIIGHTFLHLPETVVALLIICCLFAVFEWTGKYFAPAGALALIPLIVPQEGVHWLPLQAAAGAALFIAIGMLVFQQCYKWSKAQLIFCFTPTLLRRYLNRRRKE

SEQ ID NO: 8725 - protein, 138 aa, B.fragilis
ESGEVKEVPRITIFTINDYFPPKSFCNIRVNRIFVYNFGVVMTEEEKKLLSTFEARLRHLIYLHDELKRENAELKQLLEEEKSELEKARAEYKALESSYTDLKTATTISLNGSDVKETKLRLSKLVREVDKCIALLNE

SEQ ID NO: 8726 - protein, 390 aa, B.fragilis
GMKLSDYIRGFRKGKEAHRLEKEAMRDPFLADALEGYSRVESGADEQIELLRRRVNMRVTQKRRHTIAWSVAASLLIGVCIGSYFLLQENTLPDEARIAMEEVSHLEPLSVQKEEKKEDLVATVRKDSATIQKGLITGNREKKVVVSPHTEVPQAMTQEWIDEALETTIAEEPLAATTSSAMKSIPANDSSLTAQVAVGGKVHGRVTDSSGYPIVGATVKLKGTNQGTISDVNGNFVLKTGGNRELAVDYIGYESVTLPADTTKSLLIAMNEDQATLDEVVVVGYGSQSKGSITGAVASLKMSGTPQPTIGRKAFRKYLKESLVHPSDKDCARAKGKVILTFRVDKEGRPQDITVKKGLCASADEEAIRLIEEGPDWTMGEEPVEISIRF

SEQ ID NO: 8727 - protein, 311 aa, B.fragilis
TFPCFAAEIKFSMAKQQFNKLIWLVDTIFRNAPVTFAEINRRWRAGDDNRSDIPLRTFHNHRQAIEEMFDINIECDKRNNTYYIADAEGMLGDKLKMWLLNSFSLNNVLQENVDMKNRIVFEEVPSGVQFMDLVIDAMRSGRVLAMEYQAYNWEHSKDVLLEPYFVKLFRHRWYLIGINREYKAFRSYSLDRIKRIALSEETFNFPRKFTPQDHFRDSFGIIRDENLLPQHTVLRTTISQAPYLRNLPLHSSQKEIAVTESYVDFELYISHTYDFIQELLSKGAAVEVLKPQSLRDKIKAEIQNMQTLYRL

SEQ ID NO: 8728 - protein, 552 aa, B.fragilis
NSNCMKKISDILRKKQVLYPLIALAGFVLGWLLFSPSSSPESAGGTHAEAHNHDMHGTSHDLVQDESGVWTCSMHPQIRQDKPGKCPICGMDLIPLKKNVISGGDAVSDPDAIRLSDEAMALADVQTTRVSRSNPVKQVRLYGKIIPDERSLQSQTAYVGGRIERLDIEFTGETVRAGQTLATLYSPELFTAQQELLEAVRMQQPALVQAAREKLRLWNLTDAQIDAIQYSGQASPMVEIKSNTNGIVIAKRVNRGDYVSQGSILFDIANLSRVWAMFDAFEVDLPFLAKGDRVEFTLSAFPGKTYSGRISFIDPILNATTRTARVRVDVANPTLEMKPEMYATAQVAAPLKGYKDRIVVPQTAVLWTGKRAVVYVRLPDTDTPTFRMREVTLGPALGGAYVVLDGLSDGEEIVTNGVFSIDASAQLEGKRSMMNEDTPGTAPMTGHQGHSMSGMSGSHAVSQESEHVLFAVRGSCDMCKERIETAAKGVSGVRSAHWDREKQMIHLQLDPSETSADAVAKAIAAAGHDTDKYKAVKAVYDALPGCCKYRDE

SEQ ID NO: 8729 - protein, 394 aa, B.fragilis
NMKCNVSYKYLFIAIGILCPLFSACDYADGEGSGSENAVYMETPDNKGIVNFTLEPDGGITYLTPRLANISQNPVTIQVGYDKEALDKYNKDNGASYEPLPPSAFKLADAEGNELSASEGIRVPAGDFSAKIMVKVGQLNSKDFPANKKYAIPLSITGASNYSLIPSQRSAILLLNRSILSSVAKVSGGEGIRIKPVGMHTKAEWTIQMSAIYSSLTRSNLTTAYLSNGTGGAFYTRISSTAGIQVKNGRDGDDTWTQIPLQAGKWLHITYVHKDKKTTVYVNGKVQKVFENSAITFGENSMIVVGNSGYRNDYLREIRLWDKALTESEINDYLYLPMDPATPHLISYLPLSKEMETKDLKAPAGTENVTTKARIEYVENVKFPADELVIVNQE

SEQ ID NO: 8730 - protein, 511 aa, B.fragilis
KERCNFACQKITYLMAVYVEEVSRTFGEYLLIPGLTTKQCVPSNVSLRTPLVKHAAGTQAAIELNIPFVSAIMQSVSGPELAIELARNGGLSFIFGSQPIASQAEMVRKVKKFKAGFVTSDSNLTPEHTLEDVLRLLRQTGHSTIGITDDGSPNGHLLGLVTSRDYRISRDPLDKKIKDFMTPFEKLIVGEVGLTLSEANQIIWDHKLNTLPIIDKEGRLAYFVFRKDYDSHKENPNEVSSPDKKLLVGAGINTRDYQERVPALVEAGVDVLCIDSSDGYSEWQYETLQWIKQQYGDKVLVGAGNVVDKEGFLYLAEAGADFVKVGIGGGSICITREQKGIGRGQATALQDVARARDEYQARTGIYVPICSDGGLVHDYHMVLALAMGADFLMMGRYFARFDESPTKKLCIKNNYVKEYWGEGSNRAQNWQRYDMGGTESLKFEEGVDSYVPYAGKMKDNLAATLSKIKATMCSCGAVTIPDLQQNAKITLVSSTSIVEGGAHDVILKEKG

SEQ ID NO: 8731 - protein, 110 aa, B.fragilis
ADLCYLCGRTKINRAMFVLILTYKAPIEKVIELLEAHCCYLDKYYAAGIFLASGPQVPRTGGVILCRAQSRAEVEKIIGEDPFNAVADYRVIEFEPNKSVEGFKELLKIG

SEQ ID NO: 8732 - protein, 435 aa, B.fragilis
DKSRDTKHANSLPLMNANVLEKLKILAESAKYDVSCASSGTVRANKPGTLGNTVGGWGICHSFAEDGRCISLLKVMLTNYCIYDCAYCINRRSNDLPRATLSVSELVDLTIEFYRRNYIEGLFLSSGVVRNPDYTMERLVRVAKDLREVHRFNGYIHLKSIPGASRELVNEAGRYADRLSVNVEIPKEENLKLLAPEKDHKSVFAPMLYIQQGVLESSEERKKFRYAPRFAPAGQSTQMIVGATAESDKDILFLSSALYQRPTMKRVYYSGYVSVNTYDTRLPALKQPPLVRENRLYQADWLMRFYQFKVNEIVDDTYPDLDLEIDPKLSWALRHPEQFPVDINKADYEMILRIPGIGVKSAKLIIASRRYSKLGYYQLKKIGVVMKKAQYFITCSELPMRTVNEMTPQTVRSLLLPKSAKKKTDENQLSFVFND

SEQ ID NO: 8733 - protein, 82 aa, B.fragilis
FPSRVHHFTDLRPVLPTSPEYVSPFSSRRYSANRSVTKNNINRRFKQMPYQFAIKEVAGITKIKTIVSIFHKTKKRSLFFIY

SEQ ID NO: 8734 - protein, 246 aa, B.fragilis
LLLRLNKKTFNMRRTAIALFCLFLLSVGIGLRAQNIQLHYDFGRSLYDKDLKDRPVLTSTVEKFHPDKWGSTYFFVDMDYTSDGVAAAYWEIARELKFWKNPFSVHVEYNGGLAKGFSYQNAYLGGVTYTYNNTAFSRGFSLSAMYKYIQKHHSPNNFQLTGTWYMNFSNNLLTFSGFADWWREETAYGKTIFLTEPQFWVNLNRIKGISDKFKLSVGSEVELSNNFGGRDGFYVIPTLALKWTIN

SEQ ID NO: 8735 - protein, 703 aa, B.fragilis
KQSRMKQKKMLSLTLSQIRQLYCQELPELTAMAQQSLDDTDFKNHLQEFLTPYISGGNKAGEQIRLLISYDGKTVHELSNEQDMQIQTLSLLRRFLTGNLENAEIPTDLFLDLYYLFKRLEEPESPLPSPQRIKNRTERWATGLDEDVIELRSENQERMLHLLIQKIENRKSKPSSRFHFEEGMSYEEKYQQVCQWWNDFRFHLSMAIKTPTELNRFLGNSLSSETMYLLSRARKKGMPFFATPYYLSLLNTSGEGYNDEAIRSYILYSPRLVETYGNIRAWEREDIVEVGKPNAAGWLLPDGHNIHRRYPEVAILIPDTMGRACGGLCASCQRMYDFQSERLNFEFDALRPKESWDKKLRRLMSYFEEDTQLRDILITGGDALMSQNKTLKNILEAVYRMAARKRKANQERPEGEKYAELQRVRLGSRLLAYLPMRINDELIEILREFKEKASVIGVKQFIIQTHLQSPLEVTPYTREAIRKILSAGWLITNQLVYTVAASRRGHTTRLRQVLNSLGVVCYYTFSVKGFNENYAVFTPNSRSMQEQHEEKAFGKLTQEQADELYSLLETGEDIATRIRHFMKKHHLPFMATDRSVLNLPAIGKSMTFNLVGITEEGRRILRFDHDSTRRHSSIIDKLGKIYIVENKSLAAYLRQLSKMGEDPEDYASIWSYTEGETEPRFKLYEYPEFEFHTTERMSNLEVL

SEQ ID NO: 8736 - protein, 134 aa, B.fragilis
FSFSEKSYFSYFCRMKTICIILGTISLGLGILGIFLPLLPTTPFLLLTAALYFKGSPRLYQWLLNHKYFGTYIRNFRENKAIPLRAKIISLLLMWGTMLYCIFFLIPLVWVKILLFLIAAGVTYHILSFKTLKK

SEQ ID NO: 8737 - protein, 404 aa, B.fragilis
KNHRMKVKKILLSMCAIAALASCSQNDDVAVPTDSAPPAKVTIRFAGSEGMTRAIGSEDAVVNNLTAFFFNTAGALIKAPMPVAGNDLKPEITLATTTDASQVVLVANVPAGTAFAGVTSLSKLKEFVVSSLGTEASSNFPINQTKTNLTMSGWGAINMNADNNTGTANVKLHFMAAKIETLKVTIGGKNVGHYADTEDGVTDDKWFTIKQAYLMMAQTNSVLLPATDLGAWTGAFTPATFAYAGGLAWGTRPWENPPVNPDPVKATDYLQTTIPAGATSNVIDNILVSAPWYVFENASPNATGVVLEVVCNVRKDNNTLEKESRYFTMYFGEKKTGDSGNQPILNAGQRYSINIALNGSFDPGDGTGGGGTTDPTKPSVDANVEITVAPAEWTAVAVINKEFN

SEQ ID NO: 8738 - protein, 777 aa, B.fragilis
RKNSNRTMIKHYLKVALRNLMNFKVHSLISAICLAIGITCFSMMNYFIDAITGKVELSDNNKYSIRLSGASSQTAADIYLFKEDFDYLKELPIAGIDTLVASSSYSNGKEITAIDKKQRELPFLVSFQNVSSNYFTYNSLQLKYGNQEITAPDEVIVSRSFARKAFGEENPIGQVIRQETEAANPSDLMVYKIVNVALTEEKDFHGKTIDCYFPLSAKSRTPLCIRSRLTGQTTTESLNKQLKGLTWKHGDQDIYLYASLESEQNSSVQRTISILLARFIASLILLSGLINFLKFIIQMFYNRQRELVLRKCIGSDIKGLFALLFAEIFWMLSVAFLLSLAVTEITLSLVYTYIRPEDMISFSLVDLYGSQLGLYLALLLICMLAILYPIYRLRRLSVLHSVVQRQKRHVFRNFMIALQLAISILFTGGVFGITLLFNEMFEGMYRPLSTEEENRVISISVNTICMQKNMDAILSDIQSLSEITDRTSAFNTFDADVYTYMTYMKDGKPRGNVMMIQAEPHYFEFFKIPFSGKLVDKDAQGFVYISEQFKEQLQRDSIAGSVTLDGKEYRIAGTYRALNREDTQSSSVGSVFLVNPQAYTYYFKTLHSDITPVALEKITEICRRYVPETLPLNIRNTGDSKQSVMGTVALLQTASLLLAIVSILLLILSIYSGISMDVINRQKEVAIRKINGATPRVIALLFGKIYLIIYLSVFVIIYPLVRLVLISITQKSNLQSIYSWSWGVLLFFTMALLIFLVTAYKIYKVMHLNPASVLKKE

SEQ ID NO: 8739 - protein, 316 aa, B.fragilis
QPGRQEGPDRPHYNKRSHNTQVVQEMATAISAQSVTSRKKGAMKRTILILLGWMLLSQGCSYGVGDDCLPPEEPVPIRMAIAEGKLSTRAPVTTIDASNLSNVGIYAVSEGSIAGQYPWTSTPFALNLVPSGISGSQLSFNPKLYYPLGGKRVIFYSYYPRTTATSGSNYITAPGNGVAPAYHFTLTGAEDIMYAAGTPTGSTSTMPVSLTFNHVLTQLQLNTSLLGALSSIKLLGVYNKGTLDIGNGNVTYDSSTTDITLTVPLLGSVTNTVMVPAGVASYKVEVVLLLSLLKRTYLVKPTSGNFQPGVIYTISL

SEQ ID NO: 8740 - protein, 170 aa, B.fragilis
EYKSMEIHIGNRVAEIELVSKEDNKVVLTIDGKTFEADVVMAENGNCNILMDGRSSNAQLIRKENGKSYKVNTHYSSFNVEIIDSQAKYLRMRKKGEEEQNDRITSPMPGKVVKIPVSVGQEMKAGETVIVIEAMKMQSNYKVTSDCRIKEILVQEGDNIAGEQTLITLE

SEQ ID NO: 8741 - protein, 449 aa, B.fragilis
KEKRIMNAAKVLEDLKRRFPNEPEYHQAVEEVLSTIEEEYNKHPEFDKANLIERLCIPDRVYQFRVTWVDDKGNVQTNMGYRVQHNNAIGPYKGGIRFHASVNLGILKFLAFEQTFKNSLTTLPMGGGKGGSDFSPRGKSNAEVMRFTQAFMLELWRHIGPETDVPAGDIGVGGREVGFMFGMYKKLSHEFTGTFTGKGREFGGSLIRPEATGYGNIYFLMEMLKTKGTDLKGKVCLISGSGNVAQYTAEKVLELGGKVVTMSDSDGYIYDPDGIDRAKLDYIMELKNLYRGRIREYAETYGCKYVEGARPWGEKGDIALPSATQNELNGDDARKLVANGVIAVSEGANMPSTPEAIKVFQDAKILYAPGKAANAGGVSVSGLEMTQNSIKLSWSSEEVDEKLKSIMKNIHEACVQYGTEPDGYVNYVKGANVAGFMKVAKAMMAQGIV

SEQ ID NO: 8742 - protein, 294 aa, B.fragilis
NNRSMKKLMFAVIACAMGLSGCSSEDDCATNPEPAGDVTEIKLSAGIQGVATRSPVSTNDNITAPFVASATTGDYTTNAWSSTVTFVASPTPTAALSFSPARYYPVDNSPIYIRGYYPAGTLSGKTVTLAGDGTEDVMLTAQASGTKATAGALSFVFNHLLTQLQFKLVAGAGYPASGVNVTSLVIKQQKTPATLDLNTSSLTYTTKDLTLSGTFPILTAGSTINNYPMVKSGEALTVAVTTSDGVTYPESTISVTTEVGKSHLITLTFTPKEITSSISVTAWQTGGTGSSTLQ

SEQ ID NO: 8743 - protein, 936 aa, B.fragilis
RQTSILQMFSLHSPDDSYDEAFLANYISINLKPEILRISGVGDMMIMEGDYSLRIWMKPDVMAQYRLIPSDVSTVLAEQNIESATGSFGENSDETYQYTMKYKGRRITPEEFGEIVIRSTDDGQVLKLKDIATIELGQESYAYSGTTDGHNGVSCMLFQTAGSNATEVNNQINRFLEEARKELPQGVELTQLMSSNDFLYASIHEVVKTLLEAILLVILVVYVFLQDIRSTLIPLVGIIVSLIGTFAFMAIAGFSINLITLFALVLVIGTVVDDAIVVVEAVQARFDVGYKSSYMASVDAMKGISNAVITSSLVFMAVFIPVSFMSGTSGTFYTQFGLTMAVAVGISAVNALTLSPALCALLLKPYINEDGTQKQNFAARFRKAFNAAFDVVVEKYKGIVLFFIKRRWLTGSLLIASIALLVVLMNTTKTSLVPDEDQGVVFVNVSTAAGSSLRTTDDVMKRIEERMEQIPQVKHVQKVAGYGLLAGQGSSFGMLILKLKPWDERPGKEDDVQAVIGQVYGRTADIKDASVFAISPGMIPGYGMGNALELHMQDKTGGDVNEFFQTTQQYLGALNQRPEIAMAYSTFDVRYPQWLVEVDPSKCKRAGITPDQVLSTLSGYYGGQYVSNFNRFSKVYKVMIQSDPQYRLDEASLNNTFVRMSNGEMAPLSQFLTLTRTYGAESLSRFNMYNSIAVNAMPADGYSTGDAIRAVQETASTSLPKGYGYDYGGITREENQQSGTTAIIFGICFLMIYLILSALYESFLIPFAVLLSVPCGLMGSFLFARMFGLENNIYLQTGLIMLIGLLAKTAILLTEYAAERRKAGMGLIASALSAAKARLRPILMTALTMIFGLLPLMVASGVGANGNRSLGTGAVGGMVIGTLALLFIVPSLFIAFQWLQERIRPVQIEPSHDWQIQTEQEVSEHEKEEAKNRPLK

SEQ ID NO: 8744 - protein, 102 aa, B.fragilis
HKKGCMNDKIKINLQIADSYYPLTINRDEEETVREAAKQVNIRLNAYREHYRNVAPEKIIAMVAYQFSLEKLQLLQRNDTQPYTAKIEELTEMLEEYFRNEE

SEQ ID NO: 8745 - protein, 185 aa, B.fragilis
KRTGLICNRYENILSCRDDIRRINTTFVGIQRFQPNINPYNMTPDFDYSEVPFGFNYCLNKSCKQASTCLRYRLYTHIPAACQTIRIINPVYAATIDDVCPFFMPDKKVRYALGITHLLDHVPYSDAVSIKRQMLAHFKQATYYRCRRKERMLDPSEQEYIRKLFVSKGIKELPVYDEYIEKYDW

SEQ ID NO: 8746 - protein, 96 aa, B.fragilis
GMKGTYWYAVDYAGTGHLFTYKPERDAGIWNGEEALQVSQGALREVFPKITWQDSPVVVTLEVLPCEETFRLRLSKNCGYILRKYLRFPRKEKTND

SEQ ID NO: 8747 - protein, 142 aa, B.fragilis
YPLIKRITNKNIMNLRTFIERPVLSAVISITIVVVGIIGLFTLPVEQYPDIAPPTIMVSTSYFGASAETLQKSVIAPLEEAINGVEDMTYMTSSATNAGTVSITVYFKQGTDPDMAAVNVQNRVSKATGQLPSEVNQVGVTT

SEQ ID NO: 8748 - protein, 374 aa, B.fragilis
IGIMIEKVSKVKQAILFACCLAATGCKQAPQATVESGYKVITLAPTDRTLSSTYSATIRGRQDIEIYPQVSGTLTQVCVSEGERVKRGQSLFIIDQVPYEAALQTALANVEAAKASLATAQLTYDSKQELYKQNVVSTFDLSTAKNSLLAAQAQLAQMKAQEVNARNNLSYTLVKSPADGVVGTLPYRVGTLVSASLPEPLTTVSDNSDMYVYFSMTENQLLGLIRRYGSKEEALKQMPEIGLQLNDRSDYPQQGRIETISGVIDRNTGTVSLRAVFPNREGLLHSGGAGNVIVPTEKAGALVIPQAATFEVQDKVFAYKVVDGKAQSAPVQVTRVNGGQEYIVESGLQPGDVIVAEGVGLLREGTEIKTINGE

SEQ ID NO: 8749 - protein, 61 aa, B.fragilis
IRIMKELVEKIATLVAEFNKDANAQIENGNKAAGTRARKASLEIEKAMKEFRKVSLEESKK

SEQ ID NO: 8750 - protein, 226 aa, B.fragilis
RGVMGRRNRIMHKMTEMEITYNIQTIYTYRNENMPEDSTKVYRFSRKVSRRIWKYALSTPDFRSFLEAKSRECSDTISRMNQELQNVVVTFHISFNGDIPFVGSAVCFFKTVSGGELRCRYNQSILFEETLPGGKYLRDSSIEGMIQKERPENSAFGLLLFAVSLVSVFGILTVPFAFNLARFPLVPAGFTVIAVLILLTVCLRHMNRRRITRRMEIQDKRQEPIK

SEQ ID NO: 8751 - protein, 411 aa, B.fragilis
FCYIKLKLMTSVKLKLNKTRALKDGNYPVVFQLIHQKRKKIIYTKYRMKEEDFIIIAGNVVSGCHTGCKISRELLRIYKQLTARVRRLESRGEEYTINDITTVMFSKVTGKFLLLPYIDTQIEWKKSIMKNGTAAAYQSTYASLAKYIGKKEVKISQVNHRFVTCYRDFLSKNGATENTIGYYLRNFRALYNLAVKDGLVPPCDYPFKEICTKPCKTVKRALDREQMVKLACLSLHSDAELKRSLDLFLFGFYAQGMAFVDIAYLKWKNISGNRIIYRRHKSKQLIQIVITPQIKSIIDEHGNNTNNAEEYVFSVIKNNANEYTQYRTALGRTNRHLKIISAKLKIDPPLTTYTARHTWATLAREYGAPVSAISAGLGHTKEEMTLVYLKELDLAPLHRINKMVNNLLERK

SEQ ID NO: 8752 - protein, 65 aa, B.fragilis
RINMAWMVTQKNIKIHTCIDGIDSVEDVRVVISHKKLKALGAKRRVYKDTRESFFLIESDCEIIL

SEQ ID NO: 8753 - protein, 393 aa, B.fragilis
STNIMIQNSISDNRIVWLDVIRCVAMIMVIGVHCIDPFYISPTMRAIPEYTHWAAIYGSLLRPSVPLFVMMTGLLLLPVKKQPLGKFYKKRIYRVLFPFLIWSVLYSMFPWVTGVLGLPKEIIGDFFCYTQGQESQSLIDSLKDVAMIPFNFSHKENHMWYIYLLIGLYLYMPFFSAWIENADRKTKRAFLLIWIISLFIPYLKEYVANCLFERSGYVFGTDTWNEFGLFYYFAGFNGYLLLGHYVKKGNDWSLMKTFILCILMFAVGYYITYTGFSTTASNPNATETEMELFFTFCSPNVLLMTLATFLLLQKVVITNSTVIKVLANMTQCGFGIYMVHYFVVGPFFLLIGPSSLPIPLQVPLMAICIFLCSWAFTALIYKLMPRKAVWFMG

SEQ ID NO: 8754 - protein, 507 aa, B.fragilis
EMNMIKRILVANRGEIAVRVMRSCREMEITSIAVFSEADRTAKHVLYADEAYCIGPAASKESYLNIEKIIEVAKSCHADAIHPGYGFLSENATFARRCREEGITFIGPDPETMEAMGDKISARIKMIEAGVPVVPGTQDNLKSVEEAVELCNQIGYPVMLKASMGGGGKGMRLIHHADEVAEAYTTAKSESLSSFGDDTVYLEKFVEEPHHIEFQILGDKHGNVIHLCERECSVQRRNQKIVEESPSVFITPELRRDMGEKAVAAAKAVNYIGAGTIEFLVDKHRNYYFLEMNTRLQVEHPITEEVVGVDLVKEQIKVADGQVLQLRQEDIQQRGHAIECRICAEDTEMNFMPSPGVIKQITEPNGIGVRIDSYVYEGYEIPIYYDPMIGKLIVWATTREYAIERMRRVLHEYKLTGVKNNISYLRAIMDTPDFVEGHYDTGFIAKNGEVLQQCITRTSERAENIALIAAYMDYLMNLEENNSGLAADNRPISKWKEFGLHKGVLRI

SEQ ID NO: 8755 - protein, 110 aa, B.fragilis
IRNISFKLTGNNTTWQTLSYLRCYTSTYKKQPPMSQEMKAFPGMKASQKLNFNHSEVIINSAPDRKVILESTLLEQSFVEKGCGETTPHAWKTTSKESLKRPVFNEIWYT

SEQ ID NO: 8756 - protein, 462 aa, B.fragilis
LIDMNLINDILWTYILIAMLLGCAIWFTIKTRFVQFRMIGEMLRLLKDSAGKEEHGEKHISSFQAFAISLASRVGTGNLAGVATAIAIGGPGAIFWMWIIALLGASSAFVESTLAQLYKEKGKESFIGGPAYYMKKGLKKPWMGILFAILITVTFGFAFNSVQSNTICAAVEHAFGISHVPMGIILTGLTLLIIFGGIQRIAKVSSIIVPVMALGYVGLALVIVLINITHLPDVIGTIVSHAFGWQQALGGGVAAALMQGIKRGLFSNEAGMGSAPNVAATAFVSHPVKQGLIQTLGVFTDTLIICSCTAFIILFSGAPLDGSTNGVQLTQHALNNEIGSIGGIFVAVALFFFAFSSIIGNYYYGEANIRYLTHKRWIVYLYRLLVGGMVWVGAMSTLDFVWGLADITMGLMAICNLIAIAFLGKYAFRLLQDYREQKKSGIKSPVFTKNKMKDIEKDIECW

SEQ ID NO: 8757 - protein, 63 aa, B.fragilis
QTDIASMANHHLNEEKPSTKVSQSLLLGDNFLSPERKKFFTYTTQSETIEKGINTSPSTGFFH

SEQ ID NO: 8758 - protein, 1255 aa, B.fragilis
SICMINKIIRYFLENRVITILLLTLVVVWGISTAPFNWHGGIVPRNPIPVDAIPDIGDNQQIVATEWMGRSPKDIQDQITYPLTTSLLGIPGVKTIRSSSMFGMSFIYIIFEDDIEFYWSRSRILEKLNSLPPGTLPENVQPTLGPDATALGQIYWYTLEGRDPKTGKPAGGWNAEELRTIQDFYVKYSLSAAEGVSEVASAGGFIKEYQIELNPDAMYSFNVSVMDVMNAVKKSNLDIGAETMEVNKVEYLIRGLGYVKNVADIENTVVTVREGVPVRISDIAFVNIGPGTRRGGLDKEGVEAVGGVVIARYGSNPLEVINNVKEKIHEMDAGMPQKTLADGTVSKVTVVPFYDRTGLIKETIGTLETSLSHEILICIIVIIVLVLNLRASVVIASMLPIAVLATFILMRYTGIEANIVALSGIAIAIGVMVDVGVVFVESIIRYMEMPENKGITRGKPFVGLIYKAVSEVSGAIATAMITTIVSFLPVFAMQAQEGKMFSPLAYTKTYALASAFVLGLIVLPTLAYILFSVRIDSRLIRRVMNCVLIASAIVLFAVYDSVPALGLTAVGINNLLAYRWKNPKTGNYVNIGIALTVAVFYLSEEWLPMGPQRGLSVNVLIVAGCVAIILALLWILVIFYERILRWCLANRWKFMMIPAATVVCGFLIGRSIGKEFMPSLNEGSFLLMPTSMPHTGIEQNLDYVEKLDKRLAAIPEVETAIGKWGRVNSALDPAPVQMFENTINYRPEYIIGEDGKRARFRVNYDGAFLLKGGGTYNPANGFRLIPADSLVPDSRGDYFRQWRPEIKNANDIWQQIVNVTHLPGLTSAPKLQPIEARLVMLSTGMRAPMGVKVYGPTLEDIEQGGKAIEQALKSVPSVIPSSVFYDRAVGAPYLEIKLNRESMARYGVAVGDLQEVLSAAVGGMALTRTVEGRERFPIRLRYARELRDSPEALSMLLVPTATGIQVPLKELADIEYSRGAQMIQSENTFLVGYVIFDKLSGRAEVDVVKEASNLLEAKVKSGELLLPKGVSYKFAGNYEQQQRATDRLMIVVPLALLIVLLVLYFQFRTVTASLIHFSGVFVAFAGGFILLWLYGQPWFMNFSIAGENMRDLFQMHPINLSVAVWVGFIALFGVATDDGVLMGTYIHHVFLERDPRTKYDIREAVVEAGLKRVRPAAMTTATTLIALLPVLTSTGKGADIMVPMAIPTFGGMLIQSMTMFVVPVLQCWWRETVERRREKKNGSEVSEPVTGSPGI

SEQ ID NO: 8759 - protein, 293 aa, B.fragilis
YKCMFANKVKKVAAIHDLSGMGRVSLTVVIPILSSMGFQVCPLPTAILSNHTQYPDFTFLDLTDEMPRIIAEWKRLEVEFDAIYTGYLGSPRQIQIVSDFIRDFRRKDSLTVIDPVLGDNGKLYSNFNESMVVEMQHLVTHADVITPNLTELFYLLDRPYKESNTDQELKEYLRCLSDKGPEVVIITSVPVLDEPHKTSVYAYNRTGNRYWKITCPYLPAHYPGTGDTFTSVITGALLQGDSLPIALDRATQFILQGIRATFGYEYDNREGILLEKVLHNLDMPIQSSSYELI

SEQ ID NO: 8760 - protein, 377 aa, B.fragilis
KAIFASEKAKIHLRSQTIAQQPEPASFIRSDMKRKLCLLLFFCLLLTAPALRAQQKATPRSGEGISTFLLRHNRAPKKYYNDFIELNKAKLGKSRTLKMGVTYLIPPVKKASAATSGKTTEAAAEKTSAHHPRRTEVNEPLFGKWLSNVKVTSNRLAGTCFYVVSGHGGPDPGAIGRVGKHELHEDEYAYDIALRLARNLMQEGAEVRIIIQDAKDGIRDEAYLSNSKRETCMGSPIPLNQVQRLQQRCDKINALYRKDRKKYKYCRAIFIHVDSRSKGTQTDVFFYHSNRKAESKRLAKNMKETFESKYGKHQPNRGFSGTVSGRNLYVLAHTTPASVFVELGNIQNTFDQRRLVIPSNRQALAKWLMEGFIKDYK

SEQ ID NO: 8761 - protein, 106 aa, B.fragilis
CLIMVLLLFFLYDRKNHAISLNGYYIIQYIPEHSFAIVRTRTKAVHYRTITSGYPWILNRSFCKKRYIRNLILNIESDKFIGRIQWKNPVDGDVFIPFSIVSLCVV

SEQ ID NO: 8762 - protein, 62 aa, B.fragilis
TSVISSLVCPNPALIAETGAPYSLASVAHVWRAVYVVNGGSIFSFAEIIFKCLLVRPKAVRY

SEQ ID NO: 8763 - protein, 348 aa, B.fragilis
RMNILFGLILLVIFTPLINIIIVMKHISINYILTTALALGIGISIPVLIGSTCLSEQHSVQSEVPYCVTPPTVPEQAVFDGDTIDLRRYDRRERMDRELMSFIYMHSSTMQMIKRANRYFPVIEPLLKANGIPDDFKYLMVIESNLNPIARSPAGAAGLWQFMPVTAREFGLEVNDNVDERYHIEKATAAACRYFKQAYAKYGDWMAVSASYNAGQGRISSQLDKQLADHAMDLWLAEETSRYMFRLLAVKEVFGNPQRFGFLLKREHLYPAIPYKEVAVDTEISDLSNFAQKQGITYAQLRDANPWLRGSSLKNKTGKKYVLHIPTQEGMNYDPRKTVPHEHKWVID

SEQ ID NO: 8764 - protein, 197 aa, B.fragilis
TMDIEIENHPLEPFLPANARLLMLGSFPPQKKRWSMDFYYPNLNNDMWRIVGLLFFNNKDYFLNETRKAFCRERIISFLNDKGIALFDTASAIRRLQDNASDKFLEVVQPTDISRLLGQLPECKAIVTTGQKATDTLRAQFEVEEPKVGDFSEFVFDGRPMRLYRMPSSSRAYPLALDKKAAAYRTMYQDLQMLNIE

SEQ ID NO: 8765 - protein, 213 aa, B.fragilis
LMSIFANLFKKQADADAKVVGNVEDFVSLTRVYFQSVIAVNLGITNIRFLPDVANFKRLFKVATQGGKLGLAEKSASRKMLMQDYGISESFFKEIDTSIKKNCRTQNDVQAYLFMYQGFSSDLMMLMGNLMQWKFRMPAIFKKALRSMTEKTVHDVCTKTVWKADDVHKTAAAVRQYKERLGFSEQWMSEYVYNIVLLAKKEPKHKDEEAKAK

SEQ ID NO: 8766 - protein, 117 aa, B.fragilis
PLIISTTMFTVIKRMEISAAHKLILPYRSKCASLHGHNWIITVYCRSERLNADGMVVDFTQIKQAVKEKLDHRNLNEVLPFNPTAENIARWVCKQIPQCYKVEVQESEANTVIYEKD

SEQ ID NO: 8767 - protein, 551 aa, B.fragilis
IITFKKCNTMKLNKVKNMWRILSVIALLGSTLCTSCISEDINRNPLLPTKEDEKMDGVIYGAYLPNLEKSVIPIGTASESTEPVNRYQIGVNLAGDAWAGYMSPRDNKFNGSKNFTNYFMYENWVNYVYSFMVTDVYSPWMQIKRISQDEGTRNDEIYALAQIIKIAALHRTTDMFGPIPYSQVGKGSFKVAYDSQESVYRSFLKELEEAVQTLDDYSNKSKEVLPAFDIVYNGDVNKWMRFANSLMLRLAIRVRFADAGLAKEYAEKAEKHPAGLIDSKELAAHMGKGAGLQMKNPLKVINEEYNDTRMGATIYSYLAGYNDARAAIYFVKNNGFKAVRCGIAKSGDAYNGFTRPNVHEDDPLYWMKASEVCFLKAEGALAGFDMGGSAGDFYNAGIRMSFSENGLDNSSAETYLKDSTRKPANYTDTSNGELSANAPSSITIRWENGATEEEKLERIITQKYLAIFPNGQEAWTEWRRTGYPRQIVVAENKTNSAVLIGNGYDLGGVRRLPYPRTEYEQNGENLHNAISQYLGGVDNAAPKVWWDKKSK

SEQ ID NO: 8768 - protein, 226 aa, B.fragilis
EEKMEKRFMQSVAMRIIYKGVFHWFLKLIVGVQFTDCQFLKKEKQFIILANHNSHLDTLSLLSSLPGNLLWKVKPVAAEDYFGKTRFQASISNFFINTLLIRRKGEKDSEHDPIRKMLEAIDAGYSLILFPEGTRGKSEQMGKIKSGIARILSLRPEVKYIPVFMTGMGRSLPKGKMILLPYKASVYYGIPTLVKSTDTHEILDQITGDFEVMKEKYQVVIDEEEE

SEQ ID NO: 8769 - protein, 76 aa, B.fragilis
SFSVFRCLYSFSTRVLPYRQPPFFSTLQRSVFGTVREMAIQPDNLAILPDYTKTSIFIPERDRYRKKAGAGTPIYI

SEQ ID NO: 8770 - protein, 532 aa, B.fragilis
VADFSISDDLAAKVTLVPIEGYYDKGKSRQNQAEAQAVVDEIVRRLSDPELRNQSIGVVTFSSVQQTLIEDMLSDVVLQNAELENLAFNREEPVFIKNLENVQGDERDVILFSVGYGPDVNGRVSLNFGPLNRDGGERRLNVAVSRARYEMKVFSTLRADQIDLKKTSSIGVAGLKYFLEYAGKGTGVLNHSYVAVSEEVEMGELIAAALREKGHQVKTKIGCSGFKVDVGIIDPNDTSRYMLGILCDGENYRAAKTARDREIVQDSVLKMLGWNICKVWTLDWWEDSQKVIDHIEAELKRAECGKSQRSVPVISLASGSGEVQKEGLLCHAQHCLVKLPEQVIREEVKTASPEIYEKTLLNSVNVSAWELMMPRREPRIRKQLNEIMRTEAPISRSLLSSRIFNAYGILRKTARLIEWMDGILDKTPYYKQEIDGLVFYWNTKEEADSYTGFRIDSKREAVDLPPREVANAARNILEQQVALPLVDLMRVTAQLLGYARFGLNVETAMRRGVQILLDGEEVKIEGGKILMK

SEQ ID NO: 8771 - protein, 69 aa, B.fragilis
IDGVLLKREKSFLSDLKIGISSSICVRAIKVSLFYEKLVDIIILLLSIKVGIPLVDFCFHWLYLRVSKI

SEQ ID NO: 8772 - protein, 614 aa, B.fragilis
NNEVMKTNQFRAMVFALLMAVISLATVSAQAITVSGTVTDAKDGTPLVGCSVQIKGTTKGTVTNMNGQYTIQSKKGETLLFQYIGYKQEKRVVKSSTLDVKMKADELVLEECVVVGYGHELRATKSMSTAYMAVCPASGIMYNAVNAEEYGEIQENGFKNVSDAPLSTFSIDVDAASYSNMRRFINKGKLPPVDAIRTEELVNYFSYDYPKPTGSDPVKITMEAGTCPWNADHRLVRIGLKAKEIPTDNLPASNLVFLIDVSGSMWGANRLDLVKSSLKLLVNNLRDKDKVAIVTYAGNAGVKLEATPGSDKQKIREAIDELEASGSTAGGEGIMLAYKIAQKNFISGGNNRIILCTDGDFNVGVSSDKELEKLIEQKRKSGIFLTVLGYGMGNYKDSKMQTLAEKGNGNHAYIDNLQEANRVLVNEFGATLHTVAKDVKLQVEFNPAQVQAYRLIGYESRLLADEDFNNDTKDAGEMGAGHTVTAFYEVIPTGVKSDFAGKIDDLKYQKKQKPSTPLNESDELLTIKLRYKAPDSNTSKKIELPLIDHKSNRVSADFRFAAAVAMFGQLLRDSEFKGNATYDKVISLAKTGLENDEKGYKREFIRLAETAKSL

SEQ ID NO: 8773 - protein, 104 aa, B.fragilis; identical to SEQ ID NO: 7368

SEQ ID NO: 8774 - protein, 191 aa, B.fragilis
MLFFKRNISRLSDEELLIHYTKSGDTEYFGELYNRYIPLLYGLCLKYLHDEDRAQEAVMQLFEDLLPKLGNYEIKVFKPWLYRVAKNHCLQLLRKENKEIPLDYTVNIMESDEFLHLLSEEESSEEQLKALHHCLEKLPEEQRTSITRFFLEEMSYADIVEQTGFTLNNVKSYIQNGKRNLKICIKNQLKG

SEQ ID NO: 8775 - protein, 107 aa, B.fragilis
SASSLNFFSTINAYFIASVSSAPGLNLATFFAGISIAFLVEGLIPILADLSATENVPNPTKEILSPADKAFVTEEKKASSAFLESTLLKPDSAAIALISSALFIIRK

SEQ ID NO: 8776 - protein, 577 aa, B.fragilis
CPLPFSSFPFSFSTFAIDLFINTQTMKSLHSLLFCGVLLLHASCSGIKTSDEKSLGDCPLVATWKQAGTDSIVVLDVGLIKDTMQIRLSQLVDDLEIIKLETRDTALVKSGYMAVSDRYMLLGSYLMPCKLFDKNGTFLRQIGGLGQGPGEYTNIYDAQIDEVNNRIYMLPWTSNQLLVFDLDGNILPPIPLPARVPKGVFRVDTKKNLLTMGILPFQDLENKFVLWQQDLKGNVLQSISSTPYYTYDDYSNEVSSNRNAGSFDFFIFNWSAVQDSLYHYDAKENRLVPVFTANFGTQDIPKHTYTEFPGHYWVNIITEVVNGQGMPPMNVLIDKHSLKGTYCTLVIDELGGIPVEYPYDCFQDGRFLMNLDPGDLIDELEKVLARPERFSKEESDRLTKLKNSISVDDNNYILVGKFKSKGESLILSANPVQKITEQEQQPAKEEPVKTAVQSEVASEADTVWSVSPYSAILPDAIDYFRTHNKYKDWDPKKGKRVLVRGIAEKDGTITGVGISYGWDLDPQSGAMKNKSEGTCGLKELDEEALRLIRQAKLLPGMTDKKIPVRSKFVIVVDFPPK

SEQ ID NO: 8777 - protein, 64 aa, B.fragilis
LRPLRLFPKARKGRIVLLFMIHQPCKQKDRKKTDPLTRLYKKNAQPEAEQEENRVIEGSKPGIK

SEQ ID NO: 8778 - protein, 161 aa, B.fragilis
LVFTKRMPNRRPNRKKTGSLKGQSRGLSKNKSGFDTKSLFVFRKRSKHFLQKTVTFSKNAYFFALTSPYVLKTTFTAPENTTYSGSSCSNRLLSESPTGVSKSLKFPSLKSTGNIYFQIAFFLTENKSRTKQNDKPGNEIETFFRPRLSRESKKRKLGGFI

SEQ ID NO: 8779 - protein, 400 aa, B.fragilis
GIDTLLMNPKLCCKMTKTTNMKQNTFFVNVWTLMLILGLIACGEKKTQVKTELQRIEAFAFDVNDDYLQSYAGTFCYSTSARIDGKECLIVYNGKLHSIDILNLADRRPLKQIALAKDGPDQILAPKGIGYYKDSFIILNTGGLYRVGQDGKVVSKKLLNDFPQIKEEGYGIAVPDLTVYFSVYSFFGFDAANGRVALPLYFYEKDTTGEYPKKVLIVSCDDWNIRDEVEIHCPDVIRKEGDMQLLGCVNVLPYGDWLIYNFPASSKVYVYDLSVKKSKEYDFPSTFTDPFFHLPDINGSEPGFGCLKTGYYFPLCYDAYHNVFWRIQHGPLDGHGVGGKPFSVMCISPDFLNSAEYVIPAGASIYPDLAFTDSLILLPYTGGDKIGENNMCFYGLQYRE

SEQ ID NO: 8780 - protein, 107 aa, B.fragilis
NVYLIIDKKLNMKKIDLIRSIAVKSNLKKEHIAIVVEGVMEAIAEALHQGESVTLVGFGTFEVKERKARKGYNLSTGEIMTIPGKKTVRFKPGAKMNLETKHQDTSR

SEQ ID NO: 8781 - protein, 612 aa, B.fragilis
RLLFLYLCAQNNNLDMKIEDKLVTSVISGLKALYGQDVPAAQVQLQKTKKEFEGHLTLVVFPFLKMSKKGPEQTAQEIGEYLKANEPAVAAFNVIKGFLNLTVASATWIELLNEIHADAQYGIVSADENAPLVMIEYSSPNTNKPLHLGHVRNNLLGNALANIVMANGNKVVKTNIVNDRGIHICKSMLAWQKYGKGETPESSGKKGDHLVGDYYVAFDKHYKAEVAELMEKGMSKEEAEAASPLMNEAREMLVKWEAGDPEVRALWQMMNNWVYAGFDETYRKMGVGFDKIYYESNTYLEGKEKVMEGLEKGFFFKKEDGSVWADLTAEGLDHKLLLRGDGTSVYMTQDIGTAKLRFADYPIDKMIYVVGNEQNYHFQVLSILLDKLGFEWGKSLVHFSYGMVELPEGKMKSREGTVVDADDLMAEMIATAKETSQELGKLDGLTQEEADDIARIVGLGALKYFILKVDARKNMTFNPKESIDFNGNTGPFIQYTYARIRSVLRKAAEAGIVIPEVLPANIELSEKEEGLIQMVADFAAVVRQAGEDYSPSGIANYVYDLVKEYNQFYHDFSILREENEDVKLFRIALSANIAKVVRLGMGLLGIEVPDRM

SEQ ID NO: 8782 - protein, 450 aa, B.fragilis
WGPYAQTINLNSIVAMKHMSLLLIGVFVLLGCSSNKKQEPISKSGIPVINLSEDVSTVPSLLLSEAASKVDIVPLEVTDESLLGEIYHLQITENDIWVHHYKDKCICRFSRSGKFLNKVGKIGQGPGEFIQLSDFFIDEKHREIYIVSASRGIFVYDFDGNFKRQPTRTIVETMFGSIFNQFMIYNNHFFILQNLPLYREIPKDSLWSLALVDSSYKKKKIFKNPVHIGKEDQIIENRIQMNYMFNYWLESSTNIDTYNNQLTLKFPDTDTIYSYDSIKEELVPQYAIWVDEEKGDYEYTHLWFRDRKAFDYFSIHSYYSTKENIYLVGSKGEEVYIYCYNKQEKNVRLQKQQGEITERDVSWFSIPFRRMECPFVLSNDLCGGDFIIDFRSSGKYWVDVLYLGNDGNRVDLNQIKSSTVIDESKKKELIQVLESATEDSNPVLMIATLK

SEQ ID NO: 8783 - protein, 68 aa, B.fragilis
TTVYKHNRHESHDFNPKYPDSYKLVIQVNFTIIPTFALYIHQYNANGSSKNLLMVHSYKRQYLVYTFF

SEQ ID NO: 8784 - protein, 366 aa, B.fragilis
HMKHIGRLALFLCLAVNAFFIGMLLLTAYSPYINPEVHPVQSCLGLTFPIFLVINFCFLIFWLIVRYRFALVPLLGFLLCYPQLRTYMPVNPGTAGQPENSIKLLSYNIMSFGNMKKENGQNPILNYIKNSNADIVCMQEYAGSETAKIHLSNKEIRQALKDYPYHNIKQVGKTGAGSQLACYSKFPILSARMLDYRSNYNGSMVYEIKIGKDTVLLINNHLESNKLTREDKVVYEDMLKDPKAGKVKSGVRQLVNKLAEASAIRSAQARTIAQEIAHSPYPSVIVCGDFNDSPISYAHRVISQDMDDAFTESGCGLGISYNQNKFYFRIDNILVSKNLKASGCTVDNSIKDSDHYPIWCYITLPD

SEQ ID NO: 8785 - protein, 85 aa, B.fragilis
KRTNSRLFFCCRTEFIRIFAFIMMREEANTHIITLITLTNKKDAYCNKKPDNYQCSPVPRTICSTKLWDQLIRLSGSALFPCRQF

SEQ ID NO: 8786 - protein, 608 aa, B.fragilis
ELNKGSDMQAIILAAGMGRRLGELTRYDTKCMIEVNGIRIIDRLLANLAVARLSRIVLVIGFQGDKLRAYLGNEYCGIPIYYLENPYYAHTNNIYSLFLARHHLASDDTLLLESDIVFEKRILERVLEEPYPNVAVVDRYKSWMDGTMVTVDEKQFIVDFVSKHTFSYEKTSTYFKTVNIYRFSKEFSVGKYVPFLEAYCKCFDNSAYYEQILAVLSLLDKAGLKALPLEGEKWYEIDDMQDLDIAETLFGKKEGLLPGYQKRYGGYWRFPFLLDFAYLVNPHFPTERMLEELKANLDKLLRQYPSGSYVNRRLVAKHWNIPAEAVAVGNGAAELIRKLMELLPGRMGVILPTFEEYLVRDDRIETFLPLGPGYRYTVSDLKIFFEDKGVTSLLLLNPDNPSGNSIPYEDLISLAGWTQERSIRLIVDESFIDFSEGGEETSLIGDKILKEYNHLVVIKSLSKSHGIPGLRLGIAVSGDHKLMDELQQKLPVWNINSLAEYYLQILDKYTIDYRQACARFREERTLFFEELQEVGYLAVFPSQANFFLCEVTHKYSARELAEVLLREHDILVKDCSLKRGMYGKQYIRIAIRSKEENRYLAGILKYKL

SEQ ID NO: 8787 - protein, 154 aa, B.fragilis
KSLLRVIAEEAFYFLTDLPFTETRSNEKEIKGRECRCNLLNLPHGHLTKVITSHTKSKCILAPPGRMHLHTNKTNNKPICHRWALALIRTFTISPGGILMLRLKIHLCTRFESHRLFSRNSHYLSRRQIITFTGFALFYFKGSETYQCDGFSLM

SEQ ID NO: 8788 - protein, 1011 aa, B.fragilis
IKSKMQNKGFVKVFAVLLTLVCVFYLSFSFVTRHYTNKAKEFAKGDVKVEQDYLDSLSNEKVWLGNYTLKQCREMEISLGLDLKGGMNVILEVSVPDVIKALADNKPDEAFNKALAEAAKQATTSQDDVITLFIKEYHKVAPGAKLSELFATQQLKDKVNQKSSDAEVEKVLREEVKAAVTNSYNVLRTRIDRFGVVQPNIQSLEDKMGRIMVELPGIKEPERVRKLLQGSANLEFWETYNAKEVAPYLQAADSKLRAVLAHEATVNDTVAAVDSTALAAAEATPDKAVSAADSLAAALKGGEKKQQASSADLEQLKKEHPLLAILSVNPNGGPVVGYANYKDTATVNSYLAMKEVAAELPKDLRLKWGVSPFEYDPKGQTFELYAIKSTERNGKAPLEGDVVTDAKDDYDQYGKPSVSMSMNSDGARRWALLTKQNINKSIAIVLDNYVYSAPNVSNEITGGNSQITGHFTPEQAKDLANVLKSGKMPAPAHIVQEDIVGPSLGQESINAGIFSFVVALILLMIYMCSMYGFIPGMIANGALVLNFFFTLGILSSFQAALTMSGIAGMVLSLGMAVDANVLIYERTKEELRSGKGVKKALADGYSNAFSAIFDSNLTSIITGIILFYFGTGPIRGFATTLIIGILCSFFTAVFMTRLVYEHFMSKDKLLNLTFTSPISKKMLVNTHFDFMGGNKKWLTITGVILLICIGSLVTRGLSQSIDFTGGRNFKVQFENPIEPEQVRELISNKFGDANVSVISIGTDKKTVRISTNYRIQDEGNNVDSEIESYLYEALKPMLTQNITLATFIDRDNHTGGSIISSQKVGPSIADDIKTSAIWSVVFALVAIGLYILIRFRNIAYSAGSVAALTSDTLMILGAYSLCWGWMPFSLEIDQTFIGAILTAIGYSINDKVVIFDRVREFFGLYPKRNVKQLFDDSLNTTLARTINTSLSTLIVLLCIFILGGDSIRSFAFAMILGVVIGTLSSLFVASPIAYMMLKNKKGSAPATTTEE

SEQ ID NO: 8789 - protein, 82 aa, B.fragilis
ISPNRDSSVTSNGTISTFEAASLKRSEGTVDTSSERLITGIPDLDIGSCFLLELHPNNTNTPISNKDMCFIATIELRFIVCA

SEQ ID NO: 8790 - protein, 493 aa, B.fragilis
FENKMKSFTFFRTEEGNYYLYNSRKSSLLNVHPVIKVIEALDNNDGEETLFAKIMNQNLEIGDDEKRLLLDKYLFLRDNGFFEEINEEDFIDGKITPEIVEKQIAFIDNVLFQVTGNCNLRCQYCCYGDMYSDKVEKKNLSFETVETVLNYLMSLWTSNKNLSYEHPIRIGFYGGEPLVNFSLIEKIVSLCESITERTGLVFIYSMTTNALLLDRYKDFIVRHNFSLLISMDGNEAHNVLRIKPDGEQSFQTVYENVKKLQQQYPDYFQNKVEFNSVLNSHSSVDDIHDFIFNEFGKIPLIETISHTALSDEQKYQEIAKDYKESPEMMIKRKDRSPVYKELGFFFYYQLDNAYKHYCEVLYGTIKQKKRIPTGTCLPFFKKMFVTADNKLLTCERISLHHVLGTVDNEVHLNFGEIASIYNSYYEKMRSQCRGCYLIENCGECFLQFPLKNGVPVCHVKMNEIQYQHYLSEIFGVLEKNPSLFEEVNKMVFA

SEQ ID NO: 8791 - protein, 126 aa, B.fragilis
CNSNLLAMDKIEFREDKITFSYKKSYGECLYQDLIAVEYSKPYCILQIGGRNSILFLISLRVILEKLPADFLLINRGIIVNKERIVDCVLQDGAYHIKMDNNKIYRISTRKLATVKKYFMVQNDTI

SEQ ID NO: 8792 - protein, 334 aa, B.fragilis
NKQNEQSMKKVILAVASIALWASCIEDEKDYSQIIETRVANCETSKDFSVPVKEGYTTFVTSGEDTLAMANEPITIRIPKNATISTRAEGDGINISYTILDEGSETTYAKVWQAIMFEDTQNGDYDYNDLIIHVKNTASNHAYQHPSETWQTIEIQPIALGSTKTIKLGCILSDGSTHMISDDVRTDLFGGRQGFINTVNDNDPIRYKLASTNIKNYAMPKKEKTSAAWVAWFIEVDGKRMYAASSDIDYKSYDMVNKENMPYGLAVSNNNGTFSYPQEKNSLFETYPGFSDWINGKVSSIGSFQKELVYKYCSGGIIGEDGKSHKIWDYLDLN

SEQ ID NO: 8793 - protein, 1003 aa, B.fragilis
IMKKKISRLICAVACCVPVALQAQTSEKITSPVNLYKEGKELFLQKNYAAAMPPLRTFVRQKADVNLKEEAEYMLVCSAYELKDRNAIAQLRNYLDTYPDTPHANRIYALIASAYFYQGNYDEALALFNSSRLDLLGNEERDDMTYQLATCYLKVGNVKEAAIWFETLKASSPKYANDCSYYISYIRYTQKRYDEALKGFLPLQDDAKYKALVPYYIAEIYAVKKNYDKAQIVAQNYLSAYPQNEHAAEMYRILGDAYYHFGDYHKAVASFRNYLEKENTPRRDALYMLGLSYFQTGVFSKAAETLGEVTTESDALTQNAYLHMGLAYLHLAEKNKARMAFEQAAASNANLKIKEQAAYNYALCIHETSYSAFGESVTVFEKFLNEFPNSEYAEMVSSYLVEVYMNTRSYEAALKSIDRIAHPGKRILEAKQRILFQLGTQAFANTQFEQAIGYFDRSLGLGQYNRQTKADALYWRGEAYYRLNRMEEAKRNFTDYLQLTQQTHNEMYALAHYNLGYIAFHQKDYTQAQNWFRKYISLEKGENKTALADAYNRIGDCYLDVRNFDEAKHYYSQAEAMNTPSGDYSFYQLALVSGLQKDYSGKITLLNRLAGKYPASPYAISALYEKGRSYVLMDNNQQAIASFKELLAKYPESPVSRKAAAEIGLLYYQNEDYDQAINAYKQVVQKYPGSDEARLAMRDLKSIYVDMNRIDEFAALASAMPGNIRFDASEQDSLTYMAAEKIYIRGRVEQAKESFGKYLQTFPDGAFGLNAHHYLCLIGKEQKNYDMILEHSGKLLEYPDNPFSEEALIMRAEVQFNKVQFADALASYKMLKEKATTAERRLLAETGMLRAAYLLKDDTETIHAATALLSEAKLSPELKNEALYYRAKAYLNQKADKAAMGDLKELAKDTRNLYGAEAKFLVAQELYNSQNYAAAEKELLNFIDQSTPHAYWLARGFILLSDVYVAMDKKLDARQYLLSLQQNYHADDDIESMIESRLNNLNK

SEQ ID NO: 8794 - protein, 801 aa, B.fragilis
GKENVFFYFCGQFICFNITDMQKNLVIVESPAKAKTIEKFLGKDFKVLSSYGHIRDLKKKEFSIDIEKNFKPKYEIPAEKQELVNKLKEEASKAETVWLASDEDREGEAISWHLYEVLKLKPENTKRIVFHEITKTAILKAIEQPRDIDINLVNAQQARRILDRIVGFELSPVLWKKVKPALSAGRVQSVAVRLIVEREREIQAFKSEASYRVTAVFLVPDADGKLVEMKAELARRLKTKKEAQKFLESCKAATFSIEDIVTRPVKKSPAAPFTTSTLQQEAARKLGFTVAQTMMVAQKLYESGLITYMRTDSVNLSEYATEGSKVAIAQMMGDQYVHPRHFATKTKGAQEAHEAIRPTYMENQTIEGSAQERKLYDLVWKRTIASQMADAELEKTTATIGISNGNDKFTATGEVIKFDGFLRVYKESYDDDNEQEDESHLLPPLKKGQMLEHQGIVATERFTQRPSRYTEASLVRKLEELGIGRPSTYAPTISTIQQREYVEKGDKPGEERSFDILTLKDNQITDIKHTEIVGAEKSKLLPTDIGTVVNDFLTEYFPNILDYNFTANVEKQFDEIAEGDKKWTSIMKDFYKDFHPSVETTLATKTEHKVGERILGEEPKTGKPVSVKIGRFGPVVQIGTADDTDKPRFAQMKKGQSMETITLEEALDLFKLPRKVGEFEDKTVTIGTGRFGPYVYHNSKYVSLPKTYDPLEVTLDEAIELILAKREAEAKKHIKKFDEDAEMEILNGRYGPYIAYKGNNYKIPKDVVPVDLNYQTCLEIIKLQSEKAENAPKRGRYAKKK

SEQ ID NO: 8795 - protein, 569 aa, B.fragilis
QSMKYNNYILLGIAFTALPVSIQAQTQPKDTTVNRTVIVEQQYNPDIMDAAKVNVLPKVEEPSVSKKEVEYATFTTPATSIPAGTIGAYTGKEIQPGFIPGYVRLGYGNYGNLDVLANYLFRLSDRDKLNVNFKMDGMDGTLDMPFGDTRKWNAFYYRTRANVDYVHQFAKLDLNVAGNFGLSNFNYEPYGFKKQKFTSGDVHFGVKSTDETLPLQYRAETNLMLYGRQQCQLFGGVNETMVRTLATVSGSVSDEQTVAIGFAMNNLIYGNELKENKDRIKDIFKNRTTLDLNPYYELNNDSWRVHVGANVDLSFGNGKAVRVSPDVKAQYVFSDSYVLYAKATGGRQLNDFRRLETYNPYLDPGQEVKDTYEQLNAGLGFKASPTPGLWFDIFGGYQNLKDDLYQSADAWEGGDGANYIGLGQTHTDNFYAGIKASYEYKDLFAISAGGTYYHWNADAQTTGSKSSDYNEALLMKPEFDLGIHTEIHPIAALWLNAGYQYTRRAERYTGLYAKSIPAVSNLSLGATYRIFKGISAYVKADNLLNKKYQYYLYYPVEGINFVGGLSFRF

SEQ ID NO: 8796 - protein, 436 aa, B.fragilis
IVMKSILLLLIITLLGCSSNMKQEPISKSGIPVINLSEDVSTVPSLLLSESAEKLEIVPLEMTDQSMLGEIRRIQVTEHDIWIHDFNKFYIYRFSRTGKFLNRIGSIGQAPGEYVNFSTFLVDEYKKEVYIISNNNGILVYNFKGEFKKKIVDQQTINNLFSSVYSQYILYNGNFFAAQNIALYKLIDKDSLWSFAFLDTAFQEKKLFKNPAHMGREEQIIANCVDKGRMINLWMEYQTSIDTYNNQLTLKYPDTDTIYCYDDATNDLLSQYVICTREEKGDYEVTHLWFKDRKAFDYFSIKSYYPTKAFIYLVGSKGEEVYTYCYNKKDGSVRLQKRQSAITERDVPWFSFPLRQMKRDFVLDNDLGGGDFTVDSRSSGKYWVDILEPGGDENWIDIDQIKSSTVIDESKKKELIRVLESATEDSNPILMIATLK

SEQ ID NO: 8797 - protein, 436 aa, B.fragilis
IVMKSILLLLIITLLGCSSNKKQEPISRSGVPVINLSEDVSTVPSLLLSEAAEKLEIVPLEMTDESVLSDITEMQVTDHNIWIDHGREFYIYRFSRTGKFLNRIGSIGQGPGEYVNYLTFLVDEDKKEVYIFSTNNGVLVYDFEGGFKKQISDFQTMVGMFSSIYKQYILNDHKFFAIQNFGLYRSVDKDSLWSFVSLDDNFQKKRLFKNPVHVGKEEQIIANRANMDRMVNYWMEYLTSVDIYNGQLTLKYPDTDTIYCYDDATNQLLPQYAIFTDEEKGDYEATHLWFKDRKAFDYFSIFSYYPTKDFIYLVGSKGEEVYTYCYNKKDGSVRLQKRQSTITERDVPWFSFPLRQMKRDFVLDNDLGGGDFTVDSRSSGKYWIDILEPGGDENWIDIDQIKSSTVIDESKKKELIRVLESTTEDSNPILMIATLK

SEQ ID NO: 8798 - protein, 411 aa, B.fragilis
NGVCMKKYWFIVETYVFLWKKEDHILVYNSISGKGYIYKCSPDLLSFMDQLMLPENLYCSQVDEELLRRKSIGEFVISMQSNFCGSLFDVDEFPQKPIVAVPDVNIGEDIEGVDNSVFGGNVLRNLTDVFICLTGKCNKNCPDCNLIYKQMCWCHKSNESLAFEKLEAILKKLEYLNVFELHFTGGNMFLYPYWRELLIKLNEISYKKSFYVHYSQLRGYDEDIDHILNLENSVIRILVDFADFDVENLLLISKSGGPFEYLFKITSWNEYNEACDIIERLCLNAKIIPFYNVGNYSFFEDNVFLNMQDILSTKWTKNEIFANQKLNTNDFGKIRILENGFVYANLNFAPIGKWHDDYREIVYNELKRGTSWRRTRDSLPVCKECLCKYLCPSPSNYELAIGKSNLCHVKS

SEQ ID NO: 8799 - protein, 126 aa, B.fragilis
SVTCISVISLNTDSSVISKGTISNFSAASLKRSEGTVDTSSERLITGTPDLDIGSCFLLELHPNSVIISNNNIDFITIYLLETTYFSIIGTYSIILKLQSSKPDCYPQSHFPKPELAPFSWIHLLQ

SEQ ID NO: 8800 - protein, 399 aa, B.fragilis
NEFCMKVLYVIFICVLYSCMQNVEPDNKINVGAAMNALGKITAQTISSNVRYVALETNDSSLVGEMPDMRVLEHAILVSSVNQCLKLFDRSTGKFIRDIGHVGTDPQGYAKDAWGKVNYWVDYDQNIIYVLGWGNDLILYDLAGNYKDRICIDDNVRYNLQQSYLYVTYGKLWGHNKLDISKSPLFCIDENSNHITDIVGLPVDLLPMDDLQSVSELLGDYVSYGGDLTMASFANGGKFYTAINSPSLWRFENDIRLKQTFNDTIYTLSDSKIKPYLIFELGDWAWQYQDRLEEGGCEKKIMIDYALENERCIYFHFHTGFYTKNRQAFCGLYYKADHRVVLMCGDRLLDTVNRQSLRVRGVSSDGCFIALLQPDELCDEVKKKTGSKEEDNPIVVILE

SEQ ID NO: 8801 - protein, 428 aa, B.fragilis
KILCIFTSNLMMDKAMRIILILGAMILGFTACSNKKTVNPNPVVRDNIIHLSTAIKNVREEMMLSELVDSVRYIPLETNPNCMLRNYQRLTFSPQYIFYLNYCFDWNGQFLFRIGSQGQGACEDIYAHVAEIVYLNNHFYGNASKIIEYDDRGKCTGKELSWFTQKTMDTAPVGHLVNQVCFAPAGENLMFYNSPDTVYFINTDYEFVAKRSMMPWNRKGIAPSMGSVKYTSYYKDTTLFYIFYTDTVFTVTPTSLVPRWVVELDEELRFPTQYLYEDGLFSDAFKCWESGNLENAKMIKMLDHKYIVSGVFETEHFVFLSVYEYMAYWELRKLPKPPLLTAIYNKRTGETFAVKQIIDDLGGMKTFFPSWGAYNEKLLATIWPYKLKEFIEEEQSAGRTVAPQILNLMKRVREDDNPILIIANLKTK

SEQ ID NO: 8802 - protein, 561 aa, B.fragilis
DTMCLNKNIKSFLGILMCGILAFLPVSCSDDSPVTGSPLLPEAPEGKVNVFLSLHKGSDYESPATRSGTAADETIMGPPWVLVFLGNDKDATFLEAVQADMTSVGELYAQLSACNSSVVLLLISNADELIQAKLGSLTTTTTLSDAVTNLLLYGDPSDSPVGGNSALAIPQATVPFTGKKIPMSAYCPLPQIITGTTVGTVGTPLRLKRIVSKLYVDASGAHASDGFILTGVSVINVPVQGALAFEYGNANETLPITAQFTDYGHKSGSASRLDNPIIASSTGFAGHITAGMGSEDYPVYVYETAGGPADRSDVILAGKFDNGPVRYYRASLKNSKGEKLAFKRNYLYTLNLVRVEGGGYSTMDEAIAAPSGSSGILCNVTVVDDSHEITGNGVYYLGLTNSSYVLYTDEEQKDVTVCVIGTNAYSRPGSTVTPGVVSMSSGIAGVTLKTTSISADSTAIKLDFAKGAQGETTLDVQVGGLRREIKLKAAGMGVSGNYASGSQGLLLGDFNQIRILESTSKSGLAISPASPDRDSEVISSVTSPSVPVYFFVEEAAGPTKC

SEQ ID NO: 8803 - protein, 228 aa, B.fragilis
QIRRMPTVTKNLIIINVLLFLAQFVAQSYGINLSDYLGLHFFLADNFNPAQLFTYMFMHGGFTHIFFNMFAVWMFGRILEQVWGPKRFLFYYILCGVGAGLLQEGVQYIQYVTELSQYTSVNIGTGIIPMSEYLNMMTTVGASGAVYAILLAFGMLFPNQQLFIFPLPFPIKAKFFVIGYALIELYAGFANNPGDNVAHFAHLGGMIFGFILIMYWRKKNRNNGTYYN

SEQ ID NO: 8804 - protein, 309 aa, B.fragilis
SCTGEKRTETMGHIITDLKEAFRRGNVYIQLIFINVGVFVITTLIGILLQLFNRSAAGIFELLALPASFTRFAWQPWSIFTYMFMHAGFLHILFNMLWLYWFGALFLYFFSGKHLRGLYIVGGICGGLLYMISYNVFPYFRPMTAYSTMVGASASVLAIVVATAYREPNYPVRLLFFGNVRLKYLALIVVLTDLLFITSSNAGGHIAHLGGALAGLWFAASLNKGKDITSWVNKALDAIAALFSAKTWKRKPKMKVHYGNNTRQNDYDYNARKKAQSDEIDRILDKLKKSGYESLTTEEKKSLFDASKR

SEQ ID NO: 8805 - protein, 77 aa, B.fragilis
ADIGIFFPVKGTVACGIANAELPPTGESDGSPYRRRLVTASDKVVVVVRLPNFACINSSAFEINSKTTEELQALNCA

SEQ ID NO: 8806 - protein, 489 aa, B.fragilis
KDRGWGPGNKKWRMPTLDELKLLGDGIRETISSTPNWNSISISSDDGSFVISNGIRTNNRYYLPANRYGDSGEYWSASAAISGSARGLCFRYSSTSIKDWTTALVSGAIRCVVDSENNYSKVYRVVYSNTDPLNQENNLYSVPPPALLNEGETITLPALSTKFNDYEVREGSKVVTKYFHSGWLVNGRHFDFGDSYVVGADGIGNTEVEIRPEWTKLCKIEYVATPPYPGAIFYWRFPSTTIFVKIGEKHSLFYVESAVNSSPVKMCTGLLVNGIRYSFGDEIVASTDVKIEPYWANTPETPFASTNLELSNPGSTDATFIFAPTGSKGSKCSHQVANSNFPINGVTIPSLLPTDYDNARRLIHSVEGLKRGVGDVCRLVGIPLNEINAKLAAGELPDNKTWRLPAVYEMAALLHPYQDSSEGRFYPILNTYFPYHTVYIGIPGIAASYITAGSRNNNRVVTVTISQGDGGITGGMFSATSDYARCIRQ

SEQ ID NO: 8807 - protein, 189 aa, B.fragilis
NCFFFVIFACTKTNRMMEHPLNQFKYCPKCGSAAFEIHNEKSKQCTDCGFVYYFNPSSATVALILNEKDELLVCRRAKEPAKGTLDLPGGFIDMNETGEEGVSREVEEETGLKVKKATYLFSLPNIYIYSGFPVHTLDMFFLCQVEDTSHFEAMDDVADSFFVPLCQINPEEFGLGSIKKGLKRFLKER

SEQ ID NO: 8808 - protein, 207 aa, B.fragilis
  UNSURE (199),(200),(201),(202),(205): Identity of amino acid sequences at the above locations are unknown.
IMNIDIKEAHRRMLYLLQSFDTVCKKHDIDYWLDYGTLLGAIRHQGFIPWDTDTDVGMLRSDYALFLEKGVSELPQDIFFQTPETEPAMAPWSWLVEARLRDRHSRYVPDKKTPAEPMQFGGLQLDLFIYDWDGKYENALSNSFERNLSESRIHLRLDEVEYLDTARFEGVEFPVPSGYDAYLTRWSSPRGWREARRGXXXXYGXSP

SEQ ID NO: 8809 - protein, 77 aa, B.fragilis
FTVFADNAAGAIFVDKFFLETADGAYFTVDPIAKARIRLKKTVLFLWIAERAIIIRNGQAIRHIFLIYHIVGFVIDV

SEQ ID NO: 8810 - protein, 99 aa, B.fragilis
HILINHLRIMNKAELINAMAAESGLSKVDSKKALEAFFSSVTKALSAGDKISLVGFGTFSVAERSARMGINPSTKKAIEIPAKKVAKFKPGAELTDAIK

SEQ ID NO: 8811 - protein, 426 aa, B.fragilis
MKQIFLFLFIFLLTSCISGGAKQDQIKVIDRTIRIGDAMEHPVPMKLSAFVDSITYIPLETTKSYVKDKMLISYVEPYWVVYPGSLFDKEGRFVTNIGALGQGRGEETNGWGYSVFYDLQRNVFYTLGDKIIEFDSNRKFTGKEVRISYRERNAMQVAGGLKNVVALLKADTKYLLVNYPDSIFWMDSDLEVTHNTRIIPDSLFLDPPGDANGMSYTFSRYKDTTIFYNCFTDAIYAVTDTGLQKRWDLDLKGLKPDNRCFLNELNRLYLQEMVKIVRSSSGNENVVKSKAENSELAQLIDDKKWVNHAYESERYVLMSWVNLKAFSGWRGLKEESHLAFYDKRSGKTIAVAGDGLIDDIDGGMMFYPSLGVCDGAMVYSVWPFELKEYIQEKKAKGEAVSDRLIALADSLDDEQNPILVIAHLKK

SEQ ID NO: 8812 - protein, 100 aa, B.fragilis
FHFVKFTICPVSSVCNRINSDEDSCSAKNALHLASVFVYIVAVLLIGGCLDMIFLDPSVYLSPVLAVCFLSSIGAFSFSVCNQPLSSPIGSLIYPPFLVS

SEQ ID NO: 8813 - protein, 107 aa, B.fragilis
LISVAYKAANIVFFSHSEVIRRQIFECEGDFWDASTDIGGSIVCLFGNMSNETSQFSFFRLSGQAGPEKRLYFVSRFIVLFCPAFIFRQKESDLEVNIPGALQGGEF

SEQ ID NO: 8814 - protein, 69 aa, B.fragilis
SRRVRVGLYQKRVKKIPEREVKYIKTSTFVKTLNYEKKDITIDMCRGMLCACRLAGTNQRENNVSRKSV

SEQ ID NO: 8815 - protein, 1022 aa, B.fragilis
KLPVWVFPAIMLQVLKDSCWEISTRSVFLKVRLSLDWQYLPHLRTGIARSSLPLLLLLSLFTSLSRRLRAPQSAKLSGLAGESVVVIENRVYNDLPAASNIYWDAAQGRLTFDDVPSYVPAARNQKQGVYFLYGSLIALQGGSSATDVCQLDAAEVNPVWKTNQSPNIPKFNPASLAPGADLENVLTHIHNPGNRIGDICRYLTQRGWAPPGKKWKMPVKERLEAVLNSIYRTEGSWLPIGGLATDGTGEVVHGRLIKDRFYFPASGSRKEDGTFIEQPGVSGHYWSSSVISGSIGWQPASLWFQGGDAAIQATALDVALPVRCVVDNTSTDWPELATVTYYAYPPGGATLTSELPANHFVEQRKPFALPSTPLTLSDPSVAHTGWGNNLGLGENTTINTSVGSFYATFSQGASLEYDSNLPAGTALVSGTVPGVYVAAGGTSIKLSTNQLVCSNPGYVHTGWSIDGVYHGLGANYVMHASGSRKAFAVWSRDCWVEYLAKAPAGAPAGVTVTGTLPSPVKVAQNSSVTLATEAQGLQVCSDPRWKHTAWTAGAFGGNTIVTNALKIYPEWTRYYQVTYSPQPPSGTVPGYPRSEIVAPGSSVMLPVQLHTSDPLQVHQAWLVGGQEKAPGTSVIVNGDMTITAKWLLYEVSYLANAPVGTTSVTPLPALQKIAPGKMVTLSATRLVCSDPAWIHTGWSVGGVHYILGANIPVLSNMQVSAEWTKRFKIKYHLNLPSGTGHAGDMLPEDEYVMPGQNVTLAVPRLKCSNEDFFFTGWMINGQFYGLGSSYTPLPGQDTDVYAVWKYAQAMEFNVTVSNSGRGTDNATLVFTDSKEETGAFFQSRGVVAWSNTGSPVTWFDPVSTGRTWSSNWMAFASEELHTYANLRNGGGDPCRLIGYSQKYVSTQISKGELPDNRTWRLPKGREYMQYGFTPENTVGSWANGWTFNNGKFLPASGMRSVADGQLRESGVGYYWLSDHFAIIDHFGKQYMGRGSKVSSDKVIEEGVVYHSAAGFQIRCVRQ

SEQ ID NO: 8816 - protein, 233 aa, B.fragilis
KRLSENNNLSLPILNMKINYTYMMRYSVIIPVYNRPDEVDELLQSLTAQHFKDFEVVVVEDGSSVPCEKIVNQYQGKLDIHYYNKPNSGPGQTRNYGAERSNGEYLIILDSDCILPEGYLDAVEKELQTAPADAFGGPDRAHSSFTDIQKAINYSMTSFFTTGGIRGGKKKMDKFYPRSFNMGVPPGGLSGIRTFLQYAFRRTHRFQYPHIQGRIPMPSLSRCLGVPQTTYGF

SEQ ID NO: 8817 - protein, 254 aa, B.fragilis
PVLSLGNAEMERLRMTTKTGQAEWRALDENQKMRELPLAIELQDFTIDEYPPKLMLINNETGEALPSKKPENLLIEDNFHTGRLLDWEIGIEKKIPLAASVATQDTLNFVEFHSMGATYAVYLKAVNNKTGQQREGWVSCGSFMFPYKAIRLDDQTSLVMPEREPRRFASEVKVYTESGCRDSATIEVNKPFELEGWKIYQLSYDESKGRWSDISVFELVRDPWLPVVYTGIWMMIAGAVCLFALSQKRKEDNT

SEQ ID NO: 8818 - protein, 94 aa, B.fragilis
KSVSKPSLLVFHLAPDTVIKLEPVLKQKEAKESSFTSSYSFAMANTYAFTPLYSSETVSFLRPLARRAANTLRPLAVAILSRKPCLFFLFLLEG

SEQ ID NO: 8819 - protein, 627 aa, B.fragilis
QIKSSSMNRRLSIFVIILFFLLPVAARAQVTGSFRFAQLTDIHLNPNNPKPTEDLKRSVEQINATPGVDFVLVTGDLTEEGDRTTMLVVKSILDRLKVKYYVIPGNHETKWSDSGCTAFSEIFGGERFKFEHKGFLFLGFNSGPLMRMAYGHVVPQDITWMKQEMDKVGKDKPVILVTHYPMQDGDVDNWYDVTDAVRPYNIRTFIGGHYHRNRFLSYDGIPGILTRSNLRDKNGSSGYSIFDITPDSIITYEQRIDEPMKRWTALSLTKSYYNRTGKAVKYPSFSVNKEYPQVKIGWQVQTGVGIYCSPALWKGRVYVGDDLGFLTCYTLKEGRKLWSFQSGKRIVGTPAATDGIVVFGSADHNIYGLDAVTGKERWRVTVAQPVLGAVTIEKGIAYIGGSDSTFRAIRIKNGKVVWTYTGIKGYIETKPLVEGDKVIFGAWDNTLYALNKSNGKELWKWTGGLTRMHFSPAAVWPVAAHGKVFITDPQRAMTAISLKTGKTVWRTFQSMVRETIGLSANKNQIYSKTMNDSVVCYSTISDTPKEIWASNVGFGYEHAPSMQMEKDGIVFSSTKEGLIFALDASTGQVLWKHKIGNSLINTVLPISRHQVLFTATSGETGLLEWKE

SEQ ID NO: 8820 - protein, 307 aa, B.fragilis
KNFPIKTNQITKNIIYLYPNQKGCEMKLIAESGSTRTEWALVEDNHLVQRVFTEGLNPFFQTRREISRSVRLGLPESFFKKKLDQVYYYGAGCSSYEKKNILGASLVAQFKTPIQVESDLLAAARGLFKCEAGIACILGTGSNSCFYDGKIIVKNVKAAGYILGDEGSGAVLGKLFLADLLKGLAPKELANEFHEKFRISVNDVMESVYNLPFPNRFLGTIAYFLGDYMDNEYVYNLLTNNLRSFFNRNVCQYDYINYPIRFVGSLAYAYPDILQEVAQEFGVEIDVIEETPMNGLIEFHSMNIEES

SEQ ID NO: 8821 - protein, 258 aa, B.fragilis
YFSPVFFEFGIKDFIDILLVAFLLYYTYKLMKASGSINVFTGILVFILIWLVVSQVLEMKLLGSIFDKLVSVGVLALIVLFQDEIRRFLLTLGSHQHASALVRFLTGNKKEKLQHDDIMPIVMACISMGKQKVGALIVMERNVPLDDVIRTGEIIDANINQRLIENIFFKNSPLHDGAMVISKKRIKAAGCILPVSHNLDIPKELGLRHRAAMGISQVSDALAIIVSEETGAISVAWRGQFYLRQSAEELESLLTKES

SEQ ID NO: 8822 - protein, 157 aa, B.fragilis
SISFTFSLFFCSSPLLNKNLRALLVATLTLFFITLQRFQKSIGNSMIRQCAILFGCLALGELIVYLTGIKLPSSIIGMLLLTLFLKLGWIKLHWVQGMSDFLVANLGFFFIPPGVALMLYFDIIAAQFWPIVIATLVSTLLVLVITGWVHQLTRKLK

SEQ ID NO: 8823 - protein, 633 aa, B.fragilis
PTIPLSMENKINFSPPSTREGKGVRFLLTTFSILLCSLQAVAQSLPRVAPEQVGMDSHRLLHADEAIHRAIDHKEIPGAVLAVIRHGKMAYLKAYGNKRIYPNVEPMEINTVFDMASCSKSMSTAVSVMILVERGQLRLLDRVSFYLPDFQEWRGENGEKKDIRIIDLMTHTSGLPPYAPVSELQEKYGSPNPKGLIEYISTCKREFKPQTKFQYSCLNYITLQHIIETITGQSLRDFAKENIFDILGMQYTDYLPTIQQQDGKWINTVACPWMDRIAPTEKQKDGSVLCGQVHDPLARILNGGISGNAGIFSNANDIGILAAALLNGGEYNGHRILSPLGVKTMCTVPRELTAFGRTPGWDIFSPYASNKGDLFSPNTFGHTGYTGTSIIIDPDNDTAVILLVNAVHPEDRHSIVRLRSLVANAVAASICPPAQVYTDHYYKRFLQFETETPISPKDIVMVGNSLTENGGNWSKRLNKKNIRNRGIIGDEALGICQRLFQILPGTPQKLFLMAGINDVSHDLSTDSVVTLITKVIEKIQTESPRTKLYIQSLLPINESFGRYKTMIGKTDLIPEINRKLEALAKEKKIPFIHLFPLFTEKNSNVMRKELTTDGLHLTEEGYRIWSKALKRYL

SEQ ID NO: 8824 - protein, 110 aa, B.fragilis
LCQPHALSGQCHHHRRPKPERFGYAFYFRTAQRMERPFFSRPHFDAEMNTMSLAFEPDFKAIFFPKIDFEGKIPLFKRARKPLKDKIFSPKVPKSQDKFFFSHVGVLTPF

SEQ ID NO: 8825 - protein, 82 aa, B.fragilis
FQQFVGLFLEEEVLLHRHFRALEQEMEVHNSEYKGPLQSERFVHVAIPSEPIWIRNKSRDFAIEQCDGFAIRLWGYKEQIIG

SEQ ID NO: 8826 - protein, 137 aa, B.fragilis
PLITNYMSKMNSMLMGICFLLSSLFSCQQSKGDFKTVPVKEFASLIEDASVQRLDVRTMAEYSEGHIPGTININVLDDSFADIADSTLQKDKPVALYCRSGKRSKKAAAILSEKGYKVYELDKGFNAWQEAGEKVEK

SEQ ID NO: 8827 - protein, 307 aa, B.fragilis
TGATEIKMWKDFFYFTRAERQGILILAVLCILVFVAGWLIPVKENTAKNNTEKFKKEYAGFMSSIREKEQKIYSHNNRFQPPRTVRLTTFDPNITDSVGFLDLGLPAWMAKNILKYRNKGGKFRRAEDFRKVYGLTQEQYEMLLPYIHIATLAKPKDTLRLYTRKIEEDTLKFFKYAAGTVVELNSADTTELKKIPGIGSGIARMITGYRNRLGGFYDIAQLKEIHLDVEKLRPWFNVATGNTRRLNINRTGIERLKAHPYINFYQAKIIVEYRKKKGILKSLKQLSLYEEFTPQDLERISHYICFE

SEQ ID NO: 8828 - protein, 391 aa, B.fragilis
IKNTMNQTVNKRLLALDVLRGITIAGMIMVNNPGSWSYVYAPLGHAAWIGLTPTDLVFPFFMFIMGISTYISLRKYNFEFSHSAALKILKRTIVIFAIGLGIAWFSMFCRTWNSLSGEDISFFSRLYESVWTFGHIRILGVMQRLALCYGATAIIALIMKHKYIPYLIAILLIGYFIILINGNGFEYNSSNILSIVDRTVLGEAHMYKDNGIDPEGLLSTIPSIAHVLIGFCVGKLLMEVKDIHEKIERLFLIGTILTFAGFLLSYGCPISKKIWSPTFAIVTCGLASSFLALLVWIIDVRGYTRWSRFFESFGVNPLFIYVMGAVLSILLGSILIPYDGGSISLHGFVYNAILQPVLGDYPGSLAFAILFVGLNWCIGYILYKKKIYIKI

SEQ ID NO: 8829 - protein, 237 aa, B.fragilis
RILTTKNRIDMKKSLLISVFATLAMMISLNALAQEKATGKAYKAIQKDEKVINKDLQKKAIKEARKQAKELTKEGFKTPVGKLPLDKQLENSWEKQMEIDMNGNPYWYIATSRVIGGNQSAAAMQATNTAKIDIAGQVQTKVTQLIESKVANDDMGQEEAASLSSAVAAGKSIISGTLGRTIPLVEVYRTLPNKNVEVMVTIGYSLEAANKVAVKALSEELAKKSPELAKELDKLAQ

SEQ ID NO: 8830 - protein, 399 aa, B.fragilis
LPVTRCSSLVVYKRIKAMNTTEFDEIRPYNDEELSGVFEELIADPAFQKVVAGVIPDVPFEMLAQKMRACRTKLEFQKTFCYGLLWKLAGDCTDGISLDHTAIPDKSKAYTYISNHRDIILDSGFLSVLLVDQGMDTVEIAIGDNLLIYPWIKKFVRVNKSFIVQRALTMRQMLESSARMSRYMHYAIGEKNQSIWIAQREGRAKDSNDRTQDSVLKMLAMGGEGDVVSRLMEMNIAPLAISYEYDPCDYLKAQEFQLKRDIEGYKKTMADDLKNMQTGLFGYKGRVHFQTGACLNDLLSTVDRSLPKPELFARISTWIDQRIHSNYRLYPGNYVAHDLLTGKNDFESHYTLAEKERFEAYVEKQLEKIEIPNKDISFLREKLLLMYANPLTNYLAARQ

SEQ ID NO: 8831 - protein, 295 aa, B.fragilis
SMVAGRLYRYLDDDSGSCLPVCLVTEKKGGQHMSWDQFVIFAIVALLCWGIGAVAAWRGKRQWMVYTATLAGLAVFFAFILGMWISLERPPMRTMGETRLWYSFFLPLAGIITYSRWRYKWILSFSFILSLVFVCINLFKPEIHNKTLMPALQSPWFAPHVIVYMFAYAMLGAAAVMAVYLLWIKKKTPEEREMELCDNLVNVGLAFMTLGMLFGALWAKEAWGHYWSWDPKETWAAATWLGYLCYIHFRMNRRQKVRTALVGLLICFVLLQMCWYGINYLPSAQGTSVHTYNLN

SEQ ID NO: 8832 - protein, 71 aa, B.fragilis
NPSAAISCVAELNATSQKMARVVWKKFDIGMVKAIPASPAPTNSCMLTIHQRLVFNKSTNGLQKGLITHGK

SEQ ID NO: 8833 - protein, 263 aa, B.fragilis
DNYFCFGIEIRIFAPLFSQFPMQKVFLFLLLFLLPLAEVPNHAPASEPVSVASTPETDEIDQLFDDMQLDGIVSYTAFRQAVTGYRKIEQKSKSIMTLIDFSKPSTEKRLYVLDMKNKKLLYTSVVSHGKNSGGNYATSFSNKNGSYKSSLGFYLTENTYQGRNGYSLVLNGLEKGINDQAKQRAIVMHGAAYANPNITASAGRLGRSLGCPALPQALAKPIIDTIKKGSVLFIYANNKDYLANSTFLSPRQTEYLSWAQPAN

SEQ ID NO: 8834 - protein, 309 aa, B.fragilis
QKSAMKNPIIYRILQQGFCLIFCLGLLSSCIREEEFVNNPQGNFEQLWKIIDEQYCFLDYKQIDWDEIHTRYQKLITPNMGSEGLFEVLSEMLYELQDGHVNLASAHNVSYYDAWYQDYPRNFRADLLEDSYLGRASTDYRTAAGLKYKILKDNIGYIRYESFADPVGNGNLDEVLSYLSVCNGLIIDVRDNGGGNATNSARIASRFTNEKILTGYISHKTGTGHNDFSKPYAIYLEPANGVRWQKKVVVLTNRRSFSATNDFVNHMRCLANVTTIGDQNRRGSGMPFTFELPNGWSVPFFPGPILMRR

SEQ ID NO: 8835 - protein, 79 aa, B.fragilis
YQLALLILLRDKLFIINKGLETLWSSTMAKIYFILISRTNILYNLDLYLYIHIMTLLCFIKMICEYIYKRWFLRFRNIF

SEQ ID NO: 8836 - protein, 370 aa, B.fragilis
CALYLRQQQGLSGQQHLPVSTANGVSFMGAACQLKILSYLCGKGIFILTKTIMKKFTCVQDIGDLKSALAESFEIKKDRFKYVELGRNKTLLMIFFNSSLRTRLSTQKAALNLGMNVIVLDINQGAWKLETERGVIMDGDKPEHLLEAIPVMGCYCDIIGVRSFARFENREYDYNEVIINQFIQHSGRPVFSMEAATRHPLQSFADLITIEEYKKTARPKVVMTWAPHPRPLPQAVPNSFAEWMNATDYEFVITHPEGYELDPKFVGNARVEYDQMKAFEGADFIYAKNWAAYTGDNYGQILSTDRNWTVGDRQMAVTNNAYFMHCLPVRRNMIVTDDVIESPQSIVIPEAANREISATVVLKRLLENLP

SEQ ID NO: 8837 - protein, 208 aa, B.fragilis
AGNYWSAYYRYFFHFFLFITMKGYNIFFFIPLLFLLLSLHACTSKSKKDMEYVKGWHGKKISLPSESDFLLFGRDSVVYDYSSFPYKIVLVIGKEQCISCKFDVAKWQELIQQVDSITSFKVGFVFVLEPIYQHDVYVMLRSHQFMTPVFIDTNNTFRGMNKISDNDSHVWLLDSNNRIIYIGDPTVNQKINKEYMELVRTNYLFNDK

SEQ ID NO: 8838 - protein, 139 aa, B.fragilis
VLDYLCRNINLFIMKKLTCLITLFLFISVGYINAETMASRKKIKMKVETQHHQRSLPPPCPAEAFICGNTVDLIFRETNKTAVVTIMNLDTGEAIHYNVSTNDCSISIDLGNNQSESNYNIELILDGKAYTGEFTTNEI

SEQ ID NO: 8839 - protein, 297 aa, B.fragilis
IFLYMKTISKLFLLLSIILLSSCDETELDQTVTNQVNPQKEEDSRIVFNSAKEFYNTLDTLSYMTYEEQTEWIRASGIKYPLYKDLEFCEDEIMTEMPRAFQALFNHKMEMQINDTVIAFEKGNMYVKSIKEKILPVPVLYGQVGVNQEESEVTTRTVYETKYGKIGTSYQYEFKIPEGKSKYKYVHELKSVIIKENLPPYKSWSNLFLVLKLEWKGKKKWKVAEKEERNISIDLNVCKRNLAKVKYNQEIRIDVQNMDSKSHSINIEGYIIHEVVGIPSTKMFNGWSYPLVEWQPR

SEQ ID NO: 8840 - protein, 255 aa, B.fragilis
ISIHAFYLLSGKIGTGENAIFAQKTSIVVKVEFTDEYQKILWQISLFKDMDNSLQRRLPQELELSVYEVARKEIVLKQDTYCNHLYVLLKGELEVNIVDVAGNLVKVEDIRAPRAFATPHLFGDKNLLPATFTASEDSVLLMATRTSVFKLISSVPDLLHRFLCVTGNCNKCTVTRLRILSYKMLRSRLVYYFMEHKISPDTALLEHNQVQLAEYLGVTRPALSKEINKMMKEGLISINKKVVTLEDMAALKEYI

SEQ ID NO: 8841 - protein, 456 aa, B.fragilis
DRSQLWQESRGYSPKNKINPFLFTGYLKHTENMTYRRSILKLLLTFFVFMTSTLLSRGAEPGARPPRIRIKTGIEVLKEQNFKCLEGKRVGLITNPTGVDNHLISTIDILHEAPNVNLVALYGPEHGVRGDVHAGDKVDNANDSSTGLPVYSLYGKTRKPTPEMLKDIDVLVYDIQDIGCRSFTYISTMGVAMEAAAENNKEFIVLDRPNPIGGLKIEGNVVEDGYISFVSQFKIPYLYGLTCGELALMLNGEQMLSKPCNLHVVKMKGWKRKMDYVQTGLQWIPSSPHIPHPHSAFFYPVSGLLGELGYMSIGVGYTIPFQMFAAPWVEAEKLADNLNRLHLPGVIFRPMHLKPFYSVGKGEHLQGVQVHIVDFNKASLSEIQFYVMQEVTALYPDRAVFDHADKERFHMFDLVSGSKEIRERFSQRNRWEDVRDYWYKDVDDFRRLSQKYYLYK

SEQ ID NO: 8842 - protein, 443 aa, B.fragilis
FCTHNREKPIIMKLSALYQIFLDCAVVTTDSRNCPAGSLFIALKGESFNGNAFAAQALKDGCAYAIVDEAEYAPENNRHIILVDNCLQTLQQLANYHRRQLGTKVIGITGTNGKTTTKELISAVLSKSHNVLYTEGNLNNHIGVPMTLLRLKAEHELAVIEMGANHPGEIKFLVHIAEPDYGIITNVGKAHLEGFGSFEGVIRTKGELYDYLREKEDSTVFIHHDNAYLMDIAHGLNLIPYGSEDALYVNGHVTGNSPYLTFEWKAGKDGDLHKVQTQLIGEYNFPNALAAVTIGRFFGVEAGKIDEALAGYTPRNNRSQLKKTADNTLIIDAYNANPTSMMAALQNFRNMTVKKKMLILGDMRELGAESAAEHRKIVDFLQECSFEKVLLVGEQFTATHPPYHTYANAQEVIKELQTEKPKDYTILIKGSNGIKLSTVVEFL

SEQ ID NO: 8843 - protein, 287 aa, B.fragilis
LFNHIPIMKQSLPYQPGPIGVFDSGYGGLTILSKIREALPEYDYIYLGDNARTPYGTRSFEIVYEFTLQAVNKLFEMGCHLVILACNTASAKALRTIQMNDLPNIDPDRRVLGVIRPTAECIGSMTQTRHVGILATAGTIKSESYPLEVHKLFEDIKVSGEACPMWVPLVENNEANGEGADFFIRKYIDNLLAKDRQIDTLVLGCTHYPILLPKIQKFIPQGVKVVAQGEYVATSLKDYLHRHPEMDMKCTREGKCRFYTTEAEDKFIESASMFLNENITVQRITLE

SEQ ID NO: 8844 - protein, 459 aa, B.fragilis
HILFMTKKERGNFGSKLGVILASAGSAVGLGNIWRFPYETGNHGGAAFILIYLGCILLLGLPIMIAEFLIGRHSQANTARAYQILAPGTQWRWVGRMGVLAGFLILGYYSVVAGWTLEYIFEAVSNSFAGKTPAEFISSFQSFSSNPWRPALWLTLFLLATHFIIVKGVEKGIEKSSKIMMPTLFIIILILVGCSVTLPGAGKGIEFLLKPDFSKVDGNVFLGAMGQAFFSLSLGMGCLCTYASYFSKNTNLTRTAFSVGIIDTFVAVLAGFIIFPAAFSVGIQPDAGPSLIFITLPNVFQQAFSGIPILAYIFSVMFYVLLALAALTSTISLHEVVTAYLHEEFNFTRGKAARLVTTGCILLGILCSLSLGVTKEFTIFGLGMFDLFDFVTAKLMLPLGGLLISIFTGWYLDKKLVWSEITNNGTLKVPTYKLIIFILKYVAPIAISVIFINELGLLK

SEQ ID NO: 8845 - protein, 1121 aa, B.fragilis
KTKQLNHLSFMNEDRKKRGLANSNLLIAMAITALIIGSSNAMANQTASGSSYKVTEQMQIQTVTGVVVDANGEPIIGASVVEKGTTNGIVTDMDGKFSLNVKVGTTLQITFVGYQPQDVKATKSMKVVLKEDNELLDEVVVVGYGTQKKANLTGAVSTVDVSKTLEARPQSDVSKALQGVVPGLTITNTSGKLNSKPTMTIRGTGTLSNSATSNPLIVVDGVPMDDISYLNTQDIDNISVLKDAASTSIYGTRAAFGVILVTTKSAKKTDKVTINYTNNFSWDTPTILPNYPDVATQARALRAANTRANLENELFGMYMDDNFIAKAEAWKQRHGGKKAGYREMIPGDDFDLGEDGSALYYADWDVVGIMFRDWKPAQSHNISIQGTSGKTSYFLSVGYNHEEGVMTFNPDKLNKYNANMNVTSDITNWLQIGGRFSYSDKAYTTPNTRRNTYTYMWRWGSFFGPYGTYQGIDMKNDIAYLKQAGDDKTNDSYTRIGAFLKATIIKGLTLNADYTFNINNKTTKSVGLPVICWNSWGGKLNTPTTAAGANGDTWVYQNSVRDNSYALNVFANYELTVAKDHHFNFMIGANAEEGEYQNHWSQRKGLLDDKLPEFNLATGDQTVGGTHNEWGTAGWFGRINYDYNGIWLLELNGRYDGSSKFPSSDRWAFFPSGSVGYRISEEKFFEPIKKIVSNTKIRASYGEIGNQAVGSNMYISTVSKRTDGNTHWLNGSNKVVAYDLPSLVSPTLKWERIQTLDIGGDFGFFNNELNISFDWYQRTTKDMLAPGQTMPDVLGAGAPKINAGTLRTRGWELSIDWRHHFNEINVYANASIGDFKTVITKWDNDSQLLNENYSGKVYGDIWGFETDRYFTKDDFNADGSYKEGIASQKKLEQDGFVYGPGDIKFKDLNNDKEINGGEGTVKDHGDLKVIGNTTPRYQYGFRLGGEWKGIDIDMFFQGVGKCDAWTQSAFVMPMMRGADAIYANQANYWTDENPDPNADFPRMWPGNAGKGTVSVLDLGNHNFYPQSKYLVNMAYLRFKNLTIGYTLPKDWTRKVYMDKVRVYFSANNICELINKSNAPVDPEVNTSEAIANGGSSDYGNGTWGRVDPMYRTVSFGLQVTF

SEQ ID NO: 8846 - protein, 175 aa, B.fragilis
TMWQKPWGYKEGFAICGGLFLTGTFLQITIGKCELSILSYPMNVCVGVLYLVILLLIYAFSQKSYFIRWMGSCQAAVSSMVSVAMLTVVMGLIRQVKSDVPLLGAESWLGFSQMLSACSFVLLFLWMITMLRLTTIRRIHHLRLCDIPFVLNHLGTVPCTDPCYLWVMPKWNVCG

SEQ ID NO: 8847 - protein, 893 aa, B.fragilis
FVVKTRGKFDFMSEENNEITEGHSDYKPADSHNESIKHQLTGMYQNWFLDYASYVILERAVPHINDGLKPVQRRILHSMKRMDDGRYNKVANIVGHTMQFHPHGDASIGDALVQLGQKDLLVDCQGNWGNILTGDGAAAPRYIEARLSKFALDVVFNPKTTEWKLSYDGRNKEPITLPVKFPLLLAQGVEGIAVGLSSKILPHNFNELCDASISYLRNEEFKLYPDFQTGGSIDVSKYNDGERGGAVKIRSKINKVDNKTLAITEIPYGRTTTSVIDSILKAVDKGKIKIRKVDDNTAANVEILVHLAPGTSSDKTIDALYAFTDCEVSISPNCCVIDDQKPHFLTISHVLRKSADNTLSLLRQELEIKKDELQENLHFASLEKIFIEERIYKDKEFEQSKDMDAACEHIDRRLTPFYSQFIREVTKDDILRLMEIKMGRILKFNSDKAEEAIARMNEDIAEINNHLANIVEYTIQWYRMLKEKYGKNFPRRTELRNFDTIEAAKVVEANEKLYINREEGFIGTSLKKDEFVACCSDIDDVIIFYRDGRYMVTPVADKKFVGKNVIYVNVFKKNDKRTIYNVAYRDGAEGTHYIKRFAVTSIVRDREYDVTQGKPDSRISYFSANPNGEAEIIKVTLKPNPRVRRIIFERDFSEVTIRSRQSQGVILTRLPVHKIVLKQRGGSTLGGRKVWFDRDVLRLNYDGRGEYLGEFQSDDNILVVLNTGEFYTSNFDLSNHYEDNVSIVEKFDPNKIWTVALYDADQQNYPYLKRFCFEATTRKQNYLGENKHNRLILMTDEYYPRLEIIFGGHDSFRDPVVVDAEEFIAVKGFKAKGKRLTTYTVETINELEPTRFPDPPQNNEEDDTGEEPENLDPDSDKTENDILDEMTGQMKLF

SEQ ID NO: 8848 - protein, 111 aa, B.fragilis
PFGKHTLYEMIVFNQCPFRSCRTTFRNKFHFAAFLIWIQIYNIFCNLICFDRKVFSYQINAFGNVVPSLNACAEQSFVFILVSDLIKSFLFNRLYEVYKKKISAGLTTWLR

SEQ ID NO: 8849 - protein, 839 aa, B.fragilis
GRPKKYEIADIKVEGVKNYEDYVLIGLSGLSVGQTITVPGDEITGAIKRYWRHGLFSNVSITAEKIEGNKIWLKITLAQRPRISDIRYHGVKKSEREDLQTKLGMIKGSQITPNLVDRAKVLSKRYFDDKGFKNAEITITQRDDPANENQVLVDIDIDKKEKVKVHAITFAGNHAIKTSKLKRVMKKTNEKGKLLNLFRTKKFVNEKYEEDKQLIIDKYNELGYRDARIVKDSVSKFDDKTVDVFIELEEGDKYYLRNVTWVGNTLYPSEQLNYMLRMKKGDVYNQKLLNERLSTDEDAIGNLYYNNGYLFYTLDPVEVNIDNDSIDLEMRIFEGRQASINKIKINGNDRLYENVVRRELRTRPGELFSREDLMRSMREIQQMGHFDPENIKPDIQPDPVNGTVDIAYDLVSKANDQVEFSAGWGQTGVIGKLSLKFTNFSLANLLHPGENYRGILPQGDGQTLTISGQTNAQYYQQYSISFFDPWFGGKRPNSFSLSAFFSVQTDISSRYYNSSYYNNYYNSYYSGLGGYGMYNYGNYNNYENYYDPDKSIKMWGLSAGWGKRLNWPDDYFQLSAELSYQRYILKDWQYFPVTNGKCNDLSIGLTLARASYDNPIYPRSGSDFSLSVQFTPPYSLFDGVDYSKYNEYNQNDMNKMHKWVEYHKWKFKAKTYIPLLNPTVVKKTPVLMTRVEFGILGHYNKYKKSPFGTFDVGGDGMTGYSSYATESVALRGYENSSLTPYRGQEGYAYTRIGFELRYPLMLETSTNIYALTFLEAGNAWHDVKNFNPFDLKRSAGVGVRIFLPMIGMMGIDWAYGFDKVLGDKSAGGSRFHFVLGQEF

SEQ ID NO: 8850 - protein, 297 aa, B.fragilis
HKPKIKLRMKVKTSILLLLMIATALPSFGGNGNGNGTDSLQATRYVTRATMYGVGYTNVFDTYLSPQEYKGIEFRISRETMRMTTLGDGNVSVQNFFQANLAYTHNRVDNNNTFAGLVNWNYGLHYQFRITDNFKLLAGGMGDFNGGFVYNLRNTNNPASARAYINLDASGMAIWHTKIKNYPLALRYQVNLPVIGVMFSPHYGQSYYEIFTLGHASGVVRFTSLHNQPALRQMLSVDFPIRYTKMRLSYLCDLQQSKLNGIKTHTYSQVFMVGFVHDLFRIRNKNGTPLPPAVRAY

SEQ ID NO: 8851 - protein, 702 aa, B.fragilis
LDAKIKKNKCPNAISTLKIKLSLQLSRLLKNMSSKPYRHFIALLLVLFCSRFEAQAEDLFAKTDSTLQQYLIRCKAQIKDPDFLQTNDTLTRMAQEKNDKRMQVIAVALKLDYYYYQNNPDSILVMVDRVKKISRRNNELKYFYFAWGSRLIIYYIKQHQTNTAIYEARKMLQSAEADNFIPGIVQCYRTLGTVYMTQSNPKLAYENFRKQIALIEENEIEDINLPTQYASLAQCALEMHRPDEALKALEKGSKCTRSSYQIFTVQKAYILYYLETKEYEKARKTLVELEQLFEKDKSLTLYKSGLFYIQIEYYRNTGQYRKALDVIEEIKNDSSSINKYLDYTLTQKQGDIYWEMNQKARAAQYYRDYILATDSIRSQEIQNSTNEFYTIMEVEQLHKEKNELLLHMQEEKLQKINIALVSLVIILVAGTMLLFHISKLNKKLKRSEAKVIQQNKELVENGEELRKAKEQAENASRMKTTFIQSMSHEIRTPLNSIVGFSQVLSNYFKEEDNDEIREFASIIEISSSNLLRLINDVLDISYLDQSEILPYDKPEDINNCCLLSIERTRNSIKKEVSLRFEPSCGPLMILTNPERVAQILTHLLHNAIKFTDKGNITLAYTISPTEKQIVYTVTDTGKGIPVEQQEYVFERFAKLNDFSQGTGLGLPICRIIAEKLGGSLIIDKTYTKGCRFILTLPLIKAD

SEQ ID NO: 8852 - protein, 89 aa, B.fragilis
VINKLRITTGGIDGTYADVRTILREALIGRATQIALIHNHPSGHAKPSQEDKRLTGAIQKASQTMNITLVDHVIVCDGCFYSFADEGLI

SEQ ID NO: 8853 - protein, 141 aa, B.fragilis
IMNKQKLNIKQWSKADRPREKMMAKGSEALSDAELLGILIGSGNTEESAVELMRRILATCDNNLNELGKWEVRNFSSFKGMGPAKSLTIMAALELGKRRKLQESKEREQIRCSEDIYKLFHPLMCDLPQEEFWILLLNQAC

SEQ ID NO: 8854 - protein, 184 aa, B.fragilis
RMNKKIYLLPLLLLALIFVSCEETKEATKFDNWRARNEGYIDSLKTVFDEKTDPELKAFEPEINPKLRIYYKKKISNDTGAIPLYTDSVNVFYRGSFIFGETFDQNFTGADPGPFDSPTKFVIQTFITVGGVSGWAEILQRMRVGERWLVYIPWELAYGASGTDDIPGYSTLIFDMQLEEILDE

SEQ ID NO: 8855 - protein, 286 aa, B.fragilis
IKNKNMNSNIEKSDKPSFIKISEQPSLYDDLEKKSIREILEDINKEDQKVAIAVQKAIPQIEKLVTQIVPRMKQGGRIFYMGAGTSGRLGVLDASEIPPTFGMPPTLIIGLIAGGDTALRNPVENAEDNTIRGWEELTEHNINDKDTVIGIAASGTTPYVIGAMHAAREHGILTGCITSNPNSPMAAEADIPIEMIVGPEYVTGSSRMKSGTGQKMILNMITTSVMIQLGRVKGNKMVNMQLSNRKLVDRGTRMIIEELGLEYNKAKALLLMHGSVKKAIDAYKAG

SEQ ID NO: 8856 - protein, 265 aa, B.fragilis
MNVNRLLGILAILLLTAASALYAQKPVKVKGVQGRWQVSDDITLKQAEERAFMEAKKAALQKAGVMENVWSVFGQITQEDGQELHEAYSQMNVLAIGGMVNVTNKKVEEVWDTDTRSLYKVVTIDAEVRKEDKSDSSYALEVKGVETLYREGDVFHCKLTIHGTDSYLKFFWFDSNGGALLYPNSYEPNTLLKAGKEYAIPFSNAVDYRMEKQHGKESEKINMMMVATKEDIPFTKEVTYQNVLEWVYSIPAVQRCAFYDMVLIK

SEQ ID NO: 8857 - protein, 76 aa, B.fragilis
SMKNAKITIGLIGLLLIGLVSVRKEGKVQEAGLLLQNVEALATGESFPDGDIACIGDGSVDCPFTYLKVEVVYREE

SEQ ID NO: 8858 - protein, 404 aa, B.fragilis
LNRKSDMKVLVLNCGSSSIKYKLFDMDSKEVIAQGGIEKIGLKDSFLKLTLPNGEKKILEKDIPEHTVGVEFILNTLVSPEYGAIQSLEEINAVGHRMVHGGERFSKSVLLTKEVLEAFAACNDLAPLHNPANLKGVDAITAILPNVPQIGVFDTAFHQTMPEHAYLYAIPYELYKKYGVRRYGFHGTSHRYVSQRVCEYLGIKPEGLKLITCHIGNGGSIAAIKDGKCIDTSMGLTPLEGLMMGTRSGDIDAGAVTFIMDKEGLTTTGISNLLNKKSGVAGMMNGSSDMRDLEAAVAKGDPQAILTEQMYFYRIKKYIGAYAAALGGVDVILFTGGVGENQATCRAGVCEGLEFLGVKLDPEKNKVRGEEAIISTDDSRVKVVVIPTDEELLIASDTMAILDK

SEQ ID NO: 8859 - protein, 490 aa, B.fragilis
AYMKSTINCFIPYAGAVQAERTVQGLQATGLVKKIYLLVTSPSFDPLPGCELLYVDKLTNSASMYAIATYSDASYTLLYTKYTSLELGLFALERMIHIAEDSAAGMVYADHYQVTEGKQSNAPVIDYQFGSLRDDFNFGSVLLFKASALKEAAKRMKSDYDFAGFYDLRLKLSQKYPLVHINEYLYSEVENDTRKSGEKIFDYVDPKNRDRQIEMEEACTEHLQEIGGYLKPEFQKIEFNTGNFPYEASVIIPVRNRIRTIRDAIRSVLSQKADFKFNLIIIDNHSTDGTTEAIDEFKDDERLIHLIPERNDLGIGGCWNLGVHHPLCGKFAVQLDSDDVYAHDGTLQVMVNAFYEQNCAMVVGTYMMTNFDMNMIAPGIIDHKEWTPENGRNNALRINGLGAPRAFYTPILRELKVPNTSYGEDYALGLNFSRQYQIGRVYEVVYLCRRWDDNSDASLDIVKMNAHNLYKDRIRTWELQARIALNKKQR

SEQ ID NO: 8860 - protein, 233 aa, B.fragilis
TQMNYLENEFFLLAITFGIYFFAKLLQKKTGILLLNPILLTIAVIIIFLKLTNISFETYNHGGHLIEFWLKPAVVALGVPLYLQLETIKKQLLPIILSQLAGCIVGVISVVLIAKLMGASQEVILSLAPKSVTTPIAMEVTKTLGGIPSLTAAVVVCVGLLGAVLGFKTMKIMHVGSPIAQGLSMGTAAHAVGTSTAMDISSKYGAYASLGLTLNGIFTALLTPTILRLLGIL

SEQ ID NO: 8861 - protein, 341 aa, B.fragilis
KQKKKMKVAIVGVSGAVGQEFLRVLDERNFPLDELVLFGSKRSAGTKYTFRGKQIEVKLLQHNDDFKGVDIAFTSAGAGTSKEFEKTITQYGAVMIDNSSAFRMDADVPLVVPEVNAADAKDRPRGVIANPNCTTIQMVVALKAIEELSHIKTVHVSTYQAASGAGAAAMDELYEQYRQVLANEPVTVEKFAYQLAFNLIPQIDVFTENGYTKEEMKMYNETRKIMHSDVKVSATCVRVPALRAHSESIWVETERPISIEEAREAFAKGEGLVLQDNPAEKEYPMPLFLAGKDPVYVGRIRKDLTNDCGLTFWIVGDQIKKGAALNAVQIAEYLIKEGNIG

SEQ ID NO: 8862 - protein, 470 aa, B.fragilis
SMPETGSLPHIDRTHKTTIMKEPKVQVGILFEPQIKFILLTPYHINGEEVSGKQVVTYDNGHILWQGHSYDELLFEPLHEKSDAFELQDVTIGINFHWERKENQRFIGALKIIVENKKLTGINVIHVEDYLTSVISSEMSATASLELLKAHAVISRSWLLAGLSLPYSKDREKSNTTPEKVPYSTSSFPPLAQEAENKILIRWYERDAHTHFDVCADDHCQRYQGITRASTDMVRQAISATRGEVLMSEGTICDARFSKCCGGAFEEFQYCWENIRHPYLSKQRDSKKATDLPDLCKEAEAERWIRTSPEAFCNTKDKKVLSQVLNNYDQETTDFYRWKVEYEQEELSKLILKRSGIDYGQILDLVPVERGTSGRLVRLKIIGTKRTMIIGKELEIRRTLSPSHLYSSAFIIDKVNVTNGIPDRFILTGAGWGHGVGLCQIGAAVMGEQGYTYDTILLHYYIGATIDKLY

SEQ ID NO: 8863 - protein, 242 aa, B.fragilis
MVKEELMENWQQRTELLLGAEKMERLRKSHVLVVGLGGVGAYAAEMICRAGVGRMTIVDADIVQPTNINRQLPATHATLGMEKAKVLEARFRDINPEIELTVLPVYLKDDNIPELLDAARYDFIVDAIDTISPKCYLIYHALQRRIKIISSMGAGAKSDITQVRFADLWDTYHCGLSKAVRKRLQKMGVKRKLPVVFSTEQADPKAVLLTDDERNKKSTCGTVSYMPAVFGCYLAEYVIKRL

SEQ ID NO: 8864 - protein, 61 aa, B.fragilis
RRKDTDFYSKTKIIVSFTGAQSKINLECDVAFRTHMCERGVVPRDGLYSISALRGSFTGTP

SEQ ID NO: 8865 - protein, 495 aa, B.fragilis
QIMEKKLKSWQGWLLFCGAMAVVFVLGLVVSSLMERRAETVSVFNNKRVEITGIEARNEVFGENYPRQYETWKETAKTDFKSEFNGNEAVDVLEQRPEMVVLWAGYAFSKDYSTPRGHMHAIEDITHSLRTGAPMDDKSGPQPSTCWTCKSPDVPRMMETIGVDSFYNNKWGAFGSEIVNPIGCADCHEPTNMKLHISRPALREAFARQGKDIDKATPQEMRSLVCAQCHVEYYFKGDGKYLTFPWDKGFSVEDMEAYYDEADFADYTHALSKARILKAQHPDYEISQMGIHAQRGVSCADCHMPYKSEGGMKFSDHHIQSPLAMIDRTCQVCHRESEETLRNNVYDRQRKANEIRGRLEHELAKAHIEAKFAWDKGATDAQMAEALKLIRQAQWRWDFGVASHGGAFHAPQEIQRILGHGLDKALQARLAISKVLAQHGYTADVPMPDISTKEKAQEYIGLDMEKERKAKDKFLKTIVPEWLEKARANGRLAKL

SEQ ID NO: 8866 - protein, 323 aa, B.fragilis
ISMDKKISISQIKEVVQQAYEQVKGNTGGKNADYIPYLANIDKNLFGISVCLLNGQTITVGDFDYRFGIESVSKVHTAILILRQYGAQKVLEMIGADATGLPFNSIIAILLENDHPSTPLVNAGAISACSMVTPIGNSDKKWDAIVQNITDLCGSAPQLIEELYKSETATNFNNRSIAWLLKNYNRIYDDPNMSLDLYTRQCSLGVTAQMLSVAAGTVANGGVNPVTKKQVFDAELTPKITSMIATVGFYEHSGDWMYTSGIPAKTGVGGGVMGVLPGVFGVSAFAPPLDGSGNSVKAQLAIKYIMNKLGLNVFNGARVTIVD

SEQ ID NO: 8867 - protein, 288 aa, B.fragilis
QKMDSTIFKSLNVNGRLLDLSIPQVMGILNVTPDSFYAGSRSRTEADIAARARQILDEGASMIDIGAYSSRSNAEHISPEEEMRRLRTGLEILNRNHPGAIISVDTFRAGVAEECVKEYGVAIINDISAGEMDEQMFPTVARLNVPYIMMHMQGTPQNMQKEPHYENLLKEVFIYFARKVQQLRDLGVKDIILDPGFGFGKTLEHNYELMAHLEEFGIFELPLLVGVSRKSMIYRLFGTTPQEALNGTTVLDTVALMKGADILRVHDVREAVESVRLIEKLKSVSACS

SEQ ID NO: 8868 - protein, 70 aa, B.fragilis
VKTCSLDVNNKFFKCKRLVICAQEPDNLQKTLTMLIEERCKNEDTDSDSVNSLPELELSYSAGICFFLLK

SEQ ID NO: 8869 - protein, 712 aa, B.fragilis
YMHWFDLSLQLPITDPTWVFFLVLIIILFAPMILGRLHIPHIIGMILAGVVIGEYGFNVLERDSSFELFGKVGLYYIMFLAGLEMDMEDFKKNRTKGLVFGWFTFIIPMALGVWSSMELLGYGFTTAVLLASMYASHTLIAYPIISRYGLSRLRSVNITIGGTAVTVTLALIILAVIGGMYKGTVDGMFWVLLVVKVAFLSFLIVFFFPRIGRWFFRKYDDSVMQFVFVLAMVFLGSGLMEFVGMEGILGAFLAGLVLNRLIPHVSPLMNRLEFVGNALFIPYFLIGVGMIIDVRTLFTGGEALKVAVVMTVFATLSKWLAAWITQKIYHMQPNERSMMFGLSNAQAAATLAAVLIGHEIIMENGERLLNDDVLNGTVVMILFTCVISSLVTERSARRFALHEEMQFEDNKEKTEQEQILIPVANPDTIEDLINLALVIRDTKQKKELIALNVINDNNNSENKELQGKRNLEKAAMIAASADVSVNMVSRYDLNIASGIIHTIKEYDATDVVIGLHRKANIVDSFFGNLAESLLKGTHREVIIAKFLMPVNTLRRIIIAVPPKAEYETGFSKWVEHFCRMGSLLGCRVHFFANEQTLMRLQQLVKKKHGSTPTEFSRLDEWDDLLLLTGQVNFDHLLVVISARRGSISYDPSFERLPNQLGKYFSNNSLIILYPDQFGEPQEIVSFSDPRGYNESQHYDKVGKWFYKWLKKN

SEQ ID NO: 8870 - protein, 969 aa, B.fragilis
IKNWAECRTNRETMKMERNYSAFLQDIGRFIPRDRLFTDELHRLAWGTDAGFYRLIPQIVIHSINDDEVIEIIYLADRYNIPVTFRAAGTSLSGQAISDSVLIIAGKGWENYELSPDHEKIYLEPGIVGQRVNEILAPYGRKFAPDPASIKSAMVGGIVMNNASGMNCGTHANSDKMLLSVHIIFPDGYYLNTDSQESRENFKEDYPEFLQRICELRDQIRSNEKLSARIRHKYSIKNVTGLNILPFLVYDDPFDIIAHLMVGSEGTLAFLAGVTMKTEYDYPYKASAMLYFSDIKEACRAVVAMKRLVNANGEWIVKGAELLDWKSLASVNDPTGEGLTAVLTETKACTQEELNQNIAIIEEALKAFDTYIPVHFTDQPEEYSKYWAIRAGIFPSVGGTRPSGTTCLIEDVAFHIEDLPEATAELQQLIARHGYDDACIYGHALEGNYHFIINQSFSNEAEVKRYEALMNDVIDLVVGKYDGSLKAEHGTGRNMAPFVEYEWGEEAYAIMKEVKQLFDPKGLFNPGVIFNDDPQCHIKHFKPLSPLTIGQDTQVTRQIDRCIECGFCEVNCLSCGFTLSSRQRIVIQREISRLKKSGENPQLLETLSELYRYSGNWTCAGDGLCAMSCPMGINTGDLTHILRQAEFPPGSTGYRAGKFAANHFAGIKSTLRPVLSLANAAHSLLGTSTMTSITRKMHSAWGLPQWTPAMPKSYKIRKSDQTPAMNNKVVYFPSCINQTMGLAKDSPVDQPLVKQMLSLLQKAGYEVIFPPKMEKLCCGTIWESKGMLDIADSKSTELEAALWEASEQGRYPVLCDQSPCLHRMRATIQKIKLYEPAEFIYTFLRDKLEFTPTDRPIAIHITCSMRKMGLANILISLAKLCSTQVFIPEEVGCCGFAGDKGFTQPELNTYALRKLRPQLTKAGIGIGYSNSRTCEIGLATNTGIPYVSIAYLVDQCTRPIKQKNNLTLK

SEQ ID NO: 8871 - protein, 385 aa, B.fragilis
SKIWFPFQLLISFFKTIFMKKLNQLLLGLLLVGSAIACHRETSLEERDIVIDLSVSNPYLPMSVLVDTIESVRLQLPSPYFWGMVDNVISKDSCYYISDRKQEMAFRFSKNGTFLNAIGQRGEGPGEYREMDSFFVGKDCVYVCDMGKRTIYSYSFDGKFLHSLSFPYSLVFNDVVELPDGRFLCHRPSQSENCKGLWILDQKGRRVKNLLEYEKGTPCKNSYWNTLCAQEDGTIKIYNPVDGSYYQYDAVNDTVVRTMRQKSNLPMLADFHCSDRELYETKEECTYSLFTVDGKNLVFSLWSFNSANKGMWSVYFKKDGRIEQGNLTKMDIPGYSEMGRPVSSNIPNTFVTVYTDEFPDDAFPSAYQQQEINEQTAILSLLRLK

SEQ ID NO: 8872 - protein, 600 aa, B.fragilis
LRQWNLGTSRPDVSYRIVRFTSYFLIYHKQLIANYMKKIKYIACLLSLAVVSGCDSILDKGPLDSFTNDNFWTGEGNISGYANAFYEQFLGYGNGNGYGDFYFKTLSDDQAGMSFAKWTYPDNAPSTSATWKNGWIEVRRANIMLENVPTVASLDEATKNHWLGVARLMRAWQYYHLVRMYGNLPWIDKALNINDEGEIYGNREDRDMVMDKVLEDLDFAVTNIKDISSKTTWSRSLANAMKAEVCLYEGTFRKYRKNEDGQQAPDATGAARYLTACKEACLAVMSKGYKLNTSYQGNYNSTDLSSNPEMILYKAYKEGLLMHSTIDYTCSSTQISGMSKNAFESYLFKDGKPMALTSLNKSDEAPFQYGHLSLKAILAVRDKRLAQTIDTVLLYNGRGFTRFNTGMESTSSTGYGVAKYDNEAIPEGFRSQSGKNYTHAPLFWLSVIYLNYAEACAELGNITQDDLDKSINLLKDRAGLPHLNPIVGFSDPANNHGVSDLIWEIRRERRCELMFDNDNRYWDLIRWHQLDKLDTTKYPDIILGANVANDMDGCEANKVGKYIDGSKDGSRIYDKKHYLYPIPTGQIALNPQLAPNNPGW

SEQ ID NO: 8873 - protein, 341 aa, B.fragilis
ISMLNLINSIVARAQANRQRIVLPEGTEERTLKAANQILTDEVADLILLGNPEEINAAAVKWGLGNINRATIIDPENHPKKEEYAQLLCELRKKKGMTIEEARKLVLDPLYLGCLIIKSGDADGQLAGARNTTGDVLRPALQIIKTSPGITCVSGAMLLLTHAPECGQNGLLVMGDVAVTPVPDASQLAQIAVCTARTAQAVAGIAEPKVAMLSFSTKGSAKHENVDKVVEALKLAKEMAPDLNIDGEMQADAALVPSVGASKAPGSPVAGEANVLIVPSLEVGNISYKLVQRLGHADAVGPILQGIARPVNDLSRGCSIEDVYRMIAITANQAIAAKNGK

SEQ ID NO: 8874 - protein, 237 aa, B.fragilis
AICRRCLVVIWQSTLSKDCKIMIHLEGITKSFGSLQVLKGIDLEITQGEVVSIVGPSGAGKTTLLQIMGTLDSPDAGMINIDGTNVSRMKEKELSAFRNKHIGFVFQFHQLLPEFTALENVMIPAFIAGVPTKEASMRAMEILDFMGLKERASHKPNELSGGEKQRVAVARALINQPAVILADEPSGSLDSHNKEELHQLFFDLRNRFGQTFVIVTHDEALAKITDRTIHMVDGNII

SEQ ID NO: 8875 - protein, 328 aa, B.fragilis
QRFRMKRNIAIVAGGDTSEIVVSLRSAQGIYSFIDKEKYNLYIVEMEGRRWEVQLPDGSKTPVDRNDFSFMNGAEKVVFDFAYITIHGTPGEDGRLQGYFDMMRIPYSCCGVLAAAITYDKFVCNQYLKAFGVRISESLLLRQGQAVSDEDVVEKIGLPCFIKPNLGGSSFGVTKVKTREQIQPAIAKAFSEAEEVMIEAFMDGTELTCGCYKTKEKSVVFPLTEVVTHNEFFDYDAKYNGQVDEITPARISEELTRRVQTLTSAIYDILGCSGIIRVDYIITEGEKINLLEVNTTPGMTATSFIPQQVRAAGLDIKDVMTDIIENKF

SEQ ID NO: 8876 - protein, 171 aa, B.fragilis
NFDRMEYINDLIRRKDRLLSEDEAMSLLENGEYGVLSISSTEEGVYGIPINYVWDKQQSIYFHCAPEGHKLCILQNCNQASFCVVGRTRVVSNQFSTEYESIVINGTMICQLEETEKRKALELLLDKYSPEDKKVGLKYIEKSFHRTHVLKLVIKVISGKCKKINQPCQDY

SEQ ID NO: 8877 - protein, 450 aa, B.fragilis
VISSPNRKISQHTFCCLCAEHSNGSFVLHTPKLYNTYITMRIQTGHGTIPLITLIGIWSISALNALPGLAVSPILGKLSAIFPHSTELDIQMLSSLPSLLIIPFILLAGKLTERVNFIRLLQAGLAIFALSGVLYLLSGQMWQLIAVSALLGVGSGLIVPLSTGLISKYFVGSYRVKQFGLSSAITNITLVVATAVTGYLAEVNWHLPFVVYLLPIISLVLSVYLQRSMASEGSTSLTNDKAPADKEEDVDTGNSKYGIHVRHLAGIMGVYGLATFLVLVVSFNLPFLMEEYHFTSGNSGIMISLFFLAIMTPGFFLNRIVGTLKEKTKFYSFLSIGIGLALIWISPKEWVIAPGCILVGLGYGVIQPVVYNQTTHTAISRKVTLALAFVMAMNYLAILLCPFIIDFFQSTVFHIKSQQFAFVFNLCISIVMLVISYTKRNSFLFNDNLK

SEQ ID NO: 8878 - protein, 486 aa, B.fragilis
LKIRVIMEDLNFRKGDAKTEAFGSNRMLQPSPVEKIPDGPTTPEIAYQMVKDETFAQTQPRLNLATFVTTYMDDYATKLMNEAININYIDETEYPRIAVMNGKCINIVANLWNSPEKDTWKTGALAIGSSEACMLGGVAAWLRWRKKRQAQGKPFDKPNFVISTGFQVVWEKFAQLWQIEMRQVPLTLDKTTLDPEEALKMCDENTICVVPIQGVTWTGLNDDVEALDKALDAYNAKTGYDIPIHVDAASGGFILPFLYPDTKWDFRLKWVLSISVSGHKFGLVYPGLGWVVWKGKEYLPEEMAFSVNYLGANITQVGLNFSRPAAQILGQYYQFIRLGFQGYKEVQYNSLQIAKYIHSQIAKMTPFVNYSEDVVNPLFIWYMKPEYAKNAKWTLYDLQDKLAQHGWMVPAYTLPAKLQDYVVMRVVVRQGFSRDMADMLLGDIKNAIAELEKLEYPTSTRIAQEKNLPVEAKVFNHTGKPQAAKK

SEQ ID NO: 8879 - protein, 192 aa, B.fragilis
RISSMINAQDIKNGTCIRMDGKLYFCIELVHVKPGKGNTFMRTKLKDVVSGYVLERRFNIGEKLEDVRVERRPYQYLYKEGEDYIFMNQETFDQHPIAHDLINGVDFLLEGAVVEVVSDASTETVLYADMPIKVQMKVTYTEPGLKGDTATNTLKPATVESGATVRVPLFISEGETIEIDTRDGSYVGRVKA

SEQ ID NO: 8880 - protein, 470 aa, B.fragilis
NSTRMKRLFYFFLFVCVAVIANAQAKYVFYFIGDGMGVNQVNGTEMYRAEIQKGRIGVEPLLFTQFPVGTMATTFSATNSVTDSSAAGTALSTGEKTYNGSIGMDDQKNPLQTVAEKAKKAGKRVGVTTSVSVDHATPAAFYAHQPDRNMYYEIATDLPKAGFDFYAGAGFLKPTTTYDKKEAPSIFPMFEEAGYTIARGYNDYKAKAAAAGKMILIQEEGADTGSLPYAIDSKEGDLTLAQITESAIDFLTKGKNKGFFLMVEGGKIDWACHGNDAATVFHEVADMDNAIKVAYEFYKKHPKETLIVVTADHETGGIALGTGKYALNLKALENQKASAEVLSKKISDLRKAKNNHVAWEDIKNLLSEEMGFWSVLPITWEQEKKLRDEYEKSFVRNKVEFAESMYAKTEPMAAKAKEVMDQIAMVGWTSGGHSAGYVPVFAIGAGSDLFIGKMDNTEIPKRIAKAGGYK

SEQ ID NO: 8881 - protein, 376 aa, B.fragilis
QKRRQLCKLLVIREQNALLFLIKNIIFVNELQTYPIMKQTAYIYLLTLSCLLCACNRENRTNLPQPQVTGVADSLETVPPEEKPKAISAEQIEIKKDLLYDKYTLEDTYPYKDTTRSFQWDKIKERLALLENIQQTPSQWGILQNYKNRNGEAPLVRHYKRNAYKRIADTLGIERYQSVPLYLLTDTLVPERYGEDGSLVRFLADGENFVKVSPIYIGEEWYVPKRYVKVLPDTTHFIKTIMIDRRDQNIMTLEQTGEAQWTVRSMNPATTGRHRPSYAQETPLGIFVLQEKKTRMIFLKDGSTATGRFAPYANRFSDGGYIHGVPVNEPRKALIEYSPSLGTTPRSHMCVRNATSHSKFIFDWAPVNETIIFVLE

SEQ ID NO: 8882 - protein, 413 aa, B.fragilis
KCNGNSEKPRKGKRINSPRSPLCHTDILFQDIRMGEVTYRQKSIYLCFQIVSIMKKEFTRIAIKVGSNVLTRQDGTLDVTRMSALTDQIAALHKAGVEVILISSGAVASGRSEIRTLRKLDSVDQRQLFSAVGQAKLINRYYELFRDHGIAVGQVLTTKENFGTRRHYLNQKNCMTVMLENGVIPIVNENDTISVTELMFTDNDELSGLIASMMNAQALIILSNIDGIYNGSPSDPDSLVIREIGQGKDLSNYIQTSKSSFGRGGMLTKTNIARKVADEGITVIIANGKRDNILINLIEHPEETVCTRFIPASQPVSSIKKWIAHSEGFAKGEIHINEQATEVLNSDKAVSILPVGITRIEGEFEKDDIVRIIDYRGTPVGVGKVNCDSMQARDSIGKHGKKAVVHYDYLYIE

SEQ ID NO: 8883 - protein, 175 aa, B.fragilis
TNLGVQFFNKTTKRRYRALVWGIVDQDERTIVGSIARNPKDRMQMAVMADPTQGKHAVTHYRVLERVGYVTLVECILETGRTHQIRVHMKHIGHVLFNDERYGGHEILKGTHFSKYKQFVNNCFDTCPRQALHAMTLGFVHPVTGEEMHFTSELPDDMTRLIEKWRGYISNRDLE

SEQ ID NO: 8884 - protein, 297 aa, B.fragilis
RIMGRPIKIIGYLCFLMALCSCKETKEQQISRLIHKWEGRTIVYPADMTFSVLGKDSAGYSFPQNEYTIMTYVDSVGCTSCKLQLPTWKYFISMVDTMANGKVSFLFAFHPKNKKEISFLLKRDRFLYPVFIDEKGGFDALNHFPSDVNFQTFLLDSQNKVIAIGNPVHNKKVRDLYLQIITGRQTGVATSSQTKVVLDKKLDEMGDFDWKIPQTATFSLRNLGDHLLIIEDINASCGCTSVTYSKEPVPSGKSADIQVTYRAEHPEHFEKTITVYCNTPTSPIRLKIRGNAIDEEY

SEQ ID NO: 8885 - protein, 114 aa, B.fragilis
LCLMNFQRNTDMTKFEIEEKIVDMLKTVFDPEIPVNVYDLGLIYKIDVSEDGEVSIDMTLTAPNCPAADFIMEDVRQKVESIDGVNSATINLVFEPEWDKDMMSEEAKLELGFL

SEQ ID NO: 8886 - protein, 521 aa, B.fragilis
SLIMMKTKHYFSFVFASLFLIPSVITAQDVNYQKEFDTFQEKQQKEYKEFKNKADEEFATFLKEAWQKYNASMGDSMPTRPEPVKPTLFDKKKPVPAPVEIKPAVPKIPIADKPGVGGKVNVEVKKPELPAVADKPAPGVYVPGKPYTPVKVDIPAPLPGSSAHRNAIEFYGTRFEVATDVIDGFELGGTSESKVAGAWSRLCKADHEQLINDCIRLKKEHQMNDWAFLMFIKQLGVQMCGVAKKDDVAFLQMFILNKCGYKVRLSKINDKLKLLVAPAGTIFGIPYITFKGVKYYVFEADKGGSMAVYTYSQDFANAKNLVCMDLSAVPQFGMQEFSKTVSPSEKSLLKVNTAVNKNLMDFYKDYPQCEVAVYYKTPMSKELKSALYPPLQAAIKGKSEKDAANILIDFVQNSFQYQTDGEQFGYEKPFFMDENFYYPACDCEDRAILFSNLVKDLLGLDAVLLDYPNHIASAVRFNEDISGDYILLDGKKYLICDPTYIGAPIGMCMDRFKSVPPEIIR

SEQ ID NO: 8887 - protein, 103 aa, B.fragilis
KCIMKVKLLFVICLSVFSLCGIYHVQANKEDKNVSTLVLQNIESLAQNEGNSDHGNIDTTLEPYYYQSSRDYWLPGMNGTTEIPCCEKCESKYSGCAKGLARC

SEQ ID NO: 8888 - protein, 424 aa, B.fragilis
NRVMRITNLFWTVVLLAPLSVFAQQQKENLFTIDAQIRTRGEYRNGVLNPRPEGEEPTFFVNERARLSLGYQRDRLQMRLSAQHVGVWGQDPQIDKNGRFILHEAWARLDFSKGLFAQLGRQPLSYDDERLLGGLDWNVAGRFHDALKLGYESKLHKLHLILAFNQNDENRSYGGTYYAPGAQPYKTMQTVWYNGHWAKDFTVSLLFMNTGFETGTEGNGKTANMQTMGTYLVYTPGAWLFNGSAYYQFGKNKADKKVSAYMFSLKAGYKIDPKWSVSLGTDYLSGDPDSKKVSTFDPLYGTHHKFYGGMDYFYASAYNKGLWDKILSVDFKPTKKLSFSLNYHHFSTTYDVMATDGKEGRCLGSELDMQVDYILMKDVKLTAGYSTMLGTKYMDIVKGGNHKSWQDWGWLTLNINPRILFTKW

SEQ ID NO: 8889 - protein, 85 aa, B.fragilis
THYIPTIMKEDKDTRVVEVFTGSPWEAEFIKGLLESNGIESILKDGGGLAALAPYYIGQEIAVLVNEDDYENAMEIVRNREKANE

SEQ ID NO: 8890 - protein, 376 aa, B.fragilis
IKNMHIIKVIFSLALILNICVSCHENDDTAYFNGKIQTIEDSIKDTKKATLKILPLDGANFGWLSTYDSLMFFMNPKLPDRFYNIFNIDTGKEIGTFCYRGSGPGEVAALGPIFHFFKEKGDLKTLLFAPNEEKLFIWNITQSIKRDTTVMDKQISYPWREENGGAPYYLMFLKDENTLITELQSFPLNDKEATLPAYQKRTLDTNKLLKSFSSYKKSIRNDEASILPESFFYSNDAIKPDGTKVVQAMVHLAQLNILDLETGHVSGYRLEGEPDFSVFKSDEKIKSYFTRVQADDNYIYAVYWGKERWERFETPHMNIIHVYDWDGNLVQKIETDYSIGQMWIDPIRNRLYVTNPQIDDVLYLDLDDFLVPNTGL

SEQ ID NO: 8891 - protein, 285 aa, B.fragilis
EKNIYKNMILIADSGSTKTDWCVVEHGQLIQQIFTKGTNPFFQSEEEISNEIATALIPQLKTNKFEAVHFYGAGCAFPDKIETMRKAIASHLQVSGEIEVSTDMLAAARSLCGHQPGIACIMGTGSNSCYYDGKNIVTNVSPLGFILGDEGSGAVLGKLLVGDILKNQMTPGLKEKFLEQFNLTPAEIIDRVYRKPFPNRFLASFSPFLVQHLDEPVIRELVLNSFKKFLKRNVMQYDYQHAPVHFIGSVAFYYRELLSEACKIMGVHLGTIIQSPMEGLIKFHE

SEQ ID NO: 8892 - protein, 599 aa, B.fragilis
IVDIFHSIKILKVISIIIFTKFVTFTFRISKNIKMRQYLLNIILLFLGFTIIYSCSRHQQINRTIFLADSIMEYQPDSAFKLLKTINQTDLSVSENAKYALLLAQAQDKAGHQLINDSLILIAINHYDHLSKDNNKAKAYFYLGRFYQNNNDYAKAINSYLIAEKATSDHDTLLTLIYDNLGTCYKNQDFYDKALEVYKDAYYIYKQYNSKNILYPLRGMASIYAIQEQFEKALKYYQTALTIASSTNDSTWQSILFCDISRIYDNKNLYEAAYSYIVRSIQYAPRSSDLSAMYFWKGEILHNLNQLDSAFYYINLAKKSSDLNTQASAYQALYEIKKEQGELNDAILYNDTSLILYDSIQDLNHSAEISHILKQHATETLQQAEVIKRQKHTAFLIVTTLLLIACITFIFLYKDNKRKKVYIKIQCELRNNQIEKDELKEKIKTLIDSNTYIAERNKELKKEELKQQQIELWKRTLQICTRLFHTSTSYKKLHAIETAKFKKEREEKQKEINSIQKEINEVFIEAIQELREQYPKLTQEDLFYCILQYLRLSTSTIKFCMRVESNQALTQRKYRIKKQISPQTFSIIFNESSPSEGVL

SEQ ID NO: 8893 - protein, 437 aa, B.fragilis
THTIIMKNKNISPWAWIPTLYFAQGLPYVAVMTISVIMYKNLGISNTDIALYTSWLYLPWVIKPFWSPFVDLLKTKRWWIVSMQLLVGAGLAGIAFTIPMSNFFQTTLAIFWLVAFSSATHDIAADGFYMLALNVQDQALYVGIRSTFYRIATIAGQGLLVMLAGGLEIWTGSIKYGWSITFFILAGLFLAFCLYHKCILPKPNSDKAVVGENSASAIFSGFIETFASFFRKKQAGVAILFMLFYRFPEAQLVKLINPFLLDPIDKGGLGLTTAEVGLVYGTIGIIGLTLGGIIGGICAAKGGLQKWLWPMAWSLSLTCLTFVYLGYFQPQNFVIINLCVFIEQFGYGFGFTAYMLYLIYYSDGEHKTAHYAICTAFMALGMMLPGMAAGWLQELIGYENFFIWVMVCCTATIAVCAFIKIDPNYGKKAEGIPQKTK

SEQ ID NO: 8894 - protein, 419 aa, B.fragilis
TNCIMNLNDTFAAVQAAGRHLALLPDDRINQILNAVAEAALEQTSYILSENRKDLERMSPDNPKYDRLRLTEERLRGIASDIRNVATLPSPLGRILKESIRPNGMRLTKISVPFGVIGIIYEARPNVSFDVFSLCLKSGNACILKGGSDADYSNRAIVEVIHQVLRQFNIDTHMVELLPADREATRELLHAAGYVDLIIPRGSSALINFVRQNATIPVIETGAGICHTYFDEYGDTAKGAAIIHNAKTRRVSVCNALDCVIVHESRLSDLPLLCEKLKADKVIIYADPSAYQALEGHYPAGLLKPATPESFGTEFLDYKMAIKTVNSFENALGHIQEYSSRHSESIVTENPKRAALFTRMVDAACVYTNVSTAFTDGAQFGLGAEIGISTQKLHARGPMGLEEITSYKWIIEGDGQTRQ

SEQ ID NO: 8895 - protein, 184 aa, B.fragilis
KKRMIEELPDDIEQDELDDIEPVGDENQLYEHFRVVVDKGQAMVRVDKYLFERIVNASRNRIQKAAEDGFVMANGKPVKSSYKVKPLDVITVMMDRPRYDNEIIPEDIPLHIVYEDKYLMVVNKPAGLVVHTGHGNYHGTLVNAIAWHLKDNPDYDANDPHVGLVHRIDKDTSGLLVIAKTPDA

SEQ ID NO: 8896 - protein, 202 aa, B.fragilis
IHSIIHTMKVKEYIQWLLPSRKWRVLAIIITGVIVGGGALFLYMLRAHTYLADDPSACVNCHIMGPYYATWFHSSHSRNATCNDCHVPHENPVKKWVFKGMDGMRHVAVFLTRGEKDVLRANKESAEVIMNNCIRCHTQLNTEFVNTGRIDYMMSQVGEGKACWDCHRDVPHGGSNSAASTPDALVPYPDSPTPEWLRKMIE

SEQ ID NO: 8897 - protein, 642 aa, B.fragilis
AFVLTMKYVLFILLVLTLAACQSEKDRRLEYALEFAGDNRVELEKVLEHYRTDPEKLEAARFLIRNMPGWYSYEGNELDSIHHLLVGVCEGRSISKREKNKWNRISFNSLSKIYDAQVITAEYLIDNIDLAFEVWRKYPWNRNLPFDDFCELILPYRIADEPLSDWRKLYYEDYGTLLDSLYKGSDVIEASKIIDGKLRKLYYIYNTDFRVPHLNAVFLYHNRIGYCREACDLTIYAMRACGIPVATDYFVYSPDYQHYHCWTMLRDTTGTFLQFGFNEFEASRDTLRHDGRKKGKVYRYCFGMQADKNSGTSGNRQLSPVLKNRFVKDVTSEYFGSNDTTIPIQMSGEQYIYLGIFSPGGWIPIDMALGNAGKVTFRDIEPDVIYQTLYQGDGGKLYPAGYPFISKTGGGFVLLKPNIDLMEEAILKRKMPQQKTIAEWAYRAIIGAKVEAADDLSFMQADLLWQFEDTLTTNYCVLTPLLRKKYRYVRYVAPIGKRMELAELALFKDSLCKEKVRLGRINSIEPIAKLEYVTDGNILTYFQARDTSCYLAYDLGESTLIERIVFSPRNDDNYIWPGDNYELFYQDGINGWKSLGSKVATEREIDFLVPQNALLWLRNRTKGREEQVFIYKNGRQYFAFDL

SEQ ID NO: 8898 - protein, 217 aa, B.fragilis
QLIIMTIKEFFSFKANRFFWINIIAMVVVAVLIVVGTLKGLDIYTRHGEAVIVPDVKGMSVSEAEKMFRNHGLTCVVSDSSYVKNKPSGIILDLNPSVGQKVKEGRTIYLTINTLSTPLSVVPDVADNSSVRQAQAKLIAAGFKLTENRMVSGEKDWVYGVIYQGRQLQIGDKAPIGATLTLMVGDGVQSTATDSVDMVENAAMSVEDSGTDDDSWF

SEQ ID NO: 8899 - protein, 1027 aa, B.fragilis
LNIIMKPILTSLILLLTAGLFPQAAATQELSKELRSQIGDFLNGTARKEISVGKIHIDSVNTEGNDLILFANINCSYIPFRTDNVSKIYQGIKALLPPELAKRKLQIRTDHHAIEELIPLALRNTRGRKIPTFSYKADTPLITRLSVPYTPTNGLQNRHIALWQSHGFYYESKLARWEWQRARIFQTVEDLYTQSYVLPFLVPMLENAGATILLPRERDPQTVEIIVDNDRCRDGHSVYSELNGSKMWKNGEEAGFAHLKRTYKDFENPFREGTYRQVETTKKGTVSVAEWIPEIPRAGRYAVYISYKTVNNSTEDALYTVYHQGGKSQFKVNQQMGGGTWIYLGTFSFGIGKTDCKIVLSNQSAKEGRLVTADAVKIGGGYGNIARSISEEGVTVNTKSSDTMITDTYHPKAQVNYPYEISGYPRFCEAARYWMQWAGIPDSVYSDSHGKNDYTDDYKSRGIWVNYLAGGSAANPTEKGLNIPVDMAFAFHSDAGTTYGDTIIGTLGIFHTSAYNGAYANGASRYASRDLCDLVQSNIVKDVRTLYEPEWTRRGMWNQSYYEARVPRVPTMLLELLSHQNFADMRYGLDPRFRFTVSRAIYKGILQFICSQYKMEYVVQPLPVDHMSLRFEEGNRIKLSWQPVDDPLETTAKADQYIVYTRIGDSDFDNGVIVNSPTYQTVIPSGVVCSFKVTALNKGGESFPSEILSIGKTFNDKGTVLIINGFDRVCAPADFTADADTLAGFLDELDHGVPYKTDISYIGPMKEFRRQIPWMDDDASGFGDSYGTHETMVIAGNTFDYPAIHGEAILKAGYSFTSCSDESIVHPDSSPKERETQICMNDYKYVDLILGKQCQTKMGRGGIRPLEFKTFSKEMQNAITNYCQAGGNFFVSGAYVASDLWDNRLVKANEEDKKFAMEVLKYKWRVGQAARNGKVKSVASPFPEITGSYTYYQDLNPESYVVESPDALEPAAQGAFTILRYSENNLSAGIAYKGNYKTCVLGFPFEAIRTVTERELLMKAILTFFEH

SEQ ID NO: 8900 - protein, 87 aa, B.fragilis
KMVIILFIKVYDMGEIKLISSLFVQGKRSLGNCVKSNESIVYLHVAQLDNVRLLLIKFIDETGGRKIIFYLQSTLFLIFFAKENDEQ

SEQ ID NO: 8901 - protein, 342 aa, B.fragilis
HNPMIKEQVKSLWKLCFDDSEAFIELYFRLRYNNEVNLAIQSGEEVIAALQMLPYPMTFCNKIVPTSYISGACTHPDYRAKGVMRELLSQSFARMLRNGVLFSTLIPAEPWLFGYYAKTGYTPAFRISHKVFSLSELTIGPEPDTMIEETTEYQEDYYQYLTGKLSERACCLQHTPTDFKVVLADLALTQNTVLIARKDNRVTGIAVAYKHDDSSYINELFADNEAVRAQLLYRAGLRNGTERIILQLPPVESLPSVPLGMARIIDARAVLQLYAAGCPEVEMNIELTDEQLSVNNGYYYLCKGKCMTSEVRLPGVHTRMTIAELSEKILDEMQPYMSLMMN

SEQ ID NO: 8902 - protein, 105 aa, B.fragilis
ENKMKTRMKITIAFVAVMVLSFTGYNVYKTQKAIQLSDVAMANVEALADGEGTNAGYCYLEDTWSTKRGYKYFCDSKTDKNTIYPCPSSMESGWYDDNKQDRCTK

SEQ ID NO: 8903 - protein, 313 aa, B.fragilis
ETKMNKEIETLLSEQLSSWETAQNNYAVLKRVRIKDVKVNGCLYRIQFNPARIVSSAAKVDDKSIQERKCFLCPANLPPMQKGIPFGEHYQILVNPFPIFPKHLTVPELQHVEQRILHRFSDMLDLATYAEDYIIFYNGPQCGASAPDHLHFQAGNKGFLPIEQEWKEKRGEKVITCKDATLWALNDYPRATLVIEAGSKETAIMLFNTVYQAMPSTSGEDEPMMNVLVWKEQKNWIVCIFPRNKHRPSCYTAEGDTNILISPASVDMGGVFITPQEKDFEKITANDIADILGEVCLRPAAFRILIERIKQQL

SEQ ID NO: 8904 - protein, 249 aa, B.fragilis
KAVVDVCQSVDQLFGRSSMRIWTLHIVLSVLFSVFLFSCNEDDGAPYPSVRLEFLTAESGADGRLQTLVTDKGERLVVAEDRTESELLPNSSSRVVSNYEVLSSVGGRKEIRIYALANTVSPVPLPAGEFRNGLKFDPVDMLSIWMGRDYLNMTLSIRAQNARHTFHFIHESVERDAVTGKLKVHLMLYHDDGGDVEAYAKRAYVSVPLRQYTSDIGESAIIYFNFHTYDGEVQTYQFEYVPSHLTINY

SEQ ID NO: 8905 - protein, 164 aa, B.fragilis
KVYVILQFDRFSRFKRANIENVPYICDSSVIYLGMLSYIKKYPVSLFIILAVIYLSFFKPPSTEISKIPNIDKVVHICMYFGMSGMLWLEFLRAHRRDHTPVWHAWVGAFICPVLFSGCVELLQEYCTTYRGGDWMDFAANTTGAVLASLIGYFIIRPRILSKK

SEQ ID NO: 8906 - protein, 63 aa, B.fragilis
ILRVGVHLAYSKEPVSSGKSADIQVTYRAEHPEHFEKTITVYCNTSTSPIRLKIRGNAVDKEN

SEQ ID NO: 8907 - protein, 323 aa, B.fragilis
QNSFIFVIYKQLKGNNNFMIAFRDITIQDKDTITAYTMNSCRRNCDLSFSNLCSWRFLYHTKFAIINNFLVFKFWAGDELAYMMPVGEGNLEEVLNELIEDARQEGEPFCMLGVCSCMREDLEAIMPGQFGFTVDRDYADYIYLRSDLATLKGKKFQSKRNHINKFRNTYPDYEYSPITKDRIQECLELEAKWCKANDCDQQEGTGNERRALIYALNHFEELGLTGGILHVNGQIVAFTFGMPINKETFGVHVEKADTSIDGAYAMINYEFANHIPEQYIYINREEDLGIEGLRKAKLSYHPETILEKYMACLKEQPVEMIKW

SEQ ID NO: 8908 - protein, 455 aa, B.fragilis
CHTVVFQCLMVNSHTVRSTDGVLTTVTFTDTVFFIILAMEVELKIVNDLTSLFRQSVFLYQRHYSQFHRCQCSRQFQYNAAFTIFQLLFAISSRHNTEEHTINTDRRFDYVRSIRFVQFRIEILNALSRKFFVLRKVEIRTGVNTFYFFETKWHQELNVSSGVCIVSQFIVIVETIMIVTKAQCLVPLQTNFFPFLEIFQFAARTNKELHLHLFELTHTEDELTGYNLVTESFTDLSDTERNFHAAGRLYVQIIDKDTLCRLRTKIDFHRTIGSRTHIGREHQIELTNFCPILSTGNRASYFFVNNDLTELFQIVIVQRFCETFVQCITLCLMLKNTPIGAAELSFVESFTKSFGSFGHLFINLIIVLSQLIFNQHIGTVAFFRVFIINQRIVKCIHMSGSLPDGRVHKDCRVNTDNVFVQQHHAVPPVFFNIVFQFNTHLSVVIHRAQSVVDIA

SEQ ID NO: 8909 - protein, 112 aa, B.fragilis
ERGFSTFDVFRLLSGSLVKISVEWLNLSYRRGQGGHRVFLSFRYAYIIVPISVVFVLWGGMKGGNKIELPAFQPDIPAECREAVLMSLCILMLSHDLRKNRHEYRSRLFRLH

SEQ ID NO: 8910 - protein, 64 aa, B.fragilis
GRGFLIILTGLIYFLTLTGYYFNNKFQDVGTMKRLFYILQPHLFIFWRIFIKQKFQCLSLLSFF

SEQ ID NO: 8911 - protein, 62 aa, B.fragilis
AKRVLHNKTTMSRIFFIKIVLGGSFCCSKDTFYFNIKNNYLEIFYIIIDNLQIGCYRVKLFS

SEQ ID NO: 8912 - protein, 168 aa, B.fragilis
SVLLIIVLYAVGMTAQAQKFALIDMEYIVKNIPAYERANEQLSQATKQWQGEVEVLAKEARTMFKDYLAAYAKLTAAQKTQIEDAVVEKERVASQLERECFGHEGELFKKREELMKPILDEIYNAVKAVAEENGYAVVVDRASASSIIFATPRIDVSNEVLAKLGYSN

SEQ ID NO: 8913 - protein, 447 aa, B.fragilis
LFIFVTQFLLLLPGDRKYRPEAHLFGQQILNVFPSYMIVLSFAQITDLFREYFGRCFLVLKCFEIQGILSSSQCDTSCFMVGSYHNQSFFRVFLVKLISNFDGIIHIRHFVEHRSGIIPVTSPVYLTPFYHQKETFVFAFSQKVNSAFCNLCQSQVSFFTIDSIRQRARIGTFFLNQYHLTCRSSFGFIIVIPTSNGVTGFFKHRENARSFFLIISSGWFQETGTGIKIKTCFRKIGSYFIIHIPIRLMCVESSRSSMIDTDTGSNSHPFTGFLCFLSNCLQRILLIIHPNGTIISLFAGGKSSSRSRRISHGISGRESSSHCPHRELCKKQRLYTNAALLDFGTIHFRTIHLIDTHSITNEIENIFCLSIGYNCHTDKKKEIKKSFHSCTILSLFELVIAKIKILKRRKGERDMNILLNRSPSINYPSTQTAISNLPHIKKPENRE

SEQ ID NO: 8914 - protein, 404 aa, B.fragilis
KVSLLQQKLPPNTIFMKKILLIVVLLCSTLFAQAQKSDVIIGAEQTKAYFPILKNKRIAIFSNHTGMVGNKHLLDILLENNFNVVAIFSPEHGFRGNADAGEHVSSTIDSKTGVPILSLYNGKSKKPSEASMKKFDILIVDIQDVGLRFYTYYISMVRLMDACAEYDRKILILDRPNPNGHYVDGPILDMKYKSGVGGLPIPIVHGMTLGELALMVNGERWLPSSRICDVTVIPCKNYTHQTMYRLPIPPSPNLPNMKAIYLYPSICLFEGTPVSLGRGTTLPFQVYGHPNMTGYNYNFTPRSIPGAKNPPQLNKLCHGVNLSNLSDEEIWKKGINLDYLIDAYHNLNMGDRFFRPFFELLVGTDYVRKMIEGGKSADEIKARWKRDVERFKIQRKPYLLYQDN

SEQ ID NO: 8915 - protein, 494 aa, B.fragilis
NISFINLKSMTPVAVLITIASYFLILFTISYIAGRKADNEGFFVGNRKSAWYVVAFAMIGSSISGVTFVSVPGMVGISNFSYLQMVLGFVTGQIIIAFVLIPLFYRMNLVSIYEYLENRFGTSSYKTGAWFFFISKILGAAVRLYLVCLTLQLLVFEPFHMPFIMNVILTVALVWLYTFRGGVKSLIWTDSLKTFCLIVSVVLCIYYISTDLKLSFTEMFSTVSDSALSHMFFFDNVNDKRYFFKQFLAGVFTMIAMTGLDQDMMQRNLSCKNFKDSQKNMITSGISQFFIILLFLMLGVLLYTFTSHQGITNPAKSDELFPMIATGGYFPIIVGILFIIGLISSAYSAAGSALTALTTSFTVDILGIKGKTEDTVRKTRKKVHVGMAIVMGIVIFIFNLLNNTSVIDAVYILASYTYGPILGLFAFGILTKRQVRDRYIPLVSILSPILCFILQKNSETWFHGYQFSYELLIFNALFTFIGLCFLIKKTINLT

SEQ ID NO: 8916 - protein, 188 aa, B.fragilis
FHTFAPDNLKVIIQINNKTMLKKIALLMMLILPMGVFAQNLKFGHINAMEIVSAMPEYTKAQSELQALNKQLGQDLQRSQEEFSKKYQEFMQQKDSLPAVIAERRQKELEDMMQRQEQFQAKAQQDMEKANNDLMAPVYKKLDDAIKAVGAAEGVIYIFDMARTPIPYVNEAQSINLTPKVKTQLGIK

SEQ ID NO: 8917 - protein, 521 aa, B.fragilis
MIKFVNKTMAPEDVFKKVVSHCKEYGFVFPSSDIYDGLGAVYDYGQMGVELKNNIKKYWWDSMVLLHENIVGIDSAIFMHPTIWKASGHVDAFNDPLIDNKDSKKRYRADVLIEDQLAKYDDKINKEVAKAAKRFGEAFDEAQFRSTNGRVLEHQAKRDALHERFAKALNDNNLEELRQIIVDEEIACPISGTKNWTEVRQFNLMFSTDMGSTADGSMKIYLRPETAQGIFVNYLNVQTTGRMKVPFGIAQIGKAFRNEIVARQFIFRMREFEQMEMQFFVRPGSELEYFKKWKEIRLKWHKALGFGDDHYRFHDHDKLAHYANAATDIEFLMPFGFKEVEGIHSRTNFDLSQHEKFSGKSIKYFDPELNESYTPYVIETSIGVDRMFLSIMSAAYCEEQLENGESRVVLKLPAALAPVKLAVMPLVKKDGLPEKAREIIDNLKFHFHCQYDEKDSIGKRYRRQDAIGTPYCVTVDHQTLEDNCVTLRNRDTMEQERVAISELNNIIADRVSITSLLKTIQ

SEQ ID NO: 8918 - protein, 357 aa, B.fragilis
TMKFIYSILFALLWIGVTITFGSYLYRMGLPIVNASAQKLLLRTIDEDLECRFRKLKPNQAYVTGKKHTKNKKVTLTDKSGTHNVRQFAIDTVYTDTSFVHRVKQSYLIERNSINVDSLNQKWQLKLRMDGICANTGIKLTNSLKNGERISASSGLNEPDCFLLAYSTGVGYGIKMDAFIRPFWATVVLKAHWNNIWTWNYVLFSLIFCLFYVPGVRLFLVQVLSKFRIVDNHVKSSQPLVQQKSEFVWEVNGLTFDYLQRSITYHNQTCILRKQVVEVLLAFLKVPGHLLLNEDLKKLFWKELEDVDSCMERRNRLITDLRTDLRKIGANLGVTLVNGGYQLHFRSENSKKSVKNQ

SEQ ID NO: 8919 - protein, 196 aa, B.fragilis
LLSSPREASAEAKRKWINSIREVSTWVSRREVYQALGRFSNMRFGEHIDFSIRISKGGYQCRLFPDAWVYHKRRTDFKKFFKQVHNSGIARINLYKKYPESLKVVHLLPVVFTSGVALLLLCTPFCLFNLVPILLYALLVCLDSALQNKSLRIGIYSIAASFIQLIGYGTGFWRAWWERCILGRNEFEAFRKNFYK

SEQ ID NO: 8920 - protein, 260 aa, B.fragilis
TIHSYSMKNVYFLSDAHLGSRAIEHGRTQERRLVNFLDSIKHKAAAVYLLGDMFDFWYEFRLVVPKGYTRFLGKLSELTDMGVEVHFFTGNHDIWCGDYLTKECGVTIHREPVTTEIYGKEFYLAHGDGLGDPDKKFKLLRTMFHSRTLQTLFSAIHPRWSIDLGLNWAKHSRLKREGGKEPDYMGENKEFLVLYTKEYLKSHPNINFFIYGHRHIELDLMLSATARILILGDWINFFSYAVFDGENLFLENYIEGETQL

SEQ ID NO: 8921 - protein, 123 aa, B.fragilis
AMHSCLICIGSNYNRKENLLLARRRLTALFPSIRFTGEQETRPLFFRNPALFSNQMARFYTDADAERVVKELKTIEREAGREQEDKKKEKVCLDIDLLVFDDRILRPEDLQREYVRKGLEELK

SEQ ID NO: 8922 - protein, 336 aa, B.fragilis
GFSSGLVARLYACLLRTTQLICPMKRPTIPLMLLIAASIFVFFLLNLLLGSVSIPIGSVWNILWGGTDESVIWQNIIWKSRVPQALTALVAGAGLSISGLQMQTIFRNPLAGPSVLGISSGASLGVAFVVLLSGAFGGVALSKLGYMGEVALSLAAVIGALSVMALIVYVSQKVKGNVTLLIIGVMIGYVASAVIGVLKYFSVEEDIRAYVIWGLGSFARVSGDQMTLFVCIMVVLIPLSFLLIKTMNLMLLGDGYARNLGLNIRRARLVGHFMFGSACSHRDRLLRTDYVHWFGGSSSLPCHLSYLGSPHPDAGHFAGRCFVGFGMQSGCPHAGL

SEQ ID NO: 8923 - protein, 70 aa, B.fragilis
LATPSAVRTTKNVLSAGFGLTMISKSAATVGGFFLADMMLVGVNTPLTLIKVAASTLDVPEIYWNAFSVA

SEQ ID NO: 8924 - protein, 350 aa, B.fragilis
CNAPSSKGLFVSIGATKVTDYLFTDKNIKTMIMRNINTDLIDAMKIYLPKGNNLANALMDILYLGKEATYRRLRGEVPFTFAEVATISQHMGISLDKIVGADLNDNAIVNLNMLQCQRPAETYYSIIDSYIKLFGQLIERESSERSTSSNTVPQTLYLKYEALSKFQLFKWIYQHESTYAGRHYEDLEIPEKLIDKQKEFVNLSQLFQSTNYIWDKEIFIRLVNEVKFFLNINLISEDSVKRIKKELLILLNELEKISAQGKYSSGKDVKIYISDINFESTYSYVETDIYHQCLIGVFSINSITSKDDFLFQHLKLWIQSLKKYSTLISQSGEVQRIHFFNRQQELVKSL

SEQ ID NO: 8925 - protein, 69 aa, B.fragilis
ATEPSFIASAKVVLFLKSPKKSVSFFTYIFTYIFYNPKGKLVKYQIKSNIVQPISIYTEYRQVYFKSEP

SEQ ID NO: 8926 - protein, 199 aa, B.fragilis
NREPVVFQLQGQDKLLRQAAFDLLILDIIMPKMIGLELCRLYRHQYGYLTPVIMLTALGTTEDIVKGLDSGADDYLVKPFSFQELEARIKAILRRGREDSVQQLVCDDLVLNCNTRRARRKEVEIELTVKEYRLLEYFMTHQGMVLSRLTLLKDVWDKNFDTNTNVVDVYVNYLRGKIDKEHDKKLIHTVVGSGYIMYA

SEQ ID NO: 8927 - protein, 90 aa, B.fragilis
RNKFLSEVIEILPGLFKIILPESVPQGLSLFLKESTIQPIDPHAGNLASNQQMCLNIGRKECFCSRSLSSERFSITCNFYRLSLYDVPLC

SEQ ID NO: 8928 - protein, 60 aa, B.fragilis
TTTTRFEIGNYLFDSLAQTLTHAGLKHELSHRESEILRATLRKSESSGQHTECITRPMGR

SEQ ID NO: 8929 - protein, 236 aa, B.fragilis
QMITTHPIRFVSLGPGEPDLITLKGLKALQGADCIFCPATMTQDGKSSSRALSILNTLGFSDTVQCFRLPMDKDRTLALRSYEAVYESSKILRAEGQNVVIVAEGDAGLYSSIHYIYDKLQQDDIPVEQIAGIPAFIASGAMAGLHIVSQEERLIVIPGHVTAKELDDYLKHQTVVVIMKLSQCIDEVHQCIINHPEYQYHYFENVGTEKEYYSCSTEELREKRYPYFSVMIIRFG

SEQ ID NO: 8930 - protein, 60 aa, B.fragilis
RGVTLSESDNHYREIRISFFPKFFGGARVVFLLGPYIFKVVVLVFRMVNYTLVYLVYTLR

SEQ ID NO: 8931 - protein, 492 aa, B.fragilis
LIWTIWKQMKSKWRMPHPATMFFLFTLAVIFLSWIFDIYGLRVQLPQTGAEIRVQSLLSPEGIRWMLRNAITNFTGFAPLGMVLIAMFGIGVAQHSGFIDACVRQGVKNRKNTRRIILWVIILGLLSNIVGDAGYIILLPIAATLFYSVGLNPVAGIITAYVSVSCGYSANVVLSTMDPLIARTTQEAAIDSGVYQGNTGPLCNYYFMSVSTFVIGAIIYRITCKRLIPSLGQYEGKQIFEGYKQLSRKERRAMTMAIVVGMLYAAIILWATFSSWGILRGVNGGLIRSPFIMGILFLLSLGAAIMGMVYGFSSGRYRSDNDVIEGLAQPMKLLGGYLVIAFFAAQMFACLEYSHLDKCVAIIGANLLSSVQAGPLWTLILFILFTATINLIMVSATAKWAFMAFIFVPVFARMGIEPDMTQCAFRIGDSATNAITPFMFYMPLVLTYMQQYDKQATYGSLLKYTWRYSVYILIGWTMLLFIWYLTSLPLGL

SEQ ID NO: 8932 - protein, 240 aa, B.fragilis
IRMASHCVGYFKYLGQHVGFFSRITPVFQERRKVMKSSLIVVAFFCIGCLVGIFNDFQFDMHNLSMYILYALMLQVGISIGSNKNLKFLIKSLRPNMLLVPIATIVGTLLFSAFASLLLSQWSVFDCMAVGSGFAYYSLSSILITQFKEASVGLQLATELGTIALLANIFREMMALLGTPLIRKYFGKLAPISAAGVNSMDVLLPSITHYSGKDMIPVAIFHGILIDMSVPFFVSLFCSL

SEQ ID NO: 8933 - protein, 73 aa, B.fragilis
VMVAGQKMQSAPCSALSPFNVIRSGSPGPKDTKRMGCVVIICYRFIILMFCKSEENISMKQELLSIFDRCNLN

SEQ ID NO: 8934 - protein, 163 aa, B.fragilis
ESLYKIFYKIMSENKQALQVAALKNGTVIDHIPSEKLFTVVSLLGLEHMTTNITIGFNLDSKKLGKKGIIKIADKFFCDEEINRISVVAPHVKLNIIRDYEVVEKKEVRMPDELKAIVKCANPKCITNNEPMATLFHVIDKDNCVIKCHYCEKEQKREDITII

SEQ ID NO: 8935 - protein, 198 aa, B.fragilis
LVTYKVNKKMKQDWKPGTLIYPLPAVLVSCGSDESEYNILTVAWTGTICTNPPMCYISVRPERHSYPIIKKNMEFVINLTTRDMAFATDWCGVRSGKDYHKFEEMKLTPGKCSVVDAPLIEESPLCIECRVKEIVSLGSHDMFISDVVNIRADDRHLNRETGKLELAEANPLVYVHGGYYNLGEKIGKFGWSVEKKTK

SEQ ID NO: 8936 - protein, 682 aa, B.fragilis
KKAYICYLQTTNNMMRYIILLVLCAWTGIALAIDYHAKDSLLLQLKQTTIAAERINIYRNLADICFETPDEKTYLLNMYREAQKAGDTSGMLNALNDLVCGETKEYRMDSAYHYMELIKAIREPQETAPVLAYLQMRFFDTLCSHNETEEAITKELQFIEEKKSDEASLYSKIAQAYITGGSLHYNDMIKEALPYLETAMNLSKQLPPEKQILFVSIIVWKLSNTYSMLNKCDSAIRILDENLQTQQQYYKDHYQTQRPFYNMAIHELRFYTSLLTNAISEAPEKMDYYWQQIVKLNKKLTNPYDRYNYFLSMDNYYLNQKPQPHYEKALVANDSLIQIAQEIIPNNLPGLYDIQSQTYEAMGNFKEALAYLRIATQYKDSLTTENMQKQLGELQIKYEVNKLNNEKSQLEIKNKRILVICLSIILIIVIFVCLYLYHDLKKEKKMKFHLRNLKQKAEESEKMKTAFINSICHEIRTPLNSIVGFSDLIFNDEIDKETREGFSQEIQKSTILLTSLIDNMLEISSLDVSQEKLPCKEANLNSICIQEMTLLNRSHKPDIDYRTDLPEHPIILTTHEKYLSLVIEHLLNNANKFTEKGIITLHCHIDEARQQVHISVTDTGCGIPADKHKEVFERFSKLNAFTPGNGLGLYLCQLIIRRLSGKISIDPTYTGGTRITVILPVQ

SEQ ID NO: 8937 - protein, 310 aa, B.fragilis
LMPHRMFTCKIEAGFRVFIFIILHFVLTNCIREDMSGCPRDDGGLALKFSYDTNADSRLSTAQGVDRLAVFIFDEKGLFISQVNDSMTSINDDYVMELPYKQGSYQFVAWGGYDKSTYQTSECVPRKTYIDDFFLSVKRQEDNRVTNQPKLLYHGMHDIVELNSKEKTIVLINLKQMTNHIRVIAHNLNQDRSDNIYIEDNNGKYGYDSQFSDDDRITYIPIYEASSEQSNPLIADFNVMRLEKDREPRLRIADKTGTIRYDENLIGKLIGGNPNIDFEHNHDFTIEISFDNYIPVIIKINGWEIVNEEI

SEQ ID NO: 8938 - protein, 317 aa, B.fragilis
QLLHTMSEKAPFMVFSGTNSRYLAEKICASLNCPLGNMNITHFADGEFAVSYEESIRGAHVFLVQSTFPNSDNLMELLLMIDAAKRASAKSVVAVIPYFGWARQDRKDKPRVSIGAKLVADLLSVAGIDRLITMDLHADQIQGFFNIPVDHLYASAVFLPYIQSLKLDELVIATPDVGGSKRASTFSKYLGVPLVLCNKSREKANEVASMQIIGDVKGKNVVLIDDIVDTAGTITKAANIMLEAGANSVRAIASHCVMSDPASFRVQESGLTEMVFTDSIPYSKKCAKVKQLSIADMFAETIKRVMNNESISSQYII

SEQ ID NO: 8939 - protein, 94 aa, B.fragilis
KVTQCTPWQLLCISCRTVPLFHLILISERKEINQTTKQGVIQINPLNQCTCTMQCPYRILFSCTALCMLYVVNNRFILFINYSAKVILLRIFSK

SEQ ID NO: 8940 - protein, 388 aa, B.fragilis
IKRQIPMKQFLIGCALLACISLAGCRPKNNQNATIVTGEVSDTSSVRITPVYAKGFKVTYTPTCRLVDISDPQKEGGESFHYALVPGGTKPENIPAGYTVIETPVKSVICMTSLQLSNFIKLDALSHVVGITSTRHLFNKEMNERLKQGKTAKIGIEGNFDNEVIMSVNPDVIFISPFKRGGYDAMREVGIPLVPHLGYKEMTPLGQAEWIKFIGLFIGEEETANRKFAAIEKHYNELKERVAHVKKRPVVFSGEIRGGNWYAVGGKSFLAQLFRDAGADYFLKDDPRSGGVTLDFETVYSQAESADYWRIVNSFDGTFSYDVLKSEDPRYADFRAFREKGVIYCNMREKPFYESMPTQPEVLLEDLIKAFHPDLLPDYTPVYYERLN

SEQ ID NO: 8941 - protein, 789 aa, B.fragilis
LSLQLRIKLRNKMIKKIVKGLWVFFALMVLAGIAVFASIAYGWIGYMPPVEELENPNYKFATEILSEDGKVLGTWSLSKENRVYTSYNELSPNIVNALIATEDVRFTEHSGIDAKALIRAVVKRGLLMQKNAGGGSTLSQQLAKQLFTDEVARNTLQRLFQKPIEWVIAVKLERYYTKEEILSMYLNKFDFLNNAVGIKTASYTYFGCEPKDLKIEQAATLIGMCKNPSLYNPVRFNERSRGRRNTVLDQMRKAGYITAEECDSLQNLPLELVYHRVDHKEGLATYFREYLRGVMTASKPVRSNYRGWQMQKFYEDSIDWEMNPLYGWCEKNKKKDGSNYNIYTDGLKIYTTINSHMQRYAEEAVEEHVGEYLQPLFFKEKKGRKKAPYSNQLTQEEIDRILDRAVKQTSRYQTMKEAGISEAEIKKAFNKPESMSVFTWHGVKDTIMSPMDSIRYYKHFLRAGFMSMDPINGQVKAYVGGPNYTYFQYDMAMVGRRQVGSTIKPYLYALAMENGFSPCDETRNVEITLIDENGKPWSPKNTSKGHYGEMVTLKWGLANSNNWISAYLMSKLNPYALARLIHSFGVRNKEIQPTVSLCLGPCEISVGEMVSAYTAFANKGIRVAPLFVTKIEDSEGNVLATFSPQMEEVISASSAYKMLVMLRAVINEGTGARVRRYGITADMGGKTGTTNRNSDGWFMGFTPSLVSGCWVGGEERDIHFDTMTYGQGASLALPIWTKYMHKVYADQTLGYDPKETFNLPDGFDPCKDFSISGDSIIDEPESGLDDLFN

SEQ ID NO: 8942 - protein, 60 aa, B.fragilis
PILKVYKSMGKTLPENSSRNFITVLRAARTSKSRYLQNTRDCKYTTANSEDHRCYHRQHR

SEQ ID NO: 8943 - protein, 208 aa, B.fragilis
NNIKTKSMENQETKTEKKIVKVKLSDAIKKASILKAVLLAYKDKELSAELKSKVMMTRIYYGKFRKQFEEDVKEAREGLKPEGYDTQLQEIDELENKARGDKDIRNLTPEMLKSALTEEEYDKHETFMPIFNKYMEEVTNFKSEKLDEEVEMEEKKFTQKEFDEILNVNTAESYNLDLCMPYNGKNMIFPGTMKSADFMEVLYEEFID

SEQ ID NO: 8944 - protein, 198 aa, B.fragilis
FGDKHVEFATCLWNNSTNKILLLLLLIKLEIKKNLIMKKLKFNLLTGLLLLISVSVFAAGFPPPDKVQETFQKMYPKVTTVDWQRKGDYHIADIRVDGRELNVWFSDKGKWLMTEVDVETLEAVPAAVAKAFMQSTMASMQLEDVRIITFPKQPAVIVIEVEEYNTDSEFQLFYAPDGKLLQTLNVSDTGGEIYPGLF

SEQ ID NO: 8945 - protein, 137 aa, B.fragilis
KNKKMSRGLRNNNPGNIRHDRDKWQGEIVPSQDRKFKQFISMAYGYRALIKLLQNYRKLHNRQTIAEFINRYAPPCENNTSGYITRVCSEMQVPSTYIPDIDDKATMCAFAAAIGQVENGVPAVMADIEAGWDLLMK

SEQ ID NO: 8946 - protein, 259 aa, B.fragilis
FRRKDRKIRLVSRKENKVKRIVLLFISIWIAFAAYGEDNHKKERHPDDRKINVGIRGGFNSSMFLVSDLKIKDVTIDEIQNNYKIGYFGALFMRLNMKRHFIQPEISYNISRCEISFDKLGSQHPDIEPDYASVSSTIHSIDFPLLYGYHVVKQGPYTMSLFAGPKLRYLWNKKNKITFENFDQQGIHEKLYPFNVSAVIGVSVNISRIFFDFRYEQGLHNLSKSVTYDNIDMEGRPEVSNITFRRRDNVLSFSLGVIF

SEQ ID NO: 8947 - protein, 1496 aa, B.fragilis
LYLKEMNPRLLIPLFCMLLLTTFFSCVDTAPTKEVQHIDSLNSRAYMYRYRDLDSSCKAASQAYKEVSMYSQGKAEASNNLAFCAFMRMDFDTAERLHKGVYDLTKNELELLIADIGLMKIYQRTAMNKEFYDYRNSAIRRMKRIDEENNLFVDRHESARLDYAFTEFFIVSAVYYYYLQQRTEAMASLNEIQLNEDLATDTNQILYFHYIKGSAGLCEGKTPDERKLEEFDELYTTWKMASEQGYLYFEGNGLQGLTNLMASQESYELFLNRRSHALTRFGIPVDSLLPLRLGQMALERFRKYNDLYQIAGAYVSIGKYLNAHGRYTEALDTLAKALDCVNQHHMSYYHSVADTLDKLQVFVPNKDVAYTEVTWLGKEKVKTVPEWISRIREQLSVSYACLGMKPASDYNRNVYLDILRYTRQDKELESRYLSLEQESRQLNVVLFFVIIGLILVTAMFWLFNKRSKVRNRIHIARLRQTLDVCQKITASIPVDVTDESEIVYAISESIQPDMEQLFGATEIRIGIRNEETGDIEFNEECESEQTDEPKSIGEVGIGSVFNLYVPDKTEPIGILKLFTRHRLNKDEQALVKVITPYIAWALDNGMTFISLGDERNKLEKQRYVYEQHIAGNKRQNLIKKSCLAIVDGINPYIDRIINEVHKLTEKGFINNDRIKKEKYQYIDELVTTINEYNDILALWIKMKQGSLSLNIENFELNELFELISKGRKAFEMKKQRLEIEPTKALVKADKALTLFMINTLAENARKYTPEGGIVKIYAKRTDEYVEISVEDNGRGLSTEDITKIIGEKVYDSQSIGMKDNPDKEELKRSKGSGFGLMNCKGIIEKYKKTNDLFRICTFNIESTPGKGSRFYFRLPPGVRKIIGICLCLVGLFGFFSCQGEPMPEKLKDIPVDSVTLAAEAEYERLLDEASRFADTVYYCNVIENFELALQYADSALNRLNAHYKKYARHPQRFMKLVGSGIPAELEWWVEPYNTDFHVILDVRNEASVAFLGLKKLDAYTYNNVAYTALYKLTGEDQSLEGYCRQLERSTTNKTVGIILCILLLVASLCGYYLLYVRKRLLNRLNLEQVLEINKKVFASSLVRTQESAEALQREEDTLKEIPQRIVNESFDSMNELLTIECLGIAVYNEMGHRLEFASTPRMDTPPEIIQQCFDNQTYLSDGDMQALPLLVDAGGKHQCVGVLYLERQEDSMQEADRLLFQLISRYVGIVVFNAVVRLATKYRDIEAAHEETRRASWEDSMLHVQNMVLDNCLSTIKHETIYYPNKIKQIIGRLNTHSLSGEEEKECVETISELIEYYKGIFRILSSCASRQLEEVTFRRATIPVTDIMAYAGKYFKRISRGVNYKITLTIEPLEAKVIGDINQLRFLIENLIDEALSFHQDGELVLKAIMDGEYVRFLFTDRRREKQVEELNQLFYPNLARMTSGEKGELRGTEYLICKQIIRDHDEFAGRRGCRINAEPAQGGGFTVYFTVPKR

SEQ ID NO: 8948 - protein, 329 aa, B.fragilis
FIMNRTLQPEIQELVQFNILPPVRTVMPNGVPLTIINAGEQDVVRVDILFGGGRWQQSQKLQALFANRMLREGSRKYTAAEIAEKLDYYGAWLELSSSAEYAYITLYSLNKYFAETLDVLESIIKEPLFPEKELGTVIDANIQQYQVNASKVDFLAHRSLLRALYGEEHPCGRYVEETDYHHITPALLREFYDTYYHSGNCYVYLSGKVTDEITHRIEAAFGTTHFGNHQQVAVKKDFTFVSIPEKRLFIEREDAMQSAVKLGTTTIMRTHPDYLKLRVLITLFGGYFGSRLMSNIREEKGYTYGISAGIMFIRATVCWVSVQKQLMNM

SEQ ID NO: 8949 - protein, 318 aa, B.fragilis
EIMNSHQELFGGNIPQDVTGKQGENAIFIVYGLKQSDNTIKQVKDLCANFSALIRSMRNRFPEMQFSCTIGFGADAWKQLFPEQGNPKELKTFETIKGAKYTAVSTPGDILLHIRAKQMGLCFEFASIIDEKLKGVVDSIDETHGFRYMDGKAIIGFVDGTENPAVDENPYHFAVIGDEDPDFIGGSYVFVQKYIHDMTAWNSLPVEAQEKVIGRHKYNDVELSDEEKPQNAHNAVTNIGDDLKIVRANMPFANTSKGEYGTYFIGYASTFSTTHKMLENMFIGDPVGNTDRLLDFSTPITGTLFFAPSYDLLAKLGE

SEQ ID NO: 8950 - protein, 238 aa, B.fragilis
TDMKIRNLMVAATLLVTAGAMAQNQDCAFFFPNQEGEQITRNCYTADGKLTNILVYRVDQAYEYPSGMEVVANYTFTDATGKTLNSGQMVARCSDGNFSMSMGDVATFPTALNMMNADVYMMGDLMNYPDAFSNPMNPGDDDEFDDGTLRLYQKGNKNNRAEISVFDREFVTTETVNTPAGAFYCTKVKYEMNIWTPKETIKGYGYEWYAPNIGIVRSEQYNNKKELQSYSVLERIKK

SEQ ID NO: 8951 - protein, 344 aa, B.fragilis
RIMKQKTIHIENLSIGYLGKTDVKVVADRINAGINCGELTCLLGANGVGKSTLLRTLSAFQPKLGGKIEIVGKEIDAYTDKELSTVISVVLTEKCDIRNMTVHELVGLGRSPYTGFWGTLRGEDKEVVERSIALVKIQNLAHRMVHTLSDGERQKVMIAKALAQETPVIFLDEPTAFLDFPSKVEMMQLLHRLSRQTNKTIFLSTHDLELALQIADKIWLMDKMNGVTIGTPEDLSLSGKLSSFFARKGIVFDLETGLFRVDNEYTSQIRLVGHGQKYAMVRKALQRNGILANRTVESDTYIETGDLKDGNGFILHPQEGEAVTLNSIEELLERLQAGSAERAV

SEQ ID NO: 8952 - protein, 725 aa, B.fragilis
TLMKKLMVILITGLLYMSCTDSMEVSGDADRNNTEDVSVRLVITIPASTTYARTRGTFATTDHESKISEIQVLVFEEGKYKYRVPGISINNTSSAASFKALLKSSSSPLKLLILANATDAVIANEPSVDDSEDLVKKNINLRFNNITSDFPMYGEYELPGGLEATVINNITGIKMLRSIARVDVKATEVANFKLSGVKAYRANDHLQIIPDETGVVRVTLPSVPAGSSGNVNSILYPVPAENLNEFSAQLYLPEADSPTPDNRVSQATCIVVEGYYEGSDQPGYYRMDFDPDNVENAFGQVLRNHKYIFNIKKVSGPGWGSPDEAANNRSAHIVAEVQAWDDYTIDMNFDGEHHFGVSTREIVLKNKAGSAGIINVSTDLPDYTLQWADAAGTPTGTGSQSLANEYFTVTKAQNGSQLVITALQSNSTNDTSRIQNFVITAHRWRILVNIQQKYDVAAYQTIHLLTFNAGLGYLGTNIIGSGSAEARATGLRGILNNQNNFGPTGTVECGGYNLIGVNANYNNLTDALFASFDVVYVHYMGNLLFGTSDAQKAHNWVKSKKNRVLIVSYDALDVSQNLLKEILGGNNGISFLTSNTGPYPLATPENGNSYFSTTGPFTSAPYTPINTDFSLRNYDAYHGEIQLNTEASKGITPILMGPAGGIVLGIDYSRRIVYWGDTDIGSSASSSTSTTDNRINNNSGTINNNASKLIANVFAWIAETVLYGE

SEQ ID NO: 8953 - protein, 428 aa, B.fragilis
QIMKRDDLIFDIIEKEHQRQLKGIELIASENFVSDQVMEAMGSCLTNKYAEGYPGKRYYGGCEVVDQSEQIAIDRLKEIFGAEWANVQPHSGAQANAAVFLAVLNPGDKFMGLNLAHGGHLSHGSLVNTSGIIYTPCEYNLKQETGRVDYDQMEEVALREKPKMIIGGGSAYSREWDYKRMREIADKVGAILMIDMAHPAGLIAAGLLDNPVKYAHIVTSTTHKTLRGPRGGVIMMGKDFPNPWGKKTPKGEIKMMSQLLDSAVFPGIQGGPLEHVIAAKAVAFGECLQPEYKEYQKQVQKNAAVLAQALIDRGFTIVSGGTDNHSMLVDLRSKYPTLTGKVAEKALVSADITVNKNMVPFDSRSAFQTSGIRLGTPAITTRGAKEDLMLEIAEMIETVLSNVENEEVIAQVRARVNKTMEKYPIFAY

SEQ ID NO: 8954 - protein, 467 aa, B.fragilis
YIHLNKKIMKTSKIFMTTLVALTMAACSNDNDWVDQSSNPDVIAPDAYASFSINIPHASKTRAVSTDPGIAAENTVKSLHVFIYDAESPNTPTVAEFTVAGGTLTQKPAGSSTWMTSQPISTKKTDKYIFAGVNLNTEIVNYITSNGLGAFSYKDFTQEITKLADQTNGFVMFNSAYPTLTPAADLYEKKSEAENNHITISVNRITAKAAVFQSQSFVVNGGGTMTDLKFGWRNLNKKFYFIQDNRDTLIKDYNWANYTAEDFTRGTDAINVYASADVPTSFSYATENAFQYISGTSNVDAATFISVSGVFTPTNIISAKKNPPTVAADFEIIVNPKPADKTFFVVRTADGVANYFIDGPTAEKFAELCAANTPQMPSINGIYLLSENTYSNGLCYYHIFVNGDAVTPQAPYNIYRNQYFKININSIQAPGNPSDNFDRGEPIKPNSWIGVDIQIIPWEVIEEDHDL

SEQ ID NO: 8955 - protein, 468 aa, B.fragilis
QEIDSYGGRFGIYHVCLTLTSQAMKIGRKIALFYTLVTVLTTMAVIGVFYLFSSRYIDGLYRSYLREKAFLTAQKHWERDEVDEQSYQTIQRKYDELLPEAKEILLDMDSDAVVRDTLNKYLSASQQKQLLESKEMSSVSFVYQDMLGAALYYPDNEGNFIVIIMSHNSYGVKIQEHLLLLSAFLVLCSSVLIFFIGQLYSTRILIPLQHVLLQLKQIRGNSLNRRLKTTGNKDELDHLIETLNSMLDRIDTAFRAEKSFVSHASHELNNPITAIQGECEISLLKERSTDEYIEALRRIAGESKRLSNLIRHLLFLSRQEEDIRKNNVEEIRLADLLEEAGAANPRIRLQYPEDAARYAVVSASPYLFKIALQNVIDNACKYSQGEVLIRLYKEDERWGIAVKDSGIGIPADEMELIFQSFYRGSNTREYAGQGIGLSLSMKIFSVYRGKVSIRSEEGKGTEVRVVFA

SEQ ID NO: 8956 - protein, 312 aa, B.fragilis
TYNDMENRSLVTIAEHSREKILYMLEMAKQFEKNPNRRLLEGKVVATLFFEPSTRTRLSFETAANRLGARVIGFSDPKATSSSKGETLKDTIMMVSNYADVIVMRHYLEGAARYASEVAPVPIVNAGDGANQHPSQTMLDLYSIYKTQGTLENLNIYLVGDLKYGRTVHSLLMAMRHFNPTFHFIAPEELKMPEEYKIYCKEHNIKYVEHTDFNEEVIKDADILYMTRVQRERFTDLMEYERVKNVYILKAKMLENTRSNLRILHPLPRVNEIAYDVDDSPKAYYFQQAQNGLYARQAILCDVLGITLQDIL

SEQ ID NO: 8957 - protein, 300 aa, B.fragilis
KKKEMKNILIIGANGFTGRRILNDLSVNPIYHVTGCSLRDDICPGKDYRFVRTDIRDENEVRKLFKECRPDIVINTSALSVPDYCETHHAEAEATNVTAVETIAHVCEQYGSRFIHLSTDFVFDGKSIRLYKEEDEAIPVNYYGVTKLKAEKIIASICSNYAIVRVVVVYGKALPGQHGNILQLVANRLRNGETIRVVSDQWRTPTFVGDISVGVEKLMFHTANGIYHICGSECLTIAEIAYRVADFLKLDRSLIEPVTTEEMKEATPRPRFSGLSIEKAKAEIGYTPRTLEEGMEASLF

SEQ ID NO: 8958 - protein, 244 aa, B.fragilis
NSMEDKKFKVIIVEDVKLELKGTEEIFRHEIPNAEVIGTAMTENEFWPLMETQLPDMVLLDLGLEGSTTIGVDICRNIFKRYPGVRVLIFTGEILNEKLWVDVLNAGADGIILKTGELLTKTDVQAVMDGKKLVFNYPILEKIVERFKKSVANDAKRQEAVISYDIDEYDERFLRHLALGYTKEMIANLKGMPFGVKSLEKRQNDLIGRLFPQGERVGVNATRLVVRALELRIIDLDNLEADEE

SEQ ID NO: 8959 - protein, 181 aa, B.fragilis
HRTDMKKLIFFLLLLLSTASLSAQSEQPSDSIRHLPSTVKQYGDFLIDMGLFIAAPPKLPKYKFELPDASKDYNRIFSLNPDVIMTQGLSNVFTPSLSYGFGWGGHDFFSSPQQLQMGSFKLKNGMRLNTYGEYNADGKKVPNPAAMPWEKNNFKGAFEMKSSDGNFGIRIEVQQGRNYPY

SEQ ID NO: 8960 - protein, 69 aa, B.fragilis
LRLFIRTCCPIIRLSITNDSINLSDETTDNTSYAAYSRIYFCLFSAESVVGLGFHSHRFGMEHTLGRNG

SEQ ID NO: 8961 - protein, 75 aa, B.fragilis
GLGLFSQIQRWTFSRKNPWRLMNGVNKDFSIITSHMNLLSNYATIGNVCKDVYLFSKLRHKLFTSSCCRLKKWIR

SEQ ID NO: 8962 - protein, 72 aa, B.fragilis
QEPCFSHLHTICLLNSESNSYSPYSTVSAIQAKTLAMSLDALLLMVPELLFIRLSVVDVELDAELPISVSPQ

SEQ ID NO: 8963 - protein, 318 aa, B.fragilis
GRRLNIFSLKKPVKFNKQFVTDADAWWKADNGNFGIILPPTGSLPAVGSPMSPWSWDFPGGSGSPLRISDYAGYNPKAPHLFSMHPDPGLYPNSQFRCSILLRQNAEISINNIADISRAYMGVVVRHQANGELRFRTLNRSVMEMQQQEYAVVLDVPNWPDGKVDVYMVASYAEASEQSYSSINVTLFSMNQGPLETAYMVKTLAKPVPNSFKFDYKVVNDFANEYHLECTFTSIKGAWEKARFSVFLESDPIGAFLGGMGESLSPAPIGEMLSQGESYTFNSQSFTRVQTSQNNYVNYTARYLGDNYQSGSIFFRAK

SEQ ID NO: 8964 - protein, 447 aa, B.fragilis
KNNRRIWGIQSFTGMKTEDIAISITGYSYSNIKETIPDGVDKEEIAAVYEEIIDEYLQKGIPREIPALINVSGIPGAGKSTFCKKLLAMPENSSAIYIGFDAIMENERLPYIREEVNHAEEAFKRWELSARIAGYELLKRAIENKYLIIFDHSSALPQHIDLFNLLLSEGYEVHFNFIFIPEEEARRRAKNRKRYIPPYYIEERSKTLQYLLPEYKRICTTFKQIEPMRTRLIIARHGNTFRPEETPTRVGAKTDLPLVEEFKGRSIGRYLKEHDMIPDVIYAAPLLRTMQTARLAVQTIGLDSDISPLNAFVEIDYGVDENKTEEEVRLRLGNGNIEKGKKIIEDWDKNAVVPDGWKVDPDQIIHTWLDFAEKTVIPHQTTLLVTSNGIIRFAPYLTGDFEKFAQEHKIKVAPGGLCIFDKNDGDSFWTCSAWNVKPYELYADSHY

SEQ ID NO: 8965 - protein, 451 aa, B.fragilis
KWLREDFVFLIKTMVIHSGLALPGMSSLMNYMQIATTENTIYTSPDASKIFCYTPSIIVTPTGRLIVSFDLGGEGVKSIEGHKSSRAGGSRFGQGKIFISDDNGQKWTFVQNFPFWHARLFTIGNSIYLIGHAGDICIMKSEDNGESWSDTYFLTHGEKWHSSACNVLFSNGNVYLAMEQRCRLNEVTGWDVAGLSPTLFRACVEDNLCLASSWSRSEKFIYKEVFDGAKLDFFGIPFYDCETNKPKEIATGINNAPLGWLEANVVKFVDKDHIWHTDLKEVFHLFLRAHTGGVNYAHLFKIEIQDDQSMIPSLEHTPSGQKISYIPFPGGHLKFFIIYDELTRFYWLVSNQATDSMRRVSSLSNIKRYGLPNNERHRLQLHFSRNCVDWCFVGMVACSTNELYSRNYPSAVIKGDDLHLVCRSADEHALNPQYNNMITHHIVSNFRQLIY

SEQ ID NO: 8966 - protein, 706 aa, B.fragilis
KMKRIYLTFVFAGAVCFQVAAQNADEDRILSADSLITMDGRLDSLYRSLPEVMVVGERPVVKAMQGKLVYDLPRLIQNFAVDNAYDAIKELPGVSEMNDNLTLGGKSVTVVLDGKVTTMTQEQLNTLLKSIPAGRIEKAEVMYSAPARYQVRGAMINICLKQGDSGKSTLQGEFFSDYRQKHYEYLTERASLLYSGHKFSADFLYSYSHGRNYFLTDKEALHALSDGTIHPISTNESQRSRSNRHNLRLAGDYVFAANHQLSVTYNAQFVNGFNLSTVDGTQISNARTRMTDQLHNARLDYHMPFGWKAGVEYTYYHSPSSQLLHSRMGSDELDFRVKDSQRINRWKLFLSGEHDLGNGWGMNYGAVYTTSLDNSHQYYHDPETDEIISGNSNMKSRRREQTLNFYAGFNKAFGDKLSLDASLAAEQFHTTVWNEWSLYPTFNINYAPAPGNVWQLSLSSDKSYPDYWATQDAVSYMGGGYSEIHGNPYLKPEINYQLQLTYVLNSKYMFNAWYSHTKDNATQTLYQSPERLVEIYKYFNFDFEQQAGVQAVVPFAIGRWLKSRFTLTGVYDRQKDSDFWDIPFDRKAYYAMLNMNHTVTLFSHPDIKLIVSGMIRSKAIQGIYDLPASGNLDIALRYGFANGKALLTLRCNDLFETGQISPRICYVMQNVTNHYSAFREFGVSFTYKFGGYKEKKREGVDTSRFK

SEQ ID NO: 8967 - protein, 160 aa, B.fragilis
KKKRSMSVIFKTVKRPSDPRVENSPKRYYPQLITLGRSVDLKFIAQKIQDRSSLSVGDIKSTIQNFVEKLKEQLLEGKAVNIEGLGVFMLAAKSKGSEKQEDITAKSVDSVRIYFQANKELKITKTATRAGEKLDLISLDDYLKGTADGGNGDIVDDPTA

SEQ ID NO: 8968 - protein, 233 aa, B.fragilis
WSILKNARTMSLSNLLIIFSSSFMALFPVVNPLGNGFVVNGFFTDLDPKQRKTAIRKLILNFIIIGVGTLVIGHLFLLMFGLAIPVIQLGGGILICKTAMELLGDSNSPDQEESNRNMDSLKWKNIEQKIFYPITFPISIGPGSISVIFTLMASASVKGKLLQTGINYFVIALVIVCMAAILYIFLSQGQRIIQKLGPVGNQIINKLVAFFTFCIGIQISVTGISQIFHLSIL

SEQ ID NO: 8969 - protein, 536 aa, B.fragilis
QQQRLTIIFACMKLPIKHIAILVIASLMAIFAYQAYWLVSMYHTMKSDMEHSIIEAMRTSDYNEMMLRIERMRRDDQDHGEISVSAGYNDEGGTLVRSSTMVHKEKIPGSTGIQQDSILKTERKLDTLIVVRNDQKEIKVVPQDSTAQEVKAAMLQTKGGLDILLKDQNTMLELATYFQRGLHSGLDVIMDPDFQSYDSLLTLSLQERGISLPYRIEYLHFGNTPDSSLLFTDTLGMGGTANYIPGPDAHTYDYTFDIHSHSLYRLRMDSVAGVIVHQMAGILITSFIILLILGFSFWFLIRTLLKQKTLEEMKSDFTNNITHELKTPIAVAYAANDALLNFGQADEKAKRDKYLSISQEQLQRLSGLVEQILTMSMEQRKTFRLRPEEITLATLLESLTEQHKLKAQNPIDIDYRVEPANLTVFADRTHFSNILSNLIDNAVKYSPGKAVIRIHCRETADNGKVEISVSDEGTGIAQEKQKHIFDKFYRVPTGNLHNVKGYGLGLYYVKTMIEKHGGTVCVKSEPGHGSTFTITL

SEQ ID NO: 8970 - protein, 135 aa, B.fragilis
YPGRERVHVWDFGRNHVYPGNGLLGISTETTNEYVEPLIQEVYKEIDKLQNDKVTPEELAMVRNYMLGEMCRNYESPFSLADAWMFILTSGLDDDYFARSLQAVKEVTPEEIRELAGRYLCKESLKEVIAGKKLT

SEQ ID NO: 8971 - protein, 107 aa, B.fragilis
KLPGSALCNFLKYTSMFSIISIMFLGIGIGYLLRNLKFLEKVEKSTSLTIFLLLFVLGLSIGSNSLIVNNLGKFGWQAIVLATSSILGSMLASFLVLRLFFKKGGKS

SEQ ID NO: 8972 - protein, 570 aa, B.fragilis
LLILQLHFKNLKTPDMKSDIEIARSVELKKIKQVAESIGIPRDEVENYGRYIAKIPEYLIDEEKVKKSNLILVTAITATKAGIGKTTVSIGLALGLNKIGKKAIVALREPSLGPCFGMKGGAAGGGYAQVLPMEKINLHFTGDFHAITSAHNMISALLDNYLYQNQSKGFGLKEILWRRVLDVNDRSLRNIVVGLGPKTNGITQESGFDITPASEIMAILCLSKDVDDLRRRIENILLGYTYDNKPFTVKDLGVAGAITVLLKDAIHPNLVQTTEGTAAFVHGGPFANIAHGCNSILATKMAMTFGDYVITEAGFGADLGAEKFYNIKCRKSGLQPRLTVIVATAQGLKMHGGVSLDRIKEPNLEGLREGLRNLDKHVRNLHSFGQTVIVAFNKFASDTDEEMELLREHCEQLGVGYAINNAFSEGGEGAVDLANLVVETIENKPSEPLQFTYNDEDSVQQKIEKVATNLYGASVVTYSTLTRNKIKLIEEMGIGHYPVCIAKTQYSFSADPKVYGAVDNFELHIKDIVINNGAEMIVAIAGEIMRMPGLPKEPQALHIDIVDGNIEGLS

SEQ ID NO: 8973 - protein, 1095 aa, B.fragilis
LKPILFMTKKSNLSLRFTRVWEKHCLKTAAATLLLCCALPVQAKADTYKTQETASIQQQTVKTTGVIIDNTGEPLIGVSVKVQGTNTGTITDLDGKFSIGTPPKALLEFSFIGYKTIIMEVTGKELHITMQEDSKQLDEVVVVGYGSQKKVNVTGSVSMVNADVLESRPVQNVSQALQGVIPGLNMSVGSSGGTLDGKLNVNIRGAGTISDGSSSSPLVLIDGIEGDMNTVNPNDIESVSVLKDAASSSIYGARAAFGVILITTKSGKSGKTRVNYSGNVRFSDAIQLPDMVDSYTFAQYFNRASTNGGESPTFDEKALQNILDFQNGKFTDPSTPEYYGVEAGPDGKWKSYAGSFANTDWFKEFYKSWTPSTEHNLSISGGTEKLTYMISGSFLNQNGLIRHGEDNFNRYTMNAKISAKPAEWVTLNYTSKWTREDYDRPTYMTGAFFHNIARRWPTCAPMDPNGHYMPNMEIIQLEEGGVQTSQRNWYTNQLQAIFEPVKDWRIVVEGSMRTYTRKQHWAVLPIYGYDVNNKPYLLSWNGGAAGYSEVQDEREDEDYFSGNIYSDYAKTIGNHYFKVMGGFNAELFRPSGMTGFGTDLISSNVPSLGLTQDNQKASAWARERAIAGFFGRVNYNYKERYMLEANLRYDGSSRFVGDKRWGLFPSFSAGWNIAREDFFRPLTGVIGTLKLRGSWGQLGNNNTDKANAWYPFYQNMITGSANSGWLIDSKKQNTAQLPGIVNSLMTWETIESWDIGLDFGLLDNRLTGSVGYYNRYTYDMIGPAPILPPVLGALPPQVNNCDMKSYGWELELSWRDRISEFDYSARFVLSDGKRKILRYPNPTNSLSSDVYYNGQILGDIWGYKTVGIAQTQEEMNAHLANGGTPNWGTNWGAGDVMYANLDGKEGVNNGSNTLEDHGDLTIIGNNTPRYNFGLTLTGAWKGFDFSVFLQGVMKRDYWLDGPYFWGANGGLWQSTAFKEHMDYWRPEGDPLGANTNAYYPKPYFNTDKNQKVQSGYLQNAAYCRLKNAQIGYTLPKIWTRKAAMESVRVYVSGDNLVTFSGISGVFDPELLGSDWGDGKLYPLQRTISIGLNVNF

SEQ ID NO: 8974 - protein, 74 aa, B.fragilis
LLTIIMVSFRVSPLDELVALGSENPITRAPSRLAAVSKLSRVRVEGSKNRVATTLPSNNRRLGFFSNCFAISSI

SEQ ID NO: 8975 - protein, 407 aa, B.fragilis
KVNIKICQKKVALVYKLYICQMKTTRYIYTALILAALSQGNAVAQNKGGFFSKVRDTFSTEIKIGNYTFKDGSVYTGEMKGRKPNGKGKTIFKNGDVYEGEYVKGKREGFGVYTFPDGERYEGQWYQDQQHGNGIYYFMNNNRYDGMWFQDYQHGPGTMYYHNGDIYVGDWVNDKREGKGTYTWRDGSKYVGDWKNDKKDGKGVLVWNDGCKYDGDWKNDVREGKGTFEYTNGEKYVGDWKDDLQHGKGIFFLGGDRYEGSYLQGERTGPGIYYHANGDKYVGNFKDGMQDGEGTFTWANGAVYEGEWKDNKRNGHGIYKWSNGDVYEGEWKNNQPNGKGTLTLTNGTKYKGGFVNGMQEGNGVEEDKNGNRYEGFFKQGKKNGPFVETDKNGKVIRKGTYKFGRLE

SEQ ID NO: 8976 - protein, 112 aa, B.fragilis
LRIMENQETKISNVTTSMKVEKEINGFKVSGTVEVYNDSKRIKRIDASVQKTDSKAMAPFKYSFTVTRGLNDMVNPSEENEPERDQALTAGIEFEKAVEQAVSGMIFNTIVE

SEQ ID NO: 8977 - protein, 154 aa, B.fragilis
DTQMKYLRYTCHGNLYADAECKKGNELVNDLIPYRPEFLNNSLPLGKKDIKYGCHTNYNKCDHKIIDSGLQQFTFDAGRSHQSKYNGYTARTDADGKRDGIKYLLFYILPFEAIHVPVRFFLIRRVRIAEQLHGRFTDKYPTAQLNDRDGQTEH

SEQ ID NO: 8978 - protein, 390 aa, B.fragilis
KTKMIIRIVQNIQRINKEGNAPLYISFYLGKEKVVIPCKLSVPTTKFDSKTGMLRGTNKEAKDINLIIERLKAKVNDILVKYRLKNLTLNKEAFMREYNNPSDFKSFHDFVASYMKTYSRRLEIGTFRHHKSCMRKFKEYCEGLQFHELTEDFLRDYLIYMKKTLCNADSTAQRNLSTIKIYVSAAIKKGYMENDPFKDFGVKRIKSNIDYLTEEELIKFISLYYDRRLPERLERTLGFFLFMCFTSLHISDARHVCLEQINNGILTYYRIKNRNCKPEAIKIPLSIPAFKIIEELQGKRKEGHLFTSLQCDQVVNRQIKEIASILEIKKKVSAKTGRHTFATIFLKKTKDVATLQKLLGHSNLKETMIYAHVLDESKQEGMQCFNCFAI

SEQ ID NO: 8979 - protein, 266 aa, B.fragilis
IHRMMNNRIYCTFILSIIAVMVCAQTEQPKDSIKRQRETVPEIRQELHINDRNIQTDGTLPDNTRQAAAGDSMTFRIPYPESIPSGWIVPQLGTYSTPFIWDYDRYYNFNLSPNSNLSTFSNYNTYLSIGTIVKAGAAYSFSPNDRWIFSGGVFVAKYTLPSLRIPTAPMAGSRFDAGIHGKITYRLTDHLYLNVFGQYSLNGQRNSKKGYMVPDLYMQNHFGGTVDYMFNGKFGITGGAIHEFNPVKGRWETNPVFGPVIHLKKK

SEQ ID NO: 8980 - protein, 585 aa, B.fragilis
YSMIMKTTKLQLSLLALFLGCASLQAQYKWADPLKQDFHTVRGQAWQDELKDSYARLPQRAEDKVRKPLWDLSRQSAGLSVAFRSNASEIKVRYVVKGGLSMPHMPATGVSGIDLYATDNNGQERWCAGNYSMGDTIVYNFRGLSYAAKSGNGFEYQLFLPLYNSVSWMEIGVPADASFRFLPVSQEKPLVIYGTSIAQGACASRPGMAWGNILNRKLGHPVINLGFSGNGKLEEALFDLLSEIDARLYIIDCMPNLAGKEASAVVYQRTLEGVKKLREKSRAPILLVEHDGYSNEFSSESAEESYRVANAELRKAYETLQKEQVPTVYYLTKEEIGMPMDAMVDGVHSTDLGMQQYADSYRKKIGEILHEESEGPTSCIPCKQQRDPYDWYGRHEEILKLNKQSAPEVVMIGNSITHFWGGEPIAHNQFGTESWDKLFKGKRVRNLGFGWDKTENVLWRIYHGELDGFQAQNIFLLIGTNNLLFNTDDEVIEGICRVVKAIRERQPRTKLCVMGILPRKEMETRIAQIDAALQERLNDKDCTFINLAPQLTHKDGTIDHSLFRDGLHPNAEGYKRIAKVLKGYL

SEQ ID NO: 8981 - protein, 79 aa, B.fragilis
RFYLFSLSFYLGGYTTFFSDNKYTFQTATICDFKNVFINKKCLLKQSLKKKALIMQRTVIKGIVRFDRRNKSYRLLVYR

SEQ ID NO: 8982 - protein, 106 aa, B.fragilis
TSGVPAWLVISCSGVLVAIVTAYCGPIMFIGLAVPHLCRAIFHTSDHRILMPATLLAGASLALVCNLVARMPGFEGALPVNSVTALVGAPVVASVLFRKRKSELSE

SEQ ID NO: 8983 - protein, 288 aa, B.fragilis
IKIVFNIINNYSMKKNKILIIIPSRFASTRLPEKPLVKIAGKEMVLRVAEIANYVCNKVEGCNYIVATDHEKIVNFCKENNIAVMMTSENCKSGTERCWDVTTKIAEKPDFIVNLQGDNPLCPPWFIEQLIEAWKNDKEGQVFTPSLHLSWEEYDRMKESKKITPYSGTTVEVDKFGYALAFSKAMIPVIRNEEKVRKILDKSPVRRHIGLYSYTYDALKKYFEVEASPYELPEGLEQMRFLHNRIPVKMIDVDYRNRKSMSGVDSPEDIERAEKIIAEFGEFNLSPE

SEQ ID NO: 8984 - protein, 704 aa, B.fragilis
MLTSNFTRQIMKIKLKHIYFCSLIGMGGLALTSCNDFLDRSPISDITPEDYFNTVDQVGSYVINYYDDYLENSNTTKMYHQRAWNSGVVRNDANTDNLLSDDGNLDYFAGNKQVPEGKNIQEPLNRIRVWNYLFEKVLPKEKEGTIPGDAELLKQYIGEAYFFRALAYYNALVRFGDYPIITEVLPDDSETLIKKSQRAPRNEVARFILKDLDEAVSRLKERGFQNNQRINKQAALVLKSRVALFEATFEKYHQGTGRVPGDPTWPGAAMSYNSGKTFDIAGEINFFLTEAMQAAVAVADHVQLAENSHVMNPPYNTLYGWNPYFEMFSQPDLSNVEEVLLWKQYNLSLTVSHCVGARLKNGDRTGLTRSLIKTFLMKDGLPIYASNSTIDDRTVSDEKKDRDERLQLFVWGEKDAWMTDERADTVKNYNKDQAGNSVTNPVPVPWVKSTVISDQEQTRDITGYRSRKFYPYDDEQSKSDELLGTNACPIFRASEAYLNYIEACYEKNGTLDSKAQEYWKAIRRRAGVDEDYQKTIARTDLGREDDLGVYSGDRMVDATLYNIRRERRCEFIAEGMRWDDLKRWRSWDRLFTEPYIVEGINFWDEAYKLYTTVDKDGNEKSAVVADGSTSANMSPKSDGKYVRPLRRTQTNNQLYDGYTWKKAYYLEPLGLQDLQLSATNPEDINTSMMYQNPYWPAGTGKALE

SEQ ID NO: 8985 - protein, 159 aa, B.fragilis
ITNFLKQQPMTLIKSISGIRGTIGGGAGEGLNPLDIVKFTSAYATLIRKTCKSKSNKIVVGRDARISGEMVKNVVVGTLMGMGWDVVDIDLASTPTTELAVTMERACGGIILTASHNPKQWNALKMVDEHGEFLNAAEGQEVLRIAAAEGVDYADVDHL

SEQ ID NO: 8986 - protein, 136 aa, B.fragilis
KIGYLVVLVQCFLKFTNIVEIGVYILVCTLMSHLRRYNIVAVRFVEHDIKANDTTCFNVVLPGFENYPNYYTYPDVFRYVDNGTSVAGVFTEGSMYAKYGTTDVPPGWLLALKYVTNYAHVRMIGLHHGAGRIRAN

SEQ ID NO: 8987 - protein, 76 aa, B.fragilis
STVIHITENVRISIVIRIIFETGKHHIEASGIVRLDVVLYKAYGYNIVPSKMGHQSANQYVNPYFYDIRKFQKALN

SEQ ID NO: 8988 - protein, 219 aa, B.fragilis
KMYSSTKTVSAFSVLLPDGRTKWRWDTGRSMGVEFMAQKTIGKTTGWLAYTLAKSDRKFATGGINNGERFPYKYDRRHNIDLTLNHRFNERIDVSASWIFTTGGTTTIPTELTGIIRPGDNDSSIEEGDYVKHRNNYRLPATHRLNVGVNFSKKTKHGMRIWNVSIYNVYNAMNPTLIYRTYKKTEYTQGEQAQGNRIPVIRKFTLLPCIPSFSYTYKF

SEQ ID NO: 8989 - protein, 360 aa, B.fragilis
VQRFIVFLPTQYLYKQVMLTKVIAQAHIDHFTKWFERADKIVIVSHVSPDGDAIGSSLGLYHFLDSQDKIVNVIVPNAFPDFLKWMPGSKDILLYDRYQEFADKLIMEADVICCLDFNALKRIDEMSDIVAASPGRKIMIDHHLYPEDFCRITISHAEISSTSELVFRLICRMGYFSDISKEGAECIYTGMMTDTGGFTYNSNNREIYFIISELLSKGIDKDDIYRKVYNTYSESRLRLMGYVLSNMKVYKDYKSALISLTKEEQGKFDYIKGDSEGFVNIPLSIKNVCFSCFLREDTEKKMIKISLRSVGKFPCNRLAAEFFNGGGHLNASGGEFYGTMEEAVKVFEQALEKYKPLLKE

SEQ ID NO: 8990 - protein, 78 aa, B.fragilis
RTLSDPYQRTSRTITKCAFKAYSLLFVDYTTVAEQNPERNENVISELDTATERVKTSTEALPYSSFHISLVIPIIRSI

SEQ ID NO: 8991 - protein, 154 aa, B.fragilis
RQFPFILFLCANNKSFAFKTLVICIQRTSFNTVLKQSLFLIGSLILQTKDFSWLVMLTVYGVDSVLTIIHRLLLHENIGLPHRKHLYQIMVNELRIPHVVVSLVYMIVQIVIIIGYLYCRGYGDWYLLGCILLLSGIYIVLMRKYFHLHLLPKR

SEQ ID NO: 8992 - protein, 374 aa, B.fragilis
ILLLYLHILNFKALFNMFNSFGNIFRLTSFGESHGKGIGGVIDGFPAGIVIDEEFVQQELNRRRPGQSVITTSRKEADKVEFLSGIFEGKSTGCPIGFIVWNENQHSNDYNNLEKVYRPSHADYTYTVKYGIRDHRGGGRSSARETISRVVGGALAKLALRQLGIHITAYTSQVGPIKLEGNYTDYDLDLIETNPVRCPDPEKAKEMQDLIYKIKGEGDTIGGVLTCVIKGCPIGLGQPVYGKLHAALGNAMLSINAAKAFEYGDGFKGLKQKGSEQNDVFYNNNGRIETRTNHSGGIQGGISNGQDIFFRVAFKPVATVLMEQETVNIDGIDTTLKARGRHDPCVLPRAVPIVEAMAAMTILDYYLLDRMTQL

SEQ ID NO: 8993 - protein, 370 aa, B.fragilis
NQVFFTLLSLFSVIFSIFVRPTTQTSGMGDDKNKRIDFVDLTKGVCIILVVMAHIGGAFEKLDYHSMIASFRMPLYFFISGIFFKSYEGLFGFFIRKINKLIIPFLFFYLSAFFLKYIVWKIAPGVFQLPVSWTELLVVFHDHALIKFNPPIWFLLALFNCNILFYLVHSLRNRRLGLMFALTLLIGTAGFYMGKHQIELPLYMDVAMSALPFYVAGFWIRRYNFFLFPHRFDKLIPLCILAALAVMYFTATFVGMRTNNYAGNIFQFWASAFAGIFMIMLFCKKFKKLPVISYMGRYSVITLGIHAPLLHFEYPVVSRFIHNEWGQAIALLLLTLTVCIIATPIFLKLIPQAVAQKDFIKTKQSTQQGS

SEQ ID NO: 8994 - protein, 158 aa, B.fragilis
RTRPGEKNFYRIIVEQRKYWKYYWEQNDQTCWSSAMQKSFKLQTNEDVVLTDGKPSTEEDDENGLFGTVNNKYAIFDDSRFTDGSYTMNVYNDIYGWGFWGQEYIWIKTDVSIPILSITEKEYYYFRSVNLVESDAYDNNLSEPIVFPNNWKRRYRNG

SEQ ID NO: 8995 - protein, 913 aa, B.fragilis
LMTPLKANTIISSILLLILLMLPYEAMAQRRRVRELKGPVVYSPPKNDSLRVDTLKNDTLKANVLKADTLSAESVKKKKQPLDAPVVYSANDSIVFTQGGFAHLYGDGKVNYENIELGAEIITMNMDSSTVYARGVIDSVGVEKGKPVFKDGETPYETKAIRYNFKSKKGFINNVVTQQGEGYVVGNNAKKGANDELFMENGRYTTCDHHDHPHFYMQLTKAKVRPKKNVVTGPAYLVVEDVPLPLAVPFFFFPFSSSYSSGFVMPSYMDDSSRGFGLTGGGYYFAVSDLMDLKLTADIFTKGSWAANMETNYNKRYKYSGSLQAGYQVTKLGDKGMPDYSVAKDFKIVWNHRQDQKASPNSTFSASVNFATSSYERTNINNLYNSQLMTQNTKTSSVSYSRSFPDQKLTLAGTFNIAQTMRDSSIAVTLPDLNITLSTIFPFKRKRAVGEERWYEKISLRYSGRLTNSLKTKDDRLFKAGFREWENAMQHNIPVQATFTLFKYLQVVPSFNYTERWYTRKVMKSYDETTQKWDTHPGDTIHGFYRVFNYSASLALSTKMYGMYQPLFMKKKEIQIRHVFTPQISLNGSPSFGQFWEYYRDADGNDQYYSPYSSQQFGTAPREKSGTVSFDVSNNLEMKYRNKKDSLVKVSLIDEIGFNLSYNMAAKKQPWSNLNMRLRMKFKKFNNYTLNMNAVFATYAYTFDKSGNVIVGDRTEWSYGRFGRFQGWGSSINYTFNNDTWKKLFGKDKDNDQKKKKDGVDEEKGNSTGDEAVTEKRVEKAQADRDGYQVFKMPWSLNVNYSFRISEDRSKPINRNTMRYPFKYTQNINMSGNLKISNNWSFTFNSGYDFEAKEITQTSCTITRDLHCFNMSASISPFGRYRYYNFTIRATASILRDLKWDKRSQTQSNIQWY

SEQ ID NO: 8996 - protein, 376 aa, B.fragilis
KYPTIMATKIKLNDCVPCIAIHPGEIIKDELDAREMKQKELASLMSMPTSVLNDIIKGRRAVTPEVAVLLQEILGIDASYWLSLQNQYDIDRANINKKIVERKKNIEIWKVISQYCSVKYFEKLNVIGTKISENIKIIYSIFGVTSVEELIASFSSEKELSYFKKSERLKSDPINIFSWKHFAFYQSSQMLDVADFDENSLERLVQELNQMFVVNINTIDKTKEILSRYGIKFIIVPKFDKTPIDGFSFWQGKNPTIVLTLRLNKIDNYAFALLHEIYHVYMHLFNNREQKYIAIEGAEINKCEEEANKFAKCSLIGKDLWNTFLKQHSMISPHAMQMKIKQFAHQHNINEAIVLGFYQHDINLYSIKSSISREIK

SEQ ID NO: 8997 - protein, 64 aa, B.fragilis
IHKTYKAEIPIFVIKKRLLSKSIITKKIFYFYLYFSGIFLSMMASNTRDNSLITKKHFCHLKIG

SEQ ID NO: 8998 - protein, 412 aa, B.fragilis
NPRTGFRKPEANCGRRKGLQVLKTSPRSNRLHIALFGKRNSGKSSLINALTNQNAALVSDIAGTTTDPVYQPMEIHGIGPCVFIDTAGFDDEGELGSLRIERTLQAADKADIALMVCCDTELSEEQRWIELLKERNIPYLLVLNKADLLEKPDEVADKLEQQTGQHPLIVSAKEKTGIDSIRQSILHRLPELNEQPDIVGDLANEGDVVLLVMPQDIQAPKGRLILPQVQTLRELLDKKCITLSCTTDQLDNALKVLSAPPSLIITDSQVFRTVYEKKPPQSRLTSFSVLFAHYKGDIDYYTEGAYIIDQLTENSRVLIAEACTHAPLSEDIGRVKLPRMLRKRIGEQLHIDIVSGNDFPKDLNCYDLIIHCGACMFNRKHVLNRIVKAKAQGVPMTNYGIVIAYINGIPFH

SEQ ID NO: 8999 - protein, 213 aa, B.fragilis
IYPTEAFAFYLGLLIGIRYKVVRSLKCLYVFGICILAMGSFHWVSRMMDRPVQSIVFYNVRGCPVVHCIEACGKSWLAYADSIPDERRLSRAVAGYWNRLHLDVPVTITDNFHSSGFWMQDHLLMFGNKRICMVSDNRWRNKTAAESFNIDYLYVCKGYTGKLESLVGLFHCREVILDSSLSAYYKEAYSEECRRLGLHFISLSDEGSVRFLL

SEQ ID NO: 9000 - protein, 122 aa, B.fragilis
FIYLIKTSMNQYETVFILTPVLSDVQMKEAVEKFKGILQAEGAEIINEENWGLKKLAYPIQKKSTGFYQLIEFNAEPTVIDKLELNFRRDERVIRFLTFRMDKYAAEYAAKRRSVKSNKKED

SEQ ID NO: 9001 - protein, 510 aa, B.fragilis
CTLAEYSYKPYLCNPNSKYSNMAFTNNVMIVRHKLLAKLVNLWKENKLTNEIDRLPIELSPRRSRPLGRCCIHKERAVYKYKLFPLLGFDMTDETDELTPLSEYARQALERKNKQKENILCVIDEACSSCVQVNYEVTNLCRGCVARSCYMNCPKDAIRFRKNGQAKIDHDACISCGKCHQSCPYHAIVFIPVPCEEACPVKAISKDENGIEHIDESKCIYCGKCLNACPFGAIFEISQAFDVLEGIRSGEKMIAIPAPSILGQFNTSIEAVYGALRQMGFADVVEVAQGAMDTVSHEAAELKEKLEEGQPFMTTSCCPSYIELVNKHIPGMKPYVSSTGSPMYYAARIAKERHPDAKIVFIGPCVAKRKEARRDECVDYILTFEEMASIFEGLDIQLEQTQPFSVLYTSVREAHGFAQAGGVMGAIKAYLGEEAKKFSAIQVSDLNKKNIGLLRAAAKTGKAQGQFIEVMACEGGCISGPSAHNDAIGGRRQLNQELIKRRESYEETHR

SEQ ID NO: 9002 - protein, 801 aa, B.fragilis
IGIAEKNYLCISTTHHKDKIMKKKVLSLLAFLPAFTTVMAQQTAEVPDVCAFVNPIIGTNGMGHTFPGACAPFGLVQLSPDTDTIPHNIDGTYQRNAYEYCAGYQYHDPTIVGFSHTHLSGTGHSDLGDILIMPATGQLKLNPGRAGTPDEGYRSRFSHDTEVARPGYYEVELADYGIKAQLTATQRVGIHKYTFPDNADGHIILDLIHGIYNYDGKTLWANLRVENDTLLTGYRITNGWARTNYTYFAISLSQPIKDYGYTDKGKALYKGFWRRFNTDRNFPEMTGRKLVAYFNFDTRQNPELVIKVALSAVSTEGAVKNLQAEAAGKTFNQLVAEANSAWNRELDVLEAKGTPDQLAMFYTSLYHTMINPSVYMDVDGRYRGLDHNIHTSEGFTNYTIFSLWDTYRAEHPFLNLLKPRQNTDMVQSMIRHQQQSVHGMLPVWSLMGNEGWCMSGYHAVSALADAVAKGADISVGEALMAMDHTANVPYYEGVEAYKRLGYVPFDQSGTAASTTLEYAYDDWTIYRTALLAGDDQLADLYKKRANNYRNVFDTSVGFARPRYSNGEFRKEFDAMQTYGEGFIEGNSWNFSFHVPHDVAGLIRLMGGEKKFVSRLDTLFSMALPRKYYEKNEDIAEVSLVRRYVHGNEPSHHIPYLYAWTSQPWKTQYWLRTVMNRMYKNDIDGLGGNDDCGQMSAWYLFTAMGFYPVCPGTDQYVLGAPYLPYIRMNLPNGRTFEIKAPKVSDRNCYVRQVKLNGKVYDKMYITHADLLAGGTLEFDMAASPNKKRGLAKEAKPYSMSEE

SEQ ID NO: 9003 - protein, 181 aa, B.fragilis
DMKAFFSFVAALVLSLSMAAQNKSFYDFTVKTIDGKEYPLSGLKGKKVLVVNVASKCGLTPQYAELQELYDQYKDQNFVIIGFPANNFMGQEPGTNEEIAKFCSVNYDVTFPIMAKISVKGKDMAPLYHWLTEKKLNGKQDAPVQWNFQKFMIDENGNWVGFVAPKESPFSETIISWIEKK

SEQ ID NO: 9004 - protein, 787 aa, B.fragilis
RKEALVRRLKNSKQFNKNMKKLILLLILIFSLPVAAQNFTIGKSTFLLNGKPFTVKAAELHYTRIPAPYWEHRIEMCKALGMNTICLYVFWNIHEQTEGQFDFTGQNDIAAFCRLAQKHGMYVIVRPGPYVCAEWEMGGLPWWLLKKKDIILRTLDPYFMERTAIFMKEVGKQLAPLQITRGGNIIMVQVENEYGAYAVDKPYVSAIRDIVKSAGFTEVPLFQCDWSSTFDRNGLDDLLWTINFGTGANIEQQFKRLKEARPETPLMCSEFWSGWFDHWGRKHETRPAKSMVQGIKDMLDRNISFSLYMAHGGTTFGHWGGANNPSYSAMCSSYDYDAPISEPGWTTDKYFQLRDLLRNYLPAGEQLPEIPEAFPVIEIPEVEFTQIAPLFSNLPEAKESMDIQPMEAFDQGWGTILYRTTLQEPVENGTTMKITEVHDWAQVFADGKLLARLDRRRGEFVLQLPALKKGTRIDILVEAMGRVNFDESIHDRKGITEKVELVRGKQSAELKNWTVYSFPVDYSFVQDKRYKNGTAQTMPAYYRTTFRLDKVGDTFLDMSTWGKGMVWVNGLVIGRFWEIGPQQTLFMPGCWLKEGENEIIVLDLKGPEKASIRGLKKPILDWLRNEGASTHRKEGEQLDLSRETPVAEGTFVPGNGWQEVCFDRQSIGRYFCLEALSAQKGKKIAAIAELDVLGADGKPISREKWRIRYADSEETRSGNCTGDKVFDLQESTYWMTVAKDAYPHQLVIDLGGDYTVTGFRYLPRAEKGYPGMIKDYRVYVKGEDFQY

SEQ ID NO: 9005 - protein, 359 aa, B.fragilis
QNHFNIKSMRRKIMMATLIVIAVNFIWSGQPVKACTRAVYIGPDNMVITGRTMDWKEDIQSNLYLFPRGIKRAGYNKGNTVEWISKYGSIVATGYDIGTCDGMNEKGLVASLLFLPESIYVRPNDTRPVMGISIWTQYVLDNFATVSEAVAELKKQTFRIDAPDMPNGSASTLHMAITDETGNSAVLEYIDGNLIIHEGKEYQVMTNSPRYDLQLAVNDYWKEVGGLNMLPGTNRSSDRFVRASFYIHAIPQTSDAKIAVPSVLSVMRNVSVPFGITTPDKPYISSTRWRSVSDQKNRVYYFESTLTPNLFWIDLHKVDFSPNASIKKLSLTHGEVYAGDVVKDFKDSRSFTFMFELPK

SEQ ID NO: 9006 - protein, 471 aa, B.fragilis
ITNFLKQQPMTLIKSISGIRGTIGGGAGEGLNPLDIVKFTSAYATLIRKTCKSKSNKIVVGRDARISGEMVKNVVVGTLMGMGWDVVDIDLASTPTTELAVTMEGACGGIILTASHNPKQWNALKLLNEHGEFLNAAEGQEVLRIAAAEEFDYADVDHLGSYRKDLTYNKKHIDSVLALDLVDVEAIKKADFTVAIDCVNSVGGIILPELLERLGVKHVEKLYCEPTGNFAHNPEPLEKNLGDIMNLMKGGKADVAFVVDPDVDRLAMICENGVMYGEEYTLVTVADYVLKHTPGNTVSNLSSTRALRDVTRKYGMEYNASAVGEVNVVTKMKATNAVIGGEGNGGVIYPASHYGRDALVGIALFLSHLAHEGKKVSELRATYPPYFIAKNRVDLTPEIDVDAILAKVKDIYKNEEINDIDGVKIDFADKWVHLRKSNTEPIIRIYSEASTMEAAEEIGQKIMNVINELAK

SEQ ID NO: 9007 - protein, 304 aa, B.fragilis
TDSYNRYRHWAGQSRQTLSPLVPTRNTNHRRQKLHRSYTPHPERPMKAIIIEDEKAAVRNLTSLLGEVCPQIEIVTELDSIADTIEWFTDHSMPDLVFMDIHLADGSAFEIFEHVHITCPIIFTTAYDEYALRAFKVNSIDYLLKPIGRQDIEQALEKLTLFSSGNSKPTGPETNELVNLMRMLKKQESYKTHFLIPIKGDKLLPVSVDMILLFYIRDCQVKAVLTDGTEYSFPQTLDELTECLDPTLFFRANRQYLLSREAIKDIDLWFNSRLSINLRHSVSGEKILVSKARVAEFKEWFSVK

SEQ ID NO: 9008 - protein, 85 aa, B.fragilis
RFSLLLPPKKLCRDTFHHGTQSNTEFFLLIINNLKLPLCYSVSSVVSFNTLNYFFSIQLIIVSEKGLSLGATKPTQFPFSSIINF

SEQ ID NO: 9009 - protein, 293 aa, B.fragilis
TMKYTDRELDRLLEKLIASTRSPRGKFSAAASYQILEKRLPRPALRLFSLRTLSAVAAIALLCFIGWNTYCYLKPAALQTISTLADTRTIKLPDGTEVTLNHFSSLTYPEKFKGEHREVNLKGEAYFEVTKNRKHSFIVQTESVNVEVLGTHFNVESYPDDPEVKTTLLEGSVAVSNKSNSVRIVLKPNESAIYNKEKKSMTLEVSDRVAEEIAWRNGELIFTNLPLQEIARQLSNTFGVDISITDTALQNYRITARFSSEEGLDQILDLLHTVGNFNYSYNNKEITITTKLN

SEQ ID NO: 9010 - protein, 369 aa, B.fragilis
RREYRNNPVYCLIFVPMKRIRAIYNDKYLLSTLIISLAVAVLIHFPESVSLFDGFESHTLFPGMKFADVANEILFTFLSLLILFAVNTRLFHFNQTSMKITWQKIILSFVLTWILSNFLGQCFVYLHKTFDIPAIDAMVHHYLHPLRDFIMSSLVTSSCYIIYLIRRQQQVIVENEQLKAENIRNQFEVLKNQLNPHMLFNSLNTLRSLVRENQDRAQDYIQELSRVLRYTLQGNESQCVTLREEMDFVSAYIFLLKMRFEDNLRFEINITHNSEEYLLPPMSIQMLIENAVKHNEISNRRPLTITIATDSEEGLLVSNPIQSKLTATTGTGIGLVNLDKRYRLLFRQEIQITEDRNFTVRIPLIRKDL

SEQ ID NO: 9011 - protein, 465 aa, B.fragilis
IDLYLCTLKIIGMTGQKTPTALGTEKIGKLLMQYAIPAIIAMTASSLYNMVDSIFIGHGVGPMAISGLALTFPLMNLAAAFGSLVGVGAATLVSVKLGQKDYDTAQRVLGNVLVLNIIIGLAFTILTLIFLDPILYFFGGSDETVGYARDYMKVILYGNVITHLYLGLNAVLRSAGHPQKAMYATIATVVINTILDPLFIYGFGWGIQGAAIATILAQVISLMWQFRLFSNKEELLHFHRGIFRLKRKIVFDSLAIGMAPFLMNLASCFIVILINQGLKKYGGDLAIGAFGIVNRLVFLFVMIVMGLNQGMQPIAGYNFGARLYPRVTRVLKLTIYGATIVTTTGFLMGMLIPGLAVSIFTSHEELIRQSAEGLRIVVLFFPIVGFQMVTSNFFQSIGMASKAIFLSITRQVLILIPCLLILPRYFGQTGVWVSMPVSDLIASLISAGMLWWQFRLFRIHGRQAA

SEQ ID NO: 9012 - protein, 118 aa, B.fragilis
NPYLCRKITNCMNIYTEDEALIELLEEGCTNDKRYKRLPKDVIKGYIKAYNHLKAATRIEDLFRIGSLHYERLKGDLKDFESVRCTGRWRLIFQSSTIDGSLIITEIELIEISNHYGD

SEQ ID NO: 9013 - protein, 532 aa, B.fragilis
PGCQFFSDLFSATAQLTADIDDIITIHSTFVYWFNSKHTHYFRKKKINNVPIYRVPHFLSIGNFYPFSESYLCSRKKINIVFMKDSIDFGNMEIPRLFRKLLIPTVLGMVFSAVFVITDGIFVGKGIGSDALAAVNITAPLFMITTGIGLMFGVGASVVASIHLSQGKRKVASINITQALAFSALLILVLSALCCYFAEPIGRLLGSSERLLPLVVEYMNWYVPFLVFYLLLSAGMFYIRLDGSPNYAMMCNAVSAIINIILDYVFIFQLGWGMMGAAFATSLGTMVGGLMTLIYLLRFSRNVGIYRIKLSRKSMRLTCRNIGYMIRLGSSAFISEASIASMMFLGNYVFISHLGESGVAAFSIVCYFFPIIFMVYNAIAQSAQPIISYNFGQQNPGRVARTIRLALKTALGCGIFFFAATLVFNHQIVGLFIDKSYQAYDIAVNGIPYFAVGYLFFALNIVGIGYYQSIERARRATVITLFRGTLFMLAGFLLLPPVLGVRGIWLAVPLGELLTLLLIIGIYLKDSFAVRR

SEQ ID NO: 9014 - protein, 169 aa, B.fragilis
PFIQSTMGLIYLVRKKKFRTAEGIRELYFAIQRKLQKRGGKNEEDLAEILSANSSRSKGEVLSILTDLPDVIEEILKNGESVSIRGLGSFHASITSNGFEHPEDVLPHEVRVSKVYFIADRKFTQRVSRMKFFRYPLSKYFPKDLLRPETIREEETREEEPEFIPDDDE

SEQ ID NO: 9015 - protein, 145 aa, B.fragilis
ISRQLTFVPTFKHLKTMFKAIVRFSIKKKLFVGLTTLFLLIGGIYAMLTLPIDAVPDITNNQVQIVTVSPTLAPQEVEQLITMPIEIAMSNIMNVEDIRFVSRFRLSVVTVVFKESVPTLDARQLINEQIQSVAGENPPELGMPK

SEQ ID NO: 9016 - protein, 240 aa, B.fragilis
EMRHSVYWYIIYFLLSEIMCMFAIEPIYKSTMNGNYVINIGRQLGSGGKEIGEKLAARLGIDFYDKELINLASEESGLCREFFEKADEKASQGIIGGLFGMRFPFISDGAMPCTNCLSNDALFKIQSDVIRHLAANKSCVFVGRCADYILREHPRCANIFISASQEDRIARLCRIHGISEEAAAEKMNKADKKRSEYYNYYSYKTWGAAATYHLCIDSSVLGIDETVRFIEEFVVKKLAL

SEQ ID NO: 9017 - protein, 779 aa, B.fragilis
YHIKNNPIFIPMTKPSYKQWIAACTLTSTLLLGACGSAPVTRDASIVPLPNQIQQSGNAFVLTPNTTIGTTDPELQPAAQYLKEILSAATGYDLQVKEGKGTITLAKANIEGKEGAYTLSAKSDRIDITGNSYGGVIAGIESLRQLFPPQIESKQIVDSVAWAIPTAEIQDAPRFEWRGIMLDVSRHFYTKEEVKELLDLMALYKMNKFHWHLTDDQGWRIEIKKYPLLTEKGAWRTFNSHDRSCMKSAKSEDNPDFLIPENKLRIIEGDTLYGGYYTQEDIKEVIEYAKVRGIDIIPEIDMPGHMLAAVSNYSGVACTDKVGWGTTFSSPVCPGKESAMEFCKNVYSELIDLFPYKYVHIGGDEVEKANWKKCPDCQKRMRDNHLKTEEELQSWFIHDMEKFFNAKGKEMIGWDEIIEGGLSPTATVMWWRSWAKDAPAKTTQQGNSIIFTPNGQFYLDYQEDKNSVRNIYNFNPAIEGLTSEQQALVKGVQGNIWCEWIPSRERMQYMAVPRLLAIAELGWSQPSQKNWNDFAQRMANQFERLNIMGINYRIPDLEGFHRNNAFIGEGTVKVTCLDPNAEIHYTTDGSTPTLQSPKYEGPIQVKETTDFTFRTFRPNGKAGDISRTRFIKSEYAPATTVTPSAKGLQAEWYEFKGNKCADITKAPLNGTYPIEKVMIPEKAKGNIGLVIKGFINVPKDDIYTFALLSDDGSTLVIDGEQVIDNDGPHGPREVIGQKALSKGYHPIEVRYFDQNGGQLKMTVTGTEGNEIPTSDLYAN

SEQ ID NO: 9018 - protein, 580 aa, B.fragilis
LTPKGFLIRKFIPTFAQIFKKRAMIKENFIKLYENSFRENWDLPCYTNYGEPESYTYGEVAEEIAKLHLLFKHCSLRRGDKIAVIGKNNARWCIAYMATITYGAIIVPILQDFNPNDVHHIVNHSESVFLFTSDTIWENLEEERLTGIRAVFSLTDFRCLHQRDGETVQKFLKHIDQYMTDTYPKGFRKEDVLYTTLSNDKVMLLNYTSGTTGFSKGVMLTGNNLAGNVTFGIRTELLKKGDKVLSFLPLAHAYGCAFDFLTATAVGTHVTLLGKVPSPKIIMKAFEEVKPNLIITVPLVIEKIYKNVIQPIISKKGMKWALSIPLLDNQIYGQIRKKLIDALGGRFKEIIIGGAAMNPEVEEFFHKIKFPFTIGYGMTECGPLISYAPWDKFVPSSSGKILDIMEARIYKENPEAETGEIQVRGENVMTGYYKNPEATQEVFTKDGWLRTGDLGTMDDEGNIFIRGRLKTMILSSSGQNIFPEEIEAKLNNLPFILESLVIERNKKLVALVYADYEALDSLGLNHEDNLKTIMDENLKNLNNNVAAYEKVSQIQLYPTEFEKTPKRSIKRYLYNSIAED

SEQ ID NO: 9019 - protein, 69 aa, B.fragilis
LEYNNLLKYTHMKGLLKNLGLLLILVGVIILIACSLTGEVNNNAVLGGSIVLVVLGLITYIAINKRIAD

SEQ ID NO: 9020 - protein, 477 aa, B.fragilis
NTNKMKKLLLILLLVLAGEISAQQAATIVVKTTPDNEIAYWPTGKEHLFCIALGTKAQAGPLGEFVHQFRTDRPGMVQVWTQGSDSFTLYLTPGSKDTITVTKDTLIISGTNSAYNRCLKTVNDYQKYSDKLVYMQPHELRGITSLEQYHRLADARMRQALDAVNTSGLNEEFLAEQRAHIDYIRRSIFIHIARQLSRKEKLPEDWQRELTEVINSSVNGDYLRSYRGIGFFVNDLVMMQFTNLENGDLKEIKDYASFLFDRYRKFFTGDNLQYMQAQLIYEDEFQGSKTPSIPQLYETYRAEFPNSPFLNVLEPGVKENLRFQNSRITDKDYHILTCDSTITSLEDAVKPFKGKVVYIDVWATWCGPCLKEFQYLPALKEKAHNMDVVYLYISIDRPEERKKWEKTIAYHQLKGYHLLVNEKLGKSLYTELGNERQILSIPCFVIIDKTGKIVIRHAAAPSEPEKVIEQLSTYYNK

SEQ ID NO: 9021 - protein, 423 aa, B.fragilis
KSNKKNPFTLSRFRNSVCLFMKRRKMEKNHYIHYTAADLLNDGTFLDSMQHPTEQSEKFWSQLEKENETFAGELRMARSFLMAVAESPQKRMTDDEVGTLWERISRQVAMEKRVKRKKQLLFLRVAGIAACISVLALSSYFVFSLISFYEESSCYSLAGISEPDSSNDIQLILSEGRKLVMDGKESRLHYKEGGKIAISSGKTQLDEENETGYNQLIVPSGKRSFITFSDGTRVAVNANTRIVYPSEFSGHKREIYVNGEVYLQVSPDKKHPFVVKTNRMEVEVLGTEFNVSAYDFTKNQSVVLVSGKVEVDTYKYPKKVLKPNDMLTYDGQDDGLRVNTVDVSEYISWVDGYYCFNHEKIEIITEKLSRYYGKRVIPDSGLIGLTCSGKLDLRDDLRDVLEVLSKTIPAQIETRDNYFLLTK

SEQ ID NO: 9022 - protein, 743 aa, B.fragilis
SETNVVVMKKRICFVLILCISLFVFSPVHAQQRKSVAVVLSGGGAKGVAHIGALKVIEEAGIPIDYIVGTSMGSIIGGLYSIGYTPHQLDSMVNHQNWPLLLSDRISWEDQTMTERQNSETYVLSVPLKKNLKANVFGGVIKGQNLANLFSELTVGYHDSINFNKLPIPFACVSENIVNGDEVVFHNGVLATAMRASMAIPGVFTPVRLGDKILVDGGMKNNFPTNIARTMGADVIIGVDVQNDLRTADELNNLSEIFNQIINLTGQTRYEENIKLATVYIKVDVKGYSAASFNIPALDTLVNRGEEAAREQWTALQKLKKGIGLPENYVAPRHGPFSSLWSSKDIFVKEITFDGIEDSDKKWIMHRCHLKENSKMRMEQLYEALTTLRGSQAYSNVSYKLTDTPQGYQLHFILEEKYERNLNLGIRFDSEEIASLLLNVRSRLDTRVPSWVSVTGRLGKRYLARVEYTLAPMQMRNFNFAYQFEYNDINIYDHGRRSYNTTYKYHSGEFGFSDVWFRNLRFGAGLNFEFFKYKDFLYNTGGQRLEVKPQHFFSYFAQLHYNTYNKGYFPSKGTDVQGRYSLYTDNLTHYKGHAPFSALAASWAGVFSLTDRFALIPSLYGRVLIGKNIPYPYLNAMGGENFGHYLPQQLPFAGITNLEIVDNSVLVTSLKLRQRIGSKNYVTFTGNVAFRNDNFFDIWGAKPVWGGSVGYGYDSLFGPLEASLGYSSRSHKVGFYVNLGYVF

SEQ ID NO: 9023 - protein, 196 aa, B.fragilis
KPCNMYNDELIESSKIKWQSFLKGDDDAYAWLYSRYVQQLYQYGCRFTTDTEMVKDCVQDVFVNVYRQKDRYSSPPDNVKIYLMSSLRNSIFNVFNKGNLHDTYISNINYEFDLSVEEKLIETEDETSQKHTVAHLLNTLSPRQREIIYYRFFEGLDYSAICELMGLNYQSAYNLLQRSLSRLREMYGILPFFFLF

SEQ ID NO: 9024 - protein, 437 aa, B.fragilis
KTQNLTLNSEFSTNFCYICTLFYMELRRPHILYILICLWLLVSPSNVSSVWAKDFVVVIDAGHGGHDPGAIGKISKEKNINLKVALKLGNLIKQNCNDVKVVYTRSKDVFIPLDRRAEIANNAKADLFISIHTNALANNRTAKGASTWTLGLAKSDANLEVAKRENSVILYEDDYKTRYAGFNPNSAESYIIFEFMQDKYMEQSVHLASLVQKQFRHHCKRVDRGVHQAGFLVLKASAMPSILVELGFISTPEEERYLNTEEGSSTLAKGIYRAFLSYKREHEIRLTGSSRTALPNDDEVTDTEVAQIDSTESENKKPQNTPRTDKLVTEAKTQRPIVVESTTNDSEITFKIQILTSSRPLSKNDKRLKGLKDVDYYKENGLYKYTYGASSDYNKVLRTRRNTVTPLFKDAFIIAFRNGEKMNINEAIANFKKRRNK

SEQ ID NO: 9025 - protein, 98 aa, B.fragilis
IKQKGGLIMAQQVQSEIRYLTPPSVDVKKKKYCRFKKSGIKYIDYKDPEFLKKFLNEQGKILPRRITGTSLKFQRRIAQAVKRARHLALLPFVTDMMK

SEQ ID NO: 9026 - protein, 447 aa, B.fragilis
INKKDVLMNRFNYIGMLAYVALSMSSCDDSFDVSSKADGVLAVSQEGFNTLQSYNVGEKYTADLWIQQGGLKSTASVVSFSVDKALLDSMNIADGTSYELLPADCYQLTKSSVDIPANERLLKGELTYDPAKIQELSGYDHLKYVLPLRATSSGMPFVSGRSVVLLGFKVSEPIVTIMNAGVEEINLAEVKELPVQIGVPFTNKWEISCRLESRQSVIDAYNTAHGTYFSMLPSDAYAAPETPILHSGVNQVTATYKLKDDVLPGNYMLPVQIAEVTSDATIRADKDVYAAYSIIKEGDKLSKTDWKIVSFTTEEASGEGSNNGHAKHLIDGNVETFWHSRWQGGSDPLPYEIIIDMNHRVKIAQIELLPRGRGSNNPIKVIRFEASEDGTNWESIGQFGFTNQDAALKYYVKSSTARYIKLVIPDGVGNGTVAAIRELDVRGTVVN

SEQ ID NO: 9027 - protein, 458 aa, B.fragilis
QLLNVNEIQKYIAENESTMMEDLFSLIRIPSISALPEHHDDMLACAQRWTQLLLKAGADEAIVMPSKGNPIVFGQKIVDPNAKTVLIYAHYDVMPAEPLDLWKSQPFEPEIRDGHIWARGADDDKGQAFIQVKAFEYLVKYNLLENNVKFIFEGEEEIGSPSLEAFCEEHKELLKADVILVSDTSMLGADLPSLTTGLRGLAYWEIEITGPNRDLHSGHFGGAVANPINVLCGMLSKVIDTDGRITIPGFYDAVEEVPQAEREMIAHIPFNEEKYKEAIGVKELFGEKGYSTLERNSCRPSFDICGIWGGYTGEGSKTVLPSKAYAKVSCRLVPHQDHHVISKLFADYIRQIAPATVEVKVTAMHGGQGYVCPISLPAYQAAEKGFEIAFGKKPLAVRRGGSIPIISTFEQVLGIKTVLMGFGLESDAIHSPNENFSLDIFRKGIEAVVEFHLIYGKK

SEQ ID NO: 9028 - protein, 299 aa, B.fragilis
QNMKLITKEVRIGIAGVAALCLLVFGINYLKGINMFKPASYFYVKFHNVNGLAQSSPVFADGVRVGIVRDIAYDYNQPENVIVEVEVDTDLRIPKGSSAELVPELMGGVRMNILLANNPRERYTVGDTIPGTLNNGMMEKVAAMMPAVEKMLPKLDSILTSLNTIMADQSIPATLHSIEKTTANLEVTSRQLKVLMNNDIPQLTGKLNTIGDNFVVISGNLKEIDYAATFKKIDTTLSNVKMLTEKLNSKDNTVGLLLNDPQLYNNLNQTTINAANLLEDLKEHPKRYVHFSLFGKKDK

SEQ ID NO: 9029 - protein, 297 aa, B.fragilis
KKMKKIFYPVLLLVLAACKNPEQTSETIVPAPAIADIPTDTVTTQVDGITSATSKPNQVSFNGTIVLPPQRQATVALTMGGVVKHTSLLPGQQVRQGALLATLENPDFIALQQTYLDSHAQAEYLQAEYERQKTLSTEQAASQKKFQQSKADYLSMKSKLEATAAQLTLLGIVPEELLKSGIQPLLQVKAPISGYISDVAMNIGKYIQPGEALCEVIDKSAPLLCLTTYEKDLADMKVGSPVQFRVNGMGKTVFKATLVSIGQKVDEVSRSLEVYARIDDVNQQFRPGMYVTARIQK

SEQ ID NO: 9030 - protein, 400 aa, B.fragilis
NMMNTKSFFMVAIGVFVLASCNLNQVDQTGLLTASVRDALNSPATLSIADEIESVEYIPLEMTNDDASLIDGVVDFAITSKYIYVLVGKEARIVLFDRQGHFLRTFLRQGQGPDDFNGMIGFIQADEADNRFYVIGNKVGIYTLEGTFVEDLPVNSPIIYAHHLGNKRIGAIAMPLMPFQNGSFGIGVFQEDGEAIITKNDFYSPLVPREDSGFTFGVMGSPSDGKQASVLFKTASNDTIYRLSADTIQPVLVAGLSNSDEEVIRGLNIRDIKRFPANGDIFVSDIFETPRRFYLRMMLNEKYYVASVDKHSGETVVEQCDIPETSAYNLADINMQLGMVGSKGHNRFPVWGRVLGNNLVQVVTPYEIETFKEQTQITVPQELQKRNANENPIFIIYKIK

SEQ ID NO: 9031 - protein, 350 aa, B.fragilis
NAVNHMKKLIDKLREERTLTSEEFAHLLSHYDDEALAYINQQAREVATAHFGQGVYIRGLIEISNYCRNNCNYCGIRKDNWRADRYRLSKEMIWDCCEHGYKLGFRSFVLQGGEDPKRSDNDMEEIIAEIRRRYPECAITLSIGEKPAKAYERYFMKGADRYLLRHETFNRGHYYCLHPYEMSNERRIKCLQELKRIGFQTGTGIMVGTPRQRVEFLIEDIRFIENFQPEMIGIGPFIPHQRTPFCDEKAGSVELTLLLLSIFRLMHPKALIPSTTALASLAPDGRIRGILAGANVVMPNLSPIIVRNKYNLYDQKVAFGAEAAEGLALLEKQLTAVGYHIDYSRGDYNN

SEQ ID NO: 9032 - protein, 63 aa, B.fragilis
LIPKTSKHKAATPAIPILTSFVMSFMFCYLVFLFISSFLKIGYSLVDIHLFSVAECNDEGILK

SEQ ID NO: 9033 - protein, 349 aa, B.fragilis
NAPKRKMNKISVVILNWNGCEMLRSFLPSVLRYSEAEGVEVCVADNGSTDQSVEMLRREFPSVRRILLDGNHGFADGYNLALRQVEAEYVVLLNSDVEVTGHWLQPMAAYLDAHPEVAACQPKIRSWRQKEWFEYAGAAGGFIDRYGYPFCRGRVMGVVEADRGQYDTVLPIFWATGAAMFIRLADYREAGGLDGRFFAHMEEIDLCWRLRARGRGIVCIPQSVVYHVGGATLKKENPHKTFLNFRNNLVMLYKNLPDRELAGVMRVRCWLDYIAAATFALKGQLPNAKAVVRARREFKLLRDSFRDARAENLRKTSSHFIPERIKSSILVQFYVKGRKFFSQLSDLKG

SEQ ID NO: 9034 - protein, 76 aa, B.fragilis
KAKKMKKLVLMFVAIAAVSFASCGNKAADAEKATADSIRIADSIAAVEAAAAEAAAQAADTIAADTTVVTETVVAE

SEQ ID NO: 9035 - protein, 146 aa, B.fragilis
LMKKLLRPTTFALLTMALCFTACENGNNSYPKEYLGFEKKAQDFSYQKNAEETELQVKIVAADKTSEDRIVFIESPARPTKPGSSSAPFYKIKDNKITIKGGSKSAKATILVYPRKVGTNEYIQLICRPQNGKSETTKMSIRLVKK

SEQ ID NO: 9036 - protein, 82 aa, B.fragilis
WGNLYRTKRLTWIHKVITLLIWLLLFLLGIDVEGIEAIVKGLHAIGLEALIITAAAVTGSTLAAWGLWYLLHTRYQKKEAKP

SEQ ID NO: 9037 - protein, 237 aa, B.fragilis
KMIDMDEKLRILLCEDDENLGMLLREYLQAKGYSAELYPDGEAGFKAFLKNKYDLCVFDVMMPKKDGFTLAQEVRAANAEIPIIFLTAKTLKEDILEGFKIGADDYITKPFSMEELTFRIEAILRRVRGKKNKESNVYKIGKFTFDTQKQILAIGDKQTKLTTKESELLGLLCAHANEILQRDFALKTIWIDDNYFNARSMDVYITKLRKHLKDDDSIEIINIHGKGYKLITPEPES

SEQ ID NO: 9038 - protein, 449 aa, B.fragilis
LCAEYAFLQIMIDTTVFQDKTAVYYTLGCKLNFSETSTIGKILREAGVRTARKGEKADLCIVNTCSVTEMADKKCRQAIHRLVKQHPGAFVVVTGCYAQLKPGDVAKIEGVDVVLGAEQKKDLLQYLGDLHKHEGGEAYTTATKDIRSFAPSCSRGDRTRFFLKVQDGCDYFCSYCTIPFARGRSRNGTIASLVEQARQAAAEGGKEIVLTGVNIGDFGKSTGETFFDLVKALDRVEGIERYRISSIEPNLLTDEIIEYVSRSRSFMPHFHIPLQSGSDEVLQLMRRRYGTELFASKIAKIKEVMPDAFIGVDVIVGTRGETAGYFEKAYEFIHGLDVTQLHVFSYSERPGTQALKIDHVVTPEEKHQRSQRLLALSDEKTKAFYARHIGQTMPVLMEKPKAGAPMHGFTANYIRVEVESDAALDNKVVNVLLGDFNEEGTALKGTITQ

SEQ ID NO: 9039 - protein, 81 aa, B.fragilis
TGGDRGGRIGEEKKEKEIRAYSVTKYISLQSIQRARSFNYVESLYNNFVLSVYFVARLLCDVSVPAAVFPPIFVNSRFMYC

SEQ ID NO: 9040 - protein, 311 aa, B.fragilis
NLNDITMLKFLKNWTLPIAMLVGAVGYPVFISFSFLTPILIFTMLLLTFCKVSPRDLKPKPLHLWLLLIQIFGSLIVYLLLYRFNKIVAEGAMVCVICPTATAAAVITSKLGGSAASLTTYTLIANIGAAIAVPILFPLIEANPGISFIDAFLVILSKVFPLLICPFLAAWFLQRFIPKVHKVLLGYHELAFYLWGISLAIVTAQTLYSLINDPADGLTEIMIAVVALIACCLQFFLGKTLGSIYNDRISGGQALGQKNTILAIWMAHTYLNPLSAVGPGSYVLWQNIINSWQLWKKRKKESEKCSNNVSG

SEQ ID NO: 9041 - protein, 159 aa, B.fragilis
SDGLRMLSFRARPEGWPEKRLHLPTDFSPVSQIYGICVQMDGLGAESDEFAFVLSLSRCFCYILSVCFCGATGEKKAPVRGSAHNNICEEAKHIDILPERSKHFPEMLTSFAQNVCFFLGKCTVFNPKYPLLWLEKPPSCTEKSAAAFYFILSGRRRSQ

SEQ ID NO: 9042 - protein, 633 aa, B.fragilis
TMADSKEKLFSDFSPVSTEKWMEKVTADLKGADFEKKLVWKTNEGFKVKPFYRMEDLEGLKTTDALPGEFPYLRGTKKNSNEWLVRQEIKVESPKEANAKALDILNKGIDSLSFHVKAKELNAEYIETLLNDICAECVELNFSTCQGHVVELADLLVAYFQKKDYDLTKLQGSINYDFFNKMLAKGKEKGNMVQTAKALIEATAQLPKYRVLNVNALTLNNAGAYISQELGYALAWGNEYMNQLTEAEIPAAIVAKKIKFNFGISSNYFLEIAKFRAARMLWANIVASYNPECLRDCENKGPNGECRCAAKMKVHAETSTFNLTLFDAHVNLLRTQTEAMSAALGGVDSMTVVPFDKTYETPDEFSERLARNQQLLLKEESHFDKVIDPAAGSYYIENLTVSIAKQAWEIFLAVEEEGGFYAALKAGTVQAAVNESNKARHKAVAQRREVLLGTNQFPNFNEKAGDKKPVEATCCCGGHDTCEKDVATLNFDRAASQFEALRLETEASGKRPKAFMLTIGNLAMRQARAQYSCNFLACAGYEVIDNLGFETVEAGVEAAMAAKADIVVLCSSDDEYAEYAIPAFRALNGRAMFIIAGNPECAEELKAAGIENFIHVRVNVLETLKEFNAKLLK

SEQ ID NO: 9043 - protein, 476 aa, B.fragilis
STKDMYKVDSPDAVDFINHQEIIETLEYARAHRNDRELIRNLIEKARLCKGLTHREAAILLECAEEDLTKEIFHLAKEIKQKFYGNRIVMFAPLYLSNYCVNGCVYCPYHLKNKTIIRKKLTQEEICREVIALQDMGHKRLALEAGEDPVRNSIDYILESIRTIYSIHHKNGAIRRVNVNIAATTVENYRKLKDAGIGTYILFQETYHKENYEQLHPTGPKSNYAYHTEAMDRAMQGGIDDVGMGVLFGLNTYRYDFVGLLMHAEHLEAVYGVGPHTISVPRICSADDINAEDFENAISDEIFQKIVAVIRISVPYTGMIISTRESQKTREKVLDLGISQISGGSRTSVGGYAEAETPEENSAQFDVSDTRTLDEVVNWLLKLGYIPSFCTACYRAGRTGDQFMSLVKSGQIANCCSPNALITLQEYLEDYASEETKARGVAMIKQEMQHIPNPKIRERALENLKQIAAGERDFRF

SEQ ID NO: 9044 - protein, 449 aa, B.fragilis
IKKDMISLNIEKTFGFISKESVSAYEAQVKAAQEALENGTGKGNDFLGWLHLPSSISKEHLADLKATAQVLRDNCEVVIVAGIGGSYLGARAVIEALSNSFTWLQEKKTAPVMIYAGHNIGEDYLYELTEFLKDKKFGVINISKSGTTTETALAFRLLKKQCEDQRGKEMAKKVIVAVTDAKKGAARVTADKEGYKSFIIPDNVGGRFSVLTPVGLLPIAVAGFDIEQLVNGAADMEKACGADVPFAENPAAIYAATRNELYKNGKKIEILVNFCPKLHYVSEWWKQLYGESEGKDNKGIFPAAVDFSTDLHSMGQWIQEGERTIFETVISVDKVNHKLEVPSDEANLDGLNFLAGKRVDEVNKMAELGTQLAHVDGGVPNMRIVIPELSEFSIGQLLYFFEKACGISGYLLGVNPFNQPGVEAYKKNMFALLNKPGYEEESKAIQARL

SEQ ID NO: 9045 - protein, 60 aa, B.fragilis
TGSETIEMRTRQLIDTDMPMCMNDTENLTAVQTDMLRVVANGEYRFNSIPVVRKYELGSA

SEQ ID NO: 9046 - protein, 442 aa, B.fragilis
GSALYHLFSLFCLQFTIYNLQIKANITTFVVAKKEMMKENPKHIRISEYNYPLPDERIAKFPLPVRDQSKLLIYRHGEVSEDVFTSLPEYLPAGSLMIFNNTKVIQARLHFRKETGALIEVFCLEPIQPNDYVLNFQQTEHAAWLCMVGNLKKWKDGPLCREMTVKGFPITLTATRGECRGTSHWIDFRWDNPEVTFADILEVFGELPIPPYLNRDTEESDKETYQTVYSKIKGSVAAPTAGLHFTPRVLDALTEKGIDLEELTLHVGAGTFKPVKSEEIEGHEMHTEYISVSRSIIKKLIDHDACAIAVGTTSVRTLESLYHIGVTLANNPEATEEQLHVKQWQPYETECDVRPVVALQKILGYLDRHGMEALHTSTQIIIAPGYDYKIVKAMVTNFHQPQSTLLLLVSAFVKGNWHTIYDYALGHDFRFLSYGDSSLLIP

SEQ ID NO: 9047 - protein, 81 aa, B.fragilis
YRACSLEIPMKIYKAAAQADKHIAAALPVKNGRVELIIILRSKVLPLNIIDTEVFRKYPPLNKTNTLWFCYLNADNKTILI

SEQ ID NO: 9048 - protein, 591 aa, B.fragilis
EKFRIFASKIELISNEMNILELSEQEIIRRNSLNELRAMGIEPYPAAEYVTNAFSTDIKAEFKDDETPRQVSVAGRMMSRRIMGKASFIELQDSKGRIQVYITRDDICPGEDKEMYNTVFKRLLDLGDFIGIEGFVFRTQMGEISIHAQKLTVLAKSIKPLPIVKYKDGVTYDSFEDPELRYRQRYVDLAVNEGVKDIFIKRSKVYSSMREYFNSKGYMEVETPILQAIAGGAAARPFMTHHNALDIPLYMRIASELYLKRLIVGGFEGVYEIGKNFRNEGMDRTHNPEFTCMEIYVAYKDYNWMMEFTEKMIEKICLDVNGTTEVKVGDNIINFKAPYKRVTMLGAIKEHTGYDLTGMNEEQIREVCKKLNMEIDDTMGKGKLIDEIFGEFCEGTYIQPTFITDYPIEMSPLTKKHRDNPELTERFELMVNGKELCNAYSELNDPIDQLERFEDQMKLSEKGDDEAMIIDKDFVRALEYGMPPTSGMGIGMDRLTMLMTGQSTIQEVLFFPQMRPEKVVPKDSASKFMELGIAEEWVPVIQKAGYNQVADMKEVNPQKFHQDICGINKKYKLELTNPSVNDVAEWIQKIK

SEQ ID NO: 9049 - protein, 110 aa, B.fragilis
HRIRQIELNLLLINDIYLCKSVYSVVNTSLGTPSDTRIIIQFRSITQKIDIMIKLKLSILVWAIGLSMTAFSQTTSSLRAKVLTLNDYPDALRLWELYNDSASVEQKNPS

SEQ ID NO: 9050 - protein, 183 aa, B.fragilis
RVHRGHTKPSEVLVHAGHEPFKMARKEAGIDRTPDNTVNKYQFSAPFQWNFLSTLHVNLKFLSAEFIHIGHGHSFIIGFHYQMHLAELSGTTRLLFVTIVGTGGFCDGFTIRDLRFFKFHLKLFIVLQTPFQRTEVEFSLAMHDGLFQFFRLFDDPSRIFLTHTVQDGHHLFRIGLVHRLDGA

SEQ ID NO: 9051 - protein, 567 aa, B.fragilis
FCTRLHKIINYYIMDWLQDLLWNPNSVAHIVFLYAFVVAAGVYLGKIKIFGVSLGVTFVLFAGILMGHFGFTGDTHILHFIREFGLILFVFCIGLQVGPSFFSSFKKGGMTLNMLAVGIVVLNIAVAMALYFILGGRIELPMMVGILYGAVTNTPGLGAAQEALNQLSYSGPQIALGYACAYPLGVVGIIGSIIAVRYIFRINFAKEEENWNQETDGTHHKPHLMSLEVHNEAIYGKTLGTISSFLGRPFVCSRIRKNGHVSIPNHGTILEQNDQLFVVCSEEDSDAIVAFIGREVQVDWEKQDMPMVSRRILVTKPEINGKKLGMLNFRSMYNVNITRVNRSGVDLFANPNLILQVGDRVMVVGSEDAVERVASVLGNSLKRLNEPNIITLFVGIFLGILCGSLPIAFPGMPTPVKLGLAGGPLVVAILIGRFGHKLHLVTYTTQSANLMIREIGIVLFLASVGIEAGANFVDTVIHGDGLLYVGCGFLITIIPLLIIGVIARSYYKINYFMLMGLIAGSNTDPPALAYSNQATGSDAPAVGYSTVYPLSMFLRILAGQMILLLMM

SEQ ID NO: 9052 - protein, 311 aa, B.fragilis
RGYRTERNYNTINMKSKLLYLLTYVGMWLLAVLPFPVLYALSDFIYFWLYHVIGYRRKVVRTNLKNSFPEKSAAELKAIERKFFHYLCDYMLEDVKMLRMSEKELCKRMTYENKETYLRMIDERGGIVLLIPHYANFEWITGMGMIMRPGDVPVQVYKPLKDVYLDGLFKYIRARFGGYNVPKHSTAREVIKLKRAGKKMAIGLITDQSPNMHEAHYWTTFLNQDTVFMDGAERIAKMMDFPVFYCELRKERRGYCRVDFDLVTDRPKETADGEITEIFARRLEQTIRKEPAYWLWSHKRWKLKRPEKKNE

SEQ ID NO: 9053 - protein, 633 aa, B.fragilis
LINRKMKKQNSIYTLLIALLCFVSSCDYLGVSDQLAGGLQNTEQVFDNVSYTKRWYANVFAGIPDYSGINSVNVGAFKNPWTGMCDELVVGYGNSSKYNNSDRNAANMGFHRYGDCYKYIRQANIFLQKAHPIMTTGTQGDQLLEDELTQMKANVRFMRAFYHYLLFEQYGPIILVKDKIYNATEDQDVPRNTVDEVIEYIDSELTAVASELTQEPIFEDKDYRAWPTKGVALAVRAKLWLYAASPLLNGGYREALSVTNPDGTRLFPDYDAGKWEKALAACKDFIDYAEAGRYELYKEYKDDNGAVIDPDKSVYNLFQKYTHEIIWATANNDWGGMNGDAFDRRIAPRCEKNGLGSTGVTQELVDAFYMKDGFPVSATAYLPQSTLYQEEGYGTYKDQNDNFSKKYTNVTVSNRYLNREPRFYNTVFFNGRQWPVSCNQVLFYNGGNSGVQEGQATLTGYMLFKRFNRSVSLTNPGVASQFRPSIIFRLADFYLMYAEAANEVNPNDARVLKYLNLVRERAGLPDIETLNPAIRGNQELQRAAIQRERQIELATEGQRYFDVRRWMIADKNGEGRQNGYVHGMNVRGESNDKEDFNRIVEASQIVFNRKMYLYPMPDSEMRKTKNLVQNPGW

SEQ ID NO: 9054 - protein, 354 aa, B.fragilis
IVNRTMKIGDKVRFLSEVGGGIVKGFRGKDIVLVEDADGFDIPMQIRECVVIDTDDYNMTRKAAPAPKKPEEPVKPVKPEIPVVRSAEVRGGDVLNVFLAYVPEDVKAISSTSFEAYLVNDSNYYLYYTYQSAEGKAWKTRSHGLVEPNTKLLLEEFTKDMLNEMEHVAVQFIAFKDGRTAPLKPAVCVELRIDTVKFYKLHTFRESDFFEQPALVYDIVKDDVPTRQVFVSAEELQSVLIQKKEVDKPKSQPIVKRGGKNEILEIDLHINELLDDTRGMGNAEILNYQLDKFREVMEKYKAKREQKIVFIHGKGDGVLRKALIDELKRKYSNCRYQDASFQEYGFGATMVTIK

SEQ ID NO: 9055 - protein, 161 aa, B.fragilis
CKRLINKIIIMDIISLRKSPQYLEEAIAYFQRKWADENSRMVYDNCFRTCLESESPLPQWYLLINGEGEIIGCAGLATNDFNSRMDLYPWLVALFIEEQYRGHNYGNLLIKAVEEDTRRLGFGNLYLCTTHTGYYEHFNFVYIGDCYHPWGEHTRVYQKEI

SEQ ID NO: 9056 - protein, 177 aa, B.fragilis
NMQSDNNQEMFPIVDEQGTITGAATRGECHSGSKLLHPVVHLHVFNSKGELYLQKRPEWKDIQPGKWDTSVGGHIDLGESVEIALKREVAEELGITDFTPELLTSYVFESARERELVFVHKTVYDGEIHPSDELDGGRFWSYEEIKTNLGKGVFTPNFESEIDKVEIFSSTSPKEAV

SEQ ID NO: 9057 - protein, 191 aa, B.fragilis
VFMRRSILDIFLFLLVIISTAACNNDLPFDLKENPPKLVMNAIINADSTYNTLFLNLTGRNQIGQIKGATVEVRINGSLSETLRPDPHSSDKGRFYINSAFHPGDVVRIDAMTDDGEHHAWTEVTVPQPIGKIEKVDTASIMRKPSNYGYGTPPRRHLRYQIKIKDPPGREEFLSDHCGTTEILEILLGTK

SEQ ID NO: 9058 - protein, 728 aa, B.fragilis
LDMRKSNPDFHHIRSYILMCVVSLTFSTIYAQTPEPKLTLKLQNTSLSEVIRQIEQDTGFSFIYGEEVKLDHKVSLNVQKKPLREVLNLLFANKPISYKITGKHILLQKTPPKPVSRKFTVSGYVTDGASAETLIGANILESRHHQGTTTNPYGFYSITLPEGEARLSFSYLGYTGQQHVLNLTADTLLNIRMKDNNMLQEVVIVSDKAESGVMATQMGASEIPMTQIKNTPSILGEADVMKAIQLMPGVQAGMEGSAGLYVRGGGPDQNLILLDGVPVYNVDHLLGFFSVFTPEAVKKVTLFKSSFPARFGGRLSSVIDVRTNDGDMKNYHGVVSVGLLTSKINFEGPIIKNRTSFNISARRSYIDLLAKPFMPKDEKYSYYFFDVNAKINHKFSDRSRLFLSAYNGKDHFMTKYDDTYYGDEDKYRDGGKMNWGNTIVSGRWNYIFNNKLFSNTTVAFNNYKFDVSTFTKNEIHTNNQITWNRYKADYKSGIRDWSAQIDFDYNPIPTHHVKFGVQYLHHSFRPEVSTSKIFDKTGETIERDTTYYTTSNSEILAHEASAYLEDNFNLSSRLRMNLGLHFSTFQVQKKNYFSVQPRISARYQLSKDVVLKASYTKMSQYVHLISSMPFAMPTDLWVPVTSKIKPMQAHQVSLGGYYTGIDGWEFSIEGYYKGMKNVLEYKDGVSFLGSSTGWEDKVEMGHGPLYGCRVHGTENHRKDNGMAGIYPG

SEQ ID NO: 9059 - protein, 717 aa, B.fragilis
SKMRKDFKNLDIYAAFQPANGAEWQKANGIEANWKTPEHICVKPVYTKEDLEGMEHLDYAAGLPPYLRGPYSVMYTLRPWTIRQYAGFSTAEESNAFYRRNLASGQKGLSVAFDLATHRGYDPDHERVVGDVGKAGVSICSLENMKVLFDGIPLNKMSVSMTMNGAVLPIMAFYINAGLEQGAKLEEMAGTIQNDILKEFMVRNTYIYPPAFSMKIISDIFEYTSQKMPKFNSISISGYHMQEAGATADIELAYTLADGLEYLRAGVAAGIDIDAFAPRLSFFWAIGTNHFMEIAKMRAARMLWAKIVKQFNPKNPKSLALRTHSQTSGWSLTEQDPFNNVGRTCIEAMAAALGHTQSLHTNALDEAIALPTDFSARIARNTQIYIQEETYICKNVDPWGGSYYVESLTNELAHSAWEHIQEIEKLGGMAKAIETGIPKMRIEEAAARAQARIDSGSQTIVGVNKYRLEKEDPIDILEVDNTAVRKEQIENLKRLKEGRNQAEVDKALAAITECVKTGKGNLLELAVEAARVRATLGEISYACEQIVGRYKAIIRTISGVYSSESKGDADFKRACELTEKFAKKEGRQPRIMVAKMGQDGHDRGAKVVATGYADCGFDVDMGPLFQTPAEAAREAVENDVHVVGVSSLAAGHKTLVPQIIEELKKLGREDIVVIAGGVIPAQDYDFLYKAGVAAIFGPGTPVAKAACQILEILMDED

SEQ ID NO: 9060 - protein, 72 aa, B.fragilis
RRTGSRLFYRISAIDVSPYPCGTNDIVANDVITIHPDTAMASYHVFIYIVIGHFYMVTASITKPVSSPQILL

SEQ ID NO: 9061 - protein, 201 aa, B.fragilis
TMKGSLIIVSFFIVGTLCGLFQLIPYDFSQSKLSFYALCGLMFCVGISIGNDPQTLKSFRSLNPRLLFLPVMTILGTLAGCAVVSLFLSHRSPSDCMAVGSGFGYYSLSSIFITEYKGAELGTIALLSNIMREIIALLCAPLLVKFFGKLAPISVGGATTMDTTLPIITRCSGQEFVIVSIFHGFIVDFSVPFLVTLFCSI

SEQ ID NO: 9062 - protein, 912 aa, B.fragilis
KLILKPTQQKRFKLMRKPFMLISVLPITVHISHDTDTGSNRIGGIPEKYAFKNKVLRSICFVLFLLSIGLNSAFAQVRNAAGLVVDENGQPLIGVQIKLEGTTTGVITDVDGNFSINAKKGDILLFSYVGYEPQRITYKGEKILAIKMLPNTELLDEVVVIGYGKQKKNSVVSSINAIGPKELAVSSNRNLTNSLAGQVPGLIAVQRSGEPGYDNSEFWIRGVSSFKGGTNPLVLVDGVPRNMQDIEPDEIESFTLLKDAAATAVYGAEGANGVILITSKRGNSQKPKISLRAESTLLTPTRLPKFMNSVETLDLYNEALNNEGTASIRTAEEIAMYGPGADRDLYPDTDWLREMLREHTYNMRYTLNVRGGSERARYFVSGAFYQENGIFKEGKKNEYDNNIGLKRYNLRSNIDFDATKTTLVKVDISGQYLQTNYPGTSTNTIFNSMCRTPSYLMPAEYSDGTIAGHPRPSGNRVNPYNLLMNSGYAKEWRTSIQSKLEVDQKLDFITKGLNWKGLISFDADMKYIAKRTKTPTQYLATGRDENGGLQFKKVVEGSDVLTEKLENSSNKKIYFETSFNYNRTFAQKHDVTAMVLYMQKETQYHNNALPYRKQGLVGRATYGYDGRYFIEGNFGYTGSETFAKGYRFGFFPAMGLAWYVSNEPFYPEVLKKVVNKLKFRFSIGRTGNDDTGGDRFLYRGTMKQDNGGYDLGFSDTGGMGGIGNGITEARFEAPYLSWEIEEKKNYGIDLGLFDNRIDLQVDYFNNKRKSILLQRNTVSNVTGFQQMPWQNFGIVKNHGVDASLILNQKIGQVNLSARGNFTFARNEIIEYDQVPQVYPWLEKRGTRLNSNKLYIAEGLYTYDDFIINGEGLNRTYELKPGVVSGLSSGVRPGDIKYKDLNGDGKIGLRHVR

SEQ ID NO: 9063 - protein, 264 aa, B.fragilis
YIILTELFYKKLVINTTYQLITSLMNTMFFNAVSCFFVCAGLIIALILAINVIFHRQSMKIMNIVWVLTGLWGHYFALFAYYTFGVRKDNMVATVPMENMKMDMKISMEMDMSEVRPQWQSITLSALHCGAGCTLADIIGEWFTYWVPLQIGGSLIAGSWALDFVLALILGVFFQFIAIREMEAISFREAVSRAFKADFFSLLAWQVGMYSWMAVATFILFKDESLEKTSWTFWFMMQIAMLLGFMVSYPVNAWLIKSGIKKGM

SEQ ID NO: 9064 - protein, 392 aa, B.fragilis
KIIIIFAIIINIIILVMAVINPFVVGGYVSPRYFCDRVAETENLIRNLINGRNVALVSTRRMGKTGLIRHCFYQPLIKEGYYTFFIDIYATSSLKEFVFALGKGIFEKLKPQGNKFIDRFFSIITSLRIGFKLDSITGEPILELGLGDIHAPETTLEEIFIYLEQADKPCIVAIDEFQQISSYPEKNLEAILRTKVQHCSNSNFVFAGSQRHIMMNIFNSPSRPFYQSVSMMHLGAIPLEVYKPFVKGLFEENGKKVTDQLVENVYTLFDGHTWYVQLMLNELFILTDKKGICDVPMINLALNNIIATQDFTFQEIFSRLPEKQKEIMIAIAKEQKAKGVTSAAFIKKYRLTSASSVQSGLKGLLEKDMLTQESGGYQVYDRLFNIWLRRNY

SEQ ID NO: 9065 - protein, 578 aa, B.fragilis
ILYIMKVYQTNEIKNIALLGNDGSGKTTLTEALLYESGIIKRRGRITAKNTVSDYFPVEQEYGYSVFSTIFHVEWNGKKLNIIDCPGSDDFVGAAMTALNVTDTAILLLNGQYGAEVGTQNHFRYTEKLGKPVIFLVNQLDNEKCDYDMVLEQLKSIYGPKVVPVQYPLATGPNFNSLIDVLLMKKYSWAPEGGAPIIEEIPAEEKDKAMELHKALVEAAAENDEGLMEKFFEQDSLTEDEMREGIRKGLAARGMFPVFCVCAGKDMGVRRLMEFLGNVVPGVSEMPKVHNTRGEVVEPDPNGPTSLYFFKTGVEPHIGDVQYFKVMSGKVHEGDDFTNADRGSKERVAQIYACAGANRIKVEEMVAGDIGCTVKLKDVHTGNTLNGKGAENRFNFIKYPNSKYSRAIKPVNEADTEKMMAILNRMREEDPTWVIEQSKELKQTIVHGQGEFHLRTLKWRLENNEKLQVKFEEPKIPYRETITKAARADYRHKKQSGGAGQFGEVHLIVEPYYEGMPVPDMYKFGGQEFKINVKGTEEVPLEWGGKLVFVNSIVGGSIDARFLAGHLKGFMSRMNKDL

SEQ ID NO: 9066 - protein, 1175 aa, B.fragilis
YPHIIQPLIRLNYVKTNLLIKSYKCMNNHGIFSPDRTKVRTLLSIKSIFLFLLFTFAFEMAYASSVYSQTKVFTMQSAEKTVLQVFKEIEKNSEFIIFYRDGVIDLNRKVSVNVVNQSVDKILEQLLAHTDNGFTIKDRQIIIYKKETSATPSVSQQKNKIKVTGVVTDAKGESIIGANVVVKGNPTIGAITNMEGRYEVMLPSDDVILLVSYLGYNTEEIKVKGRRNINVVLHEDSKALDEVVIVGYGKQKKESVVVSMSSIKPKDIVVPSRSLNNSLAGQVAGLIAVQRSGEPGYDNAEFWIRGVSTFAGGTSPLVLVDGVPRNMSDIEPDEIETFSVLKDAAATAIYGAEGANGVVLVTTKRGRVEKAKISFKTEHTISSPTRLPEFVGSADYLSLYNEALRNDGEGPQFSDELIAHYRNNDDPDLYPNTNWIDELLRKNTFSHRYTLNVRGGTEKAKYFVSGAYYNESGLFKNRPNGIYDTNIGIDRFNLRSNIDMAVSSTTTVGVDLAMQYLINNYPGTGTSTIFRSMLITPPYAFPAVYSDGTVATYAQERDANMRNPYNLLMNSGYAKEYRTGIQSKVNVNQKLDFITKGLSANLNVSYDYDSEMIIRREYNPTRYHATGRDELGQLIFSTVVSGNPDIQDPKNSATSATKKIYIDASINYKRTFGKHDVGAMLLYMQKETQQHNVPLPFRKQGFVGRATYGYDGRYFIEGNFGYTGSEAFAEGNRFGFFPAIGAAYYLSNESFYPEAIKKVVNKLKLRASVGRTGNDKTGQERFLYRPTFTTNAGGFTQGIGDTGGTNGIGNGIVEGRFAAPYLAWEIEDKQNYGFDLGLFDNRIDIIFDYFRSERRDILLQRRTVPQLGGLRQDPWQNFGKVRNQGIDMSMNLNQQIGKLKLSARGTFTFTRNKILEYDELPQKYGYQAVTGTRVSENTLYIADRLYTEDDFIVSTNANGLKTYKLRSELPRPTLGGLIGPGDIKYVDVNGDGVIDSYDQVRGVGNPSTPEIIYGFGLNAEYKGFYASIFFQGAGNTSVLLGGATSEGWYPFSWGVDQSNYRTFALDRWTENNPSQDVIIPRLHKNNANNANNRVASTWWLRNGSFLRLKNIEFGYQLPKKFMDKIGFEAARIYIMGYNLAVWDDIKYFDPEAGNANAGLNYPLPRTFTLGLDFTF

SEQ ID NO: 9067 - protein, 66 aa, B.fragilis
KTIFMPGNGSRHTGKSSGSNRVNEENNGSKVGEHRLCKLWKPALREHTVSSIKNREKPMLLPITVL

SEQ ID NO: 9068 - protein, 144 aa, B.fragilis
TDIFFLIGFHSRHCRLCIAIVPLCSALRCFCDCKVKHIILTGGTDTARSIAKAIPATPLSAETGGKNVIILTASGDRDHTIMNIVISVFGNAGQKCSACSLLVERSVYEDKNFQKKLIDVASSMKAGSVWNPGNVVGPMITNKK

SEQ ID NO: 9069 - protein, 245 aa, B.fragilis
VYIMFQEAIAQYLKQNHYESIQLKSVLFDMDGVLFDSMPYHAEAWHKTMKAHGLNLSREEAYMHEGRTGAGTINIVCQRQLGRDATQEEIESIYLEKSIEFNKHPQAERMPGAWELLQKIKAEGIIPTVVTGSGQASLLDRLEHNFPGMFRQELMVTAFDVKYGKPNPEPYLMALEKGGLKPNEAIVIENAPLGVEAGHKAGIFTIAVNTGPLNGEILLNAGADLLFPSMQALCESWEKLVRLLH

SEQ ID NO: 9070 - protein, 485 aa, B.fragilis
SVSIYFVALLRIIFKIRKNMKSYKLLLAFTLFLAFAFNMKAQYVHERSDQYTPPEDSLVIQKLHHWQDQKFGMLIHWGLYSVAGIVESWSICSEEADWIPRDSTMAYEDYKKWYWGLKDSFNPTRFDPEQWAQAAKSAGMRYAIFTTKHHDGFNMFNTAFSDFSIAKGPFQTDPRADVAKYVFEAFRNNDLMVGAYFSKPDWHSEYYWWPRYATPRRTQNYNIDKNPWRWNQFKEFTYNQIGELMHNYGPIDILWLDGGWVNNPGTKSVLDMDRISQMARQAQPGILFVDRTIHGKYENYQTPEQQIPDKQLPYPWETCMTLGVDWGYTPHAVFKSPVTVIAKLMEIVAKGGSLLLGVGPTPEGILQDEIVSRLQTIGGWMKKNGTAIYNTVTTPQYYSEGIWFTMNKDGKTMYALYSNPETEKFPDYIEWENNIPAKRSAIYCLQNGKKVKWEIKNNRVRVYLPQNLKTEVNALAFSFTRQAIQ

SEQ ID NO: 9071 - protein, 171 aa, B.fragilis
YDCMKKLFFPLLSLCLLTTACKDSVPSPTIEMQGLYVNDGEMDYTRQMEALPPLKVDDELEISLKLDGNGEELNTFLVKEETPGSKETAVEIDFNDLPEETLSDDKEFTDKDNGKLGFKDGVSQTQIGIRAKVQQVTEDGVKLKFYLFSKPVNCEGAKYELEIKTSDKQDD

SEQ ID NO: 9072 - protein, 1285 aa, B.fragilis
YDRMGLRTIQDWMVKRQLSGIPGIVEINSFGGYLKQYEVAVDPNALFSLNITIGKVFEALSKNNQNTGGSYIEKAKNAYYIRSEGMISRTKDIEQIVVANRNGIPVHISDVGIVRFGAPKRFGAMTKDGKGECVGGIAMMLKGANANVVTQELEKRVEKIQKLLPEGVSIEPYLNRSELVNRNISTVVHNLIEGAIIVFVVLIIFLGNIRAGLIVASVIPLAMLFAFILMRIFGVTANLMSLGAIDFGIVVDGSIVIVEGILAHLYNNKLNGRTLSGTEMDEEVEKGASGVVRSATFAVFIILIVFFPILTLSGIEGKYFTPMAKTLVFCIIGALLLSLTYVPMMASLFLKHTIMVKPTFADRFFEKLNVIYQRCLHFCLRFKWQTVTVAFATLIGSFLLFGRLGAEFIPTLDEGDFAMQMTLPAGSSLSESIEVSNQAEKLLMDRFPEIKHVVAKIGTAEVPTDPMAVEDADVMIVMKPFKEWTSASSRAEMVEKMKEALQPLENRAEFNFSQPIQLRFNELMTGAKADIAVKLYGEDTHELYAKAKEAARFVEQVSGASDVIVEQTMGLPQLVVKYNRGKIARYGINIEELNTMIRTAYAGEVSGVVFENERRFDLVVRLDQEKVADLSLDKLFIRTSEGIQIPVSEVASIDLVNGPLQINRDATKRRIVIGVNVRDADIQQVVSEIQQILDKNIKLQPGYYFEYGGQFENLQNAIRTLTIVIPVALMLILLILFFAFKNVTYTLMVFSTVPLSLIGGILALWLRGLPFSISAGVGFIALFGVAVLNGILMINHFNDLRKQNKYAMTTNQIIKRGTPHLLRPVFLTGLVASLGFVPMAIATSAGAEVQRPLATVVIGGLILSTILTLIILPVFYKIVNAASAGWKQPKRRLHLFILLPALLLSATATAQAPQTVSLEQAIEIAKQNHPRLKIATTAIRQAQAGRGEIVEATPTTFNYSWGQLNGENKKDKEMAFEQSLGSLLTPFYKNVLINRQVQTSTYYLQMVEKEITAEVKRAWAYYQYASGMSSLYHDQDRMAAELRRIGELRYEQGEITLLEKNMMTTLAADLHNRLFQALEEKKVALARFQWSCYADDPITPKDTIMTLFPTDCEQRSTSEAHLGFFNSQASEARAILNVERSRFFPELSIGYSRQDILPLKNLNAWMVGVSFPIYFLPQKSRIKQAKLAVSAAQIQAEANIRELNNKITELSAALRRYEESLRFYTSSALKEADELVKTANLQLQHSETGIAEFIQSVSAAREIRKGYIETIYQYNIASLEYELYQ

SEQ ID NO: 9073 - protein, 892 aa, B.fragilis
YRLINYLVFILIYQKTFIALQARLLMISKLLHIYLLIKKSKTHCIVEKQIYSYEEAFEESLRYFQGDELAARVWVNKYAVKDSFGNIYEKSPKDMHWRLANEVARIEAKYPNALSSEQLFELFDHFKYIVPQGSPMTGIGNDYQVASLSNCFVIGIDGSADSYGAIIKIDEEQVQLMKRRGGVGHDLSHIRPKGSPVKNSALTSTGLVPFMERYSNSTREVAQDGRRGALMLSVSIKHPDSEAFIDAKMTEGKVTGANVSVKLDDAFMSAAVEGRKYTQQYPIDSDHPTTVKEIEASNLWKKIVHNAWKSAEPGVLFWDTIIRESVPDCYADLGYKTVSTNPCGEIPLCPYDSCRLLAINLYSYVVNPFTKDAYFDFDLFHKHVALAQRIMDDIIDLELEKIERIIEKIDQDPENEEVKHTERGLWEKIYKKSGQGRRTGVGITAEGDMLAALGMRYGTEEATEFSEKVHKAVALGAYRSSVDMAKERGAFDVYDSEREKNNPFINRLREADPALYEDMKKYGRRNIACLTIAPTGTTSLMTQTTSGIEPVFLPVYKRRRKVNPNDTNVRVDFVDETGDAFEEYIVFHHKFVTWMEANGYDPAKRYTQEEIDELVAKSPYYKATSNDVDWLMKVRMQGKIQKWVDHSISVTINLPNDVDEELVNRLYVEAWKSGCKGCTVYRDGSRSGVLISAKSDKDKKEELPPCKPPTVVEVRPTVLEADVVRFQNNKEKWVALVGLLDGRPYEIFTGLQDDDEGIIIPKSVNTGRIIKNVDENGNKRYDFQFENKRGYKMTIEGLSEKFNKEYWNYAKLISGVLRWRMPIEQVIKLVGSLQLDSENINTWKNGVERALKKYVQDGTEAKGKKCPNCGNETLVYQEGCLICTTCGASRCG

SEQ ID NO: 9074 - protein, 905 aa, B.fragilis
LNLIYMIVTFHIEYRTSWGEEVRILGSVPELGKNNPEQAVALTTVDGIHWSNEISIQLPAEGVVEYSYHIYRDGKAIRTEWNSFPRRIYLPADVKKSLRINDCWKNLPEQQYFYSSAFTEALLAHRERSAIPKSYKKGLMIKAYAPRINSKYCLAICGNQKALGNWDPDKAWPMSDANFPEWQAELDASKLEFPLEYKFVLYNKEEKRAEAWENNPNRYLAAPEIKANETLVIADRYAYFNIPSWKGAGVAVPVFSLKSEKSFGVGDFGDLKRMVDWAVSTNQKVVQILPINDTTMTHTWTDSYPYNSISIYAFHPMYSDLKQMGNLKDKETAATFNRKQKELNALSAIDYEAVNRVKWEYFHQIFKQEGEKVLASKAFRSFFEANKDWLQPYAAFSYLRDLYHTPNFREWPQYSEYNAQEIEELCRPDTADYAHIAIYFYIQFNLHLQLLEATTYAREHGVVLKGDIPIGISRNSVEAWTEPYYFNLNGQAGAPPDDFSVNGQNWGFPTYNWDVMENDGYKWWMKRFQKMAEYFDAYRIDHILGFFRIWEIPMNAVHGLLGQFVPALPMSREEIESYGLSFREEFLRPYIHEYFLGQVFGPHTDYVKQTFIEPTETYEVYRMRPEFDTQRKVEAFFAGKNDEDSIWVRDGLYALISDVLFVPDRKDPNLYHPRIGVQHDFIYRALNDWEKTAFNRLYDQYYYHRHNDFWQQQAMKKLPQLTQSTRMLVCGEDLGMIPDCVAWVMNDLRILSLEIQRMPKNPAEEFGRLNEYPYRSVCTFSTHDMSTLRGWWEEDYQQTQRYYNQMLGHYGTAPAIATPELCEEVVRNHLYSNSILCILSLQDWLSMDGKWRNPNVQEERINIPANPRHYWRYRMHLTLEQLMKAESLNEKIRELVKQTGRNPEK

SEQ ID NO: 9075 - protein, 149 aa, B.fragilis
NQTIDTTRIIIALIILFLPEDTSIIKLMTTQHYIFLENVRFYSYHGVAPQETAIGNEFIINLRLKTDFGKATETDEVEDTVSYADIYAALKEEMELPSKLLEHVCGRIVKRLFRDFRKIREIEIKLAKRNPPMGADIDSAGVEMHCTRD

SEQ ID NO: 9076 - protein, 719 aa, B.fragilis
EKQMIVCIAEKPSVARDIADILGARERKEGYIEGNGYQVTWTFGHLCTLKEPHEYTPGWKSWSLGSLPMIPPRFGIKLIENPTYEKQFHIIEGLMQKADEIINCGDAGQEGELIQRWVMQKAGARCPVKRLWISSLTEEAIKEGFAKLKDQKDFQPLYEAGMSRAIGDWLLGMNATRLYTVKYGQNRQVLSIGRVQTPTLALIVNRQLDIENFQPKQYWELKTMYRDTTFSALIRKSDEELAAEEEKSGGKAKKTENRGIDPIANREEGMALVERIKDLPFVVTSVAKKDGKEYAPRLFDLTSLQVECNKKFAYSADETLKLIQSLYEKKVTTYPRVDTTFLSDDIYPKCPNILKGLKDYEVLTTPLAGASLPKSKKVFDSSKVTDHHAIIPTGVHPQNLTDMERRVFDLIARRFIAVFYPDCKVSTTTVMGEVDSIEFKVTGKQILEPGWRVVFAKDVKDLNEEKEGEDENVLPAFVKGESGPHIPDLNEKWTQPPKPYTEATLLRAMETAGKLVDNDELRDALKENGIGRPSTRAAIIETLFKRNYIRKEKKNLIATPTGVELIQLIHEELLKSAELTGIWEKKLREIEKKTYDARQFLEELKQMVSEIVNSVLSDNTNRRITIQEATAVEEEKKKKEPKRRERKSATPKEKKGKSEPATVDVSSTGQSVRADALKETDSLVGKLCPVCGKGVIIKGKTVYGCSEWKNGCTYRKAFE

SEQ ID NO: 9077 - protein, 385 aa, B.fragilis
NAKITQTIMAGIYIHVPFCKTRCIYCDFYSTTRSEWKGRYIEALCKELEMRYTYLKGKPIETLYFGGGTPSQLDEKDFRKVFDTVRRVYGMENCHEITLEANPDDLCPEYLQMLSELPFNRISMGIQTFDDTTLKLLKRRHNAAQAIRAVELCRAHGFLNISIDLIYGLPGETTERWEKDLQQAIALDVEHISAYHLIYEEGTPIYKMLQKHQVEEVDEDSSVRFFTLLIDRLREAGYEHYEISNFCKPGMYSRHNTSYWQGVSYLGCGPSAHSFDGQTREWNCSSIEKYMSGIESGQRDFEREERDLATRYNEFIITSVRTQWGISLERLSNDYGTQLEQYCLKMARPSLENGKLEIYEGALRLTREGIFISDSIMSDLLWVEN

SEQ ID NO: 9078 - protein, 155 aa, B.fragilis
HDEIRRKSMEIILKEDVVNLGYKNDIVTVKSGYGRNYLIPTGKAVIASPSAKKMLAEELKQRAHKLEKIKKDAEALAAKLEGVSLTIATKVSSTGTIFGSVGNIQIAEELAKLGHEIDRKIIVVKDAVKEVGAYKAIVKLHKEVSVEIPFEVVAE

SEQ ID NO: 9079 - protein, 334 aa, B.fragilis
FIEMKLPGKIAIMGGGSWATAIAKMCLAQEESINWYMRRDDRIADFKRLGHNPAYLTGVKFDMKRINFSSNINDVVKESDTLIFVTPSPYLKAHLKKLKTRIRDKFIITAIKGIVPDDNLIVSEYFNKEYGVPPENIAVLAGPCHAEEVALERLSYLTIACPDKDKARVFARRLGSSFIKTSVSDDVIGIEYSSVLKNVYAIAAGICSGLKYGDNFQAVLISNAIQEMNRFLNTVHPINRNVDESVYLGDLLVTGYSNFSRNRTFGTMIGKGYSVKSAQIEMEMIAEGYYGTKCIKEINKHHHVNMPILDAVYNILYERISPMIEIKLLTDSFR

SEQ ID NO: 9080 - protein, 128 aa, B.fragilis
FSGITIKKVGIMKRLGLTLVAALCLVATTFAAGNQPTVAKWEGNINVNKLGKYLNLSSVQAEEVANICNYFDEQMGRATTAKKNKDTMVRNAVYGNLKLMKKTLTDAQYTKYTTILNMTLKNKGIEVK

SEQ ID NO: 9081 - protein, 261 aa, B.fragilis
DRMIILFISLQKKDMMDTVKNRRTIRKYQQKDITPDLLNDLLETSFRASTMGGMQLYSVVVTRDAEKKEILSPAHFNQPMVKEAPVVLTFCADFRRFCKYCQERNAEPGYGNLMSFLNAAMDTLLVAQTFCTLAEEAGLGICYLGTTTYNPQMIIDALHLPELVFPITTVTVGYPAESPKQVDRLPIEGIIHEESYHDYTAEDINRLYAYKESLPENKLFIEENQKETLAQVFTDVRYTKKDNEFMSENLLKVLRRQGFMD

SEQ ID NO: 9082 - protein, 173 aa, B.fragilis
SFFVLRDRICQRRHLSLQSCLNNNFMIEQFNFDIRLIFAILNGKVSAAINRKLYRNFRQNGLEISPEQWTVLIFLWEKDGVTQQELCNATFKDKPSMTRLIDNMERQHLVVRISDKKDRRTNLIHLTRTGKELEEKARIIANRTLKEALHGITVEELSVSQEVLRKIFFNTKD

SEQ ID NO: 9083 - protein, 226 aa, B.fragilis
NTFVRDILKIQKLKKLYWYFFSLLAFGYMFQACDNSKTYAEMLDEEKDAVNAFIKKHNIQTISESDFEANGYKTDTTKNEYVAFSNGVYMQIVDKGIVTDKPENDSIKNNNIVAVRFVEHDIKANDTTCFNVVLPGFENYPNYYTYPDVFRYVDNGTSVAGVFTEGSMYAKYGTTDVPPGWLLALKYVTNYAHVRMIVPSKMGHQSANQYVNPYFYDIRKFQKALN

SEQ ID NO: 9084 - protein, 154 aa, B.fragilis
RVHVPHEQGPLTVSYARDVRVIVYEEKMHRVDSNEISFMLAERNAFSEAFKNAGPKILEPIYDVEVFVPSDKMGDVMGDLQGRRAMIMGMSSENGYEKLVAKVPLKEMSSYSTALSSLTGGRASFIMKFASYELVPSDVQDKLIKDFESKQTEE

SEQ ID NO: 9085 - protein, 527 aa, B.fragilis
LGSVNFVAMKKSTIWILGIIMGLSFLSLLYLQVSYIEEMVKMRKEQFNTSVRNALFQVSKDVEYDETQRWLLEDITEAERRALAQSSSTTEQKNGLIQQSERYRFKSPDGTLYSEFELKMITTEPSKVPKAMISERHGRNTIPQTSRSLTDAIKNRYMYQRFLLDDVALRMIYKASDKSIGERVNFKKLDNYLKSNFINNGVELLYHFSVIDKDGREVYRCSDYEDGGSEDSYTQPLFQNDPPAKMSIVKVHFPGKKDYIFDSVSFMIPSMIFTIVLLITFIFTIYIVFRQKKLTEMKNDFINNMTHEFKTPISTISLAAQMLKDPAVGKSPQMFQHISGVINDETKRLRFQVEKVLQMSMFDRQKATLKMKELDANELITGVINTFALKVERYNGKITSNLEATNPVIFADEMHITNVIFNLMDNAVKYKKPEEDLVLNVRTWNEPGKLMISIQDNGIGIKKENLKKVFDKFYRVHTGNLHDVKGFGLGLAYVKKIIQDHKGTIRAESELNVGTKFIIALPLLKND

SEQ ID NO: 9086 - protein, 488 aa, B.fragilis
KFCLINKCITAAMSESSHVGLWNRCLEIIRDNVPESTYKTWFVPIVPLKYEDKTLIVQVPSQFFYEFLEDKFVDLLRKTLYKVIGDGTKLMYNVLVDKSSGATVNQESTTRSTAIPQSGLPRVDERKAPGLLRAPAVQDLDPHLNPNYNFETFIEGYSNKLSRSVAEAVAENPAKTVFNPLFLHGASGVGKTHLANAIGTRIKELYPDKRVLYVSAHLFQVQYTDSVRNNTTNDFINFYQTIDVLIIDDIQEFAGVTKTQNTFFHIFNHLHQNGKQLILTSDRAPVLLQGMEERLLTRFKWGMVAELEKPTVELRKNILRNKIHRDGLQFPSEVIDYIAENVNESVRDLEGIVISIMAHSTIYNKEIDLDLAQRIVRKVVRCETKAVTIDDIINVVCKHFDLESSAIHTKSRKREVVQARQVAMYLAKTHTDFSTSKIGKFIGNKDHATVLHACKTVKGQCEVDKGFRSDLENIETLLKKRNVSNGER

SEQ ID NO: 9087 - protein, 221 aa, B.fragilis
PMNVQIEESWKTHLEPEFEKDYFRTLTEFVRSEYSQYQIFPPGKLIFNAFNLCPFDKVKVVIIGQDPYHGPGQAHGLCFSVNDGVAFPPSLVNIFKEIKEDIGTPAPSTGNLTRWAEQGVLLLNATLTVRAHQAGSHQRRGWEEFTDAAIRVLAEERENLVFILWGSYAQKKGAFIDRNKHLVLSSAHPSPLSAYNGFFGNKHFSKTNEYLKAHGKTEINW

SEQ ID NO: 9088 - protein, 176 aa, B.fragilis
KDDVMEKLIRRIGLVAHDAMKKDLIEWVLWNSELLMGHKFYCTGTTGTLIQEALKEKHPDVEWDFTILKSGPLGGDQQMGSRIVDGEIDYLFFFTDPMTLQPHDTDVKALTRLASVENIVFCCNRSTADHIISSPLFLDPDYERTHPDYSGYTKRFENKPVVTEAVESVKKRKRKK

SEQ ID NO: 9089 - protein, 189 aa, B.fragilis
NYKVMTESEVRKLLRRMKELDSQTAFRAFYDMTYDRLYRIAYYYVKREEWSQEIVLDVFLKLWEQRSSLPEVKSIEDYCFILVKNASLNYLEKENRRTTVSTETLPEPEAQSDSPEESMISEELFAIYVKALDRLPERCREVFIRIREEKQSYAQVAEELGISTKTVDAQLQKATIRLKEAISMVNNDR

SEQ ID NO: 9090 - protein, 179 aa, B.fragilis
NMKVLDLIDKYYPQDNELKHILNVHSRSVADKALWIAGKHPELNLDTVFLEEAAMLHDIGIFLTHAPGIQCFGTEPYICHGYLGAGLVRKEGFPRHALVCERHTGAGLSLKDIMDQKLPVPHREMLPVSMEEQVICFADKFFSKTHLDREKTVEGARKSIAKYGDEGLQRFNNWCKLFL

SEQ ID NO: 9091 - protein, 375 aa, B.fragilis
NDQFDNILAYCSYRYRYYSYLCRQITINKPMSYLIKPQNYKPLLDLKQTELGIKQIKEFFQLNLSSELRLRRVTAPLFVLKGMGINDDLNGIERPVSFPIKDLGDAQAEVVHSLAKWKRLTLADYHIEPGYGIYTDMNAIRSDEELGNLHSLYVDQWDWERVITAEDRNADFLKEIVNRIYAAMIRTEYMVYEMYPQIKPCLPQKLHFIHSEELRQLYPDMEPKCREHAICKKYGAVFIIGIGCKLSDGKKHDGRAPDYDDYTSKGLNDLPGLNGDLLLWDDVLQRSIELSSMGIRVDKEALLRQVKQENQEQRLELYFHKRLLNDTLPLSIGGGIGQSRLCMFYLRKAHIGEIQASIWPEEMRRECTALNIHLI

SEQ ID NO: 9092 - protein, 211 aa, B.fragilis
RTLSPFADDTYLCIIQTDAKSLMETFIEKFRNSYHLSENDTQTLLSYMEEIRFKKKEVIVHEGSKNGNLYLIKQGIWRAHYLKDGVDTTIWFAGAGEAAFSVWGYVENTASHITIEVMCDSIAYCIPGSTLNNLYASSLGLANLGRQLMERQLLSLENWLISAGSPKAKERYLTLIKEHPELLQNVPLKHIASYLWITPQSLSRIRREMKM

SEQ ID NO: 9093 - protein, 519 aa, B.fragilis
EYFPSSVIILFSEINKRRTMNKPYFIAFLLSLALWTVIPSVFAGDVVLKVFEGKPRINSPHITGNYPSTPFIFYIPTSGQRPMQWSAEKLPEGLELDSKTGIISGVVTSKGDYTVTLKAENALGVSVKQLVIRIGDELLLTPPMGWNSWNTFGQHLTEELVLQTADAMITNGMRDLGYSYINIDDFWQLPERGADGHLQIDKTKFPRGIKYVADYLHERGFKLGIYSDAAEKTCGGVCGSYGYEETDAKDFASWGVDLLKYDYCNAPVDRVEAMERYAKMGRALRATNRSIVYSVCEWGQREPWKWAKQVGGHLWRVSGDIGDIWYRDGNRVGGLHGILNILEINAPLSEYASPSGWNDPDMLVVGIDGKSMSIGYESEGCTQEQYKSHFSLWCMMASPLLSGNDVRNMNDSTLKILLDPDLIAINQDVLGRQAERSIRSDHYDIWVKPLADGCKAVACFNRASSPQTVILNENTIADLSFEQIYCLDSHLTKSGSDSKELIVKLAPYQCKVYIFGKTD

SEQ ID NO: 9094 - protein, 167 aa, B.fragilis
NYKPPTHMKDLTITSVIKVYEYDELNDTDRALLDDAIEATRRSYAPYSHFSVGAAALLANGVVVTGTNQENAAYPSGLCAERTTLFYANSQYPDQAVVTLAIAARTEKDFIDTPIPPCGACRQVILETEKRYKQPIRILLYGKKCIYEVQSIGHLLPLSFDASAMED

SEQ ID NO: 9095 - protein, 426 aa, B.fragilis
KQRPMMIKQIFKMIWNQRRLNGWIWMELLVVFVALWYLVDMFVVQLYSYTRPMGYDITNCWKLSFDVYPEDADEYVNDTTQTQTEGEALAKILERLRRAPEVDNACVAFYSSPYSGGNSWTQIMPCTADSSKFKEQSYHQYIVSAEFYDVFRIKNREGKPLSELLTQKQLSYFITPALEKDFFGSQSAVGQKVRYPGSTREIHIAAVTAPVRITEFVKPEPELFFTMWPKELERQVNATGASNMEVTVRMKEELTSEQMGHFLNRMKNQLTENNLYITGMEDMKQQRSDRLQYEWRKISINLLLSVFILLNVLFGITGTFWLRIEQRRCETGLRMALGSTRRRVGWFFTAEGWLLLTTVVPLVLVVIFNMVHMEIPDLYNLSFTWWRFAVSFGGVLLLMGLIIALGIWLPARRAMKLQPAEALHYE

SEQ ID NO: 9096 - protein, 81 aa, B.fragilis
RHHTGCRTQDLSYVFKFRCCSKNNISSRMIDPYSLKKAKEDEEDKMLKEVRLPIGQVQTDIPLTCLLFKEYVPRNDQLKNR

SEQ ID NO: 9097 - protein, 329 aa, B.fragilis
LVTTRPTSLSWTSLPTIWIYKVSKSSQLPFGTIRAVYCLYHMMNILQRKPASERVSFYNFAPFKKNNPKMINTETNYRWFIFYQDQLLLEKNDNAFSIPTGKNAPVTIPEGITVHTITTATGMVCKAFYTDSPIAETPEYVQIGLRASYDYLSPEHYQAAGKVHEILYWDRSNRFCPTCGTPLVQKEPIMKKCPNCGREIYPVISTAILVLVRKEDSLLLVHARNFKGTFNSLVAGFLETGETLEECVAREVKEETGLDVKNIRYFGSQPWPYPSGLMVGFIADYAGGDIHLQDDELSSGNFYTRDHLPELPRKLSLARKMIDWWIAQQ

SEQ ID NO: 9098 - protein, 213 aa, B.fragilis
SLHQKVKPIKRNSMKEKFITLLTVASGLKGFGLKFIRVAILVVFVWIGGLKYFHYEADGIVPFVANSPFMSFFYAKDAPEYKEHKNPEGAYVPANREWHEANRTYTFSYGLGALIMSIGILVFLGIFFPKVALVGDTLAIIMTLGTLSFLVTTPEVWVPNLGSGEYGFPLLSGAGRLVIKDIVILASAVTLLSDSSQRVLNSLKKADWEKRNK

SEQ ID NO: 9099 - protein, 287 aa, B.fragilis
RISHGGLIMIRTYQTKLKGMLALTTSYHTEKSLQKEKSLYKFIWVRKGSITLEIDHQEVILAENEVISLSNLQHLEFLSIDGEYLTVLFNSNFYCIYGNDHEVSCSGFLFNGSSHVVRFMLNESERRSMEDVVGLLDREFTVSDNLQEEMLRILLKRFIIQSTRIARQRLNITQEKEYSFEIIRQYYNLVDEHFRTKKQVQDYADLLHKSPKTLSNIFSSCKLPSPLRVIHERVEAEAKRLLLYSNKSSKEIADILGFEDQSSFSRFFKNMTGESPVQYRNSVEGKN

SEQ ID NO: 9100 - protein, 478 aa, B.fragilis
GGIHMNKIKNLFVIILFALVAFSCSDILDKGPLDKYSENDVWKSTDLTQAFIYTALANATNMMVWKDNWTDNEAIMEDGRDVNAELIDRYYDAGWNKYEDIRRCNMVLARVPEAPFTNAEKANFIAQAKTIRAMIYFTRARLFGKLMLVKELIDPEADMKFPRTATVKETYDFILNDLREAAPDLPVDAPSGALSRGVAYALLGEAALHGAAYIENGQEEYYRIAAKACEDLFALDKYSLDGNYAGMFNDYDHSLASSEIILAQWRSAENTNFSDTWMQRLVPNIDPSKLIADVQAKYPLVEEMAGWPQRFPSVDLVNDYLVVDEDGKAKEWDQTSYYKKFLVDGGTVEDAIYKNRDKRFKASIVYDGCSYFANRVWLREGGNLYYTSKTTEFWGMPVSGYVYRKCVYEAKRLLNSEKTDYHYTLLRLGRSYLNYAEIKLRQGDKETAIDYINRTRVTHGGFAGIAKILITGRYLERV

SEQ ID NO: 9101 - protein, 467 aa, B.fragilis
RYILKVIRIMKQYDAIIIGFGKGGKTLTAELAKRGWKVALIERSAMMYGGTCPNIACVPTKRLIHEAEKVSWLYPTDYEKQAEAYKAAIARKNEMTAASRANMFNKLSSLPNVTIYTGMASFVSKDVVKVTLPDEVIELQGKKIFINTGSTSIIPAIDGLKDSKRVYTSTSLMELDVLPRHLIIVGGGYIGLEFASMYASFGSKVTVLEGGNKFIAREDRDIADAVKETLEKKGIEIRLNARAQSIQDTADGVTLTYTDTADGKPVTIEGDAILVATGRKPMTEGLNLQAAGVEVDSHGAIVVNGYLHTTAPNIWAMGDVKGGLQFTYISLDDYRIIRDDLFGNKERTADDRNPVAYSVFIDPPLSHVGLTEEEAIKRGYSFKVSRLPASALPRARTLQQTDGILKAIVDSHSGRIMGCTLFCAESSEVINVVNMAMKTGQHYTFLRDFIFTHPSMGEGLNDLFSID

SEQ ID NO: 9102 - protein, 299 aa, B.fragilis
MNSKLLRLIAIVTVLAFAAGAQAQRRNSRYVDYINKYSALAVQQMKEHKIPASITLAQGLLESGAGMSTLARKSNNHFGIKCGSNWNGRTVRHDDDARNECFRAYRNPRDSYEDHSAFLKRGARYAFLFKLKITDYKGWARGLKKAGYATDPSYANRLITIIEDYDLYKYDRKGGWSSSKSEPTVLNPHQVYIANGIAYIVARDGDTFKSLAKEFDIRWKKLVKYNDLQRDYTLMSGDIIYLKEKKKRASKPYTVYIVKDGDSMHTISQKFAIRLKNLYKMNRKDGDYIPEVGDRLRLR

SEQ ID NO: 9103 - protein, 300 aa, B.fragilis
KRMKDLVSGIRYDASNVISQAIGPSKEFCMGYLNPGVVGGEGYISTMKLSVGTVDVKDLDAITERIVAKDRCEKNDAYLGQVNLMKASSFCGQNGAIWGFDLAMHDDIAKRKEMPIYMQAQPEGADIPVYNIRPLLEATERLFGRAKERRFPVLPGAYVPGGSRKVVACGPVWVWSVIGLAILKDRSKGACLFVKDAGTYGDDSTTEGEAIGFLEGILRKATNSIALCGEDQDVIYDRIYIGYKYTFVEPGQVGCALSCTPAVYMAQNAIPADMKPADLCQMTISDWEEKLGLEELTIFE

SEQ ID NO: 9104 - protein, 156 aa, B.fragilis
SITNMKKLINTVLLLFLIGIVSSCLKSGLDDLEAYNEAEITNLNFEYRWWDEAKDQMAVKTLNIEKQISQDDNLITCKLTVPAAGGSFTDAVRQNVSLSNLIAYMDLSTAARITPLNGAPKLGNPGDFSAKEFKYQVTAADGTKREWTIKITDFVK

SEQ ID NO: 9105 - protein, 430 aa, B.fragilis
AVCLLICKIMITIYLKQSYNLLKENRFVNGISIAGTALSVAAVMLIYLVYQVNFSAYAPESNRYRILFVSSLQACGSDGHPINNGGMSHKVVRECLYPLQTPEAVTAFTSGDLPVNVHGQQFYDKYAIKFTDDGFWKVFDFTFLAGGPFTHTDWESGIRKAVISDKLARRLFGTVEAVGQTLRMNYADYRICGVVKEVSRAAESSYGDVWIPYTANASLLKDNISYCEGTTGEFQACILSRSRSDFEAIRREMLKLQSTFNASLTGTKLDYMHSPFTQWQAVLGTNGFSEGTVGEWLKSTGAVILFLLLLPALNIIGITLTQFRKRRSEIGVRKAFGACSFSLVEQVVIENLLTSCMGGLIGLLLSFGLLSLCKSLFFSGDVSLTHDMLIQPLTFVAAFFFTLILNLLSAAIPAWRASRMPITEALHDME

SEQ ID NO: 9106 - protein, 417 aa, B.fragilis
LYMDREIPKEVRNKERNKKIIRFSAIGIVGIIGISVLISLLRTGVQKKDLVFSTVDKGTIEVSVSASGKVVPAFEEIINSPINTRIVEVYRKGGDSVDVGTPILKLDLQSTETDYKKLLDEEEMKRYKLDQAKVNSQTKLSDMAMQIKVSEMKLARMKVELRNEQYLDSLGAGTTDKVRQAELSYNTSRLELEQLKQQYTNEKQIAAADLKVLELDLNMFRKGLAEMKRTLDDAQIRSPRKAILTYINNQIGAQIPQGGQVAIISDLSHFKVDGEIADTYGDRVAAGGKAIVKIGSEKLEGIVSSVTPLSKNGVISFSVQLKEDNNKRLRSGLKTDVYVMNAVKEDVLRIANASYYVGRGEYDLFVMTSDDEIVKRKIQLGDSNFEFVEVVSGLNPGDKVVVSDMTNYKNKNKLKVK

SEQ ID NO: 9107 - protein, 531 aa, B.fragilis
TAMCIQVQQITYIHPDKEVLFRNLSFTVGRGRQLALIGNNGCGKSTLLQIMAGKLQPSSGNVLRPDDLYYVPQHFGQYDEMSIAQALGIDRKQKALHEILNGNASIDHFNILDDDWNIEEKALAALNGWGLGNRSLSESMHTLSGGEKTRVFLAGLELQEPSAVLMDEPTNHLDNQGRNRLYEWVKKCRSTLIVVSHDRTLLNRFPETCELSRNALVCYGGNYEFYKQQKELQQNALQQQLNEKEKELRQIRKLAREVAERKEKQNIRSEKSVPKKGISRMAVHTLKDRAEKSTTKLADIHQNKSEKLTSERSLIRNRLAENTLLKTDFHASALHTGKTLLAAHKINFSYGNSPLWEVPLCFQLKSGDRIRIEGDNGSGKTTLLKLVTGDLLPTSGTLERAGFSYVYLNQEYSIICNQLTVLQQAESFNVRALPEHEIKIRLNRFLFPATSWDQPCIQLSGGEKMRLAFCCLMISNNTPDLFILDEPTNNLDIQSIEIITATVRNYTGSVLLVSHDEYFAKETGIRKSIFL

SEQ ID NO: 9108 - protein, 112 aa, B.fragilis
LMAGLPELQKSLSLEDTWKEYKRERRIELVSEGDRYWSVLRWGKADGLEVVPELIVEQKFMKIAPDGKSFEILPLPIYQSDNERTFTKKHYLFPVPQGQRDLNPNLDQNEGW

SEQ ID NO: 9109 - protein, 63 aa, B.fragilis
GLFIVLLLLISLNNIITDEGKYSQISSFIISISNPNNLNRYSYFTKSVIFIVHSLFVPSAAVT

SEQ ID NO: 9110 - protein, 194 aa, B.fragilis
IDGFFSPLVKTYTDVNGDGKIDGEDQVRIGKPTMPHFTYAFDFSLGYEGFTLSGLLYGTGERYMTFGNRYQSGEGKYLYYENQLNYWRPDNTGADFPRISISSGVNGNNNKAGSTFWMRNASYLRLKDLQLSYDFKYKYLKKCDWLQTCRVNLSGSNLFTISGVSKFFDPETSSTSGDGYPVQRVYSIGVTIGF

SEQ ID NO: 9111 - protein, 160 aa, B.fragilis
LLKLHIMIKLYLKQSWMLIRQNKLFSSLYVLGTGLAIAMTMIIAIVYYIKIAPIYPEVNRSLTMRMKGVSAMHVKGGGNSYSCSYEMLKDWFYPLQSAELVTAVNEHFLTRKGSYIQPAGGGEQIPALVKYTDPNFFRLFECELLDGSSPRGWKDPRGCY

SEQ ID NO: 9112 - protein, 155 aa, B.fragilis
KVLLKKKCTASSNPAVKTIWMLPIDAPWPMGGEIDIMERLNHDTIAYQTIHTNYTYNLGIKDNPLSHSVGAINPDDYNVYSVEMYPDSIAFYINDTHTFTYPRIETDKEGQFPFDQPFYLLIDMQLGGSWVGAVDPKELPVEMYVDWVRFYQKEK

SEQ ID NO: 9113 - protein, 71 aa, B.fragilis
TIRPILLLYLHKLKKRDDMKYICTVCDFIYDPEIGDPEGGIEPGTQFEDIPDDWVCPLCGVGKEDFEPYNG

SEQ ID NO: 9114 - protein, 423 aa, B.fragilis
AAGTCLGYQIILLIADASEVFVSLHFIVIDKVGELLLALPEIYQFGNKVDARLHGMYKTRLQRNGQTLRLTAELRALGLSVIAHPEFTQILHVMHVEPHHVSQPVRIEQSMCTLAHSVFGISLHQPESFQTFDHHTCRQVVYIHIRNTRTKCFHRLQVHGVLYLVNLALAPGKLFIGRNGRRHIACITHLRFCAGIDQEQIARLDDIAMIMVVERLSVHRSDGSKRKVTPCGMRHGFHGCRYFPLAHPGTQDLHGRNVHIRRNIAGLLDFDNLLGRLVVTLRDHRTDKRHRTLLTRGRHSQPVHQLQFMLCTVGRQVMDGLSLLYRLVQIAHNVGRRHGDVHSHPLTLFLQCGLSPHPYDMIDGQFITEYNFLIFINVDYSRKPGKRKAEVVEKGRILTIAERIVLVVQSTLVVSQKQQYSGA

SEQ ID NO: 9115 - protein, 66 aa, B.fragilis
ALSASNWGTWTITFFSVMSVEVVLLPFVPQEKAENRMKADSMNIEFLFIIMLLEFKASKLMIFTVG

SEQ ID NO: 9116 - protein, 70 aa, B.fragilis
YKEASKNQRQGEYIHLIAYYTFRRHSDTIHPNLLTRTKTQIIKQEEENAYKTHITCNKMQHRPKISNKYA

SEQ ID NO: 9117 - protein, 262 aa, B.fragilis
MKTAIKLILIYLGIQLICGGLIGIPFTIIARMNGGSVDATRVSELTLAPSMLLSMAVMFFYLWKAHYIPKDKTSWSFISFPFLIITFLIGLSMTVLMDMLTAVLSWVPDILEQQFDALQSGWLGIVAITLLGPILEELLFRGGATKALLERYSPRKAIFLSALLFGVFHLNPAQIVAAFFGGLLLAWVYYRTRSLIPCILIHIVNNSISVMLSLTYPDADTIRDVTGTTPYYLLIAVAAMVFVGCFLRIKQVTVPGTWRKDE

SEQ ID NO: 9118 - protein, 140 aa, B.fragilis
RNHQHQPQQPQSAGAAHEPRLHGDGRGTYEEQGQPIERIERGHDVPQAEDGRRTRLHRRREATPEYIDDHHAGHHRPATPLLPRRRRVIAPPDDSEGRGGTHRAGHLDHLTRQQQQIRANELRHLSPEVLLQRRIHHRRR

SEQ ID NO: 9119 - protein, 217 aa, B.fragilis
IISHNMKRRLNILCLLVFLVFCYSVFNMGRDFGHGFSEGMKISHSGNQSVEQAINFRIATLMPKDFSSFKDSVYNEKTGSYVPVAYTQMVTNVKVDRSTWMMVAQVISGLLAVFAIIASTVLFIQLIVAINKSDIFNWKNVRRLRWLGVALLLNFISEAVPALMNDYELSSVFSLSGYSMETSIDSVMLVILGLVSLIVGEVFAIGLKMKEEQDLTI

SEQ ID NO: 9120 - protein, 304 aa, B.fragilis
MNLQFPPFLHEGDKVAIVSPSSKIDSIFLKGAKTRLSSWGLTPVMGDHVRSSWGSYAGATHQRLKDFQVAMDDEEIKAILCSRGGYGAVHLLDKLDFTRFRNHPKWLIGFSDITALHNLFQYNGFASLHAPMARHLAVTGEEDPCSLYLRDILFGKLPGYKCHRHKLNHLGQAKGILRGGNMAVFHGLRGTPYDIPPEGTILFIEDVGERPYAIERMMYNLKLGGVLEKLSGLIIGQFTEYKEDYSLKKDLYSTLDALVKEYDFPICYDFPVGHVTENLPLINGAEVEFVSGKKGVELLINPPI

SEQ ID NO: 9121 - protein, 64 aa, B.fragilis
FNPHSSFPRNNSTPEPNVFFSRALRCVYVSLLNIMVYIKVMMAKIGTKDELTKEIKQIRFTAEQ

SEQ ID NO: 9122 - protein, 610 aa, B.fragilis
SGFKHILSRYFFRGETLSDGKLQQHFSFGIEYFHLKYVLLLFNHHYRCTFHAITATDNHREVIAKAAFGMIGIFMCMRVKADIERCFLQKFTPKPGTQILVVVSVKRNVMNQNPLSGFLKFFGSELTLQKSYLVITQLRKVVESVVYPMIIRLIFTAIEHYDTGISPVEGAVSLIAYIIEQAVQAYRIGIPDLVITAHKEDRYAITLHAFGQFADKGCCLIVIGGVVYTIAVEHYKIIVNPLYLFAQCLKRLRLFMQVVEHHGRKTVITGCGQRELPEFCTGCIAKHLFVGLVKQDLLRTGTIIIFLSGLQTIEANLVKSIATNNLTIQKGTCALQIGRVRAVLHPAIGRHVGLPHHRDSTSYGILKIGFGTANPILGYRHPYFYHKRTMIGRQRLIDHRGRVDNKSRRFLFQSNQVVERLLRFGSRISELLRVGKYLECTLQIFDKAGVGIRVEVTGKEERFPGIGCNGLQDFERLHPILFGQRKVRTRKDILRELGDKQRACLFTSRKGEGLHTERSLFRKYTDAILSSVIIDGRRKAGMQLSAFRQFLENIGPVAPGSHAVQFLDGNDVRTGVVDHIGYTLIIAYTVHAIGVTDVVGHQAQHIFSLG

SEQ ID NO: 9123 - protein, 646 aa, B.fragilis
TMRKLKNVLRASSCCAFSILMCLPAAGQNAWSEADCVTLLDSTSVTVQPNGSGSFAVYKSFKVQTPKGAVNNHVIKYDYDPLTAFARFKQVTVQRANGETMQVDVTKTCDYAAPARAIYWGARQIMLELGRLEPGDVVSYEISKKGFTYALLAGAEDDDARFIPPMRGQFYDIVPFWVNEPTRRKVYVVSMPMEKELQFQFYNGVCTSSMRYEDGRKVYTFAVDEVLPFRKEPNMVDLFDEAPKLMMSSTPKWEDKSLWFHDLNEAYGSFAALPEAQKKVDELIKGKKTEMERIAVLTHWVADNIRYAGITMGEGEGFTLHNTKMNYTDRCGVCKDIAGTLISFLRMAGFEAYPAMTMAGSRIESIPADHFNHCVAVVKLANGTYMPLDPTWVPFCRELWSSAEQQQNYLPGIPGGSDLCLTPVSAPENHYVRITADNKIDAKGTLKGSFTITAEGQSDSSIRRIFTQGWQTEWQSTMESQLLNVSPKARMLGVDYGKAPKDYQAGPIRITFRYEIPDYALVGDRELLLKPMVMNNLYTSVLSFLRIDTGLETRQYGFRDACSRLVELDETIALPRGYRLAGEPRSEQKAAPAADFEGSLQQVGNKLVLKQKLALKKRIYRAADWEGFRAAVNAYKSFADYLIVKL

SEQ ID NO: 9124 - protein, 188 aa, B.fragilis
SVVKLIHSISLSINLKSRINMTPIVSIIMGSTSDLPVMEKAAQLLNDLHVPFEMNALSAHRTPEAVEEFAKNARSRGIKVIIAAAGMAAHLPGVIAASTPLPVIGVPIKSSLDGMDALLAIVQMPPGIPVATVGINGALNAAILAVQMLSLEDKELEAKFIAYKEGLKKKIVKANEELKEIKYEFKTN

SEQ ID NO: 9125 - protein, 157 aa, B.fragilis
SYKNMSGLYYNLALRNSDLRDKDSEKLYYCVLKNRGVLDQDTFVNYLSQITGIKEAICLGVLSKLGAAVINYLKDGQSVDIPHLGTFNLTASSTGVKTLDEAKASQIKAINLRFSAKEETDLVLSRCALTRSVSLTNTNDVIKEKDPSGEIVDDPTA

SEQ ID NO: 9126 - protein, 214 aa, B.fragilis
AFKNRIEMKRKGIKNLIFDFGGVLINLDRQRCIENFRKLGLEKVDELLGMYSQQGIFMQHEKGLISSAQFRDSIRGQITQEVTDEQIDAAWNSFLVDIPRFKLDMLLKLREKYVVYLLSNTNEIHWKWACEHAFPYRGFRVEDYFEKMYLSYEMKMVKPAEEIFRGVLDDANLDPRETFFIDDSEANCQGAQALGISTYTVKPGEDWRPLFAEN

SEQ ID NO: 9127 - protein, 612 aa, B.fragilis
GGTLMRKLLLLLFSALFVLSAQAEDVLRLMTYNVRNANGMDGICNYQRVANVINNARPDIVAIQELDSMTARSNRTDVLKELAERTQLHPCFAPAIDYDGGKYGIGILSKETPLRVQTFALPGREEARTLLVAEFPEYVFACTHLSLTEEDRMKSLEILKSVAANTRKPFFLAGDFNSDADSGFIKDLKSTFQILSNPKQLTYPASEPKETLDYLIALKQETPTFVVNSAPVIDEPLASDHRPFVVEVRMAVPENRICRTKPYLQNPVRGGITVMWQTNVPAYCWVEYGTDPSNLKRARTLLDGQVVCGNTLHKIRLDSLQPGQKYYYRTCSQEILLYQAYKKVFGNTARTELREFTLPAAGDDSFTAVVFNDLHKQSKTFQALCEQIKGIDYDFVVFNGDCVDDPANHDQATAFISELTEGVEGDRVPVFFMRGNHEIRNAYSVGLHSLFDYVGDKTYGSFNWGDTRIVMLDCGEDKPDDHWVYYGLNDFTKLRNDQVGFLKRELASKEFKKAAKRILIHHIPLYGNDYENLCSGLWGKLLEKAPFNISLNAHTHEYAYHPKGSLGNNFPVIIGGGYSMKSATVMVIEKKKDILKVKVLNTKGEVLLELTV

SEQ ID NO: 9128 - protein, 559 aa, B.fragilis
REMKQMLQIYCKNNNISKEFPIGSSLLDIYYGFNLNFPYQVVSAKVNNRSEGLNFRVYNNKDVEFLDVRDSSGMRTYVRSLCFVLYKAVSELFPNGKLFVEHPVSKGYFCNLRIGRPVTLEDVSQIKKRMQEIIAEDITYHRIECHTTEAVRVFSERGMNDKVKLLESSGSIYTYYYTLGGTADYYYGNLLPSTGFIHLFDLVKYYDGLLLRIPNKENPSVLEDVVKQEKMLDVFKEHLRWNYIMGLNNVGDFNIACEEGHATDLINVAEALQEKKIAQIADSIFHRGENGTRVKLVLISGPSSSGKTTFSKRLSIQLMTNGLKPYPISLDNYFVDREDTPLDENGNYDYESLYALDLELFNTQLQALLRGEEVELPRYNFMLGKKEYKGDKLRIDEHTVLILEGIHALNPELTPQIPAANKFKIYVSALTTISLDDHNWIPTTDNRLLRRIIRDFNYRGYSAQETISRWPSVRAGEDKWIFPYQENADVMFNSALLFEFAVLRCHAEPILTSVPRNCPEYAEAYRLLKFIKYFTPVQDKEIPPTSLLREFLGGSSFKY

SEQ ID NO: 9129 - protein, 333 aa, B.fragilis
NPVKTGGRFLPRIKINRRNSMQIIRNIPGVLPEPCVATIGFFDGVHMGHRFLIEQVRELAAARGLRSALITFPIHPRKVMNADYRPELLTTSEEKLALLEETGVDYCFMLDFTREVSHLTAHEFMSDILRDRYRVQILVIGYDHRFGHNRSEGFEDYCRYGSEMGIEVIRARACVCDDLHISSSVIRKMLHQGEVDRAARCLGYDYFLDGTVVSGYQVGRKIGFPTANLSVDDPDKLVPADGVYAVHVTFDGHTYNGMLNIGTRPTIGNGPERSIEVNILHFHSDIYDKFIRLSFVKYLRPELKFDGIEGLIAQLHQDAADVEALLGKIQNVN

SEQ ID NO: 9130 - protein, 185 aa, B.fragilis
SPGEDQMFLNPVNREKYPAFVLVPQCPEKDYWAYTSRPSSFIPSEMPVGQEITPVLRAVKELLDTYLDLPQVDRNRIYVVGLSMGGMATYDLAVRFPDTFAAAVPICGTVNPVRLADAANVRFRIFHGDADNVVPVEGSRGAYKALKNLGAEVEYIEFPGCNHGSWNPAFNYPGFMEWVFAQRKR

SEQ ID NO: 9131 - protein, 526 aa, B.fragilis
LCHCLKPNRMKISTLILTILVCFSTIVDAQGTQNRANELMKQAQSSLEQKEYTKARYLFIQAYGAFATQENYPKAVECGIQGAALYHRENYYKEAFDLCRGMDQLVWAGEQKQQKQFYPLRFQITKERLQMYIGLKNAAQAKIQLDKLAETVGLAKNDSLSENLLYTQASYYYTFGQNTQGDACFQKLINQYKAQKNYDKVNECYKKLIAIGRKSNNASLVARTYENFIVWTDSVKAMTAQDELNVLKRKYDESQQIIQEKEDTLSGKQYMIVGLCTLVVILIAGLIFVAIVLLRFIAGNRKLKKSVQIANEHNELKTQFIQNISAQMEPTLDTLASSAAELSDKAPQQAQQMQGQVAALKKFSNDIQELSTLENSLTEPYEMKEINVNTFCEATMDKVKEFVQPEVSTVVNAAKLQIKTNPEQLERILIHLLKNAAEYTESGKIFLDFKKRGAHTHQFIISDTGTGIPVEKQENLFKPFTEIKDLTEGDGLGLPICALIATKMNGSLTLDTSYTKGSRFVLELHT

SEQ ID NO: 9132 - protein, 562 aa, B.fragilis
FNVCICMTAKNDDYFHLGLTDQEVLQSREKYGANLLTPPKRPSLLKLYLEKFEDPVVRVLLIAAVFSLIISVIENEYAETIGIIAAILLATGIGFYFEYDANKKFDLLNAVNEETLVKVIRNGRIQEIPRKDVVVGDIVVLETGEEIPADGELIEAISLQVNESNLTGEPVINKTIIEADFDEEATYASNLVMRGTTVVDGHGSMKVLRVGDATEIGKVARQSTEQTTEPTPLNIQLTKLANLIGKIGFTVAGLAFLIFFIKDVVLYFDFGALNGWHDWLPVLERTLKYFMMAVTLIVVAVPEGLPMSVTLSLALNMRRMLATNNLVRKMHACETMGAITVICTDKTGTLTQNLMQVHEPNFYGLKDGGKLTDDDISRLIAEGISANSTAFLEETGKGEKPKGVGNPTEVALLLWLNSQKRNYLELREGARVLDQLTFSTERKFMATLVKSPLIGKKVLYIKGAPEIVLGKCKEVILDGRRVDSVEYRSTVEAQLLGYQNMAMRTLGFAFRLVEDNEPDDCVALVSENNLNFLGVVAISRPIRSDVPAAVAKCHREVLVSRL

SEQ ID NO: 9133 - protein, 575 aa, B.fragilis
TMMWQIVLSLVCVAFLGAILWEKRQGKLMQSASDRKLENVNCLFDAILTHIHAYVLVIDSDFKVLKTNYYDLTHLSPDGKEKRVGDLLQCRNALSAKGGCGTHAFCQECPVRGAIGNAFRQKKEFTDLQSSLNIAIDEHEFVKCDVMISGVFMTLDSEERMVLTVHDITSIKQTEEALAEAKEKAENADRSKSAFLANMSHEIRTPLNAIVGFSELLAAANTEEEKQKYLEILHTNSELLLQLVNDILDLSKIEAGTLEFVYSDVDINLLLNDLEQLFRMKIGSNSPVQIITESGLPSCMVHTDRNRIAQVVSNFVSNAIKFTTEGSIRIGYQSSENGLRFYVSDTGSGISADKLEGVFDRFVRLQSDKNGNGLGLSICKTIVNKLGGEIGAESEVGKGSTFWFTLPEHSDIKPKVIIEKEQEELPSAVRVPVIDAGSDKKLSILVAEDMEDNYRLCEAILASRYELHWAHNGEEAISLFLKFQPDIILMDIRMPEVNGYEATEAIRQMSATVPIIALTAFAYEEDRQKIMHSGFTDFPDEAHFVKSTVGKTGILKKDLRNILYRIYVVLLQLLI

SEQ ID NO: 9134 - protein, 90 aa, B.fragilis
AGIRWNGLQTISGDPWKEDVSKLAFTTDYTNVYRWILLSINRLSSSCEVLYHSVVSYGIPPFCRSRSVELLSCASLPMQLCGETGFRDIF

SEQ ID NO: 9135 - protein, 515 aa, B.fragilis
RKNRRERGRHGGGVPERYSRPLPWRDGYCSAVNLICFISFVNSSFVPIFAIITLIYTIMFSKETYTQRRALLKKTLGSGVLLFLGNDECGLNYEDNTFRYRQDSTFLYYFGLSFAGLSAIIDIDEDKEIIFGDELTIDHIVWMGTQPTLKEKSERVGVDITMPSADIVSYLHKAVQKGQAIHYLPPYRAEHKLKLMDWLGVPSARQEGSVPFIRAVIAQRNYKSSEEIVEIEKACDITADMHITAMKILRPGMREWEVSAAMEAVAHAAGGDLSFATIATVNGQTLHNHYHGNIVKPGDLFLIDAGAETEMGYAGDMSSTVPADKKFTRRQREVYEIQNAMHLESVKALRPGIPYMDVYDLSARVMVEGLKGLGLMKGNAEDAVREGAHALFYPHGLGHMMGLDVHDMENLGELWVGYNGQPKSTQFGRKSQRLAIPLEPGFVHTVEPGIYFIPELIDLWKGQKKFTDFINYDKVETYKDFGGIRNEEDYLITETGARRLGKKIPLTPDEVEALR

SEQ ID NO: 9136 - protein, 496 aa, B.fragilis
SIKRMAQGSRQIQSQAQQQIQTLSPQQILVVKLLELPAVELEDRVHAELLENPALEEGKEESTSDETTPAETSEGETEGDTDYDSLSDYLTEDDIPDYKLQENNRSKGEQAEEIPFSDATSFYEILREQLGERNLTEHQRELAEYLIGSLDDDGLLRKSLESIGDELAIYAGINATEEELEEALRIVQDFDPPGLGARSLQECLLIQIRRKKQSHCTDPLLETEEEIISECYEEFTRKHWEKIIKKLGLDEEHFYKALEEITKLNPRPGASLGEAIGRNLQQIVPDFIVDTYDDGTINISLNNRNLPELRMSRDFTEMVEEHTKNKANQSKESKEAMMFLKQKMDAAQGFIDAVKQRQNTLMTTMQAIIDLQRPFFLEGDESLLRPMILKDVAERTGLDISTISRVSNSKYVQTNYGIYPLKFFFSDGYTTEDGEEMSVREIRKILKECIDSEDKKKPLTDDELAEILKEKGYPIARRTVAKYRQQLNIPVARLRK

SEQ ID NO: 9137 - protein, 80 aa, B.fragilis
KINRIMAIIVNLDIMMARRKISLGELAEKIDITPANLSILKTGKAKAIRFSTLEAICRVLDCQPGDILEYQVDEEDGGTS

SEQ ID NO: 9138 - protein, 490 aa, B.fragilis
KKLSTSLKQTKKMDLFNYSRRETSEVNIGAVPLGGPNPIRIQSMTNTPTQDTEACVAQAKRIVDAGGEYVRLTTQGVKEAENLMNINIGLRSTGYMVPLVADVHFSPKVADVAAQYAEKVRINPGNYVDPGRTFKQLEYTDEEYAAELQKIRDRFVPFLNICKENHTAVRIGVNHGSLSDRIMSRYGDTPEGMVESCMEFLRICVDEKFTDVVISIKASNTVVMVKTVRLLVSVMEQEGMSFPLHLGVTEAGDGEDGRIKSALGIGALLADGLGDTIRVSLSEEPEAEIPVARKLVDYITSRRNHPYIPGMEAPDFNYLSPVRRKTRPVRNIGGDHLPVVLADRMDGRMETHPQFTPDYIYAGRALPEQTEPGVQYILDADVWKGEPDTWPAFNYAQLELMVTCVAELKFLFYPLHGAYRGSCRMPEATPRSSRCLTKQPPEPCRRTSCPGTSTDGGGITESGYLLPTLCRRYSRRLAGQSRCGYGSLDL

SEQ ID NO: 9139 - protein, 224 aa, B.fragilis
RSTRSASPFPGGQHLEYALNNHKAKASVTESEGMKQVSWTLKNLPALSREPQVSVIGGDLPLLTATTEEKPLSFLTSQWQPEGDAGIRALAGKLTAGAKDDKEKVTAIRDYVIDNLYYSSLPLAESGYRIRPAAEVIRSAYGTEAEKANLMAALLKAAGLKAGIGAVCAPSENTASLGVGSIRDTICVDQRRRQPTGSVSERQNSLSRFVAERLCLCSFIDAAV

SEQ ID NO: 9140 - protein, 389 aa, B.fragilis
LSGGTCDREPTTNQRCGSGVRIRKERSGIVNKPSYLTHPTVKIINFEALNSKSIIMKRNSMFILSAFILFSAFSCGTNGSKTTSTDITEKKVIVQVPQFDADSAYKYIQAQVDFGPRTPNSKGHVACGDYLAAKLAEHGAKVISQNAELPAYDGTLLKARNIIGSFKPESKKRIALFAHWDTRPWADNDPNEKNHHTPILGANDGASGVGVLLEIARQINQQQPELGIDIIFLDAEDYGAPQFYTGEHREDQWCLGAQYWARTPHVDGYNARFGILLDMVGGKDATFFKEVYSEKYAKGINKKVWKKANDAGYGRYFINEVGGQITDDHLFINRLAGIPTIDIIPNDENCELSSFGPTWHTVNDNMDAIDRSTLKAVGQTVLEVIYNEK

SEQ ID NO: 9141 - protein, 348 aa, B.fragilis
MPSGSFGIKIVTGDTPGTATEIARQIGLWKPEDTERNRITGVAFAELSDEEALDRVMDLKIMSRARPTDKQRLVQLLQQKGAVVAVTGDGTNDAPALNHAQVGLSMGTGTSVAKEASDITLLDDSFNSIGTAVMWGRSLYKNIQRFIVFQLTINFVALLIVLLGSIVGTELPLTVTQMLWVNLIMDTFAALALASIPPSESVMNDKPRRSTDFIISKAMQHNIFGVGTLFLVVLMAMIYYFTNADGGMTVQRLTIFFTFFVMLQFWNLFNARVFGTTDSAFKGLTKSYGMELIVLAILGGQFLIVQFGGAVFRTEPLDWQTWLIIIGSSSLVLWIGELIRLVKRLTQK

SEQ ID NO: 9142 - protein, 145 aa, B.fragilis
LFIMSINELQDEVVAEFSDFDDWMDRYQLLIDLGNEQEPLDEKYKTEQNLIEGCQSRVWLQADEVDGKIIFKAESDALIVKGIIALLIKVVSGHTPDEILNSELYFIDRIGLKDHLSPTRSNGLLSMVKQMRMYALAFKAKEAKG

SEQ ID NO: 9143 - protein, 130 aa, B.fragilis
KLIIMNFPQNVKYTNEHEWIRLEGDVAYVGITDYAQEQLGDIVFVDIPTEGETLEAGEVFGTIEVVKTISDLFLPVAGEVVEQNPALEENPELVNKDPYGEGWLIKMKPANAADLDNLLDAEGYKAVVNA

SEQ ID NO: 9144 - protein, 180 aa, B.fragilis
SSHMTKIYTLLLLCLFALTLPVTAREAEFKKIKESWTLQADGTQVYRQSKVLTLYTHTAMNRTYGESFITYDPRYQTLQIHESYTRQKDGNIVKTPANALVEVLPSAAANAPAFNALREMVVVHTGLELGATIYLDYSITTKPGYLPGIQICRLLEHSSPVKEYEISITVPRGATSGICP

SEQ ID NO: 9145 - protein, 235 aa, B.fragilis
KSIIKETNKMAEEEKIEQHIIADRTLIRTARIISGILTPFSIPFLAFLVLFLFSYLRIMPLQYKLIVLGIVYCFTILMPTMTIFLFRKVNGFARQDLSDRKKRYVPILLTIISYVFCLMMMHKLNIPWYMTGIILASLVVLVICIIVNLKWKLSEHMAGMGGIVGGLVSFSALFSYNPVWWLCLFILVAGILGSARIILQHHTLGEVLAGFTVGFVCSLLVLHPLSNVLFRIFLF

SEQ ID NO: 9146 - protein, 230 aa, B.fragilis
NSSFTLYMALTGEVVACLKQHPEAVVVSQSNHPNRVGEHRALAHQLTVEGLQNPVIFFQHYAEDTAEDLQVKAGADMGALIFDGLCDGIYLFNQGKLSHAVIDATAFGILQAGRIRTSKTEYISCPGCGRTLFNLQSTIARVKEATSHLKGLKIGIMGCIVNGPGEMADADYGYVGAGRGKISLYKQKECIEKNIPEEEAVEKLIELIKANGDYEEKTSSLSSPKEKEDK

SEQ ID NO: 9147 - protein, 145 aa, B.fragilis
VNLSPVTVRKVYALQPDAANAKDGYVVFTLPVERGSLADSQYVRFNSKRTSNLLLPGLAGESFTYTIDTPAGMEPVTRPMEKKMDNAVGTLTISIRPEGAKTRVIRSLKLKKQMIRPADYAAFRQLMTEYGAVDGLTLVYRKPLP

SEQ ID NO: 9148 - protein, 565 aa, B.fragilis
TEYSFYDFLKLIGSLGLFLYGMKIMSEGLQKVAGDRLRGILTAMTTNRVTGVLTGVLITALIQSSSATTVMVVSFVNAGLLTLAESISVIMGANIGTTVTAWIISIFGFKVDMAAFALPLLAIALPLIFSGKSNRKSIGEFIFGFSFLFMGLSYLKANAPDLNANPEMLAFVQNYTDMGFFSVLLFLFIGTILTMIVQASAATMAITLIMCANGWISLELGAALVLGENIGTTITANLAALTANSQAKRAALAHFVFNVFGVIWVLIIFHPFMVFVNWVVDTFFHPGSAEVAISYKLSAFHSIFNICNVCLLIWGVKLIERTVCAIIRPKEEDEEPRLRFITGGMLSTAELSILQARKEIHLFSERIHRMFGMVQDLLHTEKDDDFNKLFSRIEKYENISDNMELEIANYLNQVSEGRLSSESKLQIRAMLREVTEIESIGDSCYNLARTISRKRQTNQDFTEKQYEHIHFMMKLTNDALSQMIVVVEKPEHQSIDVNKSFNIENEINNYRNQLKNQNILDVNNKEYDYQMGVYYMDIIAECEKLGDYVVNVVEASSDVKEKKAS

SEQ ID NO: 9149 - protein, 551 aa, B.fragilis
MICSFFFIYFCPLRILIINLTIMKRKATLLFLVTFVLLLGAVAQEKLKTVIEPLQNERWWGGFVALGNQMPFNDHLRMQDMSRNNMNNQVVPFMLSSEGRYIWAENPFCFEVKDGQLIIYSDSEKIEPVKAGTTLKEALLAASAKHFPPSGKIPEPTFFSLPQYNTWIELMYDQNQEDIMNYAHKAVENGFPQGVFMVDDNWQRYYGNFDFKTERFPDPKGMTDELHRMGFKVMLWVAPYVSPDSPEFRELEAKGYLLKDKNGRTAIIHWWNGYSACYDTTNPEAMNYLKEQLKANQEKYGIDGFKFDGGDVAYMTGEYTFHDKNANVNTFMEKWAEIGLSFPYNELRASWKLGGQALVQRLGDKDYSWRATQLLIPDMTAAGLLGHYYTCPDMVGGGQFGAFLNVKKFDEELIVRSCQVHALMPMMQFSVAPWRILSKENVAICAKYAHLHQQMGDYILELAKHASKTGEPIVRHMEYQYPHQGFIDCKDQFMLGDKYLVAPMLTSGTSRTVMLPKGRWKDDRGKVFKGPRTMTIDVPLERLPYFEKLTK

SEQ ID NO: 9150 - protein, 108 aa, B.fragilis
FVPLHRFKRKALLNRSFGEVAEWSIAAVLKTVVLRGTRGSNPCLSAINAENQQIIKQTPNFIPKNVKLGVFILFKTNHIRSENNLIKNRTNEKNNQFIFRKISYLCSK

SEQ ID NO: 9151 - protein, 72 aa, B.fragilis
ITISKKNAEICDIHEKLSTHIARHSYATSISLTNGVSMENLAKILGHTDTSITRTLCTGAGPKYYGRYTESK

SEQ ID NO: 9152 - protein, 464 aa, B.fragilis
GPASVFLKKFINNSDSFCVSPYFGVICGHETIQTYMEFLVIILLLVLNGIFAMYEIALVSSSKARLETLVSKGNKSARGVLKQLEEPEKFLSTIQIGITLIGIVSGAFGGVAIADDVTPLFAMIPGAEVYAKDLAMITTVIVITYLSLIIGELVPKSIALSNPERYATLLSPVMILLTKISFPFVWLLSISTRLLNKLIGLKSEERLMTQEELKMILHQSFDQGVIDKEKTEMLRDVFRFSDKRANELMTHRRDLVVLHTTDSKEKVLQIIDNEHFSKYLLIDDDTDEIAGVVSVKDIILMIGSEQEFNLREIARPALFIPESLYAKKVLELFKKNKNKFGVVVNEYGSTEGIITLHDLTESIFGDILEEDDTEEEEIVRRQDGSLLVEASMNIGDFMEEMGILSYDDIESEDFTTLGGLAMFLIGRIPKAGDIFTYKNLQFEVVDMDRGRVDKLLVIKREEEE

SEQ ID NO: 9153 - protein, 97 aa, B.fragilis
YSQSMRFYFNDLFSALPHIQHNSLSRHNLYFVQQIPRVNRPQERGYSQGKKSYDNIHNKNVYVDPLPHKYIHYHKPHISKTLYHHLHYVPNDERQTK

SEQ ID NO: 9154 - protein, 469 aa, B.fragilis
NCKSLIIIYYLKRRVNLNLSEYLLLFQILGVYLGVEFQTHPIMNIKRNIIFALESRKKNGVPIVENVPIRMRVIYASQRIEFTTGYRIDVAKWDADKQRVKNGCTNKLKQSASEINADLLKYYAEIQNVFKEFEVQETIPTTQQLKDAFNLRMKDTSEEQQEETQISFWEVFDEFVKECGNQNNWTASTYEKFSAVKNHLKEFKEDVTFEYFNEFGLNEYVNFLRDKKDMRNSTIGKQMGFLKWFLRWSFKKGHHQNIAYDTFKPKLKTTSKKVIFLTWDELNRLKDYRIPKDKQYLERVRDVFLFCCFTSLRYSDVRNLKRSDVKPDHIEVTTVKTADSLIIELNDHSKTILEKYKEVHFENHMALPVISNQKMNDYLKELGELAEINEPVRETYYKGNERIDEVTPKYALLTTHAGRRTFICNALALGIPAQVVMKWTGHSDYKAMKPYIDIADDIKANAMNKFNQL

SEQ ID NO: 9155 - protein, 713 aa, B.fragilis
LRKSRWQMQRLFLLRLQIPPICPIIMHIWLIWNSKPYKRIVTMKQILHILLIALMLMGFYSCVPKTELASPDGHIKVAFTADTDGKMMYRVTVNDTLLLDNSPLGFEAKEGIDLNRGFRVVNTVFTDKDEIWTQPWGENKTNRNHYNEMAVLLKNAANVELTLRFRAFDDGVAFRYEYEVPGVDSLLITDELTAFHFHEDGTSWSIPASFETYELLYSKQKISEVENANTPFTFKTSGGVYGSIHEAALYDFPEMTLKKDGENTLKSELASWPDGIKARKENRFTTAWRTIQIAPQAVGLINSSLILNLNEPCKLDTTDWIKPMKYVGVWWGMHLGVETWKMDDRHGATTANAKKYIDFAHANNIEGVLFEGWNEGWESWGGMQSFDFTKPYADFDMDEITRYAREKNVQIIGHHETGGNIPNYERQMEKAIKWYTDKGIHILKTGYAGAFPDGHSHHGQYGVNHYQKVVETAARYRMTLDAHEPIKDTGIRRTWPNMMTREGARGMEWNAWSEGNPPSHHEMLPFTRLLGGPMDYTPGTFDILFTQTKDSPKRQKWNDQDKGNSRVNTTLAKQLANWVILYSPLQMASDMIEHYEGHPAFQFFRDFDPDCDESRALAGEPGEFVAVVRKAKQNYFLGASTNEEPRVLPVSLDFLEKGKIYKAIIYADGEKADWKTNPTEYQITEQEVTADDTLNIRMAAGGGQAISFMPLQK

SEQ ID NO: 9156 - protein, 620 aa, B.fragilis
LKMSIMDNKGFYIKAILATGTKVQDSRVDFNKGCNLIHGQSDTGKSVVFSIIQYLLGQEDPPKEATEGKEYDTFYMQICMYFNDEDVYTIQRKLTDKTKVYVKHCSIDQIHDMHIKQEIYSVKSSEKPSSYSSFLLKLCGFDNTIKIKQKDSKFSNLYYTQLRHLLMLGEQRIVDDRSIFLPSGIPSDVTKEKSVISYLYSGEGDPEIDGLEDKKLRKARITGKIEYVQEEIKRLDQTIEDIGDVSFAGLEEALNVNKIKSEIKNAAQRLDILYKQKHTKNEELDKWQSKILFEQELYNRLLLLKSHYELDIERYKGIEEARELLSILTYRECPKCHTKLQTDSFDLEDEQFIAAIEQESFSDQCKLRSLNEYIKEKKAYLKKCKEKIDKLEIENISINNQISETEPRLTSFRDLLKRIELNWEKKTRLKHLEEDSFRLTKELSELKKSLTNKQVLTIPSRNKLPAKEFYDTVKEKMVAWNLENHETIVMNLDDFDFTLGGKRRITCGKGYRGITATAIMMSLVEDCIYRNVPFTRLLVTDSPITAHFGKEDKKTDADDLEENVQRSFFQYMEDKNWNYQLIMMDNKHPYTDQKKIMKNIHFIEFSETGRKGFYVGKRKE

SEQ ID NO: 9157 - protein, 74 aa, B.fragilis
HPSSIRLLMLGMSALGTLYAPQPSNAINTTCFACRLAAQATLQNPIASKHTKTNNFFMVFYLYLSFVFCVSSIL

SEQ ID NO: 9158 - protein, 169 aa, B.fragilis
QLTFYINLKHLTMKKVIMLAAVVAALVSCQSKGTKAEEAVADSLAVAMEPTMEETQVYEGVLPAADGPGIRYVLTLNTLANATDTTYTLDVTYLDAEGKGKDKTFTSKGKPVKVEKTVKDKKKTAIKLNPSDGSEPVYFVIANDTTLTLADDSLEVSESDLNYNIIRVK

SEQ ID NO: 9159 - protein, 391 aa, B.fragilis
QLMFNQTNLKFREMKKSIFMFALATLMSASVFAQDNDAKRLPGYKTTFEGNGFWNNWFMSANFGAQSLFAENSKDAKFRNTITFMPTLSVGKWFNPYWGVRLQGTGGSLHGFTSGANSMLHYQYGAVHADFMFGLINFFAPYKENRRFDIVPFAGIGGAFIRKGDQSFTINAGIQARYRISKRFDINVEYQGAILDDDMVVRGGFPNDGISGLTAGVTFRFGKTGFKKGYSSRQYNAIKSNYSDLEANYATLKKENAAQQAEIAELKARKPEIVKEETIIDNSEIKALPSTITFPFNSSKIELSQEVSIFNIAEFLKANPEIRVRLTGYADKRGSEQANRIVSERRANAVTEVFVNKYGIAKDRITTEFKGTSTKFENDDWNRAVVVELIK

SEQ ID NO: 9160 - protein, 167 aa, B.fragilis
TPDPSSDARAVPIYQTTSYVFRDSAHAAARFGLQDPGNIYGRLTNSTQGVLEERIAALEGGVGGLAVASGAAAVTYAIENITRSGDHIVAAKTIYGGTYNLLAHTLPAYGVTTTFVDPSDLFNFERAIRENTKAIFIETLGNPNSNIIDMDAVAAIAHKYRIPADCG

SEQ ID NO: 9161 - protein, 60 aa, B.fragilis
SYLPLLFSWIMRLLLSICHSERIGRNRAGYYDVAMGKQKNPYTGTYFKDSSLYYRQEQSA

SEQ ID NO: 9162 - protein, 68 aa, B.fragilis
YNSPGKTTNLYHPFFIKLYQYNTRKEAPKTFIPDASRPLIYNLNTSIASHINLSQQTRYNYPESDSLF

SEQ ID NO: 9163 - protein, 332 aa, B.fragilis
IIKPMKRIYLLLAILLGSLQLANAQQQTLQFNKDGKFKIVQFTDVHYIYNDPRSDVSIERINQVLDMEKPDLVLFTGDVIYGKPAEEGMRTVLNLVSKRKIPFAVTFGNHDNEQGLSREELLKIIQSVPFNLTQTTPGISGVTNFILPVKASDGKRNATVLYCIDSHSYSQIKGVNGYDYIKFDQIQWYRENSKKFTEENNGVPVSSYAFFHIALPEYNQAASSESAILYGIRKEKACAPQLNSGLFAAMKEMGDVRGVFVGHDHDDDYAVSWKGILLAYGRYTGGNTVYNHLTNGARVIELDENANSFRTWIRLKEGVVQQVTYPADFIKE

SEQ ID NO: 9164 - protein, 257 aa, B.fragilis
LPLPINIGFPLIVDNTFGTPYLIRPIEHGADIVVHSATKFIGGHGSSLGGVIVDSGKFDWVASGKFPQLTEPDASYHGVRFVDAAGAAAYIVRIRAVLLRDTGAAISPFNAFILLQGLETLSLRVERHVANALKVIDFLVNHPKVAAVNHPSLPGHPDHAIYQRYFPGGAGSIFTFEVKGGTEEAQKFIDSLQIFSLLANVADVKSLVIHPATTTHSQLNAQELEEQGIKPGTVRLSIGTEHIEDIIDDLRQALEKI

SEQ ID NO: 9165 - protein, 64 aa, B.fragilis
RQYTEKQTNGKVIPQTNCPDFIHKHIIFYFTKLCIFTKSDNLKINEEIFATNKNYLYFCDRFAN

SEQ ID NO: 9166 - protein, 60 aa, B.fragilis
GPFTQNSPMCDTSKTPTLLQTVRCSSMIPEYSIGMLYPANSCILAPSAICFSVNGVVFMK

SEQ ID NO: 9167 - protein, 445 aa, B.fragilis
NFPTKIADKNERRNHFYITLHRIHKVYRTGPMKKNVLFLLLLGLLTTVSAQPTHRIKGTVIDKASRQPLEFINVLVLGLGRGGVTDAEGHFNIGEVPPGIYRLQASAVGYKTILTPEYIVSTKDLTIQIETEENLTELEGVTVTASPFRRDPESPVGLRIIGLQEIEKSPGANRDISRIVQSYPGVAFSPAGYRNDLIVRGGSPSENRFYLDGVEIPNINHFSTQGASGGPVGIINADLIREVNFYTGAFPTDRGNAMSSVLDFKLRDGDMERNSLKATLGASEVSLASNGHIGKKTSYLVSVRQSYLQFLFDMLGLPFLPTFTDAQFKLKTRFNANNELTILGLGGIDNMKLNTKLDGEKAEYILSYLPKIQQETFTLGAVYRHYAGIHVQSVVVSHSYLNNRNTKYLNNDESSADNLSLKLRSVEQETKFRIENTSTFGKLEN

SEQ ID NO: 9168 - protein, 234 aa, B.fragilis
KTLTRYWHIIKKCDICGMIQIETILDILVKGFVIGIVVSAPLGPVGVLCIQRTLNKGRWYGFVTGLGASLSDIAYALLTGYGMSFVFDYINKNIFYLQLLGSIMLLAFGIYTFRSNPVQSIRPVSANKGSYFHNFITAFAVTLSNPLIIFLFIGLFARFAFVQPGVLVFEEITGYLAIALGALAWWFGITFFVNKVRTRFNLRGIWILNRVIGSIVMAVSVFGLIFTLLGESIY

SEQ ID NO: 9169 - protein, 103 aa, B.fragilis
KKGTISLQKQPPLRDLGYKIFLLSIRLRSQYYIVILTFIIETFGKSEYRKNLSYIIVRTKSTGKTVLLQLCIRNNEMNIKMFFKTLHYFLKCGLFEFQFSVNP

SEQ ID NO: 9170 - protein, 106 aa, B.fragilis
IDWTMTNLQELLLKPVWQMTGEEFIFLSKYASNQTEAQPQPVTDTERKYVYGILGIAKLFGCSLPTANRIKKSGKIDKAITQIGRKIIVDAELALELAGKKTGGRK

SEQ ID NO: 9171 - protein, 442 aa, B.fragilis
IIFATTINIRMENNREYHIGRTDFDAFVHAVGSEIEQAQVRLIAAANAQMLFHYWKMGNYILYHQNLQGWGSKIIKQLAKAIRFNYPEKKGYSERNLTYMCQFARSYPLNVLRSFIDTDTRLSVPSIQNVTDEVLKLNNGQFTQELTAQIQSADCQSLEITQEVPAQIQDVEKTVSAIYRMEIREIEKVFLKSPVAKINWASQMVILNGSLPLGIGYWYMKQAVEMGWSSNVLKMQIENNLYNRQINNNKVNNFTATLPAPQSDLANYLLKDPYIFDLAGAKEKADERDIEEQLVKHVTRYLLEMGNGFAFVARQKHFQIGNSDFFADLILYSIPLHAYIVVELKATPFKPEYAGQLNFYINVVDDKLRGKNDNKTIGLLLCKGKDEVVAQYALTGYDQPIGISDYQLSKAIPENLKSALPSVEEVEEELASFLDKDNNPQN

SEQ ID NO: 9172 - protein, 268 aa, B.fragilis
DNSATYTGLCLGHLPKKVFFLSEMSQQFVEDYMFWLLTKKGCSHNTSTKYLKNFKKIILLSLAKGWLKKDPFAEYKFTLEAVDRDFLEDSEIQKILSKEIAISRLVQVRDTFIFCCFTGLAFSDVKQLKQEDIVEDSNGVKWIRKERQKTKIICNIPLRDIPLQILKKYENNPQCVIKGVLLPILCNQKMNAYLKELGDICGVNKTITMHTARHTFATYALANGVSMESVAKMLGHTNLQMTRHYARTLDRIVVKELFQIKDNFEMAN

SEQ ID NO: 9173 - protein, 75 aa, B.fragilis
SADAIQFAGYLDFEPGDWQYRDGSIRVRTHIHFAGRIYLLIGEKTEDENSATTQGEEHCRIPYLYVADRGFDPCQ

SEQ ID NO: 9174 - protein, 331 aa, B.fragilis
GLSALPLFLCWLLSRPEAIIGNISATIVGKLSKSRLRNSTLLLWKRKIEKTNSKKHRLKMKRRNLFLACLLLFVLPLSAARVDTLMVKSPSMNKEVQVLVVTPDVALGKNAAACPVLYLLHGYGGHAKTWIQIKPNLPEIADEKGIIFVCPDGKDSWYWDSPKNPAYRYETFVSSELVNYIDRNYKTIADRKGRAITGLSMGGHGAMWLGIRHKDVFGAAGSTSGGVDIRPFPKNWSMNKQLGELASNKRIWDEHTVVNQLDKIQNGDLALIIDCGEDDFFLNVNKDFHDRLLGRKIDHDFITRPGEHNGKYWNNSIDYQILFFSKFFAGE

SEQ ID NO: 9175 - protein, 62 aa, B.fragilis
MVKAIPIIIKGRGIKNKAAIANETIVTVSCLDTREVNNSEYGSELVSTSLRSASCPITKAVF

SEQ ID NO: 9176 - protein, 431 aa, B.fragilis; identical to SEQ ID NO: 6067

SEQ ID NO: 9177 - protein, 746 aa, B.fragilis
LINFMELNKTFKDGLWSKEINVRDFVSNNITPYKGDASFLQGPTERTKAVWNHCLKALEEERNNNGIRALDYTTVSTITSHPAGYIDKENELIVGLQTDQVLKRAIKPFGGINVVMKACRENGVEVDDRVKDIFTHYRKTHNDGVFDVYTEEIRSFRSLGFLTGLPDNYARGRIIGDYRRLALYGLDRLIEAKKEDLHNLTGPMTEARIRLREEVAEQIKALKEIKVLGEYYGLDLSRPAYTAQEAVQWVYMAYLAAVKEQDGAAMSLGNVSSFLDIYLEYELSQGTITETFAQELIDQFVIKLRMVRHLRMQSYNDIFAGDPTWVTESIGGRFNDGRTKVTKTSFRFLQTLYNLGPSPEPNMTVLWSPELPEGFKAFCAQVSIDTSSVQYENDDLMREVRQSDDYGIACCVSYQEIGKQIQFFGARANLAKALLLAINGGRCENTGTVMVKDIPVLTGETLKFEEVMANYKKVLIQIARVYNEAMNIIHYMHDKYYYEKAQMAFVDTDPRINLAYGVAGLSIAIDSLSAIKYAHVKARRNDIGLTEGFDIEGAFPCFGNDDDRVDHLGVDLVYFFSEELKKLPVYKNARPTLSLLTITSNVMYGKKTGATPDGRAKGIAFAPGANPMHGRDKNGAIASLSSVAKLRYRDSQDGISNTFSIVPKSLGATQEDRIDNLVTMMDGYFTKGAHHLNVNVLNREMLQDAMEHPEKYPQLTIRVSGYAVNFVKLSREHQLEVISRSFHERM

SEQ ID NO: 9178 - protein, 1111 aa, B.fragilis
KHFLIKKKNKMKKSVKHKFQYLLFFLLSMPAFIFASAQDIRVNIDFTKASLGSVLNEIGRQTSLSIVYNTGDVNPTQPVSIKASNENITTVMNRLLRGTGLSYSIMNKHLILSTTDKNHSIQQEKVTVTGNISDAKGEPLIGVSILVKGTSNGTITDMNGHFSLPVAKGDVIEISYIGYAPQAITVTDSKPLKIVMKEDAEVLDEVVVTALGIKRAQKALSYNVQQVGGDAINTVKDANFINSLQGKVAGVTINNSAGGVGSASRVVMRGTKSITKDNNALYVIDGIPMFNVSFGKSEGSFATQSGSDGVADLNPDDIESINMLTGPSAAALYGNAAANGVVLINTKKGSAEKTTLTVSNNTMFSDAYMMPEMQNRYGNNPGEFASWGNKTKQSYDPSRFFNTGVNVINAISFSTGTKKNQTYASASTTNATGILPNNSYSRYNFSIRNTATFLKDRLTLDVGASYIIQNDKNITAQGQYFNPLPALYLFPRNDNFEEIRMFERYSESRGVNVQFWPYGHQGLSLQNPYWIMKRMNRKTEKKRYMINASLTYKLTDWLNVAGRVKVDNSDIRMTQERYASTLTTFAGANGFYSDQNRTDRNTYADMMVNIDKRIGDFSLNANIGASIKDLVYEQMGNEGDLAGIPNFFTVRNINYESNYKPKQFGYHDQSQGVFANIELGWRSMAYLTLTGRNDWESQLAFTKHSSFFYPSIGGSVVLSEMFRLPEFISYAKLRGSYSSVASSFERYLSNPGFEFNEQSHQWGSSTTLPATNLKPEDTRSWEIGLNARLWNHFSIDATYYHSNTYNQTFNITLASSSGYSSAIVQTGNIQNYGLELALGYNNTWGDFSWNSSLTYTMNRNKVKRLASGATNPITGEIIDMPELRMAVLGADGYGPRVILREGGTMGDLYVDKGLRTDGNGNIWVDSQTGKVGVQDYAEPKKIGTMNPDFNMGFSNTFSYKGINLGVVLTARVGGLCVSNTQGILDYYGVSKATADARDAGGVWINNGFVDAKSYYQTIGGSTGGLGQYYTYSATNIRLSELNLSYTLPRKWFNNKVGITAGIVGKNLWMIYCKAPFDPEMTPSTTSNFYQGVDYFMQPSTRNIGFNVKFQF

SEQ ID NO: 9179 - protein, 68 aa, B.fragilis
MKSYRLPCFVCPVPDKWGVAFVLIPFSSFSCQKEKNIPWGVTGSFAVQVKREERRCRNRAFFPQKAGF

SEQ ID NO: 9180 - protein, 76 aa, B.fragilis
AFHYYLLPSNQKVNAYLKEITDICDIHKNLTFRVARHMMATTICLANGMLIESLSKVLGWSNIKTLNFMLRLLMKS

SEQ ID NO: 9181 - protein, 79 aa, B.fragilis
RIILPQLDKLRESLNEVAKSLREILHKIQVSTASKVYSDCLLSVRLGELSGTSFSNAKNMINSLPSLRIVLFTIPFSTK

SEQ ID NO: 9182 - protein, 130 aa, B.fragilis
YKTYLIMKRKLFFMSCIAFPLFYSACTLKVEKCPAIQENAIPHSKTSREEHEAKSITLHEKLHATFSVSRSDKPSYPNYYGGAFIGDNGRLIVLVKEDLSLKGGLEKTLKVIVFSSSSLRLFLSRTIGFQ

SEQ ID NO: 9183 - protein, 394 aa, B.fragilis
VPGYCLRTMSRCPSRFEKIVYGFANKRSRHMIFNREEQHLMLEGSVLSKEDVKRLVACHTEEASGFLYELYRFLEEWFSDSPYLTVKTSGSTGTPKLLKVRKEQMMQSARLTCEFLGLRQGDSVLLCMPLQYIAGKMVVVRALVAGLNLVIRTPSGHPMADVDIPLRFAAMVPLQVYNTLQVSAEKERLCRTDILIIGGGAIDAGLEAEIRQLPVKVYSTYGMTETLSHIALRQLNGPDASMLYRPFPSVRLSLSSEHTLVIDAPLVCDTTLVTNDVAEIYPDGSFSILGRKDNTINTGGIKVQAEQIEEILRPWMRVPFAITSVPDARLGEAVVLLVEKGADAELPETKMKELLSKYQLPKMILSVGAIPLTETGKINRAACRQLALTYRTDR

SEQ ID NO: 9184 - protein, 70 aa, B.fragilis
CFSLKALQRYESFFNLQIIPQKNIRKVYLEVITALWLLPINRYFYAIQHKIGPFYIPKPKKGCKFARSKG

SEQ ID NO: 9185 - protein, 354 aa, B.fragilis
TVLYVTVYDIGIKDLVKTMDETKLLNYLKGESDAEECLEVEAWYHASAEHKKQLDQLYYMLFVGERKVAMDGVDTENSLSVLKDRIKHKESEKKSVHRIRVSKWKRYAMPLAAFLCGLLVSVGALYWISSGKSAGYIFATESGQRAQAVLPDGTKVWLNASTQIVYKPSFWKRERQVDLSGEAYFEVSRNKTKPFVVNSNDVRTCVLGTKFNVRARPSEEKVVTTLLKGSVKVQLPGQSEEEGILLKPGQMLSVDTRTMQPMLTEANRPGDVLLWINGKLKFEQATLQEIVQCLEKHFDVHFIISDAQLQKDRFTCTFSTDDDIRQILSILALTKRFDYKCEDNNIILTPKTNR

SEQ ID NO: 9186 - protein, 833 aa, B.fragilis
FMIYPQNFEQKIGFDQIRQLLKDKCLSTLGEERVNEMNFSDHFEEVDELLNQVAEFVRIIQEEDNFPDQFFFDVRPSLKRIRIEGMYMDEQELFDLRRSLETIRDIIRFLQRNDEEESDCPYPSLKKLAGDITVFPQLITKIDGILNKYGKIKDNASTELSRIRRELANTMGSISRSLNSILRNAQSEGYVDKDVAPTMRDGRLVIPVAPGLKRKIKGIVHDESASGKTVFIEPAEVVEANNRIRELEGDERREIIRILTEFSNTLRPSIPEILQSYEFLAEIDFIRAKSHFAIQTNSIKPSLENEQLLDWTMAVHPLLQLSLAKHGKKVVPLDIELNLKRRILIISGPNAGGKSVCLKTVGLLQYMLQCGMLVPMHERSHVGLFGSIFIDIGDEQSIEDDLSTYSSHLTNMKIMMKNCNERSLILIDEFGGGTEPQIGGAIAEAVLKRFNIKGTFGVITTHYQNLKHFAEDHEGVVNGAMLYDRHLMQALFQLQIGNPGSSFAVEIARKIGLPEDVIADASEIVGSEYINADKYLQDIVRDKRYWEGKRQTIRQREKHMEETIARYQAEMEELQKSRKEIIRQAKEEAERLLQESNARIENTIRTIKEAQAEKEKTRLVRQELADFRESIDNLTSKEQEDKIARKMEKLKEKQNRKKEKKQNGTKEQPAVQQTPKATPITEGCPVRIKGQSSVGEVLEINGKNAVVAFGSIKTTVKTERLERSNAVPQKQESAKSSFVSNQTQDSMYEKKLNFKQDIDVRGMRGDEALQAVTYFVDDAILVGMSRVRILHGTGTGILRTLIRQYLQTIPGVRHFADEHIQLGGAGITVVDLA

SEQ ID NO: 9187 - protein, 512 aa, B.fragilis
SCPYFTSFSGGTFEKVISRRNLCQHESFLYFCAIFLKTTSKKNHMGGFFGTVSKTSCVTDLFYGTDYNSHLGTKRGGLATYSEEQGFIRSIHNLQSSYFRTKFEEELDKFKGNAGIGIISDTDAQPIIINSHLGRFAIVTVAKVTNLKELEEELLSQNMHFAELSSGSTNQTELIALLIIQGKNFVEGIENVYNHIKGSCSMLLLTEDGVIAARDKWGRTPIVIGKKEGAYAATSESNSFPNLDFEIERYLGPGEIVRMHADRLEQLRKPDDKMQICSFLWVYYGFPNSCYEGRNVEEVRFTSGLKMGEQDDCDADCVCGIPDSGIGQALGYAEGKGIPYHRAITKYTPTWPRSFTPSKQELRSLVAKMKLIPNRAMLQDKRIIFCDDSIVRGTQLHDNVKILFDYGAKEVHMRIGCPPLIYGCPFIGFTASKSDMELITRQIIKELEGDENKNLDKYATTGSPEYEKMVGIIAKRFGLSSLKFNTIETLIEAIGLPKCKVCTHCFDGSSCF

SEQ ID NO: 9188 - protein, 526 aa, B.fragilis
IIHLKSIFDIMLDSAIKEQLRTIFAALEANYTFDITVSPQHESRTELLELLNDVASCSEKLSCRINEGKGLEFTLLKGEHRTGITFRAVPNGHEFSSLLLAILNTDGKGKNFPDEGICNRVKSLKGPVRLTTYVSLTCTNCPDVVQALNAMTTLNGQIQHQTVDGAINQAEVEALKIQGVPSVFADGKLIHVGRGDFGELLAKLEEQYGTETNSAETSIKKYDVIVAGGGPAGSAAAIYSARKGLNVAVIAERIGGQVKETVGIENLISVPSTTGSQLADNLKTHMSQYPIDLLEHRQIEKIELDGKDKVLTAKGGERFSAPAVIVATGASWRKLNVPGEAEYIGRGVAFCPHCDGPFYKGKQVAVVGGGNSGIEAAIDLAGICSKVTVLEFMDELKADQVLQEKLKSLPNVEVLVHSQTTEVVGNGDKVTGIRVKDRKTEEERVISLDGIFVQIGLVANSGIFRDVVEVNRPGEIVIDAHCRTNVPGIYAAGDVSTVPYKQIIIAMGEGAKAALAAFEDRMRGEI

SEQ ID NO: 9189 - protein, 282 aa, B.fragilis
ILNLETTILLTIKTHKMKKRIVFIAALLCGMCFTTASAQFKIGGKKINVGKVVQAGSDAAKAITLSDSDIAAMSKEYMQWMDTHNPLTAADSEYGKRLEKLTGHIKEVDGLKVNFGVYEVVDVNAFACGDGSVRICAGLMDIMTDDEVMAVVGHEIGHVIHTDSKDAMKSAYLRSAVKNAAGAASSTVSKLTDSELGAMAEALAGAQYSQKQESEADDYGFEFSIKHNIDPYAMYNALNKLLELSAEAPKESKFQKMFSSHPDTAKRVARAKEKADNYTKNK

SEQ ID NO: 9190 - protein, 874 aa, B.fragilis
DRTHNGKTNLPSNPRYEMKTPKILKVHLLLYLFCLSVSAQTTDSIVQKLSQYAYLIDNFSKYIPQEKVYMQFDNTSYYQGDNIWFKCFLVTSDLHPATDLSKTLYVELLNPGGEVIDKRTLKIENGQCHGDFTLGQLPFYSGFYEIRAYTKYMLNFGGDIIFSRLLPVFDKPKAEGDFTEKEMRKYATGNYPLERPKPTKSKKVNLKFFPEGGNLVRGIESEVAFEATDTYGNPITLTGIVINEEKQETARFNVTHDGRGIFNYTPTGEKQKAIVEFNGKKHQFNMPEALPEGYTLHADNLSYTDSIEIAVQKNSNTPSDVLGLAVISGGKLYKFCLIDVEGNETIRFKIDKSKLVPGVSRIALFNSNGEVLSDRLIFTYPKEQLSVQVQADKETYDPYELVNLEFTLTGKEKIPVQTPFALSVRDGMNEVESGHNMLTDLLLMSEIKGYVNNPQYYFESRDDTRRKAIDLLLRVQGWRRYSWKQMTGIESLDLKYGPEQGIETRGQVVSFVRQLPKPNVEVSCFLKKRGENEENSSFIEAITTDSLGHFSLISDIYGKWDLILAVTVNRKKKDYRILLDRLFSPAPRKYHYADMQVSIANAEKEKELMPEVETTPLPEEDIEAFFAAYADSLAKADNHEKNYRLKEVTIKAKKRTKEKEIYESRSKSIAYYDVHSELDDIKDSGKFIGDDIHELMMNMNKNFSPVSGRNYLYYKSKMPLFVINYERTRHTEMDYNKYKYIRLEAIKSIYITENLSTICQYADPRLTPFDVSDLYSCAVLIETYPEGKIPTEAGKGVRKTWLDGYSQVKEFYHPNYSVLPPVPDYRRTLYWNPSVTPNKEGKAHIRFYNNSRCRKLKISAETITTNGLIGTYGN

SEQ ID NO: 9191 - protein, 95 aa, B.fragilis
LACHRSQEHNNNQITFAGCTDGQKDYTLILYYEINRIVCCMLFVISCLGKSQPKQQSADLYRLPLCNECVKNEIYCALTLMGSVEVDDLNENTNK

SEQ ID NO: 9192 - protein, 64 aa, B.fragilis
SICLYTQTYYFLSNIILGYVYEIFLFQNNLYFCLYRLLYLHYILISTFFDFLELIFICIFDLYI

SEQ ID NO: 9193 - protein, 322 aa, B.fragilis
TYRLMDIQTAKQIKIADYLHSLGFSPVKQQGINLWYKSPLREETEASFKVNTERNQWYDFALGKGGNIIALAQELYCSDHVPYLLQKIEEQTPRIRPVSFSFGKQSSSEPSFQQLEIVPLSSPALLAYLQERGINIAMAKRECSEAHFTHNGKRYFAIAFPNVSGGYEIRNQYFKGCIAPKEISHIKQPGTARETCYVFEGFMDYLSFLTLRLENCPKYPELDRQDYMVLNSVANVSKAIYPLGSYERIHCFFDNDRAGMEAMQQIYKEYGRDLYIRDASQTYSGCKDLNEYLQKQTERNRQVQSAKGVRSQPPKKKNGFRL

SEQ ID NO: 9194 - protein, 106 aa, B.fragilis
QKLHNYQNIRQIKENKTIGSGDFQYIKNACKLLTYRRLHHLAERQGFEPRVPRSTTVFKTAAIDHSATSPELRLSSAFLLKRCKGTNHFLTCKLFRKKILEKYIWK

SEQ ID NO: 9195 - protein, 186 aa, B.fragilis
EKRQKMKIAQQLKEKNIAEYLIYMWQIEDLIRANDCDVDRIEENIVSRYQVSDEERRELTEWYANLASMMREEGVREKGHLQINRNVIINLTELHAALLASPKFPFYSSAYFKALPFIVELRNKNGQKEEPELETCFEALYGMMLLRLQKKPVSPETTKAMEAISSFLSMLANYYDKDRKGELKLE

SEQ ID NO: 9196 - protein, 72 aa, B.fragilis
VSMQFKEQKLFFNTHTNSVNLLTKEKYENLLIFRISANRTLRLPIRFVIVGSFRYHQNYTTFIKKATTKSIF

SEQ ID NO: 9197 - protein, 83 aa, B.fragilis; identical to SEQ ID NO: 6082

SEQ ID NO: 9198 - protein, 65 aa, B.fragilis
KSRQYTDFRKIKDKVNYPVYRGKCKLQMLDIQLDIAEDRFPVSPLKTKKQSYKSLNFNNSRTFFF

SEQ ID NO: 9199 - protein, 310 aa, B.fragilis
RKFKKMDIAALLSGGVDSSVVVHLLCEQGYKPTLFYIKIGMDGAEYMDCSAEEDIELSTAIARRYGLALEVVDLHREYWDNVAAYAIEKIRKGQTPNPDVMCNKLIKFGCFEQQVGKDFDLTATGHYATTLQLGGKTWLGTAKDPIKDQTDFLAQIDYLQVSKLLFPIGGLMKHEVREIALQAGLPSACRKDSQGICFLGKINYNDFVRRFLGEKEGAVIEFETGKKIGTHRGYWFHTIGQRKGLGLGGGPWFVVKKDIQDNIIYVSHGYDAEQQYGYEFRMKDSNFITDNPREGSTVEEDALIEYPLYT

SEQ ID NO: 9200 - protein, 358 aa, B.fragilis
SLHNDIVFFELILYFFFLSGTKIRHKMIRVKLKISIFALIDSISLINQRTMTIQQLEYILAVDQFRHFAKAAEYCRVTQPTLSAMIQKLEDELGVKLFDRSMTPVCPTAIGKKVLEQARKILSEVICVKEIISEEQHSLSGTFRLAVLPTIAPYLLPRFFPQLMEKYPDLDIRVMEMKTPDIRKALLTGEADAAIIASMLDDAALTEETLFYEQFLGYVSKKEPLFKHDVIRTSDVTGERLWLLDEGHCFRDQLVRFCQMEAVKISQMAYRLGSMETFMHMVESGKGITFIPELAVMQLSEEQKELVRPFAIPRPTRQIVLVTRKDFIRTSLLQVLKEEIQAAVPKEMLTLQAVQCLV

SEQ ID NO: 9201 - protein, 308 aa, B.fragilis
LMNKKPISPVCWVPTVYFAMGLPFVALSMVSVLMFSDMEVSNAQIAFWTSLIMLPWTLKPLWSPFLEMFKTKKYFVVATEIITGLAFALVALSLPLPDFFRYAIALMGIIALSGATHDIAGDGVYLTELTATQQAKYIGWQGAFYNLAKILANGGLVWLAGMLKDEFGVVHAWMIVMLMCAGIMILIGLYHIRILPSGGGASGEVNTMSDALNMLWEVIRSFFQKKHIAFYHAFIIWYPVAQGICHQDGTVVPENVGCRMGIGTQHSGYRTGIWYVRSGSFYSRFAFGRLLHFGFRTSEDFVFFMLRF

SEQ ID NO: 9202 - protein, 165 aa, B.fragilis
LFDNLKKERTMKRISFLLAALLMMGGMVMAQGPRRGGQDMDPKTRAERMTERMAKEYSLNETQKKELLEVNMAFVQKMGERPGRMKPEMRQGKKGQSQATDSCTCKQDRRKAPRMSKEDREKMRQEMKASRESYEAGLKKIMTKDQYAAYTKKQAEREQRRGGGR

SEQ ID NO: 9203 - protein, 532 aa, B.fragilis
FFILNSRNMADNTEILRRRTFAIIAHPDAGKTSLTEKLLLFGGQIQVAGAVKSNKIKKTATSDWMEIEKQRGISVTTSVMEFDYRDYKINILDTPGHQDFAEDTYRTLTAVDSVIIVVDGAKGVETQTRKLMEVCRMRNTPVIIFVNKMDREGKDPFDLLDELEEELMIQVRPLSWPIEQGPRFKGVYNIYEQKLDLYQPSKQVVTEKVEIDIHSDELDRQIGDTLADKLRGDLELIEGVYPEFDVETYLQGECAPVFFGSALNNFGVQELLNCFVEIAPAPRPVHAEEREVIPEEPKFTGFIFKITANIDPNHRSCVAFCKICSGKFVRNAPYLHVRHGKTMRFSSPTQFMAQRKTTIDEAWAGDIIGLPDNGTFKIGDTLTEGEQLHFRGLPSFSPEMFKYIENADPMKQKQLAKGIDQLMDEGVAQLFVNQFNGRKIIGTVGQLQFEVIQYRLLNEYNASCRWEPLSLYKACWIESDDLEELEAFKKRKYQYMAKDREGRDVFLADSNYVLQMAQMDFKNIRFHFTSEF

SEQ ID NO: 9204 - protein, 257 aa, B.fragilis
DKTNKKLMKKFNLITFAVILMLLPILQSCLDDANNDEWVTCPPGGILAIGTMKIPNADTPRDFFIALDNGDNVLPADTADIRNRKYTVAEGQRVFVGYLQMGEEKPGYENGKIFTIEDILTKEIIPLTEATADSIGDDRINVTAHALTKDYLTIEYQYLGSMNENKKHMLNLVQNEITGPIKDDGYIYLEFRHNAFNDSPNQLGSSLVSFKLDSIAEQLATAKGIKLRVNTIYDNIQYVTIDINEDKNLKIKSFHSQ

SEQ ID NO: 9205 - protein, 417 aa, B.fragilis
DFSKLLNFKDMNLVERFLKYVSFDTQSDELTRLTPSTPGQMVFAEYLKSELESLGLEDITLDENGYLFATLPANTEKELPVIGFIAHMDTSPDMSGKNVTPRIVEKYDGSDIVLCVEENIVLSPSQFPELLDHKGEDLIVTNGKTLLGADDKAGIAEIVSAVVYLQEHPEIKHGKIRIGFNPDEEIGEGAHKFDVQKFGCEWAYTMDGGEVGELEFENFNAAAAKITFKGRNVHPGYAKHKMINSIRIANQFITMLPRHETPEHTSGYEGFYHLIGIQGDVEQSTVSYIIRDHDRNKFEDRKKEIEHLVNKINAEFGEGTATLELRDQYYNMREKIEPVMHIIDTAFAAMEAVGVKPNVKPIRGGTDGAQLSFKGLPCPNIFAGGLNFHGRYEFVPIQNMEKAMKVIVKIAELVASK

SEQ ID NO: 9206 - protein, 339 aa, B.fragilis
IKLNYSVAELRIMFKNRSMKKSRRKRLVILCIALVCIIVLVFLLFSKSTSNNSTNPPLTDVLTDSISRIVSACPGEIGVAIIINNTDTVKVNDKSVYPMMSVFKVHQALALCNDFDNKGISLDTLVKIDRNRLDSKTWSPMMKDYSELVISLTVRDLLRYTIAQSDNNASNLMFKDMVNVAQTDSFIATLIPRSSFQIAYTEEEMSADHDRAYFNYTSPLGAAMLMNRLFTESIVSGEKQSFIKNTLKECVTGTDRIVAPLLDKERVSIAHKTGSGYVNENGILAAHNDVAYICLPNNVCYTLAIFVKDFKGNESQASQYVAHISEVVYSLLIQNSAIP

SEQ ID NO: 9207 - protein, 186 aa, B.fragilis
KIQKEPFSLFIPKSFPFLSRYLQCEIVPKLIIDTKKITIMKKILSILVLAIAAVQFAFAGDIITKDAMKLPLPARNFINRHFSNPQISHIKIENEILQTKKYDVLLTNATEIDFDNRGNWIEVDCKKAAVPATIVPDFVKEYMKANGYHSEFVTQIERDRKGYEVELNTDLSLKFTKDGKFRKAEH

SEQ ID NO: 9208 - protein, 164 aa, B.fragilis
LKKNNIIMKTLNYTHLEEKGANTIVLSLQQLLADFQIHYANLRGFHWNIKGHGFFVLHSKFEDLYNGAAEKVDEIAERILMLGGTPANKYSDYLKMAQIKEVDGVNKADDALNHILETYGHLIAEERKILSLASSHNDEVTVAMMSDYLKEQEKMVWMLTAYNG

SEQ ID NO: 9209 - protein, 769 aa, B.fragilis
LTENTNFAFDLNSIRMSQLPTLIADLALILICAGIMTLLFKKLKQPLVLGYVVAGFLASPHMPYTPSVMDVANIKTWADIGVIFLLFALGLEFSFKKIVKVGGTAVIAACTIIFCMILLGIAVGMGFGWQRMDSLFLGGMIAMSSTTIIYKAFDDLGLRKKQFTGLVLSILILEDILAIVLMVMLSTMAVSNNFEGTEMLGSIGKLLFFLILWFVVGIYAIPEFLKRCRKLMSEETLLIVSLALCFGMVAIAANTGFSAAFGAFIMGSILAETIEAESIDRLVKPVKDLFGAIFFVSVGMMVDPAMIIEYAVPIIVITLAVILGQAFFGTMGVMLAGQPLKTAMQCGFSLTQIGEFAFIIASLGLSLHVTSDFLYPIVVAVSVITTFLTPYMIRVAEPASNFVDRKLPESWRRFLMRYTTGTRTVNHESLWRKLLFALARILVVYSIVSISVITLSFRFVVPLLREHLPGIWGPLAGAVFTILCISPFLRAIMVKKNHSVEFITLWNDNRVNRGPLVSTVVFRVAVSVLFVMFVITRLFKASVGLMFGVALLLVILMILSRQLKKQSILIERKFFQNLRSRDMRAEYLGEKKPAYAGRLLSRDLHLTDFEIPGESAWAGKTLLELNLGKKYGVHVVSILRGKRRINIPGGSIRLFPMDKIQVIGTDDQLNTFAEEMSHVAVIDSGVFEKSEMTLKQLLIDTDSAFLGKTLRESGIRDKYHCLIAGVERGGEALMTPDVNVPFEEGDVVWVVGENEDVYRLIGQNCDRKR

SEQ ID NO: 9210 - protein, 301 aa, B.fragilis
NTMKKLFVLVCLLAIGFCNVAWAAKRQAKHVVLIALDGWGAYSVPKADIPNIKSLMDEGCYTLHKRSVFPSSSAINWASMFMGVGTELHGYTEWGSRTPEIPSRVVNEHGISPTIFSVMRQQYPEAETGCLYEWEGIKYLVDTLALSYHAQASDYDKYPTALCEMAEKYIKDKKPAMLAVCFDQLDHTGHAVGHDTPGYYEKLKELDGYVGRIIAAIKEAGIYDDTIIMMTADHGGIKKGHGGITLQEVEIPFIIAGKNVRKGGEFQESMMQFDTAATMGYVFGVKQPQVWIGRPMIQVFK

SEQ ID NO: 9211 - protein, 395 aa, B.fragilis
SNQNNESCCKMTLKNLIMKRITIKQYLLACFVLPMILAGCNDADYQVIDNAIYLNEASENGSAKVTVDPENVTTTTLTVRVGQPVTENVTAVLTVDPSILKEYNEANETSYEVLPEQYFTYDKEIKIAAGDVSAIPSEFRVKPYSNENGELYAIPVSLTEIQGPVSTIGLSSKFIILLDKPLIQSVPFMNTTNAVKPAKDELWGVTTNEWSLEAWVQMDGFDINNQAIFNSGSSDHEVYIRFGDAMIPYNSLQVKTLGSQVNTVTLFEKNKWYHLAFVYNSSGLLSIYINGVLDVTLQTKGGPVRFDKMNMVSSGSYFRNNCQMAQVRLWKSAISQTQIQSNMYFAVKPADPNLIGYWKMDEGKGNAFVDCTGHGYDLVAGGTLVWKEHVRFDKQ

SEQ ID NO: 9212 - protein, 246 aa, B.fragilis
REKKMKKRYLNIVVFALFVSMLWGCSDWTKPEAEDFFEMPGNDYYENLRAYKRSEHSVAFGWFGGWTGVGASMVGSLMGLPDSVDFVSIWGNWKNLDEARMLDKKKVKEQKGTRALMCFIVANVGDQLTPEEHKENYKEYWGWKDGDQEAIDGAIRKYANAICDSIDKYGYDGFDIDYEPNYGSPGNLASYPENMLTFVKALGERIGPKSGTGRLLVIDGEPQSIHPETGPYFDYFIVQAYSNPCG

SEQ ID NO: 9213 - protein, 357 aa, B.fragilis
KKKNMKNNLLSERLVYNGESQTPTHLHLCTYNALVMQEVSGVNFQTVANSLNREQINWLQVHGLQNTEVIREICSHFEIDFLILQDILNAEHPTKIEEHDKYTVLIMKLFRFNNKEEKSPEDELDELEQQQVCIIQGSNFVLTFLENETDFFDDVTSALHNDVLKIRGRQSDYLLSVLLNSIMGNYIATVSTIDDSLEDLEEELLTISDGNDIGIQIQALRRQYMLMKKAILPLKEQYVKLLRAENSLMHKVNRAFFNDVNDHLQFVLQTIEICRETLSSLVDLYISNNDLRMNDIMKRLTIVSTIFIPLTFLVGVWGMNFKIMPELDWRYGYVYAWILMLLVGGAVYWFFRKKKWY

SEQ ID NO: 9214 - protein, 190 aa, B.fragilis
SMENGIKKILRDKYGLFEKDIEILLEKFTKFSVPKREIILQEGQTDHYIYFVEKGIVKSTILREGREFIIFFALENDVPLSSPNLTESRQSLYTLEAVDTCILWRISRKDLATSFKDSLNLSNWGRMILQEWLTSSAFYFSSIHWMSKKEQYQYLLKEMPKLIQRLSMRDLSAWLDITPQSLSRIRADMH

SEQ ID NO: 9215 - protein, 66 aa, B.fragilis
VRWNPRTRLLEIFESTDHSIHARGSTSLDHSFLYYPHYLVSYTRILFPTAFNLGCSRGVHPLSVPC

SEQ ID NO: 9216 - protein, 374 aa, B.fragilis
TGWKENRRTKITGGVLMDYMKDIKEISAEEAVILWQASRLSLSKIYEKAPEILKVQGSVIGTLGNFSASIGKAKSKKTFNVSAIVAAALKNGTVLRYVAELPEEKRKILYVDTEQSPYHCLKVMKRILRMAGLPDDRDNEHLEFLALRKYTPEQRIRIVEQAIYNTPDIGLVIIDGIRDMVYDINSPGESTRIISKLMQWTDDRQIHIHTILHQNKGDENARGHIGTELNNKAETVLLVEKDKSNGDISNVSAMHIRAMDFEPFSFRINDNAIPELLEGYKPETKKPGRPEEEKFDPYRHITEQQHRIALEAVFGLKEEYGYKELEDTLIKTYVSVGVKLNHKKAVSLITMLRNKRMIVQENGRKYTFMPDFHY

SEQ ID NO: 9217 - protein, 423 aa, B.fragilis
IFYLCNLNKKLEVMKYKLLVLDVDGTLLNDEKEITPRTLATLLKVQQMGVHIVLASGRPTYGILPLAKKLELGNYGGYILSYNGAQVINAKNGEVLLERRINPEMLPYLEKKARKNGFAIFTYTEDRMIADQADNEHILQEAFLNRMELIEEPEFSVAVDFAPSKCMLVSDDEEALIGLEEHWKKRLNGALDVFRSEPYFLEVLPCGIDKSTSLGALLSHLDITPEEIIVIGDGVCDVSMIQFAGLGIAMGNAQDSVKVCADVVTASNEEDGVALAVEKAILSEIRPAEIPLDQLNERARHALMGNLGIQYTYASEDRVEATMPVDERTRQPFGILHGGATLALAETVAGLGSMILCQPDEIVVGMQVSGNHMSSAHEGDTVRAVGTIIHKGRSSHVWNVDVFTSTDKLVSSIRVVNSILKKR

SEQ ID NO: 9218 - protein, 346 aa, B.fragilis
YKFDKMKKIIFMTLFLLVAMTGQSKGKGEFTVLQWNVWQEGTMVPGGYDAIVNEIVRLQPDFVTFSEVRNYHNTRFNERIVASLKEKGLDYYSFYTYDTGLLSKHPITDSLTVFPENGDHGSIYRLTSSVNGHKVAVYTSHLDYLDCAYYNVRGYDGSSWKEIPIPTTVEEVLKVNVASQRDDAIKMFIAQAQKDIANGYSVIIGGDFNEPSHLDWIEANKNLYDHNGLVIPWTVTTLLEQNGFVDTYRHIYPNPLTHPGFTYPADNPLKEPGKLTWAPKADERDRIDFIFYKGKNLEAKKAIVFGPKGSIVRNKRVQETSKDNFLLPLDVWPTDHKGLLVTFKIK

SEQ ID NO: 9219 - protein, 278 aa, B.fragilis
NIIDMNKLLYCFFLSFSVIATSACTDDKEEREFPPAPDFSLMILKENLHSNGGDVLRTDTYVYDNNKLTTHTTLQEFYGQSLTHETTLSYSGNEVTLADENGNTAIYILGSAGYATECTYKLSDQVRKYTFTYSGEYLTRIDEEINSTPYSSVELAYDDNGNLSHIIANGLQTNYQAGNTENLYQLPCLQVCETYPLSFHNDAIYAGLLGRQSKHLIIGNTPKENKEEYTKYTYELDENEKPTGIIAKTTSTGTVIDITGNAYDETKTDTRTIGITIE

SEQ ID NO: 9220 - protein, 76 aa, B.fragilis
KRNEKSLEGKRGYLISISLSPSSTFLYSAIQYTYGGQTRKVRSCAHDEGQETDPQVADSDNHEYRENHRHNNGHSF

SEQ ID NO: 9221 - protein, 111 aa, B.fragilis
KHTDMEEKKEARQKRNREKLATADWVMAEFYATWCPHCKRMQPVVEEFKKLMEGTLEVVQIDIDQEDALANFYTIESVPTFILMRKGEQLWRQSGELDLERLKKAVKDLKS

SEQ ID NO: 9222 - protein, 291 aa, B.fragilis
KNTEMNILVTGANGQLGNEMQVLARENLQHTYFFTDVQELDICDEQAVYAYVSEHKINIIVNCAAYTAVDKAEDNVELCDKLNNIAPGYLARAAQANGAAMIQVSTDYVFDGTAHIPYTEEEPTCPASVYGSTKLAGEQNVMDHCEKAMVIRTAWLYSIYGNNFVKTMIRLGQERDSLGVIFDQIGTPTYANDLAQAIFAAINKGVVRGIYHFSDEGVCSWYDFTVAIHRLAGIASCKVKPLHTADYPAKAPRPHYSVLDKTKIKDTFGIEIPHWEESLKRCINQLRMETL

SEQ ID NO: 9223 - protein, 373 aa, B.fragilis
YIKEEMTLEETNNCEIIDELIRQGRSFAMYRNPGEEEPHFLMQTCGEVHLIRKMEDLNGRTGFVIAPFRVTPQCPIILIRPDCHEIPSCAGNLHTPAQGDDAASYGQQLRSDRSLGAKKAYEACFDVFIRALRERTFDKLVLSRRMMVRREPGFSPAAAFYRACRRYIYSYVYLCYTPQTGVWMGSTPEIILSGEKGEWNTVALAGTQSLQNGELPQQWDEKNREEQEYVAAYIRKQLRSLGISPTEKGPYPAFAGALSHLKTDFHFSLNDSQRLGDLLKLLHPTPAVCGLPKEEAYRFILDNEGYDRSYYSGFIGWLRPEGRTDLYVNLRCMNVKEDSLTLYAGGGLLASSELDDEFQETEKKMQTMQNLNS

SEQ ID NO: 9224 - protein, 579 aa, B.fragilis
VSGDGKEDADHAELELLNKIIYKAMYSDKKNILQLVALLRAHGVTKVVLCPGSRNAPIVHTLAGHPDFTCYSVTDERSAGFFAIGLALQGGTPAAVCCTSGTALLNLHPAIAEAYYQKVSLVVISADRPAAWINQMDGQTLPQPGVFRSLVKKSVDLPEIHTDEDEWYCNRLLNEALLELNHHGKGPVHINVPVSEPLFQFTAESLPEVRVITRYQGLNVYDRDYDGLIDRLNKYNRRMMIVGQMNLIYLFEKKYSKMLYKQFAWFTEHLGNQTVPGIPIRNFDAALYAMSPEMQEKMIPELVITYGGHIVSKRMKKYLRQHPPKEHWHVSPDGEVIDLFQGALTTIIEMDPFEFMEKIAFLLDNRTPEYPRQWENFCKELPRPELPYSEMSAIGSLIQALPASCALHLANSSAVRYAQLYSLPDTVEVCCNRGTSGIEGSLSTAIGYAAASKKLNFVVIGDLSFFYDMNALWNNHFGSNLRILLLNNGGGEIFHTLPGLEMSGTSHRFVTAVHKTSAKGWAEERGFLYQEVQDEKQLDEAMKTFTQPELLTQPVIMEVFTNKNKDARILKDYYHQLKN

SEQ ID NO: 9225 - protein, 351 aa, B.fragilis
SGGDIMLAYTYVEHGKFELLEKLRPQIKDARDAIVRVTLGSICTSDLHIKHGSVPRAVPGITVGHEMVGIVEEVGSGVISVRPGDRVTVNVETFCGECFFCRHGYVNNCTDPDGGWALGCRIDGGQAEYVRVPYAEQGLNRIPDNVSDEQALFVGDVLATGFWATRISEISEDDTVLIIGAGPTGICTLLCVMLKKPRRIIVCERSAERIRFVREHYPDVLVTEPENCRDFVLCNSDHGGADVVLEVAGSEETFRLAWECARPNAIVTIVALYDKPQFLPLPDMYGKNLIFKTGGVDGCDCAEILSLIEQGRIDTTPLITHRFPLNEIEEAYRIFENKLEGVIKIAITGGR

SEQ ID NO: 9226 - protein, 145 aa, B.fragilis
MIMEDLCLKILEQRGIKPTAIRMLVLKAMMETEQAVSLLDLENKLDTVDKSTIFRTITLFVSHHLAHSVDDGTGSLKYAVCDSECTCAVKDLHTHFYCEYCHKTFCLENIHVPVVDLPEGFAVRSINYVLKGCCAECAAELKKDH

SEQ ID NO: 9227 - protein, 276 aa, B.fragilis
IEMETKREWTPIKEYEDILFDYYNGIARITINRERYRNAFTPTTTGEMSDAMRICREEPDINVVVLTGAGDKAFCSGGDQNVKGRGGYIGKDGVPRLSVLDVQKQIRSIPKPVIAAVNGFAIGGGHVLHVVCDLSIASENAIFGQTGPRVGSFDAGFGSSYLARVVGQKKAREIWFLCRKYNAQEALDMGLVNKVVPLDKLEDEYVQWAEEMMQLSPLALRMIKAGLNAELDGQAGIQELAGDATLLYYLTDEAQEGKNAFLEKRKPDFKQYPKFP

SEQ ID NO: 9228 - protein, 134 aa, B.fragilis
KKMEQTFKARNPQLGVWLFAIGIIACIAISFITIQAIWIGTACIGPSVTIYFSQTSCKYIVKKNGDLQIVNDFFRQKRTFSHITDVTYTRHALGMQKIKIRHATGFVMIDPQSPRELIKALQKTNPDVRVKNFI

SEQ ID NO: 9229 - protein, 161 aa, B.fragilis
RKMERATFSLLFYIRRTKLNRHGEAPILMRITVNGVRADASIKKTILPQLWDADKGRALDKKREGKELNLYLDAIHMRILKIQRDLEIEGANVIASKVLDRYLRKGGFVDRSLFDVFREHNDKCKKLVGISMAAATAQRYETTLQHTQDFVWDTYRKKFFF

SEQ ID NO: 9230 - protein, 331 aa, B.fragilis
RKREKSIVPLAGNLPSLIGQIAKCFFFFSCIIYEIALNLITNTYKLMNKICFFIGVFITLLLAGCSSNPITHVRVATFNIRYDNPGDSLNSWKYRKEKVCEYIREKHPDVLGMHEVLNHQSKDLMSGLPDYAYVGVGREDGKTQGEYAPVFYRKDKYDLLDSNTFWLSEHPDSIGKLGWDAACTRVATWAKLKDKTTGKEFLMLNTHFDHVGTEARRNSALLIIDKIKEIAGTHPAMMTGDFNVSEEWEAYKTITSNEFVLKDAWKIAGKQSGENYTFHDFGRVPVAEREKIDFIFVTPQIKVADAEIISSAITDSTYLSDHNAHLADLEF

SEQ ID NO: 9231 - protein, 64 aa, B.fragilis
CQPWVSHLNIKSRNNYIINYKNSQNEKKNCFYCGTFMRNVLHDSIRTVQNRWKENQCRQSGTSR

SEQ ID NO: 9232 - protein, 805 aa, B.fragilis
LNLCYFCLDRELTMEFINPKFKYIFASILLLGGFLCGYNFKQWYVTNHRNEKHISLIYSCSKKEADRGQFEELLKKEFRSKGVEPIFDKFYLDCNRFGQKVEIEHISNYLEALKSKPIDLVMAMGDQATHSLLSTRHPLLYSVPVVACNVHFPDEDLLKKYESRKVYALRDTPDFKHNMEFIRSLQPHVGLEIVYNIDLTPLGHKSFDLLNQVVDRKDVQILGHKSAFSMEYEYKEMREMIEFYNLMPAVANNRIKKKELTISLCPFRYIKGASLLVMMENSKSEQGKKAFLLDKFDMVSFPIVNALSIPSFSCVHAGFGEGNKIVGGYMATKEISVQAAADLSTRLMNKEKIGMPKIRDLRKEYVLDWSVFSTYNGYDIKNVGKNVRIINYPIYDHYREEFYLLGVLFVFAFIFISVSLLHTRRRSLIERKNLKILEEAHKRLTLSADGGQISLWNMQRSDIEFDDNYARLTGVEKRKFKRTDFLEYVHPDDSQLLSSFYEALCKSPGVEIQRVRFRFDEKKGYQWYELRCRSLKDIKGEMMLAGIMQNIQESVEREHQLIVAKQMAEKAELKQSFLNNMSHEIRTPLNAIVGFTNVLLGEGSEEIDPDEKASMLEIINHNNELLLKLINDVLEISRLDSGSLDFDMKEWNMTDIVKEIYKTYQPLIRSSLQFRLELDDTVSVPVHTDRLRFAQVISNFLNNANKFTQNGYIALGCKVDKKHREVRIYVEDSGKGIDEKELMMIFERFYKTDEFEQGSGLGLAISKVIIERLSGRIKVHSEKGKGSCFTVILSLADAPENHMLI

SEQ ID NO: 9233 - protein, 924 aa, B.fragilis
SQTCRRDKNIIIYKMRIERYVIKVRDQIRKALVSIAEPLEYIKAQKETFYKAAILFLILLLLWRAYEGFWISLFDKYVLSCLNVSWDWVSFTLYTLIICSIVYQLVQCFKHKHILSMYHLSIYSVLIIVYTFYRFSAFHKGYQDFSSLYYLDLLVLGLLVLVVSAISNFIIVLMSEQRDKPNTNFFMIPDQPITTDDDDRLDYAPEARMLAETISGLKLNKSLSIGVTSQWGSGKTSYLNLVEQCLDRNLFIIIKFNPRYSKNVACIQEDFFSIISSALKPYNSCFSKMFKNYMETLQLFDDKNIVTAILNLKGIVDRDSEKEKLDMALKILPKKVVVFLEDFDRLFKEEIIEVFKLIDGNAAFPNLVFLTAYDKAYIVKTIGSNLEDGASLFSDKFFDMEVVVPLRPYQQIFDFLSKHLLEGLNCEVGDEHRYQTALEKHFYVIKRYLITLRDVKRFLNLFINDYKFVKGEVNFEDYFLLTIIKFKDSEEYKELGHNHKNISNEFGRYCFDNNGGDEIKFADILNILFPPNFSSLETDSELRDNFRRINSTASFNNYFFNRIYNQLRLSDMEECLRKDFMMAKLDIDNWIENNLIGGFVEFLQQKNLLCFDNKERFIVFMQIVFYLSLRLFDTEVYILILRLVTVEHIKQFEQRYTFSQMEYKILISEILNEGYPCFHYRIIQKLILNLCNGELVFEIIYTKEELINIARKLLKGYISENETMCDVHMDILYSCVKDVNQETRKVTLDEDSCLAVRNLIFLSPGYYISTFVRLGMFSSNPDMNSIACEPYWKQIFGEAQTFETFILGETLNSIPEIQRVRNFWKLYSNNDYEPIPMERMGNVQKMINDNLVILMPLFENIQAIERKFKEIQRDYDVANPQESIDKCQLLKQKIGADGLFIAKNGQLIRQIDQWISGISGSNNA

SEQ ID NO: 9234 - protein, 344 aa, B.fragilis
SGMWAWGIFGTINYATTDERFTASLGVRTDANNFSSGMKGMGDQLSPRLSLSYRLTDGLYLSGNAGLYYQLPPYTGLGFKDNNGAWVNKYLRYMSVSQESLGLSWHPGNTFELSAEGFYKQYDKIPFSIADGIPLACKGNDYGVIGNEALSSTAQGRAYGIEILMKWLIAKKLNLASSFTLFKSEYRNNKQSEYIASAWDNRYIFNMSGTYNFPHNWSLGMKISCIGGAPYTPYDVEKSSLVTAWNAQGRPYYDYTKYNTGRLPAFGQLDVRVDKTFYLKRCMLGFYIDLQNVTNSKFKQPDILMSTGVIENPSAPMAEQRYKMKYITQKSGTLMPTLGITFEY

SEQ ID NO: 9235 - protein, 115 aa, B.fragilis
PVPWERNSMRQIMSAYMWNREFRISLMMAPKYKPSEKKGLVTLTCRQDCDSLIKVGWQKICRLHYLPVLALYCNELRQEQGDFYIVTYKIINKCSRHNSPQSELNLLMANESLSV

SEQ ID NO: 9236 - protein, 110 aa, B.fragilis
VSVRNTSPPLLCRFSFRIIRLKSGAGGNSRSSLSSVHAEVAMTENDKKKQYRSLFISIMFYLPANVVNNLLYLPRLWYKNAFNVRFLSIPDSSIFATYKDWTLTMNSKYR

SEQ ID NO: 9237 - protein, 61 aa, B.fragilis
LEPRSSGRADQVITIILPSKKRIDILNQCAFILMIFFQLCRTFSTTAFQDIIYTSYSKSLG

SEQ ID NO: 9238 - protein, 173 aa, B.fragilis
KSKLLSIFVNRLNSKINSMAKELNFTLEGVQGDLKLKYGPFNQRLYQDGREIKKQGRFNPKYYVINTNGEKEEIKVVYGFDFVHVAVFRGQKIDLEERLSIREYIVGGLPVLLVFLGGLIGALFGIMGATFNYNHMRQEKSFMKQLLVSLGVSILCYVAYFIFAIGVQLIVAR

SEQ ID NO: 9239 - protein, 214 aa, B.fragilis
QKFSYVCSLITMERRMAQTLTNLNINDNNAVISALREGDEEVFDHIYRYYFRGLCAFCSQYVTLSESEEIVQDTMMWLWENRKTLIPELTLKTLLFTIVKNKALNKISHFEIKRKVHQEIAEKYETEFSSPDFYLENELFRLYEEALRKLPAEFRQAYEMNRSLQMTHKEIAEKLNVSPQTINYRIGQALKILRSELKDYLPLIMLFLFLQGHK

SEQ ID NO: 9240 - protein, 338 aa, B.fragilis
DMNRHLNFVTLICLITGFVSLASCSNDDDEMDKYQKIYIRTGVAPGAEMGAAVVVDCVSNSSTADRSDFEIQLCAVQPVTRDVTAALGVDTLKVDTYNSANKTKCKLLPQDNYTIETSEVVLKTGQTVADSSFQVVLKNIEKLTNPDGYVLPVALKGVTGMDEQAVSTSMKTVYIRIYTSVLYTSYTKPGNWSAVDRSAWSVSCSNVYADDDAKYGAHLAIDGEINTTWFTWGVANAGECWWNTVLDRPVTLTGFSVTKQSAYGSGYNLRSAEIKVRKEGETEWVTYPRVLTFRNFKGADPQYAAIEPPIPNVKEFRINCLTPDNYTGFAEINLYVKQ

SEQ ID NO: 9241 - protein, 483 aa, B.fragilis
ADNRRFHQQSKSNFKNMATKSSIHIKPCRVTSSGAHNRRTAEYMRNIGESRIYIVPELTSNNEQWINPGFGSPDLQAHYDSIKRMVKEKTGRAMQEKERERKGKNGKIIKVAGCSPIREGVLLIRPDTTLADVRKFGEECQRRWGITPLQIFLHKDEGHWLSGQPKTGDRESFQVGEKWFKPNYHAHIVFDWMNHDTGKSQKLNDDDMMEMQTLASDILSMQRGQSKSETGKEHLERNDFIIEKQRAELQRMDAAKRHKEEQIGLAEQELKQVKSEIRTDKLKKTATNAATAIASGVGSLFGSGKMKELERTNEDLHQEIAKRDKGIDTLKIQMQEMQERHGKQIRNLQSIHNQELEAKDREISRLNTLLEKAFKWFPMLREMLRMEKLCAVIGFTKDMIDCLLTRKEAIQCNGKIYSEEHRRKFEIKNNIFKVEKNPTDDSKLVLTINRQPISEWFKEQWEKLRQGLRQPTEEPRKSRGFKL

SEQ ID NO: 9242 - protein, 65 aa, B.fragilis
AKIRDIKNITQDYDKKLLSLFNNTTHPGKLLTSITLFLLNFINTTHAKKHRRLSSPMPLAPLSTI

SEQ ID NO: 9243 - protein, 137 aa, B.fragilis
LMASLKVFIRKPGLTLTISLCRHTLTLAGNSDANLDRRLAGTIANFKGILPPEKVANMYIVTENFESYAPTGGGDYVDRYGNKMRALAGMARWTPTIDGKQVRKGGVGTYHMEYDYPGDIEYKYLREAIRIMNPAVK

SEQ ID NO: 9244 - protein, 327 aa, B.fragilis
LPFGNFSFFPVTYLCAQILILYDMKSLKGIIYAMISSGTFGLIPLFTIPLMGNMEMNESNILFYRFLFSTLMMGAVCLLHKSTLKINMKHLISIIGLGALYALTALFLIYSYHYITSGVATTIHFLYPICVSFLMVVFFKEQKSKSLFLAASLSLIGVALMCWSGGGSIRLMGIGLAALTILTYGIYIVALNQLDIGKLPAEVLTFYVLLGGCVIFFIYSLFTAGISSIPSTKAGFYILALAFLSTVISDLTLILAVKYAGSTTTAILGSMEPLVAVVVGVLVFSEHFTLQSLIGLLLILMSVIIVILADQQKKSKRITEQKIIKPH

SEQ ID NO: 9245 - protein, 211 aa, B.fragilis
ICFGKSSALFSKKNILLSTMPLSFGTRWPKEFAIKMVPLFLKTSVAGWGLGLSTQDIGLVYGTFGAGAFILGSLLAGYYISAFGLRKTLFSLCCAFNIPFLVYFLLALYQPSDLWIIGMAIVSEYLGYGFGFVGLMLFMMQQVAPGKHQMAHYAFATGIMNLGVMLPGMMSGYLSDWLGYRDFFIWVLIATIPAFIVTWLVPFTYPDGKKK

SEQ ID NO: 9246 - protein, 301 aa, B.fragilis
REAGRGVFVLTLSAHITIEKGKIIELIKSKRIPIIEISSLSHPGVEIFSTLTEAQLRNRIDSDRGIFIAESPKVIQVALDAGYEPLAILCEQKHIIGDAAVIIERCGDIPVYTGKRDILALLTGYTLTRGVLCAMRRPELRSVEEVCREAKRIVVIDGVVDTTNIGAIFRSAAALGIDAVLLTRNSCDPLNRRAVRVSMGSIFLVSWTWIDGSLSRLGDLGFRTAAMALTDDSISIDDPVLKTEPKLAIIMGTEGDGLPYETISEADYVVRIPMSHSVDSLNVAAAASVAFWELRAPTFKE

SEQ ID NO: 9247 - protein, 355 aa, B.fragilis
ADRGLLDGRPFLYIIFMYTINIIPRVLHFKQPAGTSRGSYTTRNVWYIHLSSIECPGRVGVGECAPLPKLSCDDLPDYEQVLRSACQRLEQTGELDIESLRGYPSILFGLETALRHYETQSWALWDTPFSRGEAGIPINGLIWMGSFDRMLQQIEVKMQAGYRCIKLKIGAINFEEELALLRHIRAHYSAREIELRVDANGAFSPADAMDKLNRLAELDLHSIEQPIRTGQWEEMARLAAESPLPIALDEELIGCNALERKRELLAAIHPRYIILKPSLHGGISGGNEWIAEAEKQHIGWWITSALESNIGLNAIAQWCATFRNPLPQGLGTGLLFTDNVEMPLEIRKDCLWFCK

SEQ ID NO: 9248 - protein, 169 aa, B.fragilis
IDMGKEKNKIAVLNNPIEHAIKIIVALKCAMTPLTRDRLVAYEYFALHLTDLNKNAESLFPQIPYRACTYVCNHTDITMALEILLSRDLIKYAIKNDRLCYTLTEAGILFEEYLQNEYKQRLTIMMVEVVSLLKNKSDADIQEYVEQNIGKWGSEFEREYILIKDVNHG

SEQ ID NO: 9249 - protein, 191 aa, B.fragilis
ETIMEPIINSQMPEFKVQAFQNGSFKTVSSEDVKGKWAIFFFYPADFTFVCPTELVDVAEKYEQFQAMGVEVYSVSTDSHFVHKAWHDASESIRKIKYPMLADPTGVLSRGFGVMIEEDGMAYRGTFLVNPEGKIKIAEIQDNNIGRNADELLRKVEAAQFVATHDGEVCPAKWKKGEATLKPSIDLVGKI

SEQ ID NO: 9250 - protein, 400 aa, B.fragilis
KSIIMRQTFSLLFFLKKRQNHMDGLHPIMVRITINGKSVEICTGQKALLANWSIRLHQCVGSCAKQTNLFLKSIRFRLNQIFYQQSLYGETTTPQKIKDTFTGADKKNHYLLSLFELHNESIRKQVGISKSPTTFRKYETTRKYLQGYLRSKCLEDIILENINHTFICDFEVYLRVTAHCAHNTTAKFMQFFKRIIILALNNGYITKNPFSEYQIKLQKVDRGYLTREELQRIKEKKIEIKRLVLVRDLFLFACYTGLSYIDLKNLSKHHLYIAHDGNLWLRMNRNKSGETANVYLFNLPKTLIAKYENPDSIYLFPVPSNQKVNAYLKEIADICGIHKNLTFHVARHTMATTVCLANGVPIESLSKVLGHTNIKTTQLYAKITDEKLSNDLAILMSKID

SEQ ID NO: 9251 - protein, 445 aa, B.fragilis
EPNIDFIMELYRSIIENLKNWKASPDRKPLILKGARQTGKTWILEHFGRTEFEHVASFNFDKDESLNEIFEKTKVPERIISQLKLHTDSPILPGKTLIIFDEIQECNKALNALKYFCEDAPEYIVVAAGSLLGVTLSKGDSFPVGKVEFMDLYPLTFREFLKVNDEKIYQYIEEISMIEPLPQIVTNKLTEYYRQYLVVGGMPAAVKAFMENKGMEAVKREQRFILDAYALDFSKHAESKDIPRIMNIWNSIPGQLAKENRKFIYKMVKPGARARDYEDALLWLESAGLIHRVFCCSKPFLPLKSYDDLSAFKIYLSDIGLLRELAGLPPEAILSGNVVYTEFKGALAENYVLQSLVCQIEVLPRYWTSLGKAEVDFIIQLNMDIIPAEVKSETRLGGKSLSVYDDNYRPAYKIRYSLNNLKMDGNLINIPLYLADWTVKLVSIQ

SEQ ID NO: 9252 - protein, 337 aa, B.fragilis
KTNMMTKHKMNLFCGMLLLSASLFVEKAQAMFPERYVSEESAARADTINFRLASAGEAKRLIAAKDSYTANWSPFDIAARLENPEGKREDLVSLAVREVREWTAEEAQQIEQIRKNLNDTIRKYGYRIPFPKEIVLVKTTMKDEGGAGGYTRSNWIALTDATFQRGTEASHTRLLVHETFHILTRLNPGFKKKLYRAIDFNILPKEIEFPEDIRKSRISNPDVSRCDSYATFTIDGKPQNCTMIIYTNRPYTTGKFYQYINVGLIPLDESFKPLRESGKTVIYPLQKATDFFDKVGRNTGYVIDPEEVLADNFAIALLNTPNVHTPELQKKVQELLK

SEQ ID NO: 9253 - protein, 405 aa, B.fragilis
LANMKSIKELYRIGTGPSSSHTMGPRKAAEMFLTRHPEAASFKVTLYGSLAATGKGHMTDVAIIDTLKPTAPVDIIWQPKIFLPFHPNGMNFVALDAGGNELENWTVYSVGGGALAEDNKQPSIESPEVYSMNSMTEILDWCEHTGKSYWEYVKECEDPDIWDYLKEVWDTMKESVQRGLEQEGVLPGPLNLRRKASTYYIRATGYKASLQSRGLVFAYALAVSEENASGGKIVTAPTCGSCGVMPAVLYHLAKSREFSEMRILRALATAGLIGNIVKQNASISGAEVGCQGEVGVACAMASAAANQLFGGSPAQIEYAAEMGLEHHLGMTCDPVCGLVQIPCIERNAYAAARALDANLYSSFTDGMHRVSFDKVIQVMKQTGHDLPSLYKETSEGGLAKDYKPM

SEQ ID NO: 9254 - protein, 250 aa, B.fragilis
TNDMDNFKVIYSIPFLFFIIVSCSNSSTEMVAKSKYDAKIAEYKELNEQQAAVIEDNLEKSKIINNVVTELNQIAGNTHSLRVNVEHGVGELSQAEEINQKLQTLKKRLSAVEGKRSDGSKNLLATMDKLKSIIEQKEIEINNLKQEIANQQQTIANQKNTIASQQVTIDAQSQELMNKQQEMWYKLGTELHSVVEELPKVKGRKDKRNIKNTRYYILNKAKECFEHAAQLGHSLAGSKARQVEGEMSRL

SEQ ID NO: 9255 - protein, 592 aa, B.fragilis
LTIIYIVNLTGFYMKKTSLFLSFFIALFLFSACTDDTEQCLYSPKVFDTGNLLSNRVKEEFLNFDYPAGIVPILFAVDSIEAIQMGAYADECFNDLVDSISESRDFKHRGMLVLVSKNPKLIQIRLGNRYRVYCNMTGATSGLDYLDLQKQIQERGVEETLPLFLQNTSVRIQELNELPSYKKYRINSAISVISTCLEYIGTPSENFYGKCVLTPILKITSFGYYIFKSWLLTFMFVCLIMLLCRWMIFLLVKRLLGENVIALMWTQKIINWGLGLLFSISAAASAIILSSGRMEDAIALQAIGIPFMENFQIAAADYVLKTSFVAAFFFVLMYALKRNIVSDIFLMSLLEPAKQQEVYRSLSDAQKTALVIGHEADLNEVETSSEPYSELFTSRVSKQETVTIVSLAIAALFLIPRPLIIMGIALTIYPLVGQCVKIYHVVSNHTLPAQIKGDRRRALITNLLIIFAIAFITVLIGLFFNPMPDKKEIDRNEIKMELIAPDRLEGNYTVSKSIVGQIQVSSGIIKKVKDGTFQLLITGKSSPKVYKLDFNSDKMIFVSGELGNGAIHYDKDLDKIKIVFNINEQTTWTISK

SEQ ID NO: 9256 - protein, 512 aa, B.fragilis
LTTMSNRIVSRSLMGALCSACFTTASAQERPNIIVFLVDDMGLMDTSVPFVTDENGNAQRQPLNDWYRTPNMERLANQGIRFSTFYAQSVSSPSRASIMTGQNAARHRTTNWINAESNNRTPYGPFDWNWKGLTHQDMIYPYLLQQAGYQTIHVGKAHFGCLKSEGENPANLGFDVNIAGSAIGHPGSYHGENGYGWIKGQRARAVPDLEQYHKTHTFLSDALTLEADKEIEKAVAEKKPFYLNMAHYAVHSPFETDERFISHYTDPNKSQQARAFATLIEGMDKSLGDILDKLEDMGIAENTLIIFLGDNGGDAPLGDAADYGSSAPFKGKKGSEYEGGVRVPFIVSWAHPNPNNKFQKAYPIARNAIQTQMGTVMDIYPTVLSVAGVKPAPNHILDGADLRKLLKGKRDKKHRDDFLMHFPHEHRGSYFTSYRKGDWKFIYYYNPQTPEAPTYKLFNLSEDPYEKNDLSKTNQQKAKELFRLMVQRLEKEQALYPVDADKNVLSPIFVAE

SEQ ID NO: 9257 - protein, 336 aa, B.fragilis
FNRIMEEIKIAGAALPAMPWEERPAGCKDVVWRCSANPIIPRDLLPTSNSIFNSAVVPFKDGYAGVFRCDDTNRRMRLHVGFSKDAVHWDINEEPLKFQCDDAEVGTWVYGYDPRVCFIEDRYYVTWCNGYHGPTIGVAYTYDFVTFHQLENAFIPFNRNGVLFPRKINGRFAMLSRPSDNGHTPFGDIFYSESPDMEFWGRHRHVMSPAPFEDSAWQCTKIGAGPIPIETSEGWLLIYHGVLASCNGFVYSFGSALLDIDQPWKVKFRSGPYLISPQKDYECMGDVPNVCFPCAALHDSETGRIAIYYGCADTVTGLAFGYIPEIIEFTKRTSII

SEQ ID NO: 9258 - protein, 679 aa, B.fragilis
ISLILFPIEFCNFVALENYYLCIINLIVDWIMGHCKCEMNANVRVESCQEANGFIKEYWKVILSLLMLIAGAIMNQLDVAFFRDNTISLVWYILAYLPVGLPVIKEAWESILQKDFFSEFTLMSVATLGAFYIGEYPEGVAVMLFYSVGELFQDKAIDKAKRNISALLDVRPEKAVVVRSNEIVTVDPRSVLINEIIEIKAGERVPLDGVMLDEVAAFNTAALTGESVPRDISRGEEVLAGMIVTDKVIRMKVTKPFDKSALARILELVEDASERKAPAELFIRKFARVYTPIVIGFAFLIVLIPYIYSFINPLFGFVFNDWLYKALVFLVISCPCALVISIPLGYFGGIGAASRLGILFKGGNYLDAITRVNTVVFDKTGTLTKGVFEVESCRVVPGTSEEDLLRVVASIEKNSNHPIARAIVAYAQDKGIDLIVTKNIEEIAGYGLMTEIDGKRVLVGNTRLLSKYSIEFPKAVFSITETTVVCAVGDKYIGCIILSDVLKDDASDTVKALKELNIKNIQILSGDKQSIVTIFANKLGITQAYGDLLPEGKVEHIERLKEEKGNQIAFVGDGMNDAPVLALSDVGIAMGGLGSDAAIETADVVIQTDQPSKVATAIKVGRCTRRIIWQNVLLAFGVKLLVLILGASGIATLWEAVFADVGVTLIAIMNAVRIQKMIK

SEQ ID NO: 9259 - protein, 171 aa, B.fragilis
KKTLIMKFLKFSLLTAVLLSVVFAFSSCGDDDDTGYLPPSQAIQDALKKLYPNATAIKWEQKGVYYVADCQADGREKEVWFDANANWLMTETELNSINNLPPAVLTAFMESSYNNWVVDDVVILEYPNEPSTEFVVTVEQGKKVDLYFSEGGGLLHEKDVTNGDDTHWPRI

SEQ ID NO: 9260 - protein, 422 aa, B.fragilis
NRMMKEDEKWIKAFKDKLEDYSEPMPASGWERLERELMPVTEKRIYPYRRWAVAAAAVVLVLTTAVSLYFLNSPVADEIRYATAPSLAVNPDVLPEPALPDVQVAVSEPVKPVGTTSINPVSGYLAKNTDPVIVPEVSSLVEKRPEAVTEEKRSEPQQEAIAAIEKKESATAQPPKRKEARRPSGKDKYQLPIGDSSAKRGGKWSMGVGIGNGGGLPTNGSENFAPRPMTNRVDLMTIMNGAVSIPADQEVIFEEGVPYLKSNTTAVVDYEHHQPVSFGLSVRKSLPKGFSVETGLTYTLLSSDIKRQGDTKMQSQKLHYIGIPVRGNWNFLEKKYFTLYVSAGGMVEKCVYGKLADDKVNVKPLQFSVAGAVGAQFNATDHVGLYVEPGVSYFFDDGSKVQTIRKERPCNFNLQAGLRFTY

SEQ ID NO: 9261 - protein, 518 aa, B.fragilis
NQSIMKKKILNIVLAAAVTPFLCCCTDNFEEYNTNPYEPHSLNPPMLFATMITTGINVQQNDNQMIDQMVAGPFSGYLTMANSWGGSNFNTFNQTESWNQIPFNTPFEKFYCNYFKLETATGGKGHYWAMAKLLRVNTMLRVTDCYGPIPYSQVANGKTAVAYDSQEDVYKHMFEDLDYAIQMLGEFVDEVGGLKPLEGYDPVYNGDYNKWMRFANSLKLRLAVRISNVSPELARTKAEEAVKSTRGLIDTNDNNAYVGVGAEPNPLWLVASSWGEIRINATIASYMKGYSDPRSAVYFTTSKLGGDSPYMGMRSGLEGVKPATYSGYSMPNYEQKDDMLMFCAAETAFLRAEGALRGWDMGGSARDFYEQGVKLSFDQRKVSGADEYLANAVAVPEPFVDPVNPAKCNYTPKTKITIAWNEGASTEEKLERIITQKWIANFPLGFEGWADYRRTGYPEVFPSVSNLSNGVIDTNRQLRRLPFPLSEKQGNSANVSAAVSMLGGPDTGATDLWWAKKN

SEQ ID NO: 9262 - protein, 148 aa, B.fragilis
IEKMKTVKLITCDDAFQAHIIQGALANEGIDSLLHNENMSTLLRGFVHDISRVDVLVADCDYEAAIQLLKQNQMIPEEQKFCPFCGSDRIKFVLKKEHRVRAVSAAIVSMLATVPPGGNHWEYICDHCGKAFEKPVTEFNPSALEEKD

SEQ ID NO: 9263 - protein, 380 aa, B.fragilis
RYGIYRKELLIRKSIDLPTLPCPKKRYTMKVKLLFLVFVLYACGTKTVSEEKSYDRITMTTYENKYDENNRLSEVQLTRTSHHRYEEDSETIDLIDDKSTYYYTYINNEEFTVRRKSKRSGNIKIMRYAPQREEVLTLNAQGDTIDYLLQKYYDKSKLKLVYVRNINNDYVLHEDNDYEEKNEYDGNGNLTKRVQYYFDIGKKRTTYFFRGLSYEEAKKRIPRTDEDYDIVCDIEKMAGDTLIRKCIKNGIVSSINKTIVDEKGKKEFIFDADMKFTGSFTEFKSDGFDIHVDRIVLDDCTDIDSTYYKNGKEVRCVYLSDTSKRIVLSKYDKWGNMVERVEKTKYFYSQDGEALINEMLQVVRENEKKKESRKRLKISK

SEQ ID NO: 9264 - protein, 90 aa, B.fragilis
LINFDNVCCSLKSNVQANGLYKRPQLLHLQLDTGGVVMTSAQVAEQIKSIFPLFYIQGRSSRVIIDLRCSSFFIMQTDMLYTKKRKSLNY

SEQ ID NO: 9265 - protein, 189 aa, B.fragilis
GKHVFRRMNELELSERCRQGDNRARKELYEQYAGRMLGVCLRYAGDRDMAQDLVHDGFLKIFDSFDKFTWRGEGSLRAWMERVMVNTALQFLRKNDVMNQTTALDEVPETYEEPDASAVEAIPQKVLMQFINELPAGYRTVFNLYTFEDKSHKEIAQMLGINEKSSASQLFRAKSVLAKKVKEWLVTNG

SEQ ID NO: 9266 - protein, 241 aa, B.fragilis
MINVHSYESMGTFDGPGLRLVVFLQGCNFRCLYCANPDTIEAKGGTATDPEEIVRMAVSQKAFFGKKGGITFSGGEPTFQAKSLIPLFKRLKEAGIHICLDTNGGLWNNDVEELLELTDLVLLDIKEFNPEHHQSLTGRSNEQTLKTAAWLETNHKPFWLRYVLVPGYSDFEDDIRQLGEHLGTYQMIQRVEILPYHTLGVHKYEAMNKEYMLKGVKENTPEQIEKAEKLFRQYFRTVQVN

SEQ ID NO: 9267 - protein, 387 aa, B.fragilis
LIVVNTKVILLNQFTMHTDLKPINKDASNHVLTNLEKLEKKTAEERLKFMDEDRYEEMITKWAYFCLKEDSNKKYEDVFRYGGSGDGGIDVIAFYDFKNQICDIYQCKHYKDSIGYSDINKELCKFLYNTFIDYIPFPKTYYLVAPQNITGPLGSLFNDHEKLRNRLWEDWEKSIKKKLAVNITNDENDKFKKHVDTFDLSIIKPLSPDKIIEGLRKEYWLYFQYLGIDRTLIPRIHAAPPSTVADYESTYINHLVDAYSDANKSSITQINLNDENMAMYKAHFTASREQFYLAESAAMIGKEICSGGNDEYSEIKDNIEEHVIDEYYSQYHTDGFEKVKAVTKSASQYQVEEMNSVKPIISSRVLKGMCFQLSNENKLIWVKKKIK

SEQ ID NO: 9268 - protein, 135 aa, B.fragilis
TFSVFMGYFIKIGLGMTEIKIKRVYEDPSDTDGYRVLVDRLWPRGMKKEHLKYDYWAKELTPSSDLRKWFHDDVPGHWKEFAEMYRKELETSDKTSEFLSRIRSCESVTLLYASKEPVYNHARILQAFLEERLKK

SEQ ID NO: 9269 - protein, 348 aa, B.fragilis
INSFMLSEKRNSMLHGVLLIALFSCAAFYIGDMEFIKKLSFSPMIVGIILGMLYANSLRNNLPETWVPGIQFCSKRILRIGIILYGFKLTFQDVLAVGLPAILIDTIVVTITILGGILIGRMLKMDRGVALLTSIGSGICGAAAILGAESTIQTKPYKTAVAVSTVVIFGTLSMFIYPILYRNGTFVLSPNEMGIFTGATLHEVAHTVGAGNAMGKEVSDVAIIVKMIRVMMLVPVLLITSFMVSRAAVKAGGQGGSMKDISIPWFAIGFLAVIGFNSFDLLPQSLIAFINNLDTFLLTMAMTALGAETSIDKFKKAGAKPFVLASLLYLWLIVGGYFLVKLLAPVLM

SEQ ID NO: 9270 - protein, 351 aa, B.fragilis
SPKLKSMAGEINKLIPQYGELNRIYNDWVTNYAFSFDKQKFITDFYRQHNDTKAFEAAILELVLDKQKEQYTLILNSLKIEIEKNIRAYETKPLNDDVIKRVCFHYADRHNSAIKDQLEITTKLHEPLNDAYHRYDFIGFREHTDEEEIQAEKEYERCKAEYDKEKKELDKLYELQKQDRKEAFQYIENLSGNVYRLSLLFMEVLKKYLPNDREEKQQDEPVKQNEQEEVQNSPEGQHEYFDMKQLSPIHETCVGEQFEAITIADFYANINLYPCKNKLKIKAREKIRVCYLIFLMSEKLSKQYRDEWRSQILKLLDIDESYYRSKYKEPVSDFPSDSNQKFAKEMESIFG

SEQ ID NO: 9271 - protein, 63 aa, B.fragilis
SGYSFISVFCYPLIHYTTFFFTFFYISVIDLRSTLFKRFSVVVICEIYTNGWLFFKETINGNG

SEQ ID NO: 9272 - protein, 189 aa, B.fragilis
TDNSNMKKLIYLLGLAMLMAVAACSGSAEKKKSDIRVLMQDSTDAHGVQRMTARKSEVDIKYKGKEYHSFISRTPNDSLPRVVSQMGNTYVDNQIVLRLTRGNERVFSRTFTKKQFESLIGDDFMAKSILEGIVYDKTTPEGIVYAASICYPQTDLYVPISITISPDGKISMKKEELLEEVYDEDTSAR

SEQ ID NO: 9273 - protein, 367 aa, B.fragilis
FLNSHFMKTTPFTEKHIALGAKMHEFAGYNMPIEYSGIIDEHLTVCNSVGVFDVSHMGEFWVKGPHALDFLQKVTSNNVAALVPGKIQYTCFPNEDGGIVDDLLVYQYELEKYLLVVNASNIEKDWNWCISHNTEGAELENSSDNMAQLAVQGPKAIQALQKLTDINLADIPYYTFKVGEFAGEKNVIISNTGYTGAGGFELYFYPDAAMKIWDAVFEAGAEFGIKPIGLGARDTLRLEMGFCLYGNDLDDTTSPIEAGLGWITKFVDGKNFTNRSMLEKQKAEGTVRKLVGFEMIDRGIPRHGYELTTAEGDKIGVVTSGTMSPIRKIGIGMGYVKPEYSKIGTEICIDMRGRKLKAVVVKPPFRK

SEQ ID NO: 9274 - protein, 74 aa, B.fragilis
  UNSURE (67),(68),(69),(70),(71): Identity of amino acid sequences at the above locations are unknown.
MSQQQEYWFAARTRKDQELTTRDALEKIGVEYFLPTQFVIRQLKYRRRRVEVPAIRLHQGCKGPQGXXXXXGVL

SEQ ID NO: 9275 - protein, 634 aa, B.fragilis
RSLSYRLLIINHLKKRMDKNTITGLVLIGILLVGFSFLSRPSEEQIAAQKRYYDSIAVVQQQEEALRAKTEAALANEKEETAADSASLFFSATKGKEAFTTIQNNLVEITLDNKGGRVYSALLKNYMGQDKKPVVLFNGSDASMNFNFYNKKGALQTKDFYFEAVNKTDSSVTMRLAADSASYIDFIYTLKPDNYLMSFVIKATGMDGKLAASTNYVDISWSQRARQIEKGYTYENRLADLTYKYTGDDVDNLSASKDDEKSVSERLDWIAFKNQFFSSVFIAEQDFEKTTVKSKMEKQGSGYIKDYSAEMSTFFDPTGKQPTDMYFYFGPNHYKTLTALDKGREEKWELNNLVYLGWPLIRWINKWITINVFDWLSGWGLSMGIVLLLLTIMVKIVVFPATWKTYMSSAKMRVLKPKIDEINKKYPKQEDAMKKQQEVMGLYSQYGVSPMGGCLPMLLQFPILMALFMFVPSAIELRQQSFLWADDLSTYDAFITFPFHIPFLGNHLSLFCLLMTVTNILNTKYTMQQQDTGAQPQMAAMKWMMYLMPIMFLFVLNDYPSGLNYYYFISTLISVVTMIILRRTTDENKLLTELEAKKKDPKQMKKTGFAARLEAMQKQQEQLAKERANKQNKK

SEQ ID NO: 9276 - protein, 191 aa, B.fragilis
RIKSLSPYYKCKLSLYLPYKLKNTTNMFTIRKATSDDCKLINELANQVFPATYKEILSTEQLDYMMEWMYAPENIRKQMEEEGHVYFIAYQGDEPCGYVSVQPQDADVFHLQKIYVLPGFQGAHLGSKLFDHAVQYIKEIHPSPCLMELNVNRNNKALHFYEHKGMKKLREGDFPIGNGYYMNDYIMGLEL

SEQ ID NO: 9277 - protein, 143 aa, B.fragilis
IMMPVRRSQNWLPSIFNDFFDNELMAKANATAPAINVIETDKAYKLELAAPGMTKEDFSVRIDEENNLVISMEKKAENKEEKKDGRYLRREFSYSKFQQTMILPENVDKDHISAQVENGVLNIELPKLSEEEVKKPDRTIEVK

SEQ ID NO: 9278 - protein, 113 aa, B.fragilis
FYNTMKRYCQTLELYNDSELIRAYVAEHQHVWPEIKAGIREVGILDMQIYIHEHTLFMIVDTVDEFDWIKDNERLAKLPRQAEWEAYMSRFQRSLPGQASHEKWKMMERIFKL

SEQ ID NO: 9279 - protein, 438 aa, B.fragilis
QNTTKDMIWNESIECMERDNLHKIQSIRLKKIVEYVYHNTPFYRKKMQELGITPDDINGIEDISKLPFTTKLDLRDNYPFGLCAVPMSQIVRIHASSGTTGKPTVVGYTRKDLSTWAECLSRAFTAYGAGRSDIFQVSYGYGLFTGGLGAHAGAENIGASVIPMSSGNTEKQITLMHDFGSTVLCCTPSYALYLADAINDSGFPREEFKLKAGAFGAEPWTESMRKDIETKLGIKAYDIYGLSEIAGPGVGYECECQNGTHLNEDHFFPEIIDPHTLQPVEPGQTGELVFTPLTKEGMPLLRTRQKVLPVLHYEKCSAERIWVRMGRILDVSADMLIIRGVNVFPTQIESVILEMAEFEPHYLLTIDRKNNTDTMELKVEVRPDYYSDEINKMLALKKKLTGRLQSVLGLGVDVKLVEPRSIERSVGKAKRVIDNRKL

SEQ ID NO: 9280 - protein, 1033 aa, B.fragilis
KEKTDILSYYIMNKQTSTPSQIHRLQQTIYENLPVGMELYDGDGYLIEINSVGLKMMGVKDKQDMLGINIFENPNIPVEMKRRLRAGENIRFTVKYDFDLAKAHYPTVLSGISYFEIAVSVVLDENKEIDKFLFIAQDVTEAVHTQEILRQSKQKTALAMQAAEVMLWEFDVCTRLFYAENEPLNGYDPTQALTIEDYKKQIHPEDWKKAEIILLDMLSGCDCLYEIDFRIRLSDTSEWQYCKLNCTPYERGTDGKVIKYVGFRKNNTELQRRKLLQENILNSIPLPIHIKDVEDDFRYVFCNEESMRMFGTHEGETVCSVLDSEQAERMQKTDLEVFTTGKPYFGVERIILKDGRSYDTIVRKNIIYDGTKRLLLNIRWDQKLQNDLKRRAKVLSMSMEVMNAYTWFYEPSKQRVSFGEGFDKIGRNALDINSFEKFAECVHPDDRQRFVDTMDAVLKQDSGEWDIEYRADLRGNGNYEWWKTRGVLETSILNDHPYQYVSGMSISIESYKQTELTLLKNKEKLNKLIRQNELVLNNTNSGLAYITTDYVVQWENVSVCSSSLSFEAYKRGECCYKSAHNRTSPCDNCVLSKVLVSRQMEKIKFHLENNRIVEVLATPVFNESEEIDGIVIRVDDITDRERMIEELRQAKLLAEQSDKLKSAFLANMSHEIRTPLNAIVGFSDLLMNSEEQGDKEEYMQIINTNNELLLKLINDILDLSKLESGSVELKYEEFDLAEYFDSMASSMKQRVTNPKVQLVAVNPYSVCRVRLDKNRVAQVVTNYVTNAIKYTPQGTIEMGYEVVDAGIRLYVRDTGIGIPEEKKRKVFHRFEKLDEFAQGTGLGLSICKAITESMGGSVGFESEYSRGSLFWAVLPCDPEVQMRRESNIAIGQNTGKDDLIRSGNQYSALDRKTVLVVEDISSNYLLISAMLSKHYNLLHAVNGEQAVAMVKEYKIDLLLMDMKMPVMDGLTATAEIRKFDTNIPIVALTAHAFESDKVAALKSGCNDYLVKPVDKARLMSVLRKYCHPSTLVL

SEQ ID NO: 9281 - protein, 737 aa, B.fragilis
RKETGRKSRFDLIFAYLRSTIMEENTSKLLIIKITMRQVNLFIMSAAMMLASCGGTKDAGKTDQALIGKSDIKIEGKRMTPEALWAMGRIGGLAVSPDGKQIAYTVAYYSVPENKSNREVFVMNADGTDNRQITHTPYQENEVTWAADGSKLLFLSNDNGSSQLYEMNPDGSGRKQISKYDGDIEGYSISPDGKKILFIAQVKTVKSTADKYPDLDKATGIIITDLMYKHWDEWVTTAPHPFIADFDGKSISNIIDVLEGEPYESPMKPWGGIEQLAWNTTSDKVAYTCRKKTGLAYAISTNSDIYVYDLNTKKTVNITEGMMGYDTNPQYSPDGKSIAWQSMERDGYEADQNRLFVMNLETGEKRFVSKAFDSNVDAFVWSRDAKTIYFTGVWHGETQIYSLDLSNDSVRPVTSGMYDYEGVALFGDKLIAKRHSMSMGDEIYAIALDGQTTQLTQENKQIYDQIEMGKVEGRWMKTTDSKEMLTWVIYPPQFDPNKKYPTLLFCEGGPQSPVSQFWSYRWNMQIMAANGYIVVAPNRRGLPGFGLEWNEAISGDYGGQCMKDYFTAIDEMAKEPFVDSDRLGCVGASFGGFSVYWLAGHHDKRFKAFIAHDGIFNMEMQYLETEEKWFANWDMGGAYWEKQNPTAQRTFANSPHLFVEKWDTPILCIHGEKDYRILANQAMAAFDAAVMRGVPAELLIYPDENHWVLKPQNGVLWQRTFFEWLDQWLKPNETAQK

SEQ ID NO: 9282 - protein, 556 aa, B.fragilis
YSNFMFEGQPKGLYALALANTGERFGYYTMLAIFTLFLQAKFGYTAAETSTIFGCFLAAVYFIPFFGGILADKFGYGKMVTMGIVVMFIGYALLAIPTSDNSGKIMMFGALALIACGTGLFKGNLQVMVGNLYDAPEYSSKRDTAFSIFYMAINIGAMYAPTAATKVTNYMLGKAGLSYVPQIPSLAHQYLDGTITPANQATLESLQAAQNFTGDIATFCTTYIDKLSEAYNYGFGVACVSLIISMLIYVAFRSTFKHADYNSKQAKPANVVEEKLTPEQTKQRIVALLLVFAVVIFFWMAFHQNGLTLTFFARDYTAQEVTGLDRLGFNIVNLTFLLIVIYGLFSLFQGKTGKSKTIAGVVVMVALLCLGWSYTSMDPTINILPQIFQQFNPFFVIALTPVSLAVFGYLARKGKEPSAPRKIGIGMMIAVCGFLIMAIGSIGLPTPDALAASGIEKDALVSPNWLISTYLVLTFAELFLSPMGISFVSKVAPPKYKGMMMGGWFAATAIGNYLVAIIGYLWGGMQLWMVWSVLIVCCLLAALFIFSIMKKLEKVA

SEQ ID NO: 9283 - protein, 207 aa, B.fragilis
TIHYMSKKETLKQQILDLTREYYKEVHGSSRSFEPGKSFVNYGGRYFDDRELVNLVDSSLDFWLTAGPWARKFEIRFAEWLGVKYCSLTNSGSSANLLAFMALTSPQLGERRIRRGDEVITVACGFPTTVTPCIQYGAVPVFVDVTIPEYNIDVTQLEAALSPKTKAVMIAHSLGNPFDLQAVKDFCDKHNLWLVEDNCDALGSTVF

SEQ ID NO: 9284 - protein, 189 aa, B.fragilis
RKDYCRNILSVHVRVLSLHHQLSKKYLTKKRKMKKKAIFLLTILLMASFVTSCSSDDDNEKTEFTSTLTANGSAVKITNLEGKAIAGSIYEFWINDATSDFYIQGNITSHEVHTSGKDVTKDCKMMIALVNNEEWYTSEKEYVSGTVTIEKWDLENFKVTLVFKDYKCKSGSKSIVLNGSVTFPTSINI

SEQ ID NO: 9285 - protein, 476 aa, B.fragilis
RNRYGEVEALKSATFSVNPGELFGIIGPDGAGKSTLFRILTTLLLADSGTATVNGLDVVKDYKQIRQQVGYMPGRFSLYQDLTVEENLDFFATVFHTTIRENYDLVKDIYQQIEPFRKRRAGALSGGMKQKLALSCALIHKPEILFLDEPTTGVDPVSRKEFWEMLRHLKDQGITILVSTPIMDEARQCDRIAFINEGEIQGIDVPERILQRFSHILCPPGLERTEVHAGNDFAIEVDQLTKCFGHFTAVDHISFRVNRGEIFGFLGANGAGKTTAMRMLCGLSKPTSGMARVAGFDVAAHPEEVKKNIGYMSQKFSLYEDLKVWENIRLFAGIYGMQDREIAEKTDALLDRLGFSGERDTLVKSLPLGWKQKLAFSVSIFHNPRIVFLDEPTGGVDPATRRQFWELIYQAADRGITVFVTTHYMDEAEYCNRVSIMVDGRIEALDTPRGLKAHFHADTMDDVFQQLARKAVRKAD

SEQ ID NO: 9286 - protein, 112 aa, B.fragilis
TKILWMSCLGRMLPQTIRMDGSRPPIRKKLVTNNYNPTFCRNRLYRLWIKLFYGPSTQVYRNSKRINVHQKYKKENNAQIIMEQQPQLNDHNKQEYPPMHTAEINTPLINQL

SEQ ID NO: 9287 - protein, 452 aa, B.fragilis
IKSYYAHNKMFKNSKKKITLGVSVQKFENKPNNWKILTYKRHTITIEELVNLICKGHCICQNFKTTSEIFGLREKTIANFDFADCVILDIDDTFLSMNDFYLSLKDEHKPTIIYTTYSNIDNINNRFRPIYVFNEPIRSNEYYRGIANTIVYNIQKEIEGFDLKDKTCLNASQQFAGNGNDNIVYYYNDNIFCPTDFGFDENSFSNSDSILKRERKNNIQIDLESLIGNSEFMKDFWSMGYKKNEEIFIRKYAQIYPFIEATPLPETDSDTPYILLPDNYVKIARYWYKEPLTKGDGTIVYKSHAVKLKSGHRRKLLYDGCLLRKIMLPKITMEHLLYCLVCERRYYVDNQDKVITNKILYQIAKDAWNDTKRSINPKKEERQFVVNPKYCEKYGISKQAARNIAAKILLDLQLKQLYDTNLSVKENLESLKNQGIKIGKSSLYNWVKSQKI

SEQ ID NO: 9288 - protein, 61 aa, B.fragilis
CGLYPSPPMTLLYINGIPSLKINLPYIVGIINVFSAIGNILVIWVASDEYAVLVCKSVCIV

SEQ ID NO: 9289 - protein, 958 aa, B.fragilis
WNVYLNSDNMQKLLSLPPNLVQSFHELERVNRTDWFCTSDPVGKKLGSGGGTSWLLEECYNEYSDGATFGEWLEKEKRILLHAGGQSRRLPGYAPSGKILTPVPVFRWERGQHLGQNLLSLQLPLYEKIMSLAPDKLHTLIASGDVYIRSEKPLQSIPEADVVCYGLWVDPSLATHHGVFASDRKHPEQLDFMLQKPSLAELESLSKTHLFLMDIGIWLLSDRAVEILMKRSHKESSEELKYYDLYSDFGLALGTHPRIEDEEVNTLSVAILPLPGGEFYHYGTSKELISSTLSVQNKVYDQRRIMHRKVKPNPAMFVQNAVVRIPLCAENADLWIENSHIGPKWKIASRHIITGVPENDWSLAVPAGVCVDVVPMGDKGFVARPYGLDDVFKGDLRDSKTTLTGIPFGEWMSKRGLSYTDLKGRTDDLQAASVFPMVNSVEELGLVLRWMLSEPELEEGKNIWLRSEHFSADEISAGANLKRLYAQREEFRKGNWKALAVNHEKSVFYQLDLADAAEDFVRLGLDMPELLPEDALQMSRIHNRMLRARILKLDGKDYRPEEQAAFDLLRDGLLDGISNRKSTPKLDVYSDQIVWGRSPVRIDMAGGWTDTPPYSLYSGGNVVNLAIELNGQPPLQVYVKPCKDFHIVLRSIDMGAMEIVSTFDELQDYKKIGSPFSIPKAALSLAGFAPAFSAVSYASLEEQLKDFGAGIEVTLLAAIPAGSGLGTSSILASTVLGAINDFCGLAWDKNEICQRTLVLEQLLTTGGGWQDQYGGVLQGVKLLQTEAGFAQSPLVRWLPDHLFTHPEYKDCHLLYYTGITRTAKGILAEIVSSMFLNSSLHLNLLSEMKAHALDMNEAIQRGSFVEFGRLVGKTWEQNKALDSGTNPPAVEAIIDLIKDYTLGYKLPGAGGGGYLYMVAKDPQAAVRIRKILTENAPNPRARFVEMTLSDKGFQVSRS

SEQ ID NO: 9290 - protein, 409 aa, B.fragilis
LYGYWLSLFLSSTSLTWDGLILSFGSDDVKCQLVDDHRNASRSVSGRHFFSHKNTVLCNEPQIFCYFCLLLIEKNTYHMGEHICFRRNERLATVNPHWRGNPVVRGKFVNRQHRFRPGMGSVLKWRLSPNPQRKEKKSVKWSPKLNYLRSLDGVVGNSLIWLGHNSFFLQLGRKRIMFDPVFGDIPFVKRQSDFPANPDIFTDIDYLLISHDHFDHLDKQSVARLVKNNPGMKLFCGLGTGELIKGWFPEFEVTEAGWYQQIEDDGLKITFLPAQHWSKRSVRDGGRRLWGAFMVQADGISLYYSGDTGYSRHFREIPDLFGAPDYALVGIGAYKPRWFMQPNHISPYDALTASTDMKAALTIPMHYGTFDLSDEPLHDPPLVFAAEAKKRKIDVYIPVLGEVVKLKRM

SEQ ID NO: 9291 - protein, 142 aa, B.fragilis
VLIQKEDIMIKQDYLIRMIQEIISLIVNAILNKKKFRKDEWTEYDCLTRQILGVSQEELLSMSLDEMIDCYEGDPNRMGKIELAAVTLLKVSDEAESDILQKSKLRQDGLSLLKYVQKESSTFSIQRTNLIRMIEINESLKM

SEQ ID NO: 9292 - protein, 172 aa, B.fragilis
MSQQQEYWFAARTRKDQELTTRDALEKIGVEYFLPTQFVIRQLKYRRRRVEVPAIRNLIFVHATKEFACAIANEYGVRLFYMRDFDTKSMLIVPDKQMKDFMFVMNLDPAAVILNDDCFAVGTKVQVIKGDFCGVEGELASLSNRTYVTIRIRGVLSASVKVPKSYLRILAP

SEQ ID NO: 9293 - protein, 367 aa, B.fragilis
YMKQFIAFVKKEFFHIFRDRRTMLILLGMPVVQIILFGFAITTEVKNVRVGVLDPSNDIVTRKIIDRLDASEYFSVKCLLHSPQEMERAFQENEIDMALVFSEQFADRLYTGDARVQVVSDATDPNMATTQAGYATGVIAAVRQEMLPPGMSVPSVVPNVKLLYNPQMKSAYNFVPGVMGLILMLICAMMTSISIVREKETGTMEILLVSPVKPLFIILAKAVPYFVLSFVNLTTILLLSVYVLDVPVAGSLFWLIMVSLLLIFVSLSLGLLISTVTRTQVAAMLASGLVLMMPTMLLSGMIFSIESMPLVLQLISDILPARWYIQAARKLMIEGVDISLVWTEVSILALMAVLLITISFKKFKNRL

SEQ ID NO: 9294 - protein, 179 aa, B.fragilis
LGRHRSQWLETASLLPKMWSLQDQYDQFAGNRGSSSRISRLATSRGTIGESVTSFRLSVVLYLQNMPKPGKLAAVGNPLLKVADIDQMYLRAYITSEQLSLVKLGNRVTVFSDMRGEERKEYPGVVTWISDRSEFTPKTILTKEERANLVYAVKIAVKNEWTSEDRYVRRSEVINDACL

SEQ ID NO: 9295 - protein, 117 aa, B.fragilis
HILNTCNLFTLEIVKNMTFIHFMQYNSYFCNKAILIMTEKEKKERTVIHLYIKENDTHHYFGSIANVFEYFSPEELGITYGSLRNYGLSNENSYQNSKCIIRKGILLSKSGNRGKNR

SEQ ID NO: 9296 - protein, 93 aa, B.fragilis
FVSKSFDLNLKNRKITKKWGRTDAFYKTNLLKNAIPGTEMFERQTVTCLPAYKHAFIQLALSSRGKAVLSSICIVLRDNARSNKTAELLYRFI

SEQ ID NO: 9297 - protein, 116 aa, B.fragilis
SIYNNDMQAIILSSNTAIRAEVITIRTNARKIDGISKAVLIEQLKEKLKSGKIVKFTYLKSNGEVRVAFGTTHPDFVKDKVCGWGASRESYATTAYFDLEKCDWRSFRWENLIAVF

SEQ ID NO: 9298 - protein, 424 aa, B.fragilis
LNDKNMKRQIVSCGIFAMLLLASCNGAQQTSEVDLIDIAGGMEKLTELKVSDLGKTIRYIPLETTDSCLIGDFPNIKLLDDKIMVYNGKQCLLFDKETGKFICSVGHRGDDPEAYSSTCGYLNSKNQLLYFNRDPNQLVKYDQKGNFAGVITIPSPETSTGNIQINRPGMNGFVFSDSIIIGHYVGGLGQRCPSSVLYFSDKGNYIDTIPNIIPELGTGQVGDINNISVRKGFGLLEGIIQIQYNNGKQSICVPGYTALWKCNDEIRFKELFTDTIYTLKHNQLEKYIIFNTGKYYWPASERTLTDNNSDRIMISYAIENDKLLYFQFIRGLYTDKHILYNGIYDKNTKVTNIALAEKNFVDDLTHFMPFTPSFLNEKGECASLVQAADILTWLEEHPEVKIEKELGVLKNLNEESNPVVVLVK

SEQ ID NO: 9299 - protein, 485 aa, B.fragilis
ICPKFVIKMKTSHISTLAFAILFSSSVMAQKTNKPVSETVQSEVKADTLSETLQQYLVLKLNLDGPKPKIDTVSILYNKYIGELEYLNDPSVPMRYIKTDPDYYRLFVPLTYYNSPIAEYSTMHWKFKEPFVTPSLSSQLLPPYDTLQFSKAERASRLVNVALMDLYLNHPNLVVNTEDHIMSRKLYHGDKKIEVPKTEVKSLFRADKVEDNVGEAEMVISKPNWWVTGGNGSLQITQNYISDNWYKGGESNNAVMANLQLFANYNDREKVQFENLFEAKLGFNSSPSDEYHKYLVNTDQLRLYSKLGIQAANNWYYTITGEFKTQFVKGYKANSEELVAAFLAPADVIVSVGMDYKLKKKKFNLSVFMSPLTYNLRYIGNKNVDETKFGLDKGKCSKNDFGAQVQPTISWTIIPSIVVDSRLNYLTNYKWVRVEWENTFNFVLNRYLSTKLFVHARFDDSAKPTTGSSYFQLKELLSFGLNYKW

SEQ ID NO: 9300 - protein, 447 aa, B.fragilis
TDYNMTTKYTYKEIWIIAYPILISLIMEQLIGMTDTAFLGRVGEVELGASAIAGVYYLAIFMMAFGFSIGAQILIARRNGEQQYQAIGPIFYQGVYFLLSLAVVAFTLSLCFSPHILKKVISSEHIYDASISYINWRVFGFFFSFVGVMFRAFFVGTTQTKTLTLNSVVMVLSNVVFNYILIFGKFGAPQLGIAGAAIGSSLAEMVSVIFFVIYTWKRIDCKKYALNHLPGFRPEMLKRILNVSFWTMIQNFFSLSTWFMFFLFVEHLGERALAITNIIRNVSGIPFMVTMAFAATCGSLVSNLIGAGEIKCVPGTIRQHIRIGYIFVLPLVILFALFPNLILSIYTDIPDLREASIPSLWVLCSAYLILVPANVYFQAVSGTGNTRTALGLELCVLAIYLIYITYMILYLRVDVAVCWTTEHLYGICILFLSYLYIKKGNWQKKQI

SEQ ID NO: 9301 - protein, 150 aa, B.fragilis
RILNIKSFIMVAKQLSIFLENKSGRLTEVTEVLAKEGINLSALCIAENADFGILRGIVSDPDKAYKALKDNHFAVNVTEVVGINCPNVPGALAKVLQYLSNEGVFIEYMYSFANNNSANVIIRPNDMENCIRVLTEKKVDLLAASDLYKL

SEQ ID NO: 9302 - protein, 363 aa, B.fragilis
KEIKMKKTLTVNLGGTVFHIDEDAYRLLDNYLCNLRLHFRKQEGAEEIVNDIENRISELFAEKLSAGSQVITIADVEEVIARMGKPEDFGEDTEEEEPKKTTGQTGAQQGATIRRRLYRNPDDKILGGVISGLAAYLNWDVTVLRLIMFVVLICGYGVLIPIYIICGVVIPEARTAADKLNMPGEDITIENIGTTVTDGFDRMANGVNNYVNSGKPRSFLQKVRDALVSIAGFLLKACLVVLAIICSPVLFVLAIDVVALVIAAIAVAIGGGAALYQMLPSVDWSPLISTSPMMTIAGSIAGVVLAGIPLTAIIFVILRQIFNWSPMSSGLKWSLLIIWILAVVIFVINLSYLGWPYPFLWVG

SEQ ID NO: 9303 - protein, 259 aa, B.fragilis
YMQKLLFLFLLPLIPFSFPCHAQTTYRMVTRNYSPVTDSYPQEVSNFKKADSVYYFTVKVSKAYDDTLKRKVAEKVLYSPNDIYDGEVASYLNPTRLIDYSSPTIELITDSLFKGEDSIMTIIRKGLEFVSHYISFDDSLAMAISRGDCKTLDVNHILQRKKGTCSEYTNLFTALMRKKGIPCRFVAGFIFIPEQKFYGCHAWAECYLKQYGWMAVDPQSGKSWLPTTIIRLFAGTDYTDCGLNSFMDLVPKSIEIVKE

SEQ ID NO: 9304 - protein, 237 aa, B.fragilis
LRMKRDQLKSLLLGAILLAGITLPAKAQIGEQRHNFAIGINGGANYSTVSFQPTIKQNGLLGITGGVTARYISEKYFAMICGAQLELNFSQRGWDEKFDPEQGFSSEDSYVRTMNYLEIPFLAHLAFGKDKGVQFFVNLGPQIGLLLNESEKRKGTWETANRAPNEQYGKWVENKFDYGIVGGGGIEVRTKAGNFLLEGRYYFGLADFYNSTKKDYFSRSANSTITAKITYLFDIKK

SEQ ID NO: 9305 - protein, 200 aa, B.fragilis
LKENIMSLKNSYVTSDYIEWDTMLSLVRKLYRDKEYRMSLLIGCGSFFGLRISDILTLTWSMLLDDEKFVIIEKKTGKRREIKINSNFQKHIADCYMALGVTDKNEKCFLSRKKTVYSTQRINVLFKSIKSKYGLKVEHFSTHSMRKTFGRKVVEAAGENSEFALIKLSELFNHADVMTTRRYLGLRTQELLETYDMLSF

SEQ ID NO: 9306 - protein, 546 aa, B.fragilis
WKIDNRELSLPTFCGCAQPSTIHFLYFNKIQMAEQRRNTRSTAKSKVQPVNDYGRIQPQAPELEEAVLGALMIEKDAYSLVSEILRPESFYEHRHQLIYAAITDLAVNQKPVDILTVKEQLSKRGELEEVGGPFYITQLSSKVASSAHIEYHARIIAQKYLARELITFTSNIQSKAFDETLDVDDLMQEAEGKLFEISQRNMKKDYTQINPIIAEAYEQIQKAAARTDGLSGLESGYTKLDKMTSGWQKSDLIIIAARPAMGKTAFVLSMAKNIAVNFRNPVALFSLEMSNVQLVNRLISNVCEIPSEKIKSGQLAAYEWQQLDYKLKDLLDAPLYVDDTPSLSVFELRTKARRLVREHGVRIIIIDYLQLMNASGMAFGSRQEEVSTISRSLKGLAKELNIPIIALSQLNRGVESREGLEGKRPQLSDLRESGAIEQDADMVCFIHRPEYYKIFQDDKGNDLRGMAEIIIAKHRNGAVGDVLLRFKGEYTRFQNPDDDMVIPLPDAGAMLGSRMNNTGTVPPPPAEFAPQNSNPFGGENDGPLPF

SEQ ID NO: 9307 - protein, 105 aa, B.fragilis
NEDDMKRYNKQQVMKDAHRLYKNDFQRRGRSWGECLKAAWSWEKDAVRVREEKAARLDAMIAASWAAHNAHKNEKSNKKEFEDLSSDAVSYAMGYGRGNGFYCGD

SEQ ID NO: 9308 - protein, 244 aa, B.fragilis
QRLEQGVAPFFMLSNQLSHQILIFAQHPEYRKMKKIVLMGIPLLLIVLVITIYVCNRTIQKNSETYIYSTVSDIPYNKVGLLLGTSPKLKSGKANLYFDYRIKAATELYNAGKVKYILVSGDNRRNSYNEPEEMKKALIAAGIPDQRIILDYAGLRTLDSVVRAHLIFGLERFTLISQQFHNERAIYLAQQSHLQAIGYNAQDVSAYAGFKTNLRELLARVKVFVDIVTNKAPKHLGEKVKIPE

SEQ ID NO: 9309 - protein, 192 aa, B.fragilis
TIMEYILIFISAIFVNNIVLSQFLGICPFLGVSKKVDTALGMSAAVAFVLTIATIVTFLIQKFVLDAFGLQYLQTITFILVIAALVQMVEIILKKVSPALYQALGVFLPLITTNCCILGVAILVIQKDYDLLTGVVYAFSTAIGFGLALVLFAGLREQMSLVKIPEGMKGTPIALITAGLLAMAFMGFSGVV

SEQ ID NO: 9310 - protein, 943 aa, B.fragilis
NMQETEYINVYGARVHNLKDIDAEIPRNSLTVITGLSGSGKSSLAFDTIFAEGQRRYIETFSAYARNFLGNLERPDVDKITGLSPVISIEQKTTNKNPRSTVGTTTEIYDYLRLLYARAGIAYSYLSGEKMVKYTEEQILELILKDYKGKKIYMLAPLVRSRKGHYKELFEQIRKKGYLYVRIDGEVREITHGLKLDRYKNHDIEVVVDKLIVEDKDDKRLKQSVATAMRQGDGLLMILDAQTESIRHYSKRLMCPVTGLSYREPAPHNFSFNSPQGACPRCKGLGVVSQIDVDKVIPNKEMSIYEGAIAPLGKYKNAMIFWQIGALLEKYDASLKTPVKDLPNDAIDEILYGSDERIKIKSSLIGTSSDYFVTYEGVVKYIQMLQEKDASATAQKWAEQFAKTTVCPECKGAKLNKEALHFRIHDKNINELSNMDINELYDWLMKVDKFLTDKQKTIAAEILKEIRTRLKFLLDVGLDYLSLNRSSVSLSGGESQRIRLATQIGSQLVNVLYILDEPSIGLHQRDNLRLINSLKELRDMGNSVIVVEHDKDMMLAADYVIDMGPKAGRLGGEVVFAGTPEEMLKTSTLTSQYLNGQTAIEVPSKRRPGNGKSLWLRGAKGNNLKNVDVEFPLGKLICVTGVSGSGKSTLINETLQPILSQKFYRSLQDPLEYDSIEGLENIDKVVNVDQSPLGRTPRSNPATYTGVFSDIRSLFVGLPEAKIRGYKPGRFSFNVSGGRCEACSGNGYKTIEMNFLPDVYVPCEVCHGKRYNRETLEVRFKGKSIADVLDMTINRAVEFFENVPQILNKIKTIQDVGLGYIKLGQSSTTLSGGESQRVKLATELSKRDTGKTLYILDEPTTGLHFEDIRVLMGVLNKLVDKGNTVIVIEHNLDVIKMADYIIDMGPEGGKGGGELLSFGTPEEVAKSNKGYTPKFLREELKIN

SEQ ID NO: 9311 - protein, 202 aa, B.fragilis
IRKEYKDMNNFKVLMNGIVKENPTFVLLLGMCPTLGTTSSAINGMGMGLATMFVLICSNVVISLIKNLIPDMVRIPSFIVVIASFVTLLQMVMQAYVPGLYATLGLFIPLIVVNCIVLGRAEAFAAKNNALSSMFDGIGMGLGFTIALTLLGAVREFLGTGKVFNLSIIPEEYGMLVFVLAPGAFIALGYLIALINSLKKAN

SEQ ID NO: 9312 - protein, 115 aa, B.fragilis
KIELMNVDNVKSQMRKGMLEYCIMLLLHKEPAYASDIIQKLKEARLIVVEGTLYPLLTRLKNDDLLSYEWVESTQGPPRKYYKLTGKGESFLGELEASWKELNETVNHIANRESI

SEQ ID NO: 9313 - protein, 705 aa, B.fragilis
NLGLGLFISIFVSILIDIDVINSAKIMNNMDKKILIYCRVSTQQQTTDRQKEELLKFAEDNHWNVAEEDIFIDVISGFKKGEFRPEYAKMLERVEYGDIDIILFSEFSRLARNATELLEQIKLFIDKGINLYFDKQKLWVKDTNKDVGSLILLHVLAVMSSYEIELFVERSLSGKITKVQAGHGGGDERAYGYMHNENKQIVINPIESKIVARIFEMYVGGYSSIQISEILNAEKVPAPYVRKLNEYKKNREAKGLEVKEYKFDTDNLKWRISTINRLMHNELYKGNRRITFYKPDPTNPLPLSERQDREIVYEYSEHVESLRIVSDELFQQAQDKLSKAHYNKNNAVRHENLLKHLMVCGECGANFSVGKSNETSKNYISGGRTYKCYGRVNRKDKPRTCTNGAELRQWKLDGLVLQLSIQMFAEINIQQTNILKIENLGKEIEELVQIKSSKNTELVEAENLYKKTLKRLIAIEDDEVAKNLISDAKHKYDETKNMLNKTIDKLSREITTKRITIDNLKRLNANPLLINKMDEIRKDRNLVKTMVDEYIDKITIFRLHELWLLVVVSYKGGEEMWGTIKCARYKKEEMFYDELHCHYGVEFQGWLLNNTERCFSYDKNTHIITYNGESKIYVEFKSGEYNYDTFNQMIQETGWMGCFPFYAYEDSGKDLSVPSNEDFGKSLQENRIDWKAHNEKVLERLLSKS

SEQ ID NO: 9314 - protein, 116 aa, B.fragilis
IINRFMDYKKTNAPTNTITRDMMDLCADTGNVYETVAIIGKRANQISVEIKNDLSKKLAEFASYNDNLEEVFENREQIEISRYYEKLPKPNLIAAQEYVEGKIYYRNPAKEKEKLQ

SEQ ID NO: 9315 - protein, 334 aa, B.fragilis
KIISMENKLIVSLSPHVHGGDSVQKNMYGVLIALIPAFIVSLVYFGLGALIVTATSVIACLFFEWAIGKFLLKKETTTICDGSAVITGVLLAFNLPSNLPVWIIILGALFAIGVGKMSFGGLGNNPFNPALAGRVFLLLSFPVQMTSWPVVGQLTAYTDATTAATPLALMKQAIHGDVSAFGQLPDAWSLFIGNNGGCLGEVSAAALILGLLYMLWKRIITWHIPVSILVTVFVFSGIMHLANPEAYVSPVIQLLSGGLMLGAIFMATDYVTSPMSKKGMLIYGVCIGLLTVVIRLFGAYPEGMSFAILIMNAFTPLINTYCKPKRFGEVAKKK

SEQ ID NO: 9316 - protein, 682 aa, B.fragilis
KKKRSMNFELTSAYKPTGDQPEAIAQLTEGVLEGVPAQTLLGVTGSGKTFTIANVIANINKPTLILSHNKTLAAQLYSEFKGFFPNNAVEYYVSYYDYYQPEAYLPSSDTYIEKDLAINDEIDKLRLAATSALLSGRKDVVVVSSVSCIYGMGNPSDFYNNVIEIERGRTINRNVFLRRLVDSLYMRNDIELNRGNFRVKGDTVDIYLAYLDNLLRVTFWGDEIDGIEEVDPVSGVTIAPFEAYKIYPANLFMTTKEATLRAIHEIEDDLTKQVAYFESIGKEYEAKRLYERVTYDMEMIRELGHCSGIENYSRYFDGRAAGTRPYCLLDFFPDDFLIVIDESHVSVPQIRAMYGGDRARKINLVEYGFRLPAAMDNRPLKFEEFESMAKQVIYVSATPADYELVQSEGIVVEQVIRPTGLLDPVIEVRPSLNQIDDLMEEIQIRIEKEERILVTTLTKRMAEELTEYLLNNNVRCNYIHSDVDTLERVKIMDDLRQGVYDVLIGVNLLREGLDLPEVSLVAILDADKEGFLRSHRSLTQTAGRAARNVNGMVIMYADKITDSMRLTIDETNRRREKQLAYNEEHGITPQQIKKARNLSVFGNGAETEDTQKGTRAYVEPSSPNIAADPVVQYMSKAQLEKSMERTRKLMQEAAKKLEFIEAAQYRDELLKMEDLMKEKWPG

SEQ ID NO: 9317 - protein, 176 aa, B.fragilis
LTNGQLLSVAAEIHILSMKINKTNAARLLDKAKIAYELIPYEVDESDLSAVHVAASLGENINQVFKTLVLHGDKTGYFVCVIPGDQEVNLKLAAKVSGNKSCDMIPMKELLSVTGYIRGACSPIGMKKHFPTYIHETCLGFPYIYVSAGQRGLQIKIDPKELINEVRAEVCVLYTV

SEQ ID NO: 9318 - protein, 275 aa, B.fragilis
NTKGFEKNWVNGSAANVLLAVNAVNGTKGGLGSSYLSAIVNDYGEELRTESGTTSFSADGNLPRIDILTQNLFNARLDYKLFMVPALMVMLLTMLCGFLPALNIVGEKEAGTIEQINVTPVGKFTFILAKLIPYWLIGFVVLTLCFVLAWTLYGIFPVGHFGVIYCFFIIFVLAVSGLGLVISNHSATMQQAMFVMWFCMLILILMSGLFTPIRSMPEWAQWITMLNPLKYFMQVMRMVYLKGSGFIDLLPQLGALLAFALLFNVWAVKSYRKSG

SEQ ID NO: 9319 - protein, 62 aa, B.fragilis
KPLGTETTERCTVATDFLRMAGSMAETKRNGTEIKAVLSTNKGSVPTGQSLYLLTTEALFGR

SEQ ID NO: 9320 - protein, 657 aa, B.fragilis
GFIIPMNKIALALILLILPFSLAYTSPRKKVGIVLSGGGAKGVAHIGVIKALEELNIPIDYIAGTSIGAIIGGLYSIGYTSEQLETIVKQTDWINLLTDKVSREKIPFPFKSNDSKYLVSFPFNNSEKNGGIIKGKNISQLLHQLTEGYQNVTNFDSLPIPFACIATDMARNQKEVIRFGKLSEAMRASMAVPIVFSPIYSGQKVLIDGGFKDNLPIDVVKSMGADIIIGIDVQSELSDADNLHSIAGIANQLMLMICQSSLDESTKDIDAYIKVDVENYNAASFTKAAIDTLIIRGENAAKANYNTLLSIKNRIGIVNNKRNNKAQLPLFYPQYVPSNDNQLRIGLRFDSEDIAAVMLNINLNKHKFGKAEIAVRGGKQSFLRTQYHFPISKPQWITLSNQIGYNDIFLYSHGYKISNPTFIRNTSSLIYSIIPSRNLQIEVGTSLDYHQYYRTLVNEDATPIKRKNLFLNYHTKLKYETLNKRYFPTKGLKTNISYTIHTDLHTNTAYSSLATQITKIFPIALNTFIIPTIYGRFIFNDGIPFMYSNVIGGEGYNPHYEQQIPFSGLPHTESTLKLLGNARIQIRHKFHGKQYLTLSGNYAIHQNQFSNFLQGKKIYGTSIGYGYDSPLGPIEGFICYSNRTNKLGFYLNIGFGF

SEQ ID NO: 9321 - protein, 542 aa, B.fragilis
KQIIKTVIAVGETKYIFVTGGVASSLGKGIISSSIGKLLQARGYKVTIQKFDPYINIDPGTLNPYEHGECYVTVDGHEADLDLGHYERFLGIQTTKANNITTGRIYKSVIDKERRGDYLGKTIQVIPHITDEIKRNVKLLGNKYKFDFVITEIGGTVGDIESLPYLESIRQLKWELGQNALCVHLTYVPFLSAAQELKTKPTQHSVKELQSLGVQPDILVLRTEHDLNTNLRKKVALFCNVAENAVVQSIDASTIYEVPLLMQEQGLDETILQKMGLPVGERPPLGPWKDFLNRRANATETVTIAMVGKYVELQDAYKSILESLSQAATYNDRKVKIEYVSSEHLTPDNVDEQLGHVNGVVICPGFGSRGIEGKFVAAKYTREHNIPTFGICLGMQCMAIEFARNVLGYADANSIEMDEKTKHNVIDIMEEQKAITNMGGTMRLGAYECVLKKDSKVYEAYKEEHIQERHRHRYEFNNDYRKQFEEAGMKCVGINPESDLVEIVEIPTLKWYIGTQFHPEYSSTVLHPHPLFVSFIKAAIDK

SEQ ID NO: 9322 - protein, 293 aa, B.fragilis
LKIMNLILIAVISLGAIALVLAAVLYVASKKFAVYEDPRIAQVSEVLPQANCGGCGYPGCSGFADACVKAGSLEGKFCPVGGQPVMSQVASILGLDAGTAEPMVAVVRCNGTCTNRPRTNMYDGAKSCAIAASLYGGETGCSYGCLGCGDCVAACQFDAIHMNPETGLPEVDEEKCTACGACVKACPKAIIELRAKGKKSRRVYVSCVNKDKGAVARKACTVSCIGCGKCVKTCPFEAITLENNLAYIDYNKCKSCRKCVEVCPQHTIIELNFPPRKPKEEMPVAEAAKTAEA

SEQ ID NO: 9323 - protein, 196 aa, B.fragilis; identical to SEQ ID NO: 5842

SEQ ID NO: 9324 - protein, 81 aa, B.fragilis
LAYMTNIEDFVIQKVKAMRMERKWSQVELADYMNLSPSFIADIENPKRRAKYNLNHLNELAKVFSCSPKDFLPDTPLKNEK

SEQ ID NO: 9325 - protein, 180 aa, B.fragilis
ISIFLSILFIIFALLITSISINMETNIEINKPSPKFQDVSIAPMHTAEHLLNATMVKTFGCPRSRNAHIEKKKSKCDYELPTCPTEEQIHAIEEKVNEAIDRHLPVTCEFMTHEEAKSIVDLSKLPENASEILRIVRIGDYDACACIGQHVENTSEIGLFKIISYDYADGKLRLRFKLIK

SEQ ID NO: 9326 - protein, 298 aa, B.fragilis
SIIMKGIVLAGGSGTRLYPITKGVSKQLLPIFDKPMIYYPISVLMLAGIREILIISTPYDLPGFQRLLGDGSDFGVRFEYAEQPSPDGLAQAFIIGEKFIGGDSVCLVLGDNIFYGQSFTRMLREAVHTAESENKATVFGYWVSDPERYGVAEFDKAGNVLSIEEKPTVPKSNYAVVGLYFYPNKVVEVAKSIQPSPRGELEITTVNQRFLSDRELKVQLLGRGFAWLDTGTHDSLSEASTFIEVIEKRQGLKVACLEGIALRQGWISPEEMKALAGPMLKNQYGQYLLKVIDELSIK

SEQ ID NO: 9327 - protein, 364 aa, B.fragilis
FCYICKHFTSKPKKLTIIHVMKERILVTGGTGYIGSHTVVELQNSGYEVIIIDNLSNSNADVVDNIEKVSGIRPVFEKLDCLDFDGLDAVFNKYKGIKAIIHFAASKAVGESVEKPLLYYRNNLVSLINLLELMPKHGIEGIVFSSSCTVYGEPDELPVTENAPIKKATSPYGNTKQINEEIVRDTVASGAPINAILLRYFNPIGAHPTALLGELPNGVPQNLIPYLTQTAIGIREKLSVFGDDYDTPDGSCIRDFINVVDLAKAHVIAIARILEKKQKDKVETFNIGTGRGVSVLELINGFEKATGVKLNYQIVGRRAGDIEKVWANPDYANNELGWKAQETLEDTLRSAWAWQLKLRERGIQ

SEQ ID NO: 9328 - protein, 277 aa, B.fragilis
PKDMITFPNAKINLGLNITEKRPDGYHNLETVFYPIPLEDALEITILNDSKQKFVLHQSGLEISGEPETNLVVKAYLLLEQEFQLPPVDIYLYKHIPSGAGLGGGSADAAFMLKLLNEKFNLHLADEKLEEYAAILGADCAFFIKNKPTFAEGIGNIFSPVDLSLKGYQLVLVKPDVFVSTRDAFSQIQPHYPDHSLKEIIRRPVSEWKNCMFNDFEKSVFPQYPVIEEIKKELYSKGAIYAAMSGSGSSVFGLFSPEEKITKMDFEAAFCFQTELK

SEQ ID NO: 9329 - protein, 598 aa, B.fragilis
KLQIKINKLMKSIKRIFFLLSFISVSYLSTFAQENQSYFLHTIEKGQSLYSISSMYGVSKADIIRLNPGCEDKIYAGQAIKIPQNKTAQKGETFHTIQPGETLYRLTTTYKVSAKAICDANPGLSAENFRIGQVIRIPSAAEAIDSTVEAVVAAPSEPAMQPAVKPRCKDMHKVKRRETIFSVSREYGISEQELIAANPELKNGMKKGQFLCIPYPSEKPTVTVPKTDANIIPPSDSELFRENKEVPKSISTIKAALLLPFDDKRMVEYYEGFLMAVDSLKRTGTSIDLYVYDCNKESSSLNSILAKSEMKNMNVIFGPAQQQHIKPLAAFAKKNDIRLVIPFSSKEGEVFNNPFIYQINTPQSYLYSEVYEHFTRQFPNANVILLESAVVDKDKVEFIKGLKQELGSKGIPVKTLKENAPVEALKAALHNDKENFFIPTSGNDLTLLRIIPQLTLLVRDNPEARIHLFGYPEWQTYTKDHLESFFELDTYFYSSFYTNNLLPAAINFTQAYRKWYSKEMEERYPKYGMLGFDTGYFFLKGLSKYGSELEKNLPQMDLTPIQTGFKFQRVNNWGGFVNKKVFFVHFTKNFELIKLDFE

SEQ ID NO: 9330 - protein, 452 aa, B.fragilis
TDKIQNCMLKTFSIGGVHPHENKLSAHQPIVTAEVPAKAVILLGQHIGAPAKPIVAKGDVVKVGTKIAEANGFVSAAIHSSVSGKVAKIDSIVDASGYAKPAIFIDVDGDEWEESIDRSPELVKECELTSEEIVKKIADAGIVGLGGACFPTQVKLCPPPSFKAECVIINAVECEPYLTADHQLMLEHAEEVMVGVAILMKAVKVNKAFIGIENNKPDAIQLMTKVASSYAGIEVVPLKVKYPQGGEKQLIDAITKRQVASGALPISTGAVVQNVGTAFAVYQAVQKNKPLFERVITVTGKSVAQPSNFLARIGTPMQQLIDACGGLPEDTGKIIGGGPMMGKALVNTDVPTAKGSSGILIMNRKEAKRGEVQNCIRCAKCVSACPMGLEPYLLSALAENTEFERMESERIMDCIECGSCQFTCPANRPLLDYCRLGKGKVGAMIRARQAKK

SEQ ID NO: 9331 - protein, 423 aa, B.fragilis
NNLIIKYNTMKNYLITYSCAMFLLASCGSPSQQPKAPGQIDIAGKIESLTELKASDFIKEINYVALETTDSCLVNENPNIQVFKNNIIVNTNKQCLVFDKDSGKFLRSIGHIGNDPGGYSEATFWIDDITGELYFIGWNGTLMRYDLQGNYLGDVKVASNLGVRNPACFVFTDSLIVSHQLSLLPIQGNEKKSPFLLLDKQGNVIDSIPSLLPVIPVTTNVVRLNILKSEKARELYGNIGVHGMMTAYFNNDDAIESPRVLSTLWKHNGKVRFKEAYLDTIYTLSENKLSPYLIFNTGKYHYPAEERYQQKENDERVKIDYVMESTTLIIFQFRQRGEVYTGIYNKDTQITQIAKGQNFVNDIDHFMPLNPRNCNTDNEYVDLVQANTILEWMEEHPEVNPDGKFSFIKGINEESNPVVILMK

SEQ ID NO: 9332 - protein, 279 aa, B.fragilis
KRYVDLWCLHRFADGCYPSVWCISGRYVVCYSDYECIHSANQYVLQTKTLWGGSEEEMKKLESSLKNMLLVLTGVTAISVALLAYVNELTKGPIAEANAKTLNEALKEVLPEFTNNPVAECDTVFSEKDGKKIVDFIIYPAKNGDQWVGTAVEAKSMGFGGELKVLVGFDAEGKIYNYSLLSHAETPGLGSKAADWFKEGNKGSIKGMNPGEQPLTVSKDGGQVDAITASTITSRAFLNAVNAAYGAYKGNGGANGTTGASQKVVQKSETGIVDSVVIK

SEQ ID NO: 9333 - protein, 548 aa, B.fragilis
FSLLIKLYRIMSHIDRMRQLGNIALPNEDSPLHDIIVKKLKKHDSPDIQKRVGEAFNKAFAIVDAQRKNGANLPIDIELRYYLEEFNSRAWKYGLRTMPSSFNVMEAFFTYNPQLNSFFLLDEEDFLIDFIDFIDYATSKDCPNKIEESLKLFDEDRIYNFTVTNNPPDIDFSLLDNKIKYAIGGVSMIKRGDEVSMILLAGEKNSDLSLPPLKETKRIPGKSRLEYSPDRVQEKVRFWDDEGYWKTIILLRFDVLTMELDAKFINKDMGNSFSVLTDYIESFLSEKGEFLFPEAENYLNEQKVKIQNYYPLFEIARTCLHLLSYVEKYTDSLSSEEHITVLGHEPIKPRFFKKDKMVPPKYELRKRDVWNLKRQRDNYSSSIITFNDDFKLETSGYWKSLKPNEIGQNKNGDEIHGKTWVSITKTWHETENKPIKITNNIKTLVNSVNSGFIYIMRNASHEKNIFKVGLTRRDCETRAKELSSATGVPDKYLIVEEFATADCVLAEKLIHEKLDDYRLNNKREFFKANYSFIRATINEIVNEINSNT

SEQ ID NO: 9334 - protein, 275 aa, B.fragilis
LCALFKYRMKKNIIITLLAATVLSSCGEYNKLLKSTDYEYKYEAAKNYFAKGQYNRSATLLNELITILKGGDKAEESLYMLAMSYYNQKDYSTAAQSFITYFNTYPRGQFSELARFHAGKALFLDTPEPRLDQSSTYQAIQQLQMFLEYYPQSSRKQEAQNMIFALQDKLVLKELYSARLYYNLGNYMGNNYLSCVITAQNALKDYPYTDYREDLSILILRAKYEMAVNSVEDKKMDRYRETVDEYYAFKNEFPESKYLKEAERIFKDSQKVIKD

SEQ ID NO: 9335 - protein, 71 aa, B.fragilis
SMFFKIKKNGRIEFSYEWRISIDGWLIYKQYSSYSLTIHHLVTDFTVYTSRLPPTSQLSFPSTHGYSFPYH

SEQ ID NO: 9336 - protein, 177 aa, B.fragilis
KLPSHSRTVISNILSYKMNTLMTQIHELQHVAHELLYLGADGSPIYTDSFRQLNTEVLQKSDALFALKGENPEEEARLCLALLMGYNATIYDYGDKESKKQVILDRSLLVLESLPSSLLKCQLLTYCYGEVFEEELAKEAHAIIDYWDNKTLSIDEQETVDMLKMIEENQYPNSYID

SEQ ID NO: 9337 - protein, 161 aa, B.fragilis
LFYSGLNTTLKTMIQRIQTIYLLLVTALLITSMCLPVGSFIGADAAMYVFKPLGVEMNGTLYSTWGVFGILLLSAIIAFATIFLFKNRMLQIRMTIFNSILLIGYYLTFLAFMFVLKKDLSATFQISWALCLPLISIILNWLAVRAIGRDEVMVKAADRLR

SEQ ID NO: 9338 - protein, 106 aa, B.fragilis
SQYSGFDGSSVDNNKLQEIQKQVMIKYLIEKEFKQLLRNSFLPRLIFIFPCMIMLLMPWAANLDIKNIRMNIIDNDHSVSSRRLVDKITDSTYFQTNAWRILTKKV

SEQ ID NO: 9339 - protein, 60 aa, B.fragilis
VIKSLFMLGISILVVLYVYDAGISPNAAVVLNEYPMTRIVPERVSNFPFFSTGEEAPFEV

SEQ ID NO: 9340 - protein, 1168 aa, B.fragilis
KRKSIILKKRESESTPILSDSKQSKIDLNQFINLTRYKDMRKISLPRHLCPKNFVSKQILLAMKITLFLLFFVAFQAYSENGYSQSTKISIPRSSLKVSELLSKIESQTKYLFVYNKKNVDTRRWVNVQADNKAVSEVLDQAFKGTNIKYVMEGNNIVLTRNNDNAITAQQDRVTVKGVVTDQNGDPIIGANVLEKGTTNGCITDMEGNFTLNVPSNATLAITYIGYQPQNIQVNGRQSFNVKLQEEAMALEQVVVTAMGIKKKEASLTYSTQQVGGDELTRAKDPNMINALAGKTAGVQITKSSSGLGGSAKVSIRGSRSISGNNQPLYVIDGVPMLNSSNEQASTAIGGTADAGNRDGGDGISNLNPDDIESMSILKGASAAALYGSQAANGVILITTKKGKAGIQKITFSSNLTVDHAICLPEFQNNYAMDPEAKNSWGKNQTLKDYNNADNFFQNGVTAINSVSFMNGSEKMQTYFSYANTTAKGIVEKNKMQKHNLNFRETANFFNDYLKLDANVNLMTQTIKNRPTSGGYYMNPLVGLYGFPRGEDLSEYKNNFEVFDPARNMNVQNWYTSYQDMEQNPYWITNRINSNDKRTRAIASLTANVKITDWLNIQARGTADYTHDQYQQRMYASTAPALAGQNGRYIDLNHTETLYYGDVMAMVNKKWNDFSLNGAIGGSINSTNVNSLRLDSKTASLYYPNVFTVANIKMTQAAYIDEQMNQKRVLQSLFGTAQLGWKESLYLDVTARNDWSSTLAYTKHSSFFYPSVGLSWVLNNTVKLPEWISFGKIRGSWSKVGNDLPLFISNSIPGSNDIIGAGGAIVTYSKAPFNDLKPEMSTSYEIGTEWIFFNYRLDLDISYYRTNTKNQLFTLPSSAGADYKYYMVNAGNIQNEGVEITLGATPVMNDAFRWKTQFNFSTNKNKIIKLHPDLKTFVYGDESFSSSYSMRLVEGGSFGDIYGKAFERDENGKVAFTTDKDGDKIPNVIGGGNTEKVGNCNPDFMLGWSNTFTYKGFSLYFLIDGRFGGDVLSQTQAELDQRGVSLNSGKARDAGYINIDGTQVKPRKFYTAVSGRDGCTEYYMYDATNIRLRELSLGYSLPQSWLAKAGGAFKDVQLSFVARNLFFISKKAPFDPDAVLSTGNDNQGIDVFGMPTTRSLGFNIKFTF

SEQ ID NO: 9341 - protein, 810 aa, B.fragilis
SIFPSAPETSPFTLNLGSELQELKARATRATNVTFFIIFVLFFKLQIYFFSRLVKAFCRVLRSKIEKNQIPANFLSHFHDISAINVYLCGNFERKILDKTIFMINPIVKTIELGDGRTITLETGKLAKQADGSVMLRMGNTMLLATVCAAKDAVPGTDFMPLQVEYKEKFAAFGRFPGGFTKREGRASDYEILTCRLVDRALRPLFPDNYHAEVYVNIILFSADGVDMPDALAGLAASAALAVSDIPFNGPISEVRVARIDGKFVINPTFDQLEQADMDIMVAATYENIMMVEGEMSEVSEAELLEAMKVAHEAIKVHCKAQMELTEMVGKTVKREYCHEENDEELRKAVHDACYDKSYAIAASGNRNKHERQDAFDAIRDEFKAQFSEEELEEKGALIDRYYHDVEKEAMRRCILDEGKRLDGRKTTEIRPIWCEVGYLPGPHGSAIFTRGETQSLTSVTLGTKLDEKIIDDVLAHGKERFLLHYNFPPFSTGEAKAQRGVGRREIGHGNLAHRALKRMIPEDYPYVVRVVSDILESNGSSSMATVCAGTLALMDAGVKIKKPVSGIAMGLIKNAGEEKYAVLSDILGDEDHLGDMDFKVTGTKDGITATQMDIKVDGLSYEILERALNQAKEGRMHILGKIEETISEPRTELKDHAPRIETMTIPKEFIGAVIGPGGKIIQGMQEETGATITIEEIDNVGRIEISGTNKKSIDDAIRLIKGIVAVPEVGEVYKGKVRSIMPYGAFVEFLPGKDGLLHISEIDWKRLETVEEAGIKEGDEIEVKLIDIDPKTGKFKLSRKVLLPRPEKK

SEQ ID NO: 9342 - protein, 538 aa, B.fragilis
VMNTKTKLLYVGFRALNTCCLYAAFLMITSCGDNVVNPDSPEPDGEDMIPVTVSRVEDGSYMESHIDTPDTTGGRTLVDEWVPVKEPPASRAIPAAVPYEGPSAVRMTLREEPQVPTRAATLGNGIYFRLIAFRKVGSNYVFQSAADFTTNGASAPTLRLGNLLTRAGTVRVIGYSFNSTAAMGTIPSSYTYNSTSVTIPNMNSDFMVYDSGEIANVSTISHNLSVSFTQKLCKLTVKLSLSQFVSNTFTNCTGVYVSQGGNTSAWTIGPSTNNVSANTGNTPTFNIANNSTATIRLVPFSGSRAITVHIGTLTLSNYFNANNRNITSSQNVQLLPGRSYTITLQIGLGIQVAASDINLTQNGCTASDKNDLAKLRWATGNLKSTGSANYVWASSTDRGYYYTWYSTYTGNTNINNTDPCSKLNTAYYGTGWRTPSKNELTKLARCTNKILTNSGMWFMNNSIGLFLPAAGCRQDGNGSNTSPTTDSGTDGYYWSSDIGNGNNTGKRLYFGKRYNTADVADHAKNAGLTVRCVKGTKQ

SEQ ID NO: 9343 - protein, 253 aa, B.fragilis
IMKTELKGWLADNTVTTDNKEDKILVLESAGNLTLSDVLDEMKKEDTGLRAETLKHAVDLFQRTVSELVLNGYSVNTGLFRAVPQFRGVIDGGVWNPEKNSIYVSFNQDKDLREAIARTGVKILGVKGDSAYFIGGEDAATRATDGSATAGRNYRLQGKNIKVAGTDPAVGIVLIDEKGTETKLPMDMIAVNNPSEVLVLLPADLTDGIYKLRLTTQYTSGNRQLKTPHVISQTIVIGNTTEGDGDIVDDPTA

SEQ ID NO: 9344 - protein, 86 aa, B.fragilis
CNKDKMLFLLVQIFSHRFNYQSFIYSLCILYREQESCFKRRTSFETPPVYSRQLYLIGIHKLTHNKSCIKQSLPTYTLMYKSGKRF

SEQ ID NO: 9345 - protein, 313 aa, B.fragilis
KHFMEQELLYKYFKGTTSEEEERLILDWVDASPENRKAFQKERMLYDIALFTDEKQMNRKDRKARIIPMLRWSARIAAVVIVAISFGFLFKNYQYEKSACQQTITVPAGQRAQITLADGTKVWLNSKSTLTYASNFGRKERNVELDGEAYFEVAKNKKIPFFVNTEINRVKVVGTHFNVCAYKGSNEFETTLIEGIVDIYPIGSDQVITRLTKDEFFGSYNGKYKKTTLPSYEYLRWKEGLYCFDDAPFNSLLNKLEKYYNVNISVRNLNILNYRCTGKFKEQDGIEHILKVIQKDHKFTYSINEEKDSIIIE

SEQ ID NO: 9346 - protein, 374 aa, B.fragilis
TKNMDKLNINSTPSSVKNGRGERLLVINPGSTSTKIAVYENETPLLVRNIRHTVEELSAFPRVIDQFEFRKSLVLRELEVNDIPFRFDAVIGRGGLVKPIPGGVYEVNEAMKRDTLHAMRTHACNLGGLIADELAAALPGCRAFIADPGVVDELEEVARITGSPLMPRITIWHALNQKAIARRYAAEHGTRYEDLDLIVCHLGGGISVAVHRHGRAVDANNALDGEGPFSPERAGTLPAGQLIDLCFSGKFTKDELKKRISGRAGLTAHLGTTDIPAIIQSIEAGDDHARLVLDAMIYNVAKSIGAASTVLCGKVDAILLTGGIAYSDYVISRLRERISFLAPVFVYPGEDEMEALALNALGALRGELPVQVYQ

SEQ ID NO: 9347 - protein, 189 aa, B.fragilis
NLFMPSNNSLHTMDLFSQFFQENQKKFLSFAYSYTRNKAAAEDILMEAMASLWENRKKWEKDSNLHALLLTIIKNKSLNYLEHEQVRMKAEEVINTHKQRELDLRISTLEACEPATIFDTEIQRIVYKTLEQLPEQSRHIFILSRYHNTPNKKIAEQLGISIKSVEFHITKALKLLRLELKDYLISLLF

SEQ ID NO: 9348 - protein, 542 aa, B.fragilis
KRFIMKNNIKYIAGILLGGLIGFSACTDSFESFNTNEAGFDNDSKKQDFNYYGIPLGIIQQGIYFNYDWGSGKNWPFQTMQNLGADLFSGYVHDFNPFNEGKNNSTYYMMDGWNGSTWDNTYGYIMPEVQKSETINEKDNIGFFGITKILKVELMHRLSDLYGPIVYTQFGSKTGSTPDTQQEAYKAFFNDLDTGIAKIREYQKANPDIESFAKFDILMPQGKRTFSEWIRFANSLRLRLAVRIAMADSKLAVAEAQKALTDEEGLLEGNDEVVAVSTSSGYTNPFGEINKAWGEVFMNANMESLLVGYEDPRMEKYFDKATGSDATSLIDYKGTYKGIRQGTGFSHKNYNGHSKSTITQQTDAVLMTPAEVWFLRAEAALRGWSSESVKDCYEKGVKASFAQWGAAGAEAYLESDRKPSDYVDAFKAANNVKAVNTLTPKWDDAAGNEDKLGRIITQKWLAMFPEGGEAWAEQRRTGYPRLFPVLVNQSEGTVDTNLGPRRLNFFVGIKTTNPEQYTQLVNALGGIDNCGTRLWWDTGRNF

SEQ ID NO: 9349 - protein, 250 aa, B.fragilis
FFSILERRTRQNALTNLEKKYICSLKNNTNIMKKVTLVALVALALSSCNSDPKFNVKGDVSGADGKMLYLEASGLEGIVPLDSIKLKGDGSFSFKQLRPESPEFYRLRVEDKVINFSVDSTETVSIQAPYTDFSTAYTVEGSENSAKIKELTLKQVRLQKDVDALVKAAQAHQLGNDVFEDSLAVLLKNYKDDVKINYIFAAPNTASAYFALFQKLNNYMIFDPLNNKDDIKCFGAVATSLNNTYPQVFT

SEQ ID NO: 9350 - protein, 107 aa, B.fragilis
VEAISILSALLAIRFPTVSLLKCTVIVRELAKGTMRIVVVWLVFGLNEAVLLVLAATAELPITHEVELPPCFTYTPVHPLMVLLVKPVTLMLIVSLHSFCLNVTGRL

SEQ ID NO: 9351 - protein, 317 aa, B.fragilis
KSNVMEPIRNFDQLTAHLKTLNRRKRIAVVCANDPNTEYAIARALDEEIAEFLMIGDSAILQKYPSLQKYPEYVKTLHIEDPDEAAREAVRIVREGGADILMKGIINTDNLLHAILDKEKGLLPKGKILTHLAVMQIPTYDKLLFFSDAAVIPRPTLQQRIEMIWYAICTCRRFGIEQPRISLIHCTEKVSAKFPHSLDYVNIVELAEAGEFGNVIIDGPLDVRTSCEQASGDIKGIVSPINGQADVLIFPNIESGNAFYKSVSLFAKADMAGLLQGPICPVVLPSRSDSGLSKYYSIAMACLTASTRSAERGRCSE

SEQ ID NO: 9352 - protein, 548 aa, B.fragilis
  UNSURE (118): Identity of amino acid sequences at the above locations are unknown.
SDYSLNKFRMNKLLIMRTHLLWIGVMTASSLWLSGCTQEEKYPFFPEKGYDSGTVIPIKISMAENGEYDSYTPENDMAPRYNAPLIAEWAGVQTLSRTRTKESPEYNGPRIASMELTXNTPSTLTTRANTLSTGVYFRLIVFRKSGNNYVFQSAADYTSNGASSPVLKKGKLLTRSGTIRVIGYSFNTTAALGDIPASYTYNTTKIDIPNMNNDFMTYDSGDIANVNSLNYNLPVTFKQKLCKLTISISVTGFTSNTISGCTGVYVKQGGNSTSWVIGSSAVAANTSNTASFNPNTNQTTTIRMVPFASSRTITVHFNKLTVGNLIANNADNIDIASTQSVQLKEGMSYTMKIQFKRSPGINVPAGSINLSNPKKACTNDDKQKLSKLVFADGNLKSTGASNNYVWATNKEYGYYYQWKKDYNGNNIDPCARLNPTTYGSGWRLPTRNELERLGRCNNVKKVSNGVNGLWFLNATTGIFLPLGGWRNNNSGTTAEDWPGTFGQYFTDESINTNDCYRLDISPGEGKTDVNSTQKKMAYTTRCVKGPKL

SEQ ID NO: 9353 - protein, 88 aa, B.fragilis
TLDANSYSAWRIGGRLSFKNETLAMILPRLEKWYGQKIDCPQKTADHYRFTFTLRNEPLDLILNIMSHSAPLNYKLISNDYYVLEELK

SEQ ID NO: 9354 - protein, 388 aa, B.fragilis
LIVFMRKCNMRWFSPQRMKKHLAFALAVSLVAMVPVSAFAQVLKISMTKTNVSIENVLRELEKQSDYTFFYNDIQVKLNKKVSINVSDAPIETVLNEVFKNSGYTYKIVDNQIVVSTAAAAAKEVQATQQQKQRKISGVVKDAMGEAIIGASVIEKGNPTNGTITNIDGEFTLNTAGKELQVTYIGYIPQAIVLKPGVNSYTVTMKEDTKTLDEVVVVGYGTQKKVNLTGAVSSVGADELKERVNTDVLASVQGQVPGVTIISGPGSTPSINMRGRGNLGTSSPLFVIDGAIADASFFSSLDPNSIESISFLKDAASSAIYGSRAAYGVVLVKTKGGKEGDLKISYDGSVAVKMATYTPDVLGSEWYARLSNEAAVFTAECQTTLYCP

SEQ ID NO: 9355 - protein, 71 aa, B.fragilis
ILFLVCFPKFRMNLAFYFIHYFQKYRVLLKFFENYGVFSLLLFLFLDSTYILIILYFLSFCIFYPICIACF

SEQ ID NO: 9356 - protein, 62 aa, B.fragilis
HRAKMKFKSPPLKSYLLPLIDYNSTIINIINSYYKHHIASRFRIYVANKSYTTRFVCHKLFY

SEQ ID NO: 9357 - protein, 79 aa, B.fragilis
GTHTMRLSELKTGEKGVIVKVLVHGGFRDRIVEMGFIKGKPVGVLLNAPLTDRISYAIMGYVISLRRQEADMIEIISEQ

SEQ ID NO: 9358 - protein, 790 aa, B.fragilis
SCQTKHRIRKLMNQILKPHNLPPSFQGRGWKISIKSWWKPALFLLLVLYIFCLPSQLFTSPYSTVVTDRNGELLGARIATDGQWRFPPRENIPEKVATCLIEFEDRQFYHHWGVNPLAIGRAVVQNLKHKRIVSGGSTLTMQTIRLARNKPRTFKEKLIEMVWATRLEFRKSKKEILSLYISHAPFGGNVVGLDAAAWRYFGHSAEELSWAESAMLAVLPNSPAMIHLSKSRQALLDKRNRLLTHLHKKGILDTSTYELAISEPLPQEPLPLPHIAPHLTDYFYQTRNGKYSVSTIDRGIQTQIESLVERWNSEFKRSDIRNLAILVIDIRTNQAIAYCGNVHFDKEQSGNQVDVIRSPRSTGSILKPFLYYAMLQEGEILPNTLLPDIPVNINGFTPQNFNLQFEGAVPASEAIARSLNIPSVTMLQRYGVPKFHSFLKQIGLTTLNRPSSHYGLSLILGGAEATLWDITSAYANMGRSLNRLPQFPCTLLLSDSISVHRPSFQSGAVWQTFDAIKEVNRPEEIDWRTIPSMQTIAWKTGTSYGFRDAWAVGVTPKYAVGVWVGNATGEGKPGLVGARTAGPVLFDVFNLLPSSPWFERPQGELVEAEICRQSGHLKGRFCEETDTLLILPAGLKTEACPYHHPVTLSANERFRIYENCANSEPVVRRNWFTLPPVWEWYYKQHHPEYRPLPPFKSGCGEDRFQPMQFIYPPMGARIHLPKQMDGSKGQLTVELVHSHPNTTIYWHLDETYLTQTQDFHKLSLRPSPGKHSLTAVDDEGNTISTTFFVE

SEQ ID NO: 9359 - protein, 442 aa, B.fragilis
QNYYLCNMIQNRVAQYIEKEKLFCLNDKVLVTLSGGADSVALLRLLLSMGYTCEAAHCNFHLRDKESDRDEAFVRRLCHESGVLLHIEHFDTTQYAAKKHISIEMAARELRYEWFETLRKQREASVIATAHHKDDSVETVLLNLIRGTGINGLLGIRPRNGNIVRPLLCLSREEIIAYLQYIDQDYVTDSTNLLDEYTRNKIRLNLLPLMKEINPSVKESIIRTTNYLNDAATLYNQSIGEARKRILTPEGIRIEALLQEPVPEAILFEVLHPLGFNTTQIDNIRQTLDGQPGKVFLGKGWRVIKDRDLLLIEEDTTAEESQPPFRLVMEEYDYTSEFIIPKDKNTACFDADKINKTWEIRKWKPGDVFIPFGMTGKKHVSDYLTDKKFSLSEKEKQWVLCFGEQIAWLIGERTDNRFKVNENTKRVIIVRIVSEHSDFIEE

SEQ ID NO: 9360 - protein, 182 aa, B.fragilis
LRCKSHKKCTFATEFFYGQIMREYIIADNQDITKAGMMFLLSKQKEVSLLLEADNKMELVQLLRIHPQAVVILDYTLFDFSGADELIILQERFKESDWLLFSDELSIGFLRQVLFSSNAFGVVLKDNSNKEIMTALHCASRKERSICNDVSNPALCGSGKLTTCLGRAHVLYRMNTRLLHTR

SEQ ID NO: 9361 - protein, 350 aa, B.fragilis
TPYRQLPRISERLKSTGSQKKGALPILNVAKELLNIPTQLHEINDICAIYCIFAKLKVMKMDLKKEVKEEFIRFQRNEKTESIVYERVPFIEKDESTRKVLRLISAEEKAHYATLKKYTETDVAPDKLGIAKYYWLARILGITFAIKLMESSEENAHHDYAKYTDYPDLRQLANEEEVHEQKLIGLINEARLEYMGSVVLGLNDALVEFTGALAGFTLALSDSRLIALTGSITGIAAALSMASSEYLSTKSEGGETKHPIKAAIYTGIAYIITVVALVAPFILIENVLIALGVMLAMALVIIALFNYYYSVARGESFRKRFTEMAVLSFSVAGISFLIGYALKTFTGIDA

SEQ ID NO: 9362 - protein, 93 aa, B.fragilis
YISRQPNSSPINPLTTREAKMPVSSPDTTIPTFLPLFSGRENWEAIGMNICGITEQMPVRSEAHRMTWMLGAIAITSNETINMEKLVRMIRFR

SEQ ID NO: 9363 - protein, 299 aa, B.fragilis
DLKRVALGKRRTINVALVGNPYCGKTSLFNLASGAHEHVGNYSGVTVDAKEGYFDFQGYHFKIVDLPGTYSLSAYTPEEIYVRRHIIDETPDVIINVVDSSNLERNLYLTTQLIDMNVRMVVALNMYDELEASGNTLDYLLLGKLFGVPMVPTVCKRNIGVDRLFHVVINLYEGADFIDKKGHIHPEVAKEIMDWHQSLPNFKDHGEHPADYTHGKEPVGKVFRHIHINHGPDLEKAIDAVKEEISKNEFIRHKYSTRYLAIKLLENDPEIERFIHTLPNAVEVEKSLHHGAGRISAVQ

SEQ ID NO: 9364 - protein, 208 aa, B.fragilis
TNNSFKPKQKKVMKKFIALVALVLVSASTLMYAQESQRDIRRADRKAQRDAERARLKAEEQAADQVAYQQAVQAIKDKQFVLEADQVIFKRGQTAFVSSNTNFVMLNGQRATVQVAFNTPYPGPNGIGGVTVDGTTSDVKVTTDKRGNVNCNFSVQGIGISAQVFITLTNGGNNATVTINPNFNSNTLTLSGNLVPLNQSDVFKGRSW

SEQ ID NO: 9365 - protein, 482 aa, B.fragilis
KRKRRIMKKAPSPLVSLIPLVVLVIMLFATIRTFGSDALSGGSQVSLLTTTAVCILIGMGFYKIGWKDFELAITNNITGVSTALIILLIIGALSGAWMISGVVPTLIYYGVQIIHPSFFLTSTCIICALVSVMTGSSWTTIATIGIALMGIGKAQGFEEGWIAGAIISGAYFGDKISPLSDTTILAASVTDTPLFRHIRYMLITTVPSLIITLVIFTVAGLSHNAGSTEHIAEFSAALAGKFHITPWLLIVPVVTGVLIARRVPSVITLFLSAALAGAFAVFFQPDLLQEISGLQNSEGTQSIFKGLMMTLYGGTSLQTSNEALTELVATRGMAGMMNTVWLIICAMCFGGAMTAGGMLGSITSVFVRFMKNTVSMVASTVCSGIFLNLATADQYISIILTGNMFRDIYEKKGYESCLLSRTTEDSVTVTSVLIPWNTCGMTQATILSVPTLVYLPYCFFNIISPLMSITIAAIGYKIVRRK

SEQ ID NO: 9366 - protein, 63 aa, B.fragilis
PASICQSNRRYYYICISIGSLQARSIIYFQGLYSQRYNLSYKEFTICTLKFMLRIFRLFLNKI

SEQ ID NO: 9367 - protein, 394 aa, B.fragilis
LCAMKQILKENGGLPASILWTLAIVAGISVANLYYNQPLLNMIRHELGVSEFETNLIAMVTQIGYALGLLFIVPLGDLYQRKRIILTSFSILIVSLLVIAMAPNIHVILCASLLTGICSVMPQIFIPIASQFSRPENKGRNVGIVVSGLLTGILASRVVSGFIGELFGWREMYYIAAGMMLICGMVVMRVLPDIRPNFQGKYSDLMKSLLSLLKQYPELRIFSVRAALAFGSFLAMWSCLAFKMGSAPFYADSHIIGMLGLCGIAGALSASLVGKYVRKVGVRRFNFIGCGLILSAWLLLFIGENSYWGIVAGIIIIDIGMQCIQLSNQTRIFELCPSASNRINTIFMTTYFIGASTGTFLAGTFWQAFGWHGVIGTGVALTTGSLLITFFSKR

SEQ ID NO: 9368 - protein, 1870 aa, B.fragilis
TKRLFAMKGKKNLLILFSCVLTVIIAGLFACTRSAKEIIPSSEYAPYVNAYTGGVISQSSPIRIELTQDQPMVDLNNELKDCPFSFTPSLKGKAYWVSNNTIEFLPEEGELKPGKLYQGSFQLGDFVEVDSKLKVFDFSFRVQESNFTLHTAPLEIASSSPDKVTVKGEIRFSDKMTKEQVEKILSTNGTSTITIGSTSNPLEYSFIISNIQRKEQDYDLKITADGEPVEMDRKQSESITIPAKDSFRFLSAERISQPENGIQIVFSDPVSDTQDLKGLIEIPEIPSYIFQITDNKVNVYFEAGQLSKLTLKIHEGVKNNQGKALGSSHSISFGELNLKPQVEISSAGAIIPDSKNLVIPFRAVSLYAVDLRVIRIFENNVLMFMQNNSLSSANELRRSGRLVYKKTLFLGKDPSKDIHKWENYSIDLAGLIHQEPGAIYRVILSFKQEYSAYPCGSGENPKMQFSEETESLTKVKSDILSEEDEAVWDKPETYYYFSGNENADWSQYRWDERDNPCHPSYYMTSDRIAACNVLASNIGMIVKRNSMNKLWIAVSNILDTKPVEKAKVIVYNFQLQPIGEALTDAEGFAIIETKGTPFIVVAESEKQKAYVKVADGEEQSTTRFDVGGKDIQKGLKGFVYGERGVWRPGDTLHISFVLEDRNKRIPDKHPVTLELYNPRGQFYSKQISTNGLNGFYTFKVPTQPEDPTGLWNAYVKVGGTAFHKSLRVETIKPNRLKINLKLPGEILKAADKEVQAHLSSAWLTGATASRLKAKVEMSLSKVNTQFKNYETYIFNNPATEFTSIRTDIFNGTLDENGNTGFMLKLPTSENAPGMLRANITTQVFEPGGDASIQTLSVPYSPFPSYVGINLNQPQGRYIETDKEHIFDIVTVNSDGKPVNRSGLEYKIYRISWSWWWENDNESFETYINSSSITPVATGRLNTTGGKGQFSFKVNYPDWGRYLVYVKDRESGHATGGTIYVDWPDWRGRSNKSDPSGIKMLSFSIDKDSYEPGETVTAILPASAGGRALVTLENGSSVIQREWIEVSGKEDTKYQFKVTPEMAPNVYLHISLLQPHAQTVNDLPIRMYGIMPVFVTDKQTVLEPQIKMPEVLRPEQVFNLTINEKHGRPMTYTLAIVDDGLLDLTNFKTPDPWNNFYAREALGIRTWDMYDDVLGATAGSYGSMFSTGGDETLKPSDQKANRFKPVVKFIGPFSIGKGKSRTHQITLPMYVGSVRAMIVAGQDGAYGNAEKTVPVRTPLMILSTLPRVLSTNEEIEVPVNVFALENNVKNVNVSIQASGAGIQVTGNKQQTLTFTQTGDRLIFFKLKTGTKTGKATIHLTANGNGQNTKETIEIEVRNPNPVVTLRESQWVETGKSEELNYQLSSGSEGNSIQLEVSRIPSVDISRRFDFLYNYQHNCTEQLTSKALPLLFISQFKTVDNEELEKIKVNVQEAIRQLYGRQLPNGGFVYWPGNASADEWITSYAGMFLILAQEKGYAVNSNVLNKWKRFQRAAAQNWQPVAQEQSWWYWQADFQQAFRLYTLAMAGAPEHGAMNRMKELPTLSQQAKWRLAAAYALNGKEKAAGELVFSAKTTVEPYSSNNYVYGSSDRDEAMILETLLLMNRQREAMEQAKIVSHNLTRETWFSTQSTAFSLMAMGRLAEKLSGTLDFSWTLNGKQQPAVKSAKAVYETPISTSSREGKVILKNNGKGALNADLITRTQLLNDTLPPIANNLRISVKYVDNNGSPIDTHSLHQGTDFMAVVTVANTSGTTDYTNLALTHIIPAGWEIFNERMTGQISTSAPYSYQDIRDDRILTYFNLQQGQAKTFTVRLQATYSGDFVMPAIQCEAMYDANVQARTQAGRTKVVRQSIE

SEQ ID NO: 9369 - protein, 161 aa, B.fragilis
YLVSEECSSFFYLHNSDFNMFGKKKNEDYSVKTVKVGVDKLTTIALGTMVKGTITVEGDLRLDGIIEGNVSCRGKVVIGPQGRIKGNVTCTGAVLHGMLQGDIQVAEDLIMKSGCTMNGDVYTCKLEIESKARFNGTCNTTEKDTLVTSQVVKPETVDTEK

SEQ ID NO: 9370 - protein, 421 aa, B.fragilis
SELFMRKKSMFLWSLLAAMTMSACSEHNELPSGEVPGGNSKANFIVKLNFEGTSMEQGGKTRAAQSTAVPETSWSNIRQVQILLYDASNIVRFSDVVTPTAGNTTFTYTDVPAGTYTMVAIANAKSSADAINTYLDGGTTPVEWGMWNVRQKQVQNMVMKYKTGTFPAFCSAALAGNTAYTEPAEIFMGAVSNVVISSDATATPSPIALKREVSLMRVRLNVKDKEGNTNNENTAKGVDFTQDASIMIYRLPDYLKVMAGNDGGVSATSTATNILSISDGEVFKTAEPGAGYNPGGMILNGNFTMWRDVVVFPNNGGRVNDSATTGTADRQRQYFIVVSGRGKAGHILGDGTALPSDATVYWSGVVKENFVPNVIREVNLTLRTGGSTTVPVTPTEYGGLTITVGAPTPWDSNIVNSDIIM

SEQ ID NO: 9371 - protein, 386 aa, B.fragilis
EYSFYLLLLPILTIFALRLKTKVMGKEKIILTGDRPTGKLHIGHYVGSLKRRVELQNSGSFDKTFIFIADAQALTDNIDNPEKVRQNVIEVALDYLACGLDPEKSTIFIQSQIPELCELTFYYMDLVTVSRLQRNPTVKTEIQMRNFETSIPVGFFTYPISQAADITAFRATTVPVGEDQEPMIEQAREIVRRFNYIYGETLVEPEILLPDNAACLRLPGTDGKAKMSKSLGNCIYLAEEADEIQKKVMSMFTDPDHLRVQDPGKIEGNTVFTYLDAFCRPEHFERYLPDYPNLNELKAHYQRGGLGDVKVKRFLNSIMQEELEPIRNRRKEFEKDIPAIYEMLRKGCEVARAAAADTLSDVRKAMKINYFDDAELINEQVKRFNK

SEQ ID NO: 9372 - protein, 399 aa, B.fragilis
LLRYMKKILMLLALAGVTSVASAQQTTITGYEVIQVQDKYQVITNPFWDNWFFSIGGGAEALFGDNDHVGKFRDRISPTLNVAVGKWFTPGLGLRLQYSGLQGRGFAGSETADFVKSGKLANGYYKQKFNYMNLHGDVMFNLNALFGGYNSHRVYEIIPYLGAGFTHSYSKPHREAFAMNAGIINRFRVSSAVDINIEIGGMLAEDKFDGEIGGKHGYDGVASLTAGLTYRFPARGFARPMPQIISEIELANMRRQMNDMAAANQSLQQQLVDAQNQPVAEVAEQVVVTDANIAPRTVFFTIGSSELSPREEMNLSYLAAKMKEFPDTQYTVYGYADSATGTPAFNKELSQKRAQAVVNALVKKYGVDSSRLKVDAGGGVDKFGKPIYLNRVVLVESVK

SEQ ID NO: 9373 - protein, 62 aa, B.fragilis
VNYKTGRKKDGKMIVYNHKKGEKPFIGFSPLSYYLIVANRIIYIPASSLSEYLPVSDRRMPR

SEQ ID NO: 9374 - protein, 304 aa, B.fragilis
NMRKNRLLIVLFTGVAVLLSLASCTYDYFEDETNYQVFVPEVLNKTVSDCRVLVYNDAGTLVGARYATSPWDKDPRMEAGLFSFRLTPGEYKVYCYTNTDSLTFVDGQHLDASAFILKSSSTGPNRYVQLSDILFQKFVPAIVHPGILQTDTAALERYTGRITVRFKKFPGDVSHIKKVQLLAEGAPVMQYLKNDTLTGRLTPEDKMFHFGTLPVQEKADVLEVDHRFIPSVENEPMRLNYTFLDENGAVVNHLPVEVTERETGLPLRLLHGKRIIIEIESYTVIKISVVGWNEDIESGDTDME

SEQ ID NO: 9375 - protein, 529 aa, B.fragilis
KVAEMRKKKIQILLSAAAFLFLMGGTMPSVAQERKIGRVERRADRNFIRQKFDKAMAQYETAIRREKDEAGQAALHLKTARLYFMVREYGRASEHYDKAMSLRPDLLGVDDVCDYVDALRFQGQARKAEAICLDNAYKDIYSRYQRYQNTLQALAMRHSVQEDPGFSAKRLLLNTSNAEFWVGNYGEQPFYAISYSKFNDPGKLFFHRTHYYALDEPGETGVETQKPPRYYGYFRKIPADLQNGPVTFSPDMKSMVATVIEYDKEKTTVEMANRKLRPFRTKLFYSVLKNKKKRFTKYVPAFPQEEMSSYAHPYLFNEGKSLLFTSDMPGGYGGFDLYVVHWDEEAQAWGTPVNLGPDVNTEGDEIFPVIYKGRLIFSSNGLPGFGGYDLFSAYYDKDGVIPGSISHFPYPVNSVFNDYYMCPLDLRTAYFVSDREMASRDDIYYLRTVEDLGTQQGMPFYGMSEENAILGGALLLNGTTETVSPESVTLKQYAPEGLLMTLYFDFDSDELTDECLHHGAGRIDGCSAI

SEQ ID NO: 9376 - protein, 332 aa, B.fragilis
AKACDNLICNLNRLKMKKELLTRFMEKRIVELKKEQRNGTAHVYQSTLNRLKNFMNGREITFSQLTPEWLALFEQKLLADQLKWNTISTYMRMLRSVYNQALERGVATYVPRLFNKVHTGIDCPVKRAVSPEVICRLMTDRKPLPGKLAFSRDLFVLLFLLRGMPFVDLAFLRRCDLQGNVITYHRRKTSRKLTVVVGKEAMEIIQKYMYAIPDSPYLFPIIQNPGKDEYGQYARMLRLQNYRLTQVANILGIRDRLSTYTARHTWATTALRQNYNSSLICDAMGHSSVKVTETYFQPYRDDEVNRMNSSLITYILSKKKRGTDKKNKKLIA

SEQ ID NO: 9377 - protein, 202 aa, B.fragilis
KRIRMKSVIRHILSVAVLFCLISGVQAQSVKVNIPFWLTGSPNVGFEYTLTRQLTVNGEVLWMPYLFKKHEEVFRALQSSVELRYYVNPRNFYTNDSWDGFYIGPYAMYGNFNIGLLKHNDPLQSYRRKGWGVSGGISTGYKFAFNSRWGLDLNIGLGYAHLQYNKYYLGGEYVNFPLERKKTKRWIGPTKFGINLTYNIFR

SEQ ID NO: 9378 - protein, 1081 aa, B.fragilis
QLIMTIKEMEKEMKKVLVLGSGALKIGQAGEFDYSGSQALKALKEEGINSVLVNPNIATIQTSEGIADKVYFLPVTTYFVEEIIKKERPDGILLAFGGQTALNCGAELYTKGILDKYGVKVLGTSVEAIMYTEDRDLFVKKLDEIEMKTPISQAVESMEDAIAAARRIGYPVMVRSAYALGGLGSGICANEEEFLKLAESSFAFSKQILVEESLKGWKEIEFEVIRDANDHCFTVASMENFDPLGIHTGESIVVAPTCSLDDKELKMLQELSTKCIRHLGIVGECNIQYAFNSDTDDYRVIEVNARLSRSSALASKATGYPLAFVAAKVALGYTLDQIGEMGTPNSAYVAPQLDYYICKIPRWDLTKFAGVSREIGSSMKSVGEIMSIGRSFEEIIQKGLRMIGQGMHGFVGNDDVHFEDLDKELSHPTDLRIFALAQAMEEGYTIERIHELTKIDPWFLGKLKNIVDYKAKLSAYDKVEDIPADVLREAKVLGFSDFQIARFVLNPVGNMEKENLMVRARRKELGILPAVKRINTIASEHPELTNYLYMTYAVQGYDVNYYKNEKSVVVLGSGAYRIGSSVEFDWCSVNAVQTARKLGYKSIMINYNPETVSTDYDMCDRLYFDELSFERVLDVIDLEQPRGVIVSVGGQIPNNLAMKLYRQSVPVLGTSPISIDRAENRNKFSAMLDQLGIDQPAWQELTSLEDVKGFVEKVGYPVLVRPSYVLSGAAMNVCYDDEELENFLKMAAEVSKEYPVVVSQFLENTKEIEFDAVAQNGEVVEYAISEHIEFAGVHSGDATLVFPAQKIYFATARRIKKISRQIAKELNISGPFNIQFLARNNEVKVIECNLRASRSFPFVSKVLKRNFIETATRIMLDAPYSRPDKSAFDIDWIGVKASQFSFSRLHKADPVLGVDMSSTGEVGCIGDDFSEALLNAMIATGFKIPGKGVMFSSGAMKSKVDLLEASRMLFNQGYKIYATAGTAAFLNAHGVDTTPVYWPDEKPGAENNVMKMIADHKFDLIVNIPKNHSKRELTNGYRIRRGAIDHNIPLITNARLASAFIEAFCDLKLEDIQIKSWQEYK

SEQ ID NO: 9379 - protein, 112 aa, B.fragilis
IFTVLKKTIKSFPIFQPEKWKYLLLPFPKDNPLKMFSYLISIAKIIVLLCVIQKIYLNLPPISSPVTYEVTDIFSISNQAISFLFFLSVPLFFFDKIYVIRELFIRFTSSSL

SEQ ID NO: 9380 - protein, 191 aa, B.fragilis
LSKSFFERSNHRRQRHTSLIMTLADQCGCTDHGIYASASNSFHCTLDYDDPDDPTQALYQKETDNSRIKTCTLEPKLDYRLCVFSCRNTLLRNRRTYYLYLYWTIFHKGIPEVTYLPPNIDFATRQTNHFFTTSYESRMPFETILNSTHLHSTYNVSQRILVEINSGPFYWIGKPELLETSPSISQDFSRN

SEQ ID NO: 9381 - protein, 389 aa, B.fragilis
YKMLQPELKMRRDKIRVLMAQQNIEAALITCNVNLLYTYGRIVSGYLYLPLHSPALLFIKRPNNITGEHVFPIRKPEQIPDLIKENNLPMPQKLMLEGDELSFTEYNRLAAIFPESEIVNGTPLIREARSVKTPVEIELFRRSGVAHAKAYDQIPSVYRPGMTDLEFSIEIERLMRLQGNLGIFRVFGQSMEIFMGSVLTGDNAAYPSPYDFALGGEGLDPALPGGLNKTPLKEGQSVMVDLGGNFNGYMGDMSRVFSVGKLSDEAYTAHQVCLDIQEAVSSMAQPGVVCEDLYNAAINIVTKAGFADKFMGISQQAKFIGHGIGLEINEAPVLAPRMKQELEPGMVFALEPKIVIPGVGPVGIENSWAVTPEGVEKLTICNEEIIELQ

SEQ ID NO: 9382 - protein, 69 aa, B.fragilis
LSAFLYSASLTERVFVEKEGLAESPRLNVPTPYETASLPESHEATHEISIAILTIKESLFIMITTNYYS

SEQ ID NO: 9383 - protein, 471 aa, B.fragilis
HQKTFLIFAYETSYILSESTFLKHTIMNIEKIMSSLEAKHPGESEYLQAVKEVLLSIEDIYNQHPEFEKAKIIERLVEPDRIFTFRVTWVDDKGEVQTNLGYRVQFNNAIGPYKGGIRFHASVNLSILKFLGFEQTFKNALTTLPMGGGKGGSDFSPRGKSDAEIMRFCQAFMLELWRHLGPDMDVPAGDIGVGGREVGYMFGMYKKLTREFTGTFTGKGLEFGGSLIRPEATGFGGLYFVNQMLQTKGIDIKGKTVAISGFGNVAWGAATKATELGAKVVTISGPDGYIYDPNGISGEKIDYMLELRASGNDIVAPYADEFPGSTFVAGKRPWEVKADIALPCATQNELNGEDAKNLIDNNVLCVGEISNMGCTPEAIDLFIEHKTMYAPGKAVNAGGVATSGLEMSQNAMHLSWSAAEVDEKLHSIMHGIHAQCVKYGTEPDGYINYVKGANIAGFMKVAHAMMGQGII

SEQ ID NO: 9384 - protein, 248 aa, B.fragilis
VNIKRLVYMNAIKNIYAVLALIALCLSSCEMKNELEGKYNLKNDEGLLTLDLVNKTQATPTTKAESTSLTDELDVNTYKVEIVDNATEAVVRSFASYAKLKEALPLVVPVGNYKIVAKSGVLQDASRTPYFEGSSSIEVKQGMESKAEVLCKSATVKVSLNISEEFLNMFADDYVFTVSNGIGGVIYVKKEDLSSIYHSIQAGCTSINIVSKERQKNSGRDIETVDTVTSHMQKVCKRVILLMSRCNR

SEQ ID NO: 9385 - protein, 201 aa, B.fragilis
KSVKIRTIQNVTRSDQKWGIQLHIDLTMDETGIPVKVPTELIEQSNPEDPDQPSDPDQPTVDEPDIIGPYKVVKVYTNNPPTVQVTMTAPAGIQNLLVTITSDSTEFIGLISQMGLGETFDLANPGDLEDKLEGSLEVGSGIGVIDPNDPIKDKKEFIFHVSGFMPMLSPFGLQQHYFTIKLIDNNGTELAKKLTVKVVKN

SEQ ID NO: 9386 - protein, 994 aa, B.fragilis
NYGKPMLSKFKLNQLYFKDTQFANLMTRRIFNVLLIANPYDAFMLEDDGRIDEKIFNEYTSLSLRYPPRFSQVSTEEEALRQLESVSFDLVICMPGTGDNDSFDIGRHIKEKYEQIPIVILTPFSHGITKRIANEDLSAFDYVFCWLGNTDLLVSIIKLIEDKMNLEHDVKEVGVQLILLVEDSIRFYSSVLPNLYKFVLKQSQEFSTEALNAHQRTLRMRGRPKIVLARTYEEAMDIYNKYTNNILGVITDVRFPRVDKGEKDGMAGIKLCAEVRKKDPFVPLIIQSSETENAAYAAKYGATFIDKNSKKMDVDLRRIVSDNFGFGDFVFRNPETGVEIARVRNLKELQNILFAVPAESFLYHISRNHVSRWLYSRAMFPVAEFLRPITWHSLQDVDAHRKIIFEAIVKYRKMKNQGVVAVFKRDRFDRYSNFARIGDGSLGGKGRGLAFIDNMVKRHPEFEEFENARVAIPKTVVLCTDVFDEFMDTNNLYQVALSDADDDTILRYFLKAKLPDRLVEDFFTFFDVVKSPIAIRSSSLLEDSHYQPFAGIYNTYMIPYLDDKYEMLRMLSDAIKGVYASVYFRDSKAYMQATSNVIDQEKMAVILQQVVGNQYGDRYYPSMSGVARSLNYYPIGDEKAEEGTVNLALGLGKYIVDGGMTLRFSPAHPSKVLQTSELDIALKETQTRFYALDLKNAGDNFSIDDGFNLLKLHVKEAEKDGSLRYIASTYDPYDQVIRDGLYPGGRKVITFANILQHDVFPLARILRWVLRYGQQEMRRPVEIEFAVTLNHDRDKTGTFYLLQVRPIVDSKDMLDEDLTTIPDEDVLLRSNNSLGHGIMNEIHDIVYVKTDHYSASNNQNIAWEIEKINQQFLNEGKNYVLVGPGRWGSSDTWLGIPVKWPHISAARVIVEAGLTNYRVDPSQGTHFFQNLTSFGVGYFTINAFMNDGVYNQEFLNTQPAVFETEYLRHVRFERPIVVKMDGKKKLGVVLMPDK

SEQ ID NO: 9387 - protein, 81 aa, B.fragilis
NSTDKSRCFYWEKQEKTIHFIADYPYMHRLLSRFRLKISPTLIRIDHKAGHGSNKATTKLVKEQADIYAFIMYNLGMKMKY

SEQ ID NO: 9388 - protein, 274 aa, B.fragilis
LVVIIMKRLSFMVSMAMLISCVASCDSGSDAVSYGVGTLSLGLSANPSFSTKTRSVNEAEYKKADNYQVTVKDADGASLYNGLYKDMPLSIDLTAGKGYTVKAFYGENVNAGFDKLYVEGSQEFTVSEGEQKNVILYCKPANVKVSVIYTEDFLKYYSDCTVSLSTSHLTAPFEVNMKKDFGKDAYLKANADGEKVSITVGGFRDKEGNEVVMEALVAEKKVAPKTHLTITVDPEVITISTGTASLDVTVDTGTEDKDVNIEIPEEYWPGNASK

SEQ ID NO: 9389 - protein, 104 aa, B.fragilis
RLSAFVLPYRHRYTYQKPVPIDYKLLDSQIYSYLASLALLAIGYQSVASLLYPYFLLSLVSSLLPSYYLSIYKYTQLHNIPQRKFKFFKIKGKLLNNLLYTLLL

SEQ ID NO: 9390 - protein, 63 aa, B.fragilis
ISKYSPLCQRKTQLTIFFVFLQSLLFKHTFLYSNVFVYYKFSIFLLKFVLFLPEKLYVCTSHR

SEQ ID NO: 9391 - protein, 336 aa, B.fragilis
IGNKKVIKMKQATTGNKDIIKKLLTDSLSPEEREKLNNYKFVNQAIYSQWEQASDMYTDVDKEERMLTNVMHQIKKGKTGRFRQNLHRYGWVASIALLLICGTLSLMLLSRKAEPEVWYVLNSGRQSMDSVRLADGTLVMLNAGSRLTYPKEFSGNKREVTLSGQAFFSVHPDKAHPFVVKTKNMDVTALGTAFEVFSFDGDESVETVLLNGKVKVEPKDHKEQIKGEYILQPNEKLTCQVNGDIRIDRVDANSYSAWRIGGRLSFKNETLAMILPRLEKWYGQKIDCPQKTADHYRFTFTLRNEPLDLILNIMSHSAPLNYKLISNDYYVLEELK

SEQ ID NO: 9392 - protein, 515 aa, B.fragilis
KQANAEAESGVWKHLLVLPELHQSVWRQNHKELICKDMKTIYILLITVLSWSLQACTAQCGKPDACTDSIPRIYPDYAGVTFPLNIAPPNFRIGENADAFQTEIGTGETADILYTSKSPEVIIPTKKWKKLLQKAAGKEIFIRITLLRGGKWTRYADIKDTISNEPIDEYLVYRLLYPGYELWNEMGIYQRDLTGYEETPIAENRNFGKQCINCHTFNQNSPETMMVHVRGKSGGTLICKNGKVEKVNTKPEGFKNGGTYAAWHPSGRYIAFSMNEIQQFFHSSGQKPIEVSDLAADLMVYDTEKKTFLTDSLICGERYMETFPNWTPDGKTLYFCRGNAYKEKMPLDSIRYDLCRIGFDPESGKFGTPECVYRASEQGKSVSFPRVSPDGKYLMFTLSDYGNFSIWHPESELCLLTMDTGEIRFLNEVNSNDVESFHTWSSSGRWFVFSSKRLDGLWARPFFASFDPETGKAGKPFLMPQKDPDFYDTFTKTYNLPELIKQPVRNGNEMIKAIH

SEQ ID NO: 9393 - protein, 545 aa, B.fragilis
QNMKNKILYIIASVMLTGFTSCSDFLDRYPTEELSDGSFWKTKTDAEMAVSDIYRCLPNWDIDEDINSDNAVHGIKWANGNVSKGVYDPADQGWSEDYGYIRRCNLVLQKLEEMELSQSDKEPIAGQAYFFRGYIYFELIRKFGDVPYIDQPLKLTDVEDITRTSKDEIYTKIMADFDKAFSYLPEEWPATQWGRITKGAAMAMKARAALYFGNWETAATAAKSVMDLNKYDLYDKENTGKYQELFWEKTDGCEEIILAVQYNAPDKTNYLIGWECFPTKGWGGLNPTQSLVDAFEDSEGAPISKSKIYSEKNPFANRDPRLEVNVLHDGEEMYGVTIKVAPLKSSGSTGIAQHGDATATGYYQQKWLDPSIDPQSAGWEMGKDWVTIRYAEVLLTYAEAKNEVSPLDDSAFEAVNQVRRRVGMPELQKTDATKPTYCATQDDLRQRIRNEWRVEFALEGGKRQWDIRRWGIAKDVLNAPFLGIKYKMVDDAVNADPKDGGKVCVLYEGDNVKLAGSRYEDHNYIYPIPQSEIDLNPKLTQNPGY

SEQ ID NO: 9394 - protein, 62 aa, B.fragilis; identical to SEQ ID NO: 9356

SEQ ID NO: 9395 - protein, 452 aa, B.fragilis
KNEDGGYEMSRLSYFGRVQYDFMNKYLFEANLRADASSRFPKDNRWGVFPAISAGWRISEETFIKDNVSWISNLKLRLGWGKTGNEELDPDDIYPAIPTYAYEKYMFGNSLYSTAYESRYVNNNLQWATVTNYELGLEAGFLNNMFGFELSVYKKKTNDMLLYMPIQGVIGMGAPAQNAGSVENTGFDLNLLHNNRINKDWSYAVNLNIAYVKNEIIDMNGTEGANSKNDKLWYIEGNPIGSYYGYVANGYFNTDDELANYPKRTGKEQLGDIKYLDLNGDGKITADGDRQIIGKNFPSWTTGLNLTLYYKDFDFSAMFQGAFDVDGYYMAEAAYAFYNGANALKRHLDRWTPEHHNASYPRITKDSQTNFTTSSFWLQNASYVRLKTISLGYNLPNSFLSKLGVQKAKLYVAGENLLTFSDLEGIDPEEGNERGWSYGNVKKVSIGLKVSF

SEQ ID NO: 9396 - protein, 201 aa, B.fragilis
NLYCFSLKNCMFAHHTDRFMTEKELIVSLKQGDEAAFTALYRMYWPKVHNFSRLYLSSIAEVEEVVQEVFVKLWEARIFLKENESFKGFLFIITRNIIFNQFRKSFNENAYKTTVLSSAEVEYDIENEMDAADLQGYIKKLISELTPRQQEVFHLSREEHLSYKEIAIRLSISEKTVERHINEALKFLRKNIYLFFIFLSL

SEQ ID NO: 9397 - protein, 583 aa, B.fragilis
HFKSNDYMKKIITLLCAVTTLTACDIDRLPYGSMSAEQITQDPTSSLESLVNGCYAQLKSWSDPMHRLGEYAGDNMAKDKSSTDAFFDFISYSRDADNYRLQSFWDSGYKAIAQASNIIKMIDEGKSKIIDYQLGECYYIRGMMYFYLGRAFGRPYWDKPEGHMGVPIVNGTPDDVNNLNLPDRSTVQDTYEQAIDDLKVAARLMENGETKREGPAYASKEAAWAMLSRIYLFMSGTYEAPNSENAQLAIDYATRVIESTTSEGGLKYELLSRENFMRYNTFMPENNKESIFVVKIMASEKPDYWNSIGGMYSYAGQQGWGEMYASAKYMDLLNEQGRNDWRPDKKKIVDARANFISPSYITDSDGKYVEVFRFIKNVYNKNNIHTGYTYVQLPISKRGNTVTCKEGETNYTLSLINSSEEKYSINYSDGQTYSGVIDYEIELSSGQPKFYILKCSNEGTASGEAESQLHSPVISRLGEVYLNRAEAYAKKGDYSHAQADLNIIRERSLPGRGYNDLNASNAKVRIEKERQLELAYQAERSYDVFRNCETLTRKYPGVHDAMLEIPATDYRVIYFIPQSAINS

SEQ ID NO: 9398 - protein, 1128 aa, B.fragilis
SSTGFLKDDVYYLLNLNYNLIIMVFMKKCNQKWFNPQKVKKQIAIAVAISLVCAIPISTFAQVLKFSIKKSNTSIQSVLQELEKESGYTFFYNDNQVKLDKKISINIEDASIEVVLNQIFENLGYSYRIVENQIVIYTTPTTTVQQTVQQKKQQKVTGVVKDIAGDPIIGASIIEKGSSSNGTITNVNGDFSLIVTGNELQVSYIGYIPQTINLKPGVSSYNVIMKEDTKTLDEVVVVGYSTQKKESLTGALQTVKSDKLKDITTPSVENMLNGKVPGVYVAPGSGQPGSGGAVVIRGQATLSGTTAPLWVIDGVIVGSNAGALNPSDIETMTILKDAASTAIYGSQGANGVILVTTKNGKAEKMTVNVSAKVGISKLGRGNMEMMDGAELYDYYKSFSNQEAITFSRYNDKLRNCNFDWFDLAAQTGVTQDYNVSLSGGNEKIRSFLSIGVYDEEGAVKGYDYTRYNFRLKTTYKPFEWLSIKPALAGSRRDIEDKQYDVTSMFQRLPWDSPFDEEGNLVPNRYTGWVNSSNSNYLYDLQWNKSNSTNYEFMGNLDFDIRITDWLSFSSVNNYKYIGYNYSEYTDPRSSSGEGVDGRMREYQTTTVRRYSNHIIRFNKMFGKHSINALAAYEFNDYWAKATDMYGIGFIPGFEVLDVVAKPEKVGGSISEWAVQSLLFNANYAFDNKYLAQLSFRRDGASNFGDNAKYGNFFSISAGWNINREKWFHASWVDILKLRISYGSVGNRPSSLYPQYDLYSVSSKYNEESGALISQLGNKDLTWEKTYTTGTGIDVAFFDNRLRASFDWYNKYTSNILYAVPISGLVGVTSMWKNIGEMQNQGFELSIGGDIIRTKDWDWNIEINLGHNKNKLKKLYKTKNAEGQFVEKPIIISDGTSIAGTAKRVLQPGYPCDTYYLKEWAGVNPENGAPQWYKTVENEDGTLSRQKTSNYSEADQVKCGSSSPDIFGGFSTVLRWKDLDLNAVFGYSVGGQIYNYSRQEYDSDGAYNDRNQMKLQKGWNRWEKPGDIATHPVASYSNTSKSNSSSSRYLEKNDYLKLRSLSIGYNLKLPQYYINNMRIFFTGENLFCVTNYSGVDPEIPASDGSVIGTALPSVYPTVRKFMFGLNLTF

SEQ ID NO: 9399 - protein, 496 aa, B.fragilis
AALIMRKYFPYILFIFLFFIYFLCYQSVLSHVIYYQEQHHLFLYSKTFFLQHIQSQGWMSYLTAFIIQFFHIPTIGSILLAGILALIYLLTNDAIKKITGHNDLLLLSLIPSIYLFLYSMTVDHSLTPIIATFLGLLIMGLFHQITVRPWSFIRKIYSPLPPNNKYRLLIYSLLIAIYAGTSFYFFVQTYNMSEHRMIMAEKSVKEKNWENVLTQTEKYINSGRTNQLISYFHNLALYHTEKLPYQLFDYPQKLGVKALYFPWNSDSRESEYGHFIYEDLGYINEAQRWEFEAMVVWGETAPHLLNLARYNIVNKRPEVARRFINLLKQSLFYRKDAEELEKQLHAGSVPGLRMALENNKEHPARFANVINIGPELQYLCEQDTTNRMAFEYLMSDLLLSNNVVRFVDNLKFIRHFKYPEMPPAYQEALYIYKLGVDGETFSKSGFNVSENTEKRFQRYYNLYKNRQMQRLKAEFGNTYWYYLNFISPYGDKIIRN

SEQ ID NO: 9400 - protein, 648 aa, B.fragilis
LIVFMRKCNMRWFSPQRMKKHLAFALAVSLVAMVPVSAFAQVLKISMTKTNVSIENVLRELEKQSDYTFFYNDNQVKLNKKVSINVSDAPIETVLNEVFKNSGYTYKIVDNQIVVSTAAAAAKEVQATQQQKQRNISGVVKDAMGEAIIGASVIEKGNPTNGTITDINGKFSLNVGGNELQITYIGYMPETVSLKTGVASYNIIMKEDTKTLDEVVVVGYGVQKKANLTGSVASISADALESRSVASVSAALAGQIPGVTSIQTSGAPGSQTGSITIRGKNSINAASPLVIVDGVPGTMDTIDPSDIETLTVLKDAASSAIYGVQAANGVIVITTKQGKKGEKTHINYSGIVSWASPVVKRQYVNAYEHAILYNEAVHNENPNAVLPFTDEDIENYRNGTYPSTNWYDEAFKKSAFEQMHNLSISGGSEKTTYNASIGYTNQGGLTDEISYKRYNARMSLNSDINKYVSVGVNASGYRGIKEDGWMGYVTVAQGVSRSYPTDPVYAEDGSFNYSGKDNPVAIQDQSGFTRSTAQQLNATAYAQINILPELSVKGVFSLRHDYTNQEGFKKHFTYGNFDSGLREGYDEYYNHNRYTSQVLANYNKTFGKHSIAVLGGFESFEHIYKFTKASRKGGGNNELTESLNTLKK

SEQ ID NO: 9401 - protein, 1140 aa, B.fragilis
LIVFMKKCNLRWFSPQKIKRQLAFVLAICLVCIVPVTTYAQILKISMKRTNVSIQNVIRELEQKSGYTFFYNDNQVKLTKKVSVDVTDAPIENVLDQIFNNSGYTYKIIDNQIVVSAIKAEIPKTSSLQQQKSVRITGQVKDTTGEPIIGASVVEKGSASNGTITDVGGNFKLTVSGNEIQITYIGYIPQTVKIHPGVTDYSITMKEDTKTLDEVVVVGYGTQKKVNLTGSVASVSTDEIKDRVQTNVLSAVQGTVPGVTVISRPGQTPSINFRGRGNLGTSSPLYVIDGAIADATFFSNLDPNSIESISFLKDAASSAIYGSRAAYGVVLVTTKQGKSDKMNVSYSGYVGLSNPTYKPEYVNSTQYAELYNEALYNYNPKGGKYQGYTEEEIGYFRDGSKPDLYPNTDWNDLVLDKNVLTTQHSLDFSGGTDKIRYFIGLGYVYKDNMIPGQDSQRYNLNTNLSSDITKWLTVKAGVKYIRNDSDRDCGAPSLASFSMVPVTFVAKQSNGDWGTVNGGQTATSNFITGNPLRALSKKDWSKSKSENTMYDLGFDIKPVKGLIISGQGVFKGYEYKSKSYTALQPNAINYFSGEEIAGTGVTKNKMSMDWQSTNTMLYTATARYDWSNDKHAVGALVGTSYEHYKYERLAGSREEFPSDALTDMEAGSTSGAGYTNGAGSSEYKMLSYFARVNYTLMDRYLFEVNMRADASSRFHKDHRWGYFPSFSAGWRMSEESFMKDIEWINNLKIRASYGTLGNINNVGNYDYFQNYSSGNHYSFSDSPVIGIGESKPANETLGWEKVALTDIGLDFDIFNGLLGVTADYYIKNTSDILLGYNVPTETGITAAPSQNIGKVKNTGFELALNHRNKIGAVNYSIGANIATNKNKITNLGGSDNIIQTSSYIVKYILKKGESIGSFYGFKTDGLYTQADIDAGHYYTLSGVVPNAGDIKFVPQRDIEYKQEITDEDRTILGKDVPDFTYGVNLSLQYKGFEFSMFGQGISGTKVAFDVYGVHPFYHGQDSPRKYHLKRWTEENPNPHAAYPRIYSASSVHTTYNRNFSDYHLFDSDYFRFKTLSLGYTVPSATVKNWGLQSLKVYVTGENLFTVRADKKMEDFDPETAGGVIYTLGTKSVAFGVNISF

SEQ ID NO: 9402 - protein, 591 aa, B.fragilis
KIEFTMKNNIRKIALGLCLTGALTACDLDVVPPADIAAENFWQTEKDAWYALNTCYATLDGVDIWDELCTDNAHSHKPWEGNFEMVQQNGISTANGYGSYYFGTVRIVNNFIANIDKCAVSEELKTRMKAEARFFRALSYLDLTTKFGKVPVITEVLAYDAPNVKRDEVETVRKFILDELAEIAEILPDSYNGSYLYETGRITRAGALALRARAALYFGNYAEAEASAGKIISEGHHSLFRVSSLTTAQQKEADEMDAYIDYATKGIDKDKFVKGMFSYESLWHKGNASPANPEYIVTREYMADANNYDWTRYTYFIPKSFSQYDGYCSYEPMQDLIDAYWDVDGKTMRNDITMEQRKERYAEIWKDFKDMSQSQFIEKVPQTDIMKYDYMKEFRNRDSRLYVSMMFPFKGWHETIKGTFYFRWDPDLINKDGNESWTGYFYRKMVTLDPYDTWTAEEDYPVIRYAEVLLTYAEARIQNSGWDTEVQKALNDLRDRCGMPDVPTTMPSKEEALAFVRNERRIELAAEGHRFDDIRRYGNDYCSKAMNGPSYAPNGYVVINKVWDNRLMLMPIPQGAIDLNPLLKDDQNPGY

SEQ ID NO: 9403 - protein, 169 aa, B.fragilis
LGMFDIHFVTHDQLTEIILLEVIRLKSSAWNYSYEDQVSWINTHIKDSDLHCFLSEDGVNVGYLNLIETNIIVDDLSYRAYGVGNVCSIVRKKGYGSILLNYVNDFIVNKEYIGVLLCKPELSHFYNKSGWKLVPYLKLLCEFSLTNIEMMTYNCEFNYKQIIYKGGPF

SEQ ID NO: 9404 - protein, 87 aa, B.fragilis
NVVPLPDLLRVQENLYVVPCEQVRRCCNFYEDCLNAGGTEQERGYGRSILKDFSNDAQIKSLQSDGYNVYMYLDDELIEVPPCPCAE

SEQ ID NO: 9405 - protein, 161 aa, B.fragilis
VMNTLTSQIEQLQSLAHELLYLGVDGAPIYTDHFRQLNKEVLEQSDALYPQRGATSEEEANICLALLMGYNATIYNQGDKEEKKQVVLNRCWDVLDQLPATLLKCQLLTYCYGEVFEEELAKEAHTIIESWKDKELSEDKKEAINNLRNLEENPYPYSEME

SEQ ID NO: 9406 - protein, 77 aa, B.fragilis
LPLTKEIDEVHQYPNVKLMTEDSQYKHETYLQTDKLLLPLQYSHYTISCVILALKYQQEEDKVSLKVSLLFILFIYT

SEQ ID NO: 9407 - protein, 94 aa, B.fragilis
LSRTHILSVIGLYLGCKNSIELTFKSEKDIMRCIDTVTITISKMEIDLPKIEIVKQCGMIAANTVFLINSLTSNIPYMFLDRLRGVKVTWDKIK

SEQ ID NO: 9408 - protein, 76 aa, B.fragilis
ATNALRAAGDVNYPFYVGLVVMWSVAVGIGYLFGIYWAWGICGMWVAFALDENIRGIIFVRRWYGMKWVNKSFVRS

SEQ ID NO: 9409 - protein, 85 aa, B.fragilis
AEKAGTNLQPQGIYKDNEPETLGVIQHLRINGQSEVPGQNAGKKDKGNAKRNATNMNFAQSEPNGGNQGKNDNCLQSRMFDKETI

SEQ ID NO: 9410 - protein, 402 aa, B.fragilis
IMKACFMGLGYIGLPTAIIAAKHGIQITGVDINPKVVEMTNLGKLHIIEPGMQALLQEVVSSGWLKASTTPDVSDAYFVVVPTPFKGNHEPDISYVETATRAVIPFLKEGDLYVIESTSPVGTTDKMADLIFDLRPELKDKLYIAYCPERVLPGNVIYELVHNDRVIGGINEASTDKAIEFYSHFVQGTLHRTNCKTAEMCKLTENSSRDVQIAFANELSLICDKAGINVWELISLANKHPRVNILQPGCGVGGHCIAVDPYFITSNFPMESKIISTAREINNYKAFWCAEKVQNSMLKFELEHHRRPAIAMMGLAFKPDIDDLREAPAKYITTKVMQSCNNADIMVVEPNVQEHNVFKLTDYKEAYTKADIVVFLVAHTSFKSLPYDETKVILDFCGISKR

SEQ ID NO: 9411 - protein, 431 aa, B.fragilis; identical to SEQ ID NO: 6067

SEQ ID NO: 9412 - protein, 81 aa, B.fragilis
INSYMNDIFDELVSSNYWNGKLPKVEFARKSYTNRIFGYVGNRLVKVLTGQRGVGKGCLLRQIIYQLMRWGVSSRDHSIYK

SEQ ID NO: 9413 - protein, 278 aa, B.fragilis
PINQQHNNLTIMATTYDGINYFPIAVNFMEENAMEVIEAKYGMKGLAIVLKLLCKIYKEGYYIPWGEEQCLIFANKTGKEADAEEVQGIIEIMIEKGMIDRGSYAEHKVLTSEAIQKVWIEATKRRKRNWTAMPYLLIKPKETCNEEKTVCTQNVEQDAGSDAKNACNTEQSKVKQSREFPPSAPPRGKEEEVNATPVSMPGYAFNTMTHNYVGLMGNLERFGITDEKEIEAILRLSDYGRKGTPVWKLICSTNWSNIGAKGKYMIAALNRAKKRSGT

SEQ ID NO: 9414 - protein, 174 aa, B.fragilis
MSEQQKYWFAARTRDKQEFAIRDSLEKLKTELDLNYYLPTQFVIRQLKYRRKRVEVPVIKNLIFIQATKQDACDISNKYNIQLFFPKDLLTRAMLIVPDKQMQDFIFVMDLDPNGVSFDNDHLSVGSRVQVVKGDFCGVEGELASEANKTYVVIRIAGVLSASVKVPKSYLRVI

SEQ ID NO: 9415 - protein, 565 aa, B.fragilis
LYLHNLSSNVQKTMEQSFIAYIENSIKNNWDLDALTDYKGATLQYKDVARKIEKLHIIFEESGIRKGDKIAVCGRNSSHWGVTFLATLTYGAVIVPILHEFKADNVHNIVNHSEAKLLFVGDVVWENLNESAMPLLEGILMMNDFTLLVSRSERLTHAREHLNEMFGKKFPKNFRKEHIEYHKDQPEELAVINYTSGTTSYSKGVMLPYRSLWSNTAFAFEVLPLKAGDKIVSMLPMAHMYGLAFEFLYEFAVGCQIYFLTRMPSPKIIFQAFADVKPNLIVAVPLIIEKIIKKSVLPKLETPTMKLLLKVPIINDKIKATVREEMIKGFGGNFEAVIVGGAAFNQEVEQFLRMIDFPYTVGYGMTECGPIICYEDWKRFKPGSCGKAALNMEVKVLSPDPENVVGEIVCKGPNVMLGYYKNEEATAQVIDKDGWLHTGDLALEDAEGNITIKGRSKNMLLSASGQNIYPEEIEDKLNNLPYVAESIIVQQNDKLVGLVYPDFDEAFAHGLKNEDMERVMEENRVTLNEMLPAYSQISKMKIYPEEFEKTPKKSIKRFLYQEAKG

SEQ ID NO: 9416 - protein, 72 aa, B.fragilis
LSLQHCPVVTAEGHVLIFDNGYGCNFSGSNRHSRGEYKIVGLDVEQIWEYGKERGEDFFSPITSEVQYIEES

SEQ ID NO: 9417 - protein, 103 aa, B.fragilis
QCSQVYYDAYSKCVAVLSLSCFAGGENSFVSLEGMNVAAHKGGYGQSSIFRDGGRKSGGLMRVGSFRAPNGWGEYANEKNQARAKLVIFPTNYIDKDSKKSNR

SEQ ID NO: 9418 - protein, 83 aa, B.fragilis; identical to SEQ ID NO: 6082

SEQ ID NO: 9419 - protein, 114 aa, B.fragilis
FRWHIRVNLYGYRLVGRFFPVYSGSGCKGVTYKKDIVDDLIEHKCDCSKLPAGTVILKVMKRQNLPIWVDKGTVQLNKLIPALKGIALELGSNVHVDETWCRYRTCFEYKKIYM

SEQ ID NO: 9420 - protein, 129 aa, B.fragilis
KPDNNSLINLKKSIMKKNRKAVSKNEMMKGKWKRQIMLEKDYTEQCSEWMAERLEALIEYMQYGHAAVAYMKQDGTFKLVKGTLVGYEKDFGKQYDPMEIKNTVVYRDVEQQRWMTFKIENFMEWRAIV

SEQ ID NO: 9421 - protein, 364 aa, B.fragilis
LRLNMIDRMDKNAKIYVAGHHGLVGSAIWKNLQEKGYTNLVGRTHKELDLLDGAAVKQFFDEEMPEYVFLAAAFVGGIMANSIYRADFIYKNLQIQQNVIGESFRHQVKKLLFLGSTCIYPRDAEQPMKEDVLLTSPLEYTNEPYAIAKIAGLKMCESFNLQYGTNYIAVMPTNLYGPNDNFDLERSHVLPAMIRKIHLAHCLKKGDWEAVRKDMNLRPVEGISGANSNEEILRILRKYGITETEVTLWGTGTPLREFLWSEEMADASVFVMEHVDFKDTYKAGAKDIRNCHINIGTGKEITIRELAGLIVNTVGYQGKLTFDSSKPDGTMRKLTDPSKLHNLGWHHKIDIEEGVQRMYEWYLG

SEQ ID NO: 9422 - protein, 386 aa, B.fragilis
LMKKIILVAALLSAAVCLPAQNKGGNKSGGINLSLWKKACTQPLDSTQTTYVNLGLFSAMHKLHGVGFNAFGSMVQNNMNGVQISGLANLAGGSMHGVQIGGISNVNGNNLAGLSVSGLVNITGNKAKGVLITGLSNIAGDNMRGLMMSGIMNITGDKAAGVQLAGLANVTGEEYDGLMMSGLLNVVGEEMNGLQLSGLANVTGGQMNGVQLGLFNFASKAKGLQIGLFNYHKEDMKGLQLGLVNANPQTKVQLMVFGGNSTKINVGARFKNKLFYTILGGGTHYLDFDDKFSAALFYRAGLELPLYRNLFVSGDLRYQHIETFRNKKVEGIPARLYALQARLNLEYRFTDKFGLFVTGGYGGSRYYNKARTYDKGVIAEAGVVLF

SEQ ID NO: 9423 - protein, 83 aa, B.fragilis
HVDLFSIRLYLCCTFKNNFMYSSSDFEKYNFSTRQRVNPKGISINSFCLIQGVLYRNFNTWFVKTRKRIVPVQIEGFLFLISL

SEQ ID NO: 9424 - protein, 69 aa, B.fragilis
RCRLAHVRNKFKDAYNQGYRKARFFLEQVAKLYKHEDDYRRDNLLATETKEKCNDIYINGIVDALCDGL

SEQ ID NO: 9425 - protein, 63 aa, B.fragilis
SRLLVSGALKYDLNYTDSLNNSVFPNTNFVSTRIIEVDSKNNVSFEMLYKSQKMDMTFRMQKM

SEQ ID NO: 9426 - protein, 390 aa, B.fragilis
ILFCFMKKVVLVFGTRPEAIKMAPIVKEFQKHPDEFKTIVCVTGQHREMLDQVLNIFEITPDYDLNIMKQGQDLYDITSRVLTGMRDVLRESQPDIVLVHGDTTTSMASALAAFYQQIPVGHIEAGLRTHNIYSPWPEEMNRQITSRITTCHFSPTLLSKQNLLDEGIRESSITVTGNTVIDALYMVVDKIKNNKELNKELESILKQTGYDINRLQNGRKLILITGHRRENFGNGFISMCKAINTLKKKYPDVDFVYPMHLNPNVRKPIHEIFGDNLSNHNNLFFIEPLEYLSFVYLMEKSTIVLTDSGGIQEEAPGLGKPVLVMRDTTERPEALEAGTVKLVGTNYDKIVDGISTLLDDKVYYEEMSKSVNPYGDGKASERIVNNINYV

SEQ ID NO: 9427 - protein, 673 aa, B.fragilis
IVNRKIVNHMTAQSNITPESIVADLRYLQLLSRSFPTIAAASTEIINLEAILNLPKGTEHFLTDIHGEYEAFQHVLKNASGAVKRKVNEIFGHTLREIEKKELCTLIYYPEEKLQLIKATETDIDDWYLITLNQLVKVCQNVSSKYTRSKVRKSLPAEFSYIIQELLHESTIEPNKHAYINVIISTIISTRRADDFIIAMCNLIQRLTIDSLHIVGDIYDRGPGAHIIMDTLCDYHNFDIQWGNHDILWMGAASGNEACMANVIRLSMRYGNLGTLEDGYGINLLPLATFAMDTYADDPCTIFAPKTNFADSTYNEKTLRLITQMHKAITIIQFKLEANIINRRPEFGMGGRKLLEKIDFERGVFVYEGKEYPLRDTNFPTVDPADPYRLTDEEQELIEKIHYSFMNSEKLKKHMRCLFTYGGMYLVCNSNLLYHASVPLNEDGSFKHVNICGKEYWGKNLLDKIDQLIRTAYFDEDDEEEKRFAMDYIWYLWCGPDAPSFDKDKMATFERYFIADKSLHKETKGYYYALRNKEEICDRILEEFGVTGQHTHIINGHVPVKTIKGEQPMKAGGKLLVIDGGFSKAYQPETGIAGYTLVYHSHGLQLVQHDPFQSTQKAIEEGQDIKSTTFVIEFNSQRMMVKDTDKGKELVTQILDLKKLLVAYRIGLIKEKV

SEQ ID NO: 9428 - protein, 133 aa, B.fragilis
VNKLLKNWSYLLLSDISQSVINFFVFMLLARKLTPVGYGEFNVILAIVAIFSVVATNLGANHVITREVTLHPDNTKGICYNVIPFRLIALAIAFLGVFVYIVSGKDDQFSPSLVLFICIFAPSVWRSKRPHSH

SEQ ID NO: 9429 - protein, 122 aa, B.fragilis
HYGRKKVVISLNDNLVTIEVNGKVIFAGKADLQFSLNQKVREPLRITKGKGKLMEALTESFIKGGINSMENRPIEELQETIKEYLTFEYQRKGIATEPNKRSFLSELKKYARAFRKKRDESE

SEQ ID NO: 9430 - protein, 89 aa, B.fragilis
KPFGRVNNDHYNTSKNRKGIDKDKPVKSRNDDCSDLDGTSASTSTDTGWLDASSLYIPVLAVKVLLIRKISWMILLNINVTVRNFRPGR

SEQ ID NO: 9431 - protein, 61 aa, B.fragilis
VFNGILEAKQLIGEEITSSPGFNSKTVNATCIAEAYEFVVSKFSIPKKVDNFSSKRSPHFP

SEQ ID NO: 9432 - protein, 296 aa, B.fragilis
FMKGIVLAGGSGTRLYPITKGISKQLLPIFDKPMIYYPISVLMLAGIREILIISTPHDLPGFQRLLGDGSDFGVHFEYAEQPSPDGLAQAFIIGEKFIGSDSVCLVLGDNIFYGQGFTYMLHEAVRTAESENKATVFGYWVSDPERYGVAEFDQEGNVLSIEEKPQIPKSHYAVVGLYFYPNKVVEIAQNIKPSPRGELEITTVNQQFLLDKKLKVKLLGRGFAWLDTGTHDSLSEASTFIEVIEKRQGLKVACLEGIAFRQGWISLAKMKSLANLMLRNQYGQYLLKVINELSVK

SEQ ID NO: 9433 - protein, 556 aa, B.fragilis
IIHMEWLYSLFIEHSALQAVVVLSLISAIGLGLGKIHVCGISLGVTFVFFAGILAGHFGLSIDPQMLNYAESFGLIIFVYALGLQVGPGFFSSFRKGGVTLNMLAIAVVILGTFLAVVCSYTTGVSLPNMVGILCGATTNTPALGAAQQTLKQMGLESSTPALGCAVAYPLGVIGVILAVLLIRKLLVRREDLEVQEKDDANKTYIAAFQVHNPAIFNKSIKDIAHMSYPKFVISRLWRDGNVSIPTSEKIIKEGDRLLVVTSEKDALALTVLFGEQENTDWNKEDIDWNAIDSQLISQRIVVTRPELNGKKLGALRLRHHYGINISRVYRSGVQLLATPELTLQLGDRLTVVGEAAAIQNVEKVLGNAIKSLKEPNLVAVFVGIILGLALGAVPFSIPGISTPVRLGLAGGPIIVGILIGTFGPRLHMITYTTRSANLMLRALGLSLYLACLGLDAGAHFFDTVFRPEGLLWIGLGFGLTLVPTVLVGFFAFKIMKIDFGSVSGMLCGSMANPMALNYANDTIPGDNPSVAYATVYPLSMFLRVIIAQVLLMFLL

SEQ ID NO: 9434 - protein, 343 aa, B.fragilis
IILIMFKDKVLMITGGTGSFGNAVLKHFLNSDLKEIRIFSRDEKKQEDMRIEYKNDKLNFIIGNVRDFDTINNAMAGVDYVFHAAALKQVPSCEFYPMQAIRTNLYGAENVLEAAARNNVKKVVVLSTDKAAYPINAMGMTKALMEKLAISKARDARVQANGGVICATRYGNVMCSRGSIIPLFIKQIKEGLPLTITEPRMTRFMMSLDDAVDLVLFAFKNAEPGDLFVQKAPAATIQDLAIALKELFHANNEIHIIGPRHGEKMYETLCTKEEMSKATDMGEFYRVPADFRDLNYTKYVQKDGPMLVEHEYNSENTHRLNVEELKEMLLTLDYVKEELGINK

SEQ ID NO: 9435 - protein, 187 aa, B.fragilis
MNIIKTAIEGLVIIEPRLFQDDRGYFFESFNQEEFETKVCKTTFIQDNESKSTYGVIRGLHFQKPPFAQSKLVRVIRGSVLDVAVDIRKDSPTFGKHISVELTGDNHRQFFIPRGFAHGFCVLSEEVVFQYKCDNFYHPESEGTIAWNDIDLNISWRIPLEDVVLSRKDKNALPLKEMYSDVNYFRF

SEQ ID NO: 9436 - protein, 374 aa, B.fragilis
KYRILHRQKDYKLKTIDMKKALISGITGQDGSFLAEFLLQKGYEVHGILRRSSSFNTGRIEHLYFDEWVRDMKQKRTVNLHYGDMTDSSSLIRIIQQVQPDEIYNLAAQSHVKVSFDVPEYTAEADALGTLRMLEAVRILGLEKQTRIYQASTSELYGKVQEVPQSETTPFYPRSPYGVAKQYGFWITKNYRESYGMFAVNGILFNHESERRGETFVTRKITLAAARIAQGEQDKLYLGNLDAKRDWGYAKDYVECMWLILQHDVPEDFVIATGEMHTVREFCTLAFAEIGINLRWEGEGVNEKGIDTATGKVLVEVDPKYFRPAEVEQLLGNPTKARTVLGWNPCKTPFPELVKIMVRHDMAKVKRMIATKHD

SEQ ID NO: 9437 - protein, 364 aa, B.fragilis
IIMIPLVKPYLPPADILMPELHKILYSGYIAEGEAVYQFEDKFRAYIGNPLSLALHSGTDGLHLSLLLAGVKPGDEVISTPMTAEPTNTSIAMVGGKVVWGDVNPNNGLLDPRSVESVITEKTKAIVLVHYAGMVCDMDAFNKISQKYNIPIIEDAAHALGSKYAGKMVGCSSPYTIFSLQAIKHMTTIDGGFLCLKDEIEFDKARRLRWFGLDKKRSRLENDITEVGYKYAMNNVNATIGNVQMKYVDKIIASYIENGRYYDLALSDIDGIHLVDYSAKTEASYWLYTMRVDERDNFIKAMESAGILASPLHHRSDTHSIFKESKRELPNMDRWYREFVHIPCGWWITEEVRTQIVEAIKKGW

SEQ ID NO: 9438 - protein, 83 aa, B.fragilis
LFLVDGGLIDACCKKKYKCVTWCGVKNVCILLLELLVTSCFDDDLERKVDSLEYEIEKVISTNDILSLKYELYLACYEGKLLK

SEQ ID NO: 9439 - protein, 358 aa, B.fragilis
FIMVPLYKPYMPEQLPDLDAIIHSGALSYGKWGLLLEEKLSTFLGIENLLTTNSYASAIQVALTVLELKPGDEVISSPMSCLASNMPLKTYGLDIVWADIDPTTGTLSPDSVREKVTPKTKLIFHNHFCGYVGYVDEINAVAKEFGIPVIDDCVEAFGSKYKGKYTGNLGTDLSVFSFQTVRLPNTVDGGAIVFNNKSLLDKAILTRDFGINRKTFRDEYAEISPSCDISLSGYGATMSELNSYIGCMQMGTIQQLLETQRLNSERWDTFLTENYPKVYKLNTRREIQPNYWVYGCLAENKLDMMLQFRSLGYYASGVHLNNNCYSIFGDKKYLPGVDSFNRNFLAIPCGWWVDRCLL

SEQ ID NO: 9440 - protein, 360 aa, B.fragilis
CDGVFHHGTILYISKKFTDSGVLSGYRDLDDLLFIYREKIHPVGKVYIFIEEIQKVEGWEHFVHSHSQDFVDTCELFISGSNQDMLSGEAEKLLARHYVSFEIFPFSFSEHRILERVEATGKNYAEYMGKGALPILFNLPDAEAGWKAISALRDTILFRDIIRRYRIKDARLLEDVFVYLCTHLAELITIGQLVSHFAAQNRKTSYDTVANYICYLEDTSLIHRVERYQIRSKEILLGSCKYYINDWAFMRHLYPFFAGSRKSCFENQVYLELRRAGYTVFVGVLRGGKLVDFVGRKKDRIVYLQCAPLLNDDFQVEQMYNTLEMIQDNYEKWVVSMDDTTLPSKEGIRHIQVWQLPEIL

SEQ ID NO: 9441 - protein, 83 aa, B.fragilis
TPVFQCVVAFTCASLWFSVSLCQIKAMDQEELHTQILMRDYLERQELKASAIATNHCVDMESDELRRYVYASFWGSWKRNRSR

SEQ ID NO: 9442 - protein, 471 aa, B.fragilis
LIKSYSNMFKHLNALFIGLALFACTSGAVAQTIKPIETPVPVRPAGQKDVVGLTTPKLDVVRVGFIGLGMRGPGAVERFTHIPGTQIVALCDLIPERVAGAQKILTKANLPEAASYSGSEDAWKKLCERKDIDLVYIATDWKHHAQMAIYAMEHGKHVAIEVPSAMTLDEIWALINTSEKTRKHCMQLENCVYDFFELTTLNMAQQGVFGEVLHTEGAYIHNLEDFWPYYWKHWRMDYNQNHRGDVYATHGMGPACQLLDIHRGDKMNYLVSMDTKAVNGPAYIKKTTGKEVKDFQNGDQTSTLIRTEKGKTILIQHNVMTPRPYSRMYQVVGADGYASKYPIEEYCMRPTQIASNDVPNHEKLNAHGSVPADVKKTLMDKYKHPIHKELEETAKKVGGHGGMDYIMDYRLVYCLRNGLPLDMDVYDLAEWCCMADLTKLSIENSSAPVAIPDFTRGAWNKVKGYRHAFAK

SEQ ID NO: 9443 - protein, 319 aa, B.fragilis
DSYPDSRQIIIKRQQCLQLSTPNDQSFSPRRSYEKCYFTGGFQPSSVQAADIWYLYTLYGYEININLTSSPFMQKYGLIGYPLKHSFSIGFFNEKFKSEGIDAEYVNFEIPEINDFMEVIEENPNLCGLNVTIPYKEQVIPFLDELDKDTAKIGAVNVIKIIRTPKRKIKLVGYNSDIIGFSQSIQPLLQPYHKKALILGTGGSSKAIYHGLKNLGIDSVFVSRTKKEGMLTYEELTPEVMAEHTVIVNCTPVGMYPKVDFCPAIPYELLTPNHLLYDLLYNPNITLFMKKGEEHGAVTKNGLEMLLLQAFAAWEIWNK

SEQ ID NO: 9444 - protein, 263 aa, B.fragilis
NPCPIIRLHNPSMKMKISKPSKQGVIRETKDYLMIALGMILYGIGWTLFLLPNDITTGGVPGIASIVYFATGFPVQYTYFAINAVLLMVSLKVLGFRFSLKTIFGVFTLTFFLSVIQKLTANVTLLHDQPFMACVLGASFCGSGIGIAFSANGSTGGTDIIAAVINKYRDITLGRVMLICDLIIISSSYFVLKDWEKVVYGYVTLYVCSFVLDQVVNSARQSVQFFIISNKYEEIGQRINEYPHRGVTIINGTGILYRARAKR

SEQ ID NO: 9445 - protein, 274 aa, B.fragilis
RQLPGTRRRRSFHRRIRRRKFWIRRWRRFQRWKLRRRFRWRWRCRLTFLKKSIHKICESGIKVFAPSDLHESLISNTKRNNMKKSVIILIAVVAVIIIWAISAYNGLVSMDENVSSQWANVETQYQRRADLIPNLVNTVKGYASHEKETLEGVVEARSKATQIKVDANDLTPEKLAEYQKAQGAVTSALGKLLAITENYPDLKANQNFLELQAQLEGTENRINVARKNFNDAAQAYNTSIRRFPKSIFASVFGFEKRTYFEATEGTEKAPEVKF

SEQ ID NO: 9446 - protein, 862 aa, B.fragilis
RKIPVLRFRKRNKHVPIGASINVQICQCFNIMSYTIESIVEKIGARRLGNKPAAIDWLLTDSRSLCFPEETLFFAIPTKRNNGARYIPDLYERGVRNFVVTSEDFKGLTMDSEQLKVTMAQECNFLIAPNTLKALQKLAEQHRGSFQIPVVGITGSNGKTIVKEWLHQLLSPDRVIVRSPRSYNSQIGVPLSVWQMNEESELGIFEAGISEMGEMRPLQNMIKPTIGILTNIGGAHQENFFSLQEKCMEKLSLFKDCDVVIYNGDNEMISNCVGKSMLTAREIAWSMRDIERPLYISRVEKKEDHTVISYRYLEMDNTFCIPFIDDASIENSLNCLAACLYLMVPADQITERMARLEPVAMRLEVKDGKNNCILINDSYNSDLASLDIALDFLYRRSQSKGLKRTLILSDILETGQSTTTLYRKVAQLVHSRGIEKIIGVGAEISSCASKFDIEKYFFPDTKALLASDVIKKLRNEIILIKGSRNFGFDLVSEELELKVHETILEVNLGAMVANLNHYRSMLKPETKMVCMVKASAYGAGSYEIAKTLQEHHADYLAVAVADEGSDLRKAGITASIIIMDPELTAFKTMFDYKLEPEVYNFHLLDALIKAAEKEGITNFPIHVKLDTGMHRLGFEEKDIPQLIRRLKNQNALIPRSVFSHFVGSDSAQFDAFTRQQIERYEKMSKELQDAFPHKILRHICNTAGIERFPGAQFDMVRLGIGLYGISPIDNSIINNVSTLKTTILQIRDVAEEDTVGYSRKGHLIRPSRIAAIPIGYADGLNRHLGCGHGYCLVNGKKAPYVGNICMDVCMIDVTDIDCREGDQAIIFGDELPITALSDALETIPYEVLTGISTRVKRVYYQD

SEQ ID NO: 9447 - protein, 96 aa, B.fragilis
KNETALLIICKFRYKNPPALALVDHDIRQESGDFYIPTFFIFLLKPISGPVIFVTYNFDRKVAFTQYINYKTKYLFVYIPKATVENLFQAATKVHL

SEQ ID NO: 9448 - protein, 169 aa, B.fragilis
IPIAMSSNIFLTIAIVTTGIFAVQFILSIFFGDIDADADIDTDISSVVSFKGLTHFGIGFGWYMYLQHNTEIQTYLTGVAIGLIFVFAVWFLYKKAYQLQQTTHSERTEQLVGRECTIYFKQNEKKYTVQISRDGAMREIDVVTESGKSYQTGDKATITSYKDGTLYIQ

SEQ ID NO: 9449 - protein, 525 aa, B.fragilis
LNDADMMGLFFVYIVKSSVCLAGFYLFYRLLLSKETFHRFNRIALLTLLLLSLLLPLVQLTTIEQTEVHQTMLTIEQLLMMADMPVSEVTPAEAVTLSGIQILLMVYLSGVLFFACRHIYSLGRLLMLLRSGEKEKMENGMTLVIHQQKISPFSWMKYIVISKVDLEEDGREILIHEAAHVRNRHSVDLLIADICIFFQWFNPASWLLKQELQNIHEYEADESVIREGVNARQYQLLLIKKAVGTRLYSMANSFNHSKLKKRITMMLKEKSNPWARLKYLYVLPLAAIAVTAFARPEISGKMDEISAVKVNDFVQIVGTKVPEKKVEVLKDTVKKDAPKEEAFEVSRLETVPTHSKVTITDGMKRSGMDLFSVRNAGSQPQPLILVDGKEITGEQMQRDINPDMIESISVLKDEASTAIYGDKAKHGVILITLKGKDVQNVLSLSASDSEDGVKVVGVVKDHLDKPLAGASVFISGTVSGTMSDAYGRFVLLAPKNAMLRISYTGMTTVEKAVAPEVNVTLNPAD

SEQ ID NO: 9450 - protein, 272 aa, B.fragilis
ISTAFLLIMAEIKELTFWDHLDELRRVLFRIIGVWFVLAVGYFIAMPYLFDRVILAPCHNDFIFYHLLRDIGQAFDLTDDFFTREFKVKLVNINLAAPFFIHMSTAFWMSVVTATPYLFFEIWRFIRPALYPNERKGVRKALTIGTVMFFIGVLLGYFMVYPLTLRFLSTYQLSAEIENQISLNSYIDNFMMLVLCMGLAFELPLVTWLLSLLGLVNKSFLRKYRRHAIVLIVIAAAVITPTGDPFTLSIVAIPLYLLYEMSILMIKDKNRS

SEQ ID NO: 9451 - protein, 1043 aa, B.fragilis
SKYYQLLNGTWKFYFVDSYKNLPANITDPAISTADWADIKVPGNWEVQGHGVAIYTNHGYEFQPRNPQPPTLPEANPVGVYRRDIDIPADWDGRDIYLHLAGAKSGVYVYINGQEVGYSEDSKNSAEFLINKFVKPGKNVLTLKIYRWSTGSYLECQDFWRISGIERDVFLYSQPKAALKDFRVTSTLDDTYKDGIFKLGVDLRNNGSTAGNMTLVYELLDANGKVVATGEKATNVAAGETRTMSFDQTLPDVKTWTSEAPNLYKLVMTVKENGKVNEIIPFNVGFRRIEIKPTEQLARNGKPYVCLFINGQPLKLKGVNIHEHNPATGHYMTEELMRKDFELMKQHNLNTVRLCHYPQDRRFYELCDEYGLYVYDEANIESHGMYYDLAKGGTLGNNPEWLKAHMDRTINMFERNKNYPSLTFWSLGNEAGNGYNFYQTYLWVKNADKDIMNRPVNYERAQWEWNSDMYVPQYPGADWLEAMGKRGSDRPIVPSEYSHAMGNSNGNLWDQWKAIYKYPNLQGGYIWDWVDQGIDAVDENGRHFWTYGGDYGVNTPNDGNFNCNGIVSPDRTPHPAMAEVKYVHQNVAFEAVDPANGKFLVKNRFYFTNLQKYMISYTIKANGKTVKGGKMSVNVEPQGSKEITIATSGLKSKPGTEYFIYFNVTTTEPEPLIPVGHEIAYEQFRLPIEPGERTFATGGPALKVSAEGNELTASSSKVNFVFDKKTGLVSSYKVGGTEYFKDGFGLQPNFWRAPNDNDYGNGNPKRLQVWKQSSKNFNVVDANIVMDGKDAVLTANYLLAAGNLYIVTYRISPSGVVKADFTFTSTDMEAAKTEASEATLMATFTPGSDAARKAASKLEVPRIGVRFRLPAEMNQVEYFGRGPEENYIDRNAGTLIDLYKTTADQMYFPYVRPQENGHHTDTRWLTLNKKGGKGLTIYADKTIGFNALRNSVEDFDGEETVSRPYQWLNRDAGELVHDESKAKDQLPRKTHINDITPRNFVEVCVDMKQQGVAGYNSWGARPEPGYNIPANQEYKWGFTIVPR

SEQ ID NO: 9452 - protein, 100 aa, B.fragilis
DKLYCEDACCDNSNGEENITTHGNRYLMIYFIDIVPKYTPLIFICKGKLIKKWKNRKMNVYLYPKLLNRNRKNYEDNPTLCSESVALFIRVGCLCTRAYL

SEQ ID NO: 9453 - protein, 397 aa, B.fragilis
ISSHNSFIPLSYKKKAYFLIHTNYTFHIFAVFNTHHIFNDENKKTIRQYEIMINTLTSLRFIFAIMVFGAHCYVIDNVFNTHFFKEGFVGVSFFFVLSGFSIAYNYQEKLKDDKIDKRTFWVARIARIYPLHWLTLFIAAILGSYVIASGTLDWLKHFLASLTLTNAYIPRADYFFSFNSPSWSLCCEQLFYICFPFLIPLAKNYKYLLSVFGIVAILIVVGMYFTPEDEIKGFWYVNPITRFPDFIVGMLLFQLYERLKNKNITALQGSIIEISSIILFLIFYLYAADIPKVYRYSCYYWLPVAVILISFSLQKGIFSRILSNRFLVIGGEISYSFYLIHLFVLLTYSEWQKENNLHTEWYISVPILFSIIILLSLLSYYYFEKPMNKRVKTLLNR

SEQ ID NO: 9454 - protein, 85 aa, B.fragilis
HRVKACSLDVNKKFFKCKRLVICAQEPDNRQKTLTMLIEKRYKDEDTGSDGVNSLPKLKLSYSAGVCFFLLKQAKRTIINLEIKK

SEQ ID NO: 9455 - protein, 262 aa, B.fragilis
KTNNLLSMISPLAYIHPEAKIGENVEIAPFVYIDRNVVIGDNNKIMANANILYGSRIGNGNTIFPGAVIGAIPQDLKFKGEESTAEIGDNNLIRENVTINRGTAAKGRTIVGNNNLLMEGVHVAHDALIGNGCIVGNSTKMAGEIIIDDNAIISANVLMHQFCRVGGYVMIQGGCRFSKDIPPYIIAGREPIAYSGINIIGLRRRGFSNEIIENIHNAYRIIYQSGLNTSDALTKVEAEVPASPEIEYIVDFIRNSERGIIR

SEQ ID NO: 9456 - protein, 389 aa, B.fragilis
LMSNQRYMMRGVSASKEDVHNAIKNIDKGIFPQAFCKIIPDILGGDPEYCNIMHADGAGTKSSLAYMYWKETGDLSVWKGIAQDALIMNIDDLLCVGAVDNILVSSTIGRNKLLIPGEVISAIINGTDELLAELREMGVGVYATGGETADVGDLVRTIIVDSTVTCRMKRADVINNANIRPGDVIVGLASHGQATYEKEYNGGMGSNGLTSARHDVFAKYLAEKYPESYDAAVPEELVYSGGLKLTDTVEGSPIDAGKLVLSPTRTYAPVVKKLLDALRPEIHGMVHCSGGAQTKVLHFVGDVRVVKDNLFPVPPLFRTIQEQSGTDWAEMYKVFNMGHRLEVYLSPEHAAEVIAISESFGIPAQIVGRIEESDKKELIIKSEFGEFRY

SEQ ID NO: 9457 - protein, 86 aa, B.fragilis
VPLKDVLSKIFVKLSPITSSWSRVSALKEVLLEEVCKYGMNSTCGLIVNSSRGIIYVDKTENFAAAARAAAKEVQEQMAEQLKAIL

SEQ ID NO: 9458 - protein, 230 aa, B.fragilis
IEINKKRRMFSKHPPFLWNKPSHLICNLSVFYYFYAINKTVTTMIYRFTIISDEVDDFVREIQIDPEATFFDLHEAILKAANYTNDQMTSFFICDDDWEKEKEITLEEMDNNPEMDSWIMKETRLNELIEDEKQKLLYVFDYMTERCFFIELSEIITGKEIKGAKCTKKSGEAPKQTVDFEEMAAGGGSLDLDENFYGDQDFDMEDFDAEGFDVNDGAAGGGSSYDEDKF

SEQ ID NO: 9459 - protein, 370 aa, B.fragilis
MADNNSILEKLDGLVARFEEVSTLITDPAVIADQKRYVKLTKEYKELDDLMKARKEYMQLLANIEEAKDILSNESDADMREMAKEEMDNSQERLPVLEEEIKLLLVPADPQDGKNAILEIRGGTGGDEAAIFAGDLFRMYAKFCETKGWKMEVSSANEGAAGGYKEIICSVTGDNVYGTLKYESGVHRVQRVPATETQGRVHTSAASVAVLPEAEEFDVVINEGEIKWDTFRSGGAGGQNVNKVESGVRLRYIWKNPNTGVAEEILIECTETRDQPKNKERALARLRTFIYDKEHQKYIDDIASKRKTMVSTGDRSAKIRTYNYPQGRITDHRINYTIYNLAAFMDGDIQECIDKLTVAENAERLKESEL

SEQ ID NO: 9460 - protein, 130 aa, B.fragilis
AMGKPIIRILYFQRRGIDANGYYRLNYIIQRGRKILYYATETKDFEYSDCFTSSCLAERKETILDTAQYIFKVHKVRYSRLILSPSYSYITRYKSRIRQICTATRFCKSDIIWTMCPRSFIPISKIPFSF

SEQ ID NO: 9461 - protein, 368 aa, B.fragilis
TNLKIKTMKDLLSIVSKFKVQGTVGEIKPLGAGLINDTYKVNTTEADAPDYVLQRINHAIFQNVEMLQDNIAAVTGHIRKKLTEAGETDVDRKVLTFLPTEEGKTYWFDGDSYWRVMVFIPRAKTYETVNPEYSYYAGAAFGNFQAMLADIPATLGETIPDFHNMEFRLKQLREAVAANAAGRVAEVQYYLDEIEKRADEMCKAERLYREGKLPKRVCHCDTKVNNMMFDEDGKVLCVIDLDTVMPSFIFSDYGDFLRTGANTGDEDDKNLDNVNFNMEIFKAFTKGYLEGAGSFLTPIEIENLPYAAALFPYMQCVRFLADYINGDTYYKIKYPEHNLVRTKAQFKLLQSVEEHTPEMEAYIKECLG

SEQ ID NO: 9462 - protein, 72 aa, B.fragilis
PGSNGMKRSDGSILNKRKKYYRIFRSQLNKQVYIEDKFLTKKRKKPDKIKRVTKGALLHNIFSIFVDNKNIP

SEQ ID NO: 9463 - protein, 548 aa, B.fragilis
QTQKKRTMTQEMMIMAAILVAVILITFIGILSRYRKCKSDEVLVVYGKTGGDKKSAKLYHGGAAFVWPIVQGYEFLSMKPMQIDCKLTGALSAQNIRVDVPTTITVAISTDPEVMQNAAERMLGLTMDDKQNLITDVVYGQMRLVIADMTIEELNSDRDKFLSKVKDNIDTELRKFGLYLMNINISDIRDAANYIVNLGKEAESKAQNEAQANIEEQEKLGAIKIANQIKERETKVAETRKDQDIAIAETKKLQEISVANADKDRISQVAIANAEKESQVAKAEAEKNIRIEQANTEKESRIAELNSDMEIKQAEAQKKAAIGRNEAQKEIALSNSELAVTQANADKQAGEASAKSEAAVQTAKEIAQKEVEEAKARKVESSLKAEKIVPAEVARQEAILQAEAVAEKITREAEARAKATLAQAEAEAKAIQLKLEAEAEGKKRSLLAEAEGFEAMVKAAESNPAIAIQYKMVDQWKEIAGEQVKAFEHINLGNITVFDGGNGGTSNFLNTLVKTVAPSLGVLDKLPIGETVKNMIHPEEKKEETEKK

SEQ ID NO: 9464 - protein, 1180 aa, B.fragilis
TSKNITKQIVHKTNCLQKLRYRSNDTFVHIFIRPHENPGIIMYFCCMENEVNESFEILLAACRTADSNLAVAYKQLRDLLERLCRAQMQDESLQMTDLSARISFVSARAGLTIVEQNRLHTFRLTSNAILNRKEEPVREKLLRDAKTLAFFIRKLYEVEIPGELYHLLPRADATYLVAPPAKKRIERMRVCYQYADEQYLYVTPVDTIADEYLRIRYNVPQINEEFAQTCEILWCHAQLNLLDVAIDKTGVLTPSFIVLEPDYLIDISSLAECFRDYGHHPANYVLARLQPIDNARPLLLGNIANLFLDEWIHAENAPDYRECMQKAFRRYPIELAACTDLRDREKERQFFDDCKLHFEHIREVVTDTFRAPGYELDKTDAVLEPSYICEALGLQGRLDYMQRDMSSFIEMKSGKADEFSIRNKVEPKENNKVQMLLYQAVLQYSMGMDHHRVKAYLLYTRYPLLYPARPSWAMVRRIINLRNRIVSDEYGIQLRNSVEYTASKLQAIRSDILNERGLSGRFWEQYLRPSIDNLSQKLASLTPLEQSYFYALYNFITKELYTSKSGDVDYEGRTGSAALWLSTLTEKCEAGEILYDLRIKENHAADEHKAYILLEQRKEGYGENKLSPEPNEISSEVEKGAQALPNFRQGDAIVLYERNRNEDNVTNKMVFKGNIEFITEEEIGIRLRATQQNSSVLPPDSLYAIEHDTMDTTFRSMYQALSAFASATKERRDLLLAQRMPEFEYGLDKQILTAPDDFTRVTLKALAAKDFFLLVGPPGTGKTSCALKKMVETFHCEAQTQILLLSYTNRAVDEICKAISSIRPEVDFIRVGSELSCDEAYRHHLIENELSLCTRRSEVAERIARCRIFVGTVASISGKPELFRLKRFDVAIIDEATQILEPQLLGILCARSENGENAVGKFILIGDHKQLPAVVLQNTEQSEIYDEGLRSAGLKNLKDSLFERLYRTLQTSSEDLFPDSASVSAPNHRSFDMLCKQGRMHPEVAHFANQAFYEGRLLPVGLPHQMEDNQDVQRMVFLPSEPEPQGTSAKVNHSEARIVARIAADVYQQYGGTFDGMRTLGIITPYRSQIALIRKEIVKMGIPELNSILVDTVERFQGSERDVIIYSFCVNYPYQLRFLSNLTEENGVFIDRKLNVALTRARKQSLHHRGSPIIGTKPDL

SEQ ID NO: 9465 - protein, 462 aa, B.fragilis
PMLKQKTLKESFSLRGKGLHTGLDLTVTFNPAPDNHGYKIQRTDLEGQPIIDAVADNVGETTRGTVLSKNGVKVSTGEHGMAALYALGIDNCLIQVNGPEFPILDGSAQYYVQEIEKVGIEEQNAVKDFYIIKSKIEFRDEETGSSIIVLPDENFSLNVLVSYDSTIIPNQFATLEDMKKFKDEIAPSRTFVFVREIEPLLSAGLIKGGDLDNAIVIYEREMSQENYDKLADVMRVPHMDAKLLGYINHKPLVWPNECARHKLLDVIGDLALIGKPIKGRIIATRPGHTINNKFARQMRKEIRLHEIQAPTYDCNRAPIMDVNRIRELLPHRYPFQLVDKVIEIGANYIVGVKNVTSNEPFFQGHFPQEPVMPGVLQIEAMAQIGGLLVLNSVDEPERYSTYFMKIDGVKFRQKVVPGDTLIFRVELLAPIRRGISTMKGYAFVGEKVVCECEFMAQIVKNK

SEQ ID NO: 9466 - protein, 417 aa, B.fragilis
ILMNIRLTSLFVSLFLSVPVWAGGHKNLPAKGDLHIPVFENVNVRFSPDTYPDNYNEADGTGVYHLVNGRIILKKITLPEYKRNVSVSLKVTLASNGDRWDKSGSCFVLPKSSAINLLTIARDGMKFPSVDSLKLEKMVGIVPGKDYLPTVELMRFMTPFGVGHYSNNNDSLSSKRRPVYIPKWESNVTWQQDITDLYPLLEGEAYVGIYIDTWTSEGYLVNADIDVKESRLACDVLPKRHVEPLMNTVYYMGQSYPDIFARRDVSTDFTVPKGAKNIRLKYIVTGHGGHSGGDEFVQKRNIISVDGKEVLNFIPWRDDCASFRRFNPATGVWLIKRLASYIGEKGYTEKEVEEPLASSDLSRSNWCPGSDVVPEEAVIGTLAPGKHTFTVSIPEAQAVDGNKLNHWLVSAYLVWEE

SEQ ID NO: 9467 - protein, 248 aa, B.fragilis
VKMNKQSLFENIKRKKSFLCVGLDTDIKKIPDHLLDDPDPIFAFNKAIVDATADYCIAYKPNLAFYESMGVKGWIAFEKTVNYIKENYPDQFIIADAKRGDIGNTSAMYARTFFEELDIDSVTVAPYMGEDSVTPFLSYEGKWVILLALTSNKGSHDFQLTEDANGERLFEKVLKKSQEWANDEQMMYVVGATQGRAFEDIRKIVPNHFLLVPGIGAQGGSSRRSMQIWYEQHLWTYCEFLSRNYLCR

SEQ ID NO: 9468 - protein, 251 aa, B.fragilis
IKSNKRMNYPQEKIKPYSNDGKKSEQVEQMFDNIAPAYDQLNHTLSLGIDRSWRRKAINWLKPFRPQQIMDVATGTGDFAILACHELQPEQLIGTDISEGMMNVGREKVKKEGLSEKISFAREDCTSLSFADNRFDAITVAFGIRNFEDLDKGLSEMYRVLKTGGHLVILELTTPDRFPMKQMFTIYSKIVIPTLGKLLSKDNSAYSYLPQTIKAFPQGEVMKNVISRVGFSQVQFRRLTFGICTLYTATK

SEQ ID NO: 9469 - protein, 395 aa, B.fragilis
SHANMILVQILVKDLFNMIKKIFFSSFLLIIMFCGCMTQNEITGSVAKLETVEKVVDDTLFLKNPQVFCLETKDNALIKRINRVIEWKNTYYILDKSMKQVLAFNDKGRHLFTIHRVGIGKGEYGSILDIAIDRQNENLVFLADPTSLIYYDLQGNFIKTTKLPGYYHSIAIDNGMIYLENETYINNQLSTSSITVIAPDNQKTELLKPLREIAPYCFIGGSRLNGTTPIVFTRKFDNTIYQLEDGKITPYYSFDFMNENFPEAAKDKEYTCRELNKFTWDRYVYLMANVANAPQYLMFCTNLFGVYVFDKMQNKLLKYNKIRNTGYQTDLHQYIPVEGANNRVFFTVYPTTLFSLKAIVDNHPSFKDKMSDKLYKLTESLDSDSNPVIFSYQIK

SEQ ID NO: 9470 - protein, 76 aa, B.fragilis
RHKKGVVNKVNRVWVVGNGAMLPYKVYNKNYWSEVPGNLYIDIPERVQDEQITVIAVLLDGPIKLYRGVGQVIESN

SEQ ID NO: 9471 - protein, 601 aa, B.fragilis
TEIEKTMKTILLFALSLLLSLSVSDVCAQERIYDISQFGLKANSKKNASPVVRKAIAKIKAECRDGEKVILRFPAGRYNFHEAGSTVREYYISNHDQDNPKKVGIALEDMKNLTIDGQGSEFVFYGRMIPVSLLRSENCVLKNFSIDFEQPHIAQVQVVENDPEKGITFEPAPWVDYRISKDSVFEGLGEGWVMRYSWGIAFDGKTKHVVYNTSDIGCPTKGAFEVAPRRICSPKWKDARLVPGTVVAMRGWGRPTPGIFMSHDVNTSLLDVKVHYAEGMGLLAQLCEDITLDGFGVCLKGDNDPRYFTTQADATHFSGCKGKIVSKNGLYEGMMDDAINVHGTYLKVIKRVDDHTLIGRYMHDQSWGFEWGRPGDDVQFVRSETMELIGKQNQITAIRPYDKGEIQGAREFSITFKEAIDPAINEKSGFGIENLTWTPEVLFAGNTIRNNRARGTLFSTPKKTVVEDNLFDHTSGTAILLCGDCNGWFETGACRDVTIRRNRFINALTNMFQFTNAVISIYPEIPNLKDQQKYFHGGKDGGIVIEDNEFDTFDAPILYAKSVDGLIFRNNVIKTNTEFKPFHWNKDRFLLERVTNVKISE

SEQ ID NO: 9472 - protein, 226 aa, B.fragilis
ERKETRLSDMKKSTLTLLLFILGISSSFSVGAQEAKTVFVNIPDSLCPLLSSVNRADCIDFIESKMKAQVTNRFGGKSEMTELSPDYVSLQMSDASNWQMKLLPLNDTTKVVCAVSTVCAPACDSHIRFYTTDWKELPATDFLPSVPQMNDFFTSSDSTDYDFIDARLQADMALMQAELSKENGTLTFTLTTPEYMEKETAEKLKPFLRRSIVYTWKDGKFIPDTL

SEQ ID NO: 9473 - protein, 703 aa, B.fragilis
RTVWTLKPYLFRVGGLHFNHYVFMKRLLSVFLFLFCCVIAADAQDDAAQYDSIMNLMKNKKIPLMERYYMTGDIEYLSREHQIAVLKQLIPEAKEVEDKAVITRLYSIVAMFENQLGHMTEAKNYLDSAFMNKGKFENNNISGMMHYIAGIYYSDKNLMEQAHENYYQAAEYFNRNEMKPAILTEIYYDLSIIYSMWQDDEGLHELSEAMKDLPVDFPFQQILKWTIKVKYFYALYQNEHRVDLLDSVTKYNQEAFKVYTSTENPYDVGYVISDNYLHQAIVYSEAGKIKEAEQCFETGKKLMNPKKIDANVSVSYVSGVIAYYQADYELAEQHLQDGLRELKRMDEEQEVDYYHALIEFYTLLAKVYEKQELYNKALEAARNSLKYETRLFDKNSNKTIQKLRTQYNLNEKERVVEQLSAINEKNRRINILSAILIVLALVTIFLLLKRYRSRQRIHEGMLQIAKLKQQEAELLVKLQKTKLEEREREFQSLVHEAQQRKVQYYLEGLEVERKRLAKELHDNVSNELLAIKMKITDGTSSCEEIMDTLQTLQAEVRGISHDLMPPIFKYASLSEILQDYVYQHNQPGQTELELLLEPEDNFDNLSQKVSLEIYRIVQEAVGNSLKHAQATLVKIILVREDNKVKLTVSDNGRGFEQQTGKTGIGLTIIKERVENLRGTLTLNSAPGKGTELIVEIDLENLEK

SEQ ID NO: 9474 - protein, 80 aa, B.fragilis
  UNSURE (12),(33),(46),(47): Identity of amino acid sequences at the above locations are unknown.
WRSRRMHDARTXSSHSHGYSRFLLTSFITAYTXTSLARREHCPHLXXRVMSSRLFSHCNKHVAGTRDDTLQLISPLYSKS

SEQ ID NO: 9475 - protein, 64 aa, B.fragilis
SNISFFTSRMDSSGESRDTSFFVNYKRGLTRPKTELDSMSKRKLTTKFEEEPPKNRSFIFHPLF

SEQ ID NO: 9476 - protein, 318 aa, B.fragilis
NILRRYSNKPIASNLKNSIMWLLLAFLSATLLGFYDVFKKKALKDNAVLPVLFFNTLFSSLIFLPFILLSAFAPGVLEGTMLDVPVVGWEVHKFIIIKSFIVLSSWILGYFGMKHLPITIVGPINATRPVMVLVGAMLVFGERLNLYQWIGVMLAIISFFMLSRSGKKEGIDFKHNKWILFIILAAVAGAVSGLYDKYLMKQLPPMVVQSWYNVYQMFIMCPILALLWWPKRKSSTPFRWDWAIIFISIFLCAADFVYFYALSYEDSMISIVSMVRRGSVIVSFLFGAMVFREKNLKSKAIDLILVLIGMIFLYLGTK

SEQ ID NO: 9477 - protein, 318 aa, B.fragilis
LYKSMKALTKTDFNFPGQKSVYHGKVRDVYNINGEQLVMVATDRISAFDVVLPEGIPYKGQMLNQIAAKFLDATTDICPNWKLATPDPMVTVGVLCEGFPVEMIVRGYLCGSAWRAYKNGVREICGVKLPEGMKENQKFPEPIVTPTTKAEMGLHDEDISKEEILAQGLATPEEYAILEKYTLALFKRGTEIAAERGLILVDTKYEFGKHNGTIYLMDEIHTPDSSRYFYAEGYQERFEKGEAQKQLSKEFVREWLMENGFQGKEGQKVPEMTPAIVESISERYIELFENITGEKFVKEDTSNIAERIEKNVMAFLAK

SEQ ID NO: 9478 - protein, 399 aa, B.fragilis
RFQSEIRLCKNTYKCMKRILLFLLACCPMLLCAQEDNSKYLAGAVPVVNGKVIFAEVIQASDMSKRQIYDALLKWAEKRFTPSKGQKGRVAYFDGKKGQIACLGEEYLQLSATNSFFLDRATIKYRLVINCLDGSCKMEMYNISYFHGDDTEMEAEDWITDETGLNKAKTKVVAKYGKLRIKTIDLFDDLTEQVTKTLGGAKSEVPLLAKEPKVTPEVFDREFPKAVEQGAMAGYKHIPADKIPGNIIKMLSEDWMLITAGTEDKYNMMTASWGGLGYLYNKPVSFCFIYPTRYTYQLMEKNDTYTISFYTETYRDALKYCGSHSGEDVDKVKGAGLTPLTTPSGSKAFSEAWMIIECKKMLSQPITPGAFDTPELKEAWKDKSLHTMYIGEIMNVWVK

SEQ ID NO: 9479 - protein, 79 aa, B.fragilis
KGCGSGGKRDIESGRLKNIYCGVLLPQTNVSKLTMEDKPSILGRKDGKKRENIDLKELYQLYNEIDSYISQRYNELFGL

SEQ ID NO: 9480 - protein, 147 aa, B.fragilis
  UNSURE (46),(79),(94),(101),(119),(122),(135),(136): Identity of amino acid sequences at the above locations are unknown.
AWCGPCDTVLMCAMMYGYGEAQPARRGDHVDALCLHRLAVIMHMCXYAFEPLSCDECAHALHRQHRLLLCLAVYMAPAXSSCLTYVFLLMAQSXHARRTHXIESLSRILTIPPYLVHHXVHXYESSATGALSSPXXSCNVVSSILSL

SEQ ID NO: 9481 - protein, 316 aa, B.fragilis
MKKGIKIGVITLLLLLTGCTIGGSFFMLNYSLRPEAKIRAKNADSYPFIYKNYPFLRPWVDSLNQAHALRDTFVLNPEGIRLHAYYIAAPQPTKKTAVIVHGYTDNAIRMFMIGYLYNHDLQYNVLLPDLQHQGESGGPAIQMGWKDRLDVMQWMHIANQIYGDSTQMVVHGISMGGATTMMVSGEAQPYFVKCFVEDCGYTSVWDEFSHELKSSFHLPSFPLMNTTSWLCQKKYGWNFEEASSLNQVKKSHLPMFFIHGDKDTYVPTWMVYPLYEAKSAPKQLWIVPGAAHAVSYKENKEEYTRKVKEFTDRYIH

SEQ ID NO: 9482 - protein, 349 aa, B.fragilis
SKIMEFSAKQIAAFIQGEIIGDENATVHTFAKIEEGIPGAISFLSNPKYTPYIYETKASIVLVNKDFTPEQEVKATLIKVDNAYESLAKLLNLYEMSKPKRTGIDERAYVAETAKIGKDVYIAPFACIGDHAEVGDNTVIHPHATVGGGAKIGSNCILYANSTVYHDCRVGNNCILHAGCVIGADGFGFAPTPQGYEKIPQIGIVILEDNVEVGANTCIDRATMGATVIHSGVKLDNLVQIAHNDEIGSHTVMAAQVGIAGSTKVGEWCMFGGQVGIAGHLKIGNQVNLGAQSGVPGNIKSGSQLIGTPPMELKQFFKASIVQKSLPEMQIELRNLRKEIEELKQQLNK

SEQ ID NO: 9483 - protein, 304 aa, B.fragilis
PIVMTAKTLIVLIGPTGVGKTELSLRIAEYFKTSIISSDSRQLYAELKIGTAAPTPEQLKRVPHYFVGTLQLTDYYSAAQYETEVMSVLEQLFQQHHVVLLTGGSMMYVDAICKGIDDIPTVDAETRELLLHKYDTEGLDNLCAELKLLDPEYYKIVDLKNPKRVIHALEICYMTGKTYTSFRTQQKKERPFHILKIGLTRDRAELYDRINRRVDQMMNEGLLEEARSVYAHRELNSLNTVGYKEIFKYLDGEWDLDFAIEKIKQNSRIYSRKQMTWFKRDEEIRWFHPEQEKEILSYLQVSIK

SEQ ID NO: 9484 - protein, 264 aa, B.fragilis
SSIFARKNQVNGMSVQRYFIYLAYDGTHYHGWQIQPNGISIQECLMKALATFLRKDTEVIGAGRTDAGVHASLMVAHFDYEGEPLDVDKVAEKLNRLLPQDISVYKVCRVKPDAHARFDATARTYKYYITTVKFPFNRQYRYRIHNPLDFQKMNEAALTLFHYSDFTSFSKLHTDVKTNICKIMHAEWTQEDEYTWVFTIQADRFLRNMVRAIVGTLLEVGRGKLSVDDFRKIIEQQNRCKAGTSAPGNALFLVNVEYPQEIFE

SEQ ID NO: 9485 - protein, 375 aa, B.fragilis
KKVIYRCFSFTVTKTHTCLHGWSILFMKPNRPQSNSGLYRELHMPYLIKRTRKNTPGKSKNLQTATFTDMKQILTYLLFIWILLPLKAEEKIYTVDNIPKVHLQNKMQYVCNPAGILSQQACDEIDAMLYALEQQTGIETVVAIVPSIGDKDCFEFSHQLLNQWGVGKKGKDNGLVILLVTDQRCIQFYTGYGLEGILPDAICKRIQMQEMIPYLKKGEWNQGMLAGVKAVCQRLDGSMVNDDEGRGEEGISVSMLLVVILSFITIAGVVGILAVRASTRCPKCGKHQLQRSSTKLISNRNGVKTEDIIYTCRNCGHTVVRRQQSYDDNYRGRGGGGPFIGGFGGGSFGSGGGGGFSGGSFGGGSGGGGGAGSRF

SEQ ID NO: 9486 - protein, 230 aa, B.fragilis
KRLIMNQSKCRSHFVISIFLCFILPCLAGCKKKDMSLKLNEPRNIKGVVSYKRSFGDLNDVQLKAAHAWGIAPLASREEAEEMDGKLVHIVDNDFYVVDSLTHSIPYLVPRASALLDTIGANFLDSLTAKGLNPNKIIVTSVLRTENDVKRLRRRNGNASKNSCHFYGTTFDVSWKRFKKVEDEDGRPLQDVSADTLKLVLAEVLRDVRKADKCYVKYELKQGCFHITTR

SEQ ID NO: 9487 - protein, 340 aa, B.fragilis
IDSMIEKLIVLEDIDPVIFYGVNNANIQLIKALYPKLRIVARGNVIKVLGDEEEMCAFEDNITKLEKYCAEYNSLKEEVIIDIIKGNAPQAEKAGNVIVFSVTGKPIIPRSENQLKLVEGFAKNDMVFAIGPAGSGKTYTAIALAVRALKNKEIKKIILSRPAVEAGEKLGFLPGDMKDKIDPYLQPLYDALQDMIPAAKLKEYMELNIIQIAPLAFMRGRTLNDAVVILDEAQNTTTQQIKMFLTRMGMNTKMIITGDMTQIDLPASQTSGLVQALRILKGVKGISFVELNKKDIVRHKLVERIVDAYEKFDKEKKAEREKLNGERLTISKERQNVGNL

SEQ ID NO: 9488 - protein, 332 aa, B.fragilis
NYLIMNLNTPVEIPSGFTPISHAQQLLIMGSCFAENIGTLLAENKFRIDINPFGILYNPRSISMALREIISQKQYKASDLFLHRECWHSPMHHGSFSAATLADTLRNIQSRLEQAHKELKQLDRLMLTFGTAYVYEQKETGKVVANCHKLPEKNFIRRRLEIDEIVEDYTLLLDELISLNPQLKILFTVSPIRHIRDGMHANQLSKSVLLLAIDRLMQRYPQVTCYFPSYEIVLDELRDYRFYADDMVHPSTLTVNYLWERFSETFFTPETQSLIKECETIRKAIAHKPFHPESEEHKRFLGQIVLKIERLNGKYPYLDFEKETNMCRLALQ

SEQ ID NO: 9489 - protein, 79 aa, B.fragilis
YNTVMTNLFLLGFMPSGSEWIIILLVILLLFGGKKIPELMRGLGKGVKSFKEGVNEAKEEINKAKEEIDEPENKEKKDN

SEQ ID NO: 9490 - protein, 61 aa, B.fragilis
PHPVGYDILLPAPYAVTWVHYHMTNRYDCQNFNCTYRSYRCRKNGVKPPHSRIFQDEYHFV

SEQ ID NO: 9491 - protein, 135 aa, B.fragilis
TKSFRYLCSNEEKVMKRLTAKEEEIMGFFWEKGPLFVKEILAFYDEPKPHFNTLSTIVRGLEEKGFLAHHTYGNTYQYYAVVSESDFSKRTLKSVISKYFNNSYLSAVSSLVKEEDISLDDLKKLIQEVEQKNEE

SEQ ID NO: 9492 - protein, 437 aa, B.fragilis
NREFCRCRPCCCQRSARANGRTAESYFIMPHERKIINDPVFGFINIPKGLLYDIVRHPLLQRLNRIKQVGLSSVVYPGAQHTRFQHSLGAFYLMSEAITQLASKGNFIFDSEAEAVQAAILLHDIGHGPFSHVLEDTIVKGVSHEEISLMLMERMNREMNGQLSLAIQIFKDEYPKRFLHQLVSGQLDMDRLDYLRRDSFYTGVSEGNIGSARIIKMLDVADDHLVVESKGIYSIENFLTARRLMYWQVYLHKTSVAYERMLISALLRAKELASKGVELFASPALKFFLYNHIDPEVFYNNPDCLENFIQLDDNDIWTALKVWSTHTDKVLSTLSLGMINRNIFKVEICSEPISEERKKELTLLISRQLGITLSEADYFVSTPSIEKNMYDSADDSIDIIYKDGTIKNIAEASDMLNISLLSKKVKKYYICYLRWDR

SEQ ID NO: 9493 - protein, 287 aa, B.fragilis
RVSTVTAAVTPKTEMERTKAETETGKRKRRIITARNKLPMAKHRVHSPLRLMHRRTTVLSLYKTNSVHVVNVRKTIIATTTNHVKIMSLVNRVATRTGKRVKTNPVNSALLANHADRATMNNLNVSRKLRKMKSLLKNSICMLLTTWVLTACDENTVYHSYQSTPPDGWKKSDTLFFNVSLKDSLANLRLSVGVRNSSNYPYQNLNILIHYNLEDSTVWKTDTLKFILTDREGKWTGTDWGSLYQSALPLKDWFVKHPGNYTFKIVHEMKNEQLTGISDVGLKIEHL

SEQ ID NO: 9494 - protein, 174 aa, B.fragilis
LNDHPWNFHPVVKTADSIKVVLGMEEDLAGAGYNVNQSKIAIGSGGLTGKGFLNGTQTKLKYVPEQDTDFIFCTVGEEQGFVGSAAVLLLFLALILRLIATSERQTSTFGRVYGYSVVSIFLFHLFINIGMVLGLTPVIGIPLPFFSYGGSSLWGFTILLFIFLRIDAGRSIRL

SEQ ID NO: 9495 - protein, 115 aa, B.fragilis
QKVKSSYRKRKNKRRKKIENEENREKRGYFLGKGISAGPKGIVAIKASIDTIKAGMSVIRISMIVIRASIGAIKVSIGAIRAGIGVFKANAGAIRKNICDQESFIIKYFHKQNLG

SEQ ID NO: 9496 - protein, 100 aa, B.fragilis; identical to SEQ ID NO: 7703

SEQ ID NO: 9497 - protein, 63 aa, B.fragilis
PPTKLDDIPSECRVVPFGNLRINGHLHLPEAYRSLSRPSSPPRAKASAMRPYLLSFIARDHFL

SEQ ID NO: 9498 - protein, 362 aa, B.fragilis
QQKKNHNWEQRQSFQVLQRFRFIFFSYFCPNMHPSARIAKTNKKIMRVIDLIHSNEKTAFSFEILPPLKGTGIEKLYQTIDTLREFDPKYINITTHRSEYVYRDLGNGLFQRNRLRRRPGTVAVAAAIQNKYNITVVPHILCSGFTQEETEYVLLDLQFLGITDLLVLRGDKAKHETVFTPEGDGHHHALDLQQQINNFNKGIFVDGSEMKVTNTPFSYGVACYPEKHEEAPNIDMDIYWLKKKVEAGAEYAVTQLFYDNKKYFEFVEKVHQAGIDIPIIPGIKPFKKISQLNMVPKTFKVDLPEELTKEALKCQTDEEARQVGIEWCISQCKELMAAGVPSIHFYSIGAVDSIKEVAKAIY

SEQ ID NO: 9499 - protein, 60 aa, B.fragilis; identical to SEQ ID NO: 7968

SEQ ID NO: 9500 - protein, 95 aa, B.fragilis; identical to SEQ ID NO: 8022

SEQ ID NO: 9501 - protein, 492 aa, B.fragilis
SNNFKIKYMEFKLHNGSGGLCCKSCSRQDKKLNTYDWLADIPGNAEESDMVEVQFKNTRKGYYRNSNKIKLEKGDIVAVEATPGHDIGTVTLTGRLVPLQMKKANFKQDAEIKRIYRKAKAVDMEKYEEAKAKEHTTMIRARQIAASLNLDMKIGDVEYQGDGNKAIFYYIADERVDFRQLIKVLAEAFRVRIEMKQIGARQEAGRIGGIGPCGRELCCATWMTSFVSVSTSAARYQDISLNPQKLAGQCAKLKCCLNYEVDCYVEAQKRLPSREIELETKDGTYYFFKADILSNQISYSTDKNFAANLVTISGKRAFEVIGLNKRGIKPDSLLEAERKPEPKKPVDLLEQESLTRFDRDRRRNAKDGNGKDEGGNGNRKKKKKNNNRPQQAANGETQSSQPTPINAQENNGSQPVQNQQRTRGERPKNNNRNNNQPRKNNESREPRSNENRETRKNEPREQRPPREPRGPRNNEQPKRIEKAQENEKPAQE

SEQ ID NO: 9502 - protein, 370 aa, B.fragilis
AMFFRDVIGQEEAKYRLIQEVSEGRIPHAQLFCGPEGVGKFPLALAYARYLSCTNRSDTDACGVCPSCVKFNKLVHPDVHFVFPVVKNGRSDDYIVEWRKLVLNNPYFTINHWLNEINAENAQAVIYTKESDEIMKKLSLKSSEGGFKITLLWLPEKMQQACANKLLKLLEEPPEKTIFLLVSEAPDLILQTILSRTQRFNLRKIEEECMAEALQSKYGVQQATSISIAHLANGNFIKALETIHLNEENQLFFELFVSLMRLSYQRKIREMKLWSEQVAGMGRERQKNFLEYCQRMIRENFIYNLHRKELTYMTLEEQNFATRFAPFVNERNVMGIMDELSEAQKHIEQNVNAKMVFFDFSLKMIVLLKQ

SEQ ID NO: 9503 - protein, 97 aa, B.fragilis
SQGSSSGIAGAGDFVAPGPLFRGGTVGKIAVGSKVVRKAVPLRGDDLTGRPVVTGDLNRIIVPPPGGSLPFFAGPYALQGNGVLVFRVMHPIYQFRS

SEQ ID NO: 9504 - protein, 828 aa, B.fragilis
VARSFQPRGEDERLGIPAFKLADGPLGVASWGLFGRATAFPSALSLAASWNKNLAEKTGAMYAQEWRARGIHFLLAPGVNNYRASKGARNFEYFGEDPYLASEMVVPFIKAVQDGGVIATIKHFAANDQEFDRYTVSTEVSERALQEIYLPPFKAAVQKAGVKAVMTGYNLVNGVYCTENKHLIDILKKDWGFKGMLMSDWACTYSAENAANYGLDLEMGSNDWFTRKELLPLVKEGKVTEEVINDKVRRIYGACISMGFFDRPQQDTDIPTFNPQANQMALNTACEGIILLKNEQNTLPIHRPKVIAVIGPTANPAIVSDRIYNVNSIVYGGGGSSKVHPWYVVSALEGIRQEFPEATVLYTEGISNQFKPRLFRNSKFRTKESKPGLEASYYALSSDTSATLSDKMIQQQAVAAGRTVSVNQSADRTVETDKEESGLILRRTDRTVNYEWWGYPFNESKLGNDYRVCWEGYVDVEKTDSIRFFVDAQGAYRLWIDGTLALDASQSQSFDVRNTAISAKKGDAKHIRLEFCNQRSTPAEIRMGYAYQSDIDFSEAKRLAAKADLVVFCAGLDGSIELEGRDRPFDLPYGQDMLIQELVKVNPKLIVAIHAGGGINMTRWIDQVPAVVHALYPGQEGGHALAHILSGKVNPSAKLPFTIEKRWEDSPACGHYDETRKEKKVYYTEGIFTGYRGYDQKGIEPLFPFGFGLSYTTFDYSGLNIRMTDKKQKQLVVSFTVTNTGQRDGYEVAQLYVRDMQSKEPRPLKELKGFDKVYLKAGESKQIEIGLSEDAFQYFNAKQSRWVFEKGEFEILVGASSKDIRLAEKIKM

SEQ ID NO: 9505 - protein, 325 aa, B.fragilis
IEKPIKKMDYISFLSLYLWREPMNLISMAKQKDGFLGEQALVLPPAIVQRMKTDPATSILYITDIGYYPKAYNHFRERDTPIDQYVFIYCTEGRGWFSLDGQKHPVVPNQYFILPAGLPHAYGADEKEPWTIYWIHFGGTLAPLYCTHRTCRLTDIKPGMHSRISYRTELFEEIFRVLKMGYSLENLSYASSVFHHYLGSLRYLREYREAFSEHRPAGEEDPVNAAIHYMKENLGKKLTLAELADYTGYSSSYFSNLFLKRTGYAPLSYFNQIKIQKACQFLDFTDMKVNQVCYRVGIEDAYYFSRLFSQIMGMSPREYKKVKKG

SEQ ID NO: 9506 - protein, 348 aa, B.fragilis
RSLYGDCYSHCIYNSTSLKVEHYKLIFFNIMKIKLLLLLCCGLWSSCNSYDYCPVTPSESDLVFTGLARSWDEAMPLGNATVGALVWQRDSTLRLSLDRTDLWDLRPVDSLSGDNFRFSWVKEHIRQKNYLPVQKKLDWPYDMNPAPSKIPGAAIEFPLEQIGTPTQVRLYLNNALCEADWADGTQMQTFVHATEPIGWFVFRNLKTPIEPSIITPVYNKTKPDGSLDPVSGQDLHRLGYQQGKVVREGNQITYHQKGYGDFSYDVTVCWKQEGETLYGTWSVTSSLSGEQASEKAEAALQRGVKHDYQAPLEYWDRYWAQSCITLPDADWKNRLRPKLINRVHYPEH

SEQ ID NO: 9507 - protein, 482 aa, B.fragilis
SVSLFISILKPAYFAISIKPFNNMKQTRGYLLLICIVSAMGGLLFGYDWVVIGGAKIFYEPFFGIENSAALRGWAMSSALIGCLAGALLSGIWSDKYGRKKMLVIASFLFALSAWGTGAVDHFSYFIFYRIVGGLGIGIASNISPVYIAEVSPAHVRGKFVSLNQLTIVLGILLAQLANWQIGEYYTQGSDILSETSVQWAWRWMFWAELIPAGIFFLLSFIIPESPRWLATVHQQEKAQKTLTRIGGETYARQTLEELNQLTQSQGNRQNNEWKSVFRPEMRKVLIIGIVLAIFQQWCGINVIFNYAHEIFSSAGYAVSDVLMNIVVTGITNVIFTFVAIYTVDKWGRRTLMLIGSAGLALIYLILGTCYFLDVNGLPMLLLVVLAIACYAMSLAPVVWVVLSEIFPVKIRGMAIAISTFFLWVACFILTYTFPVLNESIGAEGTFWLYGGICLAGFLFIRQNLPETKGKTLEEIEKELIK

SEQ ID NO: 9508 - protein, 1102 aa, B.fragilis
NKMKESVNVWEEDILLPTYGIGRPEKNPMFLEKRVYQGSSGAVYPYPVIEKIEDTCEEKSYHAVWLENEYIKVMILPELGGRIQMAFDKVKQRHFIYYNHVIKPALVGLTGPWISGGIEFNWPQHHRPSTFLPVDYSIERCKDGSVVVWVSERERMFGQKGTAGFTLRPGRAVLEIQGKVSNPTPLPQTFLWWANPAVAVNDCYQSVFPSDVNAVFDHGKRDVSRYPIATGTYYKMDYSAGVDISRYKNIPVPTSYMAIRSNYNFVGGYENDTQAGVLHVANHHISPGKKQWTWGNGDFGQAWDRNLTDADGPYIELMTGVYTDNQPDFSWLQPYEEKTFTQYFMPYRELGVVKNASSELLMNLETEGEECRLKLFATSAQQGLRIVVRQAGVIRFEEIGSLSPEQVFDRLIPINDLHEAEVIIYDTNGRKKLSWKAEPETIKAVPEAAKPALAPEEIKTNEELYLTGLHLEQYRHATYCPTDYYREALRRDNGDARCNNAMGLWLIRKGEFAQAEPYLRNAIARLTEKNPNPYDGEAFYNLGLALKFQGKDDEAYDSFYKSCWNAAWQDAGYYSLAQISVSRSNWEEALEEIEKSLLHNWHNLRGRHLKAIILRHLEQKEEALAWIEDSLKTDAFNFGCLFEKYLITRDETVLIQLRNLMKRGAPDYEALVLDYTSAGRFEEALAVAELAIAQPAGEQTLLHYYKSWCLIRLGKTAEAQIAIATAEKEPADYCFPNALEAIEALQCVVDFAGKAPKALYYLGNLWYDKRRYPTAIAAWERSSREDETFPTVWRNLSLAYFNKMNRPDAAVALLEKAFRLDHTDARVLMELDQLYKRLNRPHIERLCFLEQHIDIVMTRDDLYLEYVTLLNQTGQYREAIRRIDQRKFHPWEGGEGKVPAQYQLARLELAKELINRKKYDDALALIDECYIYPAHLGEGKLPGAQENDFNYYKAYILQQQGRPEEAHSLFVKACSGNSQPAAAMYYNDQKPDKIFYQGLAYRKLGEEEKARSRFNQLITYGEEHLFDRFKMDYFAVSLPDLLIWEDDMDKKNRIHCNYLMALGHLGLGNRTKTEHFFDIAASMDNNHQGVQIHRKLMNTILS

SEQ ID NO: 9509 - protein, 940 aa, B.fragilis
QSSRSTNSPEINEYHSIMKQSFQNTRYRAILLLTGLMLAMTAMAQTLTNDALDLSGMWRFQLDPMGFGKTPGSELYLDKLSETIMLPGSTDQGGKGIKNTARYVDRLSRKFEYQGAAWYQREVVIPEDWADREIYLKLERCHWETTVYVDDKEAGMKEHLSTPNTFVLTPLLTPGIHTLTICVNNTLKYPMDQWNHGTTEYTQTNWNGIAGDILLYAKEKAHIRQINVYPDVSSKAVEVSVQPAPLKTGQTGKLELCIREQGGKIIARQTLNADSLQVHAGIRQTLPMGNRVKLWDEFTPYLYEIEASWNVDGKTDTQTRTFGMRNVEQGKHHIRLNGRDIHLRGVLDCAVFPLTGYPSTNVDDWKRIFTTIKEYGMNHVRFHSWCSPEAAFEAGDEVGMYLQAELPMWIKDVGKYPDRRDFFEKEMYAILDAYGNHPSFILMCNGNENEGDFAVLEDLVKKAQKYDNRRLYSASTARTHTPSDQYYVSHVTSKGWITVYEGKPSTDWDRCKESDIDVPVIAHETGQRCMYPNFEEMKKYTGVVEARNFEVFRERLAKNGMLHQANDFFRATGAHTVLQYKEVNESLLRTRNSGGFQLLGLADFPGQGSAFVGILDAFWESKGLVTPEKFRESCAPTVLLARLPKRTFRNGEKLKAKMEIYHFGKDALNSRKLNWTLTGEDGTVYHKGSLKTKSIQPATVDSLGIIELPLNGMDSALKLTLKAELGGIHNEWDVWVYPEQPKTEQYNFVYTRTWNDETKQWLNEGKNVLLIPEKCKGRKAHFASHFWNPIMFNWNPMIVGTLIDNEHPAFRDFPTRNYADWQWWDILNYSTALELDELKEITPLIQSIDSYETNQKLGISFEAKVGKGKLFVLCADPEKKIDERPAMQQLLTSVRNYVSSGHFNPTKSLPVYLLDALFAPASEEKSGDKGSKAIELLLNK

SEQ ID NO: 9510 - protein, 224 aa, B.fragilis
KKYAVRLLLLQKKNYFCELFILKIHRMSTHGSLSEVERFNLLYKSSFNKVCNFACFYVRNKQASEDITMDAFLQLLETMKVESVDNPMALLITIVKHKSLDYLKTQVRREDTKDDLIQWKQRELAIRISNLEGCNPSYIFSQEIKSIVMKTLNQLPEQTKKVFIMSRFENKSGKEIAQTLGISVKGVDYHMNKALKELRAALKDYLPILTWLCFMNPINKVWIS

SEQ ID NO: 9511 - protein, 439 aa, B.fragilis
KLTAMPTILERLTALFSRDMRAVLRNPRAISMIENPSIRVQMAAIRRDKSVICFIDKPVEKVQLAAVGNAPHNIHFIASPGEKVQLSVIRHKPGYIGFISNPTEKAQLTAVERRPECISLISKPAVKVQLMAVLKDPAHIASIKEPAEKVQLAAVQKNPEYIRHIESPTVKVQHMAIQGNADTLRHIKSPADTVQLAAVQAKGETIRYVSEPSEAVQLAAVRNNPMNIRYIENPTEKVQLSVLHADREAAALIHFPSDEVRKQAEEMYGLKLEKPADREAEPSSEAPESSATRRTPRKKTEQSTQSTRKPSARQVKTAITKLDKEIREIRELPQGKDREQRLIKAFEEFNSSAVPEKKGCDVESILKDLRGKGVKVEAMKAEEWHSLMNGKAIQPSLISGASKPAAKGASFMLTKTPVGYAVKAVNTVNSLTRQASADM

SEQ ID NO: 9512 - protein, 1227 aa, B.fragilis
VNKYFSLMTNQVTYLFFHGMKQISENLFTTEEQAIIARSKAEGSYMKAPNGQATNLNEKQWAQVRTRAFREWFGDWENNPNEASKVRDANGEPLVVYHGTPISRDQAADRSKFRIADDWEIQTINAPFHTFRGGAYNGLIFTSLTEEKARSIGETRSMSIPDSEDGREQWTTDSYVYDLFVNAGKPFDVKNPNAVKDVLDALKGQLTAYDFYLGMEVPVSREEAEKILEGGNSWRVVETPSMQEIIRSRGYDAIHALDEGVQYMAVFAPNQLKASGKYLYSERNTGVFSPGNNDIRFREVHHGAPASFTGYRSMKTETVRDDNIPAVLAALRDKLEDTEQEWQDRILDYIAENYPTQATVSAQTRSPEGLKEREAMKKDKTLMKMKEEAVAALNAADEKVMEAFKKENGDILFREVKGKDGGKSLVGLHNITEEKLLKALKLGGLANPSAAVIDIARQSHEGYGEISLILPSSMIDKRTGRNAGTFSGDAWTPVYPQIERQFSGDGSGRVRDAISRLPQEMKPNVRSTWNSYMDGRDEGSAFAYQFLYERGEAPEFRKVEPLFGEHLRNRISAIDALDDYDERNTALLEVYIEENFGGDQTKFKDYIETRKRVLQDKIQAFPEQKQKGLAYRKAVQKLNDIEERGYEYSSVQDFYDRVKADIRQAGSVDTYHTLQDALDKIDGSEALSRQYAEWKESLADKYGIKEVLFKGYTPDGIRIYLPHTLENVSGLMKRQGLAAATGWGGSFSEFAAALMKPVGTLDGIRRQKGRLTTDHSDLEAFRDKWQEVYFNLGIKLNPGGGTFDDTGLYRVGDIALKPDPGSFAKREYGVELTGEDVRQLKEMVDAIQNEYPAMYFETKFERPVYLNEFVAAVVPENVSEDVSKAVRESGLQVFVYKPKDESSRNEAVKLASEIKGVRFRLAGGTGAFTPACTASGQVFLSDERMAELSRHAVFLARKQHIPVNIIHSIGEVDSPKVRALIAGGKDIRGWYDIPSDRICLYLPKARGKEDIERTLLHEGVGHYGLRRLAGWKHMDAFLDDIFAGCGEKVRGEIIRLAGTGKMDIRTATEEYLAQMAESGTDARVWDKIRLAFRNLLRKLGFSIEVDDRELKGLLAASRENLKRTAATRIPEKIQTPKGELELTPGYAAGSLRSKDGVRDVTPFLKEMKRAGLKPASLSPEEWKSLFSGKGIALPDGRMLMAVKEPAGYGLKITAPALRSIKTAEMEI

SEQ ID NO: 9513 - protein, 814 aa, B.fragilis
IMDFNSYKKVISNCNHIVKVGMVSAYALFLGVNTALASVTEYMDQKVSLKTQNYTIESVIQQVEKQTDYLFVYDKNDVDVKRTVYVNGSNTDVIELLKGIFDNTDIDCKVLGNNITLSKITNVATRIAQQDKKTAKGNVIDSTGEPVIGASVVEQGTTNGTVTDINGNFTLNLSTPNAKIEISFIGYKTQVLTAQFGKQMAVKLVDDTELLDEVVVVGYGSQKKVNMTGAVATIDSKSLASRPISNISQGLQGLAPGVTVTNAGGQPGQDTGKILIRGLGSFNASSPMVLIDGVEGDMNVVDPSDIESISVLKDASSAAIYGSKAANGVILITTKRGQSGKPKLTYSALFGWSKPADLMDRTNSAELAELTNEAEYWDAISQGASPEQAEKRKPYTQEDIRKYAEGSDPYGHPNTDWYDLFYTGSGFMNRHNIGMDGGSEWAKYRASLGYVKQEGIVENASNRQFNVRTNLDLKLTERLKSRINLDFANTLMKEPTDPISWSNGAAYQVFRQVNRISPMVPYKNEDGTYGTIADGNPIAFQDLGSTGDTDKDYLNAFAEFSYDIWDGLKITANGSYNVVNKSYKLYRKDLQYNANKYDGPIRLTKSHTKEIRRQGDILLNYDKTFAQKHTVNTLAGFHTELYSYEYDDAYRQNFPSSDVTDMNGGSEQVLSPVGQLCNKTVLPPAHKCTPTVCPPFLKKETTVADGVGLPRRRQWERNNPHPWREAGGASKRAYAARLGETRMKRAKPGSHPTLKSHFPPMARDRPWGGRSTDPKQHFELIQISVLRGRQSTCDSGGVDPAGDVDGEQERCMRL

SEQ ID NO: 9514 - protein, 140 aa, B.fragilis
PQTNHVMLNENNRSSDRILTERILDDPDMILKIENPSLKQQMAAVQKKPELIASLPLAGEKVQLAAVIACPESILLVDTPAPAACFMAVERMLKEELLPVPGVLNAARELILQMKKDKADGKSSGAAIEKFLDEVKPIKN

SEQ ID NO: 9515 - protein, 84 aa, B.fragilis
KMPEPIRPDTKNGKVLNLLPNVIFYGIFLLFYNSRSFFQTVVDPRLNHILYKNVIYIVIRKNFVRAPNDWHRNSFNCQPLDITE

SEQ ID NO: 9516 - protein, 320 aa, B.fragilis
RIMDDELLIAYFKGEVSDEETQRITEWIEAEIEHQRYYQQLCRLFEMSYWIEDMPEQTEVALPQKAKILPWKHYAISFMKVAAIFVLGFALHFFLNRQTTTTHHELQHQIHVPTGQHVEIMLADGSKVWLNSGSTLTFPSKFNGKKRLVELDGEGFFEVKSDKEHPFIVSTSKYQVKAVGTSFNVYDYQDSPQFEAALLNGKVEVTTNAKKSSAVILTPNQRAALCQGVLKVKPIENTNNYLWRKGILYFNEPLLEVFDKLQEYYDVEFQIRNTSLTRKSPYCTGKFRAKDGLEHIIRVLKETNHFDYQIDYENKKIIIL

SEQ ID NO: 9517 - protein, 119 aa, B.fragilis
IMNMDKNDSFDGPLQEGRHTTLRSFSWGNREFTISSDKISLYVGGIPYDTKPMLDILRGSGVDPGKLSPARWISLLRGQPTRLPGCEKPFMLVKAPSGYTLKCPGNNPGAGTRLFQPEM

SEQ ID NO: 9518 - protein, 548 aa, B.fragilis
LVDTMKKAVILFSLFCFLCAIPVVQAADTIFVRETRIPILIERQDNVLFYLRLDAKESQTLNDVVLNLGEGVNLSEIQSIKLYYGGTEALQDSGKKRFAPVGYISSNTPGKTLAANPSYSIKKSEVTNPGNQVVLKGDQKLFPGINYFWISLQMKPGTSLTSKVTADIASITLDGKKALLDVVSENGIEHRMGVGVRHAGDDNSAAFRIPGLVTTNKGTLLGVYDVRYNSSVDLQEHVDVGLSRSTDGGKTWEKMRLPLAFGEFGGLPAGQNGVGDPSILVDTKTNNVWVVAAWTHGMGNQRAWWSSHPGMDMNHTAQLVLAKSTDDGKTWSAPINITEQVKDPSWYFLLQGPGRGITMSDGTLVFPTQFIDSTRVPNAGIMYSKDGGKNWKMHNYARTNTTEAQVAEVEPGVLMLNMRDNRGGSRAVAITKDLGKTWTEHESSRKALPESVCMASLISVKAKDNVLGKDLLIFSNPNTTKGRYNTTIKISLDGGVTWSPEHQLLLDEGNNWGYSCLSMIDKETIGILYESSVAHMTFQAVKLKDIIK

SEQ ID NO: 9519 - protein, 532 aa, B.fragilis
LYMTNTNSIMKKIFTYMLAGLSLLLFSRCDALDIDPTSSIADSNYWKTEAQFSTFNVGLHALLRECSFNFFLLGEPRADIYGDVPFGGEATQGMERLPFNTINKENTGISNFAGMYKVINQINLMIAKTKETTVLSEAGKNYYLGEAYGMRAYLYFHLLRSWGDVILYLDYTNGASLDLSNLSKAASPAEEVMKQIKEDITASEKGFGSDYSFKYGRYYWSMAATQMLKGEVYLWSGRQMGGGTADYTTAKTALQSIVSNANVSLQDDFSKVFAYNNKDNSEIIFSIRNAKDEYNMWDDKFRQNLVPQQAYMTSTYCNKEGVSFKDLPEGQLNGLIRLQIRYDLYNKAFRDGDTRKDASMTAVYQKQQDGTVKYIAPFCNKYQGVLLDGASQRSFLNDYPIYRYADCLLLLAEAKALLGEDPTAEINQVRERAYGKEFFETNKATLAYPNDKGDFYTDNKYMSGDEDPLEAILKERMREFMFEGKRWYDLRLLGADYVTKRTSAVATRLLWPINESVLTDNPALKQTPGYQN

SEQ ID NO: 9520 - protein, 93 aa, B.fragilis
DRRAAVDAINGVNIDLSPPSMAGAVGMREWPHLLIVLSVEEEPDGRSRLFALAAWVHERPSAFTKDACAATRDTAPRAAGKTLHSAQLLMKTR

SEQ ID NO: 9521 - protein, 1083 aa, B.fragilis
DCTHFQVFIFMEFRRDNFPFLLTKNQFMKKVLFILLGCLLSFNVMAQVKAISGLVTDVTGEPVIGASVVEVGTTNGVITDLNGKFSLKVAPNSQFLVSYIGYKQQTIKVGSESTYNIVLKEDAEVLDEVVVVGYGSQKKVNVTGAVGMVSAEALEARPVANASQALQGVVPGLNLTVGNNGGALDGTLNMNIRGAGTIGDGSGSSPLVLIDGIEGDLNTVNPNDIESVSVLKDAASASIYGARASFGVILVTTKSGKSGKTNVSYSGSARFSDAIGVPDIMDSYTFAQYFNRASANKGGGDIFAPAVMERIKAYQEGTLKATTVDNGAGIWQKWANANGDTDWFEEFYDHWAPSQEHNLSINGGTDKTQYLISGSFLDQKGLMRHGKDKFQRYTLNGKITTAVTDWFKVTYSTKWTREDFERPSYLTGNFFHNLARKWPVHPAYDPNGFPMDEGEVEQMENGGKQNSQKDFYTNQLQLVFEPIKNWKINLDGSVRTTTQYQHWEVLPVYAYNVAGDPYYTVWDMGYGSYAAGSSRVNEYSWKENYYTTNIYSDYFKQFDNGHYFKVMAGFNAELYKTRNITAEKNTLITPGVPTINTATDDPQAYGGYADNSVAGFFARVNWSYKDRYMFEANGRYDGSSRFVGKERWGFFPSFSAGWNIAREPFMESFAEKINMGSLKLRASWGQLGNTNTNDAWYPFYQTMPVGSNYGWLVNGERPNYATNPGIVSSKKTWETVETWDVGLDWSFFNNRLSGSFDYFVRYTYDMIGPAPELSSLLGTSVPKINNSDMKSYGFELEVNWRDRIGEVSYGAKFVLSDDQQKILRYPNDSYDVGSYYKGEHLNDIWGLTTIGIAKSQEEMDAHLAKVDQSSVGTNWGVGDIMYADLDGDGKISNGTNKLGDTGDYRIIGNSTPRFKYGITLDAAWKGFDFSIFMQGIGKRDLWLDGCYFWGANGQGNEWQSTGFAEHWDFFRPEGDPLGANLNSYYPRVNFSGDRNTKVQTRYLQNGAYLRLKNVQLGYTLPRVWTEKAGISSVRVYVSGDNLATITSLSKIFDPEATGSLAGTGSGKLYPLQRVISVGVNVNF

SEQ ID NO: 9522 - protein, 861 aa, B.fragilis
KSEQFMMKKLLYGLVCCCSLAYGQNQDTSDVLMLNDDWSFSQVGTEKWLTATVPGTVHQDLIHHKLLPDPFYGTNEKKIQWVEDEDWEYKTCFVVTEEQLKRDAAQLFFEGLDTYADVYLNGSLVLKSDNMFVGYAVPVKQVLRKGENLLHVYFHSPIKQTLPQWSSNGFNYPADNDHHEKRLSVFTRKAPYSYGWDWGIRMVTSGIWRPVTLRFYDVATIADYHVKQLSLTDQVAKLSNELEINSISEKEKSAEVLISYSLQGGKEVTVKENVTLKPGLNKIHIPLDIQNPVRWMPNGWGEPHLYDFSAQVICDGKTIASRQHRIGLRTIRVVNEKDKEGESFYFEVNGIPMFAKGANYIPDDALLPCITTERYKTLFRDMKEANMNMVRIWGGGTYEDDRFYDLADENGILVWQDFMFACTAYPSDPTFLKRVEEEAEYNIKRLRNHASLAMWCGNNEILEGLKYWGWQKNYTPEVYENMFRGYDKLFRGLLPAKVQELDEGRFYKHSSPYFANWGRPESWGIGDSHNWGVWYGKKTFESLDTDLPRFMSEFGFQSFPEMKTIATFAAPEDYQIESEVMNGHQKSSIGNDLIRTYMERDYIVPEKFEDFVYIGLVLQGHGMRHGMEAHRRNRPYCMGTLYWQLNDSWPVVSWSSIDYYGNWKALHYQAKRAFAPLLVNAIQEGDSLNIYLISDMLEKQSQLTLEMKVIDFNGKTLDKEVIKAVEVAMNTSSCIVRKPLDTWVNPEQRKSSFLLLSLKDKSGRKVAEEVYFFDKTKNLELPQTAISMKVKQLDGKCELTLSSPKLAKDVFVQIPVQGARFTDNFFDLLPGENKKITITSPEIKKGESLNITVKHVRDTYN

SEQ ID NO: 9523 - protein, 549 aa, B.fragilis
KIINMKRAKSTILYSLLVAFVGVLYTSCADKLDLSPIDYYGSGSYWKTEAHVIGYMDGIHKHLRDATFQHTFIWGEARGGALITSGTSADGMGMLYGDIKLQNFDEDHTGGIKKFGDIFGRLTNLNLFIARVTDATYMDDVKKGYYLGQAYGLRAFYYFDLYRTYGGVPLRLTADVVEGVIDPNKLYMARATPKEVMDQIKKDLDKSMESFGDNNSFDPNNRGNKKGYWSKAATECLMGEVYLWISKVSTGDDAANEANLEIAKTHLQNVINNYGLKMLDDFSSVFDAKNGKGNSEIIFAVRYMEGEAGNNNNLFTYAMATGSTKDNYLANGEKFLDALNIANTGSQQLEYKHEIYNSFDVADTRREATFIASYSKNTETKELTLRGTHVRKNIGYVNAQGSRIYCGDYIIYRLPLVYLMLAEIENMQGGDVAKYINLVRERAYSTNWDKAIYGYTNADFTTNELAILHEKDKEFIQEGQRWWDIRRMTLTKGGKHLVFVKEGSIGTDMPTLDEATEAHKVLWPVDKDLLGNDPLIYQTPGYATYKKAE

SEQ ID NO: 9524 - protein, 691 aa, B.fragilis
AMIKILFLSLFLMVCTILSAQKRVKVACVGNSITYGYTLPNPATDSYPSQLQQLLGETYEVGNFGKSGATLLNKGHRPYMQQEDFKKAIAFAGDIVVIHLGINDTDPRDWPNYRDSFVKDYLALIDSFRVANPKCHIIIARLTPIADRHPRFESGTRDWHGEIQQSIETIAKYAGVQLMDFHEPLYPYPYLLPDAVHPNVEGAGILAKTVYSAITGDFGGLHLSELYTDNMVLQHGEPLAIRGKANAGEKVTVSIAKQKLTAKAASNGDWTVTIQPLKAGGPYTLTVSAGKQKQTFNNVLAGEVWLCSGQSNMEFYLSWSKTAKRDIPQAANDQIRLFDMKARWRTDAVEWDASVLDSLNHLQYYKDTEWTVCSPATAGSFSAVAYYFGKMLQDSLKVPVGLICNAIGGSPTEAWVDRSTLEYKFPAILRNWTQNDFIQDWVRGRAALNVKKATNKQQRHPYEPCYLYEAGIRPLEQYPIKGIIWYQGESNAHNREAHEKLFKLLVESWRKNWENENLPFYYVQLSSINRPSWPWFRDSQRRMMYEIPHTGMAVSSDLGDSLDVHPKHKQPVGERLAHWALNQTYGKKNVTPSGPMFRNVEFRDGAAYVSFDCAEGMHASDGKPLQTFEVAETEDIYYPATAEIVGNQIKVYSKEVKNPLHVRYGWQPFTRANLVNGDGLPASTFRTDWGK

SEQ ID NO: 9525 - protein, 521 aa, B.fragilis
IMKKIIYIISLFVSSVLYTSCDALDLAPEDYFGSGNYWNNEAQVEGFMYGMHSQLRGNYNMFYCLGELRGGTQRVGSSSQNTSLDYAILRTNTLSQDNPGFTNWFGLYSPIMQVNHFIQKVENECAFLSEADRKTYLGQAYGLRALYYFMLYKTYGGVPIVTTVELLDGKVTADKFYVERATPEATLSFIKEDIGKSESYFGTTEINNKHDKTMWSKAATLMLKAEIYMWAAKVSINGYTASGKSDLEIAKNALNGIIGKFQLLNKFSDVFSTSNRNNAEVIFTLHFADGEATNWGGMFLYQDAVFIGQVYGRDDKKIETDTLNLKGTGGVFRHEYTEDFWKSYDEKDTRRDATFLEYYTKKNKEGFGCVMQKAIGSINSNNNRIYDTDFIVYRYADALLMMAEVENGLGNPCAGYINEVRKRAYGSDYEANKYTEGNYAENELAILHERDKEFVWEGKRWFDVVRMHDANGKSLAFSATANYPADKSILDPSEEYKLLWPIDVDVMSVNPLLKQTPGYEK

SEQ ID NO: 9526 - protein, 64 aa, B.fragilis
HTENRKAKIELRLFSWYRLINIYVIGSKDSIFYYITVMLIKYFIIYGRFNKQDTIRRKALNHRK

SEQ ID NO: 9527 - protein, 673 aa, B.fragilis
SIMKLKIKNLFVQACFVAGGVMALTSCNDFLDREPLSSVTPEVYFQTVDHFAAYSIARYQNYFPSHGGYGAGIANNDGGTDNMVAGGRSSRYVKGLWKVPSSDGNWSFSNIRYCNYFFENAVPKYEAGEVAGADADIRHYIGEMHLMRALVYYNLLRTYGDFPIVTEVLPDDKTVLMEKGVRQPRNLVARFILKDLDDAANMMYSKGFKNNTRLNRETALLIKSRVALYEASFERYHKGTGRVPGDDNWPGKKVHSNFSLDVEAEVDFFLTEAMKAAEEVADKITLTPNTKVEDPASPSITSGWNPYFEMYANVDLSGYDEVLFWRQYAKTGSFSIMHGTPAWIASGSNHGLLKSYVESFLMQDGLPWYAASSAAPYKGDATLDDVKANRDNRLQLFMFGESNFVPVYSTEEPGTVKMFAPHPVSNREEMRDQTGYRIRKYASFDMAQNVWGKAESTTGCIIYRGVEAYLNYLEAYYMKNGNVTGKAAQYWRAVRERAGVDPDFTKTINATDLSQETDWGKYSGGQVVDATLLNIRRERRCEFIGEGMRWDDLVRWRSMDHLLTKNYIPEGCNFWDEMYKSANKDENGAEVTFKDSGEEGSNISSRSFKYLRPYAILKTNNDVYDGYTWQKAHYLNPVPVREMELLSPDEKAETSVLYQNPYWSTKIGEVAEE

SEQ ID NO: 9528 - protein, 209 aa, B.fragilis
KRMKKILLMMLLLASMASNAQERKYSTFYYQRATLFEELPVTSKDIIFLGNSITNGGEWSELLNNKHVKNRGISGDICMGVYDRLDAILKGKPAKIFLLIGINDVSRGTSADTIVNRIGMITQKIKQDSPKTKLYLQSVLPVTDHYKMFGGHTSRWQEVKKINEGLMYLADKENVTYIDLYSHFVDEKTGKMNIEYTNDGLHLLGKGYL

SEQ ID NO: 9529 - protein, 1093 aa, B.fragilis
KAILMKKTIFLILCILCSLGAMAQKKSITGVITDGAGESIIGASVVEVGTTNGTITDFDGKFSLTIATGAKFTVSYIGYKSQTITVGAENTYNIVLKEDTEVLDEVVITGYGGSQKRATLTTAISKLDNSVLKNAAFSNAGQSLQGSVTGLRVVNKTGQPGSEPDITLRGGATITGDNSKALIVVDGIVRNSMSDINPSDIESIQVLKDAASTAIYGARANGGVILVETKSGKEGKASVNYKFKMGVNFARKGYDFCDAHDYIYYNRLGYKRTGRTNVDTQMGYGIGNNLFDIRYLTDENANLKNEGWASMADPFYDGKTILYKDYSGELDDVVFNNSALTQDHYVNITGGNDKGTFSASLGYYKEDGQIRGTGYERFNGALNGSYKVFPFLTVKANATYSWSTQPELWIGQYEFFYRTRSQRPTWNPWNEDGTPASGFGTGDGNPDYYRDKLTSENSTNKSTYSVGFALDILPKKLVLNGNASLYRYDWQREKFNKSYQAQSSATPDNTRQAEAYVQKYNQIQLNGTLTYTDTFAEKHNLEAMLGTEYFTYDQFDFEAKTQNSPTDDIPTLNAGSTRTYTSTTKTAYRILSGFGRINYNYDMRYLISFVARYDGISKLKDNRWGFFPGVSVGWNIMEERFWKDSKISGVISNLKPRLSYGVNGNVNGIGNFDVYGAYSQVGAKTYGGSTAFYNSGLVNTGLRWEQSQSFEAGLDIGFLNNRLSFILDYYNRTTKDLLTKQALPGYTGFTEIMTNMGTLRNYGFEMEVRANILNNPKGLTWDVTANLSSVANKIVKLPYNGNPNNRVGGYEVATGRKKADGTDETKWIAGRQEGGKLGELVAYKQNHIFKDWDDVKKYANNRIDEVANLYGPGLAAQYAGKEGWQPIEPGDVCWEDINGDGVINGYDRQVVGNIFPKVTGGFSTTLGYKNLSLYARFDYALGHTIYNDLAARSLGQYQGSFNIIKEVKKTWSETNTDTDLPAFYYADQLSKKNITRSNNGLTAIDNNSSRFYEKGDYLALRELTLNYNLPKTWISKVGMTDASVYVTGQNLFYITGYTGVSPEPAVDTTYGRGIDNGRYPTPRTVLFGLSVTF

SEQ ID NO: 9530 - protein, 434 aa, B.fragilis
GLIRRLLEPPVKTDKKTLMGNGNFTGTEIYDYHRKMYGEDFTYADFAPMFKALSYDPEEWADLFEHSGAKYVVLTTKHHDGFALWPSREASISYGRPWNSMEIGAHRDLVGEYVNALRKTDIKVGCYFSLREWDNPLYNKETMDLFYERHWFPQLQDLVNRYKPDLIWADGPDQINDKQWQAERTLAWLYSESPVKDSIVVNDRWANNTGKKHGDYYTREYSNTNSSYNKPWEECRGIGLSFGYNQNEDLGDYTSPKALILTLVNIVSQGGNLLLDIGPNANGKIPPIMQERLLQIGKWLKVNGEAIYGTRAWGNFCQWSKGSKEWKSKEKHYVSGDAILKQTVDPDPGYAVKEVFFTKKGNNVYAILPRYPKNKIVLKDIQTTGRTKITLLGSDKKVQWKQKGNDIEVIMPLLYVDELPCDYAWVLKLEKISE

SEQ ID NO: 9531 - protein, 672 aa, B.fragilis
IPMRNKQIFLISFIIYLCTISSVRAGEYHLLPEPQKFTPLGSSFVLGRTKLSTPVLRQEWEAFVVDRGGVIDDKARASIEVKLVPSLEEVPLNADEAYRLVVNNGKVTVEAVTEHGVYWAMQTLAQLQDVQKKKATFNGCSIVDWPAFRIRGFMQDVGRTYMSIEELKREIAVLSRFKINVFHWHLTENQSWRLQSKIFPMLNDSVNTTRMPGKYYTLEEAKDLVAFCKAHNILLIPEFDMPGHSGAFVRTFRHDMQSPEGMKILKLLVDEVCETFDVPYLHIGTDEVRFTNPKFVPEMVEYVRAKGKKVISWNPGWHYKPGEIDMTHLWSYRGKAQKGIPAIDSKFHYLNHFDTFGDIIALYNSRIYNVEQGSDDIAGTILAIWNDRYVANERNIILENNFYPNMLAIAERAWKGGGTEYFDKNGTILPSEGSPEFKEFADFENRMLWHKEHTFKGYPFAYVKQTNVKWNITDAFPNGGDLNKVFPPEQELKDSYLYEGKEYGVHPAIGAGIYLRHVWGKMVPTFYKDPQENHTAYAYTWVYSPKDQEVGLWAEFQNYGRSEMDLAPLQGKWDYKGSRIWINNEEIQPPVWTATHRTKSNEIALGNENCVARPPIAVHLNKGWNKVFLKLPVGKFNMPEVRLVKWMFTTVFVTPDGENAVDGLIYSPDKTK

SEQ ID NO: 9532 - protein, 71 aa, B.fragilis; identical to SEQ ID NO: 6316

SEQ ID NO: 9533 - protein, 518 aa, B.fragilis
IICMRNLFKIAGLLALTGFISSCNDKETTANYQVIPLPQEITTAQSQPFTLNGSVKIIYPEGNEKMQRNAQFLADYLKKATGKDYAVEAGTEGKGAILLKLGMESENPEAYQLSVNADGVTIAAPTEAGVFYGIQTLRKSIPVAIGTTPSLPAVEISDYPRFSYRGAHFDVGRHFFTVDEVKTYIDMMALHNMNRLHWHLTEDQGWRLEIKKYPKLTEIGSKRSETVIGRNSGEYDGKPYGGFYTQEEAREIVAYAADRYITVIPEIDLPGHMQGALAAYPHLGCTGGPYEVWKIWGVSDQVLCAGNDSVLTFIDDVLTEVMDIFPSEYIHVGGDECPKTEWAKCPKCQARIKALGIKSDAKHSKEEYLQSFVINHAEKFLNEHGRQIIGWDEILEGGLAPNATVMSWRGEGGGIEAAKQKHDVIMTPNTYLYFDYYQTKDTENEPLAIGGYLPLERVYGYQPMPSSLTPEEQKYIIGVQANLWTEYIPTFSQAQHMVLPRWAALAYVPWPNPEMKSY

SEQ ID NO: 9534 - protein, 529 aa, B.fragilis
KINIVTNMKKITSILLFLSALLYVSCDALDLSPEDYYGSGNFWTKEAQVEGYMNGLHNNLRSSYTMFYVLGEARGGTSRYGTSSLGTSMSYSDPIKNNMLTKDNTGISNWYDLYGRIMQVNHFISEVSNGCSFLSESKKGFYLGQAYGLRALYYFMLYKTYGGVPLITDVKVLEGGKISADALYTERSTPETILKFIKSDLEASELNFGNNVTIDRAMWTKYATLMLKAEVYMWSAKVTTGDHQATGNSDLAIAQTALQPLINQFSLLDNFSEVFSKKANDEIIFAIRFKDGEATNWAGPFIYYGNIFEGQRYGRDGKLMQDTLDLKGTVGQFLHEYKKALWDSYDDEDMRRDATFMDHYGSAQKEGFGIAMKKGIGSVNSNNQRIFDTDIIVYRYADVLLMMAEIENALSGKCANYVNEVRKRAYGKNWHPQFAYTDGSYADNELTILHERDKEFVWEGKRWFDVVRMHDANGKSLAFSVAANYPNNETPDERVPLIKESEAHKLLWPIDVNTLNNDPKLEQTPGYDK

SEQ ID NO: 9535 - protein, 173 aa, B.fragilis
SFMIILIAGDTHTGKTILAQKLLEKYKYPYLSIDHLKMGLIRSGQCKLSADSNDMELTNYLWPIVREMIKTCIENSQNMIIEGCYIPFDWEKDFTNEYMKQIQYICLIFSQEYIKHNFQNILKYENIIEKRQSTDLIFEDISKTNKYNLEQCISRKYNYILIDKDYLIDTDDI

SEQ ID NO: 9536 - protein, 1118 aa, B.fragilis
TSLLLTQKAILMKKTIFLILCILCSLGAMAQKKSITGVVTDASGESVIGASVVEVGTTNGVITDIDGKFTLSVDPNGKIKVSFVGYQPQTIDVKGKGSFNIQLKEDSEMLEEVVVTGYGGKQLRTKVTNSIAKVKEETLKQGMFTNPAQALSGAVAGLSVSQTSGNPGSAPTLVLRGGTNFDGSGSPLILIDGQVRSSLSDINPDDIESMEVLKDAGATAIYGARANDGVVLVTTKRGKSGRAEVNLKAKFGLNYFKDSYNFMNAGDYLYWMRTGYMNAYVGDMKHPDGAGIKGWSSLSGLTTATPYGTGNLYFDKDGVTPLDGNKTSSAIWSPMLYSDNLSFLLDQGWQTMIDPIYGDKIIYKNTNIADFNINTPSFSQDYNLSVSGGNDKGNYYAGLGYNKSEGTAVGNWYQRITFTFNADYKLKEWLTSNSSFNFADATWNGLPASQTAEANYFSRCLSLPPTFRGYNADGDMLLGPNSGDGNQQYNFKQFVRDNNTDKFTMNQSFTIDFMKGLSLKLGAIWYYSEEKTEAFNKDYLSSPGNLITSHSTSASYARTLDQTYNAVLNYNYQINKDNFLDAMVGFEYYDSYSKGFSASGSGAPTDDFMDLEYTSKEEGKRSIDSSHSRQRIMSFFGRVNYDYQSKYLLSLVLRRDGYSKLAEENRWGVFPGVSAGWVFSKEEFMKNTASILSFGKLRASFGLNGNVNKNFVGNYTVQGAYGSNRYNGSTGFLLSSIPNPYLMWEKSRTFEVGLDMGFLENRINANLTYYNRLTSDKYANITVPSTSGVSSVTSNNGEFQNQGFEFELGFRIIDAKDWKWNLNWNGALNKNKVVSLPDNGLERNRQSAYQVYTGNGDEKKWVGGYQEGQRPGDLYMFVAEGLYKSQDEIPANLIDLTTGNNGSSGRPLYGGTEGYNKLTDSQKSNALPIQPGDVKWKDVNNDGVIDNYDMVKVGNTVPKWTGGINTTVSWKDLTLSARFDYALGFTAVDWKTMWIMSCAQGTYNTIEETKNTWTPENPNAKYPTYVWADQLGKRNYCRSSSMFAYNGNYIALRELSLSYKLPSILVQKAKLSNVELSITGQNLGYLTEAKHLFSPEKADNNGGYPLPRTVIFGINVSF

SEQ ID NO: 9537 - protein, 1102 aa, B.fragilis
TSLLLTQKAILMKKTIFLILCILCSLGAMAQKKSITGVVTDASGESVIGASVVEVGTTNGVITDISGKFTLMVDPNGKIKVSYVGYQPQVLDVKGKNSFNIKLKEDSEMLDEVVVTGYGGKQLRTKVTNSISKVKEEALKVGLFSNPAQALSGAVAGLKVTQASGSPGATPTIVLRGGTNLDGSGSPLVMIDGQLRDGLNDINPEDIESMEVLKDAGATALYGARASNGVILVTTKNGKAGYREINFKAKLGVNYVNNPYEFLGGEDYINVLRTTYAKSGYYCSDGEYVSIAPLTNLTGASPFGTGNVLGKSAWNIMGKTADNAYLLQKGWKEMVDPLDPSNMIIYKDINPGDYNLNNPSLSQDYNINMSGGNDRGSYYAGIGYNRQEGLPVSTFYERYSFVLNASYKITDWLTSTSNFNYNRANWKNMPGSNTSEGNYFGRIMSTPPTSRFEDEDGNPTLGPNVADGNQAFQPEKWQNFNQTDKFTMIQGFQIDIMKGLFIKGTANWYYSEGLYESFTKDYMDNMLTEHYTKTRESTAKFERNFAQTYNAVLNFTRTFAIDHNVNLMLGMEYYDNYKRGFEAKGSGAPTDDFSDLSLTDNGEGKRTINSWHEQYRILSYFGRLNYDYKGRYLVSAVFRQDGYSSLLGDNRWGFFPGVSAGWIFGQESFIKESLPFLSFGKLRASYGVNGNASGIGAYTLQGSYNTAVYNGNTGFLIGSLPNPGLRWEKTKTAEVGMDLSFLENRLNANFTYYNRLTSDKYADFSLPSTTGFSSIKNNNGKFRNSGVEIELSGKILKTKDWSWEASANISFNKNKVVALPENGLDLNRQGGQQIYTGKQLADGTYEKKWVGGYQEGQEPGVLVVYKSDGIYRSWDEIPGDLVITSGNYFGKKMYGPDAWKKLTKEQQKNALPIMPGDMKWKDINGDKIIDSYDQVVAGNTSPHWIGGFNTTLRWKNFQLYGRFDFALDYWIYDHTLPEIFLACAQGTYNTTKEVFNTWSDENPNAKYPRYAYADVLTNANYARNSTMFAHKGNYLAIREISLSYSLPKVWANKAYCQRVDVSITGQNLGYITSANVASPEVSNAGSGYALPRTLLFGLNVTF

SEQ ID NO: 9538 - protein, 1120 aa, B.fragilis
TSLLLTQKAILMKKTIFLILCILCSLGAMAQKKSITGVVTDASGESVIGASVVEVGTTNGVITDISGKFTLMVDPNGKIKVSYVGYQPQVLDVKGKNSFNIKLKEDSEMLDEVVVTGYGGKQLRTKVTNSIGKVKEDVLQKGLFSNPAQALSGAVSGVRVLQTSGDPGATPTIILRGGTDYNGTGSPLVLVDGQVRGSLSDINPEDIESMEVLKDAGATAIYGARANNGVILVTTKRGKEGKGEVSVKAKVGINYYNNPYEFMNAGDYIYWMRTAYQRSGQIYKDSKGNWVGTADMNSLNNATPYGTGNLYFDPSTGAVLDGNKDVRAVWSTMKYTDDLAFLLKQGWQTMTDPVYGDQIIYKNTDPASFNLHTPSLSQDYNISISGGNDKGNYYAGIGYNNTDGTATGNWYKRLTFTFNADYKIKPWLTSSSSFNFADATWYGLSPGSRGEVEYFNRMLSLPPTFRGYNADGEMLLGPNSSDGNQSFNLSKFKRDNNTDKFTMVQSFDIKLMKGLNLKLTANWYFDEAKYEAFNQDYLSSPNNMNTSRSTSAEFDRTLNQTYNAVLNYDYQITKDHYLAAMLGFEYYDAYQKGFNASGSGAPTDDFGDLQFTSNEEGKRNIDSWHSRQRIMSFFGRVNYDFQSKYLVSFVLRKDGYSKLAKDNRWGVFPGISAGWVFGKEKFMESLQQVVSFAKLRASYGLNGNVNKDWVGNYTVQGSYGSNKYNGNTGYLLGSLPIPYLQWERSQTFEVGMDLSFLENRINTNMTYYNRRTEDKYATIPLPSSSGVSGITSNNGKLQNQGLELEFGFKVLEKRDWKWNINLNAAYNINKILELPYNGLERNRQNAMEVYTGRKLDDGSYEKMWVGGYQEGQRPGDIYAYKAEGLYRSESEIPGNLIDKSTGNNSSNNKILYGPEAWAKLTDQEKSKGLPIQPGDVKWKDVNNDGVIDVYDQVKVGNTTPKWTGGFNTTISWKDLTLSARFDYALGFTVIDWKTPWIMGNMQGTYNTISDTKNTWSPENPNAKYPTYTWADQLGKRNYARSSSMFTFNGNYLALRELSLAYRLPSQLIKKAGMNDVSFSITGQNLGYLTEAEHMHSPESSSNNGGYPLPRTIIFGVNVSF

SEQ ID NO: 9539 - protein, 85 aa, B.fragilis
EFSFLPGSAYHDGMYGQKPHYAPAYQIPELKVYYALYKKRLNLSLLPMYSIYPAYESCSHCHSTSEKFYFAISMIDFQSDANEKH

SEQ ID NO: 9540 - protein, 385 aa, B.fragilis
FIMLTQIINGRIFTPQGWLNEGSVLMRDGKILEVTNCDLALIGANLVDARGMYIVPGFVCMHAHGGGGHDFTECTEEAFRTAIAAHMKHGATSFFPTLSSSPFSEIRKAVDICEKLMAEPDSPILGLHVEGPYLNRKMAGEQFANQVKEVDVAEYTSLLESTDCIKRWDASPELPGALDFARYLKSKGIVGAVSHTEAEYDGIKEAYEAGFTHAAHFYNAMPGFHKRREYKYEGTVESVYLTDGMTIELIADGIHLPSTILKLAYKLKGVEHTCLVTDALSYAAAEGKAIDDPRIIIEDGVCKLADRSALAGSIATMDQLVRTMVKADIPLADAIRMASETPARIMGVYDRKGSLQKDKDADILILDRDLNVKAVWAMGQLVKES

SEQ ID NO: 9541 - protein, 398 aa, B.fragilis
IPPLRIRIITKLKIGMQNRRDFLKTAAFAAIGSGLSLQGAFAGEKAPVSFAINQLGLGAKMKLRFFPYELKLKHVFTVATYSRTTTPDVQVEIEYDGVIGYGEASMPPYLGQTVDSVMGFLKKVDLEQFDDPFRLEDILAYVDGLTPGDTAAKAAIDIALHDLVGKLLGAPWYRIWGLDKAKAPSTTFTIGIDTPEVVREKTLEVAGQFNILKVKLGRENDKQMIETIRSVSDLPIAVDANQGWTDKKYALDMILWLKEKGIVMIEQPMPKTQLDDIAWVTQHSPLPVFADESLQRLSDVAGLKGAFTGINIKLMKCTGMREAWKMVTLARALGMKVMVGCMTETSCAVSAAAQFSPAVDFADLDGNLLIANDRFKGMEVVKGKITLNDLPGIGVVKI

SEQ ID NO: 9542 - protein, 451 aa, B.fragilis
TFETYLDMRKLLYIVMIFIGVSACTSRQESKPYDWDDDLHQRLLADFCLTESQVKDYIRKYIPDVTDEQMRQWEESKALECRVIDGEKRYFRNAGPNLFRIDSACCAVKMEKEGTSLSTSEQVNKEHLPEVMAAVRKEKTPVVQPKRMRVTYTLTVDSNAVPAGKMIRCWLPYPRTDQPRQQNVKLLHVSEPRYTLSPPSCRHSTLYMEKQAIPGEPTVFSETFEYTSCAEWHPLKPGNILPYDTAGALYKEYTAERETHIRFTPRIKELAANLTVGETNPLLKAQRIFRWINDHFPWASAREYSTIENIPEYVLDNRHGDCGQVSLLFITLCRCSGIPARFQSGFMMHPRAWNLHDWAEVYFEGAGWVPVDQSFGIPTFADNPEEKMFFMGGIDSWRMIVNSDYSMPLVPEKKYPRSETVDFQRGEVEWEGGNLYFPQWSYHMDIDYLNY

SEQ ID NO: 9543 - protein, 70 aa, B.fragilis
  UNSURE (17): Identity of amino acid sequences at the above locations are unknown.
KLFLLGFPTGREFFTLXLRWGDKDSVGVNEFLSLLPKGVTRVLNTLIFLSSRDADSPKRCVGVVKTRFVR

SEQ ID NO: 9544 - protein, 406 aa, B.fragilis
PPNLSFMKNMIPFVSLLLAVSACTGIPENKKNALPQDVERLSGEVRDRFIPDKRVILWDVDYDVSGKTITVKGATTSPEAKAALLSGLEEKAYEVKDSLQLVPDSAALEGKMYGIVNLSVCNMRVEDDFSSEMTTQALMGMPVKVLQHRNWYRIQTPDNYIAWVHRVGIHPVTKAGLDAWNKADKIVVTSHYGFTYQQPDEKSQSVSDVVAGNRLKYEGKQGGFYKVSYPDGRQAYISQSISMPEKEWRASLKQDASSIIRTAYTMMGIPYLWAGTSSKGVDCSGFVRTVLFMHDIIIPRDASQQAYVGEHIDIAPDFGNVQPGDLIFFGRKATAEKRERVVHVAIYLGDKKFIHSQGDVHVSSFDPADADFDEYNLNRLLYAVRVLPSIDKEETLNTTVTNPYYN

SEQ ID NO: 9545 - protein, 100 aa, B.fragilis; identical to SEQ ID NO: 7713

SEQ ID NO: 9546 - protein, 521 aa, B.fragilis
MNKKNSMKQTTKNILGIGAVVLLSAGVAGVTTYTMLKPENRDSLSFNEQFRQNPGARLAAYDAINAQPVDLTQAAENSLHAVVHIKSTQQAKEQTVTVRDPFAEIFGDIFGNGGRQQRRVQTQPRVGFGSGVIISKDGYIVTNNHVIDGADEIIVKLNDNREFKGRMIGTDPNSDLALVKIEGDDFPTIPVGDSDALKVGEWVLAVGNPFNLTSTVTAGIVSAKARTLGVYGIGGVESFIQTDAAINQGNSGGALVNAKGELVGINAVLSSPTGAYAGYGFAIPTSVMTKVVSDLKQYGTVQRALLGIKGTSLAGDGDMMSDQPIDKSGATLSDKRKEFGVVDGVWVREIVDGGSAAGSDIKVDDVIIGIDGKKVQNFADLQEAIAQHRPGDKVTVKVMRDKKEKNINITLKNEQGTTKIVKDAGMEILGAAFKELPDDLKKQLNLGYGLQVTGVTSGKMADAGVRKGFIILKANDQPMRKVSDLEEVMKAAVKSPNQVLFLTGVFPSGKRGYYAVDLTQE

SEQ ID NO: 9547 - protein, 135 aa, B.fragilis
QNMKYVKILFAVALVFTLCSAFSLKKGGHKPVYAFGVSASFTDTVIYYTEIQMLDSVALDKNGFLPHRELYSYQLKNYLEFDKGLPNRTCMIYFSENKKKLGKEAAKVVGKFKKNKTVAVEKIDPQNFRFSKPEE

SEQ ID NO: 9548 - protein, 230 aa, B.fragilis
NMVKFIESELVLLKKEIDEMWTLVYNQLDRAGEAVLTLDKELAQQVIVRERRVNAFELKIDSDVEDVIALYNPVAIDLRFVLAMLKINTNLERLGDFAEGIARFVVKSEEPVLDEELLKRLRLEEMQKQVLSMLEVAKRALNEESLELATSVFAKDNLLDEINAEATAVLAEYIKEHPESTLSCLNLVGVFRKLERSGDHITNIAEEIVFFIDAKVLKHSGKVEEHYPAK

SEQ ID NO: 9549 - protein, 69 aa, B.fragilis
KRNERRSGKKAGKLFLITAINDLSDTEWALRVGDIKKTHIALIGNGIYFTTDYTDFHGLYHPVLGGRNY

SEQ ID NO: 9550 - protein, 439 aa, B.fragilis
IKKDPTSMKLIYRIIIRIALMLTVVLGAWAVFFYIAVIDEVNDEVDDSLEDYSETIIIRALAGEELPSKNNGSNNQYYLRKVSKEYADEREDICYKDSMVYIVEKEETEPARILTTLFKDDEGQYYELTVSTPTIEKDDLKDAMLGWIIFLYIVLLLTILIVCIWIFHRSMKPLYNLLRWLDAYRIGRPNRPLKNETQITEFRKLNEAAIRNAERSEHIFEQQKQFIGNASHEMQTPLAICRNRLEMLMEDDSLSEAQLEELIKTHQTLEHITKLNKSLLLLSKIDNGQFSDTRTVEFNSMLKRYIEDYKEVYGYREIELTLDEQGIFRAEMNESLAVALITNLLKNAFVHNVDGGHIRIEITGHSMTFRNSGAGRPLDATHIFERFYQGSKKEGSTGLGLAIADSICKLQHLTLRYYFEKDEHCFELRKNNFTTDYAD

SEQ ID NO: 9551 - protein, 394 aa, B.fragilis
FMKLKITLYSVCLLMLLAACQQDGPTPEPSVGSRTVLVYMIAQNSLAPLASADIEEMKEGMRQVDATSGNLLVYIDDYSAPRLIRLGKDKKGKVVEETIENYPEQNSADANVMKKVISTAFNQYKAEKYGMVFWSHGEGWIPSPAKTRWFGQDGNNYMDIADLHAALQVAPDLDFLFFDACFMEAVEVAYALRDCGSYLISSPTEIPGPGAPYQTVVPAMFSAENAALKIASCYYDYYQSRYNDGIGMSNEDWTGGVSVGVAKMSELENLAVATSKVLPRYITGKQNFDLSGVMCYDRRTDKQYYYDLDRFIYQITAGNGDYDSWREAFDKVMVYWKSTPRNYSAYAGMFTMNQDTKGLSTYIPRMSAPSLNTSYQQTEWYKVSGWADTGWYKN

SEQ ID NO: 9552 - protein, 95 aa, B.fragilis
KVLCQNSPQSGTEQSITEFFTTNQQLKIVSVLLCVLCGEYGHTSESPAEKVFGSLIIAKEIEKRVPAINQSVLFLFILVDNNGEKVVKIYTLTNK

SEQ ID NO: 9553 - protein, 301 aa, B.fragilis
QINSRNFALQICFIRMRQLKITKSITNRESASLDKYLQEIGREDLITVEEEVELAQRIRKGDRVALEKLTRANLRFVVSVAKQYQNQGLSLPDLINEGNLGLIKAAEKFDETRGFKFISYAVWWIRQSILQALAEQSRIVRLPLNQVGSLNKISKAFSKFEQENERRPSPEELAGELDIPVDKISDTLKVSGRHISVDAPFVEGEDNSLLDVLVNDDSPMADRSLVNESLAREIDRALSTLTDREKEIIQMFFGIGQQEMTLEEIGDKFGLTRERVRQIKEKAIRRLRQSNRSKLLKSYLG

SEQ ID NO: 9554 - protein, 205 aa, B.fragilis
IKNRTMFSGIVEEYATVVALVKDQENIHFTLKCSFVNELKIDQSISHNGVCLTVVSMTEDTYTVTAMKETLDRSNLRLLKVGDKVNVERSMMMNGRLDGHIVQGHVDQTAECIDIKDADGSWYFTFKYAFDKEMAKRGYITVDKGSVTVNGVSLTVCNPTDDTFQVAIIPYTYEHTNFHTFGKGSVVNLEFDIIGKYISRMIQYK

SEQ ID NO: 9555 - protein, 527 aa, B.fragilis
LHSSFHHFFKVADFAHRLIVGFQDDEALPHTGIRHLARSDSGNLQAVSEIELFLQVVRQLLEGSAQNLHTRILHNLCCTLFVFQCYIDILFFLVTHHLHGHFIARTMLCNGFLQVGKVLHFLAIDTDDDIIYLDIGTGSRTSIYDFAYPNAIHYAELFALIGQCGSRFVDRLIGHHITVTRKRSTLDTQQRTLYGSVLFQVADHFGHHTGRNGKTVSGISACRRRKHGIDTYQFTFCIHQSSTAVSLIDGGICLDERFYSPDAVHTERTCLGTDDTGSYSRGKIERVTYRQYPLSYFQGIRIAHGDGREIVSLDLDQSQIRIRVGTDHATFELAVVIQLNDNFVRTVDHVIIGDDVTVFGNDDTGTEADTRLGLYTALLSAAITEDIPEYLCKRVAYGHSLFFSLLSRFYMYYSMKRIFRRLRQIYRLGINGVISSQASTGILTELFIKRQAVSVLRLQHRIGCHSGNSCTEKNYCSYPENVFCCLFHTILFIHLIVNILLSFNIYDVKITTKIILLFSLSLFFVLF

SEQ ID NO: 9556 - protein, 128 aa, B.fragilis
FADGVGYGKSQSGRTFLFASLIESFKDMGRIQGAACAAIPEGHAMTGYFNPDMPTVYVVYKRIFEQVRYQGYCQRFIHLRPEYSLFIQRQLNFPIAVYFFIIFYISLEHAVELYRSGIGELSVIYFGQ

SEQ ID NO: 9557 - protein, 189 aa, B.fragilis
GGPGSRGEKSMNDFLQLVNARQSDRAYDKSRLVEADKLERILEAGRLAPSACNAQPWRFVVVTDPSLAEKVGKAAAGLGMNKFAKDAPVHILVVEESANITSRLGGKLKGKHFPLIDIGIVAAHMVLAAESEGLGSCILGWFDEKEIKSLTGIPSSKRVLLDILIGYPVKEKRKKIRKESGKIISYNSY

SEQ ID NO: 9558 - protein, 125 aa, B.fragilis
TLKGAALWDEVKDKLKESAFALSGGQQQRLCIARAMAVSPSVLLMDEPASALDPISTAKVEELIHELKERYTIVIVTHNMQQAARVSDKTAFFYMGQMVEFGDTKKIFTNPEKEATQNYITGRFG

SEQ ID NO: 9559 - protein, 451 aa, B.fragilis
LLFFFLISNTRPMNQRLSDIWKFITYDIWRITESEVTRTKFSIYNIIKTIYLCVNRFNKDRIVNKASALTYSTLLAIVPILAIVFAIARGFGVSTLMESQFRDGFGGSTEATDIILQFVDSYLSQTKNGIFIGVGLVMLLWTVLNLVSNIEITFNRIWQVKKGRSMYRKITDYFSMFLLMPILIVVSGGLSIFVGTMLKSMADFVLLAPILKFLIRLIPFVLTWLMFTGLYIFMPNTKVKFKHALISGILAGSAYQAFQFLYISSQLWVSKYNAIYGSFAALPMFLLWLQISWTICLFGAELTYAGQNIRNFSFDRDTQNISRRYRDFISILIMSLIAKRFENNETPYTAEEISEEHRIPIRLTNQILYQLQEIHLIHEVVTDQKSEDIAYQPSIDINQLNVALLLDRLDTYGSEDFKVDKDEEFSEQWKVLLDSREEYYKKASKVLLKDL

SEQ ID NO: 9560 - protein, 157 aa, B.fragilis
LLKIKTNKKKTIMKKLLLLFVCLFTLQTIARADDDKPIQVSQMPQKAQQFIKQHFAGSNIAMAKVESDFLQKSYDVIFTDGNKVEFDKKGNWTEVNCKFSVVPQGIIPSPIQKYTATNYPDAKVLKIERDKTDYEVKLSNGWELKFDSKFNLIDIDN

SEQ ID NO: 9561 - protein, 283 aa, B.fragilis
KSIVDMKLKMYFLLLALGALGLQSCNDDDDHLSSVPTELKNAFTEKYPSVSNEKWETKGNYYIAEFRQQNYETSAWFTPNGIWQMTETDLPYQALPAAVKSAFESSEYAKWKVDDVDMLERPDMEKVYVIEVESGKQEFDLYYSEEGILVKSVADTDNDSENYLPAEIPAAIETFIKKQYPNARLVEIEVEHGMTEVDIIDGNISKEIVFNSSNEWISTSWDVRRNELPETVTHAIASSEKYAGYQIDDADFVETPGGEYYLVELEKGELEVKVKVNAEGEFI

SEQ ID NO: 9562 - protein, 236 aa, B.fragilis
AFSLQVEIKSPMKILIIEDEPSLRELIQRSLEKERYVVEAAADFQSGLRKIEDYDYDCVLLDIMLPDGNGLNLLEQLKKMRKRENVIIISAKDSLDDKVLGLELGADDYLPKPFHLAELNARIKSVIRRQRRDGEMDIRLANIRIVPDTFQVFVDDKEIELNRKEYDILLYFANRPGRLVNKNTLAESVWGDHIDQVDNFDFIYAQIKNLRKKLKDAGALAELKAVYGFGYKMTVE

SEQ ID NO: 9563 - protein, 94 aa, B.fragilis; identical to SEQ ID NO: 9407

SEQ ID NO: 9564 - protein, 385 aa, B.fragilis
DAYFLLIIIELNMKKIAIVTASFAPISTPRANRATELAKEFAKQGCLVTVYNCTSVVDGTFNINENIRVVDLNIRKASIMKSSTKNNVTYTILDKGIILIRKLVYYFFLGSWLLYLFGLKKKLRFDDKYDLLISIGLPFTIHWGVSLRIHGHNIARCYVADYGDPFSRGNDNLKCAKYFQWIEKKVIDKFDYITIPTYNAIDSYTWLKSSDCIKVIPQGFNFSEVKTLDYVPNKIPTFIYAGIFYSDIRNPKNLFDILLKLDFDFCFIIYTVKGLQDSYSCIKPYIDKLGSKLVIYDSIPRLALIEKLSVADFLINMSNTSANQIPSKLIDYALSHRPIYSCTPNSIDLDKLISFCKGDYTGSENINLRDYDITTIVNSFFSLMQ

SEQ ID NO: 9565 - protein, 431 aa, B.fragilis; identical to SEQ ID NO: 6067

SEQ ID NO: 9566 - protein, 208 aa, B.fragilis
  UNSURE (186),(201),(203),(207): Identity of amino acid sequences at the above locations are unknown.
YDMAKIQIKSEKLTPFGGIFSIMEKFDSMLSPVIDSTLGQRCSSIFGYQFSEIVRSLMSVYFCGGSCVEDVTSQLMRHLSYHPTLRTCSSDTILRAIKELTQENISYTSDQGKTYDFNTADKLNTLLINALVSTGELKEIEEYDVDFDHQFLETEKYDAKPTYKKFLGYRPGVYVIGDKIGLHNGXGSISIVRIQGAIVPXPXRAPXP

SEQ ID NO: 9567 - protein, 91 aa, B.fragilis
RHNFFSFFTNVTTTFHSCFVDQHCKDEDLQIIGKGKNGPESSFLRKTYNTLIICIIILSSSFKTGAYTCTQYQLSFSSSDKCIVPIQKVSQ

SEQ ID NO: 9568 - protein, 317 aa, B.fragilis
VMYYLIILVLLFLAELFYFRIADKCNIIDKPNERSSHTRITLRGGGIIFFFGALAYFLTNQFEYPWFMLALTLITFISFVDDIRSTSQGLRLVFHFTAMALMFYQWGLFSLPWWTIVVALIVCTGIINAYNFMDGINGITGGYSLVVLAALAFINGVYVPFVEPALIYTMLCAVLVFNFFNFRKQAKCFAGDVGSVSIAFVILFLIGMLIIRTENFSWIVLLAVYGVDSVLTIIHRLMLHENIGLPHRKHLYQIMANELKIPHMVVSLVYMLVQAVVIAGYLLFPGNEYGYLSGTIIALSLVYILFMKRFFCLHQAK

SEQ ID NO: 9569 - protein, 253 aa, B.fragilis
KMSLEVLKISFIVVEYHSIEDIITCYSSIIGIIPSNWQCEVIVSSNSVYPLKQQEELKTLYKDIKWRFNEKNGGFAYAMNQGLSIADGDILVIMNPDVRLKTGIEKMVTYLYSHNEIGVIAPKIININGKIQDSFRDFITPMNFIKRHLSRIFKSTNQIGIIEVISQVDWVIGAFMMMPRQAYEVVKGLDEYYFLYCEDMDFCKRIQLEGFSVVYYPESEIEYEGTRSARRSLKYACIFFKSLLRYWTKFGFN

SEQ ID NO: 9570 - protein, 91 aa, B.fragilis
HVGYKFCVNSIDALSLNKGKLERDLTNRSDVYMPLESIMFAGYNAYVFIGDELKSATFKDTEHQVCRSIRKVENRTGERFKLSERGGQLPR

SEQ ID NO: 9571 - protein, 72 aa, B.fragilis; identical to SEQ ID NO: 9416

SEQ ID NO: 9572 - protein, 83 aa, B.fragilis; identical to SEQ ID NO: 6082

SEQ ID NO: 9573 - protein, 83 aa, B.fragilis; identical to SEQ ID NO: 6082

SEQ ID NO: 9574 - protein, 129 aa, B.fragilis
DPLNSPSVSIIAFPIIGCSKNIFIPSSYIRSLPEDVSKALPSSKRVIVRSIKGLLKYSLKNKSILSKFSNSTMKQKAVVKIILKFSFKQRYNAKMANNATKGLLEFANPIDTNPKMIGMEKSHFHLFLL

SEQ ID NO: 9575 - protein, 350 aa, B.fragilis
NMIDFKIKISDRLKYPVFCTILAVFAFDLRTFFGAFLPISLITSVVLIIFIYCFCLLFLSSHRILPIKIRNMDILLIIFFFIYGVRMYYNIFVEQLYQLLFVNRFTCIVYYMFICILPYVICRRIPWNIINFRKVLWTLWWLFVLGLVLALKSVLSILASGDSFFNGRADANTYLDTIGYGHTGLSLVLICFSLISFYKRNKWKWLFSIPIILGLVSMGLANSRSPFVALFAILALYLCLKLNFKIILTTAFCFIVLLLNLDSIDLFFKEYFNSPFIERTMTLFELGSALETSSGRDLIYEDGIKMFLEHPIIGKAIILTDGEFRGSYVHNIFLEVFMGLGLVGGGLFLP

SEQ ID NO: 9576 - protein, 63 aa, B.fragilis; identical to SEQ ID NO: 9425

SEQ ID NO: 9577 - protein, 69 aa, B.fragilis
SLLRLRIRSTRFAGPYEKLKTAPENVSNYLKEAVNYLDKFGNEIFAYLKDGNYPIDKNSAERSIRKLIT

SEQ ID NO: 9578 - protein, 470 aa, B.fragilis
VNKLLKNWSYLLLSDISQSVINFFVFMLLARKLTPVGYGEFNVILAIVAIFSVVATNLGANHVITREVTLHPDNTKGICYNVIPLRLIALAIAFLGVFVYIVCGKDVSFSSSFYIFILIFATSVWDFAESVAFGRLVTKYTTFFNLSFSCSWLLFVLFLPESYFSIEVVLVIYSLLFVCKSIGYLGRSCEKFVKTTLPVISLTKRSLFMMSLPYLWMRVFGIFGEQIPILILNNKCGTDQVGYFSVGFRLIIPITIAINTGLRAVFPFMTRAYTEDPKLFSEKLIKVFTFVMIWGTLVAGILVLFSEYWIPFFLGKSYLNSIDAFNYLAWFGVGMCFDLLLSTLLSSTYKQKILAAITTIDFFIVIAFLYWGAQYGAIGLALAKLLSMLFILGYHIIVVCKVFNMSIRNRNFIISLVVYLFAMSVTLFISLFILKLLLFILPFLVVGFIPNNPIRQCIVGVRSLIYKNKI

SEQ ID NO: 9579 - protein, 171 aa, B.fragilis
MKRSSNISKEGEKIMPLFYRARQSQLKTKEGKKQWHLTLVKVGKMVTSQQLAEVIAEKSSLTPGDVHNVIRNLMTAMRKELLNSRSVRLEGLGTFTMKACTQGHGVDQEEEVSPNQVAALRCLFTPEYTRPAAIGTTRALLQGVEFQKVSAIGGAINGGSGSGDIVDDPTA

SEQ ID NO: 9580 - protein, 62 aa, B.fragilis
RSIGLARMSQKGMAEKSGVSLATISHFEQGVNQNMTLNNFISLLRIIGMEQRINDCLSCPCH

SEQ ID NO: 9581 - protein, 80 aa, B.fragilis
LTFIFLIVFNPLFKLIPIVISYSNSCNIHILFLYINERTPTIHCLIGLFGINPTTKKGNINSSNLRMNNEINKVTDIANK

SEQ ID NO: 9582 - protein, 60 aa, B.fragilis
IKIIRTTDVIRLIGRKAPKKVLKSKAKTANIVQNTGYFNLSEILILKSIIFQYIMIYIIN

SEQ ID NO: 9583 - protein, 305 aa, B.fragilis
NMNIAAITITYNDGYKFKEWVEHYQEYKSELYLHIIVDNGSEDEYMAQLKSTFTDSIIIERGKNGGCTHAYNDGIRYALNDKHVDAIMLIGNDIKLSVHGVKGLYDFLMSNAEYGMVEPILLAKDSDIVEDFGNEISRYLQMKPFAVGQNIGNLTGDEVRTVFTVTGGMNLAKREFYEIVGLQDDLLFMYSDEVDMGIRAKHCGFTMAVTKNIQAWHQHINPGGTVRRQMYTSYLIGRNKVYLANKHFGRLRQVELFLYHFFLFIGGYLKNIRNREAQAHLIQFIKGSWNGLIGKMSLVGIIKGY

SEQ ID NO: 9584 - protein, 87 aa, B.fragilis
GSILKYLSLLPNQNYIPMFSSGDMSEDRKSRYISYLVDYVNETELDKKALELVLEDFLSAWNDMKAELAELQRRQDEMVFQTTGVSL

SEQ ID NO: 9585 - protein, 77 aa, B.fragilis
RNSMLYFGSDEGVEMVATYHSLISTVKMQGRFVWEFLSKFFTNIFNGCRDYLNLSPKISDWTMAIVNKSLNLLTKQF

SEQ ID NO: 9586 - protein, 327 aa, B.fragilis
LKGIEYMDIVKDYKKVIEITLGEVVASPDFFVSVGAIDYGYIIDNGCILPFYIKKKFLFRYMIFSTGILNCSSSEQEQVFLDRLIPFVKESFKIDFILSQHVNALFSIVPPRSQYCLFGSYILDLSLTEDDIWAKMHSKHRNVIRKAEKDGVIITCGDDNKEECIKLVQNTLLRQGIAPINDNVFSNLGNVKYVDYWLATLNNGIEGGAIIYWHPNCGAYYMYGGSGEKPHTGSMNLLQWNVIKKMKENNVKFYDFMGARMNPEVGSKYEGIQRFKERFGGELKKGYLWKYSLNDFKYWLYRLLVFIYSKGHFHGDIIDQERKRGNI

SEQ ID NO: 9587 - protein, 338 aa, B.fragilis
WNLMNILITGAYGFVGTNLINNLKIKHNLYGLDIVCPTREGVLKTFYWKDINPESFSLQNLPKFDAIIHLAGKAHDTKNQSAAQSYFDINTSLTQKIFDFFLESSAKKFIFFSSVKAAADSVVGDMLTEDVIPAPVGPYGESKIRAEEYIKEHFAFPAVSPCECSPFREMTSVTEKQVYILRPCMIHGPGNKGNLNLLYNVVKKGIPWPLGDFENRRSFTSIDNLCYVIEGLLTKEVPTGIYHMGDDEALSTNELIAIMCEAMGKQPHIWKMNKGFMEGCAGLGTLLHLPLNTERLRKLTENYVVSNAKIKAALGIDKMPVTAKEGLIKTIRSFEETK

SEQ ID NO: 9588 - protein, 69 aa, B.fragilis
GHTVDGVCSSSTHRTDDIEGKIDRHAYRPTDMRGVLIKYYDITVGCSLVIEGPAEVALHWMTGRRTREF

SEQ ID NO: 9589 - protein, 345 aa, B.fragilis
YMTVKKCVLTLDYELFFDKSGTPQVSMLNPTDLLLNVLEETSSKATFFIDTIYLNKLRNSNDIKNKILFDNIVNQLKRIVKQGSRIELHLHPHWIDAYQNGDQWVFPSYAHYKLGSLSDETVECLFKEGILLLNEIAQSVDRDYRIMAFRAGGWCVEPFTKLRNLFVANNILIDSSVVSGMKFSGEVHNIDYSSILPNTHYYFSDSVYEQNSTGVFLEIPINGYQLSALNKIVWKMKSILAGEKAKIYGDGVGMQSVEHQTILNKILKLFVGQGQYVQYSLDGYIDSDNLNNAINNSKLSFISLVAHPKTLTKSSLDAIKYLTNVGCSFVSIDNIYHDILKYDRF

SEQ ID NO: 9590 - protein, 238 aa, B.fragilis
MISVCIATYNGSKYIKEQIDSILPQLDECDEIIVSDDSSTDNTLSILKSYHDRRIIIFTNQKFNSPIYNFENALKHAKGDIIFLSDQDDIWEFNKVQVMISFLQKKSLVVSDCYIINQDKNVICDSLFNGKVPNAGVFINILRNHYIGCCMAFRREILNAALPFPSSLAMHDIWLGLCASAFYSAVFIPNRLIKYRRHNTNASPTLENSNLPLLYRVQYRWTLIIALVRRALKISKHL

SEQ ID NO: 9591 - protein, 267 aa, B.fragilis
YSLTMKSSMAMIKHKKELVEYARHLKLPNLAEHVGVILHEAQEKQLTYSEFLANCLAREIQGRERKSYLTRLKLSGLPAKYDLDLYDYDRAEGMDNRRLRELRELVWVNQAYNLLLVGPSGTGKTFIAAGLVYEAVKAGYEAYLMTLEELLTCLKTKEVSAHAMKTYKRIMKARLLAIDDATLFPLKREEAVLLFKLVNDFQERTSLIITANKALTRWLETLEDEAVTAALLDRLLYCCEIIRLGGTSYRMQNRKTIFSNQNTDIGT

SEQ ID NO: 9592 - protein, 333 aa, B.fragilis
RPDTGMETKSQNLKDKLYMWYKVRELQSKGLSKTQIGKYLGVDRSTVRRYLRTSREEFFRKQNSHREYELKLGKYEEYVRGTLEEYPYISAARMHDWLRECYPDFPRVCDKTVFNFVDRIRRKYGIGKKSEARIRRDYEKLPETPYGEYAQADFGEKWIPVKNGGSTKVYFFAIVLTRSRYKFIHFSRRPFDTELAIYAHELAFQYFGGRPEKIIYDQDRVLIARENLGDLILTGKFQSFIKEQHFQPVFCRRSDPESKGKVENVVKYVKENFLVARVLQDIPGLNEEARKWLERTGNGKVHGTTRLVPSEEFAVEKGYLNLIMVYPSHHRSR

SEQ ID NO: 9593 - protein, 592 aa, B.fragilis
KSGAQICAPHPISKLLRLVMLLAVVLLLSSCRQDDDSYSSHPGPTTLVSLSVSASNSGAVAASDDPASSIRDLCILQFNVNGTGFGNLRHVAKGSPASAGTFNATLLQSVNPDDKYKLVLLANLPDYGFLNSLSGKSYDQVQKTLLSEELSGRNNIPSFDGSRPFQMFGVANSGNSIEITENMSLSDVSLIRGVARVDIGIGIKNADDTWNKNGVKFNMTQIQIWKAGKQYAYMPSENNFSSTGRVDGVTITGPSPVGTTETKVYDITHIINNTYCCGKIYLPEADLNWGDVYDASHTDRLAVIVGGKYNGSQTETFYRVDFKNDVSGEKMDILRNHVYRFTVTKVTDDGYDTAELAYKSIPKDISFTAELTPWTFPPAVSVPSIIGYRMVYQNTNGGMLLWNTATGLTIPKKRDTWKGTKMNFNYNGFYDETNNAYAITYPIEPRNGSLYHTIEVAFDYEGVYPSLMVSADDVTDVTGGDTNPWKTGKTLTAFDICRNYEGDGFGDWRLPRLSELALLYLNRGSLEAMRGFAPLSGTYWSGSEYLVSDSKVDKRHSEQAWGINFDATNPGNAAPYDKTTKKFKIRCVRQTQ

SEQ ID NO: 9594 - protein, 64 aa, B.fragilis
QPKHGYRHVKRVKESEASSMLEWDILNYLKKWRTNLRATPYIEVTSVGNAPCGGAVIVFLPSGR

SEQ ID NO: 9595 - protein, 214 aa, B.fragilis
GVRCGKRIPEPYYGLPEPPQEQMKEYHVRKDNTVQYRGNYYSLPCGTYRSGQTRVWLQETEGYVELYSKETGKIVARHPLCTRKGKTIYDERHRRPKSIGAQKLAERILVYVSGNREVALWMENLKRKKERYYKDNLEVVLHMMPGYDKDILIEAVHICLDKGIYNGDSVKSLCEHVHRRRNKETETDRTDSCPPRQTGLIQSYNEIFHGYDKT

SEQ ID NO: 9596 - protein, 123 aa, B.fragilis
  UNSURE (122),(123): Identity of amino acid sequences at the above locations are unknown.
NPVCTTNAVNEKISYTINMDTQKKHNLSGTIILVSCFLLLAGACDNSDRIETETQANGVLLNFNASTIDATTTETRSFVPIEGFAKNEYIFGMSVTKDNASRGEIFEGCSMVVSGGRSRGQXX

SEQ ID NO: 9597 - protein, 72 aa, B.fragilis
YVPFFFHKPYGDIGSSDGGKATKNLRNDQGIASVCKQGPLLYHKDGIRIPYKGDFKNNPHTLLLQQEMIREN

SEQ ID NO: 9598 - protein, 752 aa, B.fragilis
YPHPMTIEEIKNQVLQGTAISREQAGWLALYPRKEELYDAAHEITTACASQEFDMCSIINARSGRCPENCKWCAQSSHYKTKADVYDLVSAEECLRQAKYNEAQGVNRFSLVTSGRKPSPKNMKELCVAVRRMRRHSSIRLCASLGLLDEEELQALYDAGVTRYHCNLETAPSHFDSLCTTHTQEQKLKTLYAARRVGMDLCCGGIIGMGETVEQRIEFAFTLRDLNIQSIPINLLQPIPGTPLEHQSPLSEEEILTTVALFRFINPAAYLRFAGGRSQLTPEAVRKSLYIGINSAIVGDLLTTLGSKVSDDKEMILSEGYHFADSQFDREHLWHPYTSTSNPLPVYKVKRADGATITLESGQTLIEGMSSWWCAVHGYNHPILNQAVQDQLSRMSHVMFGGLTHDPAIELGKLLLPLVPPSMQKIFYADSGSVAVEVALKMAVQYWYAAGKPEKNNFVTIRNGYHGDTWNAMSVCDPVTGMHSIFGSALPIRHFLPAPSSRFGDEWNPEDIRPLEHLLEKHTDELAAFILEPIVQGAGGMRFYHPEYLREAARLCHRYGVLLIFDEIATGFGRTGKLFAWEHAGVEPDIMCIGKALTGGYMTLSAVLTTNEVADCISNHAPGAFMHGPTFMGNPLACAVACASVRLLLTSGWQENVKRIEAQLNRELAPARELPQVADVRVLGAIGVIEMKEPVNMAYLQRRFVEEGIWLRPFGKLIYVMPPFIITPEQLTKLTEGMIRIISNGLPGSQTK

SEQ ID NO: 9599 - protein, 489 aa, B.fragilis
KTKPTVTMKRKIIYFLLALAVVMPASAQKFFKDAISLSDVSLWQQGNSLYVDMKIDMKNLTVSPERMLTLTPLLTDGQHNVALEEIIINGKRRQKAYLRGLAISRELPAGIVIPYNKREVLNYAQVIPYEPWMANASLNLVENLCGCGNNEEMLAQELITNDVSTEAKRLSAMIPVVAYIQPTVEVVKNRSEQYEAHLDFPVSKAVIQPEFMNNHKELMNIHAMFDKIQNDKNLTVTGISIEGFASPEGPLKFNEQLSQKRAEALKNYLTTNEKVPGKLYKVTFGGENWDGLVQALEKSSMKDKDKFIGIIKNTTDDARRKQEIMRVDGGAPYRTMLKEIYPGLRKVNCKIDYTVANFDVEQGRVVIKVNPKYLSLNEMYQVANSYPKGSNDFVNVFDIAVRMYPNDEVANLNAAAVSLTKKDLENAIKYMDKANHQTAEFINNVGVYNFLNGDVQRAIAAFNQAAQMGNEAAKANLQQLQQILNMKKK

SEQ ID NO: 9600 - protein, 190 aa, B.fragilis
ITVPAIPRTLSGKCLFPYRPPNWKTNLGRRSKCRLVKNRLPKCLTRTKSMDYSCKGQFGNGLYSKLWQVYSRRVLRQGRKPFVYETSQGLRGIDAAQAMTPNYVTWGGWTLRQNYLDHINNSMKLHQQQCIYSLESDAQPGVVSVAITDAIDLQKTYVHYNCGIRYGHDSARTDLKMSKMVWIDFRQWDN

SEQ ID NO: 9601 - protein, 140 aa, B.fragilis
LIYTLWTFWHALCFLFSIKVVLIIHTKKITIMKKVLVALAMIMGLGTSVAFASVSGDTLAVEQTLQTPQDEFTQIAAKELPAAVINALAKDYEGASIKEAFVSERETGKVYKVIVTVIKEDQSTEDVTVLLNEKGEIVKE

SEQ ID NO: 9602 - protein, 454 aa, B.fragilis
KKYTIMRYDIAIIGGGPAGYTAAERAGANGLRAVLFEKKAMGGVCLNEGCIPTKALLYSAKVLDGIKSAPKYGVSVEGAPAFDMEKIIGRKNKTVQKLTGGVRMTVNSYGVTIVDKEAVIEGEGEEGFHIRCDGEVYEATYLLVCTGSDTVIPPIKGLSDVDYWTSREALDSTVLPSSLAIIGGGVIGMEFASFFNSMGVRVKVIEMMPEILGAMDKETSAMLRADYTKKGVNFYLNTKVTEVSDKGVTVEKDGKSSFIDADRILVSVGRKANITQVGLDKLNIELHRNGVVVDEHMLTSHPRVYACGDITGFSLLAHTAIREAEVAINHILGIDDRMDYDCVPGVVYTNPELAGVGKTEEELIAKGIYYRIQKLPMVYSGRFVAENELGNGLCKLIIDHNDRIVGCHMLGNPASEIIVVAGIAIQRGYTVDEFRKSVFPHPTVGEIYHETLFA

SEQ ID NO: 9603 - protein, 140 aa, B.fragilis
PDITIRLMKKERYISHSFIRFRQWSRKAYAIFATLGLCVTIGQLRKNITECALCKQQTPHTTGLDPQRETEDSVPEEDWENLTLSPEPLLLLLTQLQSSKYSYAGAAQSTVVTSASHITPKEVASHPDGTGNLFFNIPTL

SEQ ID NO: 9604 - protein, 60 aa, B.fragilis
PGRTGSENALGRRNPDATTQRLKFTTKGTEGVIVHHCVHGLARYIFNLLIAYDIYLYNLW

SEQ ID NO: 9605 - protein, 129 aa, B.fragilis
TFGTDAVPDTSAAFGADAVSTEPAVSDASPEPSPSISTMATTVPTGTVSPSLNNISTTFPATGEGISALTLAVFTSKSTSSSLTTSPTCTDHDKMVPSVILSPNLGIFISNLAIYTIIYSFTCTSRTRL

SEQ ID NO: 9606 - protein, 1043 aa, B.fragilis
GMKTNLRLLFTLLFVVSVVALRAGTMNDIRVSGTVVSEGDPLPGVSVLVKGTGVGTITGIDGKYSINVPSDGTLVFSFIGLKSVEHKVGGRSVINVELVPDSKQLEEVMVVAYATAKKYSFTGAASTVKGDEIAKLQTSSVSRALEGTVAGLQASAASGQPGTDATIRIRGIGSINASSAPLYVVDGVPYDGSVNSINPEDIASMTVLKDAASAALYGSRGANGVIIITTKQGQSDSKTTVNVKASFGGSNRAVRDYDRIGTDQYFELYWEALRNQYALDTKNYTPQTAAIKASKDLVGKLMGAGPNPYGSKYPQPVGTDGKLADGAVPLWNFDWQDAMEQQALRTELGLNVSGGGKTNQYYFSAGYLNDKGIALESGYERFNLRSNVTSQMTKWLRGGVNMSFAHSLQNYPVSSDTKTSNVINAGRLMNGFYPIYQMNEDGTYKLDSEGQRIYDFGSYRPSGSMANWNLPATLPNDKSERMKDEFSGRTFLEVTFIEGLKFKTSFNFDLINYNSLDYTNPKIGPAVNTGGSSSRENDRTFSWTWNNILTYDKTLGEHHFNLLAGQEAYSYRYDVLRASRSNMALPDFPELAVGSLVTGGTGYRVDYSLVGYFLNAQYDYQSKYFFSGSYRRDGSSRFAPETRWGNFWSVGASWRIDREDFMVAASDWLSALTLKVSYGAQGNDNLGTYYASSGLYSVVSNNGENALVSDRLATPKLKWETNLNFNAGIDFSLFNNRFSGSFDFFQRRSKDLLYSRPLAPSLGYNSVDENVGELKNTGVEIDLKGTLIHTRDFMWRLGLNLTHYKNVVTDLPLKDMPVSGVHKLAVGRSVYDFYMKQWAGVDPENGDPLWYKNVKDANDKITGRTTTNDYAQADYYYTGKSSLPKVYGGFNTAFSYKGFELSTIFAYSIGNYIVDRDVTMLWHNGSSTGRAWSTEILNRWTPENRYTDVPALKTVSNSWNANSTRNLFNNSFLRMKNITLSYNFPQPMIKKISLNSLQLFVQADNLLTVSKNQGLDPEQDISGLTYYRYPAMRSISGGINVSF

SEQ ID NO: 9607 - protein, 200 aa, B.fragilis
YDMAKIQIKSEKLTPFGGIFSIMEKFDSMLSPVIDSTLGQRCSSIFGYQFSEIVRSLMSVYFCGGSCVEDVTSQLMRHLSYHPTLRTCSSDTILRAIKELTQENISYTSDQGKTYDFNTADKLNTLLINALVSTGELKEIEEYDVDFDHQFLETEKYDAKPTYKKFLGYRPGVYVIGDKIVYIENSDGNTNVPFHQADTH

SEQ ID NO: 9608 - protein, 74 aa, B.fragilis
RIHFSNMKKLLCPQCKIAGMYVKNDQGERLLVYIAQDGTVVPKYPEIPIEGFDFTEVYCLGCSWHGSPKQLTRF

SEQ ID NO: 9609 - protein, 73 aa, B.fragilis
KRNLKFDPVIPQSSTGLTVMSFVCYSMAGLCVLKYELYCCPSVFLLMVYEGESVLFCFPADSRNIIDIESAHK

SEQ ID NO: 9610 - protein, 522 aa, B.fragilis
SDRYNSTIYNSVQYLDATVYRYWTLDDCFPLEYFLILLRHKFSIRKRLNIGHSLAGSYKNKYLYHELKKGSESKGDAMNTGTILIVDDNKGVLASLELLLENYFSKILTASNPNQITALLTTRRIDVVILDMNFSAGINNGNEGLYWLGHIRQMAPTLPVVMLTAYGDVELAVKALKNGAADFLLKPWDNQTLIDKVTEAYHSRKAPERTAKVDRAEGFEMLVGRSPAMLQLMKVVSKVARTDANILITGENGTGKEILAREIHRLSPRGARPMLNVDMGAISESLFESELFGHERGAFTDAHESRPGKFEAANGSSLFMDELGNLPLPLQTKLLTVLQSRNVTRLGSNKVIPVDIRLISATNKDIPEMVKQGMFREDLFYRINTIHLELPPLRERGDDILLFIDCFLRKFTSKYQRQEIRIHEQTVEKLRSYHWPGNIRELQHTIEKAVILCEGSVIRPKDILVKQTWQPQATATVPNLEEVERRAIETAILQNNGNLTAAAEQLGVSRQTLYNKLKRFKL

SEQ ID NO: 9611 - protein, 459 aa, B.fragilis
IIVYMARFEIKMPKLGESITEGTILSWSVQVGDVVNEDDVLFEVNTAKVSAEIPSPVAGKVVEILFKEGDTVPVGTVVAIVDMDGEGSGEASETAGSVETASAPKAAEVSGTASVPKVQAEVTAPKVERWYSPAVLQLAREAKISQEELDSIPGTGYEGRLSKKDIRTYIEMKKGAPAADVSTTVVSTVSANNSGSSPVPSAEVQKKAAATAPQAQHGQSASAVSSDASVEVKEMDRVRRIIADHMVMSKKVSPHVTNVVEVDVTRLVRWREKTKDDFFRREGVKLTYMPAIAEATAQALAAYPQVNVSVDGYNILYKKHINVGIAVSQDDGNLIVPVVHDADRLNLNGLAVAIDSLAKKARVNKLMPDDIDGGTFTITNFGTFKMLFGTPIINQPQVAILGVGVIEKKPAVVETPEGDVIAIRHKMYLSLSYDHRVVDGSLGGNFLHFIADYLENWKE

SEQ ID NO: 9612 - protein, 68 aa, B.fragilis
HGPQQQFGNYGLSFLCNMSFYSELFAGTPLAFDRRQQDILVSLLLKGYQWIVWRGNWDVTGLNRKLFP

SEQ ID NO: 9613 - protein, 289 aa, B.fragilis
IVLLQIKTPMKYFEFTFDTHPCTETVNDVLAAVLGEAGFESFVEREGGLTAYIQQSLYNEETLKTELANFPVPDTEISYTFAEAEDKDWNEEWEKNFFQPIVIGDRCVIHSTFHQDVPKAEYDILINPQMAFGTGHHETTSLIIGELLDSELTGKSLLDMGCGTSILAILARMRGAKPCTAIDIDEWCVRNSIENIELNGVTDIAVSQGDASALQGKGPFDVVIANINRNILLNDMKQYVACMHPGSELFMSGFYIDDIPAIRREAEKHGLTFVHHQEKNRWAAVKFVL

SEQ ID NO: 9614 - protein, 83 aa, B.fragilis; identical to SEQ ID NO: 6082

SEQ ID NO: 9615 - protein, 405 aa, B.fragilis
IKLKNITNMNKNQETERGELTRFLDELQLLKKKDNFRTLPTLVHQGKEVIIGGQRMLNLSSNDYLGLANDSGLLKAFWQTVKPEEIKFSSSSSRLLTGNFAAYDELEATLSSLFGTEAALVFNCGYHANTGILPAVCDTKTLILADKLIHASLIDGIRLSDAKCIRYRHNEYSQLERLVETYHKEYEQIIIVTESIFSMDGDEADLPRLVKLKRKYPNVLLYLDEAHAVGVRGTGGLGCAEAYGCISDIDFLVGTFGKALASSGAYIVCRQVIRDYLINKMRPFIFTTALPPVTLQWTSFVLRHLAEYQEKREHLAAISSNLRTGLQEKGYFSASASQIVPMIAGESSSAVRMAEELQRKGFYALPVRPPTVPEGTSRIRFSLTADVTEKEVKRVIATIRPVSSK

SEQ ID NO: 9616 - protein, 563 aa, B.fragilis
SPEKGCCNHMLRSGLIMHKSHITDIVKYKITDDMRTIRFNNNRHISSSPLLRTEGGREVSVSNTSGDKIPKGKFSFLLLFFLLFLGSCSSDFLDNKPTDAVDSGLVPVPSNAERIFNGAWYNLFEYGTTYANIGYRALMCLDDMMADDVVSRPMYGFNSSYQFNDVVMPSDGRTTFAWYLMYKTIDNCNTAISIQATGDDDTPEFRHAQGQALAVRAFCYLHLAQHYQFTYLKDKNALCVPLYTEPTNPNTKPKGKATLEEIYTQIINDLNRAKGLLDGYVRPNDKSKYKPNTDVVNGLLARTYLLTGQWDEAAKAALEAAKGYTLMTDAKNYMGFNDISNTEWIWGHPQSVSQSDASYNFYYLDVVEPDSYNSFMADPHFKDTFTEGDIRLELFQWMREGYLGYRKFRIRSDQTGDIVIMRSAEMYLIAAEALARKGQLGEAVKPLNTLRNARGLADYDLTGKNQEQVIDEILMERRREFWGEGFGITDVLRTQRPVVRVALTEDEAAKEYDCWQQNGTYKKYHPEGHWFTSFPDGTKFVPNSIYYLYSIPEKETNANPNLK

SEQ ID NO: 9617 - protein, 555 aa, B.fragilis
TYMNMKTLFIFLFVLLAFYSCDTDEPISAEDLSAATGTNTDEVDVASRSGSYLIWLNGMSAETKKVADQLQTVNHYDKMVAFNDLPGTDKVETLETMAKDSLNDLTIVGSVADFIAGTYSPEMIQDIRHNRQGVILIAKDGKAQDLKAQMLKLFGLYVDKGYYKVSFPREQRYAYYDANDPDALKKLCGTGGLNPHTRSMLGSPGPTDDPSAPEVTERALHAMKKIYISNRYYVYTSDYKYHMTGYETLLPYTADIKEYLPRDDKKYDGMVDREWTIDAYNLRIYAPTNGDNMLAVYSSGGNGFSNRLDHSLVSLNNAPMYELWALIWGLRNNAYTKINIRDDQSSQLNLKLIDFAPGLPETESTIEHAYEKSVGFDLGATPVLKGEYRWGKSITYQLAEMTREVTRTITDAEMSYCWKWYPETLFRGSKAMNAEGMIDAVTMISPAWYDILYDHVAGTPGTDNPFCDYDNDLQFNQNLLNYEQQCAITARTTGASAGVVAIEITDGMVLQRGGAWFTSWGAAVIHSLPSSAGTAYNTTVDVHKTTTVWIDYNNW

SEQ ID NO: 9618 - protein, 152 aa, B.fragilis
CIMNNSILINNVQIFDGSSEQTGRGNVLVVNSRIKTVSESPIPTDGIPNVTILDGKGKFLMPGLIDAHWHAYMSCNTMMDLLTADTAYTQFKAGQEARATLLRGFTTIRDAGGPVFGLKRAIDEGILSGPRIYPSGSLISQTGGAWRFPGGI

SEQ ID NO: 9619 - protein, 441 aa, B.fragilis
INMKHFISFCTFLLFSTLLFAQAERSLDECIRIAWKQNPSLRNSGIDIKEARMDYISSVASFLPRVSVSAEAGRNFGRSIDPNTNGYTNDTFDEGTVGLDMTLSLFEGFTRINRVRFEKMNRNRSEWALKERRNELACQVTDAYYKLLLEERMLDLALEQSRLSERYLKQTEAFVELGLKSVSDLQEVKARREGDIYRYQARQNGCRLALLRLKQLLNLHAEDTLAVQDTINYELLSAYPLPQTEELYTQSLVAMPSMRMMELRQRAARKEYAMAGGKFSPTVFARFSMASRYLDGFSTKQLNDNLGKYIGIGISIPLLSGLERLTTLRKHKLNIFRLRNEEELQKQQLYTEVEQTVLSLRSGYDEFRQVLQQFRAEELVLKESERKWEEGLISVFQLMEARNRFISSKAELARVRLQVDMTLKMETYYRTGSFCTLPGEE

SEQ ID NO: 9620 - protein, 199 aa, B.fragilis
TKMKMRTIKHFLAACFLLVFATSIHAQEQGTKTYLPKFAIKTNALYWATSTPNLGFEVALAKKLTLDVSGNYNPWKFSKDRQIKHWLVQPELRYWLCERFNGSFFGLHGHYADVNMSNLDIFGLGNYRYDGKIYGAGISYGYHWILKNRWSMEATIGAGYARLDYDKYACGKCGEKLGHNNKNYFGPTKVGLSIIYTIK

SEQ ID NO: 9621 - protein, 68 aa, B.fragilis
SVVNYDTLMHSVPNATYFIPESYSYRNDRAGLPTIIFTVWQATVTNEINSINTTGTAKNHIFRSVRKA

SEQ ID NO: 9622 - protein, 267 aa, B.fragilis
REVEFEIEKAFSPFSCKEGRKRLPFNKIIMIKTEKLSMLFTTEEVQTKALNEVTMQVEQGEFVAIMGPSGCGKSTVLNILGTLDSPTSGSYFFEGKQVDKMSENQLTALRKGNLGFIFQKLNLIDELTVYDNVELPLVYLGIKPAVRKEKVKRVLEKVNLLHRASHFPQQLSGGQQQRVAIARAVVTDCKLLLADEPTGNLDSVNGVEVMELLRELNRQGTTIIIVTHSQRDATYAHRIIRLLDGKIVAEDINRPLTETSGPNTESV

SEQ ID NO: 9623 - protein, 74 aa, B.fragilis
ESRLVAKNINQSRASFKYPFSRISKKASRFHSKHNTLSIITLLLSKVSLSQPGYAGRDKNLTIFTKDTKKNKLL

SEQ ID NO: 9624 - protein, 515 aa, B.fragilis
PMKELINRLEELNRQAEKGGGDARIEKQHSVGKLTARERIDLLLEKGSFIELDKLVTHRCTDFGMEKQKISGDGVVTGYGMIGKRLVYVFAQDFTVFGGALSETYARKICKVMDMAMQMGAPIIGLNDSGGARIQEGVRSLAGYAEIFLRNSLASGVIPQISAIMGPCAGGAVYSPALTDFILMVKNSGYMFITGPDVVKSVTQEEVSKEDLGGADVHTMKSGVAHLSAENDIECINYIRELISYLPGNNMEEPPFVATTDSPTRLTPELSDLVPTNPNQPYDMKEMIRAVADDNSFFELQEEFARNIVIGYIRLNGKTIGVVANQPLALAGTLDINASVKAARFVRFCDAFNIPLLTLVDVPGFLPGVDQEYGGIIRNGAKLLYAYCEATVPKVTVIARKAYGGAYDVMSSKHIRGDVNLAYPTAEIAVMGPDGAVNILFRKEIDKAADTEARRKELQDDYRSKFANPYRAAELGYVDEVIDPAITRMRLIRSFEMLANKRQSNPPKKHSNLPL

SEQ ID NO: 9625 - protein, 229 aa, B.fragilis
QKRDKKNDLRVSNKRSMKKNVYFISGIDTDAGKSYATGFLARELNRKGQRTITQKFIQTGNTGHSEDIDLHRRIMGIAPTDDDREGLTMPEIFSYPCSPHLASRIDGRPIDFDKIERATEELSRRYDVVLLEGAGGLMVPLTDELLTIDYIAQKEYPLLFVTSGKLGSINHTLLSLEAIKNRGIKLDTVLYNLYPTVEDRTIQEDTQLFIQRYLKKDFPETKFCMVPEL

SEQ ID NO: 9626 - protein, 509 aa, B.fragilis
SRGEHRMIKKILVANRGEIAMRIFRTCRVMNIATVAIYTWVDRGALHVRYAEEAYCISDSPEDTSYLKPEKILQIAKKTGAAIHPGYGFLSENADFARRCEEEGVIFIGPSADIIARMGIKTEARRIMREAGLPIVPGTEDPVKGIAEAKKVAAEVGYPIMLKALAGGGGKGMRLVRSEEEMETALRLSQSEAGTSFGNDAVYIEKYIENPHHIEVQILGDKYGNVIHLYERECSIQRRNQKVIEESPSPFVKPETRAKMLKVAVEACKRINYYSAGTLEFMMDKDQNFYFLEMNTRLQVEHPVTEECTGVDLVRDMILVAAGNRLPYRQEDVEFRGAAIECRIYAEDPENNFMPSPGVITVREAPEGRNVRLDSAAYAGFEVSLHYDPMIAKLCCWGRNRDSAISNMARALREYKILGIKTTIPFHQRVLKNAAFLKGEYDTTFIDTRFDKEDLKRRQNTDPTVAVIAAALKHYEEEKEAASRATTLPVVGDSLWKYYGKLQMTANNY

SEQ ID NO: 9627 - protein, 417 aa, B.fragilis
LSMDTMIERKPGMKRKHYYAVAGAVVLVGLVFYFIFRDTSSSMNVEKDRLTIATVTRGEFSDYIRVIGQVMPNRIIYMDAIEGGRVEERLKEEGAIVKAGDVILRLSNPLLNIGIMQSEADLAYQENELRNTRISMEQEHLRLKQERIGLNKELAVKQRRYEQYSRLIKEQLIAQEEFRLAAEEYEAARAQLEVIDERIRQDNFFRESQISSLDENIRNMKRSLALVRERVENLKVKAPIDGQVGNLDAQIGQSIAAGEHIGQIITPDLKVQALIDEYYVERVVPGLPADFTRDGGNYKLEVTKPYPEVKEGQFRTDLQFTAGRPENIRAGQTYHINLQLGDPAQAILVPRGGFFQITGGRWMYVLDESGKFATRRPIRIGRQNPQYYEVTEGLKPGDRVIISGYELFGDNERLNLK

SEQ ID NO: 9628 - protein, 118 aa, B.fragilis
ASIRFTFSCQPEVRSNRTDAQATAHANGFPINVGPCMNAPGAWLEMQSATSLVVSTADKVMYPPVNALPMHMMSGSTPACSQAKSFPVRPNPVAISSKINSTPYRWQRRAASLKYSGW

SEQ ID NO: 9629 - protein, 242 aa, B.fragilis
NLSRDIVCLMRFINSSFTDAGFNLAAEEYLLKQGTEDVFMLWQSAPSVIIGKHQRVETEVNRMMAEQNKIPVFRRFSGGGAVYHDLGNINLTFIETTCLARFETYLERTVEMLTAAGVAVRGDERLGIYVDGRKVSGSAQCVHRNRAMYHCTLLYDTNLVLLNKLLEVEGLEEKVAVHPAVRSVRSEVTNLKEYMHPALSTDKFREWVFRYFAGPSVAEAFSKEELAIIEGLRENKYNTICN

SEQ ID NO: 9630 - protein, 68 aa, B.fragilis
VASRCEWVTMIMVVPCRFNSRNNSITSTPFTESRFPVGSSASNNLQSVTTARAMATRCCCPPESCCGK

SEQ ID NO: 9631 - protein, 174 aa, B.fragilis
LKKRSIMKKIGIFYAAKADKTSWVAEKIQKEFGTSAESVAIENAWQNDFEAYDNFIVGASTWFDGELPTYWDELLPELRTLQLKGKKVAIFGLGDQVKYPENFADGVGLLAEVFENDGATLVGFTSIDGYSFERSQALKGDKWCGLVIDIENQSEMTDKRIKDWCRQVKKEFEV

SEQ ID NO: 9632 - protein, 810 aa, B.fragilis
HRERMIGNYWNSAYRNLMKRKGFSFINVFGLAVGMASALLILTYVTFEFSFDKMHQKYERIFRVESTFYEGEVQTDYWASSSFGYGSAMKENLAGIEDYTRVVSLYQPEQIVKYGELTLRENQIAYADPGFFRLFDFELVKGDKATCLSMPRQVVITERIARKYFQDEDPIGKILIFTGPYDKVICEVTGVMKEMPSNSHIHYNFLISYKSLGQYLHDYWYKHEVYTYVLLDSPERKEEIEKAFPAMSEKYKTDEALKNKIWGVSLTPLADIHLKPQVGYEAEIKGNRTAMIALIFAAIAILAIAWINYINLTVARSMERAKEVGVRRVIGAFRKQLVSQFLFEALVMNLVALVLAVGLIELILPYFNQLVSRTVTFSVWLTGYWWLLLLIVFVGGIFLSGYYPALALLNRKPITLLKGKFLNSKSGEGTRKVLVVVQYTASMILLCGTLIVFAQLNFMRNQSLGVKTDQTLVVKFPGRTEGMNTKLEAMKKAIARLPLVDKVTFSGAVPGEEVATFLSNRRKSDALKQNRLYEMLVCDPDYIDAYGLQLVAGRGFSEDYGDDVNKLVVNESAVRNLGIASNEEALGEEIEVECTDAPMQIIGVVKDYHQQALNKNYTPIMLIHKDKIGWLPQRYISIVMKSGDPKELVSQVEEIWHRYFEDSSYDFFFLDQFFDHQYRQDEVFGVMIGCFTGLAIFISCLGLWVLVMFSCTTRTKEMGIRKVLGATRWNLFYQLGKGFFQLILIAVIIALPVAWFSMNAWLSHYAFRTDLKIWFFAVPVVLMLLISFVTVACQTVKIIVGKPARSLRYE

SEQ ID NO: 9633 - protein, 513 aa, B.fragilis
MFLRRIRLPLVGKHLKTAYQAHTGYGRIDHLVHVAQLGSPVGVGKLAAIVILQLFTPGFSVGSFVNLFAEKNVHRSIGAHHGYFGSGISQIHISPDVLGTHYIISSAISFTGNHRNLRHRSFTIGIKQLGTVADDAAILLIYPRKESRYIYQCEQWNIERIAETDKTGCFNRGIDIERSGQCQRLIGHHPYRLPVQANITDNDVTGKLFLQFKETVIVRHCTDHLFHIIRLIRIGRHQIRQFGRKPRRRIGSSNKRRLFHIISGQIRNQFTNVIDAFNIIFGREVCHPRLHGMDIRPSQIFFADFFLCHALHHIGTGDKHITGIFHHQDKIGQCRRIDRPTRTRTHDGTDLRDDTGSQRITQKYLRITGQRTDSLLNTGSSRIVQPDDGCSHLHSHIHHFTNLPGIRFGQCTAKNGEVLSKNIHKPFADHTISGYNSITGYFLFLHTEIRTTMGHQFIEFNKRSFLQKQVDTFTCRQFSDRMLFLDTGVSTTFFGLPVQLFQAIDKLFHRLLF

SEQ ID NO: 9634 - protein, 144 aa, B.fragilis
RKWLVTGKVYDVDYNVGGDSIYSIIINHHSHGVQISPTSHSSYTIMNKGELYQIELKGELEKIHNARSGADAVGRQVVVAPMPGVILKTYVRKGDEVKKGDPLCVLVAMKMENEIRSVADGVVKEIFVEENTKVGLNDRIMVVE

SEQ ID NO: 9635 - protein, 433 aa, B.fragilis
DEDGQSGETTDHDTKHLVLTILMIEELIEKEEVIAGILEIAMPDLLHLRNQFLRVAGLHHNGDVALRQPTDLIFVDQHNRGIILVECLLMVVLHHSDNLHRGIGTFHLYLFAESLFVRGNSQVTDSRLVDHQLIHIVSIIFGESAPCHQLQSISINIIRVAYQHFIKAILLQSITLSPVRQEGSHLFARHGTREGNFVYQRQAGNGLLHGFEFRVHAFGPSGKFDNQSLVRLHSQRLIAHEVQLRKHNQCAAEQNHRCRVLNDYQYFASAFARLAVQELSLQQRNRFPVEKRQCRIVTGEENSPYKYDQKQKPPVSRQPNGESYRTAYQLIEVWQDQLDQSHCQYQCNQVHDQGLKQELRYKLLAESSYYPAHSYLLGTFHRAGHSQVDIIDPGNSQNGNCSKDQGDHGRTVSLDFGLVTNLRFKMNIGKRCQ

SEQ ID NO: 9636 - protein, 502 aa, B.fragilis
QQYGLYHQSNKLMKLKRLYPPQKSVNSLHSETGTGCEVAGCPPLRKEALLFFAGWGMDETPFMHNLPPNKDLIICYDYRSLDFDSTLLSTYDGIYVVAWSMGVWAASQVLPDSNLPLKQSIAINGTPFPIDDMRGIPPAIFEGTLNNLNEATLQKFRRRMCGSGSAFQAFLEIAPQRPVEELKEELVAIGRQYSELPPSTFVWNKAIIGESDHIFPPKNQEQAWQKYCNEIQRYDGAHYDEKILKENLAPAASSKLLIAQRFTKAIGTYPHEARVQQQIARKMCSLLQQHLPAHSLRRVVEFGCGTGTYSRLLLRSFRPEHLLLNDLCEEMRHSCRDILNERVSFLPGDAEALDFPHGTELITSCSVLQWFEHPDAFFRKCENILNAQGYIAFSTFGKENMKEIRQLTGQGLAYRSREELTTSLSALYDIVHTEEEVISLNFNNPMEVLYHLKQTGVTGTCNQSWTRSKLNLFCQEYERLFSPGKGSVSLTYHPIYIIAKKR

SEQ ID NO: 9637 - protein, 376 aa, B.fragilis
RTLIHPGKPSGTNYFQSRSALGAKHFNWCNVINREESLFSFLFIMKEKYWKYSLIIIIIGLGIILFRQITPFLGGLLGALTIYILVRKQMIYLGARMKRSFAALLITGEAILCFLVPISLIVWMLVNKLQDINLDPQAIITPVEELAGIIKAKTGYDVLGSDTLSFIVSLLPKIGQAVMGGISSFAVNLFVLVFVLYFMLIGGTKMEAYIDDILPFNEKNTREVTHEINMIVRSNAIGIPLLAVIQGGVALIGYFIFGAPNAWLIGVLTCFSTIIPMVGTALVWFPVAAYLALTGEWANAIGLAAYGGIVVSQCDNLIRFILQKKMADTHPLITIFGVVIGLSLFGFMGVIFGPLVLSLFLLFVDMFKKEYLDNKK

SEQ ID NO: 9638 - protein, 402 aa, B.fragilis
LKIMPTISIRGTEMPASPIRKLAPLADAAKQRGIHVFHLNIGQPDLPTPQAAIDAIRNIDRKVLEYSPSAGYRSYREKLVGYYEKFNINLTADDIIITTGGSEAVLFSFMSCLNPGDEIIVPEPAYANYMAFAISAGAKIRTIATTIEEGFSLPKVEKFEELINERTKGILICNPNNPTGYLYTRREMNQIRDLVKKYDLFLFSDEVYREFIYTGSPYISACHLEGIENNVVLIDSVSKRYSECGIRIGALITKNKEVRDAVMKFCQARLSPPLIGQIAAEASLDAPEEYSRETYDEYVERRKCLIDGLNRIPGVYSPIPMGAFYTVAKLPVDDSDKFCAWCLSEFEYEGQTVFMAPASGFYTTPGSGKNEVRIAYVLKKEDLTRALFVLQKALEAYPGRTE

SEQ ID NO: 9639 - protein, 695 aa, B.fragilis
TVIICVICGENPKPTLNMKKYDIKTTDEQTLRKWYHLMTLGRALDEKAPAYLLQSLGWSYHAPYAGHDGIQLAIGQVFTLGEDYLFPYYRDMLTVLSAGMTPEELILNGISKATDPGSAGRHMSNHFAKPEWHIENISSATGTHDLHAAGVGRAMVYYGHKGVAITSHGESATSEGFVYEAINGASNERLPVIFVFQDNGYGISVPKKDQTANRKVADNFSGFKNLRIIHCNGKDVFDSMNAMTEAREFAIANRTPVIVHANCVRIGSHSNSDKHTLYRDENELAYVKEADPLMKFRRMLLRYKRLTEEDLQQIEAAAKKELAAANRKALAAPDPIPESIYDFVLPEPYIPQKYKDGLPGPVEGEKSFMVNAINETLKEEFRRNPDTFIWGQDVANKDKGGVFNVTKGMQQEFGDARVFSAPIAEDYIVGTANGMCRFDPKIHVVIEGAEFADYFWPAVEQYVECTHEYWRSNGKFTPNITLRLASGGYIGGGLYHSQNLEGALTTLPGARIVCPSFADDAAGLLRTSMRSKGFTLYLEPKALYNSVEAAAVVPEEFEVPFGKARIRREGTDLTIITYGNTTHFCLDVAERLAREGVGSVEVIDLRSLIPLDKEAIFASVRKTGKVMVVHEDKVFSGFGAEIAAQIAGEMFRYLDAPVQRVGSTFTPVGFNPILERAILPNDEKIYKAAKELLEF

SEQ ID NO: 9640 - protein, 438 aa, B.fragilis
YLYMSFTHPHNQSNSVSSSGAKGKLRLSYFLARRIYRDTDGGKQVSRPAVVIAMIGIAIGLAVMIIAVSVVIGFKSEVRNKVIGFGSHIQISNFDAVGSYETHPVVVNDSMMVALSALPEVKHVQRYSTKPGMIKTDDAFQGMVLKGVGPEFDPTFFRDHLIEGEIPAFSDTASTNQVVISKAIADRLKLKLGDKIYTYFIQKDVRARRLTVKGIYQTNFSEYDNLFLLTDLYLVNRLNNWAPGQVSGAELQVRDYDKLEDITYRIATDTDNKQDIYGGTYYVQSIEQMNPQIFAWLDLLDLNVWVILILMVGVAGFTMISGLLIIILERTQMIGILKALGANDFTIRKVFLWFSVFLIGKGMLWGNAIGIVFCILQSQFGLFKLDPETYYVSMVPVSMNIWLFLLINAGTLLTSVLMLVGPSYLITKINPADSMRYE

SEQ ID NO: 9641 - protein, 415 aa, B.fragilis
NDNIMTINLITFASILHKQVTIRSSHEAVLSELEKYFTVKFVDYRDIHQLTKDDFSIIFIATGGVERLVMQCFESLPRPAIILADGMQNSLAAALEISSWLRGRGMKSEILHGDFMSIVQRIQVLYTNFKAQRSLVGLRIGVIGTPSSWLIASNVDYLLAKRRWGIEYLDIPLERIYDVYDRIKDNEVGASCAAVASQALACREGTPEDMIKAMRLYRAIKRICKEEKLSAVTVSCFKLIERTGTTGCLALAMLNDEGIIAGCEGDLQSVFTLLVAKALTGKVGFMANPSMINARNNEIILAHCTIGMKQTERYIIRNHFETESGIGIQGLLPEGDVTIVKCGGECLDEYYLSTGTLTENTNYINMCRTQVRVKMNTPADYFLKNPLGNHHILLQGNYENSLNEFLMANSCKRTE

SEQ ID NO: 9642 - protein, 503 aa, B.fragilis
KQTIMTLILAIVPVLLLIVLMAFFKMPGDKSSVISLIVTILIALFGFHYAVDNLVFSFVYGALKAVSPILIIILMAIFSYNVLLKTEKMEIIKQQFSSISTDKSIQVLLLTWGFGGLLEAMAGFGTAVAIPAAILISLGFKPIFSATVSLIANSVATAFGAIGTPVLVLAKETNLDVQVLSTNVVLQLSVLMFLIPLVLLFLTDPKIKSLPKNLFLALLVGAVSLGSQYVAARYMGAESPAIIGSILSIVVIVIYGKLTAPKKEKAQQNALKGKDILNAWSIYLLILLLIILTSPLFPGLRSTLENNWVTRISLPINDSTVNYTIAWLTHAGVLLFVGTFVGGLIQGAKVKELFVVLWNTVKQLKKTFVTVICLVGLSTIMDTAGMISVIATALATATGSLYPLFAPVIGCLGTFITGSDTSSNILFGKLQASVAGHINVSPDWLSAANTVGATGGKIISPQSIAIATSAGNQQGKEGEILKAAIPYALAYVVITGIIVYIFS

SEQ ID NO: 9643 - protein, 480 aa, B.fragilis
IVRMNKNTILYAILAILYFMLFSCSQEELILPDPTPLDAYKRQSTQLGIDREKININTEDASIVAEIFNRKNHHLTRNSLNEPTKRIKEIFTLYNNGKPMMYIINYQDQKGYTIISATKKYYPVIAYSDVGSFSLQESYNDGSSILLDEYKKIMQYNEIQPDSIIDKYRKKWVEFENLKTEKLSDVSTRSLSDYAMSIKKEEQKKIWTNKGYECHDLGAIRNFLSKERADGYIRDICNHTDQNYNCEKVNLLLIKKYPIKTIGPLLKTSWHQRSPFNVDAPNKLAGCVPIAIAQIAKYYEWPVTYSWTHIPLRCNTNMEDDEFFKKFIKDIRSFSKVTYKDKATGATMGNAVKAFKKLNYSATLMDYKRSETIQEIQNNRPVFMGGDRKAIFFDIITKGHAWVCDGYEVRQTQYASLVWGSKFNIPDMEEPDYFFTNGTYDTSEFLHMNWGWGENGGNGWYIFDNIYNRTHDVSYHLNRP

SEQ ID NO: 9644 - protein, 281 aa, B.fragilis
TYRIATQRLNGSETFSDSFGPINIYNEKHTRYMKRISLFVLFICTIFSCLSAQTDKENERIKQNYIRSIIGMDEEKQPYLQLLSKIPPEKEVSDQNVIELQQLYPIRQEEIHRLISTIRGDGSWPDINYADTKRSGWEPKQHTERILKLTKYYASEQENVSAQEISAVVSIIHQAMKYWFVQKPVCKNWWYNQIGIPRTLGPAFLLFETEMTEKEKQEAIRVMEQSQFGMTGQNKVWLAGNVLIRGLLLNDAELIKEARENICSEIVLGQKEGIQPDWSFH

SEQ ID NO: 9645 - protein, 425 aa, B.fragilis
TQTIQTLTPMIFSQRIYFIILFHVLLILGTAGTGLWLVVSHTGYIIGGILLLCSLFQIGALTRQLNTFNRKIRLFFDAVQDKDNMLYFPEANVGKEQAQLNRSLNRLNDLLARTKGESHKQEHFYQSLLEEVPSGVLAWDDSGRIIIANSAAFSLLKCNRLYTETQLAQLLNVTGIRKSLSISEKKMILDGETITILSIKDIGDELSDKENESWSKLTHVLTHEIMNTIAPILSLSQTLSERPDINEKSARGLRIIQAQSERLMEFTESFRHLSYLPHPEKRRFALTEMLRNLEELLQSDFRERGIRFMLQCVPDPIETDGDPNQLSQVFLNLLKNAMQALEGQADGRIILRVRRADRLQVEIEDNGPGIPEEIREQIFIPFFTTKTEGSGIGLSLCKQIIRQHDGHLSIRESRPGQTIFSLDLP

SEQ ID NO: 9646 - protein, 434 aa, B.fragilis
KEAFSSLLCRRTEKRPFLFQIQPLVISKQFIPGNNHPVARFQSFGHFVVLRILPPDTDRTARGKFTTFVKNIHPAAPGYLKESSTRYKNGLGRISQLKIDVIRLPGTDVFGTSGSKLKVGTELSLFYFRIGFGHFKFIVASVTGEIRRKSGNYPLHVVFVDQSLYFEVGGNDLPDMFAGSNGLADLGIEITHLSIDGSFYLQVFHPLAYQGEAALHVTDILVEAADLAFPEKIVLPDAFVNDFQLCPCRFVLFGSQAKLLLRYQLLFDKAAVLLVTPLFHCQFLIQADAFLFQPQMFLLHADAGIAQLVLLIGQIGFALHDADVQERIAETKNHIACLDDGSFLFQALFHTASFYRIHINDAVGHHLSDNPDVITELSPGNCSNGQPVFFHIHRRGSVSENKVKNKSHQYHGSGDGIIMLPLHSGFAFDHCIHR

SEQ ID NO: 9647 - protein, 456 aa, B.fragilis
IEVFSMSFNIVKNDKKRVIIVGGGFGGLKLANKLKKSGFQVVLVDKNNYHQFPPLIYQVASAGLEPSSISFPFRKIFQKRKDFYFRMAEVRAIFPEKKMIQTSIGKAEYDYLVLAAGTTSNFFGNEHIEEEAMPMKTVSEAMGLRNALLANFERSITCSTERERQELLNVVVVGGGATGVEIAGVLSEMKKFVLPNDYPDMPSSLMHIYLIEAGDRLLAGMSEDSSRHAEQFLREMGVNILLNKRVTDYKDHKVMLEDGTEIATRTFIWVSGVAAITFGNIDGELLGRGRRIKVDEFNRVQGTDTIFAIGDQCIQTTDKNYPNGHPQLAQVAIQQGELLAKNLQRLQKGKPMQPFHYRNLGSMATVGRNRAVAEFSSFKTAGWLAWVMWLVVHLRSILGVRNKANVLLNWVWNYFTYDQSLRMIVYAKKAKEVRDREELEAKTHWGEETQTQQPKG

SEQ ID NO: 9648 - protein, 344 aa, B.fragilis
WICLLQTPLIRSSKPDKKLELPYYAASQPSGMQVVRSSGLNGPSTKESFPDHAFIPVALLSPRQEGHGDFRAVYDEPRPFDCCGLTHTEKMGAAIIADGIDAVTVAARNNLGLGASQIKLMTGGGVASWYDRLEDSQFFEKEIHAAVKAGKDAGTYVMVHVYVPRAIQRAIHAGVKSIEHGHLIDEPTMQLIAEKEIWLSMQPFTLGDNQFPTKEQQEKHALVVQGTDQTYQLAKKYNVKLAWGTDLLFNPANTKNQNQGILKLRQWFSNFEILKMVTHDNAELLALSGARNPYPGKLGVIEEDAWADLILVDGDVLKDITLLGDPEKNFIIIMKGGEIYKNRV

SEQ ID NO: 9649 - protein, 395 aa, B.fragilis
NEPLKKIMMKTKMIYMILLFSSILFGGCVRDVIDDVPGTDEDYAADKKDVVLIRMGTNDAEVKDITSRLFNNIPSSWEIGKKTIVDYDKMKDPETELNADIKNPKIYMTVILNIDDVISGKYPISLFRMLKFYKRDFYVIATQSTPEQKEEMLSLIGVYMEAGYYAINYDNVQHYRIFPSADPYAKDNMIGKGVASFNQKLLTRSADTLPEGNDPDPGYNAQMADKEALKRIEIYNRIYGYAQGDMNYSMQAVPYKMKQGAAPDVIIDNSWAIDAYNFQIYSKNNNCILSITNNAGNGFTANIKDYTTPKGANVYAYIWNLMREASSEITVHSDGGIFREISYQPQTVNHGASYTENSFWKVSVSVSPTKLEDKPWEAFKVSFGKESSTEVSYKD

SEQ ID NO: 9650 - protein, 390 aa, B.fragilis
MEAFTFNTTELILLSATGVLLIIQLIYYLGLYNRIHTHNLAVGKDEVHFGRELPPLSVVICARNESENLRRNLPTILKQDYPDFEVIVINDGSTDESEDLLSALEEEYPNLYHSFTPDSARYISRKKLALTLGIKASKHDWLVFTEADCAPVSNQWLRRMARNFTSSTDIVLGYSGYERGKGWLHKRASFDSLFTSLRYLGFALAGKPYMGIGRNLAYRKELFFKVKGFSTHLNMQRGEDDLFINQVANENNTRVETSPDAVIRMQPVERYKDWKEEKVSYMATSRFYKGSQRWLLGLETGTRLLFYAACLAGIVFGILSFHWLVVGLSLLLWFVRYSVQAYVINKTAGEMGDNRSYYFTLPVFDIIRPLQTLKLKLYRLYRGKGDFMRR

SEQ ID NO: 9651 - protein, 345 aa, B.fragilis
SVLFSSERNKTFKTKRKMAQLNFGGVTENVVTREEFPLEKAREVLKNETIAVIGYGVQGPGQSLNLRDNGFNVIVGQRPGKTYEKAVADGWVPGETLFGIEEACEKGTIIMCLLSDAAVMSVWPTIKPYLTAGKALYFSHGFAITWSDRTGVVPQKDIDVIMVAPKGSGTSLRTMFLEGRGLNSSYAIYQDATGRAMERTIALGIGVGSGYLFETTFVREATSDLTGERGSLMGAIQGLLLAQYEVLRENGHTPSEAFNETVEELTQSLMPLFAKNGMDWMYANCSTTAQRGALDWMGPFHDAIKPVVQKLYNSVKTGNEAQISIDSNSKPDYREKLEAELKGIA

SEQ ID NO: 9652 - protein, 644 aa, B.fragilis
FLAYNLQPIKMNDNKIKSSSPLSDLQHQQLLLRMEYEYEKEEFRRQTETMGIARKVKRGLCWYPVGTGRSFYNSLNQLVIEIERKEDKDIEHVFEFGRPVCFFEQGYDGKIHYFNSICTVSYADEERMVVAVPGAGSLLEIQGAERLGVQLYFDETSYRTMFEALEDVIRAKGNRLAELRDILLSKQPSCWRETYPVRFPWLNSTQEAAVNKVLCAKDVAIVHGPPGTGKTTTLVEAIYETLHRENQVLVCAQSNTAVDWIAEKLVDRGVPVLRIGNPSRVNDKMLSFTYERRFEGHPAYTELWGIRKSIREMGNRMRKSSYSEREAARSRINHLRERATELEIQINEDLFSGARVIASTLVSSNHRILTGRRFTTLFIDEAAQALEAACWIAIRKADRVIFAGDHCQLPPTIKCIEAGRNGLEQTLMEKVAANKQETVSLLKVQYRMHQSIMQFSSEWFYQGELQAAPEVTNRGILDLDLPMSWIDTSEMEFHEEFIGESFGRINKPEANLLLQELEAYIRKIGEKRVLEERIDFGLISPYKAQVQYLRGKLKGCSFFRPFRSQITIHTVDGFQGQERDVIFISLVRANEDGQIGFLNDLRRMNVAITRARMKLVILGDAVTMSKHAFYKKLIGYIRHISQGL

SEQ ID NO: 9653 - protein, 658 aa, B.fragilis
IKFNIYLCALIKQQTILYHMKNRIYTMKGMLATLLGAFLLGYAVTGCIDEKDHYKPDDKTSGVPNSFDFATTQDVQLDLKYDVPVKDYQVLFELYFENPLTTDAEGQVVKRTDITPKVTRMTDGTGKYRAKETVPAYGEEVYIYTSYIGVPMLYKTKIVGNTITADINWDTAAEESVQTRAEGEYQTVPQGFYTLGSWNVKGRPNYLDSEGVIELTSSFYQTINQTIPEGGNCPRKYRQSADIVINDELGAEVKVRFVGGTSAAYSAFGYYCYPEGAAKKQIENARKYVVFPNTKTGVGIKGGECVKLHYIDENGEDQGTTFPKGTKIGWFISNDAFTKKGEKTGSVGKGLGMFYSTTALNSDGRTHTAAFKINDFIVLSFEDWTDQDYNDVMFNIWSNPIEAIAPDVPSVDPIDPDDASVAYRMTYKGILAFEDNWPSKGDYDLNDVIVKYSSILEFNTKNQVLSAEDTFTAMWSGALFKNGFAYQLNTDRSNVECSILEGKSGWDKQGLDKDLEQATISVFANAIEETGENTKTSTFKIQNKFKQPVDHETFGVAPYNPFIFLHQNTDKNRTEVHLVNHGPTSKENMNLFNTQQDLSDKDKGIYYVSDQNYPFAIHLSDVESFSTTEKEAIDKSYPRFASWAQSGGTTDKDWYLKK

SEQ ID NO: 9654 - protein, 198 aa, B.fragilis
NVIKMKKIVFLLLLCVACCMNAQEFHLIPKVGLNLANTTGEVDSKVRPGLNIGLGGDVMLTERFGIETGVYYSMQGSKYKGGGVSYTDKLDYINVPVYAKEFIYKGLYVFGGPQFSFNVNSENKSSSDYGTTVIGMNVIRKFDCGVGLGAGYQFERGLLISLNYNIGLINVNKSWASDSNPKANNSVVQLNVGWRFAL

SEQ ID NO: 9655 - protein, 247 aa, B.fragilis
MSNNKKIGSYKFIAEPFHVDFNGRLTMGVLGNHLLNCAGFHASERGFGIATLNEDNYTWVLSRLAIDLEEMPYQYEEFTVQTWVENVYRLFTDRNFAIIDKDGKKIGYARSVWAMINLNTRKPADLLTLHGGSIVDYVCDEPCPIEKPSRIKVATDQPCAKLTAKYSDIDINGHVNSIRYIEHILDLFPIDLYKSKRIQRFEMAYVAESYYGDELSFFEEEVSENEYHVEIKKNGSEVVCRAKVKFV

SEQ ID NO: 9656 - protein, 790 aa, B.fragilis
LLTKFPAKITILFPGWNKHFNLLNLSFILLVIINRRTDKTEIVMVYDLNMLKSFYASYKGKMEHVRAALKRPLTLAEKILYTHLYNVADLKNYERGEDYVNFRPDRVAMQDATAQMALLQFMNAGKEAVAVPSTVHCDHLIQAYRGAERDIETATQTNREVYDFLRDVSSRYGIGFWKPGAGIIHQVVLENYAFPGGMMVGTDSHTPNAGGLGMVAIGVGGADAVDVMTGMEWELKMPKLIGVRLTGELNGWTAPKDVILKLAGILTVKGGTNAIIEYFGPGTASLSATGKATICNMGAEVGATTSLFPYDERMAVYLKATGREEVAAMADSVAADLRADDEVMARPGDFYDRVIEINLSELEPYINGPFTPDAATPISEFAEKVVTNGYPRKMEVGLIGSCTNSSYQDISRAASVARQVNEKNLGVAAPLIVNPGSEQIRATAERDGMMDVFEKMGATIMANACGPCIGQWKRHTDDPTRKNSIVTSFNRNFAKRADGNPNTFAFVASPEIVLALTIAGDLCFNPLKDRLVNHDGEKVKLSEPQGDELPSAGFVAGNQGYQAPGGEKNEIRVAPDSQRLQLLTPFPAWDGNDFLNMPLLIKAQGKCTTDHISMAGPWLRFRGHLENISDNMLMGAVNAFNGETNKVWNRLTNTYETVSGTAKQYKADGISSIVVAEENYGEGSSREHAAMEPRFLHVKVILAKSFARIHETNLKKQGMLAVTFADKADYDRIREHDLISVVGLKEFSPGRNLEVILHHEDGTEERFVVQHTYNEQQIGWFRAGSALNAK

SEQ ID NO: 9657 - protein, 153 aa, B.fragilis
RRLNVSASSIKGVHKYTITAWTDKDTIEKVVKQIEKKIDVLQAHYFTEDEIYFHEIALYKVSMPEFQSQPEASKVIRRYNARIVEVNPVFAIVEKNGISEEITSLYEELSALNCVLQFVRSGRVAITTSCFERVNEFLADRETKYNLSKKEEK

SEQ ID NO: 9658 - protein, 303 aa, B.fragilis
MSKITKQQNGVLSVPDVPTIPFITGDGVGAEITPAMQAIVDAAVDMSYGGARRIEWKEVLAGERAFRATGSWLPDETMEVFKEYLIGIKGPLTTPVGGGIRSLNVALRQTLDLYVCLRPVRWFRGVVSPVKEPEKVNMYIFRENTEDIYAGIEWEAGTPEAKKFYRFLHEEMGVSKVRFPETSSFGVKPVSREGTERLVRAACRYALQHELPSVTLVHKGNIMKFTEGGFKKWGYELAEREFADALASGKLVIKDCIADAFLQNTLLIPEEYSVIATLNLNVFTTGLEGSAGGVKKDPTRWCY

SEQ ID NO: 9659 - protein, 191 aa, B.fragilis
LLLPLHTICKEMKDTKQQFEHVIALCRDLFSKKLHDYGPAWRILRPASVTDQIFIKANRIRSIEVKGVTLVDEGIRSEFIAIVNYGIVGLIQLELGYAESADITVEEALALYDKHAKEALELMLAKNHDYDEAWRSMRISSYTDLILMKIYRTKQIESLAGQTLVSEGIDANYMDMINYSVFGLIKIEFEG

SEQ ID NO: 9660 - protein, 123 aa, B.fragilis
TLYTGRGKPPSPIERPPRLNVPYPPTPDFAPVKELPSLLPSTPSPEVAVPLLPPICEPLPKAPATRLLAASAAALRSRSAFSSASFLASAAFSSGVFSGFFATFGFSFLGSALGFTTTVSSSV

SEQ ID NO: 9661 - protein, 299 aa, B.fragilis
IELTRRMNFNCIKTVMIAAAAMISLNSFSQDLIARQAPIDRKLKSVDSLALQKQIRAEQSEYPALSLYPNWNNQYVHAYGKDAIIPDSYTIDLTGFHMPTPSTRITSPFGPRWRRMHNGLDIKVNIGDTIVAAFDGKVRIVKYERRGYGKYVVIRHDNGLETVYGHLSKQLVEENQLVKAGEPIALGGNTGRSTGSHLHFETRFLGIAINPALMFDFPKQDIVADTYTFRKTRGYERNRAGSHDTNIASDGEIRYYKVKKGDSLSRIAKLRGVSVSTLCKLNRITTKTTLRPGQVLRCS

SEQ ID NO: 9662 - protein, 184 aa, B.fragilis
IMGTVYAFFADGFEEIEALTTIDTLRRAGLDVEIVSVTPDEIVVGAHDVSVLCDKNFENCDFFDAELLFLPGGMPGAATLDKHEGLRKLILSFAEKNKPIAAICAAPMVLGKLGLLKGRRVTCYPSFEQYLDGADCTNEPVVRDGNIITGMGPGAAMEFALTIVDTLLGKEKVNELVEAMCVRR

SEQ ID NO: 9663 - protein, 166 aa, B.fragilis
INEHFNLLKLYVMMEKTLVILKPCTLQRGLVGEITRRFERKGLRLAGMKMVQLTDEVLSEHYSHLSSKPFFQRVKDSMMTAPVIVCCFEGVDAIQAVRALAGPTNGRLAAPGTIRGDYSMSFQENIVHTSDSPETAAVELNRFFKPEEIFDYKQATFDYLYANDEY

SEQ ID NO: 9664 - protein, 310 aa, B.fragilis
DNSNTEKKSQICDILETFINMKFAIFGNTYQAKKSSHAATLFKLLEKHGAEICVCREFHRFLKSDLKLNVKADDLFDENNFDADMVISIGGDGTFLKAARRVGNKGIPILGINTGRLGFLADVSPEEMEETIEEVYQNHYTVEERSVLQLLCDDKHLQNSPYALNEIAILKRDSSSMISIRTAINGAHLTTYQADGLIIATPTGSTAYSLSVGGPIIVPHSKTIAITPVAPHSLNVRPIVICDDWEITLDVESRSHNFLVAIDGSSETCKETTRLTIRRADYSIKVVKRFNHIFFDTLRTKMMWGADSRV

SEQ ID NO: 9665 - protein, 257 aa, B.fragilis
PSIDPPADPSSPVVKTNVRFHQADTHKRFFALLESQNIRVNRFRADCGSCSKEIVSEIEKHCKHFYIRANRCSSLYNDIFALRGWKTEEINGIQFELNSILVEKWEGKCYRLVIQRQRRNSGDLDLWEGEYTYRCILTNDYKSSTRDIVEFYNLRGGKERIFDDMNNGFGWSRLPKSFMAENTVFLLLTALIHNFYKTIMSRLDTKAFGLKKTSRIKAFVFRFISVPAKWIMTARQYVLNIYTENRAYAKPFKTEFG

SEQ ID NO: 9666 - protein, 444 aa, B.fragilis
NLKDRELHIIQKVWTNLCRFALAGVFIFSGFAKAVDPLGSEYKIQDYLDAFGMGTWFPAFFPLLAGIVLSAIEFSVGIFLFFGIRKTTATWLALLLMIFMTPLTLYLALANPVSDCGCFGDAWVLTNWQTFWKNIILLIAAISVFRWKHQMIRFISAKMEWLVSLYTFLYVFALSFYCLGNLPILDFRPYKIGKNIPEGMDVPEGAKPTVYESVFVLEKNGEKKEFSLENYPDSTWKFIEARTIVKEKGYEPSIHDFSMTNLETGEDITEEVLSDKNYTFLLVAHRIEEADDSNIDLINEIYDYAVEHGYGFYCLTSSLDDQIEQWKDKTGAEYPFCLMDDITLKTMIRSNPGLMLIKEGTILNKWSDSELPDEYALTDKLENLELGKQKEESDVHTIGYVLLWFAIPLLMVLGVDILVVKRLEKRRKRAAEKAVENSKSSSEA

SEQ ID NO: 9667 - protein, 85 aa, B.fragilis
RRHCTMEWMYRLHGQFGATDTDAMWVSGWGGSALHRRLCRCLMCCIGLVSDTIRIRPGGNTIGVSCEGVSMDANGMRARAGIVTA

SEQ ID NO: 9668 - protein, 223 aa, B.fragilis
DVKLMCRTALIVAGGKGLRMGSELPKQFLPIGGKPVLMRTLEAFHRFDEKMQIILVLPREQQDFWRELCEEHGFDIKHLIADGGETRFHSVKNGLALVNGIGVVGIHDGVRPFVSQEVIARCFREAVVRKAVIPVIDVVETVRHLTESGSETVSRNDYKLVQTPQVFDADLLKRAYEQEFTPFFTDDASVVEAMGVPVYLVEGNRENIKITTPFDLKVASALL

SEQ ID NO: 9669 - protein, 267 aa, B.fragilis
MNNRIENLLTLLIKNKMRKNIVAGNWKMNKTLQEGIALAKELNEALANEKPNCDVIICTPFIHLASVTPLVDAAKIGVGAENCADKESGAYTGEVSAAMVASTGAKYVILGHSERRAYYGETVEILKDKVKLALANGLTPIFCIGEVLEEREANKQNEVVAAQLASVFDLSAEDFSKIVLAYEPVWAIGTGKTASPAQAQEIHAFIRSAVAEKYGKEIADNTSILYGGSCKPSNAKELFANPDVDGGLIGGAALKVADFKGIIDAFN

SEQ ID NO: 9670 - protein, 707 aa, B.fragilis
FESSFSLVVMFDLTTRDIKYLSGVGPQKAAVLNKELEIYSLHDLLYYFPYKYVDRSRIYYIHEIDGNMPYIQLKGKILGFETFGEGRQRRLLAHFSDGTGVVDLVWFQGIKYVTNKYKLHEEYIVFGKPTVFNGRINVAHPDIDSPADLKLSSMGLQPYYNTTEKMKRSFLNSHAIEKMMATVIGQIQEPLSETLSPKLIADHHLMSLTDALRNIHFPSNPELLRKAQYRLKFEELFYVQLNILRYAKDRQRKYRGYVFETVGEIFNTFYSKNLPFELTGAQKRVLREIRQDVGCGKQMNRLLQGDVGSGKTLVALMSMLMALDNGFQACMMAPTEILANQHYDTIRELLFGMDVRVELLTGSVKGKKREAILAGLLTGDVHILIGTHAVIEDTVNFASLGLAVIDEQHRFGVAQRARLWSKSVQPPHVLVMTATPIPRTLAMTLYGDLDVSVIDELPPGRKPIATIHQFDNRRESLYCSVRKQIEEGRQVYIVYPLIKESEKIDLKNLEEGYLHICEEFPDCKVCKVHGKMKPAEKDAQMQLFISGDAQIMVATTVIEVGVNVPNASVMIIENAERFGLSQLHQLRGRVGRGADQSYCILVTTYKLTEETRKRLEIMVRTNDGFEIAEADLKLRGPGDLEGTQQSGIAFDLKIADIARDGQLLQYVRTIAEEITDADPGGVLPENAILWQQLRALRKTNVNWAAIS

SEQ ID NO: 9671 - protein, 88 aa, B.fragilis; identical to SEQ ID NO: 7984

SEQ ID NO: 9672 - protein, 293 aa, B.fragilis
NGVGYTPAGNKEEMNIKRKSEYIGALGALLVHVAIIALLILVSFAIPHPDEEAGGVPVMMGDVDAAYGNYDPSTMVDVEVLPEEVPAPQPEPEVETEQEMITQTEEETVVVKPKAEPKKEKPKVAKKPEKTPEEKAAEAKKLAEEKAERERKAAAEAASKRVAGAFGKGSQMGGSKGTATSGEGVEGSKDGNSLTGAKSGVGGYGTFNLGGRSIGEGGLPRPVYNVQEEGRVVVSITVNPAGHVIATSINRLTNTVNSTLRKAAEDAAKKARFNAVDGVNNQTGTITYYFNLK

SEQ ID NO: 9673 - protein, 211 aa, B.fragilis
KLRIILRHRTMTKLSVNINKVATLRNARGGNVPNVVKVALDCESFGADGITVHPRPDERHIRRSDVYDLRPLLRTEFNIEGYPSPEFIDLVLKVKPHQVTLVPDDPSQITSNSGWDTKVNFDFLTEVLDEFNGAGIRTSVFVAPDAEMIEYAAKAGADRVELYTEPYATAYPKDPAAAAAPFVEAAKAARTLGIGLNAGHDLSLFESELFL

SEQ ID NO: 9674 - protein, 149 aa, B.fragilis
QIGILKNYFMALKRRAKISPNFSMASMTDVIFLLLIFFMITSTVVSPNAIKVLLPQGKQQTSAKPLTRVIIDKDLNYYAAFGNEKEHALGVEELTPFLQSCADKEPEMYVALYADETVPYREIVKVLNIANENHFKMVLATRPPETKKK

SEQ ID NO: 9675 - protein, 89 aa, B.fragilis
NVLMGIDQYDHASWGITRPAFFEAALDYRRGRPRRCIMMGRTMKNPHGEGNGMHQCRRTYEGWSILNGPSRSVVHHDRSMRRRRRDVAS

SEQ ID NO: 9676 - protein, 245 aa, B.fragilis
KLSSLMNAMLLLAQVATNLADSVASANPVLTPVSAPAEMNMLDMAIKGGWIMIVLAVLSVVCFYILFERNYMIRKAGKEDPMFMEKIKDYIHSGEIKSAINYCRTINTPSARMIEKGISRLGRPVNDVQVAIENVGNIEVAKLEKGLTVMATISGGAPMLGFLGTVTGMVRAFYEMANAGSGNIDITLLSGGIYEAMITTVGGLIVGIIAMFAYNYLVMLVDRVVNKMESRTMEFMDLLNEPAQK

SEQ ID NO: 9677 - protein, 185 aa, B.fragilis
NPFLIMLEEILEFNKKFVENRGYEKYITNKYPDKKIAILSCMDTRLTELLPAALGIHNGDVKIIKNAGAVISHPFGSVIRSLLVAIIELGVEEVMVIAHSDCGACHMNSDEMIAHMKKRGIKSETIDMIRYCGVDFNSWLGGFDDPVKSVRGTVRSIENHPLIPKDVRVHGFIIDSLTGELTRVE

SEQ ID NO: 9678 - protein, 68 aa, B.fragilis
GKSSDCFPFSFLLCAIYLCKRFHWKILRDGAQPIRSTFRCNQVNVTSGKGDAVIASATQHRNFGYAAP

SEQ ID NO: 9679 - protein, 74 aa, B.fragilis
SSASGRAAVGYEFNAEAEPVRFLPLPVAGKSHAFAFRTDHNKSIKFIRRVPVMLAIIKSGSVYGGDSTPDRSLR

SEQ ID NO: 9680 - protein, 364 aa, B.fragilis
WIPPSFPAHSNHNKYNKVKMKNTFLLTFALILLAGSPLKAQEKEEAATLNKVVNTLKERITLAGYAQLGYTYDDAAKKMNTFDIKRIIFMAHGKITDRWTCDFMYDFYNGGMLLEVYTDYRILPGLKVRIGEFKVPYTIENELSPTTVELINCYSQSVCYLAGVSGSDVACGMTSGRDIGAMVHGGLLNDLLCYKLAIMNGQGLNIKDKNNQKDIIGNLMVNPLKWLSVGGSFIKGTGHAIADSEITGIRAGENYTKNRWSIGGVITTTPFSLRSEYLAGKDGGVKSDGFYATGCYRMLRNFDLVASYDYFNANKAVSRKQTNYIAGLQYWFYPKCRLQAQYTFCDRNKGKDSNLFQAQVQVRF

SEQ ID NO: 9681 - protein, 474 aa, B.fragilis
QAQPSFINHTISAYNSVFTFGYRQFGRNRTGIKCHDNVVPSISVSAVFQAESHQITNIYREEFQVLTYHLGISHTESGMGFTNTDQTLIIGEHIFVSCLSVPINGINRIGTLKTIMHPFLVTHHLFSGIDERNTLRSQHCRLRQFVKSYELFGCDAGDTRLQAIYQAHIIVAGYVTDHLSRLGSPGSFTVIHRIIVDLRVTDSSYNTKLNALFFPGDPGKERSLMIIIKRTTQRITHFIGKGGNTRHFTSIDLHCQRITRILRCFRCPTFTINNDRRIYSTDRLTDFIHRLDVVNAHQVEAETIDMVFLDPVKHGFNHIFTHHRPVACRLVTTSRTISQRTIRLLAIKISRYRTFEVTAIGVVCMIVYHIEHYPYTGFVQCLYHLLKLADADSRIVRIGSIRTIGYIVILRIISPVVFIFIQLGFVYRSIIIRRKQMDVCYSQLDQMINSGQQFGRVHRTMFCQCQKFSLMLNP

SEQ ID NO: 9682 - protein, 461 aa, B.fragilis
TMQFLSFSFLALFTLCFFLYYAVKGRARNLILLVTSCIFIGWYYLPFLLTAVVVALFTFFWAQWMESRAKAGKKTKPVYIAGIIALIGGWLLLHGTVIDDIIFPLGMSFYTFQAISYLTDVYWQEQRSERNWVDFLIYMLFFMKFLSGPIERGGDLLPQLKDPRPFIYSNAVTGLKYILLGLIKKLLIANQISPQTDVMFHSIHDLSGVQLLMTCLLYPIELYADFSGYTDIAIGGAYMFGIKLSPNFNRPFAARSTADFWRRWHMSLSFWVRDYLYVPLTAGTRNWGQWGIYFSLLITFLALGLWHGAGLTFAIYGLIQGVLICWEMKTAAFRYNLPQYIGKYAADSLLIVRTYLLFALSLIFFRVQSLSDAWYFLRNISFEVHSSWKEMNIGIRDHNCIVAGSALLLVLIYEYYASKYNLMETLERQPAWLRWSVYYLLVFALLMLGKFDTETFIYLQF

SEQ ID NO: 9683 - protein, 68 aa, B.fragilis
LTTTTKNKERNNNGVSTDMAFSFVLSFLLGYARTTFRNRRENQWICSRRLYSLPRTLERNGSNDLFHI

SEQ ID NO: 9684 - protein, 382 aa, B.fragilis
LVSTSSVWQTVYLMFLQAVEHCSKQSKEKFFRVLPLSRNKTEVNHYKTEKATPLGVAFFKSRKWGESLLFSILFLFFLSACTGKKEKHSALPELQTLTFGLMPSFDGLPSLVAVRQGIYDSLDIKIDFITYASATDRDAAFLSGKLDGMLTDYPGATLLQAKGSRLRLVMETDGSLSMIASKKSNVRNPDDLKGKNISVSANTFVEYATDEVMKRACLHPGEVNKPEINNIPLRLMMLEDGQISASFLPGPASAIALNDGHTALLNTRQMGLRCTGIVFSEKAITEKDEEIRRFITGYNLGVKYLQTRPQNEWTEILVKEFGLQEKAAMQIDLPDYRPATRPSYHDIEKIIAWLKSKGAIPDYYPGENLVDTTFIPGTLKPQ

SEQ ID NO: 9685 - protein, 455 aa, B.fragilis
FLQTLNCIDMADWKSVKSISDKYGISVERVIAWVRESQITTSVVGSVVLIDDGSVCELVEKEKRLAHLKTNYEQLCAKFEQRIEAELRADEDAGLKMRLLDDFLPVLHRLLCVMIDKLNTEDRKLFNSAFTAAPLYRIAREMGFESVKDYLIAYRKVTRRLPESSDELIKRLQTDLERSRDSFKEMEHTLLRARQNHEDANRMCSDLRDKEIYYIERCERLKEKNRENEKRVERLKKRLLKWEKCPNVGEAGNTGEDESLQELSDEVGNLHIREMELRAQRRELITRVARLEREMYKYNSTENSFKSRLGEKGAWRKIESEFERCARTYFGRDVEVVSRKEAQEIRQLQIKALVDENYAQSGAWKEMMAATEAKFAMSGETMPDAGKLENEEVETGTEPAAKDEVEMIIEGIASLDEMGASLDRYKKETSEMIEKYKANEEKTEGFWNRLRSMFC

SEQ ID NO: 9686 - protein, 540 aa, B.fragilis
NMKTIKFKYLLPCALLGMMLGVASCVNDLNTVPLDKDELVSDVVFGNEPLAYEQSLAKIYAGMAIGGNSGGDSDQDVVGIDGGSQASFLRVLWNMQDLPSDIAHCAWNDPGIPEFNHISWGASSPWIKGSYYRLFYQINVANAYLRETTEDKLDARGCDASLKASIKTWRAEARFLRALSYEYALDLYRNVPFVDENSPIGSIPPKQIMAADLFNWIEKELTECVEDMLEPTVGYSQDYGHANKAAAWALLSRLYLNAETYVGQNKYTECITYAKKVIETGYQLEPVYVDMFKADNHLSNEMIFPVRYEGDQTMTWGGMTAFLCWGATATQEEVNAKGAWQGVRAKSSLYNLFLKESGSDADTRKAMLRTDLTTSLEIIDENTFQNIGIPVTKYFNVNKDGTLPPSKEAYVDFPLFRLGEIYLTYAEAVLRGGQGGDRATALRYVNDLRKRAYSDKTLAPISDSDLTLNFIIDERGREFFFEGQRRTDLVRFGLFTTAGYVWPWKGGTAKGKAVENFYNVFPIPSDDIGSNTNLKQNEGY

SEQ ID NO: 9687 - protein, 133 aa, B.fragilis
RLRTFICFGAANIMYYSEIIAMFAEIINLKIKNMLIYNTTFQVDDEVHDNFLIWIKESYIPEVEKHGALRAPRICRVLSHRDEGTSYSLQWEVDDSGVLHRWHQDQGARLNQELVKIFKDKVVGFPTLMEVLE

SEQ ID NO: 9688 - protein, 150 aa, B.fragilis
KNTTMTNNESERELVLQTLRTWMAFRQAVQRVLKRHNVDMTFEMLQVMNCLWNKQGISQQSLAEKTAKDKACLTNLINNLEKKNWVIRKEGPSDRRNRLIFLTPQGEELALTVKPLINDIYAQTGAEMEASRITECIEDLKRLHEVLNEI

SEQ ID NO: 9689 - protein, 359 aa, B.fragilis
KKSAMSTRQIKLKQLRRLKFRNIFLNTVCILLALAGISWTVNYFWKYARYEITNDAVVDQYIAPLNIRIPGYIKEVRFTEHQYVHAGDTLLILDDREYRIRLKDAEAALMDALGSKEVLNSGIRTSGVNVAVQEANIAETLAHLSQQEAELNRYTRLLKKQAVSQQDYELAKANFEATRARYNALLRQKEAAQSQYSETSKRSTGAEANILRKEADLEMARLNLSYTVVTAPYDGYTGRRTLEPGQFVQGGQTLSYLVRGNDKWVTANYKETQIAHIYIGQKVRIKVDAFSGRTFHGTVTAISEATGSKYSLVPTDNSAGNFVKVQQRIPVRIDLNDASPEEMECLRAGMMVETEAVRP

SEQ ID NO: 9690 - protein, 431 aa, B.fragilis; identical to SEQ ID NO: 6067

SEQ ID NO: 9691 - protein, 64 aa, B.fragilis
SYLLTFTRGPYGSMKVSPTFSPTLKTFHQRLLADFGDAITTDRTGMQFMIGTTTVTRYDKKEIH

SEQ ID NO: 9692 - protein, 66 aa, B.fragilis
GFPYKSIYCFWKAVFYFDASVGEGFGRIISMISFSMPEWCMAYPFQYFSIRPLGAINIKQGMDFIP

SEQ ID NO: 9693 - protein, 190 aa, B.fragilis
LAVYSNNAKYRYMENFSELIKNRRSMRKFTGEELSQEDVVALLKAALMAPTSKRSNSWQFIAVDDKKLLSELSHCKEQASAFIADAALAIVVTADPLASDVWIEDASIASIMIQLQAEDLGLGSCWVQVRERYTATGIPSDEFVHGVLDIPLQLQVLSVIAIGHKGMERKPFNEDHLQWEKIHINKFGGK

SEQ ID NO: 9694 - protein, 954 aa, B.fragilis
SMKYLTFPFLFLLLPLIGFGCSSEEKETDSLILSSDSEIFFEQGIDFAATSGTRNLSFSSGRPWRISLTTDTDTRRAADWCTVSPFSGTAGDASVTISIQENADYDSRSVKLTLVAGGIEKSFTVSQKQKDALTLTASRFEVGKEGGTVQVEVKANITFEVEIPEVDRSWISQANTRGLVVTNLAFTVAPNEGVAGREGEIVIRSGSLSEKIRITQEGRCDDGLSFRPETPDADRQLTLYFKATKTSPLYGYAGDVYVHTGVVSEGTWMYVPAEWNTNVDKCKMVRVADNIWSITLAPSIRQWFGSNETPVRQLGVVIRSADGSKKGMDGDSFVSVTDHLYKPFEPAAVRYASMPGGLQEGINLIDASTVTLVLYDKDKKGGHKDFAHVVGDFNDWKLSNESNSQMNRDDAAGCWWITLTGLQPTREYAFQYYVGTRAGEILRLADAYSRKILDPDNDKYIPSSTYPDAKEYPKGAVGIASVFKIQRDSYEWKVKNFRILDKNNLMIYELLLRDFTATGDLNGAMEKIGYLKSLGFNAVELMPVQEFDGNDSWGYNPCFYFALDKAYGTDHMYKAFIDKCHEAGMAVLFDVVYNHASGSHPFARLYWDTKNNRTAADNPWFNVKEPHPYGVFHDFNHDSPLVRAFVKRNLKFLLEEYRIDGFRFDMTKGFTQNSSTEATAGSYDASRIAILKDYNETVREVNPEAVVILEHFCDEKEESELAEEGMQLWRNLNNAYCQSAMGYPSNSDFTPLVTFGTTMPYGGWVGFMESHDEERTAFKQIAYGEGPLKSDINVRMKQLAANASFFFTAPGPKMVWQFGEMGYDVSIEEGGRTGRKPLHWEYLDNEARKGLCNTYAKLLKLRREHSELFNPGSTFSWLVKTANWTGGRFLTLAATNGKRLVVVGNFTAKPIEAITSFPVTGVWTNYLDGTKLHVTSIPTGLTIPAHECRVYINF

SEQ ID NO: 9695 - protein, 402 aa, B.fragilis
PLLQKIKKGIIMEYQRIWLLVLFCLSSWDMHAQHFVIEGKTNGYVPDGSILYLGRWNGMGAMIYFTSDMIRNGTFRLEGKREKTPDIIYLYGTEKAIGTLNLRLWVGDDTIRVSANSEVPETWIVENNMPQQAEEDFYRQLKGKDNIIKTSRMNSRQLWDRSLTPDSVRILTNQIIQNDLPGQIRILSHLHKQPKLTDTGLVYFFLSSGYAHWMTNPKHLCMGREIYGQLTGKQKQTYYGKFAKSYFYPDKTPEKGDYYIDANLFDLKGDSCKLTDYLNKGKYILLDFWDLYCAPCKKSVPGLKELFSSCADKLTIISINVGSRESQVKGSSDFLWENLSDGQGLTGIASRYGIKSIPCFILIAPNGRIEKYWKGYAMHHSGMEKEIMEIILPNPSPTEASK

SEQ ID NO: 9696 - protein, 337 aa, B.fragilis
SIKHTMSDAYKIIHNFMAFIASPDLKNKVWTWLLDPSGKQRKEEALLQIWDEYRPEADAGTRHSLRKFQKRAGLSSARPAYLHRWAHIAAILLIPLISIITAYIYVEHHTQEVRFVECIVPKGEQKQITLPDGSIITLNSGSVFLYPTQFAGDTRSVYLSGEGHFAVAPNKKLPFVVATNHLDICVLGTQFNLQAYPFDRRTITTLESGSVAVRKKNQPNSFITLEPNQQLDYENRSGRFNKTDIDASVYSGWTKGEMNFISQSLREILRTLERSYAVSIQLSSDLMESNRINSDLYTIKFKRRDDIFHVLDIVTKTVGGITYKVEKDESISICPLK

SEQ ID NO: 9697 - protein, 397 aa, B.fragilis
PMEHKISEPNARVDVADVLRGLAVMGIIILHSIEHFNFYSFPDTVPCEWMKFTDKVIWNGLFFVFSNKAYAIFALLFGFSFYIQDNNQQRRGKDFRLRFIWRMALLFIIGQFNAAFFTGEILTMYAMLGLILPLSCRLSDRSIAIFATLLIIQPIDWCKVIYALCNPDYVAGPGLASHYFGIAFDVQKNGTFLETIRMNLWEGQLANLTWALEHGRILQTPALFLFGMLVGRKGLFLYSEQNEQHWLKALGISLICFFPLYGLNNMLPEFITRNAIRVPLQLIISSLSNLSFMVLLVSGLLITFYRIKDRRFLMRFTSYGKMSLTNYIGQSVIGSLLFYHWGFELGRFLGITYSFFFGILFVLLQMAFCSWWLSHFKHGPFEGLWKRLTWIGNNKRK

SEQ ID NO: 9698 - protein, 421 aa, B.fragilis
SIMQTIDNFNFAGKKAFVRVDFNVPLDENFNITDDTRIRAALPTLKKILADGGSIIIGSHLGRPKGVADKFSLKHIVKHVSELLGVEVQFANDCMGEEAAVKAAALQPGEVLLLENLRFYAEEEGKPRGLAEDATDEEKAAAKKAVKESQKEFTKKLASYADCYVNDAFGTAHRAHASTALIAKYFDTNNKMFGYLMEKEVKAVDKILNDIKRPFTAIMGGSKVSSKIEIIENLLNKVDNLIITGGMTYTFTKAMGGQIGLSICEDDKLDLARELMQKAKDKGVNLVLAVDAKIADAFSNDANTKFCPVNEIPDGWEGLDIGPKSEEIFAEVIKNSKTILWNGPTGVFEFENFTHGSRSVGEAIVEATKNGAFSLVGGGDSVACVNKFGLANGVSYVSTGGGALLEAIEGKVLPGIAAIQE

SEQ ID NO: 9699 - protein, 83 aa, B.fragilis; identical to SEQ ID NO: 6082

SEQ ID NO: 9700 - protein, 229 aa, B.fragilis
EQTKMTKKERYEKVIAWFQENVPVAETELHYNNPYELLIAVILSAQCTDKRVNMITPRIYQDFPTPEALAATTPEVIFEYIRSVSYPNNKSKHLVGMARMLVNDFNSEVPDTLEELIKLPGVGRKTANVIQSVVFNKAAMAVDTHVFRVSHRIGLVSNSCTTPFSVEKELMKNIPDELIPIAHHWLILHGRYVCQARTPKCETCGLQLMCKYYCEKYKVSKDTPKRKNK

SEQ ID NO: 9701 - protein, 69 aa, B.fragilis
VMNKDNLLLYTAVIFLFIKRDKSVGLVLLGLWLVLNIGLIVSLLGSMSGYLLPLALLIIGGILYLISTR

SEQ ID NO: 9702 - protein, 723 aa, B.fragilis
LTHKIMKLKIKLRNILSVKIHKIVLLLLALCIYNTAYGQNQRISVYGNNQSLQKVFEQIEEQTQLSITYNQTRLDVNRKIKGNFVDKELSFVMDALLKNTGFTCRYEAEHIVITPVEQKKEKAAAGQATQMKKITGKVTGVTGEPLIGANVLAVGGKQATITNLEGEFSLEVSDNSKLQVTYIGYLPQEVSTNGKTHFVIQLKEDSQLMDEVVVVGFGTQKKVNLTGAVTAVNIQETLGDRPITNVTAALQGVVPGLKIEGTTGTPGDNLSYNIRGTTSINGGGPLVLVNNVPMDINMIDPQDIESVSVLKDAASAAIYGARAAFGVILITTKQGKKDMAPKFNYNNNFSFSKALELPQKAGPLESILAYKEMGWPNDTYVDGKNIPQWETYIRDYMANPSQYPNGYVFDEDGNLFLMRENDMFADMMDNYGFMQNHSFSVSGGSSRTNYRIGLGYTNEDGILITDKDRYERANLSSFLSVEVNKWLTTQLDIRYANSTQNKVEQGGRNGIWGSAMQLPSYQNISPYEEDGIIYPAETSATYIRYGEPRIVKKTDLRALGRIIISPLKNLKITGEYTYNRVTNYNRMYVNQYKYIGMNFTGVLNNTENTRYALTQGFTNYNAINIFANYDFSIGNHHISVMGGFNQEENHAESQWTERKDVLLSNLPSISGATGTTTATDTFNEYALRGLFYRVNYSYKDRYMLEANGRYDGSLHHEAGRDPG

SEQ ID NO: 9703 - protein, 343 aa, B.fragilis
FTNNKLLNKMVNYKDLGLVNTRDMFAKAIKGGYAIPAFNFNNMEQMQAIIKAAVETKSPVILQVSKGARQYANATLLRYMAQGAVEYAKELGCKNPEIVLHLDHGDTFETCKSCIDSGFSSVMIDGSHLPYDENVALTKKVVEYAHQFDVTVEGELGVLAGVEDEVSSDHHTYTEPDEVVDFVTKTGCDSLAISIGTSHGAYKFTPEQCHIDPKTGRMVPPPLAFDVLDGVMKELPGFPIVLHGSSSVPEEEVATINQFGGALKAAIGIPEEELRKAAKSAVCKINIDSDSRLAMTAAIRKVFAEKPAEFDPRKYLGPARDNMEKLYKHKIINVLGSDNKLAE

SEQ ID NO: 9704 - protein, 677 aa, B.fragilis
VDNNIYNIEKNMKMNYLAFIGVTAATAVVSCTPAKKEYASYELYPVRSGSLTEMEYSPESTKFTLWAPTADEVRLMLFDSGEGGHAYETIPMEPGEEGTWMATVSKDLMGKFYTFNVKVNDKWMGDTPGINAKAVGVNGKRAAIINLKSTDPQGWETDQRPPLKSPADAIIYEMHHRDFSVDSTSGIQHKGKFLALTEHGTMNSAKLLTGIDHLIELGVTHVHLLPSYDYASVDETKLDENKYNWGYDPQNYNVPDGSYATDPYDPAVRIREFKQMVQALHKAGIRVVLDVVYNHTYNTDGSNFERTVPGYFYRQKPDGSLANGSACGNETASNRPMMRKYMIESVLHWIKEYHIDGFRFDLMGIHDIETMNEIRKAVSAVDPSIIIYGEGWAAEAPQYPGDSLAMKVNTCKMPGIAAFSDEMRDALRGPFNDNHKGAFLAGIPGEEESIKFGIVGAVSHPQVNNDSVNYSKAPWASQPTQMISYVSCHDDMCLVDRLKSSIPGITPEQLVRLDKLAQTAVLTSQGIPFIYAGEEVMRDKKGVHNSFESPDSINAIDWNRKTTHEDVFAYYKRLISIRKAHPAFRMGDAEMVRKHLEFLPVDVGNLVAFRLKDRANGDTWDNIIVALNARSVPAKLAIPEGKYTVVCRDGVIDERGLGLLYGPEVTVPAQSALIIHQ

SEQ ID NO: 9705 - protein, 452 aa, B.fragilis
LADNKTIRPMRTRTMKPLFLIFCLCLSPLLMGQNQNKIQEAMANYDYETAVELINKEPPTIPLLMQKAKALKGIGSNAEALRSIRQVIAEDSTNQQAHIEAAECCKAMAKYNDALDYYRKAISLNPKNKYARLQFINLLCNTKNYAEAFGESSMMSETDSSAVVLHLQAQSLEGMQQILPAIGCYEVIQDKYPDDYLAAAKLGNLNIVAGYPEYAIQATERYRERDSTNLIVNQQNALAYCHAEQYPTAIKRYEKLCQQGDSSTQTLYYLGVSYYADEYYYEAHACFSKLQKEMEENPNLLYYLGRCCAKTSWKKEGIEHLEKAIELTIPKDSTMIRLYKGLVDCCKLAQDTPKQIQALRELYKYDKTNHKLLYDIAWNYSYQLKDNKSAERYLQAFLKTRKANARKEEPVSEKGELVLGLENYYNAAENWLKDLQKEKFFKEGIPLESQKQ

SEQ ID NO: 9706 - protein, 131 aa, B.fragilis
IMKKILLLLSVCISFSSCCTLFSSSKQDITFTGMNGTKIYEASTKQKIAEIKEDNSVTVQIKKKREDKQLVAKKEGYQTTPFVLESTFNNACLWNILFWPGFLVDLGTQKMNKWDNTIINIEMEKENTENK

SEQ ID NO: 9707 - protein, 167 aa, B.fragilis
LQKNFFIKQELIFFVLFYTIPKRRLIPKFKNIVMKISHIEHLGIAVKSIEEALPYYENVLGLKCYNIETVEDQKVRTAFLKVGDTKIELLEPTCPESTIAKFIENKGAGVHHVAFAIEDGVANALAEAESKEIRLIDKAPRKGAEGLNIAFLHPKSTLGVLTELCEH

SEQ ID NO: 9708 - protein, 425 aa, B.fragilis
KVRNNRIYPLMKHWILLLYLGFSVMLRAQNTASVQEAMANYDYKTVIRLIDEESASPQLLIQKAKALKGLGRTAEALSTLQHIIIELPENQQALVEAAECCRQLSKFNEALGYYRKVMELNPEHIYAHLQYTRLLYNYQRYGDALRESIALARKDSSATVLRLMAESMEGAGMPVESMFCYLSIIRKYPSDYLSVAKLGSIFNTMKDYEGAIALTEAYRRTDSTNVEVNRQNALAYCLRKEYPTAIKRYQDLTARGDSTLLTCYYLGVSYYATKEYYKARDWLLKAKSCQSPGANLLYYLGRSCSKTLWKQEGIGYLNQAIALTIPADSIMERLYSGLADCYRQTKQTRDQIKATKEQYKYAPDKHILLYNLAFLSDKIEDTKATEHYLQAFLRTKSKQNAVLQQPDDDEEEPAPYIDYYKSATN

SEQ ID NO: 9709 - protein, 443 aa, B.fragilis
RSSKRPIKFYCRRHEHRVSQGFLKIKKRLFVRLCVTLRSNQNHHTMSKDRLVTPSYVLILAANFLLYFAFYLILPVLPFYLTEIFQTGNAAVGVILSCYTVASLCIRPFSGYLLDTLARKPLYLIAYFLFITVFAGYILAGVLSLFIMLRVVHGLAFGMVTVAGNTIVIDITPSSRRGEAVGYYGLMNNTAMSFGPMIGLFMHDTCSFETIFLCSLLSGTVGFAAACLVKTPVKEPVKREPISLDRFVLIKGIPAGVALLLLSIPYGMTSTYIAMYAKEIGITLSSGLFFTFMAVGMAVSRMFSGRQVDKGRITQVITLGLYLVCACFFTLAACGKLMSLSPELTDVLFFMVALLLGVGFGTMFPAFNTLFVNLAPNSQRGTATSTYLTSWDVGIGIGLILGGYIAQLTSFDMAYFFGACLTVVSTFYFNLKVAPHYHKNKLR

SEQ ID NO: 9710 - protein, 349 aa, B.fragilis
RKSNNNKSQDMIAKINQLLEEVGALKAANAEELEVLRIKYLSKKGAINDLMADFRNVAAEQKKEVGMKLNELKTKAQEKINALKEQFDNQDNGQDDLDLTRSAYPVELGTRHPLSIVRNEIIDIFARLGFNIAEGPEIEDDWHVFSALNFAEDHPARDMQDTFFIESHPDVLLRTHTSSVQSRVMEVSQPPIRIICPGRVYRNEAISYRAHCFFHQVEALYVDRNVSFTDLKQVLLLFAKEMFGADTKIRLRPSYFPFTEPSAEMDISCNICGGKGCPFCKHTGWVEILGCGMVDPNVLDANGIDSKVYSGYALGMGIERITNLKYQVKDLRMFSENDTRFLKEFEAAY

SEQ ID NO: 9711 - protein, 97 aa, B.fragilis
FLCDQSSGNNNNKTIVVLPEKIVSWAVTNPPGLWGFLEILLHGACSGSKVLIVMLNERPRWPPLTPPSDTNFSKQMLTMEGTLVSQGFEFSLHAHLF

SEQ ID NO: 9712 - protein, 60 aa, B.fragilis
HYRLRFLSCFVYSVVYRYTLWQILEKTKWGSPHGFPHFNDEIFTIFINWVWRVSDSNRSP

SEQ ID NO: 9713 - protein, 733 aa, B.fragilis
IMNEQLINEQYQYILRLIGQKRLKEALTQLESFLWKCPEWSLRTRLEQIQTSYSYMLQYMRQGIEDPERRKLYQKLLTDTLEITDQARITLLDSVSNHYYHQYRTRLSEEVSPLTLEMLMHTLESFNDDLAVSGFVSDQNMEEVLKRHEDSLKTLFLQTWTHTNWTAEEVAAAQAMLQSELLPVNDLCLFTSAVTLSVMECFDLKKLLWLIDAYRHPNVQVSQRALVGITFILHAYSPRISFYPEINLRITALMEETAFERDLLRIHIQILLSQETEKIDKKMREEIIPEMLKSMSPMRNMKFGFEESDEEKDDTNPDWADAIEKSGLGDKLREMNELQLEGADVYMSTFSQLKSYPFFRDISNWFYPFDKQQSDVIKEFRHRGKEGGSLLEIILQSGFFCNSDKYSLFFTMQQLPQSQRDMMLNQLTDQQIEELADQSKAETLKKFSERPDTVSNQYLHDLYRFFKLYARRLEFRDLFKESICLYNEPDLIDILFNPEAMEAIANFHFKKKHWEEAAEAYDTIVDMLMDEEEAEICQKQGYSLQKLKRYDEAIKAYRKADILKSNNVWTNHHLGTCYRLNRQFKEALKYYRKVEEVLPEDTKVIFYIGSCLAEMWNFEEALNYFFKLDFLESNCVKAWRAIGWCSFMIAKREQAMKYYDKVIDQSPMPVDYLNAGHVAWSLGNVEKTLSLYTKAAELYGSKELFLEVFRKDEEIITSKGVTPDDIPLVLDLI

SEQ ID NO: 9714 - protein, 508 aa, B.fragilis
KLMDMTTSSQKDIINDILSAMQCYPENEAFIIDDKHYTYAQLGEITASITHSLSEIKDEKIGIVAENRIETYAAILAVLAGGKTYVILHPAYPEERNLKIAALAGLRTLLCTSDTDRSAFGTGHFRIIDTDRLPGKTLSEQQSHSSDEEGNAYIIFTSGSTGEPKGVPITRANLNAFYRAYSSLDWNLDEHDRMLQMFELTFDVSVVSLLYPLTLGAAVYTVGHQDVKHFKVFELLEKYQLTFATVTPSLLQLLSPYFDEINLPSLKYLGVSAEASQIELLERFRKSAPNATFINLYGPTEATIYCTCYRIPASDKCKHYNGMVAIGKPFPGIRAIIADEEGNELPQGETGELWVSGRQVMKGYLDDPEKSALVLIHRPDGQIYYRTGDLCILDGDGDIIYCGRKDYQVKIQGFRIELSEIEYTAQSFFKTPCSVAAVPLLCDGICNELHLAVETTECTQSALIEYLKEKLPKYMLPKQIHCISQFPVTNSNKTDRKKIAELIKEKKL

SEQ ID NO: 9715 - protein, 173 aa, B.fragilis
TIKDMKTITFFKRVLASAALVSVCGFACATNNGKQFIHNDTMEGGKLVCREIYAMNDAASGILNPVKMYKYSYDTDQQKTVKSTYAWNIFKNTWETESRTVISRYETETSVEYSVWNKEKGSFDLSKKYIYITDNNNQLIAQYAYKMNSRTNQWILEKDALTPIYENIYATTR

SEQ ID NO: 9716 - protein, 72 aa, B.fragilis
TGGCQEHGEYHEAISDDGFMQKEWFQADKGFALCTLPMDEESYQERDDEYIYSDLRGCEPIECFPVGKCIER

SEQ ID NO: 9717 - protein, 60 aa, B.fragilis
PFLLFLLLYEDRRGDSGGFLLFAVNELKILVANLILIVNKLKWIVFGEQFPLRSGFRAKK

SEQ ID NO: 9718 - protein, 285 aa, B.fragilis
LWLRKTDNPLRDCLLPSAKASAYFLPLLSNAAKSIAPAEYLITEADKERIFGEMLEHLTTEALRNSFLIEFRNLENAMFGYKYFRSNRYFPVNWLRVRNSLHGIENAEQRFSPSRIRQIKKGLKNGAKVDEARTVEEIREFSNMLRHLYSSRIRKHFPNIIFFQHMDTRLIHSRQAKIFIVRYKDKIIGGSACIYSGNDAYLWFSGGMRKTYALQYPGILAVWKALQDAHQNGFRHMEFMDAGLPFKKHGYRDFVLRFGGKQSSTRRWFRFRWQWLNDLLIKIYV

SEQ ID NO: 9719 - protein, 246 aa, B.fragilis
TQDRTWNVGDNISYNKNKITKMTFNDDPNYAGVIHGGIDGGTGYNALIHRVGEAFNSFYVFEQIYGPDGKPIEGAYVDQNGDNQINDADLICFKKAAPDVFMGLTSQLSYKNWDFSFALRGSFGNYVYNNVQSNREAYEGANMYDQTGFLKNRLTSARSTDFKNAQYRSSYYVQNASFVRMDNISLGYTFNKLFNDKQSARVYATVQNPFVITKYKGLDPEISGEGIDNNIYPRPRVFMIGLNLNF

SEQ ID NO: 9720 - protein, 97 aa, B.fragilis
KDCRTDKREETLKTIINMNREEVLKQLQSIFRNILKKDNVCIDESSTSKDVDGWDSLTHMQIIAQIEKHFGVRFNFREVIKFKNVGDLCSALLTKME

SEQ ID NO: 9721 - protein, 540 aa, B.fragilis
KRKRSALRLMVKLNLPTRPWVPQWLGIVTMFIVIFPITLLNGAYTGSMVEVSNTLGVLSEDITMAYYSASVGMAVAYPIVPKIRTIATPKTLLLTDLLLQIFFSLVCAKTGSMDVIMVCSFCMGFLKAFVMLEFIILIRPLFSPKNVRSEFYAYFYPIVFSGGQLSMAITAQLAYHYQWQHMYYFVTILLLIAILFVICFFRYARRPMHIPFKEMDGRSMFIIATAFLLTLYTFTYGKTLDWFASPKIRVYVFVIPLLIALFIHRQRTQGKPFVSLKPLFLHKSIIGYGFMVLAMFLTATSSLVTNYMNSIIRVDSIHANSLSLWLLPGYVVGAVICFWWFRWQRWRFRFLISGGMFCYVIYLAILYFGITPYGTYEMLYLPILFRGVGMMVIFIAFGVFVVEDLDPRLTLSNAFFLISFRSVLAPVLSASFFNNMLYYLQAKGMNILSENMTLTNPLAEQKYNQALSNALAQGHEFSEAGQLAANSLYSTLQQQSLLLALKTLIGYVLILALVIAVIAAFIPFHKTLKVAVVKTGDDMV

SEQ ID NO: 9722 - protein, 310 aa, B.fragilis
IRRLGIARIVVGAEHRPDCFVAWFDVRLSAAFGFIDNRRYIVFDFNTMKRSIEDTPIVFIGAGNLATNLAKALYRKGFRIVQVYSRTEESARELAQKVEAEYTTDLAEVNPYAKLYIVSLKDSAFAELLQGIVEGKREEALMVHTAGSIPMNVWEGHVSHYGVFYPMQTFSKQREVDFKEIPFFIEASSTEDAAFLKAIASTLSNRVYDADSEQRKSLHLAAVFTCNFTNHMYALAAELLKKYNLPFDVMLPLIDETARKVHELEPKTAQTGPAIRYDENVIGNHLRMLADDPAMQRLYELLSRSIHERQ

SEQ ID NO: 9723 - protein, 175 aa, B.fragilis
IKMSTINYDLTRIKALVFDVDGVLSANVIPLHPSGEPMRTVNVKDGYAIQLAVKKGLRIAIITGGRSDVVRKRFIGLGVSDLYFGSAVKIHDYRGFRDKHGLTDEEILYMGDDVPDMEVMRECGLPCCPKDAVPEVKAIARYISYADGGYGCGRDVVEQVLKAQGQWLSDDAFGW

SEQ ID NO: 9724 - protein, 63 aa, B.fragilis
QESGGDDEHASSVHLFERNVHGTPCIAEETDDEQNGDQQEDGDKIVHVLPLVVIGQLSGDSHR

SEQ ID NO: 9725 - protein, 624 aa, B.fragilis
FSMGKPQRRARPDGDCIPLRNKIHPLFYIDSTQWANRKILERICHAPLRHGERDHGNYSPKSLTYRSIKVKNSFPEAIYTFIGKTLWHNRRKNSAVGNFFRIFVTSNHKFTKKDTTMKRLTILFMLFLTSCILYAKDRKGNDLSGPIALKGELTEKYQNYTKGTPVVIRGVRKMRISPDETAGITYAVEIDGLQYPVGAEEAGKIIRLKPATVLEYWQGVYLSQGMYDYYNRKGYRYKMRQELDEECLDYLDKLNEIAYKDAYIQDYVQAIFAKVNPGEIDTNRPERLNVRIIQSPEPDAYMLPNGAMLVSTGLLCTIDSEEELEAIIANEMVHFILDHQVDNVSRAETRAKRAAFWADVLGTVAMAADDTNWMYGYDERVGAIELAASIGTIAALINVRTVNRLGMDYSSKQELQADRIARDYLAFKGMNPNALSSAINKIKEFYGSVHRYDNLTRYGSYGLLKERLAKLGETEGIHSHMFEKMTSDIVTFNAAMYQGDKRYKMAEQLAQKNIDNRVASDHDYVILVKARMAQENTPESNEACMKLLEKAREIATARNLDINKQEILLLMRMNKQAKAADKLKEYLDLLAEYKQQNDMNTQESEWIGEELDWASKMLSKISLL

SEQ ID NO: 9726 - protein, 61 aa, B.fragilis
CTFFINQSDHRFIVIVCHCFLNGGGVLGSQHYAEAQIEEEYPMFHEGIDSIVSDFLTVFLL

SEQ ID NO: 9727 - protein, 620 aa, B.fragilis
  UNSURE (367),(382): Identity of amino acid sequences at the above locations are unknown.
RANIMKKLLLLLGSFLLSLTTYAAMNISKIDPPFWFTGMNNPELQLMVYGEGIGQASVSVNYPGVSLSSVVKLESNNYLLVYLHLDKEVKPGKMPITFTVGKKKLVKEYELKARSKAGVDHKGFDASDALYLLMPDRFANGNPDNDRIEGMAEYKVDRNDPNARHGGDLAGIEQNLDYFTDLGVTALWFTPVLENNMKGGSYHGYATTDYYKVDPRFGTNEEYRSLIAKAHNRGIKVVMDMIFNHCGVEHPWIKDMPSKDWFNHADFKNNFVQTSYKLTPHVDPYASEYDFDQMNNGWFVEAMPDLNQKNPHVYKYLLQNSLWWIEYADIDGIRMDTYPYADYDAMSNWMKELNEDTPTTTRWAKPXLPKPPIQPGGRKELXNFRPGNKYLKTSMNFNFSDKVNTAKNEQTDTWFKGWNRVYNNFVYDYLYPNPASVLAFIENHDTDRFLGEGENLDMLKQASTLLLTTRRIPQLYYGTEVMMNGVKSKSDGYVRKDFPGGWTDDKENALTPEGRTRLQNESYNFYRNLLNWRKGNDVIAKGSMKQFMVQHGVYAYARQYKGKTVFVLLNGTDKEVKLPLKYYAEVLKDKTQGKDVISGKVTALNEELTMAPRQSMVIEL

SEQ ID NO: 9728 - protein, 88 aa, B.fragilis
KTNIKMKKGLHPESYRPVVFKDMSNGDMFLSKSTVATKETIEFEGETYPLLKIEISNTSHPFYTGKSTLVDTAGRVDKFMSRYGNRKK

SEQ ID NO: 9729 - protein, 190 aa, B.fragilis
IICIMKFIRKFPVTDADSLESPQKFEGFFLDYYPRVKGFINGLLQDAEEAEDLSQDIFMSLWQNRGNLKQIDNLDAYLFRIARNAVFRYIERSLLFKNYQSRQLSDDNSDLYEIESELNAKELELIIAIAVERMPSQRRKIYQMSREQGLSNENIARELNISKRTVENHLTQALADIRKILFWVIMATFV

SEQ ID NO: 9730 - protein, 283 aa, B.fragilis
NLSIMKRFLVLSCSVAISALFFHACSSSDDSMIDAPLTRADAVSEKIVFQDDFNQADSIPDRNKWSLCKKGSPAWSKYLSESYDQAYVHDGKLVLVAEKVNGVYKTGGVQSLGKAEFQYGKIEICARFTKTAKGGWPAIWMMPAKPVYSGWPACGEIDIMEQLNHDGIVYQTIHSHYKNDLGFTKPVPTKTVSYNKGQFNIFGIEWTPEALTFKVNGAATLVYPNLHLADESVKKQWPFDTSFYLILNYALGGPGTWPGTITDSELPAKMEIDWVKVSQPTGR

SEQ ID NO: 9731 - protein, 520 aa, B.fragilis
EKLMSNQLEKVKELIELRAQARLGGGEKAIEKQHAKGKYTARERIAQLLDEGSFEELDMFVQHRCTNFGQEKKHFLGDGVVTGYGTIEGRLVYVFAQDFTVFGGSLSETMAQKICKVMDMAMKMGAPVIGINDSGGARIQEGINALSGYAEIFQRNIMASGVIPQISGIFGPCAGGAVYSPALTDFTLMTEGTSYMFLTGPAVVKTVTGEDVSQEDLGGASVHASKSGVTHFTAETGEEGLAIIRKLLSFIPQNNLEEAPLVNCTDPIDRMDDLLNEIIPDSPNKPYDMYEVIGAIIDNGEFLEVQKDYAKNLIIGFARMNGQSVGVVANQPKYLAGVLDSNASRKGARFVRFCDAFNIPLVTLVDVPGFLPGTGQEYNGVILHGAKLLYAYGEATVPKVTVTLRKSYGGSHIVMSCKQLRGDMNYAWPTAEIAVMGGAGAVAVLYAKEAKDQENPAQFLADKEAEYTKLFANPYNAAKYGYIDDVIEPRNTRFRVIRALQQLQTKKLTNPAKKHGNIPL

SEQ ID NO: 9732 - protein, 146 aa, B.fragilis
NEAMKQYKYKINGNLYNVTVNDVEDNIANVEVNGTSYKVELDKPVKAAPKPVTRPAAAPKTETGAPVVTKQPTASKKDGVKSPLPGVILDIKVKEGDTVKRGQTIIILEAMKMENNINANKDGKVAEIKVNKGDSVLEGTDLVIIE

SEQ ID NO: 9733 - protein, 352 aa, B.fragilis
PKPFTRMLHHSSRISPKTRFCLKLLLLILPLIPIVVVYFMFDPYRVLHPYKRFDDSPMLLNEAHVGWQNYLQNRDSIAYNSFILGNSCTMAFLTGEWEKYLDKNDHAVRFYDNGESLGGVRQKLQLLDSVGAPLKNILIVLDKKSLDKNAPLSGNNHLFSAEAAGISQLGFQLRFLQEFLYPDRMIPYIDYLIRHKYAPYMKGVINPGDPVREPYTNNFINPREKEIAQDGEIYWSRHEKEFKKRTNAGMEELPVIFASQIQVLRSIKKICDKHHTNLKFVIGPDYYQKKASREDIKILKAILGDSAVWDFTGINEYTADIHHYYEPGHYRPLLGARLLKAIYQDQDTCHRQ

SEQ ID NO: 9734 - protein, 538 aa, B.fragilis
KQRIKIMKKIYFYTLLLGLLAFTACEDEKSPVMELQKASAFEPFSQSDFTFNDENAAAEFPEIKWTAADYGVKAVVNYDVTLTNDANAKTVLLGETGTTSLKFTNGQMNTMMAKVGAYPGQTYNFTITLTSKAYDMTADPASNSITFKATLFDPNAVDWKFAYVAVGYPDWDYTNAYLLGDPDGDGVYQGYANFDADGVSYAIIDGSDLTKILAKDQTAAKKGFYGIKVDAEGKVEQTEPLVWGVVGDATSGGWDKDTQMDYDATTRLWTVTTSLLDKEFKFRSNNNWDSDNYGAVSGKESELEGELVAGPNNFKVLKASPYVITMNLTNAGKYSYSMVETTIELSSAEMALPGSYQGWDATKDDCYKVQSAARDFIYTGTFYFDADTKFKFWDAGVWIGMMGPISWDEAKNIGTFVLMPSDGDNIKIETAGYYRVGADMKKLTASLTKTGWEIIGDATPGGWDKGTVMNYDPATKLWSVDVTLVAGEIKFRWDGAWTVNLGGSLGALTQDGANMKVTAGAYTIVLNPDAKTATMTKK

SEQ ID NO: 9735 - protein, 210 aa, B.fragilis
CFRMVISSIYLIYLFISMLANLDRYKIVLASNSPRRKELMTGLGVDYVVKTLPDVDESYPDTLQGEEIPLFIAREKAAAYQSMIGPEELLITADTIVWHEGKALGKPVGRQDAIEMLRSLSGKSHQVITGVCLTTREWQKCFAAVTDVRFAILDEDEIAYYVDHYQPMDKAGSYGVQEWIGFVGVESISGSYFNVMGLPIQKLYRELKQL

SEQ ID NO: 9736 - protein, 200 aa, B.fragilis
SSRISHIDGGIGVIQPVKEKIILGIDPGTTIMGYGVLRVCGTRPEMIAMGIIDLRKFGNHYLKLRHIHERVLSIIESYLPDELAIEAPFFGKNVQSMLKLGRAQGVAMAAALSRDIPITEYAPLKIKMAITGNGQASKEQVADMLQRMLHFAKEDMPVFMDATDGLAAAYCHFLQMGRPVMEKGYSGWKDFIAKNPERVK

SEQ ID NO: 9737 - protein, 118 aa, B.fragilis
KFIVSELKILCKSKNNPLNRETLGRKYPFEERNSILFQIISHPLRAVCNVYVANKGFLLFPHIYNGRQMIAVTIQPHSATICTQGCTLIFTILLKQVIAHENFIVIIFQSFCCLKQSG

SEQ ID NO: 9738 - protein, 308 aa, B.fragilis
TSIVMNKKRIGIFIALLAMVCMGLRAQSATSLRINEVLVVNDQNYQDDYGLHNAWIEIFNTSFASVNLEGCFLTNDKNNPTKYPIPKGDVLTLIKPRQHALFWADGMPNRGTFHVNFTLDPNKENYIALYDSNGKTLIDEVTIPAGQLADRSYAREKDGSANWVVKGEGEHSYVTPSTNNMTIDKNPKIENFKKHDSIGIGMAIIAMSVVFIGLVLLYLSFKAVGNVAVRLGKKNAMKATGITDKTEAKEKNLGSHTGEETAAIAMALHEYLNDAHDVEDMILTINKVKRTYSPWSSKIYTLRQTPKR

SEQ ID NO: 9739 - protein, 104 aa, B.fragilis
SAFSCILIVTEASPAVPENGDTVHQSAALRVSVSVVSEIRHGRPDENDRFRVPEVAAKSMPCSKKISLSEERIRESVSFSSDEQPKPISGSRRNRNGKVKYFID

SEQ ID NO: 9740 - protein, 363 aa, B.fragilis
RFISLEIEESVLIRVICGELKNKYMKKLIIAFNFLLLLAVGGRAQDHADGLYSVAFYNLENLFDTIHDTGKNDYEYLPDAAKGWNSEKYCSKLKNLSKVLGELSRDKVPAGPAAIGVAEVENWRVLDDLIRQPELAAGGYRYIHYEGPDKRGIDCALLYDPKQFTPHATALVLSTPFEGDTIHKTRGFLIVGGELAGDKVCLIVNHWPSRGAAEPVRVHAAMQVKALKDSLMRTDPDLKLIIMGDLNDDPMDLSLAVLGAKKHVEDMTEDDLYNPWWVTLEDKGVGTLLYRGKWNLFDQIILSSTLLQATKGLKYDHNEVFMRDYLFQQDGKYKGAPLRTYGGRVWLDGYSDHLPTIIYMRKQ

SEQ ID NO: 9741 - protein, 353 aa, B.fragilis
SVSSLSTLPVAKEFEPMLLIPIGFGILIGNIPFNMEAGLKVGIYEEGSVLNILYQGVTSGWYPPLIFLGIGAMTDFSALISNPKLMLIGAAAQFGIFGAYIIALLIGFEPNQAGAIGIIGGADGPTAIFLSSKLAPNLMGAIAVSAYSYMALVPVIQPPIMRALTTKHERLIRMKPPRIVSHTEKVIFPIVGLLLTCFLVPSGLPLLGMLFFGNLLKESGVTRRLANTASGPLIDVITILLGLTVGASTQASQFLTWDSILIFILGAFSFIIATASGVMFVKFFNLFLKKGNKINPLIGNAGVSAVPDSARISQVIGLEYDPTNYLLMHAMGPNVAGVIGSAVAAGILLGFLM

SEQ ID NO: 9742 - protein, 194 aa, B.fragilis
SMWPLFIHEGDNEIAMVVSNRSGAGGLLKGVRLKQEFEVIKKLNWEVSTDLGGICQDWNLGTGSTEGWSVVKLSADYPLVRKGELTGTVDGGRDALLTWYRLEFNMPRKNPSVWIPWKLIVNATGTGYMWLNGHNIGRYWEEGPQREFYLPECWLRAGEKNVIILGLRQSETKGACLFGAEVAPYTEDVECMEQ

SEQ ID NO: 9743 - protein, 83 aa, B.fragilis
TDRTLYRYRPSGRDCDCTCRNRRLIITSFKNVKCNRMKKLAILLVCAAMLASCNGLGGGSKDMKAKKLILFLMEFDPQERRIG

SEQ ID NO: 9744 - protein, 250 aa, B.fragilis
WSLTHKNAELDEMMGTFNEVQEGFRKINAAESRVDLTRGTISENSATAKQQIASDIEFITKQMEENKAQIAKLQAMLKSSKNNSAQLKKAVESLTQELVAKTQRIEELQAELASKNIRIQELDAAVTGLTADKESLAAENEAKAKTVAEQDKAINSAWFVFGTKSELKTQKILEKGDVLKSADFNKDYFTQIDIRTTKEIKLYSKRAELLTTHPAKSYELVKDDKGQLTLKITNPKEFWSVSKYLVIQVK

SEQ ID NO: 9745 - protein, 81 aa, B.fragilis
ERSALAGYTELPYLCSRFKKRIIMELPEDPMMLFSVINMKLRDCYASLDELCEDMNISKDILIGKLESIGFEYNAEQNKFW

SEQ ID NO: 9746 - protein, 783 aa, B.fragilis
GEKAMKYRILVLTAILFTACNLLHAQVQTGKLSGVIIDANNEETLVGANIYVESLKKGTSTDKNGEFSIEVPAGHYRIVISYMGYRTRQEEVRISELKTKKLVIRLEPETQSLGEVVVTAKSEARQLREQAMPMSVISMQQLQGTVSNVQDVLSKTVGVTIRNTGGVGSSSRVSVRGLEGKRIGFFIDGSPMNDNSDFIDINDIPVDMIDRIEIYKGVVPARFGGSSVGGAVNIVIREYPPKYLDASYSIESFNTHKLSLVTKRNIATKGLEFGGGGFYTYSDNNYKMESPFEEGLIIKRNHDKFKKLAVAGSLKARKWWFDLAEFEPVFIHTFKEIQGIEYNIEKAHTYSDAFIFANKLEKENFLTEGLDMESNLAYAYTVFHMVDTAAYRYNWDGTTYPAVSEYGGEIGKWASNARNEKHTITHKLHLNYVINNNHSINLNSLFSFASGHPKDDLKNKVVGYKTNFRSTMASWIAGLGYDFRTDNDIFLNSLNVKYYMYGMNTHMSSIMSSEAEKVDMLKRDFGISNALRYRFTPDFMGKLSVGYDVRLPAESELLGDGYTVAPSGNLLPERNTSVNLGFLLDRTEKDASNLQVEVNTFYGYLENMIRFTGGYLQSQYQNFGKMRTLGVEVEVKADLTHWLYGYCNMTYQDLRDVRKFEPNTHITNPTKGSRMPNIPYLLANAGLEYHKENLFGGKGQNTRIFTDGSFVEEYFYDFEQSRFQERRIPRTFSANIGIEHSFMNGRFIISARMNNLTDARMMSEFNRPLPGRNWGVRLRYVLK

SEQ ID NO: 9747 - protein, 253 aa, B.fragilis
LIRARIAQQVVRAFFLNCTRYFNMKYKNLFFDLDDTLWAFSQNAYDTFEEVYDKYRLGQYFDSFSHFYSLYQRRNTELWVEYGNGQVTKEELNRQRFLYPLQAVGIDNEMLAKRYSDDFFSIIPTKSRLMPYAEEVLSYLAPKYNLYILSNGFRELQSRKMRSSGIDTYFNKIILSEDLGVMKPWPEIFYFALSATQSELRESLMIGDSWEADITGANGIGMHQAYYNVSGRADFPFRPTYLVTDLKELMELL

SEQ ID NO: 9748 - protein, 66 aa, B.fragilis
AISYNKMQSVRARPHRHIRPGREVLRMNHLSDGILRGLLHVPIKSLKSGWGEKKKLLVDELSTRGR

SEQ ID NO: 9749 - protein, 722 aa, B.fragilis
SYYKIVSTYYSSAKTLQISYIGMQTAEVAIAPVIKVILKTDAKALDEVVVTAMGISKEKKALGYAVQDVKGDKLTQASSSNLSSALQGKVSGVEISPSSGMPGASSKMTIRGSRSFTGDNTPLYVVDGMPISSSTDLDTFNSVTGSDYANRAVDIDPNDIESINILKGQAASALYGMRASNGVVVITTKSGKGARKGKPEVTINTGLSFDKVSTMPDFQKEFAQGFNGAFSPSDSRSWGPLISELANDPKYGGNTDNSYTQKFGKHQGQYYVDQRAKAGLDPWATPRAYDNAKDFFNTGVTWNSSANVAQSLDKGSYSLSLGSTTANGIVPSTGMDRYNAKLTAQAQLSKNWSTGFNGNFVYSKIKKQTGANNGIMATVYGAPSSYDLGGIPSHIDGDPYTQNTYRSTGGFDGAYWAVENNSFKERTQRFFGNAFAKYSTDFGTENHKLDVKYQLGTDAYTTNYTDTWGYGHSNGTGSIEEQSVTNNEINSLLTVTYDWKITPELDLNVLYGNELVDNSSKYKYNLGSNFNFPGWNHIANASIYSSTGTYHRERTVGNFGNISLAYRNMLYLNATVRNDIVSSMPRNNRSFTYPSVSLGFIFTELEALKNDVLTYGKIRASYAEVGQAGTYYPSYYRTPVYGGGFSSGTPIQYPIGSISSYIPYYKIYDPNLKPQNTKSYEIGADFSFWNGLISLNYTYSCQNVKVQIFQSTLGLLFTDIRD

SEQ ID NO: 9750 - protein, 73 aa, B.fragilis
YVLKSPPMLLNAVAVITSAKMNLAGTLVVWSLSLLMLSIVSSEQEANATEINATDKIPFDKLNIDFIFVLFRI

SEQ ID NO: 9751 - protein, 287 aa, B.fragilis
SSENNTMLMYVIIACKSNSFIGFSVFFHYLFLHLPSHSKRNSDVDMQALLNDIELDIQELKYLMEIISREPDSVLRGVARRNIVQMRGRLDALLELLDAKPVIAADASESPENRPVTETIEVVEIPALKETVADIPEKNEEAAVAEDSQEAVEPGPLSLSEAVIEQLPTVELDPVADEKEEVFESVSVPQSEEPTVKVETRVASSPILAERIKTAGDLRRSISLNDSFRFSRELFGGSMEQMNNVLHQIGEMSSLDAALVFLSSKIKVDEENEAMNDFVELLRKHFI

SEQ ID NO: 9752 - protein, 219 aa, B.fragilis
KNTEKPIKLLLLQAIITYISMVLFSEDHIQETRRRGRIEVICGSMFSGKTEELIRRMKRAKFARQRVEIFKPAIDTRYSEGDVVSHDSNSISSTPIDSSASILLFTSEIDVVGIDEAQFFDSGLIDVCNQLANNGVRVIIAGLDMDFKGVPFGPMPALCAIADEVSKVHAICVKCGQLASFSHRTVKNDKQVLLGETAQYEPLCRECYQRALQEDREKS

SEQ ID NO: 9753 - protein, 947 aa, B.fragilis
YNCSSAKTLQISYIGMQTVEVAIKPVVKITLKPDTEVLDEVVVTGYGNFKKSSFTGAASSITTEKLQDVPSLSVQDKLAGSVAGVQITSTSGQPGAVESVRIRGMGSINAGNDPLYVIDGVPVMTGDASEFTYSQSGNSLLSTINSNDIESMTVIKDAAAASLYGSRAANGVIVITTKKGASGKLKLNVRADWGFSNKAIDYRPILNGEDRRDILYMGLKNYALNSGKDETYAVNYADNNIDKYAAKPWSGYTDWEDVLFRNGSHQNYEVNAQGGNERTKFYTSFGYTKQEGITLQSGYERITGRANMSHKADRVTIEASTMFTNSTQNVNSEGTSFSSPIMCLAMTASPSTFPYNEDGTFSTSFPALNGANPLQTATYNYDRSTIVRTLNTLSATWNIWDNLNIKETLGYDFNQTNNRVWWDPRSNDGRSSKGVFQRYMMNRSKLNTQTQLTYNKTFAEHHNIDVLLGFETEDYKYDYTYTNGNTYPSYLPEITNAGVSRGASNINSYRMTSYLGRLNYDYAGKYYVSGSFRRDGSSRLSRDSRWGNFWSVSGSWRLSQEAFMESLSNVITDAKIRASYGVNGTQPKDYYGYMGVYEFGYNYNGNGGSSEARFYNPSLKWEKNYATNIGIDLTLFNRLTVSAEWYNRETKDLLMDKPISAAVGVINSSGVANMLVNVGSMRNRGFELELKSTNIQNKDLLWTTSLNIGHNKNKLTKLDGEQQEIISGVSIHRVGQPYYSIYAYEYAGVDPQTGKELYYINGEDGSRETTTNSAAANKTIIGSIEPKVQGGLTNYVSWKFIDFNLTLTYSLGGHAYDYATWLQSNGGTYHYLGNVPAYYKMEDTWQKTGDNAKLPQFAYGNANKASSRWLMSTDHLRVKNMTLGFTLPQSWSSKAGISKLRAYVSGNNLLTWKKKSLYVDPEVPVDGLCTFETPALRTVTFGLEIGF

SEQ ID NO: 9754 - protein, 537 aa, B.fragilis
ILKRTKMKSIFNLSKGILSVALISVAFASCSEDTMDNINKDKDHTTSVPAKFILADVITATAFSNIGGDFNTYYSTYVEHMVGVDNQLANAEKRNGEPSASSTFNNVWGNLYSTLKNARIAINISSNEVTGNYTTKGIGEVLAAINAGLIADSFGDTPFSQAALPELANGQPQFLTPELDKQEAIYTAIMEYLDAAITDLPKGDKSDEIGEYDFIYKGDGEAWLKLAYGLKARYTMRLLARSSSKDADLQKILEYVDKSYTSIEEQAAFSIYSATNLNPLFDFQWSRDGLAASKSYADKLIERNDPRLRRIFCIGQGKLTENENAVSIQVTGADDPRFLMADNGTAESVKYEYNTPIFVYSQTCPTLLMSYHELLFLKAEALARLNRKDEAANALKDAVVAAIANAETGVSAAFNAPTVKSYGGVKETTKAITATEAEEYFTNNVKPLFDANPVKEVMVQKYIAFLGAFGETTECYNDVRRLKAMGEEYIKLDNPYKFPLRAPYGADDVSANPNVEAAFGNGQYVYTDPVWWARGSR

SEQ ID NO: 9755 - protein, 239 aa, B.fragilis
SFSGNILYNEYLKRDMGKLYVVPTPVGNLEDMTFRAIKVLKEADLILAEDTRTSGILLKHFEIKNVMQSHHKFNEHKTVESVVNRIKAGETIALISDAGTPGISDPGFLVVRECVRNGIEVQCLPGATAFVPALVASGLPNEKFCFEGFLPQKKGRMTKLKSLVDEHRTMVFYESPHRLLKTLTQFAEYFGPERQVSVSREISKIHEETVRGTLSELIEHFTATDPRGEIVIVLAGIDD

SEQ ID NO: 9756 - protein, 507 aa, B.fragilis
KQFMKKEFMKKIYKSITLVAAILSLSSCGNDWLDRKPADGIPSEDAITNYNDALTARTGMYDGIQGNSNATSYYGARMFYYGDVRADDMQARTQGMRSSSCYEMLYTVDDAPNMWNIPYNVIRRANRLIEAINEKKVTDATEAQIGKIYSEALVVRALVHFDLVRIYGMPYTADNGASLGVPVIVKPLERNDLPSRNTVAEVYTQVITDLTDAINSGYLAKDQTPGYINEWAAKALLTRVYLTKGDNENALKVAEDIITNSPYKLWTNEEYVNAWYKSNGAHTNEMIFEVVNASNDDWTDRNGIAYLLNENGYADAIVTKSFMNMLSQDPKDVRIGMVLPAQYDKDLQEEYGDAKIFINKFPADKDDVGEMRLNNLPLLRLSEVYLSAAEAAAKLGGHQDKAAKYLNEIVQRANPEAKAISEADATVERIILERRKEMIGEGQRYFDALRNNETIVRYKDEGDKGYHYSLIKESQSFDRTYFRAILPIPVDETNVNPNLRAQQNPGY

SEQ ID NO: 9757 - protein, 418 aa, B.fragilis
NKIIYFKNPKTMKIRNLMLALAGTALVFSACEKDPNPKVPTTDANIALATILPNPDGMTGAAYLQLIRDEFPQNTNNNNGIPIPYGGSYPIIEGNDIFVFPGYMGDSKNELVKYTRNNGQLSRTGTMKLPPNSSATNIVFASTGKAYLSMAGLGKIAIFDPTTMTQQGEIDLTSLGVSDSNPDPSAMLLRDGLLFVGLSQMVGGWIPPQDRPYSDIAIIDTQTDKLLKMITDKTSGISMPTRPIDRYSIFMDEKKDIYISCMGGFGMVKGHNAGVLRIKAGETEFDPTYQWTITGAAISGEEKTAGFISAIRYVGNGKAYAYINMPGYYKPGEQGHTAIADLAVEIDLYNKTMKKVQGLDLSNGFGVMLSLYKGSMLIGNSSAKAKGIYSLDIQTGEVSKEPILTTVGNPILCYYFEK

SEQ ID NO: 9758 - protein, 394 aa, B.fragilis
SQVIPMRSHIKYQVIMERKKITFDSFIRGSICCALIVGLLILFKRLSGVLLPFFVAWLIAYMIYPLVKFFQYKLRFKSRIISIFCALFSITIVGISLFYLLVPPMLAEMGRMNDLLVTYLTNGTYSSGTVPPTLSEFIHKHIDLQALNRILSEENIMNTIKETVPKLWALVAESINILFSVFASFIILLYVVFILLDYESIAEGWLHLLPGKYRTFASNLVNDIQDGMNRYFRGQAFVAFCVGILFSIGFLIIDFPMAIALGLFIGALNMVPYLQIIGFLPTIVLAILKAADTGENFWVILAGALIVFIVVQAIQDGFLVPRIMGKITGLNPAIILLSLSIWGSLLGMLGMIIALPLTTLMLSYYQRFIINKEKIKYDRHEVTDNQSAEENTKK

SEQ ID NO: 9759 - protein, 195 aa, B.fragilis
VGVMGNFVKRGLKDKLDNSFLVSGVLPKGVKKIIPFSKTRGHAQGSRPMEDLSEVKQAGFGRRQTGIQPIEEWFVKSVGTDEPRLMPAVFAEDAGWEKILLDQQTIDNLATLQIAGLEKPKWPAAWILQEKAGCAVYRTCIRWTPEMIREGMTVLEFGCIDDAGTLWVNGVEVGTHEEWDKPYVINVAPVHSRGR

SEQ ID NO: 9760 - protein, 543 aa, B.fragilis
GGSLYRGCRMYGTIRAVMKKYLYVLIAWMLPLCSIHAQAPVWNPDNGNGTFTNPIMWGDWPDPDVIRVGDDFYFVSTSMHYVPGCPIATSKDLVNWKMAGYAVDRYDEDARYDLKGGDRYLRGSWAATIRHHNGKFYVGFCTPSWEGEGPGHFSICIADDVKGPWERTIFPEYLYDPGLLFDDDGKVYVFHGQGTLYVTELASDAKSVKGEKVKIWDKRFKNAHEFGGGYGMEGAHAYKINGKYYLTCPAGGTEGWQICLRSDNIYGPYEHKLIMNDSGSYPPNGLHQGGMVQLKNGDWWFIIMQDRGPIGRVPHLVPVKWVDGWPMLGSGGKDIITYPKPEVGKTYPFASPATTDEFNTSSLGLQWQWNHNPDNSRWSLKERKGHMRLKASYAESLKTARNTLTQRVQGPSSEATVELDVSGLKDGNVAGFGVFEFPYAYVAVEQTNGEKKIVMCNDGQTIETIDRFEGNKIWIRARVMDVGFRAVFYYSTDGKYFLPIGNELSMGLGLVWTANRFALFNFSKEKAGEDGYTDFNWFRFTNK

SEQ ID NO: 9761 - protein, 339 aa, B.fragilis
LKGIMMVTRLMKHDLCEMVLEWPMPNIVKGKRTEKNNYRIDNTYLKATFEEISTPLFSIMDQHISSEEPIKIYTRADDYHAVWFCATFAGHATCCYNSVIRSEEWNKGDANLLKCDGVDSCVHFPKNTPFHMMEIMLSHDYLRELAIHYPDLLGGKDFETVLCDGQYRAYRKNRPFGPGVYKALHDIRFSQLNGNMASMYADAKIREILSLFLAGQEEENYLHCSCTIGITCDKIHHARAIIEQEYLNPPSLHQLALRVGTNECTLKRGFKTVFGTTVFGHIFEYRMKMACRYLLDSSKTIQEIGACVGYEYHAHFSTAFKRKFGLTPLEYRCSRLSGS

SEQ ID NO: 9762 - protein, 71 aa, B.fragilis
SEPVTELKVSKSVDDEIGIPSTTYNGVLSPVNEREPRIVILEEAPGIPDDGDISTPETLPCKALERLLLEA

SEQ ID NO: 9763 - protein, 242 aa, B.fragilis
FERVDGTIVTFIDILYFCVQYRTHKNTTMDTLLPFALLCFTSFFTLTNPLGTMPVFLTMTHGMTDKERQAVVRRATFVSFITLMVFVFAGQFLFKFFGISTNGFRIAGGVIIFKIGFDMLQARYTPMKLKDEEIKTYADDISITPLAIPMLCGPGAIANAIVLMEDAHTIEMKGTLIGIIALIYFITFLILRASTRLVKVLGETGNNVMMRLMGLILMVIAVECFVSGLHPILVGILKEGLL

SEQ ID NO: 9764 - protein, 189 aa, B.fragilis
CNTLFICSILPPNNSREKRNESFKLIERRKSPAVLIRSAKMGEEATLVSTFTVGSSDCGTDTDSNTSSFSSATGSSSTVGSCSITASDKLNGPGSTASWESSATAASSFFSGMSATVSFKAGISTTSIVSVTGLFSGLSEASAAITGFASNSSNNASNRPRICTIFLRATPRKTESGSREMISIRYLSS

SEQ ID NO: 9765 - protein, 253 aa, B.fragilis
DLAFNFSKIDNYVDKLAPGVSSIMLGGFVDPQVRLSAGDKFPVIYGTSYQRNEEGQIVVDENGMPTLGENRVLGNVSPDFRMGFNTTFEFYKFRLSAVLDWKQGGCMYAGSVSTLDYYGVTQKSANYRKADHFYFEKPAVKQLADGSYAPNDIKISGENAYNYFDRLSTISEAGVYGSSFLKLREIALSYPVLNKSYLGVTVNVFARNLLLWSEMDNGIDPESSQGNNNMAGAFERFSLPGTSSYGFGITVKF

SEQ ID NO: 9766 - protein, 1360 aa, B.fragilis
CIISNMKYIYRTYLSLLYFLCLLFCLPLKVHAYSLRQFSNRDGLSNSAILSLYQDDRGIIWIGSCDGMNIFDGTDIHLYTPINSSKTLLSGNLINQIIESEKDILWVQTNYGLNRLDTKQQTSQSFTEFKGQYFMANNKDDMLFILKDDGYLYYYQREAQSFNRLEIPNLEFSHVLSMTVDSNDILWIFTSNEETQSYRIENTKQGLTLTRKNLFTHSCKLYHAFAEKDMAYFIDETYALYEYDFNNRQAYYIADLRGQIEVHGEVSSIIKQKNDYYIGFKNSGLIVLKYMSSQKMKYQIQKTEIHSGIFCLMKDKFQDIVWIGTDGQGVYMYYNDTFSITNTLLDTPVYQISNPVRALYYDQEQTLWIGTKGSGILRIKKYTPDNSMPMSSDRITPYNSALADNSVYCFAPGYKDKLWIGTENGINYYSYLSRQLKELPIIANGEKVKYVHSIKQPNDTTLWVSTVGEGIVKVIFDASTATPTVKSASRTVIDNGRMASNYFFTSYQENDSILWFGNRGCGAYRMNVETGEMIPHRFDSIVSSQTANDIFAIYKNAKGYWLGTSSGLLHLEQDDSLCTKADLFLNNTVHGVLEDHQGDLWLSTNQGLIRFNPETRTGQTYNSGNGLEITEFSDGAFYKDVVSETLFFGGTNGFISIQTNDCITEEYMPQITLKGLSIFGKEHNIHKFLYEKEGKTILQLDYSQNFFQLNFMAIDYINGNNYSFYYKLEEMSNQWIENGTSTSAIFSNLAPGEYSLLVKYKNNINGQESQTQSVIIRITPPWYLSPLAYMVYFILFALLCTAGIYRLIYIYRRKQHRMLDKMNREKKEEIYESKLRFFTNITHEFCTPLTLIYGPCEKILANPEIDAYTQKYAKMIQQNTEKLNNLILELLEFRRLETGNKVLSIQQLSVSEKVRSIAESFEELAENKEMNYQLHISPGIEWNTDISCFNKIVSNLISNAFKYTPDKGIITIELKVENQSLIFCISNSGKGIAKENLSKIFDRYKILDSVEMNGKNSRTGLGLAICKSMITQLNGEISVNSVLYEMTTFTVTLPNLPITERDTTQTTYETRLLHTATEEPIVLEKTAIEFDMGKRTIMVIDDDNSMLWFVSELFADKYNVRSFDNAKDALSSLEQKQPDLIISDVMMPGIDGLSFAQKIKQHKLWSHIPLILLSALHHEDDQVKGIESGAEAYVTKPFNVKYLEKIVYRLIKREADLKEYYSSIFSSFTMEHGNCIHKEDQEFLDKMLEIIEKNIANPDLQVELLSSEMGYSTRQFYRKLKPITEQSPADIIKEYRLTMAERLLIAKNLTIEEIMDQTGFNNRGTFYKLFSKRYGMPPRQYREQQKENVKKEKISGISDE

SEQ ID NO: 9767 - protein, 221 aa, B.fragilis
FVKSINLKIMIRLVAFDLDGTIGDTIPLCLAAFREATTPYVDHELSDDEIARTFGLNEEGMINQVVSGNSREKALNDFYVIYEEMHAILCPKPFEGMKTLIGQLHERNVIVVLITGKGIRSCDITLKQFGMDGCFDRIETGSSEKNRKSEAMKAISLYYGFKSNEMIYVGDAVSDIEACNSVKIQCLSAAWAASTDCEQLEKYNSGYVFSSVRLLRDFLLC

SEQ ID NO: 9768 - protein, 159 aa, B.fragilis
YDMAKIQIKSEKLTPFGGIFSIMEKFDSMLSPVIDSTLGQRCSSIFGYQFSEIVRSLMSVYFCGGSCVEDVTSQLMRHLSYHPTLRTCSSDTILRAIKELTQENISYTSDQGKTYDFNTADKLNTLLINALVSTGELKEIEEYDVSSPRGWKDPRVGQQ

SEQ ID NO: 9769 - protein, 431 aa, B.fragilis; identical to SEQ ID NO: 6067

SEQ ID NO: 9770 - protein, 188 aa, B.fragilis
VLFYLSSIVSLGYIYNLPFTKLAILDNGTNKKQAIFALSIKLLQFIMEKDFQIPTLEAIESLMGKGLYQIWNALCLLIEHKYEMERLWNSGGRKWNYEYKYRRGGKTLCALYAKENSFGFMVILGKGERDKFEMSRELFSKEVQRLYDEATVYHDGKWIMFELRNTGLFSDIERLLEIKRLPNRKSLS

SEQ ID NO: 9771 - protein, 500 aa, B.fragilis
LKFLNYMQIKKLFIALGIVLPLHMQGQNFLIKDAPEVIESYVNQFNREDNELYKQDIPNCGASDFLRKNIPFFECPDKELEKTYYFRWWTYRKHIKKTPDGFVITEFLPDVPWAGKYNTISCAANHHFYEGRWLRNAEILSDYASFWFSGSGSPRLYSFGAADAIYNYYLIHNDKMLLADLYPKLKDNFAKWEEEKRDSTGMFWQVDDRDGMEMSVSGHLSEGGRGYRPTINSYMYGEAVALAKIASIVDRDMEARTYQKKADKLKGIINRRLWDKQADFYKVIPLNGKMEFSYARELLGYIPWFYNIPPDDYSIAWKQLFDSKGFEAAYGPTTVEQRCTDFKISYEGHECQWNGPSWPYLTSMTLTAMANYFNSYDSPIITKKDYLSLLNIYSNSHRILSVNNDTICWIDENINPYTGDWISRTRLKSWKNGTWDDSKGGVERGKDYNHSSFCNLIISGLMGVRPQEDGSIIINPLVPDGCWDYFCLDNVYCQGKTIIP

SEQ ID NO: 9772 - protein, 301 aa, B.fragilis
VYYYVLLFVISVKLRFLDYICLMKRENLHQPFEISFSEFDESMLKEHDHTFFELVYILSGTGIQWINNNKFSYHDGHLFMITPGDSHSFEIHSTTKFINIKFNDIYIHSAVFGTENIKRLEFILQHANHQPGCILRNRTDKLLVKPMIEAIIREYVNRNLYSKEIITQLINTIIIVVARNIAMFLPEQVNECSEEKSLGILQYIQTYIYQSEKIKTKAISQHFGISENYLGRYFKKHTNETMQQYILNYKLKLVENRLLHSEMRISEIVAELGFTDESHLNKLFKKYRGCSPTNFRKNNAV

SEQ ID NO: 9773 - protein, 465 aa, B.fragilis
ITLYSNYLKFMLNTENIQPLIDSGEGYNVEFKVRVPSKVRELTEEICAFANADGGYLLIGVDNNGQVIDINLENDKRSAIQGSISEISPALHCELYPVNVGNKTVWVIDVPSGKDKPYIFSGSIYVREGANSQKLRTAEEMRSFFQECNKIFFDHIPCHWFNIYTDADEQMIKDFRTEAKLSSSTPDKQIFENLELFTENGTAKNGAAMFFGKQPERKFPHAVTRCVLFKGTNKVYIIDDKTFGGSLYQQYLQAMSWLESKLQVAYKIEGAGPREEIWEIPLTVFKEAIINALSHRDYYEQGASIMIEMFDDRVEISNPGGLLPIVAKNFGHKSMTRNPLIFGLFTRIHLVERVASGIPRMQEAMREANLPEPEFHTEGMFTVVFKRAISIKHDTVNDTVNDTINSKEKEVLKIIKQYPGLNSSKIAELINKSVPTAKRYLNSLVRLDLIEFKGAQKTGGYYLKI

SEQ ID NO: 9774 - protein, 83 aa, B.fragilis; identical to SEQ ID NO: 6082

SEQ ID NO: 9775 - protein, 83 aa, B.fragilis; identical to SEQ ID NO: 6082

SEQ ID NO: 9776 - protein, 225 aa, B.fragilis
IKLNYSVAELRVSKISKEDSLVLISAVSPIRNNYNENCILLTNDADFNSWYEQAKDKIDNVFTEKSMPKPHLKHIKSAQLFDKQFNFTDNKLDITGFEVYANKCILSLLKNRLKDFYIGKSFTPYGACPPQTFAFKAEKGVYLHNQKYVTIIGKDLNFILTTNKQIDFWHKNAKIDDQGILVSVRNQIYSFIFPLSADILPDDIDAIFHLIQTEGHFVFYHPDSL

SEQ ID NO: 9777 - protein, 349 aa, B.fragilis
YPYLCFSLSVGRGKSKGKKQKMNMKKNVIQTLISLTVIIGICSCTTSPKKTIQKEEATGKWVKYENNPVLGGGDLGTVFDICVLKDSDSYKMYSSWRPQKSIALSTSKDGKNWSAPQIVLPPVEGSSWEADMNRPVVVYKDGLYHMWYTGQNDGKSWIGYAISKDGYNFERQSKEPVLSAEQPWEKVAVMCPHVIWDKHENIFKMWYSGGEQYEPDAIGYATSKDGLHWTKWDKNPIFKADPAQSWEQHKVTACQVIERENDYLMFYIGFYDINFAQIGMARSKDGINDWERYSENPIISPTEGGWDASATYKPFAIQEKDCWMLWYNGRNEHLEQIGLAIYDNHDLNF

SEQ ID NO: 9778 - protein, 71 aa, B.fragilis
SYLDLYPIRTGCIISLLLYCFAGRSCGASPDSDTILIEMAISSGENIYHALENYLSGMYYLCEPTNALYLT

SEQ ID NO: 9779 - protein, 390 aa, B.fragilis
RSIFLYYHTFEFKMSKRYCQSCGMPLRFDMEEWLGTNLDGSKSDTFCYYCLKDGKYTVDVSMHEMIDIWLKYVNKYNMYAHTVYSPEELKMILEKRLPTLNRWKQKQDTKNVHNQAIQSIVNYISNHLFEDFDIITLCQKCGMSEYHFRRVFKFIVGENIGNYIQRLRLEYAAHLLTSTEYTLSRIAELAGYQNKYSIAKAFKKHFGVSTSLFKERFTPRKRNAHTSLTPRIIMINKMFVSCLEVGKAYENKFQYKMVWDKLLYYARFNRIDKKHTNFVSLSLDNPAITPEDKCRFYVGIIMNDIPDAKLNTVQIPNGRYAIFRHIGSYDFLCDLYRIIYEEWFPDSQYYPQNTFSFEVYINSPCDTDVPELITDIYIPVLKKKIFTDIK

SEQ ID NO: 9780 - protein, 118 aa, B.fragilis
TVIRERTKLSRHCIFKEHNDNCRKLIGTDYANITVRHYDNCLKHLMKLVKRDYKVDDMLLREVNGELVYILFVMFLSDKVCQSIKKLGQFARLSLYHVLMLLVTIAYLDIEQPFNPFG

SEQ ID NO: 9781 - protein, 112 aa, B.fragilis
KRFGMSFFIKRSKLLKNGEASVCVRVTYDRLYVELQLKRSIKVPLWLQEKEKSTGKDLNSVELNYYIDVLRVKFYQIYKNLEPEGKIISARAIVNRYQGKDETFKTLYIQGA

SEQ ID NO: 9782 - protein, 157 aa, B.fragilis
YSMGKISEIALFQQSETYALVVEIRTTVKEIAMVIGRSFMEIETLFKEQNAVMADVPFVEYLNFESMSEGIHMIIGFKSAKVLCGKGNIRAITIPGRKIVSCLHKGNYTELASLYREMQEWIAAKGYKSSGASIEYYYSKPGTSEEELVTKVEMPVL

SEQ ID NO: 9783 - protein, 658 aa, B.fragilis
KRKGMKNKCMLVVILLILSGTAFAKIVLPPIFSDNMVLQQQTNAPIWGEAQPMKTVKVTTSWDGKTYAVQADKAGKWKVTVHTPVAGGPYEIALTDGKKVNLKNVMIGEVWICSGQSNMEMPLGGWGKITNYQKEIAEAGHSNIRLLQIEQINSTQPETNIKVRNDSWQVCSPITIPEFSATAYFFGREISEKQNVPVGLIHTSWGGTNVESWISGEVLKEMPEFVKTVESIQKMPGDKKILKAEYLKELTAWNNRVDEGFAEGKPVRAAASLDDKDWESMNFPGEVGPQLAGFDGVMWVRKEIEIPASWAGKDVQLSLGAIDDNDITYWNGIEIGRTDGPTLQRKYIIPEKMVKAGKAILAIRVLDTGGNCGIWGDLYLRSTNDEQISLSGDWKYQVAADTHKVGALPVDRSVDPNLPTSLYNAMIHPLISYGIRGAIWYQGENNSSRAYQYRELFPLVIENWRRDWKQDFPFYFVQLANFMHEVSQPAESEWAELREAQMRALAVGNTGMAVIIDRGDANDIHPKDKQTVGHRLALIARAKTYGEKVPYSGPIYRSHQIVGNKIILSFDHTDGGLKSSDGKELKGFAIAGRNHEFHWAKAEIDGDKIIVSAPEAVPYPVAVRYAWANNPVCNLYNGAGLPASPFRTDDWRGITQKD

SEQ ID NO: 9784 - protein, 514 aa, B.fragilis
KYNIMYKITLKNIKAITNLEFHFPEKNGVYLLTGTNGCGKTTLLIALNRLGDNLAFSRNLRTSSAGFDSFKDAQIIYSTQNESVTYHRTGIRWVPTPKSKSNLIKTFPCQNILYLSTSGLRFYAQEPKDLKDYHHNTVSDEIINPLNDILQTEKFRNLKYIKVKNIKGKQRRLHRNNKLYVIKDSQSNYYSEQNFSLGERLLLNTLDFIEAIKEKSLLLIDEIELALHPIAQVKFYNYLEHIAKDKKLIVIISTHSSSLIKHAKQRIYLENNNGQISVLNNCYPAYILREIATEEDFKPDFIFFVEDIMAQRYMHYLLSKYLKEKNSNLICKVIPVGGYRQVVELMEKYPTLSYPINKMQSMLDADVKDTYREILRKSEKTDADVAFIDLFRRNKKNISFLSITPELGTWEWLTSNSNILQQNIESKYGRLSFNLTTKIQTVEREEAGNKNGNLRNWAKGCFKNLASQICPLIVDFQETDLFKCIFESYIEDFTSDSTNMNKIKAFLGKILNRK

SEQ ID NO: 9785 - protein, 70 aa, B.fragilis
RSNILDKFSLAIPFPELDIQKINDWFSTFNSIVIIPLSGVYLKALDIKLLTILLKQLISVFHSMPGEICN

SEQ ID NO: 9786 - protein, 82 aa, B.fragilis
YSDMKNLLEQRFFRLLSECSQRKVSVFELAEAIEELAMHVANFGINEQDYSVLLRYFSFGLHRLKSYRMRFEQEKNALFAFN

SEQ ID NO: 9787 - protein, 74 aa, B.fragilis
TMKIAKKLLLVISYIIYLLSFVKRRKEIIFVLSILHERTTAKAHSKLMRKFMEYAEIKEYKALNISVVTLQGEF

SEQ ID NO: 9788 - protein, 220 aa, B.fragilis
NCYFLINPHGRERMKTEMEKCLAGEWYDCHAPVFLELKGKTHRLLMRYNSLSYEQKEEKYAILKEMFGSIGTEVSVGHSFLCDYGCNIHIGDNVTVNMGCVFVDCNKITVGNNVLIAPNVQIYTATHPIDLNERLTPVEAPEGVRYVRHTFALPVTVEDGCWIGGGVIILPGVTIGKGSVIGAGSVVTTNVPANSLAVGNPCRVIRQINKSENYDPAGSF

SEQ ID NO: 9789 - protein, 170 aa, B.fragilis
DMNFLELTKKRFSVRNYKSDRVEQDKIDYIIECARLAPSAVNYQPWHFMVVVSEEQKQNLRQCYNREWFARAPVYIVVCADKSIAWVRKSDNKNHADIDAAIATEHICLAAAEIGLGSCWVCNFDPELFKANFRLSSERYPVAIVSLGYIQEQPDHFTIRKDKDEIVTFL

SEQ ID NO: 9790 - protein, 260 aa, B.fragilis
SRTVVKTKDTTVVFIKPNITLSGVEKCSTGYELAKGADPDANEQETISGSIKGSIIFRYAEALLIYAEARAELGNITQNDLDITINKLRDRVGMPHLTLSVGYTDPKGDFTAARGYEGVPVSNLLQEIRRERRIELACEGYRHDDLKRWRAHHLWNHDRIQGANAAQFENLDWLVKYFQNDFHIPAAINKADFMEKVGHWSPERNQDNYWVDSEGYFEPYQRHIPDGHFHFDPTKAYLQPIPTEQLVLNPDLKQNPGWEK

SEQ ID NO: 9791 - protein, 174 aa, B.fragilis
PILVSTNRITAFYSDIFPLVYIVLNRTVCGLSKKKMPYLHLIDEAIGLLNTEIRLIEWRIKYTEQLQQRANKQFLSPLFLADKTTLINIMEMVSGLFLSKSIIYQNGKPAYWVDLSKGVEWLFNIKIGDCYQKHEDVIKRKPGKLTEFLNGLADFIRKEHDKKDIHQFPVYLTQ

SEQ ID NO: 9792 - protein, 654 aa, B.fragilis
NTSFSMKKQLLLLLIFSISLYIQGQNIHKLASPDGNIQISVNLSDKIYYDVICRNETLLKQCHLAMEIGDQELGTNPKMTKVSHKNIDESLKPVIPLKFSSVSNRYNQLLLDFKGGYSVEFRAFNDGIAYRFITNKKGMINVKNETLQVNFPDNYLLHMQQSGSFKTAYEEEYTHLYSKEWKSSASMALLPILIDTQKGSKILISETSLTDYPAVFLKSNGSNGMVSVFPRVPLEFGEDGDRSVKILKEADYIAQTSGKRNFPWRYFVISTEDSQLIENTMSYRLAEKNILEDTSWIKPGLASWEWWNGATPYGPDVNFVAGCNLDTYKYFIDFAANYGIPYIIMDEGWAMSTRDPYTPNPAVDVHELIRYGKEKNVGIVLWLTWLTVENNFGLFETFEKWGVKGVKIDFMDRSDQWMVNYYERVAREAAKHHLFVDFHGAFKPAGLEYKYPNVLSYEGVRGMEQMGGCRPDNSIYLPFMRNAVGAMDYTPGAMLSMQPEIYCSERPNSASIGTRAYQMALFVIFESGLQMMADNPTLYYRNDECTRYITQVPQTWDETIALKAKAGEYVIVAKRKGDKWYIGGMTNNRQQERTFELDFDFLKEGQSYRMTSFEDGVNANRQAMDYRKKEYTLKKGDKIIVRLARNGGFASVIE

SEQ ID NO: 9793 - protein, 118 aa, B.fragilis
KIRTHCTEDIMRAVKAAPFRNRPVRRLNFAAWCSAIAATLLLGLWVAEAVAVDPILSSEVTRIPKPYQEQTLTDERNYERLMTGEKREIFFSASRSRKKKMFKRERLYTRYEQIMKNE

SEQ ID NO: 9794 - protein, 98 aa, B.fragilis
ERRASGQPDALFFCYILYANPSNVNSMKHLRIICIPTLTFARLLMFTPSILQAQDKPVFPIDSLITVGYASGNKKNISGSVEKITELGMNKDQITDPL

SEQ ID NO: 9795 - protein, 788 aa, B.fragilis
  UNSURE (782): Identity of amino acid sequences at the above locations are unknown.
TLNFECMKQVNLRIYQTILTLLVGLFLSAGAYAQQISVRGIVKDQMGEPVIGANVLVKGTSNGVITDIDGKFALSAAKNDILIISFVGFMSQEIPVTGKDLMVTLKEDTGLLDEVVVLGYGANARKQDLSAAVGVLSNTDDLTVRPVSSTESLLQGQLAGVTVQSNGGDPTSTPSIVIRGQGSQNGDNVLWVVDGVPGAPIASMSDIESIVVLKDAASAAIYGAQSGAGGVILVTTKKAKAGIPTLSYEGTYGIRQATNLPEPLNAEEELEMRKRSYANANVTLPDGWNIEKNPWIGTTRTNWMDEIFRTAFYQRHNIALNVGTDNYSSRLSFSFDNDEGVLINTYNKNYAIRYNGKFDLNKWVSISEDLVWKNTENRSKDTNDAYTGPVLSAIYMPASATVYNPLDGTWGGTTTEDPEYIAKYGSNFAGAHGDAVNPVRLLRAENRFNRTSDVWSTTSLQIANIIQGLKFTSRFTYNLKTNNYKNFRPIQDEPGKPNNSNSLDVTNYRTDAWKTENTLTYDNSFGNHTVGALFSTTADHYNVRGLKVNGKNFADESPYLQYLAYAGTTSATDYLTGPDANVSLVARLAYSYDDRYFVTASWRRDYAGRLPKENNFGDFPAATLAWKISNEKFFKKSDFIGMLKLRASWGRVGNLGSIDYNYKSLLLGTSYWQEQAQYGVINNATWNNFVYNSTAMNRNLTWETSEQWDLGLDVELFKNRLALSFDYFDKRTFNLIQKQTMIWPSSIGLDTLLINKGEIRNRGIENKLTGTDRVNKIFPTSXPGIFHI

SEQ ID NO: 9796 - protein, 597 aa, B.fragilis
NQTYILINNSIERMKKLPYFVSFAAAWLFIAVASAQENPVDYVNPFVGTTNYGTTNPGAICPQGMMSVVPFNVMGDKSVGNKIDKDSQWWSTPYEHTNTYFTGFSHVNLSGVGCPELGSLLLMPTTGKLNVDYLQYGSAYKDEKATPGYYSNVLTKYGIKNEVSATLRTGISRFTFPKGESNILLNLGEGLTNETGATVRFVSDTEIEGSKLLGTFCYNPQAVFPIYFVMRINKTPRARGYWKKMRPMTVEAQWDNTSGKNKLYTAYTKEMSGDDIGTWFTFDTDEGETIEVSMGVSFVSIANARLNLEKEQAGKGFDQIRAEARAMWQNDLSRILVEGGTEEQKRVFYTAMYHLLIHPNILQDVNGQYPAMEGSEILTTKGNRYTVFSLWDTYRNVHQLMTLLFPDRQLDMVRTMVDMYKEHGWLPKWELYGRETLTMEGDPSIPVIADTWMKGLRDFDVQAAYEAMYKSATTPGKDNLMRPDIDDYIAKGYVPLTEQYDNSVSYALEYYIADYALSRFCPRRWERKKMRSYSTTVRWDINITTARSSVHYVPFYPTEHSILHSIRWKEPILLRVPVFMRGTPGIIHFMFPMILQA

SEQ ID NO: 9797 - protein, 188 aa, B.fragilis
AMEQNEIQVLVEKSRRQDASAFALLVAEYQTFVFRLAFRLLCDEEEARDMVQETFLRVWLSLDKYRPEFRFSTWLYRVACNICYDRLRALQHSPAGALSDITFAELPVCSDDNIEATLVNRELKAHILYFMHQVTPKQKLVFPLRDIEELEIKEIEKITGFTSVQIKANLYLARKSIRKKLNEINKER

SEQ ID NO: 9798 - protein, 359 aa, B.fragilis
KQMHMKTNRLLSILLLAVSMVSCTTYYQVKTRIHPDGSAHREVYAFADSAFMAGDPMKNPFMFSLDSGWVVTRFDSVRTHNYFGEEGKINVCAGREEPSVSMFAEQVHPKDPIYRPLVTPQETLTKHFRWFYTYYTYTGIYPELADKGPVPLKNYLNESEQKLWFQGDDTAYRGMNGLEMKELLDRLEKKFYDWYNRSLYELSFEVIRPFIAEIDRGKYMSRLDEVKDSLYLGYQPKDDDPDPDPELICQLLDTHYHTDCFSLLYKEKQQEVDKRFDEETRPIELFGAVIQYELKMPGQMISANTTFRDREYLVWKVDAYRLLAGEYSLTARSRVPNVWAFILTGVLILLGIGFWIKKR

SEQ ID NO: 9799 - protein, 839 aa, B.fragilis
  UNSURE (68): Identity of amino acid sequences at the above locations are unknown.
NKNKSIMNKKIKIAFASMLAVPLLACAQVRTEQTFEKGWKFTREDSKDFSNSTYDDAKWQSVTVPHDXAIYGPFSINNDKQNVAISQDGQKEAMEHAGRTGGLPFVGVGWYRLNFDAPSFSKGKKATLVFDGAMSHAHVYINGQEAGYWPYGYNSFYVDATPYLKPGEKNTLAVRLENENESSRWYPGAGLYRNVHLVVNEDAHIPTWGTQLTTPVVKDEFAKVNLKTKLDVPAGKAFEGYRIVTELKDKDGKVVAANEKKGGPFDDNVFEQDFVVTSPALWTPDTPHLYSAVSKVYEGNTLKDEYTTSFGIRSIEIIPNKGFFLNGKKTMFKGVCNHHDLVPLVGIANDAGIRRQIRILKDMGCNAIRTSHNMPAPELIKACDEMGMMIMAESFDEWKAAKVQNGYHKVFDEWVEKDLVNLIHQYRNNPSVVMWCIGNEVPDQWNGDRGPKLSRFLQDICHREDPTRPVTQGMDAPDAVVNNNMAAVMDVAGFNYRPHKYQENYKKLPQQIILGSETASTVSSRGVYKFPVVRRAMQKYDDHQSSSYDVEHCGWSNLPEDDFIQHEDLPYCIGEFVWTGFDYLGEPTPYYTDWPSHSSLFGIIDLPGLPKDRYYLYRSHWNKDKETLHILPHWNWEGREGEVTPVFVYTNYPSAELFINGKSQGKRTKDLSVTVNNSGDSTSVANFKRQQRYRLMWMDTKYEPGTVKVVAYDKDGKAVAEKEIHTAGKPDHIELVADRSVIDANGKDLSFVTVKVVDKEGNLCPLADNEISFKVKGAGTYRAGANGNPASLESFQTPKMKVFSGMMTAIVQSTEKAGKITLEATGKGLKKGTLLIESK

SEQ ID NO: 9800 - protein, 292 aa, B.fragilis
KPLNGYAMKLSIDLGGTNVRIAQVENGICLNKMSVPCLAQQDASAVLDQLFQLITGMMNVQVDGIGIGVPSIVDVEKGIVYNVANISSWKKIHLKDILEKRFMVPVAINNDSNCFTLGESMFGEGKPYAHMVGVTIGTGIGAGVIINHRLYCGQYMGAGEIGSLPYLDSDFEHYCSSSFFKRHDTTGVVVAEKAERGDGAALEIWREFGTHLGNLMKVILFSYAPQAIILGGSIVSAFHFFKDTMKDAMQDFPYKILLDNVKIITSYLKDASLLGASALFEKQYLPISIINN

SEQ ID NO: 9801 - protein, 567 aa, B.fragilis
HIPDSSLFTKNVYLCHRVILIINKLRNNNRMITVSNVSVQFGKRVLFNDVNLKFTSGNCYGIIGANGAGKSTFLRTIYGDLDPTTGNITLGPGERLSVLSQDHFKWDAFTVMDTVMMGHTVLWDIMKQREALYAKEDFTDEDGLKVSELKEKFAELDGWNAESDAAMLLSGLGVKEDKHYTLMGELSGKEKVRVMLAQALYGNPDNMLLDEPTNDLDMETVTWLEEYLSNFEHTVLVVSHDRHFLDSVCTHTVDIDYGKINLFAGNYSFWYESSQLALRQQQNQKAKAEEKKKELEEFIRRFSANVAKSKQTTSRKKMLEKLNVEEIKPSSRKYPGIIFTPEREPGNQILEVSGLSKKTEDGVVLFNDVNFNVEKGDKIVFISRNPRAMTAFFEIINGHMKPDAGHFNWGVTITTAYLPLDNTEYFNTDLNLVDWLSQYGEGNEVYMKGFLGRMLFSGEEVLKKVSVLSGGEKMRCMIARMQLRNANCLILDTPTNHLDLESIQAFNNNLKTYKGNILFSSHDHEFIQTVANRVIELTPNGIIDKMMEYDEYITSDHIKELRAKMYK

SEQ ID NO: 9802 - protein, 68 aa, B.fragilis
GSDEFPLGSMAKRFGELVRQPHKVVKSEAVVFRNYAWNGEAKDRYIGYQAHAVEEFEGWVFTNKIVVE

SEQ ID NO: 9803 - protein, 395 aa, B.fragilis
NMAEKRDYYEVLEVTKESTVEEIKKAYRKKAIQYHPDKNPGDKEAEEKFKEAAEAYDVLSNPDKRARYDQFGHAGMSGAAGNGGPFGGFSGGMSMDDIFSMFGDIFGGHSGGGFGGGFGGFGGFGGGGSQQRKFRGSDLRVKVKLNLKEISTGVEKKFKLKKYVPCSHCHGTGAEGNSGSETCPTCKGSGSVIRNQQTILGTMQTRTTCPTCNGEGKIIKDKCKVCGGEGIEYGEEVVTVKIPAGVAEGMQLSMGGKGNAGKHNGIPGDLLILVEEEPHPELIRDENDLVYNLLLSFPTAAIGGAVEIPTIDGKVKVKIEAGTQPGKVLRLRGKGLPSVNGYGTGDLLVNVSVYVPETLSKEEKSTLEKLEESKNFKPSTSIKEKIFKKFRSLFD

SEQ ID NO: 9804 - protein, 544 aa, B.fragilis
VMKSRYICMFACLWGLGFLFSCDGFLNENPKDKIPEEDAYKNLTDLYYNAVASLYNNIGGYSDSQGLQGTGRGIYDLNTFTTDEAIMPTRGGDWYDGGFWQGLFLHRWGVDNDAIQATWEYLYKVVSLCNQSLERIDTYQQTHNDEELPVYRAEVRAFRALYYYHLMDLFARVPLVLSSSTPLKEVKQNSRKEVFDFVVKELQESEPLLETAYSNRSGNYYGRITRPVACFLLAKLALNAEIYTDNNWTDGQFPDGKDIYFEVDGERLNAWQTVEAYCDAITAMGYRLEDNYEANFAVYNESSVENIFTIPMSKTLYTNQMQYLFRSRHYNHAKAYGLGGENGSSATVEVLRTFGYDTEAVDPRFDKCYFAGIVYDLKGKVVTLDDGTQLEYFPWKVDVDISNTPYEKTAGARMKKYAIDETATKDGKLMENDIVLYRYADVLLMKSEAKVRNGENGDEELNLVRSRVNAPFRTATLANLLAERQLEFAWEGWRRQDLIRFRQYTRTYTGRPQLSGEKNGYTTVFPIPEKVRLMNPNLTQNPGY

SEQ ID NO: 9805 - protein, 83 aa, B.fragilis
FIQRVPYKMLPGLTSPDVARAILYLNKRTIYLINRLFCYNDGLSYDLETAASNFPSLLAQYPGFCVRLGFINRTFSGMGNTVV

SEQ ID NO: 9806 - protein, 841 aa, B.fragilis
AIRGRVPGLTIQKGTNGPAALDAVRLRGTTSLTSGNDPLIIADGVFGDLSMLTSIYPTDIESFTILKDASETAQYGSRGASGVIEITTKKGIRGKTRVSYNGSFGISSVYKNLEMLSGNEFRNLARQQGVAILDKGNETDFLKEIEQTGLQQNHHVAFYGGTDASSYRVSLGFMDRQGIILNEDMKNFTSNMNMTQHVFDDFLVCELGMFGSIQKNHNLFDLQKTFYSAATFNPTYPNHRNPETDSWDQITNASQITNPLAWMEVKDHDATSHISTHARLTFNLFRELKLILFGSYTYNIVENSQYLPTAVWAHGQAYKGTRKMESLLGNLMLTYKKKWNKHYFDVLALAELQKETYSGFYTTVTNFNTDQFGYNNLQAGAIRLWEGTNSYFEQPRLASFLGRFNYTFADRYIFTVNARTDASSKFGANHKWGFSPSVSGAWVVSEEKFMKRIPLVDNLKLRIGYGLAGNQSGIDSYTTLNLVKPNGVVPVGSSQVVTLGNMRNTNPDLKWEVKRTFNAGVDLGMFGNRLLFSLNYYNSKTSDMLYLYNVSVPPFTYNTLLANIGSMRNSGTEIAVGLTPLKTQDMELNVNVNVTFQQNKLLSLSGMYGGENISAPEYKSLASLDGAGFHGGYNHIVYQMVGQPLGVFYLPHCKGLIADGNGGYTYDIADLNGGGVSLEDGEDRYVAGQAVPKTLLGSNISFRYKRFDLSVQVNGAFGHKIYNGTSLTYMNMNIFPDYNVMKKAPGRNIKDQTATDYWLEKGDYINFDYVTVGWNVPVTKWKKYVQSFRLAFTVNNLATITGYSGLSPMINSSTVNSTLGVDDKRAYPLARTYTLGLSINF

SEQ ID NO: 9807 - protein, 347 aa, B.fragilis
STMGRKYLQSFYVLALIISALFFPAFSGDNNIKTAGANMSYGNRLVMQTGHKSANLVSGVEKVEWMKVLQDTLPVCKISIPGTHDSGSTKGGCMLKTQTADIPAQLQKGIRAFDIRLKEKNGKLGVFHSHAFQDIYWEEDVLLAFISFLQAHPSETLIVSLKKEGGEIKDYASLLSASLNTPAYQRYFIADFHPELTLKSCRGKILFLHRDHAMDNYPGAACIGWDDNTTCLLTLRNKDGKEATVFLQDEYQYNSGKEAGKKIAACIRNFDRICEEQTFSRRWGISFVSATGLHSGIPLVFANKVNKPVADYLKENRKRNCGIVFIDFIESSGGQKLVEYLIGGNIY

SEQ ID NO: 9808 - protein, 85 aa, B.fragilis
LMEGHLVLKVRWFVPYWQHFLHYSLSGGSNIHHRGCGGIKVIAWILFFFRIWKYEMTIVKFQLSVLYGLASANDILKELLHICAK

SEQ ID NO: 9809 - protein, 353 aa, B.fragilis
TFIINMKIKHLFIGIALTANLFAATAQEVKKTYFVSKPGTLISMMTEEEANQVTHLTLTGKINAVDFRHLRDEFKNLQVLDIANASISMYSGKEGTYPDKFYIYMPNFVPAYAFCKMENGTAKGKSTLKKIILSEKIKNIEDAAFMGCENLNICQIKKKTPPNLLPEALADSITAIFVPLGASDEYRLKNRWDNFAFIEGEPLEAKIEVGALSTLENEIQKAGLQPKEINFLTIEGKLDAADFKLIRDYMPNLVAVDIEKTNATAIPDFTFSQKKYLLRIRLPHGLKSIGQRAFSNCGRLCGTVELPESITAIEYGAFMGCDRLRYVVAHGDKITTIGDNLFGEGKNKLIYKR

SEQ ID NO: 9810 - protein, 292 aa, B.fragilis
INKMEQQDHESFFSPKGIPAFASIIIFLVSFFIVMSLFHSVLNLFSVVRGYGMGYFFIGEGIMLLSVFIVTFLMMRFLDRRPFSDLGFSLKGRGKDILYGFLVAVLIYAIGFGVCLLTGQIEVVSVHLHWSDLLLSGLFFAMVAIVEETMMRGYVLGRLLRTRLNKFISLLISSLLFALLHLMNPNVAFLPMLNLVLGGLLLGASYLYTRNLWFPVSLHFFWNWIQGPVLGYEVSGNRFCETLFSLRLPANNLINGGAFGFEGSLVCTVLATLFTLFIIWWFEHSSQGMRRY

SEQ ID NO: 9811 - protein, 261 aa, B.fragilis
FCIVCTGILYSRLCALTFLPQALGKKEDAKLFYDRSLGYKHYYCKEFGTLRPILPDGTFYSPFDPMEGANFAPSPGFHEGNSWNYTFYVPHDIAGLTRLMGGKKKFVDKLQKVFDEGLYDPANEPDIAYPYLFSYFKGEEWRTQKQVKRLLAEYFTDRPDGIPGNDDTGTMSAWAIFSMIGLYPDCPGMPDYTLTTPTFDKVTIQLDPKYYKEKELVITAVRPGDNADLIKEVKLNGKKHAGYRISHEELVHAGKIEFILK

SEQ ID NO: 9812 - protein, 255 aa, B.fragilis
TFLVNNELSGMCQSDIKVLPLLRFLAKQTNWQSFCCKASTSKCRIDMKLNPFNKNKNRIDMDPKEKKTKQEEELKVDDIQDTVEGQSQNEEATEATEPLTAEEKLEKELKEAQAQIEDQKDKYLRLSAEFDNYRKRTVKEKAELILNGGEKSIKSILPVIDDMERALTTMETATDVNAVKEGVELIYNKFLSILSQDGVKVIETKDQPLDTDYHEAIAVIPAPTEEQKGKILDCVQTGYTLNGKVIRHAKVVVGE

SEQ ID NO: 9813 - protein, 297 aa, B.fragilis
HICSFHAINRFLSSVIKYPQILSSLSLIYIYVHPKNEMEREFNNDMLNRAEAIRCIRVQSLINKKFDFLDKHKMKADFIDYFAKMMQIKDQKWKMVYAHFSNFVQGKCNFGEVNVDLCKRFRAYLLNAKQLKHTTRKVSLNSAAGYYSTFRGLSKIAYRDKLLRENINDFLEKIEYEDVKKEYLTLDEVKQLAATPCDIPVLKAVSLFSCLTGFRISDIMNLQWSDFGIAPDQGYCIRIRTQKTKTGATLPISHEAFELCGEVGTGKVFKGLGRSMINYPLKNWLKQTKILKHIIFH

SEQ ID NO: 9814 - protein, 573 aa, B.fragilis
VRLSIGLHTKSCYKTSACDGLFSFEPILTLRLKPSYLLVVVHCNGITDRDMFGKSDDLKDMRKWRVWKLKLIDARLYFVSIFVGLLTGLVAVPYHYLLQLFFNTRRDFFDSHPHWYWHIPIFLSLWGILLFVMWLVKKMPLITGGGIPQTRGVINGRISYKHPFIELVSKFVGGVLALSAGLSLGREGPSVQIGSYVGCLVSKWGRVLAGERKQLLAAGAGAGLAAAFAAPLASSLLVIESIERFDAPKTAITTLLAGVVAGGVASMIFPINPYFQIDAISPGLTFFSQVKLFLLLAAVISVSGKIYSVITVWFKRLYPAIKHPAYVKMLYLLFIAYLISLTEVNLTGGGEQFLLGQAMHADTHIMWIVGMMILHFVFSVLSFSSGLPGGSFIPTLVTGGLIGQIVALILVRQGIIGYENISYVMLICMSAFLVAVIRTPLTAIVLITEITGHLEVFYPSIVVGGLTYYFTEMLQIQPFNVTLYDDMINSPEFQEEKRYTLSVEVMSGSYFDGKTVNEIQLPERCEIINIHRDRKDIPPAKQKLVPGDQVQIEMDAQDIEKLYEPLVSMANIY

SEQ ID NO: 9815 - protein, 60 aa, B.fragilis
CVMFAMESACSLGNFCAGRSEFLLIRSRLCRITHVNSIGRILKYFHRYMEIIFDFNFIVS

SEQ ID NO: 9816 - protein, 80 aa, B.fragilis
CFSTETTIYNSYLTFEDILFKYLNLLYTKVYMNILGVNQVSLFFTYASITLLFLGVFSIADTLRVRALKINATGKTVFQN

SEQ ID NO: 9817 - protein, 304 aa, B.fragilis
TLSTESNWNNNLAMNREQKILSLLDQFKGLGIDQQIDYNKFYLYSIITHSTAIEGSTVTEIENQLLFDEGISAKGRSMTEQLMNLDLKAAYEQSIVFAKSHSDISVDMLKKLSSIVLKNTGTIYNTPLGEFSSANGDLRLLNVTAGTGGCSYTNYSKVPTKLAELCENINQRRKSLSKTDIIECYKLSFDTHFHLATIHPWADGNGRMSRLLMNRLQFELDIIPFNINKDHKTEYIEAFIATRENDDIELFRGFMFDEHIRNLEQTIRNYRDSPSDCVNKKLQDFSRSFLLTLYFEHFLLNQTI

SEQ ID NO: 9818 - protein, 82 aa, B.fragilis
KTTTNSIRFYLLISMMYQYNVKALKKAIKRTFGNRHTEYKIDTMFFRAEYPDNAGMQIRWKGFIHKITSRSELSFSDVVRYL

SEQ ID NO: 9819 - protein, 87 aa, B.fragilis
KQDTNDMTVFLSFRAFRLYSSISYFVKLTIEATIAAIEAMELLMPTAPAVVIFFRSPLLGTIISHPGSMAFAVFLLNRETVPFIYTT

SEQ ID NO: 9820 - protein, 547 aa, B.fragilis
VCATQLICNPMKIYHKFFLYQNKLLQPYVRLLLRLMAIITYLASIMLIVGVIYEHGFTLSAHEVTKIHLLYKTVWIIFLIDVTLHILLEYRDTKKNFRKLAWILSWLLYLTLIPVIFHRPEEGGAILHLWEFLHGYFYHIVLLLLFSLLNLSNGLVRLLGRRTNPSLILAASFLVIILIGAGLLMLPRCTVDGVTLSWVDALFTSTSAVCVTGLVPVDVSATFTPAGLTVIILLIQIGGLGVMTLTSFFAMFFMGNTSLYNQLVVRDMVSSNSLGSLLSTLLYILGFTLVIEGVGMLSIWFSIHGTLGMDVQDELAFSAFHSISAFCNAGFSTLPGNLGNPMVMTNHNWLYITVSLLIIFGGIGFPILVNFKDIIVYHARRFWRLIRTRQWDNHRVHHLFNLNTKIVLIMTVLLLVFGTVAIAIFEWNHSFAGMSIADKWTQAFFNATCPRTAGFSSVDLTSLSIQTIMLYIVLMWIGGAAQSTAGGVKVNAFAVASLNLIAVLRGTERVEVFGRELSHDSIRRSNAAVVVSSLIPQHYNLTLFISS

SEQ ID NO: 9821 - protein, 208 aa, B.fragilis
YKIASKMKNMTLQELYDYLNSPEFQNVKSGNIFYNYYIYQYPATKEYEMRRQILVFKQNLERPSSFINAMLLDLFQVFCDYLKAEKFGMDSLFDLTLEDDKVQPDIVTTELTNEANSDHFIQYVHRRIDEYMQVNDGLNKPYIFIHGIGKMFPYLRTNRFLTRYEKYNDTSLYKIILFYPGHQEGNSFSLFDTLEDSHTYRATLLVNK

SEQ ID NO: 9822 - protein, 76 aa, B.fragilis
CWLAAPKWHIYHDEYRPYYLDGIFKYFVVCSTALLLDFRRSDESIPIFSYVHIKRYLSNVLQDVESVVLFYGNNYI

SEQ ID NO: 9823 - protein, 68 aa, B.fragilis
KEGALMYAYERLSAHPTLDINFLGANINNYGEIIISAFKEICAMPCEEDKNSVNFDLSHITAQNITEF

SEQ ID NO: 9824 - protein, 431 aa, B.fragilis; identical to SEQ ID NO: 6067

SEQ ID NO: 9825 - protein, 194 aa, B.fragilis
FCHFNAGVICVLYMDDMYLFRFKNSEYTSAARCGGARETEALILLNSVFVAYASVFDIMAKIAIEQFEFTKYNFGNYRKMKSADTIYKKSLNNIDPSLKTEGMLFSEPPIIRKIGTFRNEFVHNGPWDLRCSVYNTAVDGKPADVIIYSPDMDEIGNIISSGSRNKFYSQANRINIQLPNMIQEATIVLKNTIE

SEQ ID NO: 9826 - protein, 1198 aa, B.fragilis
YNNFVRRNKMETNRLKRFASEARNILMSGVKQRLSALGFQTDGSLSTKLPELMGGGSVFMGEVQSEDFYHKWMSLYQRIQSHSYREVAEEAAYTWFNRLMAIRIMVKNELVPAVLEYESDEVRIPLLVSEARQRRFPQMNEESRQKLEVLLNNDALTDEQFAVLIVAYCHSNPIIHKCFGTISDYTELLLPSNILAKDGFIDKLNADEYISDEDYRSPELIGWLYQFYISERKDEVFAKKGKFEADEIPAATQIFTPNWIVKYMVQNTVGRIYLDNNPYTDIKKEMQYLVEPAEPTPADAIYQFDNIHDLTCADLACGSGHILNECFDLLYQIYIEEGYNRRKAIEDIFQYNLTGIDIDTRAKQLATFALLMKACQKDNSFSDAHCMPRVLDMPIPYAEAVGKTFDNTDEERTFTKTLLSEYIMGGNAEVLDELTDAVLLMNDAQTLGSIMKFTISERTRNVIAVRTAEYEQQEVLPEDIRKMLPYMQIILTLTQNYATLVMNPPYMGGGNMNEVLSRYVKDNYEDSKADLFSVFMELAIDRLKQEGKYGMINMQSWMFLSSFEKLRKKVLDNYQIDSMLHLGPRTFDELSGEVVQNTAFVISRNHKEDVNGIYFRLVEGKSCKEKEQMFLNYSEQGAKIYYPAIPQSNFEKIPGCPIGYWVSENVLKTFNQKNLISEKSIARSGFSTGNNERYVRQWYEVPLEKIGFSLSSNDDFLSSNYKYVPFTKGGTFRRWYGNLESVVDWTNPNTMHRPRTTYMNLYYKPAITWNAICSGKLSCRFYDRGFLFEHAAASLFVNNDYQFESFLAYLNTPVFQFILSILNPTLNTGAEVVSSIPIIIPSSGIHQKIHQNISISKQDWDAHETSWDFQTNELIQLSIDGVGHIQATINEKTIQDYYSIELLLTEYKTKWEDLFNRLHANEEELNRQFIEIYGLQDELTSDVPLNEITILQQGEISIEGDKLRWNDDVLMKQLISYAVGCMMGRYSIDRPGLILANQGDSQKEYEALVPNSRFAIDDDGIIPLMSANTEFTDNITLRFKTWLGITFGEESLMDNLNFIERSLGKRLDDYFVKDFWKDHKKMYQNRPIYWLFSSKKGSFQCIAYMHRMNAYTAEKIRANYLLPHIEWLFNKQNEMQANAANLSTRERKELDSIGKQIEECREYHDRLHVVADQQIGFDLDDGVVVNYAKFGDVLAKLK

SEQ ID NO: 9827 - protein, 490 aa, B.fragilis
NQNYMENKKLTAANGRPIADNQNSQTAGPRGPIMLQDPWLIEKLAHFDREVIPERRMHAKGSGAYGTFTVTHDITKYTRAAIFSQVGKQTECFVRFSTVAGERGAADAERDIRGFAMKFYTEEGNWDLVGNNTPVFFLRDPLKFPDLNHAVKRDPRNNMRSANNNWDFWTLLPEALHQVTITMSPRGIPASYRHMHGFGSHTYSFLNAENKRIWVKFHLKTMQGIKNLTDQEAEAIIAKDRESHQRDLYESIERGDFPKWKFQIQLMTEEEADNYRINPFDLTKVWPHKDFPLQDVGILELNRNPENYFAEVEQSAFNPMNIVEGIGFSPDKMLQGRLFSYGDAQRYRLGVNSEQIPVNKPRCPFHAFHRDGAMRVDGNYGSAKGYEPNSYGEWQDSPEKKEPPLKVHGDVFNYNEREYDDDYYSQPGDLFRLMPADEQQLLFENTARAMGDAELFIKQRHVRNCYKADPAYGTGVAQALGIDLEEALKE

SEQ ID NO: 9828 - protein, 1167 aa, B.fragilis
NVIYMTENTNYIFEELLKAVQPNRGLFVIPLPTGAGKTYNSCLMMAEELKKEDARRIIYVTDAKKQLDATIEDIEKNLKKTGLKLKMYDILRVYSQEEQWERAFTDPDIRMRMEASKLFQGERAFTNLKRLYSYTDVTDEVAEEISKNRLRLMEKVRKEVFTPIRQTYKKESDEVIASHIVTEYPILEELYPELLFYKSKIIVLTASKLHTTASPKLVRKGTQPYWKHIENSLVIVDESDRVKEAAMKRLFDCECGRRRRFNFWGLCYFICLHYQEVMDMQKMPEWADHKMNIQDMLKAIRTKKEELIDDIDPQKILCGLELKENVNRGNFIFYDEDQTFSAENVVLSVHNNKEEYTSYLLQSKKTKDQNDKTLSFVANRIMLFLKGFVQIVDKHAEVYASIENELRKKKGTDTTVDLEGELAFYHIIKYMGVNEGNTEYRSALQELRNRTTFQTPRSNNSEETDGKSIYDKGISFIEIYSHDNDRYSCCFDYHEMRCMPENVLLDMVNHNRVIMCSATADCQTPIHNYDFNYIAKQGVKVEKMGNDALHKIEKYIALNYANPKVEFSLYNEEETEPKEILEDYLGKCSLALKDCLDFVMDGKNKFNKNNSARIVNMLNHYMDFMKKPEAKAWLYFQPFSYTGNSSIGIKKVLNILQQARVTKRGEVYEVSVMDPYVIDDGTTSRRADIYPKLNVCFLSGEYFKDDLEAVEKLLAEQPELKMFCFVCYQSGAVGVNYLFDTDAKYRKKCCLKAPNTKDRKDTRCNFDGIIMDKPTNFIPLLDVNDYLKACISLSILGTDNQLTLKEKSDFQRDLLRRRHHCITDDLNELKNREIQIKAVLKGTPAYDAFCLKWAVQALGRITRSTVFNKIIHVAIGKDMAYSMIIARKPEVQTELLKYVLQSIDKDPCILDRINGKESEVNIAFKNGEHRRERHISELIGISFKGTDKYARQARNRVHKIREYVMKHPEFGNREDIETSMRMYYVQAEEVKKMNLNYTDSCVHMDAIMRQRFIRNYFEKNGYCTAWKGKAWVISPQIIQQVYTGYFGEQVFKAILENAGCTITSLKEEIWERADWVVNNQLYVDVKYMVDGDFNRHVKSQAWERKIKDCGGDYVIVNVPRYVGNYSYSHSLPLESGTQLPVINGLIDVETGAIIDNNVQNILNILAV

SEQ ID NO: 9829 - protein, 334 aa, B.fragilis
MKHYRLFLLLIGLLVLAFLADIAIGSVSLSIRDVWNTFIGSNDNLIYREIILNHRLPKALTAILAGASLSVAGVLMQTLFHNPLAGPDVLGVTSGASLGVALLTLGTSSLPLWLITGWGQVTAAIIGAIGVLLLVIIVSIKIPQTISLLIIGMMFGNFAGAIVSILQSMSNPDTLKLFITWTFGSLSSVGWEQMSVMAPVIACGILTALLLQKQLNILLLGKNYANGLGVSVPRLRLWIILATALLAGTSTAFTGPIAFIGITMPHVARGLFGSPNHRIILPASMLCGAITLLVCDLISQLPGMQGTLPINAVTALFGSPIIVWIILRNSYINK

SEQ ID NO: 9830 - protein, 461 aa, B.fragilis
SNNYNIMSDKKKRYMLPEEEIPHYWYNIQADMVNKPMPPLHPGTKQPLKAEDLYPIFAEELCRQELNQTDQWIEIPEEVREMYKYYRSTPLVRAYGLEKALGTPAHIYFKNESVSPMGSHKLNSAIPQAYYCKKEGVQNVTTETGAGQWGASLAYAAKLFGLEAAVYQVKISYEQKPYRRSIMQTYGAQVTPSPSMSTRAGKDILTAHPNHQGSLGTAISEAIELAQTTPNCKYTLGSVLSHVTLHQTVIGLEAEKQMAMAGEYPDMVIACFGGGSNFGGIAFPFMRHNILEGKKTRFIAAEPASCPKLTRGKFQYDFGDEAGYTPLLPMFTLGHNFAPANIHAGGLRYHGAGVIVSQLLKDKLMEAVDISQLESFEAGCLFAQVEGIIPAPESCHAIAATIREANKCKESGEEKVILFNLSGHGLIDMASYDKYLSGDLVNYSLTDDDIQKNLDEIGNLA

SEQ ID NO: 9831 - protein, 203 aa, B.fragilis
IFLYLCNLCNKYCFFSLQQDNSMKKDGFSEIYDIYFPKLLRFTRTYLISEDESENIVQEIFIYLWEHRDIIETLQNLNAYLFTLAKNRCIDYFRKEMVREVRKGSLSEIENRELQLKLYSLEAFDNDRLSDADIEEILNNAINRLPERCREIFIMSRLQNLRYKEIAEKLNVSPNTVENQIVIALRKLKEDLKDYFPLFVFII

SEQ ID NO: 9832 - protein, 278 aa, B.fragilis
IQLYIMGKTVTTYLIDGDPKGSQYVFISNKICQMFVIPRASLSILNERKDLQTPAFYILLGEDENIKPKAYIGETENFRERVKSHDSKKSFWQKALIFISKDAAMTKADVQYLEHRAIADAKKANVFMLDENKQIPKSPNLPEYQKDSMDEFYDDIKFLTSFIGCNIFEIIEPKDKPIFQIVSKKCDAKGFYDTSGFTVLKGSRISDKSTDSLSWRDKRTKLIEEYANNKNFVINEDITFSSPSKAADFCLGSSSNGWIMWKTERGQTLDSVYRKQLE

SEQ ID NO: 9833 - protein, 305 aa, B.fragilis
VITYIVMGQNIYCYGNVIFADKSKKRIMKYIGAHVSASGGVEFAPVNAHEIGANAFALFTKNQRQWVSKPLTEDSIRLFKENCEKFGFAPEYILPHDSYLINLGHPEEEGLTKSRAAFLDEMQRCEQLELKLLNFHPGSHLNKISVEECLDRIAESINLALEKTKGVTAVIENTAGQGSNLGNEFWQLKYIIDRVEDKSRVGVCLDTCHTFTAGYDFLNDYDDVFGEFGEVVGFEYLRGMHLNDSKKELGSRVDRHDSIGKGLIGFAFFEKLMKDPRFDNMPLILETIDETLWPEEIAWLREQTQ

SEQ ID NO: 9834 - protein, 855 aa, B.fragilis
SNEYMNTSQQKIYNYFEREPELKVLFIFNDVFLADELSVVEWKAGYRYVDFKGDWFTTKYKLDTEWADEKVILYFHQPSPLQIKSLQEKFPLLDLLVANMEYHHQDYAAYMQQYGLPSNMTLFVEKNIQQLQSDRMLRLLQSHYADGSISIDVAVRAFLSSYFQQQRVLDWDYIILRILLQGCSSERSRQTDFYSRLKVAPMVKAALDERLKSIFGCTVDLNTEAKVEKLIQVLKYNSIVQNLAPVNADNYKTNRIADSLALQQMNRILELALSSSKTAAALQEVMIELGSDIHDDELIKWYGTEADYYFLPDQLCIPILRTLMEHSIATEPQKVINRLEELIIKHSGNEDLNIVMDYNLLVARFYEGALSLGSLTLNTPDEYLECYRNVYYLTDQLYRLSIENYYKISPSIVLYETIQKVKYALDIYYAKLCNRINLEWIHCVKESGGLSSVHALRQENFYENQIKPIQKKVVVIISDALRYEVAQELIGALARRKHIAHLNTAIAMLPTETKFCKPALLPHRELRLYSEVDGEQNMGVDNRILNSTVKRTEQVNAYRTGAICIDYDEVAKYDQVKNREIFKHPLVYVMHDTIDDKSHGATAKEVVNSCRDAINELEMLVHKIHETYNVTEVYITADHGFLFNDQQFEEKDKHKVTEPALENKTRYYLTTTGNKVADIAKFPLAEVSGMNAENIYVAVPEGTNRLAAKSGGYMFTHGGASLQEIIIPVIISRQEREDVKQPVGVMVLDRNLSIQASRLRFKLLQTDAVSMDMKARIIHVALYNNDKAVTPVKEFILDSTDVLLDNRKVLVDLTLNQNVDAKVLQLKVYDITDELNPLIKENVTNNTLIGNDFDF

SEQ ID NO: 9835 - protein, 83 aa, B.fragilis
VVLYSSENSLFVYFYLLIYEFRSMIHTIIGDPNKAVTALIGRVPCIPGSWEIKSQTNSVMAPQSMEAGRMMRWLGLPNKPRAT

SEQ ID NO: 9836 - protein, 285 aa, B.fragilis
FLYLRIYLKNQRMNRMKIKHIYVEGYKVFHNFDIDFTEGEKTQNLIVITGVNGNGKTTLLRDIIADTNATKKPKCAITIQDDKGLNTFLLPLQSENERYEEAFSKVSFYQTRDNSSVEKLQKDIVSYVDKVVYEIGKTSFDAYVEIQRMLDDIFCGFNLQIRFKSLNREKKLIFTNTRQEEFGIDGLSSGELQILSKVFVLFTDDMKGHVILIDEPESSLHPSWQTRILPVLRHCSETNDCQIIVATQSPLVIDSAYKDEIRFLTRDNEGYVKAEIASVTLSAEQ

SEQ ID NO: 9837 - protein, 194 aa, B.fragilis
NMNLNDNYIFTLSFPEAKSIVASGDIHGDFIQLVFKLCVQYQMKDTILIVAGDCGFGFEKKESYENMVKQNVKRMNEANNWIVFIRGNHDNPAYFDGYTFKYKRFIAIPDYTILQARSHTVLCVGGGISIDRQYRLQAWEKKQVRSVSESSTDKLARNVYRSTEAPVFDKEKMVTISAKYTVDAAITHTAPSFC

SEQ ID NO: 9838 - protein, 161 aa, B.fragilis
ICRQGNMVCIRRGIYATLEQLANTMIDLEVAVPDGILCLFSAWNIHGLTTSLPQAYHVAIKRGKKIRLPEYPPIALHFLAESILELGAEEKVVSNYEIKVYNVELSVCDAIKFRNKIGIDVCSKVVNNYLALPNRDLTLLMDNANKLRIAKTLEKYLEIKL

SEQ ID NO: 9839 - protein, 65 aa, B.fragilis
TETQDKHLSTYEDCTGCRFLIVDVYSKFIGFYWWVWFACITGKDRINDTQLIYYGLRLVVRLFAL

SEQ ID NO: 9840 - protein, 82 aa, B.fragilis
EGKHYICTYISRMYNMEKKDMNRLKVVLAEKKRTNKWLAEQLRKDPATVSKWCTNSAQPNLENLIEIAKCLEVSVNELIRNE

SEQ ID NO: 9841 - protein, 83 aa, B.fragilis; identical to SEQ ID NO: 6082

SEQ ID NO: 9842 - protein, 124 aa, B.fragilis
LLINMTAKKTDYIIIYTFLCASILSIAVLVRMFAVAELKMDEFSAFMAFFVTCLLLGGIYFSFQSILNDCLLPIMERIFSKKHLHIEPELKVTLIAETLQEKPSIPKYGEYKQTAQDKLAQKQA

SEQ ID NO: 9843 - protein, 70 aa, B.fragilis
NLNKTFLLSIHYSPKDVFLNVRLKTHQKRVIYYEKGYIKMKRENINPNNYHLFENEVISIKIEVKNKSFY

SEQ ID NO: 9844 - protein, 849 aa, B.fragilis
HKYNMKHLTVYFLLALQGVLFSFSLSAATPQNAIAYHDGNVRFSVLTDGVIRMEWSPSGSFTDDPSFVAIHRNLPIPKYTVQNKNATVVISTARMKLKYKKGQGPFTKDNLTITSAKGMFPFQWTPGTIQKGNLKGTDRTLDGFEGDHNIYSHQDMKLEDGLLSTDGWTLIDDSKNFLFDNSEWAWVKAREHKDGQDWYFMAYGHDYKAALKDFTVFAGKVPLPPRYAFGYWWSRYWSYSDKEMRQLVDNFHTYNIPLDVLVVDMDWHYTDPGFGGWTGWTWNRRLFPNPAKFLGYLKSNDLKITLNLHPADGVAPYEEKYPEMAQWMGVDTAKQERIPWVVSDKRFINGMFNKVLRPMEKQGVDFWWLDWQQWMYDKKVDSLSNTWWINYVFFSDMERNRDTRPMLYHRWGGLGNHRYQIGFSGDAVISWKSLEFQPYFTNCASNVLYGYWSHDIGGHMFKGGDKEILDPELFTRWMQYGALTPVMRTHSTKNSVLNKELWNFKGDYFEALRNSILFRYQLAPYIYTMARETYDNGISICRPMYYDYPEAKEAYDFKSEYMFGDQILVAPITTPMQNGLSTVKVWLPEGNDWFEWTTGTLLKGGQIIERSFTLTEYPVYVKAGSVLPLYNRVKNLNSNSEEIIVNIFPGENGSFTFYEDNGNDKYYANEYARTRMYTERKENHLTVTVGPRQGKYRNMPTDRQFKIKVLGSAIPETITINGNRAEYEYIGDELALLITIPQTACDQEKTIEIQYSTSIPELNDGIVSQFKRFSKAITALKYRDAGIVLTPAMGATEATSIALTYSPERFNELIETFKRNYSQMPEMLKEQKLNEANSQWFMKAIGWKK

SEQ ID NO: 9845 - protein, 962 aa, B.fragilis
KNNKVLTLLHCKSMKKNLLLLSYAIKQREIIQILRIMKCTVLLLFLLILQAHASVSSQNARVNMSRNQLPLKEFMAEIEKQTDYLFIYSDAEINASRQVTVKKGTHRVADLLREVLSKNNISYNFADNYISLHVRKEADVQSLAVSPQQKKNTVLVSGTIVDTAGEPIIGANIKLKGAQGTGTITDVEGNFKLEVPTNGVLIVSFIGYQQQEVAVNGKTMLKIKMAEDAEMIDEVVVTALGIKREEKALGYAVQKVGGSKLSTVKPVNIATSLTGKVAGLNVTNSTEFNTAPTLKLRGETPLLVVDGVPYSNISLNDIAADDIESVDVLKGATASALYGARGGSGAIMVTTKKGSQEGLNISVNSSTMFNAGYLVLPEVQHGYSTGQGGKYTAADFVWGDKLDIGRTAVQYDPYTYEWKEMPLVSKGKDNFKNFLETGFITNNNISISQTGKYGSFRSSLSHVYNKGQYPNQRLNKITYSVGGDMKFGKLSFEGGAIYNKRFYPNGEGAGYGGGGYIYNLLVWTGTDYDVRDYKNYWRKKDEEQNWMNDVWYDNPYYLAHEMTSSNDYDKVNTYLSGKYDIMPWLNFSMRAGADAYASRTEKKNAMSARGGWDKNGYFYTSKSTGFSFNGDALLSANHSFFDFAIDGFVGGTRYYYYDDAISSNTRNGLSIPGYYSLKASVDPIASSSSYKQKQVNSIYGKFSASWKSTVFVDVTARNDWSSTLPSETRSYFYPAVSGSIIMSQLLKMPEWLNFWKLKGAWTVTNSDLGIYDTNQAYSVSTNVWDGMNTAVYPEMIRSTTLEPTAARSYEIGTAFNVWDNRLRFDISYYNKLKYNLTREATISGSSGFTKTLVNYDEEQVRRGVEVSLTASLIQTKDWNWEVNANWARDRYFYAKVDPVYSTQKPWVAAGKRWDWYGIYDWERDPQGNIIHENGYPVQSKYQSVMGNEYPDWIWGLSTTLRY

SEQ ID NO: 9846 - protein, 325 aa, B.fragilis
NILKMSELIDKYFAGEMTCEEKKDLFDRIESDEALKKEFLRMQNVVALTQILSRQDDSETSRKGKQHFMQLLFRKRLKRAITVSLKYAAVFAVLVVGTFYTAKLYLSEEFGKSYTIVTAPKGQRVKIELPDGTIAWLSPCSRLRFAASFNETDRKIELDGATYFDVAKNPEKPFVVSAKGYRIRVLGTKFNISAYKNSKEFETDLVEGCVHIYDPADIRNEVFLQPKEKAVLWGDRLMKRESDFDNEEYLKNGVVSFLSEPFGRVLNSVALWNDVNIKIERSVNATQRISGKFRQSDSLESILKALQGAMPFKYKIVSEEEIIIY

SEQ ID NO: 9847 - protein, 320 aa, B.fragilis
IPLKLLFIPLWIVLQRTQSYMQKRLIHLSIIFFLLCPALVVAQNSPLETQLKKAIEGKKAEIGIAVIIDGQDTITVNNDIHYPMMSVFKFHQALALADYMHHQKQPLETRLLIKKSDLKPDTYSPLRETYPQGGIEMSIADLLKYTLQQSDNNACDILFNYQGGPDAVNKYLHSLGIRECAVIHTENDMHENLEFCYQNWTTPLAAAKLLEIFRNENLFDKEYKNFIYQTMVECQTGQDRLIAPLLDKKVTMGHKTGTGDRNAKGQQIGCNDIGFILLPDGHAYSIAVFVKDSEADNRENSEIIAEISRIVYEYVTQQID

SEQ ID NO: 9848 - protein, 174 aa, B.fragilis
MNTNERPEMTEKQSCHWYLAFTASRAEQRVKQELDQRKVRNYLPLRKITYQWQGRSKEALCPQIARCVLIWTSLSDIRQLSGISGLIIPQNIWDYRVPEWQVESYQLLFSQMDTAVEWIPDCLESATMVRVTGGPLTGLVGELDTSDTGFRIRIRFHSMGCFRVAVPEEWIEKF

SEQ ID NO: 9849 - protein, 422 aa, B.fragilis
TMKKLLVYADFDWLKDIELIGELSYESLRGSDSYAFKFNDEWLKLYGNLFISADLNNYKGLQYTQPEKDIFGCFSDALPDRWGRTLLNRREQILASEEKRPVRRLSSFDYLLGIDDSSCMGGFRFKETPDGDFINSSNTLRIPPLTSIRELIHASGEIEKSEEENKIPDKKWLTQLLQPGFSLGGARPKASIVDTNKVLYVTKFPSRKDDYNTGLWEHFCHLLAKKAGINAASTRVISTSDKYHTLLSRRFDRKDDGKRIHFASAMTLLGLSDGANASTGNGYLDMVDFILQNCTEVNKNLQELYRRVAFNICVGNSDDHFRNHGFLLTSKGWTLSPAYDMNPTLNEYQSLLISNSSNKADLTILLDACEDYMLPWDVASKIISEVVIAIRDWKILATKLGITNSEMELFGSTISNRIKEHI

SEQ ID NO: 9850 - protein, 213 aa, B.fragilis
LEMNKKNSPYTATITGCAFLYNEYLRILPLLMSENATELLKDEVKTNQILQVNSQKARQTFITEFKRRYNAVPATFWVNFQTMTEQAQRAGLLYAILKAYKLAFDFHFNVTVKRWNSVEQTLKKNDIMMEFNELSARDEFVDSWTDNTKDRCASQYLTILRQAGLLNSKTDELKPIHLEPSDYTFYIRSGEEWFLEACLLYPYEVNDIKSQVK

SEQ ID NO: 9851 - protein, 69 aa, B.fragilis
RSSETEKEIMLAKGVKIVSGKVEFNPTGKNGERIHGWFAPNGHSGFPMKGFIKKYQSLGQGGKVYPNRD

SEQ ID NO: 9852 - protein, 1215 aa, B.fragilis
IQYDMKFKDLYEKGLDRKVNPAVSASDLSEDTVLTEIVEYVFTQEIIVNLYHILINIKINQGSHVGIWINGYYGSGKSHFLKYASYCLSNKYSEMAFIRLIEATQEMMLGEKDVTALEQAGVSLSELRALQSWYVNKADVEMVIFNIGDVHDANADQATTFTTIFWNQFNAKRGYNSFNLAMAQYLEKALDDDGKFQEFKDYVKSKGYDWERNISRFAAGRLDLALQMAKEVDPALAIDVIRERILKNDVNVSVEAFAAEMKEYLDHKNNRNFRILFFIDEVSQFIGEHRDLLLQLQSLVKRLDEVCESQVWISCTAQQTLEEVVTKVGGSISNPEDEVGKILGRFEVRASLQGTSPEYITQKRILDKKGEVELQLSELFEKKKAMLDAQFILPSTYQAYKNKEDFAAFYPFVPYQFQLIMKVLDSFVNMNYVDKQVKGNERSLLNITFSIAKETAECEVGEFIPFDRFFGAMFQGSMQHIGQRAMANAREALDMVTDEDKQTFYRRVVYVLFMVCNLSEVDKQSFSATIDNIVTLLMTKVDANKAAIKEEVSQVLSFLMDKAVIRKIKTDNGTEVYEFYTEEESKVAQIIKNQKVDNNTYTEELYKIISDHFSFSASTNKETFITRSFNIGGNVDGRNILSNNPDVVVDFLTTASTDSPEQYAFTNQPNHLAFFLFPLFKNNAELRQNFLEYCRVQCFAQEQAISEERQRTKRIFSDRAKELYKNEIKPQFQQMLDACPVISGQNILSPSVLGSAKNKERYKAALTNHLKNLYDSAHLVNGSEYPKSQSELSDKILRPVEATLVDLPLTTAEKKVKDYLDRAPHDVTVADVVRQFAKVPYGWADCCSIYVVNELVRRHLYAFNYNNNPNVSREDTARNIMRDANRFTIEPAKAISQDILNEFIEAWKHIFNVVTLKGSNDSTELYRNCKETDDSALNRLLSNYRKLSRKINGCPFESVIDEAITLMEKWTNIRDHKEFFLTITEAKESAATLFDRCKNINTFVNDQFEGYQKVKLFIQENRDNFAFLPKDQEEAQNRLCAIHNDMEPWDNMPAYLKMMRNLSGRLEECKATLIKTINTNYNKAFDELEEYAVSMKVGRDKFAKRDITISQKINTGNFYALQANAVIAGFYEEQMKKINEAVPKPVDPKPYTPVADGGGSVVKEPIATPRARKMVHLHTHTTQPIQTEADIDRYLQKLKAELMQHIGGDYDIIIS

SEQ ID NO: 9853 - protein, 728 aa, B.fragilis
ATMEKIRTNHIRVEFLWKEFLEDYDFFKIEYGDVDFDNITGIYCKLEGLCPNSAICAFNKMAKNAQPGESSKHRIFLFASSKKEKVTVAQLQECMKKVNVKIKQITYCPAHNEGIYTYNMLNLLLSMIPNRNKTLSYAHGKLICGTCSSIYNKGRSAGEELGLHISFDYDNLLTAHTLTFAEEDRVEQKKKKGSSVYHLEFDEKRIYFSSKKKKGTQEYYNHPSFLRKDNKNRIPFLGFGDVEHFEESQAYIIRTVLQEFLTTYSKYISVDPIEYKKPMLLKAQDAEFKKEDELLRDMLSTSWIDIVCHTSEAGVEELRNLIEQKSREYIKKLFSNNFEGCYEKDKSKKQICIRIVGDKYQEGELSDSKRKALDHRRLKEKVDLIEKKIPTQDVMIKSEIEMATIKNIFRQILIKDYCIKETLPQYMIDRFKGCVITYAEKKTNDLYYFVQLTIGKDGLIIYKVEEPRLSHDDVITVMGENFESYEYHIPAFKKGYNKNFIYCIEKDGITYNIYDTCEFVFPEMEEIHQALVELKNVQVPVVIYHDLMDMVQRDESKVLCKQRIREYADNVPHDLFYSDIKKLGKEAPLEEKLTRKLMRFVTSKYNIKKGQDFRTAGRSEETLAACVNVHYWKQDAKLWKYCAGPNTKGKFDSINHKVYVRELVSDMTPNEAFVNELIYSLGDGWNKINEFSVHPSIFKFLKERLEIYKAQEQLNELTKKLKYKYFLG

SEQ ID NO: 9854 - protein, 679 aa, B.fragilis
TTMELHDKVMNAFIGKVVRKDLAFLVKGGLPVPTYVLEYLLGQYCASDDEEVIAEGLEKVKQVIQHNYVHRADAESIKGIIRENGHHRIIDKVTVVLNEKADEYHASFANLGLGSVPIGTEYVRKNPKLLSGNGVWCIVTVGYISGEDVKVRWEIQSLKPIQISNVDVQEYIDQRQQFSTDEWIDFLIHTIGLNPEKLNRREKFISLARLLPHVENNFNFMELGPKGTGKSHVFQELSPSGVLVSGGDVTSARLFVKMSGNREILGLVGYWDVVAWDEFEQQKGRAVDAVMIDTMQNYLANKSFNRGKGTHEASASMVFVGNTKHTIPFMLNNSHLFESIPTSFIKGAFLDRIHLYNPGWEIRMLKKESFSKGYGLITDYIAAVLHELRNRDFSSNLNSFVKFSGTLSERDHLAIRKTFSGMVKLLYPDSNYTDEEALEIIEFAAECRKRVKDQLYIIDETFRAEPAKFEYLILKTGETKQVETLERIENPAIIEDIQTEEPIEVASEPATTTSNPSIRPRIPQLASKQVDIRMNQRGVSYKSLFGDYIRTAKKITIVDPFIRVGHQIDNLIEFIQMAREVCLTPEELEIELHTQNEEDKIPEVIDIFNELQEELSSYGVTFNFMFDAGHDRKIDLDNGWIINLGRGLDIFEKFSRFSLSNSRQENRRCKEFSVTYMYK

SEQ ID NO: 9855 - protein, 98 aa, B.fragilis
ILRLPWHQIEHCSSKDTITQAMTMDIGFGDVVTPKTIPLDYSLLLKHLPIANILVYSIETVIAEKMHTVVDLADQSSRMKDYYELYQILSANQYDVSV

SEQ ID NO: 9856 - protein, 96 aa, B.fragilis
AFVCIHKSSFLSNKIVPIAGLKYDKAVALGNSVLVSFGKNFFLFGYVEQAISNRFSVVLYIITYSFISRYFSRVFAIRSLFALSINRVRSRLGSAR

SEQ ID NO: 9857 - protein, 89 aa, B.fragilis
TLERVLAYTSQQLALYMKENQFNQLYEHIRMFQYVTEEECQLIQNPVTIDSQIKSIDLMHFGWNIGNAFGKPRLQTATFIKKVFAHYSP

SEQ ID NO: 9858 - protein, 369 aa, B.fragilis
IKRRLERLLSPLCFHYLRNIPYFCQIIIYFYIQNTTMKHLVICIALLTVGACCFAQQKKVASHKATSGNPVFQGWYADPEGIIYDDTYWIFPTWSDLYENQTFFDCFSSKDLVNWTKHASVLDTTAVKWAKKAMWAPSVIRKNGKYYIFFGANDVHEGEIGGIGVAVSDRPEGPYKDLLGKPLINEIVNGAQPIDQFVYNDNGHYYMYYGGWGHCNVVQLNDDFTGLVPFEDGTVYKEVTPENYVEGPFMFKKDGKYYFMWSEGGWGGPDYSVAYAISDSPFGPFKRVAKILQQDTSVATSAGHHSLLHAPGTDDYYIVYHRRPLNDNARDHRVTCIDKMTFDKDGFINPVKMTFEGVPAQKIKKSKKK

SEQ ID NO: 9859 - protein, 72 aa, B.fragilis
YIESSGIKDKCYRQDGISKLTEICRFFDLPDLKHIYLEKKDIATIANFAANQILFASQCFFLVHSLYLFYII

SEQ ID NO: 9860 - protein, 127 aa, B.fragilis
MMTGTGSYRSILLQNLSYPFKRSERRIGNSISYRVIGTSPTTFTPHKIVFTVFLEHKRTFNIVLRSHFFIDSAIFKRNEPCKIIVQLYNIAMPPTTIIHIIMSIIIVYKLIDRLRSIHYFINQRLTQ

SEQ ID NO: 9861 - protein, 660 aa, B.fragilis
RGCGNNRTKETEIIINKRITIMGKIIGIDLGTTNSCVSVFEGNEPVVIANSEGKRTTPSIVAFVDGGERKVGDPAKRQAITNPTRTIFSIKRFMGENWDQVQKEIARVPYKVVKGDNNTPRVDIDGRLYTPQEISAMILQKMKKTAEDYLGQEVTEAVITVPAYFSDSQRQATKEAGQIAGLEVKRIVNEPTAAALAYGLDKAHKDMKIAVFDLGGGTFDISILEFGGGVFEVLSTNGDTHLGGDDFDQVIIDWLVQEFKNDEGADLTQDPMAMQRLKEAAEKAKIELSSSTSTEINLPYIMPVGGVPKHLVKTLTRAKFESLAHNLIQACLEPCKKAMQDAGLSNSDIDEVILVGGSSRIPAVQKLVEDFFGKTPSKGVNPDEVVAVGAAVQGAVLTDEIKGVVLLDVTPLSMGIETLGGVMTKLIDANTTIPARKSETFSTAADNQTEVTIHVLQGERPMAAQNKSIGQFNLTGIAPARRGVPQIEVTFDIDANGILKVSAKDKATGKEQAIRIEASSGLSKEEIEKMKAEAEANAEADKKEREKIDKLNQADSLIFQTETQLKELGDKLPADKKAPIEAALQKLKDAHKAQDMTTIDSAMAELNTAFQAASAEMYAQSGAQGGAQAGPDMNAGQSNAGQNNGKQDDNVQDADFEEVK

SEQ ID NO: 9862 - protein, 196 aa, B.fragilis
IIVMPSSSVLIPRICEYCDKPFMARSVNTRFCSTICNNKSLRERKKREKEEQRQISLLDTKKNKIADIQTRPYISVSEAAQLIGVSKSTIRRMLCRGMLAGANLGIRLTRIDRTQLEQLFTSIIVPEEQIKPKFYELDKCYTIGECLKKYNIPECRLESIIRAFNIPKRKVGNYVYIPRIEIDRVLNKIDGNMENA

SEQ ID NO: 9863 - protein, 318 aa, B.fragilis
LICISKAKENMPYPIENKLVIAVASSALFNLIESDSVFKTQGESIYREYQENRLDIPFEKGVAFPFIKRLLSLNQSFPEEQPIEVVLLSRNSPETGLRVFRSIQSYGLNISRAYFSSGQNNFQYLPAFNASLFLSANSNDTRSAIENGFAAGTVLNKVVVDDDDDMELRIGFDFDGVLADDASEQVYKKANGNMNEYFEHEKEHAADPLAKGPIGNLLQKISFFQKMEKKRAKADPAYRRVLKTAIITARNAPAHERVITTLKNWEVEVDDAFFLGGIDKARVLNILKPHIFFDDQMVHLNHIDKIPAVHIPFGIANK

SEQ ID NO: 9864 - protein, 62 aa, B.fragilis
SDSMYQKINPLISGELLTLINVLLYIDIADLNGFETLNFPSHLDVLSRYIANSNDTPNSVST

SEQ ID NO: 9865 - protein, 95 aa, B.fragilis
LRILGSLGILFVFIFILSILEPKMSIMTLTFECVSALSTVGSSLNATPLLCDESKLLVSLLMFIGRVGFITLVLGIVKQKKNTKYRYPSDNIIIN

SEQ ID NO: 9866 - protein, 396 aa, B.fragilis
SGIILYFCATTIQNSDMMTRFSFVLFALISLLLTACQDKQKVVSNTENGTSVPLSYAQGFGITHSSGYTTITVYNPWKPGEIYDTYYLVKNEGQAVPTDGLKVVIPLKSIMTNSATHLGFLELLGELDKVTGVCNSNYIYNPTILQGVKDGTIKDLGDAFNLDIENLLLLHPQAVMTSAYNAEDENGRRMKQTGLPILYNIEWQEKSILGRAEWIKFIGAFFDKEKLADSIFSQIAEQYNEIKKKAEKLSYSPSILSGQDYRGTWSMPSGRSYNAQLFRDAGANYYYANDTTVSGSISSSIEEALIHFNQADIWVGVQANTLEDLGKMDPKYKLFKSYKNGNVYHINKRTNITGGNDYWESGVARPDLLLNDMIKIVHPSLLPEYELTYMDKLKSK

SEQ ID NO: 9867 - protein, 536 aa, B.fragilis
KGIMTAEDILKLRDLGEVSKMQFKERLLDKYDIGCEIVAFSNTHGGQLIVGINDKTGKINPLSFQEVQETTNLLSNIASENVVPGILLTIDTVSIEGGTIIVTTIKEGLNNPYHDNKGIVWVKNGADKRKVFDNAELAEMMSECGSFIPDEAAVNDATIDDLDEKTLKLFLSNKFETALKTKGMTGDRLREASLDEVCSTIVQGHDKQKLLRNLHFIRPDGKLTIAAILLFAKYPQRWLPVMTAKCISFVGNSIGGTQFRDKVNDTDMEGNLLHQFETIMSFFTRNLRTVQVKKEFNSMGELEIPYTCLVELVVNALVHRSLNRKAPIRIFIFDNRVEIHSPGTLPNGLSVDDIIAGTSMPRNNFLFANAIYMLPYTGAGSGIQRALSQDKKLSFSNNESLHEFVITIERDGVIVGADLDTSLQNSDANLDTLQQDLDTQQAIPSTDLDTSQLDLDTQQATSNTSMRIKLSNKQKDIVNYCSVPRSSKEILERAGISNHSKNREKYVTFLVEAGYLEMTNPENPTASNQKYRKKLK

SEQ ID NO: 9868 - protein, 60 aa, B.fragilis
TDRITDTSICISRIYSESDLPNRGWKMKDEGGRWKIEMHFSYERLQGSFEKKTAPAPDAE

SEQ ID NO: 9869 - protein, 724 aa, B.fragilis
VRKMGKKVLVFLLLLSFIGWTKAQQEELQNGTEQSKQLQVFGRNIFASRNLSFEPNLNIPTPENYRLGPGDEVIIDVWGTSENTVRETISPEGNIMVENIGPIYLSGMNMEEAERYLRHEFSKIYAAISGESAHIKVTLGKIRSIMVNVMGEVEVPGTYRLSAFASVFHALYRAGGVNRIGSLRTIQVVRSGMKVADVDVYEYIMKGKLTDDIRLSEGDVILVSPYENLVGISGKVKRPMIYEMKHGESLATLIGYTGGFTGDAYRNTVRLVRRSGREKQIYNVDQQDYDNFILTDNDEVSVEAVLGRFSNKVEIHGAVYRAGMYQLDSVTGTIKRLIQQAEGLRGDAFLNRALLRREREDLSHEMIPVDLKKLMEGTAPDLPLQKNDVLYISSIKELEEEGVLFIYGDVAKPGYFPFARNMSVQDLILKAGGLLESASTVRIDVSRRIKDPKSVSSSTVIGKSFTVELKNGLLIGESNTLKLEPYDMVFVRRSPGYQKQANVTVNGEVTFTGNYALTKKNERLSDLIAKAGGLSKSAYAKGARLMRRMTADEIRQKQDAVRFATKGTGKDSVSLSSLEVDQTYYSVGIELEKALAKPKSDEDLVLREGDVLFVPKYVSTVTVNGAVMYPNTVLYQKGSGIDYYIGQAGGFGNRALKRRAYVVYMNGTVSRLRRNTANAIEPGCEIIVPSKGERKKMTTAGAVGMSSSIASIAAMVASMVSLTK

SEQ ID NO: 9870 - protein, 78 aa, B.fragilis
RNISYLYNQINEHQYLIDMNCITETFEIKIIEKTWFVEKIGKSFRYTKTDACNYCHPGLEQLSEIAKILLVEPQKLYI

SEQ ID NO: 9871 - protein, 233 aa, B.fragilis
SVEFIMKYIIIGLGNYGHVLAEELSTLGHEVIGADLDEGRVDSIKDKIATAFVIDATDEQSLSVLPLNSVDMVIVAIGENFGASIRVVAMLKQKQVKHIYARAIDGVHKAVLEAFGLEKILTPEEDAARSLVQLLDFGTKMETFRVDSEYYVVKFNVPEKFVGYFVNELNLDEEFNLKLIGLKRSNTIKNCLGISLVEHKVVNELPEDAKIRPDDVLVCYGKYSDFQKLWKAL

SEQ ID NO: 9872 - protein, 84 aa, B.fragilis
KEMLVTNTMEATASTTDSCQVSEPVTATQETPRTIATYTATTPAMHRKSFKEQEPAIFSIIGFAVAYIAALIINRIIKTRKTHH

SEQ ID NO: 9873 - protein, 448 aa, B.fragilis
YKVLMNKLLITLCLAASFMLSGCYNSGEPREKVLKIYNWADYIGDGVLEDFQAYYKEQTGEDIRIVYQTFDINEIMLTKIEKGHEDFDVVCPSEYIIERMLKKDLLLPIDTVFPHSPDYMNDVSPYIREQIDKLSQPGRVASHYAVCYMWGTAGILYNKAFVPDADAESWSCLWDRKYAGKILMKDSYRDAYGTAIIYAHARDLAGGKVTVEDLMNDYSPRAMEIAEKYLKAMKPNIAGWEADFGKEMMTKNKAWLNMTWSGDAKWAIEEADAVGVDLDYVVPREGSNIWYDGWVIPKYAGNPEAASYFINFMCRPDIALRNMEASGYVSAVASPEIMEAKTDTTLTYYSDLSYFFGPGADSLQIDKIQYPDRKVVERCAMIRDFGDKTKDVLEIWSRIKGDNLGVGITILIFIVVGLMNGWMIYNGIQRFNPKRLQRRRSRRRKKQR

SEQ ID NO: 9874 - protein, 1069 aa, B.fragilis
YFCTRSNKHKYFFIKDMTLFTNIKSFDKSFLLKLWLSLILYQLSVCPVSAQKDTMDIKDYILIINTYTESFPWSNRLISTATNFVKDDPKLAVYTEHMNMIMIDNDSILDQFKDSLFDRYGSHRPRMLLLLGNSSLILKDDLRKMWGDIPMVLCAGKDYTGPEHYYLTKQPIPLSERVPLAELSQSCNLTYLYANLYIHENVEMMFRTLPRMKRFIYVGDERFVNQVNSQEIQEILRTKHPDVHYTFLSSRDIKKTNQLIDSLNFVDPRTTGILFSSWFHKRQFAGNMMLTMILPEIVSTVSPPIFALNMIELNDKESGMVGGYTYDQNHFNEKLSNMFSEILSGKSPRDLPHYLPTDGTPLINYQVLVRKGLSPDEWPAHTRFLNKPITFWDKYKYFLPGTTVCIALLVWFFLYRIRTLTHLRQIQLKEIEAMANYKNLIDNMPLLYMQEKLIVNEQGVADDLIYLNVNPHFEKHFFRREDVVGKRASELFPESLPEFLHFIQISLKENRAITFPYYFKKIDRFYDIVLKGAHQENVIDIFCVDSTELHRAQQKLNATNHKLSMALEVADIIPWKWDLLSKTILCDINKPIELSAQGNNVSEEQLAVPDSQYFSKIYKEDRIRVEQAYKDLIEGRLEKVKEEYRVINIRNHTHKIEWVEAQAAVETRDENGTPVTLVGSSQVITGRKKMEMELTSAKDRAEESNRLKSAFLANMSHEIRTPLNAIVGFSGILASTEEEEEKQEYVSIIENNNALLLQLISDILDLSKIEAGTLEFQYSDIELNTELKKLESTLKLKLKSDDVQLEFVPGLPACPVCTEKNRLSQLIINLVTNAIKFTSRGSIRFGYEHRGKELYFYVTDTGCGIPKDKQESIFGRFVKLNSFAQGTGLGLSICRTLVEHMGGHIGVDSEEGKGSTFWFSLPYKAASTSAGTMQKTEIQPISVEKDKLTILIAEDNESNYRLFESILGHDYHLIHAWDGREAVERFKRENPQIILMDINMPVMDGYEATQEIRKYSAKVPIIAVTAFAYASDEQRVMENGFDGYMPKPINARQLKAQITEIMQKRIILL

SEQ ID NO: 9875 - protein, 65 aa, B.fragilis
VTYTKVIPRDLCISFNSICMSLRIFRSRAAKGSSSSNTSGSLTMARAMATRCCCPPDSESTSRYS

SEQ ID NO: 9876 - protein, 395 aa, B.fragilis
SNITEKFYPELKKHLSLHKYLFTKHTKAMKKLTYLAVAAVALGVASCNTNKPGYVITGTVEGAADGDTVFIQERVNRQFNKLDTAIIANGTFTFEGAQDSVVNRYITYSKDGDGVYVDFFLENGKIKVNLSKDDKSATGTPNNDAYQEIRNKINAIDQKQAAIYQAMGDSTLTDDQKMAKQKEFSELEEAYSQAIKEGVQKNITNPVGIMLFKQSFYENSTEDNDALLKQIPANYQNDETIVKIKDITEKQKATAAGQKFIDFEMLTPDGKPVKLSDYVGKGKVVLVDFWASWCGPCRREMPNIVEAYAKYKGKNFEIVGVSLDQDADKWKDAIKKLNITWPQMSDLKGWQNEGAQLYAVNSIPHTMLVDADGTILARGLHGEKLQTKLEEVLNK

SEQ ID NO: 9877 - protein, 204 aa, B.fragilis
NRSTMNIISDILYWISTGLLVPDIVLLIVLFGRALLLVGSFYGQYLSIRKTEALLRNELNALTPATVMELADKLPEKSSSLVISYIRQVLQAHESPAQIQRLLANFEIAADKDLAISKTLTKLGPILGLMGTLIPMGPALAGLASGDIASMAYNMQIAFATTVVGLVAGAVGFLTQQVKQRWYLQDMTNLEFLSELLNEKRAAR

SEQ ID NO: 9878 - protein, 597 aa, B.fragilis
YCQTRINKLKKYMATKGTVSGVIANMVTLVVDGPVAQNEICYISTGGDKLMAEVIKVVGTHVYVQVFESTRGLKVGAEAEFTGHMLEVTLGPGMLSKNYDGLQNDLDKMDGVFLKRGQYTYPLDKGSVWHFVPLVSVGDKVEASAWLGQVDENFQPLKIMVPFTQKGVCTVKSIVPEGDYKIEDVVAVLVDEEGNTVEVNMIQKWPVKRAMTNYKEKPRPFKLLETGVRVIDTVNPIVEGGTGFIPGPFGTGKTVLQHAISKQAEADIVIIAACGERANEVVEIFTEFPELVDPHTGRKLMERTIIIANTSNMPVAAREASVYTAMTIAEYYRAMGLKVLLMADSTSRWAQALREMSNRMEELPGPDAFPMDLSSIISNFYGRAGYVKLNNGESGSITFIGTVSPAGGNLKEPVTENTKKVARCFYALEQDRADKKRYPAVNPIDSYSKYIEYPEFEAYIAEHINDEWIGKVNEIKTRLQRGKEIAEQINILGDDGVPVEYHVIFWKSELIDFVILQQDAFDEIDAVTPMERQEAILNMVIDICHTEFEFDNFNEVMDYFKKMINICKQMNYSKFKSEQYEGFQKQLEELVAERSVK

SEQ ID NO: 9879 - protein, 198 aa, B.fragilis
RLSAYHLYSDRPFNDPFNHRNQHFMMNIDFITATVLDGAFAAVAAIGFAIISNPPRKAILISAFLAAVGHGLRYFLMHAHLFTMDIATASFFAAVSIGLLAIPFAKAIHCPAEVFSFPSLLPMIPGMFAYKSILALTKFMQTKDETDSLRYLVDFCHNGSTTIFVLFALVVGAAVPVFIFHRQSFTATRLLKKLVKKG

SEQ ID NO: 9880 - protein, 296 aa, B.fragilis
SIPASSVGRNVILKGCVMSKYYYLVAGLPELTLEDSKLSYTVADFKTEIYTGLSVSDQRLIDLFYLKFDNANVLKFLKDKEAAIDTRGNFSAEELAEYISTLKEGGEVSAKEFPAYLATFISAYFNTPAENAVLLGDHLAALYYDYAMKCGNKFVASWFEFNLTINNILVALTARKYKWDIACNIVGDTEICEALRTSGARDFGLSGEVDFLDQLVKISEITELVEREKKLDALRWNWMEDAIFFDYFTIERIFAFLLKLEMIERWISLDKERGNQLFRSIIESLKNEVQIPAEFR

SEQ ID NO: 9881 - protein, 199 aa, B.fragilis
DKAAELTRLACEAAKRHGVTVSVDLNFRKKLWTKEKAQSIMKPLMKYVDVCIGNEEDAELCLGFKPDADVEGGHTDAEGYKGIFRQMMDEFGFSYVISTLRESFSASHNGWKAMIYNGEEFYVSRHYDIDPIIDRVGGGDSFSGGVIHGLLTKRTQGEALEFAVAASALKHTINGDFNLVSVAEVEALVGGDASGRVQR

SEQ ID NO: 9882 - protein, 468 aa, B.fragilis
MHEAVSVNLYIVDAKLPFFSLSFTIFAPQNFKNYSMINEEKIHKSTSGWWALSPLFVFLCLYLVTSILVNDFYKVPITVAFLISSCYAIAITRGLNLEQRVYQFSVGASNKNIMLMVWIFILAGAFAQSAKQMGAIDATVNLTLHILPDNLLLAGIFLASCFISLSIGTSVGTIVALTPVAIGLAEKTGIDLPFMVAVVVGGSFFGDNLSFISDTTIASTKTQGCVMRDKFRVNSMIVVPAALVVLGIYIFQGLSVSAPPLVQEIEWVKVIPYLIVLGTAIAGMNVMLVLIIGIFTSGVIGIATGSLGFFDWFGAMGTGITGMGELIIITLLAGGMLETIRYNGGIDFIIRKLTRHVNGKRGAELSIAALVSIANLCTANNTIAIITTGPIAKDIAKKFQLDRRKTASILDTFSCLIQGIIPYGAQMLIAAGLAQISPLSIIGNLYYPFTMGICALLAILFRYPRKYS

SEQ ID NO: 9883 - protein, 304 aa, B.fragilis
SSMAHSHEHHHEHVHELTSLNKSFIIGITLNILFVLVEFGIGFYYDSLGLLSDAGHNLGDVASLVLAMLAFRLAKVHPNSRYTYGYKKSTVLVSLLNAVILLVAVGIIITESIEKLFHPVPVEGAAIAWTAGVGVVINAVTARLFMKDKEKDLNVKGAYLHMAADTLVSVGVVISGIIIMYTGWTLVDPIIGLVIAVIIVISTWSLLHDSLRLSLDGVPVGIDSEKIGRVILEQPGVESYHHLHIWALSTTETALTAHIVIGDLRRMEEVKREVKHELEHVGITHATLEFEYKGACCEGEDCIS

SEQ ID NO: 9884 - protein, 75 aa, B.fragilis
FIYYSPQCCEEEWLYPFLKYWYLAYCPLSVQWQATGVLYANGKNSMGIRLKDLSKLGYRDNVARSLACYSSRQIL

SEQ ID NO: 9885 - protein, 85 aa, B.fragilis
STRYPPIAGPKETEAAEAMDQNPNAVPRCSGGNTSLTIAMPTGRSMPHPKPSITRQKISSSMVDELPHMKEPAVNTSRDKKYIFL

SEQ ID NO: 9886 - protein, 865 aa, B.fragilis
VFIHQQVNNNIMKIKVSNVNTPNWKEVTVKSRVPAELEKLSELARNIWWAWNYEATELFRDLDPTLWKEAGQNPVLLLERMSYEKLEALSKDKVILKRMNDVYAKFRDYMDVTPDNKRPSVAYFSMEYGLNHVLKIYSGGLGVLAGDYLKEASDSNVDLCAVGFLYRYGYFTQTLSMDGQQIANYEAQNFGQLPIDRVTDADGKPLVVDVPYMDYYVHANVWRVNVGRVSLYLLDTDNEMNSEFDRPITHQLYGGDWENRLKQEILLGIGGMLTLKALGIKKDIYHCNEGHAALINVQRICDYVATGLTFNQAIELVRASSLYTVHTPVPAGHDYFDEGLFGKYMGGYPVKMGISWDDLMDLGRNNPGDKGERFCMSVFACNTSQEVNGVSWLHGKVSQEMFSSIWKGYFPEESHVGYVTNGVHFPTWSATEWKQLYAKYFNENFLYDQSNPKIWEAIYNVPDEEIWKTRVTMKNKLVDYIRKQFRETWLKNQGDPSRIVSLLDKINPNALLIGFGRRFATYKRAHLLFTDLERLSKIVNNPDYPVQFLFTGKAHPHDGAGQGLIKRIVEISQRPEFLGKIIFLENYDMQLARRLVTGVDIWLNTPTRPLEASGTSGEKALMNGVLNFSVLDGWWLEGYREGAGWALTEKRTYQNQEHQDQLDAATIYSILETEILPLYYARNKKGYSEGWIKSVKNSIAQIAPHYTMKRQLDDYYSKFYCKEAKRFKELSANDNAKAKEIAAWKEEVVAKWDSIEIVSKEREADIAQGDIESGKEYTITVVVDEKGLNDAVGLELVTTYTTPEGKQHVYSVEPFSVIKKEGDLYTFQAKHSLSNAGSFKVAYRMFPKNQDLPHRQDFCYVRWFV

SEQ ID NO: 9887 - protein, 231 aa, B.fragilis
LKQQNILSYMKINSLLIAITLLGTMLISFSACNGILSSLYDEPETAKDFGFITIDHANHSGTVRVDATQYTKWNYINLHTLQIDSAKVTAEGADDPDTWDLAIHRYDVKTNGGEVLETDYQSLSALKNAGSMPQGIFVADEWTTNKIAVDVSHMMEDNGYLIYAPSDFNPELSKWLNVDTSEMPPIYTPSNKVYLLRMKDGTMAAIRLVSYMNAAGIKGYMTFDYIYPYEP

SEQ ID NO: 9888 - protein, 356 aa, B.fragilis
TNKQENDMETKKLKKNALFNPEGDTETRLRKMIGGNTTNLNDFNNMRYKWVSDWYRQAMNNFWIPEEINLTQDTKDYPHLTPAERTAYDKILSFLVFLDSLQSNNLPTLSEYITANEVNLCLHIQAFQECVHSQSYSYMLDSICSPEERNDILYQWKTDEHLLRRNTFIGNCYNEFQENRDGFALIKTLIANYILEGIYFYSGFMFFYNLSRNGKMSGSAQEIRYINRDENTHLWLFRNIILELKKEEPELFTPDKVKVYEEMMREGVKQEIAWGQYVIGDQIQGLNRQMISDYIHFLGNLRWSSLGYTPLYEDNRKEPESMHWVSQYSNANMVKTDFFEAKSTAYAKSTALEDDL

SEQ ID NO: 9889 - protein, 403 aa, B.fragilis
SHYKNNKNMRQTIASKTPRIEVVDALRGFAVMAILLVHNLEHFIFPVYPAAASQPGWLNILDEGVFSVTFSLFAGKAYAIFALLFGLTFYIQYTNQQKKGKDFGYRFLWRLLLLGGFATLNAAFFPAGDVLLLFCVVGIFLFIVRKWSDRTVFILAIFLLLQPVEWYHYVMNLFNPAHSLPDLGVGQMYGEVAEYTKEGDFWKFIWGNVTLGQKASLFWAIGAGRFLQTAGLFLLGMLIGRKQLFVASEATIRFWVKALIWSAVLFGPLYQLKVQLMDAGQPDMIRQTVGVVMDMWQKFAFTIVLVASFVLLYQTEKFRKLTADLRFYGKMSLTNYISQSIAGAIIYFPFALYLAPYCGYTVSLLIGFAFFLLQVRFCKWWLKAHKQGPLESIWHKLTWIRSE

SEQ ID NO: 9890 - protein, 444 aa, B.fragilis
IVNNNMATKAFQKIYTKITQITKATCSLKATGVGYDELATVNGKLAQVVKIAGDEVTLQVFEGTEGIPTNAEVVFLGKSPTLKVSEQLAGRFFNAFGDPIDGGPEIEGQEVPIGGPSVNPVRRKQPSELIATGIAGIDLNNTLVSGQKIPFFADPDQPFNQVMANVALRAETDKIILGGMGMTNDDYLYFKNVFSNAGALDRIVSFVNTTENPPVERLLVPDMALTAAEYFAVQHNQKVLVLLTDMTSYADALAIVSNRMDQIPSKDSMPGSLYSDLAKIYEKAVQFPDGGSITIIAVTTLSGGDITHAVPDNTGYITEGQLFLRRDSDIGKVIVDPFRSLSRLKQLVTGKKTRKDHPQVMNAAVRLYADAANAKTKLENGFDLTNYDERTLAFAKDYSNQLLAIDVNLDTTEMLDVAWGLFGKYFRPEEVNIKKELVDQYWKK

SEQ ID NO: 9891 - protein, 405 aa, B.fragilis
QLIKLTPNKFRVRTQRYVNFQDYKNCYIFVSIEIKLLVCPGTKPHTNKGERMNKLPERIRIKDIARLANVSVGTVDRVLHGRSGVSEASRKRVEEILKQLDYQPNMYASALASNKKYTFACLLPKHLEGEYWTDVQKGIREAVTTYSDFNISANITHYDPYDYNSFVATSQAVIEEQPDGVMFAPTVPQYTKGFTDALNELGIPYIYIDSQIKDAPPLAFFGQNSHQSGYFAARMLMLLAVNDREIVIFRKIHEGVIGSNQQESREIGFRQYMQEHHPACNILELNLHADLNIEDSRMLDDFFREHPDVKHGITFNSKVYIIGEYLQQRRKSDFSLIGYDLLERNVTCLKEGTVSFLIAQQPELQGFNSIKTLCDHLIFRKEVACTNYMPIDLLTKENIDYYHSK

SEQ ID NO: 9892 - protein, 599 aa, B.fragilis
RQIKINMQRLLKSAYCFFAALLLTTAAAAQHKISGRVIDTTQEPLVGATITLKEKPSVGTTTDTEGRYTLTLPDQKEYTVQVSFVGYVTATKKTTAARQSRLDFILKEDQMNLSTVVITGTRTPKLLKDAPIITRVITAGDLKKVDATHIGQLLQVELPGIEFSYSMDQQVKLNMQGFGGNAVLFLVDGERLAGETLDNIDYNRLNLDNVERVEIVKGAASTLYGSSAIGGVINIITKASDDPWNLNLNTRFGVHNDQRHGGTVGFNAGKFYSQTNVQYTNIDSYNVKQGDYTTINGNKTWNVKERLMFTPNEQLRLTARAGYYFRERDASSETKNRYRGFSGGLKGNYDFNTKSNLELAYTFDQYDKSDYLVSYKNDIRDYSNVQHSVRALYNYTFNDKNTLTVGGDYLRDYLMSYQFKENADYTMHSADAFGQFDWNPTEHFNVIAGLRFDYFSESNVRHFSPHLGLMYKIGNCSLRGSYAQGFRSPTLKEMHMNFYMANTMMIYGNPDLEPETSHNFSLSGEYTKNRYNFTLTGYYNLVHGRHQVYLFQRYRRNDRTKIYQYPTGRHCRNRCQCLCQISLRYRCTYLVYVHPRVHA

SEQ ID NO: 9893 - protein, 623 aa, B.fragilis
VIAKDSEVTAGKKEGGRSMITKMKKLTFLVYHKEYEDFLNSLRELGVVHIVEKQQGAAENVELQDNIRLSARLAAALKLLQNQKHEKDAVIAANGGSAERGLQVLDEIDALQAEHSKLLQQQQTCGKEKDALEAWGNFEPEGIQRLKDAGYVVGFYTCSEGNYKEEWEAEYNAMIICRISSKVFFITVTKDGEEVDLDVEQAKLPSQSLAQLEAQYANTETALEENEKKLVALSETDIPSLKEALKQVQTEIEFSKVVLSTEQTAGDKLMLLEGWAPATSKVEIEAYLNDAHIYYEITDPTPEDNVPIELNNKGFFAWFEPICKLYMLPKYNELDLTPFFAPFFMIFFGLCLGDSGYGLFLFVGATAYRLLAKKLSQSAKSIISLIQILATSTFFCGLLTGTFFGANIYDLPWPFIQRLKSAVFMDNNDMFQLSLILGAVQILFGMVLKAVNQTIQFGFKYAIATIGWIILLLSLAFSALLPKVMPMGSTVHLIIMGIAGVMIFLFNSPGKNIFLNIGLGLWDSYNMATGLLGDVLSYVRLFALGLSGGILAGVFNSLAVGMSPDNVIAGPIVMVLIFVIGHAINIFMNVLGAMVHPMRLTFVEFFKNSGYEGGGKEYKPFRK

SEQ ID NO: 9894 - protein, 142 aa, B.fragilis
IMGKKVVTLGEIMLRLSPPGNTRFVQSDSFDVVYGGGEANVAVSCANYGHDAYFITKLPEHEIGQSAVNALRKYGVKTDYIARGGERVGIYYLETGAAMRPSKVIYDRAHSAIAEAVAADFDFDKIMEGADWIHWSGITPAI

SEQ ID NO: 9895 - protein, 119 aa, B.fragilis
RMKNFHPTGTCPIRDVLCRLGDKWSMLVLVTLNANGTMRFGDIHKTIDDISQRMLTVTLRTLEADGLVERKAYAEVPPRVEYCLTEMGHSLIPHVEALVGWALDHMTMIFEHREQQKGL

SEQ ID NO: 9896 - protein, 252 aa, B.fragilis
TASDPRTDFGVHAKINQRRIIGQSEKAPNIPIIIKKNWKSLSIKTKPLSLHPLLRVSSINSNHSLKKHLFKMATRIRLQRHGRKSYAFYSIVIADSRAPRDGKFTEKIGTYNPNTNPATVDLNFERALHWVLVGAQPSDTVRNILSREGVYMKKHLLGGVAKGAFGEAEAEAKFEAWKNNKQSGLSALKAKEEEAKKAEAKARLEAEKKVNEVKAKALAEKKAAEEAAKAAAEAPAEEAAPAEEAATEAAAE

SEQ ID NO: 9897 - protein, 447 aa, B.fragilis
  UNSURE (37): Identity of amino acid sequences at the above locations are unknown.
DFDDALVSPLFLSPTAPAPLQSLGVKTLYPVINHPAXHQTYYYEDQDRNAHSQIVSLNARPDFKNIFRLIAEITNHGTTFYHLTVRVLYLVNLQAVCSRSEEIAQIRIISQGGVCLRLHDFRRSHSTYITARFHIPQSNVGTAHKVDEIAGSFRITGILRNHPAVIPDVASFPRHYIVQVHSYRIRFFDGPFGISAPGHIEPCFIFGHHLFTEVCLPTGYIGFHRLEVFFGNLHCTGRIVVHQILYCHLASGQITGMCVNDGRPVRIAVTVFHQYLAGIFPIPKATPTFGIRIGNKSLVIQYPGRSPHVTHGIMTGNASGLTQLIDLFPDIRRHVIHVVGRMGKNGVDGQQQVFLQHPLDDVFRRAYHIKIFVPFFDLGQHDFVDIESLIDNTNILACLLLIICLEIFQHSVTDVIGPVINFQYLFAGLTGIVTTGKHKRRCKAKSY

SEQ ID NO: 9898 - protein, 154 aa, B.fragilis
RTTERVMKVEQVFSDRKRFLDLLLLADEQEDMIDRYLERGDMFALYDEDKLRAVCVVTNEGKGIYELKNIATCPDSQRKGYGKSLIEYLFHHYSDRCSVMFVGTGDTPHTLLFYQSCGFIPSHRIKNFFTDHYDHPIYENGIRLRDMVYLKREK

SEQ ID NO: 9899 - protein, 243 aa, B.fragilis
RLKEKTMLSEKYGRTYHYPFSPGTTSDDRINHTYWEDIRQISTLVHTEKLDGENNCLSRYGVFARSHVAPTTSPWTSQLRQRWELLKNDLGDIELFGENLYAVHSIEYKRLETHFYVFAVRCLDKWLSWDEVKFYAALFDLPTVPELCTECVDGLTVASLEQHVVCLAQEPSVFGSCDAQTGLDCTREGVVTRNIGEYATADFAHNVFKYVRKGHVQTGEHWTRHWKRARLVWELKQEKGGNR

SEQ ID NO: 9900 - protein, 371 aa, B.fragilis
SMIWKLSERKDWNSLEQQFGWVRDMNQVPQHTVHHAEGSVAVHTRMVLEALLRQPAYPMLPEQEREILWAAALLHDVEKRSTSVDEGNGQVTSKNHAKRGETTVRTLLYRDIPAPFNIREHIASLVRHHGLPIWLMEREDPLKRACEASLRLDTSLLKQLTVADICGRISTDKEVLLEATEFFEMFCREQQCWGKAREFANGTARFHYFHTPRSYIDYVPHDDFKCEVTLLVGLPGMGKDYYIESRCADMPVVSLDAIRRKHKFSPTDKAANGWVAQTAKEQARIYLRKGQDFIWNATNVSRQRRTQLIDLFITYGARVKIVYIEKPYSVWRRQNSTREYEVPETVLDKMLGRLEVPQLTEAHEVVYVVEE

SEQ ID NO: 9901 - protein, 65 aa, B.fragilis
RGGCTPPPAKTKVSLITAYRDQGLVGFLKPNPTGEARCKTRLLFPVLPVGVMWKRRKCHPPGLRN

SEQ ID NO: 9902 - protein, 61 aa, B.fragilis
FLLCSPNFMLSWHWLLPSLSVVRLHKLMIYKKHLSVFDRTFKCFLKRLKRFPKTLKSFFML

SEQ ID NO: 9903 - protein, 515 aa, B.fragilis
REDRQRMKESSSYKWIVLGNIMIGTFMAVLDSTVVNTGLPVIMGTLGADINVAEWVLTGYMLSMASILPAAGWLSERFGYKKIYFLSLLVFTAGSFMCGSSSTIEELIFWRVIEGFGCGMLLPVGMAIVSDVFPPEQRGTALGFWSIASAASVSFGPAIGGYLVDYMDWNYIFYVNIPIGILALIVTAIVQKEHVKGTGVPFDIPGFITSAIFLPVFMYGLSEVNSSTNSMGWSSPVVLGAMWIAVVTFILFLYFEFTVKTPLINLRLFVDRDFALSNLILFVFGIGMFGSTFLIPLYLQDNLGYSALQAGMFFMPVGIIQGVASPLSGKLMQRINPKVFIVSGILLMALSFYMNYYLSFLTEKWYIMLSLYLRGLGMGLLFTPLLTLSLVNIRNSNMAQASSITNIVRQMGGSFGVAIFSHLLTQRTAFHTQRYGEALNYTGDVYRQTLHSLSRFIEHTGGRTPDTAQEVAEMLILKRIDLEGYISAINDDFFIAFIVTLLCVVPVLFLRTKKG

SEQ ID NO: 9904 - protein, 309 aa, B.fragilis
LCNRIYKHPDIDKKNAFIKILTTKIKCQMKIKSLLTMMFVLCACAACNDDKNEETPLNQVVAGKYDGYTKAVAQYFPAGQYADKQSITLTPNDNGTVNIAYTSESFGEFSISNATVELKNDAYLVKGDGKTTMGMNGGTPKEYDCTFEGTISKDKKTSALEFNVLAVMNGLTVTFTQGEAPAAVMAAGSYKGYTKAVAQYFPNGQYAADQTIKVTANEDGTVNVTYTSTSFGEFTINNATVKSENNAYTINGEGKSVMGMEGKEPKEYACTLKGTIDAAKATPTFEISVPAVMNGLTITFATGDVPENK

SEQ ID NO: 9905 - protein, 61 aa, B.fragilis
VWLRHTGRMVTPFFVYPYCFSVKVKNRTPFSGLLEGVKLAAKSSGCPICPFLNRGCVSRIF

SEQ ID NO: 9906 - protein, 117 aa, B.fragilis
IVERKTCGPMKRNLLRKEEDADPISVVSNLFDVAMVFAVALMVALVSRYNMTEVFSQEDYTMVKNPGKENMEIITKEGQKINRYTPSEDQQKSGKKGKKVGIAYELDNGEIIYVPEE

SEQ ID NO: 9907 - protein, 138 aa, B.fragilis
LDISRYCLHLVICVLLCHHQNVKVMMELISRTRNGMITYCAHCKVYHLEFGNLFFRLSEAGFECLRNYIVSINGPYCERSNRKMNANRKIFLKLPAQNVYFCVCTAELEELKSLVLLQSPAVEETDGLIPFMHDISLN

SEQ ID NO: 9908 - protein, 211 aa, B.fragilis
IKNRIMEKTYLQITSGRGPVECCRVVALVLEKILREAQKRKLRVEILEKETGPVNRTLLSAVVALEGAGCDVLADEWEGTVLWIARSPYRIHHRRKNWFVGVQTFLLSESREATEDDIRYETLRASGPGGQHVNKTESAVRAVHIPSGISVVASDQRSQWQNKKLATERLLVKLTAWNIEQAMIQAQTNWSNHNSLQRGNPVKIIQEELRF

SEQ ID NO: 9909 - protein, 99 aa, B.fragilis
PETSVLFKSIPAIPVAISSEGCLRRTGFTDGPPIGTSCPSISGPPSIGSPKALKKRPASCSLTFSVGDLPRNTTSALVGIPSVPSNTCKVTSSPAIFTT

SEQ ID NO: 9910 - protein, 1467 aa, B.fragilis
RKRLSQRISPIVRPAFSKNEINQRTKNNMKKKQIITTCCVAAAILVGVFVWQAYFSATKIAFVNFQTINLGNISKANDNSFVKLREVSTDHLDELTGYDMVFVNGMGLRIVEEQRQQIQRAADKGIPVYTSMATNPANNICNLDSVQMSQIRQYLTNAGKVNYRNLLSYVRKEIDGKLISAPVPEAPVEKPTDILYHAGVKNPDDEMEFLNVTDYEKFLRENGLYHEGARKVVITGQMADATGLILALEKAGHNVYPISSFTRFMEFVREIRPDAVINMAHGRMGDDMVEYLKERNIPLFAPLTVNSLVEEWENDPMGMSGGFLSQSVVTPEIDGAIRPFALFAQYKDDEGLQHSFAVPERLETFVNTVNNYLTLKTKPNSEKHIAIVYYKGPGQNALTASGMEVGPSLYNLLLRMKKEGYRVENLPESAKELEKMIQAQGAVFGMYAEGAFDEFMKTGNPELVTKEQYESWVKASLRPGKYAEVVAANGEFPGQYMTTPDGRLGIARLQFGNVVLMPQMAAGSGDNAFQVVHGTNAAPPHTYIASYLWLQHGFKADAMIHFGTHGSLEFTPRKQVALCSDDWPDRLVGALPHLYIYSIGNVGEGMIAKRRSYATLQSYLTPPFLESSVRGIYRDLMEKIKIYNNTTGAKEKQSLAVKALTVKLGIHRELGLDSLPTRPYSEDEVARVENFAEELGHGKITGQLYTMGVPYEPERITSSVLAMTTEPIAYSLLSLDKQRGKATADVEKHRSLFTQRYLNPARALVEKLIANPALATDELICRTAGVSPEELAKAREIETSRNAPKGMMAMMMAAAAKNKTGDKTGKTADKMPEAMKKKMKEMGAHMDSSKAMEMAKKMGADPEALKKMEAKMNASKGDKPEADKAKGMSDMMAAMGKKTAQKEYSKEEINFALALTEVERTIRNVGNYQTELTASPEKELASLVNALNGGYTAPSPGGDPIANPNTLPTGRNMYAINAEATPSESAWEKGVALAKQTIETYQRRHNDSIPRKVSYTLWSGEFIETGGATIAQVLYMLGVEPVRDAFGRVSDLKLIPSAELGRPRIDVVVQTSGQLRDIAASRLFLINRAVEMAAAAKDDKYENLVAASVVEAEKTLTEKGVSPKDAREMAAFRVFGGANGMYGTGIQEMVESGDRWEDESEIAATYLNNMGAYYGSEKNWEAFRKYALEAALTRTDVVVQPRQSNTWGALSLDHVYEFMGGMNLAVRNVTGKDPDAYLSDYRNRNHMRMQEVKEAVGVESRTTILNPAYIKEKMKGGSSSAAEFAETVTNTYGWNVMKPAAIDKELWDNIYNVYVKDEYNLNVKEFFETQSPAALEEMTAIMLESARKGLWKASAEQVAELAKLHTETVNKYRPSCSGFVCDNAKLREYIASKSDAPAAAQYKENISKIREAKVSGDAKGMVMKKEEINRTPEEQKTTLSNIAVGAAVVVVILALVLFVRKRRKTSE

SEQ ID NO: 9911 - protein, 231 aa, B.fragilis
LISRIMDAANTSNPSDKKKFIWLVILLIIAIVVAVVWWWNYRKYVSTIDANLDGSRVNVSVRAMAPLSAVFKQEGDSVKRGELLAVLDSTMTEDYRIVSPVDGLIAKQWVVPGDLLQPGENIFTLNEGKKLWVTVYLQETKFDEVRMGQQALFTLDAYPGLTFYGKIFYIGANTASEFSLIPPDNASGNYTKVAQRIPLKISIDRVEGKEKLKANLRLLSGMSANVKIVKE

SEQ ID NO: 9912 - protein, 88 aa, B.fragilis; identical to SEQ ID NO: 7984

SEQ ID NO: 9913 - protein, 269 aa, B.fragilis
YERRRWAMVKKIFAQTYLWILLLLLYSPIVIIMIYSFTEAKVLGNWTGFSTKLYSSLFTTGTHHSLMNALINTVTIALIAATASTLLGSITAIGIFNLKARSRKAISFVNSIPILNGDIITGISLFLLFVSLGISQGYTTVVLAHITFCTPYVVLSVLPRLKQMNPNIYEAALDLGATPMQALRKVIVPEIRPGMISGFMLALTLSIDDFAVTVFTIGNEGLETLSTYIYADARKGGLTPELRPLSTIIFVVVLALLIVINRRAGKEKK

SEQ ID NO: 9914 - protein, 137 aa, B.fragilis
TERSSVMEKVFGILLLVLFVCTSCGDKSEPSFKVYDEYSKEKKVEKKNNIGKATYIFWINKTEAKKLRGLTFNIKCKVTINEDGSIKILGYEKEQPYTVTKSLKKYLKTFRVDKEALADGRVKVGDQVVFLRYVVLK

SEQ ID NO: 9915 - protein, 417 aa, B.fragilis
YRNGEFMKNIRQFHLLSSILGGVFLFSSCSVVPKAEEKNLSEQWPVVASYQWAGQDSVVVCDLSLLKDTVDLPFSFFLKDFQIIKLDNRDEAMVGENNLCVSENYILVYGSVYELHPCRLFTKKGEFVTNIGAIGQGPGEYRAVYKAEIDEKHNCIYLMPFANSNAIYVYDLAGKPLRSIPLHQSVSKAVFKVDADKRELTVGALPFTGYPFVAWVQDFEGHLLDSVPAARHLSVLPDYSNEVMYGANTEVFDFYISTFFELRPDTLYHYIRSGSRLKPRFTLNIGDRKRSITTFYELPQAYVGRLMVEEQVGDGMWETKSPSNFIVDKASLRGTFFRVINDFAGGMPDRLWTPWSLRNKQYIRLVEPGVLKAEIESYLSSTDGRKGKNRKKLQELCESIGEEDNSYVIYAKQKGVQ

SEQ ID NO: 9916 - protein, 260 aa, B.fragilis
PNLMDIHQELKELSKFLSEYSTSLMAVGVQTSRIVRNTSRIAESFGFFCDMTIFQKTIIMTLRDADNSHSYSTVNKIKPMGLNFAINSALSTLSWEAYDEHLSLSELQRRYHEIVSKPRESKWLVLILVAFANASFCRLFQGDFISMGIVFVATLAGFFVRTELMGRHWNHLAIFIISSFIASMIGSTGYLMHWGDTPDMALGTSVLYLIPGVPLINAIMDIIDGHVLAGTSRFINACLLIICIAIGLSMTLLITGISTL

SEQ ID NO: 9917 - protein, 185 aa, B.fragilis
QDIITWCTVAIKYTSFRDTDGMIAQRYINTPRVDIAGIDANASAKYPCGIGARISYTYIHEFMRDGQTKLSSTRPHSATVRLEYGKTWDHYDFNLSLDGRALSQVKTNQYTSNDPNAGTEKVTYPGYTMWNLTLTQRIWKGINVNMAVNNLFNYRPDYYYANSPYTTGTNFSVGLSLDIDQMFRK

SEQ ID NO: 9918 - protein, 227 aa, B.fragilis
IVYILMAKFDKIAVLNKIGSTGMVPVFYHEDVEIAKKVVKACYEGGVRAFEFTNRGDFAQEVFAGLVKFAVRECPEMAMGVGSVVDPATAALYIQSGADFVVGPLFNPEIAKICNRRLIAYTPGCGSVSEVGFAQEAGCDLCKIFPGDVYGPNFVKGLMAPMPWSKLMVTGGVEPTRENLTGWFGAGAFCVGMGSKLFPKDKVAAEDWGYVTKKCTEALEYIAEARK

SEQ ID NO: 9919 - protein, 199 aa, B.fragilis
SVNMENKIQELTDKIYREGVEKGNEEARRLIANAQEEAKKIVEDAHKEAESIIASSRKSADELTENTKSELKLFAGQAVNALKSEIATMVTDKIVTAPVKEFAQNKDFLNAFIVALASKWSVDEPIIISTSDAESLKKYFAANAKALLDKGVTIEQVNGIKALFSVSPADGSYKVNFGEEEFMNYFKAFLRPQLVEMLF

SEQ ID NO: 9920 - protein, 220 aa, B.fragilis
SRCIMRRIFIFIAFALCSLWQLRAQADTASFLFDKYEDAQVLLRAGGELKSKMNYSIVVNKFYFIDPQDKQVKELANPGDILLIKIAGRTFYPESNGAGIEMLPTKPVVYVQYKATARKEAPMGAYGTRSETTAVQSYGTITSNGQSYKLEGEKIIVSNRHHVYWVEKDDKMKQFRNFKQLAKIYSKHRAEVEKYIEDNKVNFEDVDQIVKLCSYADSLK

SEQ ID NO: 9921 - protein, 130 aa, B.fragilis
SSPLKTTSKTMIKEKATPHIGLVTDLTTGQIDGKITPGGMVLVTGCNIKIENGNKPVCEAIQLSHQNGEVICIDPPFEMNEPHILKFKMPDSLPTGEYTLTIKTRFAGKDKRLLTQEQTLVYMLKLIREE

SEQ ID NO: 9922 - protein, 840 aa, B.fragilis
LMEITKRNGTTEPYDREKIAVAIRKSFASTGQEVSNEIIYSVVEEVENFVGKDTANRSVEQIQDKVEQSLMEHGFYAEAKNYILYRWQRTERRKALNSIINELGDGTVMDVLKEIQKDFTTHEYSLVVLYEKFSGFCKQEMPHSERLAALIKAAVELTTQEAPDWEFIAARLLNFQLSKKLEKQAASAGIRSFYDKLRYLTEEGLYGSYILAAYSQQEIEEAAGFICPDRDKLFNYSGLDLLVKRYLIRTRLHEPAESVQEMYLGIALHLAMPEQKERMTWVKKFYDLLSRLEVTMATPTLSNARKPYHQLSSCFIDTVPDSLEGIYRSIDNFAMVSKFGGGMGMYFGKVRAAGGNIRGFKGVAGGVIRWMKLVNDTAVAVDQLGMRQGAVAVYLDVWHKDLPEFLQLRTNNGDDRMKAHDIFPSVCYPDLFWKMVKEDLNQPWYLFCPNEIMTIKGYCLEDYYGEEWEKRYHDCVNDTRLSKRSISIKDIVRLVLRSAVETGTPFTFNRDTVNRANPNAHRGIIYCSNLCTEIAQNMAAIETVSTEIRTEEGDTVVVKTVRPGDFVVCNLASLSLGHLPLEDEEQIKEKVSTVVRALDNVIDLNFYPLPFAQITNQRYRSIGLGVSGYHHALAIRNIRWESEEHLRFVDRVFEQINYAAIEASADLAKEKGRYEYFEGSDWQTGAYFGKRGYTSPEWNRLAAKVAENGMRNAYLLAIAPTSSTSIIAGTTAGTDPVMKRFFLEEKKGAMLPRVAPALSDKTFWLYKDAYTLDQKWSIRAAGTRQLHIDQSQSLNLYITNEFTMRQVLDLYLLAWECGVKTVYYVRSKSLEVEECESCAS

SEQ ID NO: 9923 - protein, 234 aa, B.fragilis
NIRIIRSMDTVVLVLMLLIAFNFLLKQTFWKTVAVGIIATVAALFAGLMWPYAIEQSKTQIADWLGNTALMLDTSVLLTIEVSLQMAYAMLAVHVASAYPVKPRTLLTYRFLRWFPGLLIFPVLFSGLVYLIFAFPGTPFTTVAWMYAACVLIAIPVGRWLLLYLLPEKELRLELFFLTNALVAILGIVATVNGRTSVAGVSEVNWGALAGVGGITIIGSAIGLVWRRVKKRIN

SEQ ID NO: 9924 - protein, 79 aa, B.fragilis
RKRIKVTTAIHMAPSTTGLLHPMELVDELTSESPYMKTGKKMAEVMKPGISKGTPVPFTCSFCTMAVTIRARIPIGMLT

SEQ ID NO: 9925 - protein, 470 aa, B.fragilis
MCTFAPQISMNMQESKSIIEVNGVSKFFGEKTALDHVTLNVKKGEFVTILGPSGCGKTTLLRLIAGFQTASEGEIKISGKEITQTPPHKRPVNTVFQKYALFPHLNVYDNIAFGLKLKKMPKQTIEKKVKAALKMVGMTDYEYRDVDSLSGGQQQRVAIARAIVNEPEVLLLDEPLAALDLKMRKDMQMELKEMHKSLGITFVYVTHDQEEALTLSDTIVVMSEGRIQQIGTPIDIYNEPINSFVADFIGESNILNGVMIHDKLVRFCNTEFECVDEGFGENMPVDVVIRPEDLYIFPVSEAAQLTGMVQSSVFKGVHYEMTVLCNGYEFLVQDYHHFEVGALVGLLVKPFDIHIMKKERVCNTFEGKLIDETHVEFLGCNFECAPVTGIEAGSEVKVEVGFDNVILQDNEEDGALTGEVKFILYKGDHYHLTVLSDWDENVFVDTNDVWDDGDRVGITIPPDGIRVIKN

SEQ ID NO: 9926 - protein, 204 aa, B.fragilis
INEMAIKFQYNKTSFQQLEKQLKVRVRTLPIIKNKESALRMEVKRCKSEAADLEKRLEKQIQAYEAMFALWNEFDTSLIKVNDVHLGVKKIAGVRVPLLENVDFEIRPYSLFNAPKWYADGIHLLKELAHTAIEREFTLAKLGLLEHARKKTTQKVNLFEKVQIPGYQDALRKIKRFMEDEENLSKSSQKILKSQQEKRKEAEA

SEQ ID NO: 9927 - protein, 439 aa, B.fragilis
ANIVNTETKEQILAALGDILKNPEVYKNSEIWSKLAEHLSPVFIEKRLTPYDLLDEPLGYKTYGSKYIETLAKQQMNLAMRLPITLAGALMPDAHAGYGLPIGGVLATDHAVIPYAVGVDIGCRMNLTLFDAGEDFLKRYSHHIKEALKEFTHFGMDGGLSFAQEHEVLDREEFRMTELLRGLHGKAVRQLGSSGGGNHFVEFGKMSLQAGNVLGVPEGNYVALLSHSGSRGLGAAIAKHYSMLARDLCRLPREAQHFAWLGLDTEEGQEYWLSMNLAGDYARACHERIHLNLSKALGLKPLANVNNHHNFAWKEEIAPGQTAIVHRKGATPAQKGQPGLIPGSMATPGYLVCGKGISEALCSASHGAGRAMSRQKAKDNFTRSALRKYLSQAGVTLIGGSVEEMPLAYKDIDRVMKTQEELVEVQGTFMPCIVRMNKE

SEQ ID NO: 9928 - protein, 593 aa, B.fragilis
NLVVNACLCYFAYIFCIKHYFSINNAYFCTCVIKRVLNIYMVKDLLTPDYIFEASWEVCNKVGGIYTVLSTRANTLQTNFRDKLFFIGPDVWQGKDNPLFIESDNLCAAWKEHALKKDDLSVRVGRWNIPGEPIVILVDFQPFFEKKNEIYTEMWNHFQVDSLHAYGDYDEASMFSYAAGKVVESFYRYNLTENDKVIYQAHEWMTGLGALYLQLAVPEIGTIFTTHATSIGRSIAGNDKPLYDYLFAYNGDQMAQELNMQSKHSIEKQTAHHVDCFTTVSEITNNECKELLDKAADVVLMNGFEDDFVPQGSAFTGKRKRARALMLNVANKLLGTHMDDDTLIIGTSGRYEFKNKGIDVFLESLNRLNRDKDLQKNVLAFVNVPGWVGEPREDLQTRLKSKEKFDTPLEVPFITHWLHNMTHDQVLDMLKYLGMGNRPEDKVKVIFVPCYLDGKDGILNKEYYDLILGEDLSVYPSYYEPWGYTPLESVAFRVPTITTDLAGFGLWVNSLKNQHGIDNGVEVLHRSDYNYSEVADGIKDTIALFSGKTDNEVKEIRKQAAAVAEQALWKHFIKYYYEAYDIALRNAMKRQLN

SEQ ID NO: 9929 - protein, 268 aa, B.fragilis
ELRVKRLSVFFSSRKSWTLPYIIFSAIFVVIPLLLIVVYAFTDDSGHLTLENFAKFFQHHEAINTFVYSIGIAIITTIVCILLGYPAAWILSNAKLNRSKTMVVLFILPMWVNILVRTLATVALFDFFSVPLGEGALIFGMVYNFIPFMIYPIYNTLQKMDHSYIEAAQDLGANPVQVFFKAVLPLSMPGVMSGIMMVFMPTISTFAIAELLTMNNIKLFGTTIQENINNSMWNYGAALSLIMLLLIAATSLFSTDDKDNTNEGGGLW

SEQ ID NO: 9930 - protein, 72 aa, B.fragilis
VAMVLGVSCVAVTGSLTWQLSVVEAVASMVLVTNISFYFFLNLCDTYMLLFRISGVWEEMWLMCQYSVSISV

SEQ ID NO: 9931 - protein, 133 aa, B.fragilis
QILLIVLIIFSMNIFIAGISYNLSNADLGELFEEFGEVISAKIVMDRETGRSKGFGFVEMPNDEEGNAAIAALNEKEIDGKTLAVSVARPREEGPRRNSNYGGGNRGGYGNNRGGGYGGGNRGGGYGGGRDRY

SEQ ID NO: 9932 - protein, 688 aa, B.fragilis
NTLFEAIYGLSRFEVGSLLAQIAYICCHSFIYCTSYMRYCILIFGFILLFFLPVGCKQSSTVTPLSFKEWMTHHPGECIEHYMGLHDSLFEAGRYDMLTDIYSGMFLYMPSDPDGNPDTLRRQLLRIMPLYNQVLSKTGAYEAAVQLLDSIRLSGHPFLTGYCAYPLWAFEAQNSLMTDDNRRTEALADSFAVLLPPDDQSVVMLCCHMVSWAYHFSSARPNVACRMQERAVEAYRRGGETQDVGAILARLGYYYRREGRYVKAVDLSLAAVEWYDKHPGIATDGMIRAYADLAALYSTLALTEKALEINARVIRMAAREDSMALCGAYRVRSSFFMDLEQVDSAAFYLGKEREVAQRMGERSLKTWLRDRAKYWLQMCPDSNAAALRDMEAIFADSAGVRPATHSGTRYWLGLALVRDGQEERGLAMMEQAHCEFAYMDWDEMEAFAAKGLLGIYASRHLGSRMLEFYPRYAALQDSLNEKDKLRYTAAANVRYDTGRKEQEYRALMAEVELKERTLTYIGIVVVLLFMLLGLVVVYMLQRRRHYRREAHLHRERLSRLISIHQELNGRYESLNNELEKVAHADVIDNVRQKLNPMLLSGDDEIRFRQSFAALYPHYLPVLRCQCPELTRNDELLCMLIRLNQSTDEIALALGISRASVNSGRSRIRKKLGLGKDESLEAYLQNIKK

SEQ ID NO: 9933 - protein, 163 aa, B.fragilis
NNKLKNKIKIMEMNLFIAYIGIAVMVGLSGIGSAYGVTIAGNAAIGALKKNDSAFGNFLVLTALPGTQGLYGFAGYFMFQTIFGILTPQITAIQASAVLGAGIALGLVALFSAIRQGQVCANGIAAIGQGHNVFSNTLILAVFPELYAIVALAATFLIGSALA

SEQ ID NO: 9934 - protein, 540 aa, B.fragilis
QLKLTFLFMFTDLLHSSYFSLFLIVALGFMLGRIKIKGLSLDVSAVIFIALLFGHFGVIIPKELGNFGLVLFIFTIGIQAGPGFFDSFRSKGKTLIIITMLIISSACLTAVGLKYAFGIDTPSVVGLVAGALTSTPGLAVAIDSTNSPLASIAYGIAYPFGVIGVILFVKLLPKIMRIDLDKEARRLEIERRGQFPELGTCIYRITNPSVFGRSLMQINARAMTGAVISRLKHQEEISIPTAHTVLHEGDYIQAVGSEEALTQLAVLVGEREEGELPLENTQEIESLLLTKKDMINKQLGDLNLMKNFGCTVTRVRRSGIDLSPSPDLALKFGDKLMVVGEKEGIKGVARLLGNNAKKLSDTDFFPIAMGIVLGVLFGKLNISFPGGLSFSPGLTGGVLMVALLLSAIGKTGPILWSMSGPANQLLRQLGLLLFLAEVGTSAGKNLVATFQESGLLLFGVGAAITLVPMLIAAFVGRLVFKISLLDLLGTITGGMTSTPGLAAADSMVDSNIPSVAYATVYPIAMVFLILFIQVIATVVY

SEQ ID NO: 9935 - protein, 65 aa, B.fragilis
VEYPDAGHGARWKREVGKEKYLNLFLDPSTTRRENSYISAVSYVLDYVLINDVIIEIIGISLSVL

SEQ ID NO: 9936 - protein, 75 aa, B.fragilis
YTDPSLLRVTGLRHFPLASMVSMAKPSCALANSTFSVIKDGTVGLWFEQATHIIAQAAPNKGFKFMFYCFFMVKE

SEQ ID NO: 9937 - protein, 67 aa, B.fragilis
LGLFKQVDEIPVINDHEGFPLPDFPVPDGVGIFMREMVFFTECAKPVIALDRFFFFFLNHYDMIIFL

SEQ ID NO: 9938 - protein, 519 aa, B.fragilis
IFFPSMSKIPPQRISALFHVFKLFNSNHTSFLWFSLIMGSKDIQNFVFLLLIHFINYLFIVACHYRTFQLQGISQFPFFHAERFGKQRKSFNLFVMGKLLLQRIDTCAEQSSNFRMLQQFGHIFVFDAFLFGILFHKTVYRYNQCRYKLTLVGNNSYLIDITVDNQFGFQCLRSDIFSVRCLKQVFDTLCQIQLPIFKIAGITGMKPTFFIDGCSRRFRLFIIPFRDGLSTKQNLVIFADLHFYLRHHLTYRTNIITRLRSTRNSCRRFCQTISDQHIDTHRMYKLANFIGNSSTGCREEVTVLYSDGLFQQSIDSLLIKLIFQLNHSGRRLTHPQIIQIMDTAYFNSIQHQHFFYSGGLGYFFLNAGVHLLPKTRDTTHQCRTDFFNGCLDIGRTKIDADLYALMHTEISPCLLKHMGQRQEVHRNILIGHIYQTDIMNTECFQIARMMQHDSFRFARSTGRIQDVCQILGTGTCRTFFHYFIVWQIFSFSQKLVIVNRTHITRIFHYRRIKNDQLYK

SEQ ID NO: 9939 - protein, 735 aa, B.fragilis
KYIPVRISYDRFHYLCTVARIVKIHRQKKERKKQQTKNKTMRTYRFMFPVLLAMTATGSLTAGPSDKGSSGIRFPEVNQVKIEDTFWKPKLNLWQKVTVNDVFDKFEGKHLEHPGEFCNTFENFDRVAKGERNIGRHAGAPWFDGLVYETIRGVADLMARQSDAALEKRVDGYIDRIAVAQASEPNGYIDTYTQLMEADHQWGERGGMLRWQHDVYNAGMLVEAGVHYYNATGKTKLLEVATRCANLMAEYMGTFPKKNVVPAHSGPEEALVKLYTLYRDNPGLKKQINVPVVEREYLRLAEFWIEGRGKHCGFPLWGTWGNPAAEQWIRDRKYEAPEFGNHTRPSWGDYAQDSIPLFEQKTIEGHAVRATLFATGATAAALENRSPEYIAAVSRLWDNMIGKRMFITGGVGAVHFDEKFGPDYFLPTDAYLETCAAVGAGFFSQRMNELTGDAKYMDELERTLYNNVLTGISLSGTQYTYQNPLNSAKHARWGWHDCPCCPPMFLKMMSAMPGFIYSQKGDDIYVNLFIGSETELSLSDQSRIRLTQKTGYPWDGSVVMTVEPEKEKTFLLKVRIPGWAQGVENPYDLYRSGVKSAVNLKVNGKSIAMKIFKGYAEIQRKWKKGDRVELTLPVQPRLVTANEAVADLQNKVAIAAGPFVYCLEGCDNEGVADLRLDTRAPLSMTFEKELLNGVNVIKGQALDKTGKKVSVSAIPYYALGNRQDKGYVVWMPANK

SEQ ID NO: 9940 - protein, 64 aa, B.fragilis
TNTFKLLILINQRAVSKTLFTTDYTDYHRLSTWIINDLELILCYSVSSVVSFDTRPLFHLKRKF

SEQ ID NO: 9941 - protein, 88 aa, B.fragilis
EPQPSNPIKTTCLAFHLLPAWQLGTIVNKQIIKQANLNTCVFMILFYNKIIYLNLFYASGLQESSSLHSSEVRRFHYYAEYCLRYASG

SEQ ID NO: 9942 - protein, 69 aa, B.fragilis
IDATPIVQKFSLLHILPDDALSYGFVSSKSPWQLLIAIAVAVNMNNLFNSFIRFQDLFRMLYWHLLQLS

SEQ ID NO: 9943 - protein, 363 aa, B.fragilis
LIRTGMYFYYVTKHIRYPDSSCTLLRFLSYLCSTKNKSMKRNESKYKQVVNHVIDGINNGSYKKGDWILSINEFRKNYNLSRDTVFAGLSELKSKGIIDSTPGVGYYIATTRIAQKLNIFLLFNEFNEFKEDLYNSFISSIRKTANVDLYFHNYNRKVFETLINEANYKYTTYILMPGKFTNIAPLLESLSGRVFLLDHFHPELAGKYSSVAQNFEKDTYEALVYGLPHLKKYDHIIMVQKEEKEPIERYNGLCAFCEEYHFTHEYTDSVRNREIRQGETFMVVNDRDLVDLLKQAQLQNFAPGKDFGIISYNDTPLKEILAGGITTLSTDFKQMGQTMASLITQKEIKTIENPWKLDIRNSL

SEQ ID NO: 9944 - protein, 641 aa, B.fragilis
NLNFITMKKLLIFTLLLCCTVKALSYTERNYLQKQANVSSLQEVLILNQQWVTYPAYTDRTGWDTFLGSFKNECILRGEKQLNYQWQVVKATDYMEFERSGNRSIMETPFANNNNAIADLLLAELAEGKGRFIDQLINGVYHSCEMTSWALAAHLNAQQSHRSLPDFKENIIDLTAGDLGSLLAWTYYYMHKEFDKLNPAISERLRHTLQQRILDPYMNNDHFWWMAVNYRPGMLVNNWNPWCNSNALMCFMLLENDKEMLAKAIYRSMVSVDKFINYTHTDGACEEGPSYWGHAAGKMFDYLELLSAVTGGTVSIFDNPMIKNMGEYISRSYVGKGWVVNFADASAKGSGDAPLIFRYGKAVNSNEMKGFAAMINTNKLPSGRDIYRTLAAIKIANELKETQAAHLTPPFSWYPETEFCYITDNKGNFLAAKGGYNDESHNHNDAGTFSFWIDQTPFLIDAGVGTYTRQTFSKDRYTIWTMQSNYHNLPLINGVPQKYGATYKATHVQADKRKNTFTANIATAYPAEAEVESWIRSYSLQKGQLRISDSFRLTTAKQPNQINFMTWGQVNTEIPGKIQLEVKGKKAVIEYDKQLFDVKTEIIPLTDTRLSNVWGKSICRITLTATNIYKTGNYSFTIKKQ

SEQ ID NO: 9945 - protein, 157 aa, B.fragilis
YMSQEIERKFLVSGDYKSQAFDQSRIVQGYISSARGRTVRVRIRDGKGYLTIKGASDASGISRYEWEKELSLAEAEELMKLCEPGVIDKTRYLVRSGKHIFEVDEFYGENEGLVVAEVELGSEDEVFVKPGFIGEEVTGDIRYYNSQLMKKPYTTWL

SEQ ID NO: 9946 - protein, 393 aa, B.fragilis
PDGQQSPCLWAQSRTGTADREIWVKTLVRLADPVLSNLANETLKKEMPYESLAPNRQRFSYLEAVGRTVCGIAPWLELGEDDTPEGQLRKKYIELTAKGISNAVNPSSPDYLIFGEPSQPLVDAAFLAEGLLRAPKQLWGNLSPTARKQVVTELKRSRVIKPNESNWLLFASIVEAALQEFTGECDTTRLNYGVRKFRDLWYKGDAQYGDGAEFHLDYYNSFVIHPMLTDVLVVMQKHRMPESEFLNVQQKRLGRYAEQLERFISPEGTYPVIGRSIVYRTGVFHALGQAALLHLLPQQIVPAQVRCGMTKVIENQFRSAANFDTKGWLKIGFSGNQVQMSESYINTGSTYLCLTGFLPLGLPADDPFWSAPPAEWTNLKAWSGKEVPTDHSL

SEQ ID NO: 9947 - protein, 696 aa, B.fragilis
SIHNQEHMKQQKCNYFPSLWWRGREKGLSTFLFLLLFSISLHAQRQDILLNNNWNFRFSHQVQGDTRRVDLPHTWNAQDALAGKIDYKRGIGNYEKALYIRPEWKGKRLFLRFDGVNSIADVFINRKHIGEHRGGYGAFIFEITDLVKYGEKNSVLVRANNGEQLDIMPLVGDFNFYGGIYRDVHLLITDETCISPLDYASPGVYLVQEVVSPQEAKVCAKVNLSNRAADGTAELQVLVTDGTKVICKESRNVSLKQGADIQEQLPLLIQKPRLWNGCEDPFMYQVSISLHKDGKQIDSVTQPLGLRYYHTDPDKGFFLNGKHLPLHGVCRHQDRAEVGNALRPQHHEEDVALMREMGVNAIRLAHYPQATYMYDLMDKHGIVTWAEIPFVGPGGYADKGFVDQASFRENGKQQLIELIRQHYNHPSICFWGLFNELKEVGDNPVEYVKELNVLAKQEDPTRPTTSASNQDGNLNFITENIAWNRYDGWYGSTPKTLATFLDRTHKKHPELRIGISEYGAGASIYHQQDSLKQPSASGWWHPENWQTYYHMENWKIIAERPFVWGTFVWNMFDFGAAHRTEGDRPGINDKGLVTFDRKVRKDAFYFYKANWNKQEPMIYLAEKRCRLRYQPEQTFMAFTTAPEAELFVNGISCGKQKADTYSTVVWKNVKLTSGGEYHSCDYSPAETTYRRSDSRI

SEQ ID NO: 9948 - protein, 390 aa, B.fragilis
LTNKTQMSNISSTVFADTKPHYHLLDGLRGVAALMVIWYHVFEGYAFAGGTTIDTFNHGYLAVDFFFILSGFVIGYAYDDRWGKNFTMKDFIKRRLIRLHPMVIMGAVVGAITFYIQGSVQWDGTHIGISMVMLSLLCTIFFIPAMPGVGYEVRGNGEMFPLNGPCWSLFFEYIGNILYALFIRRLSNKALTIVVVLLGVALASFAIFNVSGYGNIGVGWTLDGVNFIGGLLRMLFPFSMGMLLSRNFKPMKLRGAFWICTLVMIALFAVPYLEGTESICTNGIYEAFCIIIAFPILLWIGASGTTTDKKSTQICKFLGDISYPIYVIHYPFMYLFYAWLIKNQLFTLGETWQVALCVYAWNILFAYLCLKLYDEPVRKYLAKRFLNKKQ

SEQ ID NO: 9949 - protein, 204 aa, B.fragilis
ELIKLCKFVNRIMNSSPMKNIINKIRQLYPVSDEALQALQANMQVKYYPKDTYIVQSGITDRLVYFIEEGVTRSVFHHNGQDTTTWFSQEGDVTFGMDSLYYKQPSIESIETLSDCKIYVLHIDELNALYEKYIDIANWGRILHQDVNKELSHMFVERLQLSPKERYEQFNRRYPGLINRVKLKYVAAFLGISIYTLSRVRAKK

SEQ ID NO: 9950 - protein, 606 aa, B.fragilis
LTTKDMTYHHLSVLVHRQAEKYGDKTALKYRDYEKAQWIPISWNEFSQTVRQAASAMVELGVQEEENIGIFSQNKPECLFTDFAAFANRAVTIPLYATSSPAQAQYIINDAQIRFLFVGEQFQYDAAFSVFGFCPSLVQLIIFDPAVVKDPRDMSSIYYDEFLAKGKDLPHNEVVEERTARASAEDLANILYTSGTTGEPKGVMLHHSCYLEAFRIHDIRLVDMTDKDVSMNFLPLTHVFEKAWTYLCVHKGVQVCINLRPADIQTTIKEIRPTLMCSVPRFWEKVYAGVQEKIAETTGIKKMLMLDAIKVGRIHNLDYLRVGKTPPRMIQLKYKFYEKTIYALLKKTIGIENGNFFPTAGAAVPDEICEFVHSVGIDMLVGYGLTESTATVSCTSKTGYDIGSVGQVMPEVEVKIGEDNEILLRGKTITKGYYKKAEATAAAIDEEGWFHTGDAGYFKNGQLYLTERIKDLFKTSNGKYIAPQALETKLVIDRYIDQIAIIADQRKFVSALIVPVYGFVKQYAKEKGIEYKDMAELLEHPKITALFRARIDTLQQQFAHYEQIKRFTLLPEPFSMEKGELTNTLKLKRPVVARNYKEVIDKMYEE

SEQ ID NO: 9951 - protein, 469 aa, B.fragilis
LCLKHKNHATMKSFYPVLYLCFLFGLLPFLGSCSEENESSGTIEMNQLPGTAQSFLSNYFPGQTPEKIERTNTDQENAPLLYRVVFPNEVKVEFSENGGWKRLMIPDQKLPGSLDPLWGKIIEYVQQLFPDDPFIGIENACYGDCVLLSSGKKIAFYYDGTCIGYEMDIKDESGVPQPVRDFVATYFPDGVFQVVEHIPNKNVTAGYSFWLENGFKCVLNDRGQWTEVNGGTELLPVSILEALPAKVTEQLHRDYPAAQVTYIRLEGTCYTIQVSKTVYVTIDPENKPIVVPVMQAQALAEEYFGKLRSISISHPLHTDVLNFKVCLPNGFNMLVNEDASEWLNIDGNGFAFPEKLVASLPEKITEYISAHSNSEITRVDRSVAASFLVELTNGDGLMFDSQGGFLGKEKIELSISEKTYRYMRHQFPDDLNMYFSSYSIEGWIYKLGDGSQVRFDRDGNFVEMIAAAK

SEQ ID NO: 9952 - protein, 380 aa, B.fragilis
NLMKLLNKLFILTATAIAISSCQGDLLDTKPYDKASSGSMWSNENFCTMGVASIYATLREGYVAKEAYLMEAFSVGATCRDNDYPLLAGTASIGSGIFSDYWKQHYAGIYRANDAIVHLPDAPISESVKGKLLSEAKVLRAFYYYKLNAVFRGVPYYNTPMELDQADKPRESEENIWNFCIQDLTDAINDPNFPDRIAAGKAEWGHVTKSVAYALRGKIYLWTKEWSKAEADFRKVGELGHSLFQDGYKQLFKEANEQSDEAIFSLQCIDNNGSTYGNSMSFRYGGRTTFGSCWNTMLASVDFVETYENIDGSKFNWDEYIPGFSSLDIKDREVFFLRNTDPETVKAQYKRNRLCRHGRGIRRHGKKNKSQSRRTSGEVE

SEQ ID NO: 9953 - protein, 433 aa, B.fragilis
RYMEQLYNYLPEKLVTFILVTLFSLLIGLSQRKISLKREGETTLFGTDRTFTFIGMLGYLLYILDPEEMHLFMGGGLILGILLGLNYYVKQSQFHVFGVTTIIIALITYCIAPIVSTQPSWFYVMVIVTVLLLTELKHTFTEIAQRMKNDEMITLAKFLAISGIILPMLPNENIIPDINLTPYTIWLATVVVSGISYLSYLLKRYVFRESGVLVSGIIGGLYSSTATISVLARKSRNAHSQEASEYVAAMLLAVSMMFLRFMILILIFSSTIFTSIYPYLLIMAAVAAVVAWFIHTRRKRTPDADLVEEEDDSSNPLEFKVALIFAGLFVIFTVLTHYTLIYAGTGGLNLLSFVSGFSDITPFILNLLQGTGSVAATVVMACTMQAIISNIVVNMCYALFFSGKQSKLRSWILGGFGCVIAANVVVLFFFYLI

SEQ ID NO: 9954 - protein, 62 aa, B.fragilis
LMYCSDSRKFRLNNLCNHQMPFPRLDSSIMRVAVNSLKAYLKVISLQLFYLSYVFMFVALLI

SEQ ID NO: 9955 - protein, 848 aa, B.fragilis
LKARHWIRQERKCRFRLFLIMLWAIVRIKAMSFGCPQINDMNEHKHNYNMKINCLLALALSASSLAAQDAVIRVDAGKVENKITPYLYGACMEDVNHEIYGGLYDQKIFGESFEEPVSMDNFIGFTRCEGVWKLQDGQLSVQAHPGAKLVYDDTQLSDGTVGVDLKFTNGTSSSNNAGLLLRVGEYGGGADNFDGYEVSLFADGKRLLLGKHLHNWQELKTTPVDVDPTQWNRMEVKLDGDELVILLNDCEVLRFEDRDTGLRNGKVAFRNWGADVSYRSLTIGSNTPVKLLTKATPQVSGMWDAFADLAAAAVYKQIADKPFHGRYAQEIEYLAGTGKVGIANRSLNRWGISVRQGEKKTGSLYLKGKAEVRVALQSVDGEKEYAVQCIRANAGDWKKYTFELTPDKTDENARLAIYLEEKGRIQVDMVTLMNGADRQFCGLPLRNDIGQAMVDQGLRFLRYGGTMVNAPEYRFKKMIGDRAERPPYKGHWYTYSTNGFGIEDFLHFCEKAGFMPAYAVNVEESAQDMEDMIEYLNGSVDTKWGKKRAENGHPEPYGLKYLEIGNEEVIWGDIEADYQHYIDRFNDIYEAVHAKDPEVQFIHSAWWRPESPNMEKVFKALDGKAAYWDYHPWTDDLGSHVNIDRELTDMKAKFLKWNPKTSMRCAIFEENGNLHNVQRAIVHATVQNVVRRHGDFILTTCAANALQPYLQNDNGWDQGQIFFTPGQVWGMPTFYAQQMSSAHHHPLRLWSETVGELDMTATTNEARDEVILHVVNTSSEVRETQVSLSGFIPKGNMEIYTLSGELNDENLPDTPTRILPKATWKQAPGSDFTYSFPGYSYTIVVLKK

SEQ ID NO: 9956 - protein, 444 aa, B.fragilis
SLKRRMNKQLITIFSIFSITCLGMVSAQESKSFLPEVKKESLTFSSEDNKFKLTFNGRIQADGAMFFGEDYQPIGNGVGFRRVRLGATAAFGKRLSGKIEMDLTDGGFSLKDCFIKYAFPNGLYFRAGNFKESFGMAAMTSSGDLWFMEKANVVSAFAPEYHIGVQGTWEHDQFLGVAGVHFKKIEGNKEKDYSESNNKAGEDEGISVTARAVWQPVSADKVKGFHLGIAASYRTPKTTVGSLMPNTVRYSTRSLSYINKIKFLDTSPIASVSHDWLAGAELAGFYRGFRFQGEYIMNNTVRMEGLATEKFNGFYVQAAYLLFGGQQRYSKSRGAFSQPSFGRSWGDIELAARFDRIDLNGTEVMGGSSNGWTFGVNYYATRNLKFQLNYSYVDNDKYANAFGQAAVGYKSNGEIAYKPEEVDESLGKGGNAYGILGLRIQLNF

SEQ ID NO: 9957 - protein, 84 aa, B.fragilis
LSRSSRRTLAMSLEKERIEKEHIEEMNQAKLRFFTNVSHEFRTPLTLIISQVELMLQKNTIPPSLHNSIFRIRKHAQQMKLLIS

SEQ ID NO: 9958 - protein, 1119 aa, B.fragilis
SIMRKSKLHLLPLSSKRVLVSTSLIMLLSGSAWAVSSQETVENGDAITAVPQQRRTVKGIVKDANGEPIIGANVIVKGNKTIGVITNLNGEFSLEVPSNATLQISYIGYLNKEVKVSGNQVSFNIQLEEDSKTLDEVVVVGYGTQKKANLTGAVSSVDFEEQTKSRPITTVSSALAGLSPGLQASSGSAMPGEDNTTLRVRGNGTMNNASPLIIIDGMEGSLNAINPQDIENISILKDAASCAIYGARAANGVILVTTKSGDRDKIQVNYSGRISFNSPTRMIETMSNYADYMELMNESCENVGSGTLFDQKYIDLWREKSKDPNGVNENGVPNYIAYPNTNWLKELYSGGMIHEHNLSVSGGSNKIRFLLSARYQDNEGIVDNTANKTYSVRANIEANPTQWLTLGTRTYASQMDREVGDFSNANTFLRQSTAGTYPEWNGSFGYPECPDERATANNPLYKLARNDGFKRYNRFNTTLFSKVKFFKDLSWDFNFNYNRYIYETRQWGVPAYQTRFSDGVIVDGITPPSQLSTSFGYESNYSYTLENLLNYHHTFAQKHDVSALLGYQEFYKNYYTVDAAKKGLIDESLNQFDEATEMTSTKGATQDYATRSVFGRVNYAYNSRYLFEANFRYDGSSRFHKDHRWGFFPSLSGAWRISEESFMENTRTWLDNLKVRASWGKLGNSEIGNYEYMSVYSTTNAVFGNALNSALYMGAIANSLLKWESTTSVNFGIDVNLLKNRLSISADLYQKKTDGILYRPTIPYVFGTMTAPRQNLAKVSNKGVELSLGWRDNIGGVSYSINGNFSYNKSNIDAYNGTYERTWVEDPNNKLTGGKWEDNIGKVSSGGTTPIVEGRMMNEYYLRNVYHGNGSYYNADGSVNPQGGPKTGMIRTEKDMAWVKDMIAAGYEFQPGKTVAKNKIWYGDYIYADSNNNGVYGDDNDYTFQKTSNKPKYNFGFQASAAWKGFDLSMVWAGAAGFSIYWGATTGYNAASTEWGSTIAQRVAENHYFYNPENPDDPRTNINAKYPRMAYIDGYVQNRHGNTTLWLYKGDYIKLKNLSLGYTLPKNWVSKIAMQNARIYVSAENLLTITGFEGQDPESATGMGYSPFRTIAIGANITF

SEQ ID NO: 9959 - protein, 860 aa, B.fragilis
LHMRNKLLLLLLLMFMTSGMMYAQQQKTQQSQQRTAAPSYTLKGVLLDSLTQEGEPYATIKIAKKNAPQKALKMAVTDLNGKFQEKLTVAPGEYIITLSSVGKVTIVKDFTVKASEKVIDLGKLNMAEATNELKGIEVVAQKPLVKVDVDKIEYNIEDDPDSKTNTVMEMLRKVPLVTVDGEDNIKVNGSSSFKIHVNGKPNNMMSNNPKDVLKSMPANTIKHIEVITSPGAKYDAEGVGGILNIVTVGGGFEGYTATFRASGSNRGAGAGGYATIKSGKLTITGNYNYNYDTSPKSYSDSYRENYDSEDQKYLESKSSSDYNGSFQYGNLEASYEIDTLRLLTASFGMYGGANDNKSDGLTTMWNAQRDRLAYQYRSLSDGDGSWYSMRGNVDYQRTSKKNKDRMITLSYKISTQPQNSDYYTDYKDIKDPFEMDIVKKFLLNNSHSDGKTNTTEHTFQVDYTTPIGKLHTIEAGAKYIIRNNLSDNKLFEAEGVSDNYEYNNDRSSKYKHLNDILAAYLGYTLRYKTFSFKPGVRYEYTSQDVKYLAGAIGPEADFSTSYNDFVPSVTMGIKIGKTQNLRGGYNMRIWRPGIWNLNPYFDDRNPMFISQGNSNLESEKSHSFNLSYSMFSMKFNVNISLRHSFGNNGIERVSRLIGKGGEEFPGGHHAPEGALYSTYENIGKNRNTGLSLYGNWNASPNTRIYLNGDGSYVDIKSPAQGLHNYGWNASLYGGIQHTFPLKIRASLNAGGSTPYISLQGKGSGYYYYSLGVNRSFIKDRFTVSAYVSNIFEKYRSYNNTTMGENFLSKSSSRYQSRSFGISLSYRIGELKASVKKAARSINNDDVKGGGGQGGQGGGAN

SEQ ID NO: 9960 - protein, 882 aa, B.fragilis
VAFMKIGYLKPGILLLVLLFSFRQDLFAKKRITSLKCEYIEAPLGLDVQRPRLMWKVDTSDVPSRQTAYRILVSSTPELLRQGEADIWDSGKQKSDEQLVSYAGSTLRPHTRYWWRVEVWLNNKKVVSEPVWFETGKFSATDWEASWITDGYDKDYEPSPMFRKVFDVSKEVASARCYISGLGYYRLSFNGKAVNDHALDPGFTDYSKRVLYLTYDISGLLRHGKNCIGVQLGNGWFNEQTPAVWYFHEAPWRKRPQMIAEIHLCYTDGSKDIITTDTSWKTSTGPLLFDNLYVGSFYDARLEQKGWDTELFDDVSWQHAKLTAAPAPLIEAQKMPSITTADTLSVVSVNCISDTCYVFDMGINTAGVPRLEIKGERGTRIRLRHSEMLQKDGNIDQRNIDMHLRPRNKREIIQTDEYVLKGEGVETFIPPFTYHGFRYIELTSDRPLTVADVKLQTLRMHSDVAEVGSFKCSDQLLNTIFNICRNSYLSNLFGIPTDCPTREKNGWMADGFMVQEAGMFNYDSRNVYAKWVKDMIDTQEANGNVAGIAPTSRRWDSNWAGPLWDAAIFIVPSYLYRYTGDIETMRQVYPAAERYLKYIETTEDERGLINHGLGDWLFYKAETPVDFMATGFVYWDNLMMAQMAELTGRVEDRQKYLAKAEELKKRINDHFFDPQTVSYANKTQLSYALPLYLHIVPEAYRERLAENLHKIIAANDYSLDFGFIGSVMVPDVLAETGYAETAYRMLTKTILPSWGYWIKETGATSLYETWDVTRRIGDASLNHPSMGAVSAWMYKYPAGIRLSPDAPAFKKILIQPCFLSDLDFVEASHESMYGTIRVDWRREEGKIRLHLVLPSTAMATVVLPGQKPKAVKGGEHIFVIPE

SEQ ID NO: 9961 - protein, 272 aa, B.fragilis
KHSISEIGFAGTEEALDDMVKKIKAKVDGRLEKLSDKAKALYLPAGNEARIKAAYDSRDPRLSQTVITPYATYDGSGNSVDHTFTSRWPYYGADTDYPYDLRTDTQSHLYYLFRKFVAEGSSEMTNREQSPIDLPIIRYATVVIGLAEALNEQGKTDEAIEWLNKVRQRAGVALLNSNTATMVQGQEDMRVRIQNEFRWETAGEGVDFYEELRWKTWKESKFNNADGTAGMKDVWGTITYPYTWGGDQYYVWPIPKHETDMNKSLTQNSGWN

SEQ ID NO: 9962 - protein, 354 aa, B.fragilis
GGIFDIDGKKIQVEEEQLRTQAPGFWDDQKKAEAQMKLVKGLQKWIEGYNDVKTLTDELELAFDFYKDELVTEQEVDEAYAKALEHVENLELQNMLRDEADQMSCVLKINSGAGGTESQDWASMLMRMYLRYAETNGYKATMANLQEGDEAGIKTCTIQIEGDYAYGYLKGENGVHRLVRVSPYNAQGKRMTSFASVFVTPLVDDSIEVNILPACISWDTFRSGGAGGQNVNKVESGVRLRYQYKDPYTGEEEEILIENTETRDQPKNRENAMRQLRSILYDKELQHRMAEQAKVEAGKKKIEWGSQIRSYVFDDRRVKDHRTNFQTSDVNGVMDGKIEGFIKAYLMEFSSEEA

SEQ ID NO: 9963 - protein, 306 aa, B.fragilis
KSIMKTQVFKLACLIICLLTIVPNCHAGSKWKAKHVVLIGLDGWGSYSVEKANIPHIKQLMNDGSYTLTKRSVLPSSSAVNWASMFMGAGPELHGYTTWNSSTPDLPSKELSKDGIFPTIFQLLREADPKAEIGTFYEWVGIKYLVDTLAVNKYNQGINYEKHPTELCETAVKYIKEKKPALTLIAWDNPDHVGHKEGHDTPAYYHKLEEIDGYIGKVMNAVKEAGILDETIFIITSDHGGINKGHGGKTMQEMETPFIISGKNIKKGHEIQASMMQFDVAATVAAIFKLKQPQVWIGRPIMEVFK

SEQ ID NO: 9964 - protein, 135 aa, B.fragilis
SCLMVNQDAKAACMGLLNLNSLCFYDLKGNLMKEIVIGKELKFPEYDPEFLDFPNALKYFISLCGTPNYLYALYNGFPGTSGESKIMVFTWQGAPDAIYQTDVKLERIADAPSGRYVLGLNITEEVGSDVLKFEL

SEQ ID NO: 9965 - protein, 514 aa, B.fragilis
RHRMKRTNRTLFIHNTARGRIKFLLLALFAFQGLQAQKLFPAPSAIETHKGTFSYDEVSAKCVRTTISKSLPAIGIEYSDEAYQLEITPDSIFIDATSAKGAFYARQAIKQLARHERGKIRCCRIYSSPRYAWRGFMLDESRHFFGKEKVKQYLDLMALLHLNVFHWHLTDEPGWRIEIKKYPKLTKIGAVGNWHDAQATPQFYTQDDIREIVAYAAERQIMVVPEFDMPGHATAVCRAYPEVSGGGEGRWKHFTFHPCKEETYRFISDVLDEIVALFPAPYIHIGGDEVHYGNQNWFTDPEIQNFIKEKGLINETGLEHYFIRRAADLVAAKGKKMIGWDEIVDAGISPSKALVMWWRHDRKYQLLKALEQGYQVVLTPRRPLYGDFVQDASHKVGRYWDGFNPLQDIYALPEPISHLFKGYEDQILGMQFTLWTERIADGKRLDFMTFPRLIALAESAWTSSKEKDWSRFCMRLPSFLEYLKEQGIYYFDVIHPQETPEPGGPEKADVLQNG

SEQ ID NO: 9966 - protein, 404 aa, B.fragilis
NMNLKPLLGAACAMICVACSNHKPTVPSFITENVEFAKAQLGLAIDTIEASGKCLNPVTLNRDGSVYYCGYADWRSGFFPGSIWYLYELTGDTSYLPLARKYTEAIRPAEHLTWHHDIGFIINCSFGNGLRLAPDTASYKDVMVQAAKSLCTRFRPNAGVIQSWDVKGNSWQSERGWECPVIIDNMMNLELLFEATKLSGDSTFHKVAVAHADRTLSEHFRPDGSCYHVVDYNISDGSVRHKQTAQGYADESVWSRGQAWAIYGFTICYRETKDRKYLDQALKTFNRMKNDPHMPEDLIPYWDMDAPNIPDEPRDVSSASCIASALYEISTYDVPDAASYREYADRIMHSLASPDYRAALGTNGNFILMHSVGSIPHNSEIDVPLNYADYYFLEALKRRKDLDK

SEQ ID NO: 9967 - protein, 474 aa, B.fragilis
LLDFRKFDQNYIQLKLSEQSLNTFLEEVYLSFSAYASQKSISYHLKLLEQDISIWIDDWQMRKVLFNLLSNAFKHVPDKGEISILTSTTPDQVVIAVKDSGNGISKEEQERIFDRFYQADNRNKAIHVGTGIGLALTKSIIQLHHGTIEVESELNEGSCFIVKLPKTRDCFEKDTEVVFLESPEKEPMVQENTIPDENFMKKDDSTFETPLIDEREGKRKVLLVEDNVELLQVLKEIFSSLYQVVTAANGEEGLKQAFAEVPDLIVSDVMMPVMTGTEMCLKIKNNINLCHIPVVLLTALDTVDQNIEGLRRGADDYITKPFNAKILITRCNNLIRNRLLMQSRFAKDQILEINLLAANPIDKGFLDRVIKVVDKHIDNEDFDIGYVCQELEMGRTLLHTNFKALTGMTPNEFILNHRLKIASLMLKNEPYLQVAEISDRLGFGSPRYFSRCFKNQYNVTPMEYRKGAKQENLK

SEQ ID NO: 9968 - protein, 370 aa, B.fragilis
KIQVLFVHLHPFKAKKEMIDESITSEAVGLLKSLISIPSLSREEEKAADYLQNYIEAEGMTTGRKGNNIWCLSPMFDLKKPTILLNSHIDTVKPVNGWRKDPFTPREENGKLYGLGSNDAGASVVTLLQVFLQLCRKQQSYNLIYLASCEEEVSGKGGIESVLPGLPPISFAVVGEPTEMQPAIAEKGLMVLDVTATGKAGHAARNEGDNAIYKVLDDIAWFRDYRFAKESPLLGPVKMSVTVINAGTQHNVIPDRCSFVVDVRSNELYSNEELFTEIQKHISCKAEARSFRLNSSRIEESHPFVQKAKKLGRVPFGSPTLSDQALMVFPSVKIGPGRSSRSHTADEYIMIKEIEEALELYLKILDGLEI

SEQ ID NO: 9969 - protein, 170 aa, B.fragilis
VTMSIDFFIAKCQTENIVDKEFGICDDEDEEKKTPAYVDRNQPDKWVAVVKNQTNQSINFTAVDNCVEMNRSDGTMDFRCDAMLTNDDNIVFVELKVQAADWIFHAVDEQLQTTIDHFKANHDLSRYKYKRAFVCNKRHPNFRVSYKDKMTSFSMKNGIRLNLVREIIFK

SEQ ID NO: 9970 - protein, 299 aa, B.fragilis
LLPTSFCISFHSLHNHCPFPLHNTFFLFSTALLPPFPHYNIFLFFIKIFFTFPFFSFPPFTLLPSLFLFLRFSFISFSLSFFLLFFLSFPHPPLPLLLLSLFSLLIPTPLFFSHLFLFSSLSFLSISFPLILSFLSSYFLFSFPLLITFSSETLLLFLLLFLSFLSLLTFFFHSHPSPPFLFHLCLFYPSLFLSLPSPSSPSLIPSLYSPLLCPPPPPSSSSYFTPIPLLLLSFLFHIFHPPFSSSLTFPSLSPFLILHLFLLFSPLPLLFCYLPSSFPFSSFPYNYSLFLLSHSPLSF

SEQ ID NO: 9971 - protein, 69 aa, B.fragilis
ETYTLLLKRYKSDDVEGEYQNYIVSAVIQIKSNKILLFTDSYFSFSGSTRTVEVRNGWFLWRRTALLSR

SEQ ID NO: 9972 - protein, 405 aa, B.fragilis
DVSAVGTFRRKIGGLWAAVNIVLPDLTAGSTEGVIDFAGVTSGMLTHDGGQDTDNIIAVRVKANDRWSDAGMYTIRTVKPVFKVGYYPGNVWTKEFTLNTLTADSVKTGNLDKFTDIAYEFSADGNSWEAMPGDLRKAGLSPGTSYYVRAKYRGEVPGEKVEVKTYEALSIPNSDFNAGYDVTYPKSENPLYTFKGDWIGTRNPLTCHTDGANAFYVSKSSTLPVVDGERNVAHMMTLGWGAGNTCSFGNKDYWLGNSVINHISAGIVCVGDYEAAGDVVNGKAAYIRPTSMSFVYKAAPYKDDEYLIEAYLENITGEVETIIGKAYLKSGTAYSSYQTQTLNFEYNNEHRNLPISHVKIIFKAGTKEDRDHLEDKFRDAKVPYGDAYIIGSQFWLDSFTLHYDK

SEQ ID NO: 9973 - protein, 246 aa, B.fragilis
CLYHRFTVLARFIHFTLRQINMKTYIYLFLLLLATASCSEQTAPDHSVGYLRVENIILSCDTETLPITRAVDAGLKLEIWQGSECVRSYDPGAAELSKRIVLPVGEYTLKAFTPDQTEAPDNESGTPIYSVDYPFAIVSEDVTLISVKAPQINIGVGVEYSDEFMANFTDFSVTVSSPTGRQASLAGNVTDLLYFNVPTGGTHLSYTLTATNADGETMTSEARSILQESGAELTSGNYKVRIGLVQ

SEQ ID NO: 9974 - protein, 199 aa, B.fragilis
FCKHIRIPYILFLSKVIFILFILFHFFVYLLRTEHFNGNRCSKSKKNMETEEEIQNVNVHHGHNIRRTRIEKNIKQDALAALVNMTQPNVSKYEKMRVIEDEMLNRFARALNVPVEYLKTLEEDAPSVVFENITNNVHDNKDSSVPITGYKGQDATTNSFNPIDKITELYERLLEEKDEKYAALEKRIQGLEQQNNSGK

SEQ ID NO: 9975 - protein, 85 aa, B.fragilis
EIFKKEVSKLGKCNRLSRQMLTCFEVNAYLFSGKARLYRLKRAVLRQRNQPFLTSTVLVDPEKEKYESVKRRILLLFICITAETI

SEQ ID NO: 9976 - protein, 244 aa, B.fragilis
  UNSURE (27),(71),(93),(130),(171),(174),(201),(203): Identity of amino acid sequences at the above locations are unknown.
RLVEVENQALPAIIDDKNHTVLVYVSXKQDLSAVKITKMILGGSKATITPDPSTVTNFRRPQEFVVNRFDXEELWTVDVVRTTSTGTTGSADXWATRATLNGGMKQGTTPRVEYRKKSEDTWTVVPETDXKLESGTTFSTTLTGLQDGTDYVWRVVVEEVPSTESGFTTEXIQXIPNLNFDTWSQNPTGTFKKSWYPNADXSXSFWATGNDGVTSSLAGSRDSSTRPGRKERCERKGGLYGHFM

SEQ ID NO: 9977 - protein, 183 aa, B.fragilis
PLHWRAAVIRVPAPEEKSVVNGKAAYMVTLCSVPLVGVAAGNLFIGDYKTNAQSPKDSPKFGRSFTGARPTGLKGWYKYTSKPVDYVGNPDNLKNDECHIYLRLWDDKDNEIGYGEFIGKETVTQYTQFRFDVTYTNKTAKPAKITIVATSSHYGGDFTGMKVTGSVGVGSELWVDEFELLYE

SEQ ID NO: 9978 - protein, 329 aa, B.fragilis
IRKRAMHKSVLSLVCCLFFFLSCQEEIETMPNGSLNIVLTDEAAVTRTLPEALSDELRQQFTIELLRDREGTIVPEYKGALRDFGDQRVFKVGSYQLKAYLGENPSLALDAPYYYGEVQDIAIEKGKATTVTVGCKVANALATFEIVNQEVFDKRLKDYYVEVSAGGESVTWKPGDATHPYFKAGGRVTMALIGTSVETGQEGSYALNPIETVKAGVKYNYKLSMKASNVSLEVTTETQQEPITINETVPDSWLPKAKVFSEDFDENHVLTYTETADALSRAGIAYTALRPVQDVEFAFNFADKHLEHLNKTYLLSELSEERSAGFGLL

SEQ ID NO: 9979 - protein, 65 aa, B.fragilis
KSEGGKRKEGESKENFYEKEENVIMWKRWEKCSRKKKKGVMERKGAVIMKGVKRDTKRSRKKLKG

SEQ ID NO: 9980 - protein, 133 aa, B.fragilis
GIRICLQNQLFYAYFTAIEITTILLHTMIGLLTTKELDFLTKLAELLKEYSAIISYGHCSELRILVCAGDSEDVEKYPIIFEDSFDENEIYDLLRKNRKRIEEIIEREVAEAVPEGELSQPDDQAGSMADHFH

SEQ ID NO: 9981 - protein, 422 aa, B.fragilis
CIFVVYLNVNINRGLFMNETVNLTVYQFGPISEADVVFDKYTVLIGKQGSGKSTIAKLYSMFTWLEKGLARRITSEKYITQYSRFQKIYCAYHRLESYFKRETVIRFYGLHYNFFYENEKFHVEAKGLPESYKVAKVMYVPAERNFLSTADDTDGLKSLPESLETLLEEFDKAKEAFKTGYRLPFNDTDFEYDALNKISWIKGSDYKIRLSAASSGYQSVLPLSLITRFLSDLVLDNANKEDLSIKEKKQIEKEVNKVMNDKSLTDGVKFAMLRNISSRFKYSCFVNIVEEMELNLYPESQRSVLFDLLSYANKIELNRLVLTTHSPYVINYLTLAAKAFLLTQKVSANETLQERIKEVVPADSTIDPARLRIYELKDGGVFRLSTYEGLPSDENFLNIQLGVTNELFDQLLEIEQEFDYKN

SEQ ID NO: 9982 - protein, 681 aa, B.fragilis
FSVPHQPMVMYDRQNITRQAQHQGYPVTMEKNPDGTWTEAAVYIGWAGFVEGTSWQKDNKLDVRNTTTLTYTPIKQQLIFKGDFTYYSSKSTRLRAENQYNYYTGPEIMGTRNTFSSLENMDYNREYISSNITGNYIPKFSNSDHYLNVLLGWNLEHQDYKTIQTYRRGLISATKPSFALMDGDYYTTGQGGNEWAYVGFLYRLNYNYKSRYLAEVSGRYDASSKFPENQQWGFFPSGSLGWRISEEPFMKSTRNWLDNLKVRASVGSLGNGNVSPYLYLSTIPIKKTSVILGDALQTYATTPNIVPNSLTWEKSTTYDIGLDVDMLSNRLSMVFDYYQRYTTDMYTVGPTLPAVLGAATPKGNNAEMKTKGWELSVMWRDNFTLANKPFNYSVKAMLWDNRTWVTKFNNPTKLLSTYYEGQEIGTIWGYHIEGLFKDQAEIDAHADQSKLKVSATNILKPGDLKFADLDKSGTVDNGQNTLDDHGDLKVIGNTTPRYQFGLNLSANWNGIGICAFFQGVGKRNWYPHRESAFFWGQYDRPYSYMLKEHTGNNVWTEENQNTDAYWPRYRGYLANGSTKALGIQANDRYLQNIAYVRLKNLQIDYTFNKKFCDKLHLQDLKIYLAGENLLTWTPLNKHTKMYDPEGISAGDADFRSTANTDGDGYGYPILSSYTIGINVTF

SEQ ID NO: 9983 - protein, 190 aa, B.fragilis
DYQAQAAIARLTRNAAFRYKAYLEQIDYATNRGLERNQMERLATLDYVHKGQNLFITGSSGTEKSYLACALGHEACKKGFRTLYANAPKLLGALKVAKVKGTQETELKKIERCQLLILDDLFLVPLDAKERPILLEIIEDRHERKSIIITSQYPSFNWYDMVGDPTIADAILDRIIHTAHTIELYGESMR

SEQ ID NO: 9984 - protein, 89 aa, B.fragilis
CNLLTQKMSMKKYWLIGLYALALTSCDSFLNCEPENSFSSEGFLESQSDLRLYTNGFLQSFLPSEETIAWGGDQYASSPRGWKDQRGAK

SEQ ID NO: 9985 - protein, 130 aa, B.fragilis
SHSRTRSMERKVSAVQVGGSLGRSHYVNGKFIASNLGIILTPTNNPEYPINVRFYSMYSNAIRKQIVNELANGTSKLTIPVNDLMNYYVEYFHISKQNGLVEYCNKAIVTLQQKLDKEKDNFNKRINSLL

SEQ ID NO: 9986 - protein, 207 aa, B.fragilis; identical to SEQ ID NO: 8284

SEQ ID NO: 9987 - protein, 79 aa, B.fragilis
DEPGTWAKKGKGGGGGKVGQESFLTSSKSPILDFCKWMEEHPGTGNPFKGTGRSAITARMNYNSSYTDIMLYNNMACTA

SEQ ID NO: 9988 - protein, 92 aa, B.fragilis
KDNMTEQEVRRYLRKMSEQDSQSAFREFYDMTYDRLFRIAYYYTHHEEWSQKIVLDVFMKLWELEKPLYFAPFGQIGFTTLGRDMIDPLKSW

SEQ ID NO: 9989 - protein, 156 aa, B.fragilis
RQKMVSLVMVCSGPMAGIQLICKVKRRPPGGINNVFKYSTDWYNELVRRDADPSLDKVRVNDKGEYEYFGNTNWLDIIYKDQNYSTEHNVSISGGNERARYYVSGRYYNQDGIYNAGDEKYTQYNIRSKGEIQINKSLLLENNTECHDFPFPTSLW

SEQ ID NO: 9990 - protein, 299 aa, B.fragilis
LPSLRLERILNLFYQLNSMKVKRCFLEWSLVSRRFAVALTFVLEGGMLLAANLIPVKGVVKDTSGEPLAGVTVRIKDGKSGTITDVNGYFVLDVEKGKKLLLSYIGYSETEVLVKDDQQMQIVLKEDVQQLQEVVVVGYGTAKKVNLVGAVDQIDSKRIAERSNSNISRSLQGMVPGLNITFSDGKPSRTPSINLRGTGSIGAGGSALVLINGVEGDLNSVNPADVESVSVLKDASSAAIYGARGAFCVILVTTKNATAGKTKINYNGSFSMHQRTVKTEDGIVSNGLQWTDGWYTAYL

SEQ ID NO: 9991 - protein, 600 aa, B.fragilis
AAMTFCSMLVFCSFPTLAGEAEARVVLNMNTGWAFHRGEVESGGQPGLDDSGWIAATIPHIMQLEKKHCGGDIIYDGVGWYRRTFRVPSQYKDKQIKISFEGVMNACEVYLNGQKISAHRGGYVGFVTDITTRINWDRDNLLAVRVSAEYDPLTPPGKPQAGMDFYYYSGIYRDVEMVISDPLHITHALEEEEVAGGGIFVTYPVVGKEKAVTHVKAHVRNEGKRKRKAQLRTQLIDKSGKIVACQLTPFRLSAGEAIHLEQNLEIVHPSLWHPYDPNLYTLQNEIVENGKVVDCHTESIGIRTIAYTRDGGFYINGESLYLRGANRHQAFAHIGDAAANSMQERDVIDLKRGGCNAVRAAHYPQDPAFLAACDKYGLLVVECIPGWQYFKNDSTFISRLYEVGKQMIRRDRNHPSVILWETALNESRYPAEIARNLYAIAHTEYPGDQMYTAGDYFGHADRVDCFDVFYKQVSRFPKDGDVMSNYPEDQIAVKPLFCREWGDGVGEKPRVSLMENEEEQLKQCRGRFLQLNGHGYFDWCMLDANPRMGGHFLWSYNDYARGADHETMFCGIVDINRIPRCRYYMMQSIFRQEISLPANI

SEQ ID NO: 9992 - protein, 374 aa, B.fragilis
NVGSGSRSLESVVSRMGIDIFDNFYRGKRVLVTGHTGFKGSWLSIWLHELGAEVIGVAQDPFTARDNFVLSGIGEKIKADLRADIRDGERIKAIFQEYQPEIVFHLAAQPLVRLSYDIPVETYETNVMGTIHVLEAVRSTDSVKVGVMITTDKCYENKEQIWGYRENEPMGGYDPYSSSKGAAEIAIASWRRSFFHPEQYDKHGKSIASVRAGNVIGGGDWALDRIIPDCIKALESGRTIDIRSPKAVRPWQHVLEPLSGYMLLAQKMWSDPTRYCEGWNFGPRAESISTVWDVATKVVNNYGSGELRDLSDPHALHEAKLLMLDISKAKFRLGWEPKMNIEQTVELTVDWYKRYREEEVYDVCVEQIVNFIQK

SEQ ID NO: 9993 - protein, 298 aa, B.fragilis
LFKTITMKYLITGGCGFIGSNLAAEVLKRGEELFVLDNLFRYGSGSNLEWLRTKGDFTYYPYDTRNTNDVETVIKEVQPDYIFHLAGQVAMTTSISNPRLDYETNALGTFNLLDAVRKYSPDSVILYSSTNKVYGDFEYLHFREESTRYVCEEYPNGFPESISLDFHSPYGCSKGCADQYLLDFHRIYGLKTIVFRHSSMYGSNQHATYDQGWIGWFCQKALEIKNHTLQKPFTISGTGKQVRDVLHGEDVVNLYFTAKDIDKAYGEVFNIGGGIENSLSLSSPRGCNERCHWGMGGR

SEQ ID NO: 9994 - protein, 306 aa, B.fragilis
LILYRNKMETVFLIGGSGFIGKNLAQYLSQKYHVHVFDKYIDQPFFTSYPSIETTELDLVSQRIPQDMPSPDYIINLASVVTAERNMSLFDELISSNLKILLNLYERFKEESSLKLFIQFGSSEEYGSEQSPFREEDRECPNSPYALVKQLTTNTSMMLYRNYGFPIMVVRPGNLFGPLQNKDKFIPYVVGQLRSGLPLNVSPCEQKRDFIYVDDFSCAIESLLQNYFKCLGEIVNVSSGESISLKQIIEHCKASLHSSSDVNYGALPYRENEAMDLKCSIAKLSSITGCNIHFDNEKRLTDYLKQ

SEQ ID NO: 9995 - protein, 86 aa, B.fragilis
ETKYSFGRGATVTSFHIASGRGQKKTYLWGRFRPQDITFDPIRGDQQLAYPPIRFIGTRTSDTTPADKKAHHTRRVNATIELLDRA

SEQ ID NO: 9996 - protein, 81 aa, B.fragilis
VSRKRSFPRYFCTRRIRPPVWVFSPVSTIETFQHSEWLFTMVVVLLERHTAISVLLRKKVGETLLDEKWGLAATFSKRGGW

SEQ ID NO: 9997 - protein, 69 aa, B.fragilis
  UNSURE (19): Identity of amino acid sequences at the above locations are unknown.
PTFFFGAGWITEERRGVGXTADVINNRSLIFFPIDGMLYWISGICLPSPSKREIGGFVAKLDQVTRLLH

SEQ ID NO: 9998 - protein, 285 aa, B.fragilis
FFGEGSPPPKRSPKIIDCPEKRNKGKKAPPRVTSTRPPPQNMWWWVIKTTKKFSFGENTFSCSHFFKKAIHHPPLLENVAARPHFSSRSVSPTFFRNNTEMAVCLSSNTTTIVNNHSECWKVSMVDTGLNTQTGGRIRRVQKYLGNERFLLTYGDGVTDLNIGDTLKAHESSDCLLSLTAYKPGGKFGALQLDLDTDKVLSFQEKPDGDRNWINAGYFVCEPEVFDYIPEGDSTIFERQPLESIAKAGRMHAFRHTGFWKPMDTLRDNTELNEMWDQGVAPWKVW

SEQ ID NO: 9999 - protein, 845 aa, B.fragilis
CRQPIRFRQLIRRISNLLRSLKDASATAIYGSRGANGVVLITTKRGAKGKDNISFSANFGISKVVKKLDMLDGYAYAMYRNEAAQMFNEYENANEAIPYPGTSKVDPSTGESVYSPGPEDYRNGTYPSVNWQDEVFETAFSQEYNLSVNGSNDKGYYAISGNILDQSGIIHNSGYKRYSFRANLARKVHEWIEIGTNMSFTNSLNKLAKTNSVSDGIIRGALFYPATAPLDDETNNAQLNWFSSNPYVYTRAAKDELTTNSFFSSSFVEITPYKDLKVRQNVGFSYNINERDVYYNRETVEGKDPTNGYASKADNWSKNLVLETMATYNKTFNRNHSLNVVAAFSYERGDYGNKAMVATGFPQDLTEDFDMSAAVNPQKPTSGRGMTSLVSFLGRANYNLMNKYLFTASFRRDGSSKYAPGNKWSNFASGAIAWRASEEQFIKDLNVFSNLKFRASYGQTGNQAIGAYATRDYLTVANYPINGALASGFANLTWRGPANPDLKWETTSQYNVGVDMGFFQNRINLTIDLYYKKTSDLLQNIQIPQSTGFSNMTTNFGNVTNKGLEITGKFYAITGKNLNWDFDANISFNRNKISGLPGDQFAQGWSKADNVFLQRNGMPIGTIYGFVEDGLYDNIVEVRADPFYAKESEAVCKAMVGEVKYKDFDGVAGITNADRQVIGETNPDFTFGMTHNFTYKNFSLSFFLQGCVGGDIFNANLLEVTMSGIGNIPQNIYESRWTPENRENAKWPKAYAGYGRTMKLSDRYVEDGSYLRMKNINLGYKFISPFKGIESINLFASVSNVFTISGYSWYDPDVNSFGSDASRRGVDLFSYPSSRTFSFGLQCTF

SEQ ID NO: 10000 - protein, 264 aa, B.fragilis
MTPIAPLPMIPWNMQNMMMLLMALLMSGHMMAQQTIVTGVITDANDGSSLIGANVLVKGAGTGSIANVDGKYSVNVPNGKNVLVFSCVGYKEHEITLKPGQKVLNVIMKEDTELLDEVVVIGYGSMKKSDLTGSVTSIKSEDLMKTNPISINQGLQGRIAGVQVNQNDGAPGAGVSIQIRGANSFSTSTEPLYIVDGIPFTSSGMPGTGKDGMMQTANPLSTINPSDIESIEIFERCLCHSHLWIAWRKWCGIDYYQTWCKRKR

SEQ ID NO: 10001 - protein, 419 aa, B.fragilis
QKSSTSPCALKGESLLAQQIALEISKLLRHRQTFLFAFHKSPELSRYFDLGTNDALHRLQEFGRMGRFEEYACLTRLQAFLQCTVTACSMRIEQITRLLPARFHAFTNLLVGVRRSGYLGSDGCMRTAIQVEHTGKVARITHIHRIGNGGNGRTGIVLSCLQILIENIILIVGGDKTADGQAHLFAEQACSNVTKVSARHTDDDILCPAGLLQLRIGIKIIECLRQETCHVDRVSRGQQQLFVQFLIHKGCFHQRLAVIKRSVHLQGCNIPPQRSELFFLYLADFSLRIEHIHMNTLYPQKAIGYRTTGISGSGNEHIHLFPPLFPDEVSQQTGHKPSTYIFKSQCRTVEKLQGIDVLLHRHQRDIKIQRIINDLFQRFRRNIFSKESICHPVSDFPERKILYLVIKLLRQGLDGHGHE

SEQ ID NO: 10002 - protein, 270 aa, B.fragilis
VATPPTVTSSSNSSRFTPITSIDIWQAINSTPFSRACCRRDSSESMPFRCMMYRIIFPPIPPMLILESFSFSELDGSIVPNILPKMSFSTLGLCNFLITFSPQKVKKIVTFCPVAAAPLARTKVASALSKSSLNIIRVLPLLSHVVVRLQAWGSPFSMTTTDFPPVLSLEINLFPVELHHAAASRENPGSVATISTLSPGTSVSIVFFIFRTGPGHCNPQASTRIVLGFAAVVVWGASAVTEGFAGLSCAEGVSSVSSFSCKMMGAVAAR

SEQ ID NO: 10003 - protein, 321 aa, B.fragilis
KNNPRMMKNKKVEANLSMVVSKTFSGLNMNALKYLLPVWVSPLSGVTLRCVFAAIAFWIIGMFVKPEISTRKEKIFLFLLGALGIYGFMFLYLMGLSKTTPVSSSIFTSLQPIWVFVIAVVFFKEKISAMKIAGISLGLGGAILCILAQKSDDLASDALTGNMLCLLSSIAYAVYLVASNRILKSVGMFTVLKYTFAGAAFSSIVVSAVTGFHAPVFSGPLHWFPLSVLLFVLIFPTVVSYLLVPIGLKYLKTTVVAIYGYLILIVATIVSLLVGQDRFSWSQTIAIGMICVSVYLVEVAETKEKPVSNSDKPSSLPPHGS

SEQ ID NO: 10004 - protein, 312 aa, B.fragilis
LLNTYAIMPLNLPDKLPAIELLKEENIFVIDNSRATQQDIRPLRIVILNLMPLKITTETDLVRLLSNTPLQVEISFMKIKSHTSKNTPIEHMKTFYTDFDKMREDRYDGMIITGAPVEQMDFEEVNYWDEITEIFDWARTHVTSTLYICWAAQAGLYHHYGIPKYALDKKMFGIFKHRTLLPLHPIFRGFDDEFYVPHSRHTEVRKEDILKVPELTLLSESDDSGVYMVVARGGREFFVTGHSEYSPLTLDTEYRRDVSKGLPIEIPRNYYVNDDPDKGPLVRWRGHANLLFSNWLNYFVYQETPYNIEDIR

SEQ ID NO: 10005 - protein, 111 aa, B.fragilis
SLNTNPIPCCAFIEDSIFSTFSLLKSKETFCDHAETVKPNKRTPKSNSIFVLVLVFISYSIKLIIFIVYKKAFLYKLTHHRKEGMSAIFIFLQKKMQGNDRSCPYVVVHAF

SEQ ID NO: 10006 - protein, 147 aa, B.fragilis
PDWLPTWGGAGQGARKYFNFKSHETAHHFEAGVAYTVQSETFPLSVAWYTMFAGQDKNAEGGQNYSSYVEFNYPFRVRMVDLNVTCGMVPYAAPQYNCDGFAVTNVALKGTTQIRFTDKFALPVFAQAVWNPRMEDAHLVFGITLKP

SEQ ID NO: 10007 - protein, 86 aa, B.fragilis
NLKTITVMEKYLIHSNELHLIDQERIHQAVEQMVESLDMAAGSTFSFDLYKVVETYFKDLDKRREINHLLGITDNTYDPTEDFGVC

SEQ ID NO: 10008 - protein, 642 aa, B.fragilis
LHETIKMLRIKRLDIFIIKSFLLLFVGTFFICLFIFMMQFLWKYVDELVGKGLEMSVLAQFFFYSALSLVPMSLPLAVLLASLITFGNFGERFELLAMKAAGISLLKIMRPLIVLVFAICCVSFYFQNVIGPQAQAKLGTLLISMKQKSPEVDIPEGVFYDEIDGYNLKVQRKDRKTGMLYDVIIYDFSNNFDNARIIVADSGRLEMTADKQHLYLHLYSGEMFENLKAQSMSSKNVPYRRESFREKHSIIQFDSDFNMADASIMSNQSTTKDMIKIQASIDSMTVLADSIGRQYFVEASKGPYRTAVGLTKEDTLKMQEAQIRDYNVDSLFEAATLMNKQKIIASAVGRTENLSSDWGFKSFTMTQNDFSIRKHKIEWHRKITISLSCLLFFFIGAPLGGIIRKGGLGMPVIVSVLTFIIYYIIDNTGYKMARDGKWIVWMGMWMSSAILAPLGYFLTYKSNKDSVVLNTDVYISWFKRVFGVRSVRHLSKKEVIIHDPDYQRLPFDLNGLSEECRAYMQKNRLAKAPNYFSLWMSGGQDQEIIAINNRMEALVDEMSNTRSLILLQKLEKYPIIPVNAHVRPFHNYWLNMAIGIVIPIGLFFYFRIWAFRIRLNKDMERIIALNRDVELTIKDINNENKI

SEQ ID NO: 10009 - protein, 61 aa, B.fragilis
WFSATTQMIGLLKNKIPNGMSFELLFMTQRPIIFPTPFLIAQKRFLTGKESSEQASATFSF

SEQ ID NO: 10010 - protein, 74 aa, B.fragilis
KLYFCTYKLVLIIKISNKMAYVISEDCIACGTCIDECPVGAISEGDIYSIDPEQCTDCGTCADVCPSEAIHPAE

SEQ ID NO: 10011 - protein, 67 aa, B.fragilis
NIEADILFFITLLSCYSYKLKCSAIVLNACTGKKDKAATMKMTAKVITAKVTVSVFKVPALSGINFF

SEQ ID NO: 10012 - protein, 431 aa, B.fragilis; identical to SEQ ID NO: 6067

SEQ ID NO: 10013 - protein, 867 aa, B.fragilis
LNYYSIDRCRPCSGAASIFLDKLLYGNSYFLSDGVLAYVVKGPLRIFNFKYEPDIYTQEISQQICVYMKYLFTLLMACLSLSTTYGTVHHPSSSVSSGRWVVWAEKPATSWQDAFVTGNGRHGTMVMGQPGSERIICVHEELFIRGWDRHKVAVPSTASLLPEVRRLIESGRSDAADELMTGEADRQLVAMGAVQRWPLIPHPAFDLCIRYTDTTLQAENGYRRQLDLETGETSAFWGGRGGVTESVFSSREHNVNVLRLKATGQRKINLVLGLKETPGREGVHFEHNLDSAFSSVSTEVFSGWLSYRAAYKYDAGGYEGLARVSLKGGSMITEGDSLRIADADEVLVLVRITPLENANLSVRPSVQRELSRLPLDYNTLLLPHSRKHAEMFRRMQLDLGCSSDWKTTSTEKMLSDIHKHGVTPLFLEQIHAMGRYLLISSSGKYPPPLQGIWGGGWKPGWIGGFVWDSNINLAVSAASMGNLHECAESYIGYVESLLPGWRLNARNYLGCRGFIVAHYNDPESGYLTHFGRSFPWMCWPGGAGWNIRPFYEYAMLTGNEAFLKKHVFPLYREMADFYEDYLTMDGDSLYHICPSVSPENAPPGTDTWLSKDATMDVAIAKEVFRLLLEMGRTFRADKKELAKWNNYLQRLPSYRINDEGALAEWIDEAYQDVYNHRHLSHLYPVFPGSQLGKSEGDPRLIHAARIALNKRFAFDTGSAHGLIHVALQAVRLGDIDKVKTNLDRFSRRHYLYDGLVTSHDPEHQVYNLDAVLSIPRLLMEMLVYTEKGKIELLPAWPCDYADGSIKGIKIYGGHTLDITWKAGKLIEAVLYARQNERYEVVCGDVRRHVQLHKGKTYHFPASFFAEK

SEQ ID NO: 10014 - protein, 216 aa, B.fragilis
PKHYKDMKRLIPILLAVFAFAACEKDPDMDKLDNDYLVYTNYDKKADFKQFSTYYIPDSVLVIGDKKDPEYWKGEAAEAIINAYKENLNSKGFTYTDNKDAADLGIQVSYVQSTYYFTDYGQPEWWWNYPGYWDAPYWGNWGGWYYPYVVNYSITTNSFLTEIMNLKAPEGEKQKLPVLWSSFLSGPASYSGKVNQTLVVRAINQSFAQSPYLTNK

SEQ ID NO: 10015 - protein, 389 aa, B.fragilis
RYCYGLCSIKIEEKMDREESVQHFLDLIKKSRRGKFKVYIGMIAGVGKSYRMLQEAHDLIDNGVDVRIGYIETHGRAGTEALLKGLPVIRRRKLFYKGKELEEMDLEAIIRIHPEIVIVDELAHTNVEGSLNEKRWQDVMTLLDEGINVISAVNIQHIESVNEEVQDIAGIEVKERIPDSVLQEADEVVNIDLTAEELITRLKAGKIYKPEKIQTALNNFFKTENILQLRELALKEVALRVEKKVENEVVMGIGLGVRHEKFMACISSQEKTPRRIIRKVARLATRYNTSFVALYVQVPKESMERIDLASQRHLLNHFKLVTELGGEVVQVQSKDILCSIVQVCKEKQISTVCMGSPGLRLPGALCSVLKYRRILNNLAQANVDLIILA

SEQ ID NO: 10016 - protein, 191 aa, B.fragilis
AMNYLEITGALVGLIYLWLEYRASIYLWIAGIIMPAIYIFVYYQAGLYADFGINIYYLLAAAYGWMVWMRGSEKETRAELPITHTPLKRYLPLLLVFLAAFFGIAWILIRFTDSNVPWLDSFTTALSIIGMWMLARKYVEQWWAWIVVDVVCCGLYIYKELYFTSALYGLYSIIAIFGYFKWKQMMHYESK

SEQ ID NO: 10017 - protein, 64 aa, B.fragilis
KNDLVLVIHYEYKNQTTFWHWNIGRNEYFTGYTFQCKPLDFNRHGNLIVPVPCLVLSGRLYGSP

SEQ ID NO: 10018 - protein, 62 aa, B.fragilis
LYIQKRLLYHMTASSFLKAIHSMLAFHLTTLSITIYLNKGQLESSIWASFIIAFNSSAFSGY

SEQ ID NO: 10019 - protein, 530 aa, B.fragilis
TMIQEYQLRILPEIAASEQQLKAYLSQEKGLNQRDITALRTLKRSIDARQRTIYVNLKVRVYLNEMPKDDEYEHTIYNNVERKPQVIVVGAGPGGLFAALRLIELGLRPVVVERGKNVRERKKDLAQISREHRVDPESNYSFGEGGAGAYSDGKLYTRSKKRGNVDKILNVFCQHGASTAILVDAHPHIGTDKLPRVIENMRNTIIECGGEVHFKTRMDALIIEQGEVKGIETNTGETFLGPVILATGHSARDVYRWLAANNVTIEAKGIAVGVRLEHPAGLIDQIQYHNRSGRGKYLPAAEYSFVTQVDGRGVYSFCMCPGGFIVPAASGPEQVVVNGMSPSNRGSRWSNSGMVVEIQPEDIINDKRLTVNNEAEETFPELAVLHFQEELERQCWLQGGRRQTAPAQRMVDFTRKKLSYDLPESSYSPGLISSPLHFWMPEFIAGRLSQGFQQFGRSSHGFLTNEAVMIGVETRTSSPVRIVRDKDTLQHITLRGLFPCGEGAGYAGGIVSAGIDGERCAEAVAQFMNP

SEQ ID NO: 10020 - protein, 83 aa, B.fragilis; identical to SEQ ID NO: 6082

SEQ ID NO: 10021 - protein, 415 aa, B.fragilis
HYEHCKRIKKKLMKHIIILGDGMADWAVKSLGDKTLLQYAKTPYMDKLARMGRNGRLITVADGFHPGSEVANMSVLGYNLPKVYEGRGPLEAASIGVDLQPGEMAMRCNLICTEGDILKNHSAGHITTEEADVLIQYLQEKLGDDRVRFHTGVQYRHLLVVKGGNKQLDCTPPHDVPLKPFRPLMVKPLVPEAEETASLLNELILKSQELLKDHPLNLKRMAEGKDPANSIWPWSPGYRPQMERLSDTFPQVKRGAVISAVDLINGIGYYAGLRRIAVEGATGLYDTNYENKVAAALEALKTDDFVYLHIEASDEAGHEGDVALKLKTIENLDSRAVGPIYEAVKEWEEPVAIAVLPDHPTPCELRTHTNEPVPFFIWYPGIEPDSVQTFDEVAAVEGSYGLLKEDEFIKEFMNR

SEQ ID NO: 10022 - protein, 687 aa, B.fragilis
QDNKVMKNKMSASMFQKEQVIESIRQSFVKLNPRMMIKNPIMFTVEVVTVIMLVVTLLSLFTPEYGTFGYNLCVFLILFVTLLFANFAEAIAEARGKAQADSLRKTREETPAKLVIGDKVQTVSSSKLKKGDVFVCEAGDTIPADGEIIEGLASIDESAITGESAPVIREAGGDKSSVTGGTKVLSDHIKVLVTQQPGESFLDKMIALVEGASRQKTPNEIALTILLAGFTLVFVIVCVTLIPFADYTSLEHPGTAISIAAILSLFVCLIPTTIGGLLSAIGIAGMDRALRANVITKSGKAVETAGDIDTLLLDKTGTITIGNRRATKFHSAPGVGPREFVTTCLLASLSDETPEGKSIVELGRESGVRMRSLQTAGARMIQFTAETKCSGVDLADGTQIRKGAFDAIRKITEAAGNKFPKEIEEVISEISGNGGTPLVVCVDRKVTGVIELQDIIKPGIQERFERLRKMGVKTVMVTGDNPLTAKYIAEKAGVDDFIAEAKPEDKMEYIRKEQQSGKLVAMMGDGTNDAPALAQANVGVAMNSGTQAAKEAGNMVDLDNDPTKLIEIVEIGKQLLMTRGTLTTFSIANDVAKYFAIVPALFMVAIPELGALNIMNLHSPESAILSAVIFNAIIIPILIPLALKGVQYKPIGASALLRRNLLIYGLGGVIVPFVGIKLIDLVVSLFF

SEQ ID NO: 10023 - protein, 573 aa, B.fragilis
FENKAMNTEILGVAVQIVLMVVLAYPLGRYIARVYKGEKTWSDFIAPIERVIYKICGINPQEEMNWKQFLKALLILNAFWFVWGMVLLVSQGWLPLNPDGNGAQTPDQAFNTCISFMVNCNLQHYSGESGLTYFTQLFVIMLFQFITAATGMAAMAGVMKSMAAKSTQTIGNFWHFLVISCTRILLPLSLVVGFILILQGTPMGFDGRMQLTTLEGQEQMVSQGPTAAIVPIKQLGTNGGGYFGVNSSHPLENPTYLTNMVECWSILIIPMAMVLALGFYTNRRKLGYSIFGVMLFAYLAGVFINVGQEMGGNPRISEMGIAQDHGAMEGKEVRLGAGATALWSVTTTVTSNGSVNGMHDSTMPLSGMVEMLNMQINTWFGGVGVGWLNYYTFIIMAVFISGLMVGRTPEFLGKKVEAREMKIATFVALLHPFVILVFTAISSYVYTHHPDFVESEGGWLNNLGFHGLSEQLYEYTSSAANNGSGFEGLGDNTYFWNWTCGIVLILSRFIPIVGQVAIAGLLAQKKFIPESAGTLKTDTVTFAVMTFAVIFIVAALSFFPVHALSTIAEHLSL

SEQ ID NO: 10024 - protein, 954 aa, B.fragilis
DSANQIKKEGVICEKVHPSLLLEYLVSILCSLKRHYNTKYTQHMKNIFFICLFLSMSLAVSGKKAQVSISCLKTEMLVNPQNIDCPSPRLSWEILSDVRDVRQVSYHILVSTSLEKLNREEGDLWDTGDVASDQSAYVSYGGDMLDSRTQCYWKVRVKTNKGISAWSEPASWEMGLLHPSDWQAVWIGRAFPQDKLEGNTRVPARYLRKPFNLNSKKVRKATLYICGLGFYEAYINGKKIGDQVLAPTPTDYSKSVKYNRFDVTGQLLKGANAIGVILGNGRYTSMRMPGVRHFDVPKMIAQLEVYYEDGEKRVIASDASWKITAEGPIGTNNEFDGEEYDARKEMPGWNTYPFDDTKWLQAEVVSLPGGKLEAQLNRNMKVMDTVKPIGITESAPGVYILDMGQNMVGWLRMKVKGQSGDTLKLRFAELLQKDGSIYTANLRTAHSADTYILKGNSMEEWQPTFTYHGFRFVELTGFREKPSLSDFEGQVIYDEMETTGNLETSDPMINRIYKNAYWGIRGNYRGMPTDCPQRDERMGWLGDRAVGSQGESYIFNNHLLYAKWLDDIEQAQKENGAVPDVAPNYWDVCTDNMTWPGAYLIIANMLYDQFGDKQPIIKHYPSMKKWMRYMKDKYMVDHIMTKDIFGDWCMPSQSSELIHSKDPSRITEAEVLGTTFYYYLSNLMVRFAALAGYPQDAEDFRKESELAKEAFNSKYLHTELGYYSNNTVTANILSLRFGMVPEAYKEVVFRNIVEKTMKDFNGHVSTGLVGIQQLMRGLSDYGRIDLAYRIATNRTYPSWGYMVDNGATTIWELWNGNTADPAMNSANHVMLLGDLIVWAYGYLGGISNAPGSVGFKQIQLKPYPVDGLDFVNTSFHSIYGEVRSHWKKEDGSFCWDISVPCNTSALVYVPVADKSIDPKEKKRIVGEGGTFLRMEGSYAVFSFPSGSYRLKTRL

SEQ ID NO: 10025 - protein, 986 aa, B.fragilis
HKHKMRHLFLLAALFCACISYAQIRVQERLPKSKTGFALTTAKARAKIYYDANDALVIKRSAELFARDIQMVTGQKPELIQKRERAKALVIVGTIEKNQWICELAQKGKIDIRPLQGAWERYLIQTVDNPSPGVAKALVIAGSDRRGAAYGLFSISEMMGVSPWYWWGDVPVKTHKALYVDAPPTYSKTPSVKYRGIFLNDEDWGLKPWAAKTFEKERGNIGPRTYAKICELLLRLKANHLAPAMHPVSTAFYQIPENKLVADTFAIVMGSSHCEPLLLNTASEWHSKTMGPWDYNANKDKINEVLGNRVKENCAYENVYTLALRGLHDAAMGGGDVPMKEKVKMLENALKDQRSLLTRHIDKPAETIPQAFTPYKEVLEIYSNGLELPDDVTIIWADDNFGYMKRLSGPQEQKRTGRAGVYYHISYLGVPHSYLWFSTTPPALMYEELRKAYDTTADRIWLANCGDLKGAEAQVSFFLDMAYDIDQFNENNVHTYPARWLAKIFGEQYYDTLKDITCSHINLAFSRKPEYMGWGYWNNYWGGGEKRTDTEFSFINYNEAGRRLAEYRRIGKKAEEMLATVDKKAKPALYQLLYYPVKGAELMNRMNMTGQLYRQYVRQKRAAADDLKRETTTCHDSLEIITDGYNSLLDGKWKYMMSLRQNYDGSSSYFMLPLMEESYVATGDPKLAVQVESEQLNRGGFSFRALPVFNTYSRKSHWIDVYNQGGGMLDWKSELSDEWIVLSRQSGSTRTEDRIQVSIDWNKVPSGEKVTGFIEFSSGMQKERVLVSVFNPKTPVRDELQGLFIEENGYVSLPATAFHRKFESEDVKMSVLPGLGFEGAALQIGSPIAPLQMYRSSEVPRVEYDFYTFNAGMVDVYTYVLPTFPLHADRDYKLPEHTNSDTKYSVRIDDGSISTPSTSAIEYSQIWYDSVLKNCRVNKSTLYVKAPGKHTLQIRCGDPGTVIQKIVIDMGGLKRSYLGPETTLCR

SEQ ID NO: 10026 - protein, 333 aa, B.fragilis
ELPNESECRMREKVRFCVALCCSVVMVLLASCRYSLPDLPAEGMSRKTKDSLTYLSKYHYTWNTNLEVLDDSVRLEYLPLKDAYVNLYKGDRVVVAEFSVHPQDSVDSIWVKVAHSQEVQGWVRNKELVRSFVPTDSISQFIHLFSDTHASYFVFIFALFVGVYLLRAFMKKRLQMVYFNDIDSVYPLFLCLLMAFSATVYETMQVFVPDTWEHFYFNPTLSPFKVPFILSVFLTGIWLFIIVTLAVLDDLFRQLTPAVAVFYLLGLMSCCILCYFLFILTTHIYIGYFFVACFIWLFVKKVRRGSGYKYRCGNCGHKLRDKGQCPHCGAVNE

SEQ ID NO: 10027 - protein, 1152 aa, B.fragilis
KPPKDGYCLTKKNNIMNKNRSIRVAAFCLGLMLAGSLQVHAQKVTFRDGTVSLKQAFEKIEASSKYKIAYNDSHLNVSRKVSLNQKETEVLEILATILKDTGYTYKKSGNYIVIVPVEQKPASKVKKVKGVVKDASGEAIIGANVLVKGTATGVITDMNGSFELEVPGNAVLQITYIGYVQQDVAVKNRDQLAVLLKEDTKTLDEVVVVGYGTMKKKDLTGAVASVKMDDTPLSTISTVSHALAGKAAGLQVNTISAQPGGGTTFRIRGAASTGAGNDPLIIVDGFPVSNAGNVSVGYNSDNGTTDNILASINPNDIESIEVLKDASSTAIYGARAGSGVIIITTKRGKEGKPKVTYSGSATVQTMATKYEMLDAQDFMIQSNRWFKEKWMYDNKVGIYGGKNESEAGSAYHPKYSDADIANPVNDTDWYDRITRTGFQTQHNISINGGTEYTKYLISGNFFNQKGIVKNNGMSRYTGRVNLDQKLSKYAKVGINLTVSRNTLDNVPLGAGQNEYASILVSAAQFSPLLSVKDENGDYSLNQQAAYIPNPVSLLEISDQTTKERFLATPFVEIKPINELTLKASFGIDRNYQRREVYMPKTTLYGEKADGRADIGQYDRSDYLLELTANYAKRLGDHNLNALVGYSFQRFTSKYLNAGNQGFLTDAFLFNNLGAGTYEKPWVGSSASKSEMASFFGRVNYTYKDRYLVTATLRADGASNFAKNNRWGYFPSVALGWRFTEENFARSLNLDKVLSNGKLRLSYGQTGNSNIGDKSVTYYGTGYNKVFGNKEYTGVYVSQIGNPDLKWETTTEWNVGLDLGFLNNRFNVTAEYFHKVVSDLLSSRSVLSYNEVGSIAANIGKTQSQGFELTINTKNFDTKDFSWNTDFTFSFYRDKWKERDENWSPNPYDMYNAPLRGYYMYLSDGLIQPGEEVSWMPGALPGQVKLKDIDGYAYNEDGTYKTDKHGIPLRTGKPDGKIDYADAVFKGCSDPGYLLGLNNTFRYKNFDLNVYFYGQLDLLKSGSYKDYWIVGSGTMTGVNNLYRGYNMPTSAKEVWSHDNTSGKMPGYFQYMSNYGYGDYFLEKSWFIRCRNITLGYTLPVKSAKKLVSNVRIYADVNNLFTITPYDGLDVETDDSYWAYPNVRSFSIGLDITF

SEQ ID NO: 10028 - protein, 222 aa, B.fragilis
RITKMEIFRNLTVVLAITTLVACNDVTIEGSWVEPVPGISNLKQGFTLEANGSASSINMATLKYEKWKKEGNLLLLSGISIGNHQSISFTDTLTVEQLTQDSLILKKGELVLRYSKTNEIPDEEAIPTPDTPTQKLLSVKGKLIIGHETRSFTSEGDSTDYWIVDKTGELLQKYDGETKGIKNGTPVYVELEVIDMGKSDEGFAADYAGVYHVMKINKITVK

SEQ ID NO: 10029 - protein, 209 aa, B.fragilis
CIMKVNDIDMDAVILGNGEYPTHSMPETMLIMAPYVVCCDGSADEHIRRGFTPDAIIGDGDSLSPENKERFRTIFHQIDDQETNDQTKAVHFLLDQGKKTIILVGATGKREDHTLGNISLLIDYMKAGAQVTMLTDHGMFIPASGRNCFKSYPGQQISIFNFNATGLRADGLVYPLSDFSNWWQGTLNEATGTEFTIHAEGDYLVYLNY

SEQ ID NO: 10030 - protein, 118 aa, B.fragilis
GSMNTICKMRDIYKALSIFETAFEEVYGISLNEAMVLCALREAGKEITSTAIAERTEMAPSHTSKVIRAVEDKGLIRRALGEVDKRQMYFSLTEAGKKRLNELDLDKVEIPEMLKPLI

SEQ ID NO: 10031 - protein, 257 aa, B.fragilis
RKKKFIMKICSCLNKGVMIAVAVVCSAGLQSCLDDNDKYYYVEGFPNALVTVKNATDGSFFLQLNDSTTLLPTNMSSSPFGDKEVRALVNYDEVSESGGRYDKAVQVNWIDSILTKSIAPDLGSENDVVYGTDPVEIVNDWVTIAEDGYLTLRFRTKWGDYNKAHFVNLLLGQNPSDPYEVEFRHNAYGDTYGTVGDGLVAFKLVGLPDTNGKTVPLTLKWKSFSGDKSAVFDYCTQKNVTPAKPAIVSVRSNLNLK

SEQ ID NO: 10032 - protein, 290 aa, B.fragilis
LKEKGVDSSLDTIRDEIIGMNIFNSVFVDCTASPDIASLYKDFLQHNISVVAANKIAASSAYENYRELKLIARQRGVKYLFETNVGAGLPIINTINDLIHSGDKILKIEAVLSGTLNYIFNKISADVPFSRTIKMAQEERYSEPDPRIDLSGKDVIRKLVILAREAGYKLEQEDVVKNLFVPNDFFEGSLEDFWKKVPSLDADFEARRKVLESENKHWRFVAKLENGKASVGLQEVDRNHPFYGLEGSNNIILLTTERYKEYPMMIQGYGAGAGVTAAGVFADIMSIANV

SEQ ID NO: 10033 - protein, 447 aa, B.fragilis
PARKPDSSGALPGFERAPLWISVTGGICILTGLVLLVWLPRSINRPVKELTCGILEIANHNYEKRLDMRGYEEFREVSDSFNRMAEKLTEYRDSTLADILSAKKFLEAVVNSIHEPIIGLNTEREILFINNEALNVLNMKRENVIRKSAEELSLKNDLLRRLIRELVTPGEKNEPLKIYADNKESYFQASYIPIENAAAEEGEARNLGDVILLKNITEFKELDSAKTTFISTISHELKTPISAIMMSLQLLEDKRVGSLNGEQEQLSKNIRDNSQRLLDITGELLNMTQVEAGKLQMMPKITKPIELIEYAIKANQVQADKFNIQIEVDYPQEKIPKLFVDSEKIAWVLTNLLSNAIRYSKENGRVVIGVRHKKEYIELYVQDFGKGIDPRYHQSIFDRYFRVPGTKVQGSGLGLSISKDFVEAHGGTLTVQSEPGKGSCFVIRLKA

SEQ ID NO: 10034 - protein, 798 aa, B.fragilis
IMLFKRIRVTILLLGMLSFSLRVSAQIVLKHSDWEWKISETGCAEQLIFKGGKRNDTIPFFREGEHAGPSFYAKREGKEVRASWIPDGYASYRSEIDGVLCRISYIKDHGQPALRVKLTNNSPVPYQPQKAGLKLGIDTYMDKFPDWFGKYFPTLMRNEKTHFYGYLQTPSGHTLGLVSQQPVASWSVDYNLGYQDPVPFWFMGHRIESLNLDLLNELPLPARHPQNLYELKQGESKEWIFTFVNVGNLDNLERAIARVSDIPLIDIRQTSHAAREEASFTLTADNPNVKVTNDAGKELPVVLTKTKGNRWIGKVRLEDAGLYTLSVRSGNKVAEAIWTVHHPWQWVMEKARENAARYHQKPTSHAESWYGFYSAFLAARYFPNESLDKQLSNYFDRLYNKLHDSVKVEPLYFKTRIQNTSTTIGMLVDKYEAQGDLEDLKKASKLADWMIATSQRENGAYYNHGTVYTSVIYIAKSVLELAVLERKLGEQDLFWRTCADRHFLSAKKAVDQLVASQGDFQTEGELTFEDGMISCSALQIGMMGVIEQDAVARKYYTDAMLKILNSHDCLTQLRVPDGRRRQGTMRYWEAQYDVQMLPNMFNSPHGWSGWRAYATYYAYLLTGDEKWLEQTFNAMGAFANLIDYKTGQLRWAFVVDPHLEVEQACSADTKLDFSDLSFGNPHPKLYDTRKFVIGEQYVNMISDWQTVNTQDNDVHELFKCIGEAVLTNAFVIERPNGEVVGYNCRVTRKGNTLTVKADEKQIVNLHCNLKHSFSVSFDGKTCSLPEGYCDWAFGQSGY

SEQ ID NO: 10035 - protein, 208 aa, B.fragilis
KQDLRSPSEKYSIMNQFLDFDQKLYAELRKGSEHAFVTVFERYNRLLYALAYRYFKSGEEAEDAVQYTFMKLWEQRSSFEFQSGIRSLLFTILKNYIMNELRHRQIVFEKHYEMAQRNEEADDSFLKNFEDKDFREHLRTAIGKLPPQKQKICRLKIEKGLSNQEIADEMHITVPTVKSHYTQAIKILRAEIESLIVLLHVLWIHFLE

SEQ ID NO: 10036 - protein, 336 aa, B.fragilis
RKVEMKIDDAIIDKVLNNEASVEEAGLVAEWFATEEGSEYLSGRLESESARLTEERAREWLDHPVPEERMRERFIGQIKPEKKIVSYRRVLIAAAVLIPFLFLSISLWFLADRTGVFSATEYAELKVPCGEQMQVVLQDGTVIQLNSDTRLRYPKKFGLFSRSVELWGEGFFVVAKDKKRPFIIDLKGVEVKVTGTKFNVKAYPSEPNVWVTLEEGGVLLKDTKNKEYPLVPGESAEYNRTSGICQITKPDDMSQISSWRSNSLNFYLTPLRDIIKVMERQYDVHFVVRDSTLLNNRFTLSTSKVNVDDVLRDLEAVSWIRFLQTEDGVFEIQKEK

SEQ ID NO: 10037 - protein, 401 aa, B.fragilis
NRYEMNQLSDRLNSLSPSATLAMSQKSAELKAQGVDVINLSVGEPDFNTPDHIKEAAKKAVDDNFSRYSPVPGYPALRNAIVEKLKKENGLEYTAAQISCANGAKQSVCNTIMVLVNPGDEVIVPAPYWVSYPEMVKLAEGTPVIVTAGIEQDFKITPAQLEAAITPKTKALILCSPSNPTGSVYSKEELAGLAAVLAKYPQIIVVADEIYEHINYIGKHQSIAQFPEMKDRTVIVNGVSKAYAMTGWRIGFIAGPEWIVKACNKLQGQYTSGPCSVSQKAAEAAYTGSQAPVEEMRQAFERRRDLIVKLAKEVPGFEVNVPEGAFYLFPKCSSFFGKSAGDRKIENSDDLAMYLLEDAHVACVGGTSFGAPECIRMSYATSDENIVEAIRRIKEALAKLK

SEQ ID NO: 10038 - protein, 527 aa, B.fragilis
ISICMKVMKFGGTSVGSVNSILSVKKIVESAGEPVIVVVSALGGITDQLISTSRMAAMGDAAYEGAYREIVRRHEEMVQGVIPAGETQTLLHYQVNELLDELKDIFQGIYLIKDLSPKTSDTIVSYGERLSSLIASRLIQGAVWFDSRTFIKTEKKHNKHNKHTLDTELTNRLVREAFKEIPRVSLVPGFISSDKVSGDVTNLGRGGSDYTAAVIAAALDADSLEIWTDVDGFMTADPRVISTAYTISELTYVEATELCNFGAKVVYPPTIYPVCHKNIPILIKNTFNPDAQGTVIKQHVDHTKSKAIKGISSINDTSLITVQGLGMVGVIGVNYRIFKALAKNGISVFLVSQASSENSTSIGVRNADADLACEVLNEEFAKEIEMGEISPIQAEKNLATVAIVGENMKHTPGIAGKLFGTLGRNGINVIACAQGASETNISFVVDSKSLRKSLNVIHDSFFLSEYQVLNLFICGVGTVGGSLVEQIRQQQKKLMVENGLKLHVVGIIDATKAMFSRAGFDLANYRE

SEQ ID NO: 10039 - protein, 212 aa, B.fragilis
IHRLMMNHQPEIAIVEANTLTSLGLKTILERMIPMAVIRTFHSFGELTDDTPDMYAHYFISAQIYVEHNAFFLPRKRKTIVLAGDSHQFQLSGVPILNIYQAEEQLVKDILKLHQHAHHDGYPVKDMPPTPPTTGHELSAREIEVLVLITKGLINKEIADKLNIGLTTVITHRKNITEKLGIKIGLGPNHLCGDERVCGGRPHIANYVVNPW

SEQ ID NO: 10040 - protein, 193 aa, B.fragilis
SFKWIIMHSEIAEEKLLVSQFSQGSHIAFKALFMRYYPKVRSFIMGLVKSESEAEDLTQEVFLKLWTHREKFCEVEVFGTYLYVLTKNTTFNYLRSRQNRQDSQGTEWVEESTDTTPYEELVAKDLQLLIDMVVENMPPQRQMIFRLNREAGLTNAEIAEKLQISKKTVENHLNLALKELKNALLFFIFLYLC

SEQ ID NO: 10041 - protein, 486 aa, B.fragilis
TGKCHLFILIKQTKMKRRQIRKKNRITKKNREMKIYKFGKIPTGSVQGMKGMLRLIDNSIPQIIVLSATTETTERLAGIAAHLFNRDTEQAHDEISRLEFRFIDFANELFNDESIKQQAVDSIIDRFRTLWNFTRQRFTSVDEKDILAQGEFISSMLVSLYLKEQGINNRLLNSLDFMRLAPEEEPDMEYIGTKLHLLLAEHKSTNVFLTQGHLCRNAYNETCYLKQGGDDVSATLIGAALQAQEVCLWTDSKELHSCDPRFVKHPAMVKQLSFDEAEQLAYCGWTGFNPHCILPARENNIPIRLLCSMEPAEGGTLISNSQSGENIKAITARDNIYYIKFQSNRTLRPYLFISKIFDTFAKYHTSLCLFASSGSDVSVAINDKERLSHILHELSRYAVTVVKDHMCILSAIGNMQWQCAGFEARIINALATIPIRMISYGSNNNNVSLVIRAEDKREALQRLNDTLFAPCHANPSQIHVPTLKHS

SEQ ID NO: 10042 - protein, 234 aa, B.fragilis
TDRCIGFAPSEPFNLWVRRSDCSLCRNQVNRFGCQFILLNIQAMKTLLKSIKITLVFCVFFSVFYILVLWLFAQVAGPNRGNAEVVTLNGKVVGAANVGQTFTEEKYFWGRPSCAGDGYDATSSAGSNKGPTNPEYLAEVEARIDTFLIHHPYLARKDVPAEMVTASASGLDPDITPQSAYVQVKRVAQARGMDVEEVRRVVDKAVEKPLLGIFGTEKVNVLKLNIALEELKNR

SEQ ID NO: 10043 - protein, 811 aa, B.fragilis
HFLLHLCKRINEKIQHMKKNSILIALALFSAGGTWAEELPKDTLKVIDVEEIVVIAAPKENRKLREQPTAVTMLSQQDMQANQVNSIKSLTALVPNIFIPDYGSKLTSAIYIRGIGSRINTPSVGLYVDNVPYIDKSAFDFNYADIERIDVLRGPQGTLYGRNTMGGLIKVHTKSPFSYQGTDLRLSAGTYDNYNASVTHYHRMSNQFAFSTGAFYEYGGGFFKNTYLNKKIDKSQAAGGRFRGIYLPSENMKLDLNVSYEYSDQGGYAYGAYDKHTGTYLKPAYNDPSSYYRNLLNAGLNLEYQGDHFTLSSVTGLQHLRDRMFIDQDFSPANIYVLEQKQKLTTISEEIVLKSKSGRRWEWTTGAFGFYQWLTTNGPVTFKEDGVTEMLEKGINSHFPDLSAMGMKMNLDITNPTLLVDGRFHTPILSGAVYHQSTFRDLLIEGLSATVGLRLDYEKNWMKYNSGSTIDYQFNMTSPFMPVRLEQTSSPRLNGKFSNDYLQLLPKFALQYEWKKGNNVYATVSRGYRSGGYNIQMFSDLIQGNMQNDMQGQIKAGTKQIFDRLVTQGMPQAIADRILSNIPDAGENADPKASTIYKPEYSWNYEVGSHLTLWEGKLWMDLAAFLMDTRDQQIAQFAKSGLGRITVNAGKSRSYGAEAALRANLTDALSMNASYGYTYATFTDYKTIDRGQNEISYDGNYVPFVPKHTLNVGGQYIFRIAPRHWLDRVQVNVNYNGAGRIYWTEQNDVSQSFYGTLNSRVSLAKGNGQIDFWVRNALDKKYATFYFESMGNGFMQKGRPVHFGVDIRCRF

SEQ ID NO: 10044 - protein, 385 aa, B.fragilis
CPLLFLRIKRITFLTLCCHLQDISLSLQQYILHLRTMNPSDTSILLIYTGGTIGMIENPETGALENFNFEQLQKHVPELQKFTFPIDSYQFDPPMDSSDMEPEAWRKLLHVISEHYHQYTGFVILHGTDTMAFTASALSFMLEGLDKPVILTGSQLPIGVLRTDGKENLMTSIEIASARDRSGNPMVPEVCIFFENRLMRGNRTTKMSAENFNAFRSFNYPVLAEAGIHIKYNNVQIHIEGEKRELHPHYLLDTNIAILKLFPGIQENVVAATLAIEGLKAVVLETYGSGNASRKEWFLRRLRDASERGVVIVNVTQCSAGSVEMGRYETGYHLLKAGIVSGHDSTTESAVTKLMFLLGHGYSPDEVRRRMNESMAGEISIDLSK

SEQ ID NO: 10045 - protein, 836 aa, B.fragilis
ETILKRKYIQMKIIIIGGVAGGATTAARIRRSDETAEIILLEKGKYISYANCGLPYYIGDVIEEREKLFVQTPEAFGVRFRVDVRTENEVIFIDRKKKTVTVRLKSEDTYEESYDKLLISTGASPVRPPLPGIDSTGIFTLRNVADTDRIKAYVNNRPPRRAVVIGAGFIGLEMAENLHALGAQVSIVEMGNQVMAPIDFSMAALVHQHLMEKGVNLYLEQAVASFEQAGKEVKVVFKNGQSILADIVILSIGVRPETTLARAAELTIGEAGGIAVNDYLQTSDESIYAIGDAIEFRHPITGKPWLNYLAGPANRQGRIVADNLLGAQIPYEGAIGTSIAKVFDMTVASTGLPGKRLKQAGIVYASSTTHPASHAGYYPDAMPMSIKITFDPQTGKLYGGQIVGYDGVDKRIDELSLVIKHEGTIYDLMKVEQAYAPPFSSAKDPVAIAGYVAENIILGRVKPVYWRDLRDIELKDVFLLDVRTPDEFALGSLPGAVNIPLDEIRDRIAELPSNKPIYTFCAVGLRGYLAYRILIQHGFKEVYNLSGGLKTYRAATAPIILHENEETDDTPSAQDSPAKPSVTAEAPQTTTAANPKTIRVDACGLQCPGPVLKMKKTMDTLVPGERVEIVATDPGFSRDAAAWCNSTGNKFISKDSTGGKSVVVIEKGEPQACNLTTTCDSKGKTLIMFSDDLDKALATFVLANGAAATGQKVTIFFTFWGLNVIKKLHKPKVEKDIFGKMFGTMLPSSSLKLKLSKMSMGGMGGKMMRYIMHRKGIDSLESLRQQALENGVEFIACQMSMDVMGVKREELLDEVTVGGVATYMERADNANINLFI

SEQ ID NO: 10046 - protein, 340 aa, B.fragilis
ISGRMSYLKNIITYFFHHPASDGVVERVHQRLADTNSGQEKEEVLSGIWEQIGFPQADEHQTLRAFEKLEQQIGGDSLKSESSFSRFRIPRWSWIAASIIVPLLLLFGSAYLYKETLIIKNELSNVTFIQYYVSNGKREQVTLPDRSKVWLNSGSLLIYPSAFIGNEREVYLAGEGYFSVTKDKECPFIVKTNSVSVSVLGTEFNINAYPNIDKVVTTLEEGSIRMSLNRFDSSYLLEPDDQIVYIPSTGHIERKRVKASDYSDWRGGGLYFSNSPFKEVIQTIERTYSVQVHLQTSIYQSNNLTIHFYPNESIENIMMLIKEMIPGLEYQIEGKDIYID

SEQ ID NO: 10047 - protein, 511 aa, B.fragilis
YWSGYYFLSNKKIKNDMKKIIYIFSLFITVIGLLGSCINLESESYDSINTTIFPTNADDADALVIAAAYGPFRADGYSGLFQCAKGGLASNTDMSTDLLDCKWGDSWWPAVLQLNFTATSDIPTSFYGTWANHIGKMTLTLDRISGIDMKEEEKTRLIAETRCGRGWLAYILYDLYGPIQIPSLEVLQNPTQKVIVPRSSKEETVKLIEDDLKAAAEVLPAKYSKSDENFGRFTKGLAYTVLMKLYMHEKEWGKAVECGREVMKCGYSLVTNYKDIFTLDNEGNDEMIFSCIETRGVNEQMWHAHVLPSNYPTTNPNIQKWNGYRMPWQFYHSFDPKDKRLEVICSEYVGTDGVTYNETNPGEYLDKGALPIKYGEDLTQTSENSEVDVVVYRYADVLTLMAEALARSNNAVTQEAVDRLNDVHTRAGLAAYQLSDFTSLDDFLRAVLKERGHELWGEGCRRSDLIRYGLYIDYAIKYKGSTTAKEYMNLMPLPQSVITESSGQVIQNEGY

SEQ ID NO: 10048 - protein, 451 aa, B.fragilis
NSVGLCGAPTPKPFIKIPMKYYSTNKQAPLASLEEAVVKGLASDKGLFMPMTIKPLPQEFYDEIENLSFREIAYRVADAFFGEDVPAETLKEIVYDTLNFDVPLVPVKENIYSLELFHGPTLAFKDVGGRFMARLLGYFIRKEGRKQVNVLVATSGDTGSAVANGFLGVEGIHVYVLYPKGKVSEIQEKQFTTLGRNITALEVDGTFDDCQALVKAAFMDQELNEQLLLTSANSINVARFLPQAFYYFYAYAQLKKAGRAENVVICVPSGNFGNITAGLFGKKMGLPVRRFIAANNKNDIFYQYLQTGQYNPRPSVATIANAMDVGDPSNFARVLDLYGGSHAAIAAEISGTTYTDEQIRESVKACWQQTGYLLDPHGACGYRALEEGLQPGETGVFLETAHPAKFLQTVESIIGTEVEIPAKLRAFMKGEKKSLPMTKEFADFKSYLLGK

SEQ ID NO: 10049 - protein, 462 aa, B.fragilis
DLFIKRSMAKEKTVYVCSNCGQESPKWVGKCPSCGEWNTYVEEIVRKEVPNKRPVSGIESPKAKPVTLSEIEADEEPRIDMHDEELNRVLGGGLVPGSLVLIGGEPGIGKSTLVLQTVLHMPERRILYISGEESARQLKLRADRLTRTSSDCLIVCETSLEQIYVHIKNTRPDLVIIDSIQTISTESIESSPGSIAQVRECSASILRFAKETHTPVLLIGHINKEGSIAGPKVLEHIVDTVLQFEGDQHYMYRILRSIKNRFGSTAELGIYEMRQDGLRQVSNPSELLLSQDHEGMSGVAIASAIEGVRPFLIETQALVSSAVYGNPQRSATGFDIRRMNMLLAVLEKRVGFKLAQKDVFLNIAGGLKVNDPAIDLAVISAILSSNMDAAIEPEVCMAGEIGLSGEIRPVNRIEQRIGEAEKLGFKRFILPKYNMQGIDTKKLRIELVPVRKVEEAFRTLFG

SEQ ID NO: 10050 - protein, 305 aa, B.fragilis
NCIIMLLFQTTQQVADSLQVAAEKLDQAIAQADGLDKLGLITQQLIDSGIQAGGHILKAVIVFLVGRFLIRMLNRLVGRVMDKRNVDISIKTFVKSLVNILLTVLLIVSVVGALGVETTSFAALLASAGVAVGMALSGNLQNFAGGLVILLFKPYKVGDWIEAQSVSGTVKEIQIFHTILTTADNKLIYVPNGALSSGVVTNYSNQKTRRVEWIFGVDYGEDYNKVEKVVREVLTADKRILNDPAPFIALHALDASSVNVVVRVWVESGDYWGVYFDINKTIYATFNEKGINFPFPQLTVHQAPN

SEQ ID NO: 10051 - protein, 489 aa, B.fragilis
MNIMNQKLLLGSALLVGMASTQQALARQKKAKEQTRPNVVFILADDLGYGDLSCYGQEKFETPNIDRLAQNGMRFTQCYSGTTVSAPSRSCLITGTHSGHTAIRGNKELAPEGQFPLPENSQTIFNDFRNAGYRTGAFGKWGLGYIGSAGDPYKQGIDQFYGYNCQLLAHSYYPDHLWDNDKRVDLPDNNLNVQYGKGTYSQDLIHSKALAFLDEAAKEKDQPFFMWYPTIIPHAELIVPEDSIIKKFRGKYPEKPYRGVEPGSPAFRKGGYCTQFYPHATFAAMVYRLDVYVGQIVQKLKDMGVYDNTIIIFSSDNGPHMEGGADPDFFNSNGIWRGYKRDVYEGGIRVPMIISWPGHVQPSTETDFMCSFWDLMPTFREVLNPKADTRNMDGVSILPLLQNRKGQKEHEYLYFEFLEMNGRQAVRKGDWKLVHMNIRGNKPYYELYNLASDPSEKYNVLNQYPEKADELKAIMKEAHIEDSNWPLFR

SEQ ID NO: 10052 - protein, 494 aa, B.fragilis
SLHIFIMFRLIKKILPWYLKAFAENNKTLVKRFAKNNVKMQYDYLEALVKDLSLYKIKTEINMKNLRIWQTLSLFILLLSITLPLSAKSDLLTKLNTITLIIRTQSLETSLFAEKYLLRFKQPLDHSHPEKGSFSQRVIVAHVGYDRPTLMVTEGYGAARSLNPGYYEELSKLFNTNIIAVEHRYFLESTPKPKDWKYLTAWNSARDLHAIREAFRSIYPGKWIATGISKGGQTAMLYRTYFPDDIDITVPYVAPLCRSVEDGRHEPFLRTVAMPDDRQKVEDFQMEVLKRKAALLPHFKKYCSVRKLQFRAPVEDIYDYTVLEYSFSLWQWGIPVSRIPSVSASDKELFDHLVAISAPSYFVKEGSNTSFFVQAARELGYYGYDIRPFREYLSIGTSKDYLRRLMIPEELADMEFDETLSYKITRFLKENDPKMIFIYGQYDPWTAAGVTWLKGKKNIHVFVQPKGSHMARIHTLPQKEKEEAIGLIKKWLEE

SEQ ID NO: 10053 - protein, 657 aa, B.fragilis
YMNMKKILLVLTLFTGMILAGCNDSFLEKYPVTSLTEENAFKSYDNFKAFMWPCYEMFSNTNIATSTTAIGRNSHYMGDVYAGYLNQRGASSQNKYAFQTVTNATSGNGWNFSTFIRRINLMLSHVDDSDMTEAEKNHWKAVGYFFHSFWYMELIDRFGDVPWIDKPLDETSEEAYGTRMPRLEVADKVLERLQWAEQNIGDASVYEKKDGSNTINRDCVRAALSRFTLREATWRKYHELGSYDKYFDECIRVSKLLMADYPTLYYGTDGQPAAGYGEMWTTEDLSKVQGVILYQQWLETIKPGHSCYYEHTSSHDIEMHQGTVDLYLCKDGKTISHSDQYQGDKDIYATFRNRDPRMYHTIMPPYKVKDGKGDYSTWSYTSDPADREYIDIMGANESCSNPGIGMKRLPGQNWSASLVRRVPNLQGGAQYTIEGKKYGPHAYVASRSGYYVWKNWDNWEENYNNAQVNTADKPVFKIEEVLLNYAEAMFETNQFTQTIADETINKLRKRAGVADMVVAQIDGNFDPKRGKYYPKGNDNGILVDPVLWEIRRERIIELMGEGFGFYDVRRWRMAPWFVNMQQKGMWISKTELSSLTLLNEMTGTSDGANGSMTEGYIYLFNDPLKEGKGWLEKYYLYQVPLEEIALNPNLTQNPGWE

SEQ ID NO: 10054 - protein, 467 aa, B.fragilis
QKTIIFARPVFYHSHFNLSDMSKILIIDDEVQIRGLLARMMELEGYEVCQAGDCKTALRQLELQMPDVALCDVFLPDGNGVDLVTEMKKKSPGVEIILLTAHGNIPDGVQAIKNGAFDYITKGDDNNKIIPLISRAVEKARMNIRLDKLEKKMGLMYSFDSILGESKALKEAVSLARKVSVTDVPVLLTGETGTGKEVFAQSIHYSSKRARQNFVAVNCSSFSKELLESEMFGHKAGSFTGALKDKKGLFEEANNGTIFLDEIGEMAFELQAKLLRILETGEYIKIGDTKPTHIDVRIIAATNRNLPAEIAAGRFREDLFYRLSVFQVHLPPLRERTGDIKILAESFVRSFSEKLSHPVNRIAPAYLEALCQQPWKGNIRELRNVIERSLIVCEGDRLDVDDLPLEIQNSHYEKSDEGMPGSFELSAMERRHIARVLEYTKGNKTEAARLLKIGLTTLYRKIEEYKL

SEQ ID NO: 10055 - protein, 415 aa, B.fragilis
KILITKTRYKSMEPIRLNTIEEAIADFKEGNFVIVVDDEDRENEGDFIIAAEKITPEKVNFMLTHGRGVLCAPITEERCAELELDMQVSSNTSIYETPFTVTVDLLEGCTTGVSMHDRAMTIRALADPKTKPADLGRPGHINPLRARSRGVLRRAGHTEASVDLAKLAGLYPAAALIEIINEDGTMARLPQLVEVARRFGLKIISIKDLIAYRLQMESIVDRGVEVDMPTQFGHFRLIPFRQKSNGMEHIALIKGTWDTDEPILVRVHSSCMTGDIFGSCRCECGEQLHKAMEMIEAAGKGVIVYMNQEGRGIGLMNKIAAYKLQEEGYDTVDANLHLGFDADERDYGVGAQILREIGVKKMKLMTNNPVKRIGLEAYGLEITENVGIEIKPNPYNERYLKTKKDRMGHTLHFNK

SEQ ID NO: 10056 - protein, 960 aa, B.fragilis
TIKIINLILYEMKTRTRTKMLLLLGVLLFGFTVSAWSQKVSLDFNNEKVEKILSSIKAQQGMGLVFSDQLIDVNRKISIQVKDASLDEALSKLLAGTKVTFEIKINKIYFIEKKADQQSGCRKKKVSGVVKDATGEPIIGANVVEKGVGTNGVITNLDGEFTLEVPENASLIISYIGYLQQDVSTKGKDAFNIIMKEDTKTLDEVVVVGYGVQKKVNLTGAVAAVDSKSLQNRPVTNVSNAIQGLLPGVTVISGTGQPGNDNTTIRVRGVGTLNNSNPMYVVDGLPVSSINEVDPSDIENISVLKDASSAAIYGSRAANGVILITTKKGGDKAPTLRYDGYVGWQKPTALPEYLHSWEYAKLYNKAMVNEGKNPIYTDEEIEKFRNGSDPDNYPDTDWQGLFYKTGLQHSHRAEISGGTDKMTYMFSAGYLGQDGIIDIAKYDRYSVRGNMNAKMGKFTAGMNLSFTYGEAQEPVSGFTGEMSNIFSQINQIAPFIPYKYSNGYYGYANDGNPLAFIEEGNLRTTKQHITRAIGNVSYEPIKGLKIQEIVGYEYKSISDEKFIKDIQYYNWKTGEPTKYQGPNNQTDERKNGLKLNLQTLVSYNNTFGKHTVGALAGYEQEYYREDWTKGYRKNFLNNDLWELNAGSPDGQTADGSANEYALRSFFGRLTYDYDNRYLVEANIRRDGTSRIFKDSRWGVFPSFSGAWRIINEPFMEGTRNVLSDLKLRGGWGVLGNQAISYYSYQSVLDQANYSFGGTVVQGVAPVDGANRDLIWETTETLNFGLDMGFLGNQYTLSIEGYRKLTYDILMKLPVSTLYGLNAPYQNAGKVKNTGLEITAGYKLNTHGWNFQVSANAAYNKNEVMDLKNGGARIWSGKYFNQEGYAINSIGGYIAEGLFKTEEEVANSATIPGTDTAPGDIKYRDINNDGKIDGEDRVYIGNTMPKWTFGLNLFAECLHHG

SEQ ID NO: 10057 - protein, 611 aa, B.fragilis
RYPMIKQRKIELLAPAKNLECGIAAIDHGADAVYIGAPKFGARAAAVNSLEDIAALVEYAHLYNARIYVTVNTILKDEELQETEKMIWALFRAGVDALIVQDMGITGLNLPPIPLHASTQMDNRTVEKVRFLADAGFRQVVLARELSLREISKIHEACPDVPLEIFVHGALCVSYSGQCYVSQACFGRSANRGECAQFCRLPFSLVDAEGRVIVKDKHLLSLKDLNQSDELEALLDAGASSFKIEGRLKDVSYVKNVTAAYRRKLDAIFARRKEYARASSGSCRYAFNPQLDKSFSRGFTHYYLHGRTKDVFSFDTPKSLGEEMGTMKEARGNYLTVAGLKSFNNGDGMCYIDEQGRLQGFRINRVEGNKLYPQEMPRIKPRTVLYRNFDQEFEKILARKSSERRIAVSVRLTDTPFGFALTLTDEDDNSVTLSLAREKEPARTPQEENLKTQLAKFGNTPFEAVRIDIDFAGNWFLPASVLADFSRQAVEKLISARRINYRRELFVLKPTAHAFPQSTLTYLGNVMNAQAVSFYTGHGVASIAPAFERAPAEKAVLMFCKHCLRYSMGWCPVHQRERSPYREPYYLVSTDGKRFRLEFDCKNCQMKVNAV

SEQ ID NO: 10058 - protein, 707 aa, B.fragilis
EVQIVSTRATSKTPVAFTNVSKEELKKQNFGQDIPFLLSMTPSALTTSDAGAGIGYTTLRVRGTDGTRINITANGIPMNDAESHTLFWVNMPDFASSVKDIQVQRGAGTSTNGAGAFGASVNMQTEGISMQPYAEINASYDSFNAHKETVKFGTGLLKDHWAFDARLSTIGTDGYIDRASVDLYSFYAQGGYFADNTSVKFITFGGKEKTYHAWNYATKEEMKKYGPRFNSCGMYTDDHGHIRFYKDQTDNYLQMNYQLLLNHTFSAAWNLNAALHYTKGDGYYQEYKEDRSLKEYRLHPFMYDGKEVEKSDLIRQKKMDNHFGGGVFSVNYPHQNMDASLVNALNYYDGWHFGRVIWVKNYIGELLPDHEYYRNKAKKTDGNLYLKANYNLVAGLNAYADLQYRYINYKIHGDNDKYDYNTDGLQKLAVNDHFNFFNPKAGLNWDIDSNNRVYASFSVAQKEPTRNNYTDGNADEYPKAEKLYDYELGYTYRNTWLSAGVNFYYMDYKDQLVLTGELNEIGEAMARNVPDSYRTGVELMLGVKPCRWFQWDINGTLSKNRVKNFTEKLYEDEWKNPIEVEHGNTPIAFSPDFILNNRFSFSHKGFEAALQSQYVSKQYMSNAKQAEQTLDAYFVSNLNLAYTFQLRHVKSVTVGFTIYNLFNEKYENNGYAGSGYTLKDGKPERYNYAGYAAQAGTNVMGNISIRF

SEQ ID NO: 10059 - protein, 120 aa, B.fragilis
KVKMKNVINKNTILALMVIGMMCFWGSMNANAQQFNVQGDLVSSYVWRGMYQTGASIQPTLGFSVGNFSLTAWGSTDFDGTSASAGAAAKEIDLTAAYTISRSGLTGLVADLGWGRTGST

SEQ ID NO: 10060 - protein, 81 aa, B.fragilis
LVKIVLLAELVLTSVRLALSLKVIFTQLILSSVQIVVLAQMYVLLKQFTQLNNTIPNNKDKGCLPNGKQPLFISFQTFGKL

SEQ ID NO: 10061 - protein, 124 aa, B.fragilis
NMEINELTGLILKKAYEVHTVLGPGLLESAYEECLCYELIQCGLNVEKQKALPVVYKNIKVDAGYRLDIVVNNAVIIEIKAVEELHPVHTAQLITYLKLSGIKYGLLINFNVRSLKEGIRRYIV

SEQ ID NO: 10062 - protein, 111 aa, B.fragilis
LCLVIRKKYLSWHTQSIMNEAMKKEKIHLEYLLNATSKNILWSAISTPTGLEDWFADKVVSDDKTVTFCWGKTEQRQAGIVAIRAYSFIRFHWLDDENERDYFEIKMSYNP

SEQ ID NO: 10063 - protein, 65 aa, B.fragilis
LTTVGNIRTKRSTDSGNQCNGPENTGAWKPVTAETTMLEKAAPAKVYFNTVNIPTDFSIRLLATR

SEQ ID NO: 10064 - protein, 212 aa, B.fragilis
SRTVMKTMKYISLRVLAIAALALAFAMPAKAQLSDNGYANVDWQFNAPLKNHFADKASGWGMNFEGGYFVTPNLGLGLFMNYSSNHEYFPRATFPVGEGTVNTDQQHTIFQLPFGAAARYQMNRGGAWQPYFGVKLGANYAKVRSNYNMFETRDNTWGFYVSPEIGLNVYPWAYGPGLHIAVYYSYATNKANVLTYNVDKLNNFGFRVGLAF

SEQ ID NO: 10065 - protein, 72 aa, B.fragilis
RKYVGVPAINTVVETVDTSFGIRDNVLTVGLLTNKSGMWYECWGGTLRWFKTKRSLPREVRGIGFKPTPLTF

SEQ ID NO: 10066 - protein, 60 aa, B.fragilis; identical to SEQ ID NO: 7905

SEQ ID NO: 10067 - protein, 91 aa, B.fragilis
SHAALSLQQAFVESQATESLLQQVAADSAASTATEVESAAASELAVLLPPHETIAKENATIAAAKKNFVFILKIFALNVYKYSIANINKNK

SEQ ID NO: 10068 - protein, 337 aa, B.fragilis
IMKALVTGAAGFIGSYTVKALVAQGCEVVGLDNINSYYDVQLKYDRLADTGITKESIEKDILLPSAKYPSYRFIKMDLTDREGLTNLFKDEHFDIVVNLAAQAGVRYSIENPYAYIESNIVGFLNLLECCRHYPVNHLVYASSSSIYGLNDKVPYAETDKADSPVSLYAATKKSNELMAHAYSKLYSIPTTGVRFFTVYGPWGRPDMAPCLFMKAILNGDPIKVFNNGQMRRDFTYIDDIIAGLMKIIAHPSADPIPFYIYNIGNSAPVELMDFISVIEKTAGKTAIKQMMGMQPGDVVCTYADTGRLEKDFGYKPSTSIEEGIQKFYDWYVGYFNK

SEQ ID NO: 10069 - protein, 474 aa, B.fragilis
FVNHKIINKKMNTLFDKIWDAHVVTTVEDGPTQLYIDRLYCHEVTSPQAFAGLRARGIKVFRPEKVYCMPDHNTPTHDQDKPIEDPVSKTQVDTLTKNAADFGLTHYGMMDKRNGIIHVVGPERGLTLPGMTIVCGDSHTSTHGAMGAVAFGIGTSEVEMVLASQCILQSRPKTMRITVDGKLGKGVTAKDIALYMMSKMTTSGATGYFVEYAGEAIRSLTMEGRLTLCNLSIEMGARGGMIAPDEVTFEYIKGRENAPQGEEWDQAVQYWKTLKSEDDAVFDKEVHFDAADIEPMITYGTNPGMGMGITQHIPTTDGMNETTKASFLKSLDYMGFQPGEALLGKKIDYVFLGACTNGRIEDFRAFASIVKGHQKAEHVIAWLVPGSWMVDAQIREEGLDKILEDAGFAIRQPGCSSCLAMNDDKIPAGKYSVSTSNRNFEGRQGPGARTLLASPLVAAAAAITGVIADPRELM

SEQ ID NO: 10070 - protein, 201 aa, B.fragilis
IVNKKMKAKFNILTSTCVPLPLENVDTDQIIPARFLKATTKEGFGENLFRDWRYDKQGNKIDSFVLNDPTYGGQILVAGKNFGSGSSREHAAWAIADYGFRVVVSSFFADIHKNNELNNFVLPVVVTEEFLAELFDSIFKNPKMEVEVNLPEQTITNKATGKSEHFEINAYKKHCLMNGLDDIDFLLTNKDKIEQWEKASK

SEQ ID NO: 10071 - protein, 357 aa, B.fragilis
LLNNMDFKIAVLAGDGIGPEISVQGVEVMSAVCEKFGHKVNYEYAICGADAIDKVGDPFPEETYRVCKNADAVLFSAVGDPKFDNDPTAKVRPEQGLLAMRKKLGLFANIRPVQTFKCLVHKSPLRAELVEGADFLCIRELTGGMYFGEKYQDNDKAYDTNMYTRPEIERILKVGFEYAMKRRKHLTVVDKANVLASSRLWRQIAQEMAPQYPEVTTDYMFVDNAAMKMIQEPKFFDVMVTENTFGDILTDEGSVISGSMGLLPSASTGESTPVFEPIHGSWPQAKGLNIANPLAQILSVAMLFEYFDCKAEGALIRKAVDASLDANVRTPEIQVEGGEKFGTKEVGAWIVDYIRKA

SEQ ID NO: 10072 - protein, 528 aa, B.fragilis
LDVKAPSNQLPMKSKFLPFLLLLAVLPVLIFRDYTPSNELRYLSIVDEALRNGDIFTFTNHGIQYADKPPLYFWILMLGKWLLGNHAMWFASLFSFIPALVIMLVMDRWVEREVSVANRLSAQLMLMSCGLFLGLAVVLRMDMLMCMFIVLALRTFYQMLKGQGSKNWNQFLFPFYIFMAVFSKGPVGILVPLGSTFIFLLITGRVKTFGRYWGWKTFAVLLLGCFIWFGGVCWEEGGLTYLHDLLFRQTVGRAVNAFDHSAPFYYYFISVWYSLAPWALFLVGIIIAGACRRLIRSDMERFFMVIILTTLLMLSCFSGKLAVYLAPTFPFFVYLAVLLLSHFRWNQWLALTLLLPAVVFVAGLPALIVLGRMPGTEFLGQKLFYVAGGILTVSGGTALYFLYRKKSLNKTINVLALGLFCAVFVGGWDVPAINGELGYSELCRKAVELSKEKNVSGYCVLNVRRSENMDVYLHERVKEVTEEEVLDNKYQNTILMISNKKIRSNKKLEEFVNGKEHYVIGRFSVMVL

SEQ ID NO: 10073 - protein, 63 aa, B.fragilis; identical to SEQ ID NO: 7704

SEQ ID NO: 10074 - protein, 1032 aa, B.fragilis
CMTKRTNLFPSLIKTREMNCLKIAGASLLLLCISPQFAVADGLKQDAVTIMQQQNLKVSGVVTDEAGEPLIGVSVLVKGTTLGNITDLNGRFSLDVPEGSILEISYIGYKTQSIKAQREPMNIVLKEDAQKLDEVVVVGFGTQKKVNLTGSVSAVTGDDISKRPVANAAILLQGQIPGLRVNQGLGQPGGEGTSFRIRGQGTFSSAGSDPLILINGVPGSMTNLDPSVIESVSVLKDAASAAIYGARAANGVILVTTKQGAVGDKVHISYHGNVGLHTPTKLYDRVTNSVEYMELANLAWKNSGTGKQYTQDQINLYRNNVGDPQYPNFDWQDYMFRTAVVQTHNLSMAGSTEKTTYNVALNFVDQPGTMRGFKYRKYNATIDLTARITNFIKVGTYANLMYGETEQPRQGQNDAFLSTLSQAPTYMPWLPDDGTGIRRWTSSAYSFESHNKNMPAIIGDDAMKRDNNFDINAQLWLEINLAKGLTWYTKGAARLQSNKSKDWRGSTTYTYDYHTGERSSELDKGGLGLSVGDGRRFYTNLYSYLKYDLSLVDNAHNFSLMVGYNQESEKYETLNAYRKDFAFDLPVLNAGGTADWSNSGGEEEWAIQSLFGRFNYDFKERYLFEANMRYDGTSRISDENRWGVFPSFSVAWRATEEEFIKNLNLNWLNNFKLRGSWGQLGNQNIGLYPYQAMISGVDDYPFTKTSDGVIIGYQQTAYANRNIKWETTTITDIGFDLQVFDGLSVTFDWYKKTTDDILRSSQVSSLLGLSAPTVNNGSVENKGIEVALNYANMVKGGTFRGFRYNAGVYFDRSRNKLTEFGAEEIGSYSIKREGLPYDEYYMLECIGVFADQAEINASPKQFNDNTQPGDLKYKDISGPDGKPDGVIDNYDRRTFSGRFPGFEYGINASATWKGFDLSLIGQGVADKKYYTTDWGVQPFMQGSSPNKDYIKHMWTEENPYGAKHPKLYWQDMGGGKNTRPNSYYLKDASFFRLKNVTLGYTLPRVWTEKANISKVRIYFSGDNLLTLVFTTG

SEQ ID NO: 10075 - protein, 60 aa, B.fragilis; identical to SEQ ID NO: 7968

SEQ ID NO: 10076 - protein, 88 aa, B.fragilis; identical to SEQ ID NO: 7984

SEQ ID NO: 10077 - protein, 500 aa, B.fragilis
KNMSDRLFIFDTTLRDGEQVPGCQLNTVEKIQVAKALEVLGVDVIEAGFPISSPGDFNSVIEISKAVTWPTICALTRAVQKDIDVAVDALKFAKHKRIHTGIGTSDSHIKYKFNSTREEIIERAVAAVKYARRFVDDVEFYAEDAGRTDNEYLARVIEAVIKAGATVVNIPDTTGYCLPSEYGAKIKYLVDHVAGIENAIISTHCHNDLGMATANTMAGILNGARQVEVTINGIGERAGNTALEEIAMIIKSHHEIDIETNINTQKIYPTSRMVSSLMNMPVQANKAIVGRNAFAHSSGIHQDGVLKNVQTYEIIDPHDVGIDDNSIVLTARSGRAALKNRLSILGVTLDQEKLDKVYEEFLKLADRKKDIHDDDILVLAGADRSGNHRIKLEYLQVTSGVGVRSVASLGLNIAGEKFEAAASGNGPVDAAIKALKRIIDRHMTLKEFTIQAISKGSDDVGKVHMQVEYDNQMYYGFGANTDIIAASVEAYIDCINKFTK

SEQ ID NO: 10078 - protein, 512 aa, B.fragilis
NRTMGKGVKIEIMDTTLRDGEQTSGVSFVPHEKLMIARLLLEELKVDRVEVASARVSDGEFDAVKMICDWAARRNLLQKVEVLGFVDGHTSLDWIHATGCRVINLLCKGSLKHCTCQLKKTPEKHIEDILAVVDYANELDIEVNVYLEDWSNGMKDSPEYVFRIVDALKETTIKRFMLPDTLGILNPLQVIEFMRKMKKRYPDTHFDFHAHNDYDLAVSNVLAAVLSGVKGLHTTINGLGERAGNAPLASVQAILKDHFNAITNIDESRLNDVSRVVESYSGIVIPANKPIVGENVFTQVAGVHADGDNKSNLYCNDLLPERFGRVREYALGKTSGKANIRKNLESLGLELDEESMKKVTERIIELGDKKELVTQEDLPYIISDVLKHDGMSNKVKLKSYFVTLAHGLKPMATLSIEIDGQVYEESSSGDGQYDAFVRALRKIYKVTLGRKFPMLINYAVSIPPGGRTDAFVQTVITWSFGEKVFRTRGLDADQTEAAIKATIKMLNIIEEY

SEQ ID NO: 10079 - protein, 95 aa, B.fragilis; identical to SEQ ID NO: 8022

SEQ ID NO: 10080 - protein, 218 aa, B.fragilis
RKFVKGSGFIYVIGFLAQAFFSARIIFQWILSERAKKVVSPSIFWILSIAGSYLLCIYGWLRDDFSIIFGQFISYYIYLWNLNEKGIWNKLHGALKTLLVITPVIAAAFMLHDAQHFIDSFFRNEEVPLWLLIFGSMGQIIFTLRFVYQWAYSFHHKESLLPAGFWIISLVGSSVIVAYGVFRLDPVLILGQSVGFVAYFRNLMIGRKSSKQSVAYEK

SEQ ID NO: 10081 - protein, 269 aa, B.fragilis
IWIVVSIILFYFIFFVLLRDIYNEAMNKTINYQLTIVVPVYNEEDNIYSLEQKLGEFLPKSICTACVLFVNDGSRDNSKQRIMEVCARNKDFFYMDLAKNSGLSAAMKAGIDYTESVYVGYMDADLQTTPEDFNLLLKDIADYQLVMGIRANRKDSFFKNLQSKIANGFRRMMTNDGVQDTGCPLKVLHTAYAKRIPFFTGMHRFLPALILLQDAKIKQIPVRHFPRVAGTSKYHLWNRLVSPFLDCFAYRWMKKRYINYRIGDNNLIA

SEQ ID NO: 10082 - protein, 86 aa, B.fragilis
LISLKTLRFIKKKIRILHFIKSYSYLCRITSAKDLIDVNYLLALKAPKCTFYAADIVLKELNQLTTHKRPPFCTTYFILIDVQCLI

SEQ ID NO: 10083 - protein, 154 aa, B.fragilis
IRFSFVSFVFKILIKHYGCPSAGRHAYVRPRTRPASPPRCPIPSRTAAPHGLPAPPFRPHCPTPVPGAPFSGHRRSTPWRSQGCRPGNKPLIPLPPPVPGSPPAWVHSPFPPRPPPARCRSSPPRRPPLRVRPRLRLPLPPRPPLRRAGRCFLP

SEQ ID NO: 10084 - protein, 142 aa, B.fragilis
QPSSNWKAMKKQRNEKPIDEELLMRMMAGEAAGTGEPGTGKGETAVPVEKAQEGKAADTRRRKGRQADYETTFFKGMDIPARYGKPVYVRREYHERIAKISVMLTGGKVSLSAYIDNVLAQHFEQYREEIEAAYAGKLENLF

SEQ ID NO: 10085 - protein, 169 aa, B.fragilis
ISRPSSAPSGGTASTRCNSCPPVAARHGDGHGSSRDSSGTPSGTLPATVPSTESSRMTSSYVRRISATAPAFAGGRAAGTGTCRPPPPENPPSSRRTPPVGLPKPPRKDRLCPRRTSPVWLPCRPLRTGYGAAMPDARNRVPHSLPAHGGTSPGFSCPPAHVPATIRTP

SEQ ID NO: 10086 - protein, 128 aa, B.fragilis
ALLPLAPLAPSFPSFPSLPSLPKAGLPVSVPFIYQLPLSPMATSGDFPSCPTAFFPVSVPSTNQLPLSPMVTVGGTASFPSFPSLPSLPKAGLPVSVPLIYQLPLSPMVTVGGIASRPFVPSLPSLPS

SEQ ID NO: 10087 - protein, 687 aa, B.fragilis
NFAFLCVLCRFFGKKYSARLNSEYDLLNGRLKVGENLELNYMNYREANHTQLAANEPPIIPVYTETGGWGGASLDVGMDDYRNPVKDLILGKDNVNKFLKVIGNTYADLMIIKGLNLRTSFGVDYRGSYYRAVDKKWSEADGSGRDEKFNYVRNDQTHFLEYQWTNQINYNGQFGKHSIGAVVGMEFTKAESEAFYARKDGLTLEDRDYAFLSSATGDKITEATGSGDAYALLSYFGKFNYSYASKYLASATLRYDGSSKFGADNRWAVFPAFSLGWRIKNEPFLENVDFLSDLKLRFSWGRNGNSAIPSGYLQSSYVADYNGTSYAMNGQESGSLQSGFRKYLTGNSTLKWETVTQTNYGIDFGFFNQSLVGTIDYFYKKTTDMLYLPPYIGAFGEGGDTYVNGPSMENRGVEILLTYRNSLPSGFNYSITGNIATFKNKITELPDNVRSVYGGNGMLDDIIGRPRNSIYGYVADGIFKTQEEVDNSPQQAGKGLGRIRYKDLDGDGRITQDYDRTWIGVSDPDFTYGLNLQASYKNVDLALFFQGVHGGDVWDSWIEYSDFWNIQNVNNTNHLKGVFNAWSPQNPDSNIPALSTRNTNDEKRTSTYFLKDGSYLKLRTIELGYTFPESMVKKAMISRLRAYVSANNVFTIKKWWDSNRFSGPDPEIRDFGYVIPFTATVGVNITF

SEQ ID NO: 10088 - protein, 332 aa, B.fragilis
CFTPNNNRSTDYKTIKKKGQMKKIFGWVALLMGMVTGANAQVNDTIQRVTGNDLYQGITRKLPYRQMVTPHGVQVTFAKTVHIIFPSAVRYVDLGSNWIIAGKADGAENVIRVKATTEGFPGETNFSVICEDGSFYSFNARYAHEPEMLNIEMKDFLENGNTTDFSHTRMNLHFRELAGESPLLVKLIMQSIYKEDRREIRHLGCKRFGVQFLLKSVHSHNGLFYFHTETRNRSNVAFRTDFIRFKVVDKKVPKRTAIQERVIDPVRSYNEVLVTEGKSDVRTVYAVPQFTIPDDKLLVIELFEKDGGRHQTIRVENADLVAAKQINELKIK

SEQ ID NO: 10089 - protein, 121 aa, B.fragilis
HPQPCHEQADIPDGKGGDIQHGVCRKRQRKGEQPPVAEKEQQAGHAAKDDPAPRDFLLLHALCAEAAKGEEQHGEELRPEDIGEQPGGTLEAEQYPIDHADVDAPFPDGLVTEPINIDDYK

SEQ ID NO: 10090 - protein, 431 aa, B.fragilis
HIGTLFILRLRQSLDGKLQIPAQLFRQCEHLRLLALFGGIGQVLGSRYLRGIHRRLHPVQTDPHLLVLPSGMVGEVDGEYLRLLLVRQTEHRLDAVELVHVLLLVEQDFAVRVGDDSLLHDGGRDDVVHLLRDDNRLAEIFPDGLVHVFQILTHTRRGKGFPSLLADQHLPHPFQAAQLVDEGFHDDDRNHGEQLGIIFYTVNFKYDKPLVQQVDVLVRVQQEVIASALVILPECGQEVVDVEVLPAHLDVPCSQLLPVIVQHVLVEGVERGDDVPVLLYPADVRRHRTAQLAALRLRDFLVLALPQRQQQRLDAVLLLHAELVVVREEGVEADGLLLRVRVVNPVLALGLAVYQLAQPLVRVARVDQHDVAVLLVILAHEVVHEERLAASARTEDKLVAVRDHPFLHRQVADVQMQRSARHPVRHLDAEG

SEQ ID NO: 10091 - protein, 325 aa, B.fragilis
VMATTNSTIEKIAPMFTELLIKKIECLKTDWQKPWITSLEQGLPRNIRGTLYNGGNVLMLLFYTEFMKFTLPVFLTFNQAKEEDLSVSKGARSFPVYYWFKFVVHKETKKTIKYEEYRKLPATEQENYKVIPQMKYYNVFNIDQTDFAGKYPERYERMKKGEQPEDYSDRMIYEALDELVYLQNWYCPIKVQYSDSAYYSPSSDHIVCPQREQFPQGAEFYGTLLHEMAHSTGSPQRLNRTFGCFFGDALYAREELVAELTAALCGAFFGYATAPQENNAAYLKHWLTKLREEPAFLVEILGDVNKAAKMIADKVTEPVNEPAAA

SEQ ID NO: 10092 - protein, 119 aa, B.fragilis
PGRTLRGGGGYPPGGDEWRNGGLPAAAGRQVYQHPARAPANTGAGAGGGGNVGDVRRRAWRSAEKPAHARCVCQVRRPQSGVADDDPVGGTLAGGLPNGEDAVPGHSEESPGVRAGERA

SEQ ID NO: 10093 - protein, 220 aa, B.fragilis
RHKTMKTLSEKEFNGFNVNAMFTERAERAKKELSPLMQEIRKYIPQAEYGYHVESGEYPAFYGVRIEFTYNGIRFHVCKIYKENKYRIAADMEHFEYVNRYDIERAGNQYEKPCNIGVFTAKKINDWINYYTQIYRQVEQENVENSKKVADFLKSIENEPVRWEGNNHSKGTIIRNGLRFTFYIEEGHLYFELSLSYRGTADYDTFRLIADNRYIPKGNY

SEQ ID NO: 10094 - protein, 589 aa, B.fragilis
YNLLNRNSMKTFYSLFLSSALLLSLLVTSCADQLNINPKGVLADDLLLGKPEHIDDFVTPCYSLIPYLPWSEAHAWWMHGSIRSDDAYKGGSGVSDQSAWHDMEVFSSVTANVGNNDGPWFKGYVAISRYNLALYALSKVTDENYPLKGVRTGEVKFLRGATYFFMKTLWRYIPWVDEENGRTVEDVTNISNRPNGTDDTYLWEHIVADLEEAVRLLPEKQEEIGRINKNAARAMAAKALLFMAYKQDARHQVVEVDKKILERALVYINEITDQEGGNVGLCEDFAENFLPEYDNATKEAIWEIQYSINDGTSSGGNTNNGAELNAPSWEPYFPCCDFHKMSFNMANAFRTGTDGLPLFDTFNDAEMKGRFKEYFDENSFDPRLSHTAAIPGYPYKYNPDLLYEEKASRSPGDYGYLKSVKELVPAGCDCIIVNRNSMNVKQIRYAEVLLWKAEILIQLDRHKEARPIINKLRERANNSRIRLLMADGTPYMNYKVSLYTDEAAWTKDYAWKALMFENRLETACEGRRFFDLQRWGILEPTMNAYFKKEKTRFSWMNNAVFVAGRDEYKPIPQQQMNWAKGNYIQNPGY

SEQ ID NO: 10095 - protein, 269 aa, B.fragilis
LIKYALMFLYFCIHIQKRNYMRLGLLTAFILLLSFTTSCQYKEAQPHPAFKDSIVLVTPVEPQPIASKSQTAFYLDSIGLMNIAELDSTFIIRLMYATPDNFTGQLLYTDLKEAYLHPDAAKALLEAHLLLKAQYPSYRLIIYDAARPMSVQKKMWDVVKGTSKYMYVSNPSRGGGLHNYGLAVDISIADSLGHPLPMGTEVDYMDAASHITNEAKLVREGKITQQERENRILLRQVMKSAGFRALPSEWWHFNLCSRDEAKQKYKLIN

SEQ ID NO: 10096 - protein, 60 aa, B.fragilis
RAGYSDEIPVHGGDDARPEGAESERDGGDTVRAETGRTLGGRPVHDPLVPLRRGRHAQTG

SEQ ID NO: 10097 - protein, 400 aa, B.fragilis
DMYLSPETILFIREHRNDDVHSLALQAKRYPQVDMPLAIVQIAGWQATVSKIPSWHATEGLLYPRHLSLEQCSSEVTALYKASLVHGEGLVDLTGGFGIDCAFLATQFKTVTYIERQEELCELAMHNFPLLGLKHIRVQNGDGVEYLQQMPAVDCIFLDPARRNEHGGKTVAISDCEPNVATLEKLLLEKGKQVMIKLSPMLDLSLAIRDMQHVSEAHIVSVNNECKELLLLLRPGDDSPEIPSAMSQPIVCINFANQEIQRFVFTRESEQATECSYTHEIGTYLYEPNASILKAGAFRSIASSFHLSKLHANSHLYTSNERIEKFPGRIFRITGYSGLNKKELKNILNGLDKANITTRNFPQSVAELRKRLKLTDGGDIYLFATTLNDERKIIIRCEKA

SEQ ID NO: 10098 - protein, 736 aa, B.fragilis
EALQRTPVPLAHLLPVPDKDHEGAEPSGKHVLHPLQGQACPQGDRGPGDGYEVPRSRRAVREDHERQRFCYAAPPHDGRDHWDGSGGGHRGEVPLALAARHDGAEGHPVEPGGDAHRRRHPLPAHPLGHGRPAGQGGDGQPLRAALDRPLGLPAVVPPAPVGLLLDCNHCYNQYIFIDDHGENLKRFEQTARNMHSLSRYSRSNQINKAWIEEYLNEAHSKGLTSVRCHCNVMAWSDDREELRRIKNEVGSQLALMECKPRHNTVDVPTLFWAAIPGNEGDFPFEESFYTFIPQALCFFTEETNYKDSLSPFGIKMADRMTGRPLHLDISDLPMKKGVISNRNKFVLGPSGSGKSFFMNHLVRQYYEQNSHIVLIDTGNSYQGLCELIHRKTKGEDGIYYTYTEEKPISFNPFFTDDYKFSVEKKDSIKTLLLALWKGEDEKITKTESGELGSAVSAYIRRIQQNRDIVPSFDTFYEYMLNDYRKELAARDIKVSRKDFNIDNFLTTLRQYYKGGRYDFLLNSNENIDLLHKRFIVFEIDSIKDNAELFPVVTIIIMEAFINKLRRLKGVRKMLICEEAWKALSSPSMSEYLKYMYKTVRKYFGEAIVVTQEVDDIISSPIVKEAIITNSDCKILLDQKKYMNKFDGIQSMLGLTDKEKSQILSINLANHPGRKYKEVWIGLNGVQSAVYATEVSAAEYLTYTTEESEKTEVFALPKKLGGDLELAIKRLAETKYK

SEQ ID NO: 10099 - protein, 776 aa, B.fragilis
FIPHFIYLKLNNYMNLFKSSVLCGMVIVSFMTSCTDVDITMPKGPKGDTGLSAYEFWKEKVADGTVNWPKDQTEVADFFKFLKGKDGKDGKDGQSAFEQWKDMIASGSVDDPHNPGEKWPSENNTVQDFWRFLTGASGEDGQTPHIGDNGNWFIGKEDTGIGARGRDGQDGKDGKDGTNGRDAIPPTVTIGDNGNWYINGTDTGKPAFGKDGKDGKDGKDAVPPTVTIGDNGNWFVDGTDTGKKAVGQDGKSPEVAIGDNGNWYINGTDTGKPAFGKDGKDGKDGKDGANGANGKSAYELWKEYISSGDVDNPHNPDQKWPADRNKQTDFWDFLTGKSSVIEIEVGKYNVIPEYWNSSLKEYVVPSDGSVLFTVYDKTGKKVTAGVKVSDLPGVSSTDAFITNEEGQFKVTWDKLPDNKGLSERKGSVTVTVDGTQETSAGNTLVPNRINVRAIITSAYLSNYSNTSIDIYRTLNVYYSFERQVDGEWDKYPTSITTPYNSMKSARVKDINRPVNEGNVDKDQLVRYSNGNSYLYIIRPLVLTETEKANVAKNDTVGKLAKYEWDQTDNYAALYFGDGTGSYNDYGQTVYLQDKIHVPEVYPAPSFKENSVFIEIKQGITTMWGEIDTDNLQNFYKTYAYPTGQDKFTKEEGTNVWKHPEGKLPASELEENRAVFIEMRTFINGTGGTVHTGSKPLSTGGKRFKLTSTYPNNWIGLDIRRRTESTDKITYNISNEYRGRYAYYLLKEEDKYYLVDFADWSKRMPLPIKDCPVDWMN

SEQ ID NO: 10100 - protein, 177 aa, B.fragilis
RYGQTDIERGFRHTERRQRQDGYHGVGGGLPALPLGVSAGGDRLRLPAVQPVRDAGTGQPGGTGERIPETGGLRTDAAAGACRLSGAQVPGGASPRHGKGAGGGRLLRPALLRPAGHGELGGHPAHDRTDGLHLRPGECGQGGIGEHALLPRRAATDDAGQRDEPPEGALPFLEPSR

SEQ ID NO: 10101 - protein, 882 aa, B.fragilis
PIRQLTGRATRSASPSSPPCSARRRASLPSKGGCTTLPHGKRPTRRSPPPPPERLQPPCRPQGMTGRSSSGNSCGRESAWYSVRMKPGASMGRPSSTMPPKPSSTAPVWARSFPQACSTTFSPGRKAFTCRNPPPEWNIPPGSRSIRAHPNGTDIPAIVLTTRTALPKTWRPPSTSLPSYPAERPVTSPYRRSAKRKRGASTAGNNNQLKIQRIMQNEDDLRGLAKVMEFMRAISILFVVINIYWFCYQSVREWGIDIGVVDRILLGFQRTAGLFSNILWTKLFAVLFLALSCLGTKGVKEQKITWRRIILCGVSGLLLFFGNWWLLALPLSLPADTVLYIATLTVGYICLLMAGLWMSRLLKTDLLEDVFNVENESFMQETKLKENEYSVNLRTRFRFRGRAYDGWINLVNPFRATMVLGTPGSGKSYAIINQYIKQIIEKGYSLFLYDFKYPDLAEIAYNHLLAHLDGYKVKPKFYVINFDNPRESHRCNPIHPDFMTDISDAYESAYTIMLNLNRTWISKQGDFFVESPIILLASIIWYLKIYKNGKYCTFPHAIEFLNRKYADIFPILTSYPELENYLSPFMDAWESSAVEQLQGQIASAKIPLSRMISPALYWVMTADDFTLDINNPEEPKVLVVGNNPDRQGIYGAALGLYNSRIVKLINKKKRLKSSVIIDELPTIYIRGLDNLIATARSNKVAVMLGFQDFSQLKRDYGDKESAVICNTVGNVFAGQVVAETAKTLSERFGKVLQKRQNMTINRNETSVSINTQMDSLIPASKISNLTQGMFVGAVADNFDERIEQKIFHAEIVVDNEKVRRETARYVKIPQIIDFTDKDGNDTMQQQIDANYYRIKSEVKQIVADEIERIKADPKLSHLIKNG

SEQ ID NO: 10102 - protein, 77 aa, B.fragilis
QCVKSSNRKRGNKRRKRVEDEDDRETREYFLGKGISAGPKGIVAIKASMGAGNFKKQGWEWKQEEFTVKDQRTLLKN

SEQ ID NO: 10103 - protein, 100 aa, B.fragilis
PIFLTAASRRSLDRVSVPMWGTFLSEPLSIEGLVGRYLTNNLMERIPILYRNPLIMKPCGIIMPSGINLSFERLSPSKGQVGYVLLTRAPVASKESKLSS

SEQ ID NO: 10104 - protein, 186 aa, B.fragilis
KNINMETRTLAENGTPVTKEKTVAFSGHRTNRIAKFTADREKLFREVAFDTFVAIESYCIKKGYHTFLSGMCEGFDLIAAEEVLNLKKEYPHIHLKCVLPFKGQAERYTQADKRRYDTILAQADEVVTLQDGYTEGCFLRRNDYLLENSAFLMVYYDSVAVGGTFYILKRAVEQKKKFANVCYNRR

SEQ ID NO: 10105 - protein, 131 aa, B.fragilis
NFVKLKKNGIKMRRLNLILLLSAVTVALAFVISCKETNAERLEKMCGEWVSTGGKPPFTLWEEDGKYRVTVMHRNHKGDSEAETYLVRETEGVLFIETGFAVMMDYDREKDHIRLSPGGEYRRKSDGTLKQ

SEQ ID NO: 10106 - protein, 154 aa, B.fragilis
TGRKEIIYRIRVTNKKQTIMKRILYFFSVMLCILAVTGCQDRDIIDFKDGVSLPPVTDLKSSLTPDNDAVLEWKLPSAIPEEIQRPLSVYVQVYKGAVLEHQISLEGEPTSWEYTLKEPESKYRIVVKVQGMLKEKPYGQSDEIYSLGQTVSIN

SEQ ID NO: 10107 - protein, 286 aa, B.fragilis
KNRNMEQEERMYQVPLEMICRHDRTAEVCRAAVEEDGWQLENVPEEMKTPELCRKALETEAGFGNDFHRGLVQHIPFAEVCMEVLKECRENNPEELYGVAVAIRPEVMNGEMADFLLPLDGRCISILPVHLQTPERVRVAVETSGMSAVGRGGVPKSLLTPDVYVRCAAHSRESLMMIPWAERSPEVCLMAKTLYPDIVKNHPEFVPESVHNQDSIYTLNSLMESLTGEKFSYRQMTDFYNGKPLNVKRMETPGGVQKDKSVKFDKETGGFSFSDIRQERKRGLKM

SEQ ID NO: 10108 - protein, 211 aa, B.fragilis
KTGNMEFKSLKNIETSFRQIRLFTLVFACLCAVVTGFALWKSYSFAEAQRQKIYVLDNGKSLMLALSQDVRQNRPVEAREHVRRFHELFFTLSPDKSAIEGNIKRSLLLADKSAFNYYKDLSEKGYYNRIISGNINQMIEIDSLRCDFDKYPYSVRTFARQIILRESSVTERSLVTRCRLLDAVRSDNNPQGFIIEGFEITENKDLQTLKR

SEQ ID NO: 10109 - protein, 192 aa, B.fragilis
LNMKKKITICFVCLSLLLVSLAVRGQDTKTTRRVPLQAEVTHDGLSEKESKAWEIGLGGSLINWSRVSVTGFRSTPDNYFYNLKANHLMGGANLYIARELNRWFYLDLQGSVGLTKNNNRTAGDDRKRDLLYMGGLGLQFRFTPLLRSQWVEPYLRVGVNYLHKDFASVYGGNFEDDPTGSSPRGWKDRRGS

SEQ ID NO: 10110 - protein, 191 aa, B.fragilis
QLSNHEADSHADLRVEFPAVAAEQHPLATVYQQDNLVRHVGGQLQRERTPVDEIVLIREPGAVRQQALAPVHRLVPGKGGQSQCGEERLLPVGKEVQVIAALARELARRIEAVPVAVPLLQVFHTDHPMVGVLRVGAHRYPGVVAEAVAVFPAHVVRQPARELYAPHSGQAPLGVCPVHMQAHPEKQDNEQ

SEQ ID NO: 10111 - protein, 233 aa, B.fragilis
SKNEKERQPPEGVPRHSAAGKGILNLSGRTDFIFKRKWQVVCCGTRNEFRASPPPCPLDVAFPSGVGGCSRGRAVGIRRFQTMFHLKFYRMMDNQKKYAGNHGRKPKPDKMRHRYVFRLDDGDNARFLALFDESGKATKAEFIVSALFGKEIKVIKLDKGTQDFYMRLTTFHSQFRAIGTNYNQCVRALKSNFSEKKALAFLYKLERHTLELVELSKRISALVEEFQSKYPVR

SEQ ID NO: 10112 - protein, 74 aa, B.fragilis
  UNSURE (67): Identity of amino acid sequences at the above locations are unknown.
VSCESLRLNRKIAVDTVSLEYSRGGRNSWCSGEMLRYHEELRLRRQLTGLQLTLMLESVGSSPRGGXVRAIGFL

SEQ ID NO: 10113 - protein, 109 aa, B.fragilis
KSPDYLFLNTGKNEKRNESGDARKQVPAAGGGERLRREQGGGRDGRLQGGTSGTVLRYRERVRGDPLGLAQGGEGAAGVFHRTQAGLLHRGEVPAGNGQGRPELPEPEL

SEQ ID NO: 10114 - protein, 278 aa, B.fragilis
VNREAAARAARMNNQQNDDMDRQTLNVAFATQKGGSGKTAITVLVAGYLHYRLGCPLAVIDCDFPQYSLYEMRERDSRAVLENEYLKRAAYEQMRQPGRAAYPVRKCRVEQAPDTARELAAEGCYDLLFFDLPGTVNSAGILRTIAQMDYIFAPVSADKAVLESTLSFLDVLQRMMLGKETSRLKGLYLFWNQVDKRETSGLYEKYGQVVADMRLPMLQTRIPDTKRFRKEADSTGRTVFRSTLLAPDRRMLAGSGIPELTREIATILKLEGYEEAAE

SEQ ID NO: 10115 - protein, 213 aa, B.fragilis
NSKDMRTIKAIILGVACLTAGAANAQWVVHDPGNLAQGIINTAKEIVETSATAQHTLDGFRETAKIFEQGRKYYNALKAVHDVVKGGVKVKKSIGLVADISEIYVRNYQKMLGDPNYTPDELETISFGYAKLLSESADILQDLKNVVNVTGMSLSDAERLAIIDQSYKRLLEYRNLVQYYTDKNISVSYLRAKKKKDADRVVALYGDAEDRYW

SEQ ID NO: 10116 - protein, 359 aa, B.fragilis
NGKDAGRTPGTRSAGSSSTGKARSNWMTARCCCPMTATRWRKRRSGSITPGCRTSRAASPSGWRTRTVRRSSWNTTSMRTTTRRTGMEVELGKSEVPALAELKDLCRHECTAERYADTVREFGWSLEHVLEDMKTPEMCRRALEASAELGYGHLALLHHIPFAEVCMEAIRDWYGEGRADLYEVASAIRPEVFDGKMADFLVAEDGRCLSLLLVHLQTPELWRKCAEHNWMSFVMIPWRERSLEACLTAYLNYPGMIHAHPHVVPQPVDSYYNVYSLCRLMEQMTGEKFTCGQMADFYGGKRMAVKCIEVPDGFLKDREVLSTGRKRRSASPLSASGRSRGSRNSKSRNGTTHPRGATE

SEQ ID NO: 10117 - protein, 349 aa, B.fragilis
RAVCQLGGGVYAAHGLRRPALYRLSPQRHRAGAPAHRFRPGGRNRAGDFRQLRTREFDEGLPGAGTAVRSCPGYAQAVEGGTTLVARRLRGRQSQGTVGRSHPPARPGVAFPYIGRIPCRAFPYRITVDEVKGEYGGREYHGLTYSATDREGNKVGKPFKSSVFGKEAGIAALERRMHNAAAWEKTHKEVAAATAGKVAAAMQTAGHDRAQFERELMRQGIGVVFRQNEAGRIYGATFIDHAAKAVFNGSRLGKEFSAGVFNDLFAGQEGIHLPQPSAGVEHPTRQQEHTGASQWDGHTGYRPDHKDGTTQNVAASFNLFALVPGGASGDQPVPPQRKKKKRRKYGRQQ

SEQ ID NO: 10118 - protein, 226 aa, B.fragilis
GWLLSHGSVRGCRCLPASACREPAAWSGTPSVPYCPPPCGSVSCRGCGFAASAASCRRLPARTSRTARSFPAYRLGSRKGKAPSGGSSLCPASSVAARRGRRACSPIPPCPHSPGRRCSPSVRSCAGCPPSSPCPAGRRRAGRSSLPPPAPLPCRGLAPPGTCAPDRRHAPAAASVRKPPVSGIRSPVPPGCPVPASRTGCTAGSRSRSPPADTPSGSAGSPPPTP

SEQ ID NO: 10119 - protein, 116 aa, B.fragilis
RDHRRQAESLRAGAGGETAGGEGALAGGLRLLRRERYGRGGNGTAGQRAGTGTVQGLFGQWRRQPFFRYRLPGHQPSARLVLRGTEGGRGKGGAEKAGGGVDRQAGRKGTAGGRNR

SEQ ID NO: 10120 - protein, 101 aa, B.fragilis
TPHRSGAVAAPIPSAPVPPAPPRRAVLDCCRSARLRRPSRSVPCTWRQARSSSPSAPPDHRFRPPAVPFLPAWRSTPPPAFSAPPFPRPPSVPRRTSRADG

SEQ ID NO: 10121 - protein, 596 aa, B.fragilis
QRNRFPDRKKLSKRTRINNQLKNKRIMKTKANQSAAERNITMVALANIQPSGFNPRKRFDETSLYELAESIKRQGVLQPITVRPVDGTDRYGIVFGERRYRASVIAGRDEIPAIVSELSDEEAEEMAITENLQRKDVTPVEEAAAYQRLIESGRHTVQTLAVLFGKNENYIRTRLKFTALIPEIAALLDADEITISVAAEICRYGEDIQREVYEKHLQDEGTYNSWRGLKAADVARRIEQNFTTDLQYYHFDKAECATCAHNTNNLLLFHDGGCGHCANRTCLAEMNASFLMERAVQIMRNQPEVSLCRDCYTANETVVERLTASGYEVETLDRYTAFPSCPKEPKAENFNDPERYGEARTRYEQQWADYMEQEEEITRRSGAGEITVYAKIGQKEITFCYVENVTETETADGTPAPAPLSPVEKLEKQDKRNKEIALERTVEDTKKQILEADITGGKFSADEDTMLYFFLLSSLRKEHFAAVGIAEDKPYITDEDKMGIIGNLTVKMKTIIRRDFLVANFKGAYGNNTVATLLLDFARRHMPEELANIEREYNGVYEKRHQRIEEKKAVLLVQERARERKVTQPEEQPQPEEIAA

SEQ ID NO: 10122 - protein, 78 aa, B.fragilis
GENREFNGNLTEIKRGLSKKLGGTLAGIERESDRNQTKIERKTALTLLMQLGRDLFQGRKEQSFGFEKTCYLEIKGLI

SEQ ID NO: 10123 - protein, 457 aa, B.fragilis
WKNRPKKKQRPTQHVTVADAPTPETGNGKKEDKGGGKKEKKTAKPLTPKQLQQRKKLMVYPLMGLLFLGSMWLIFAPSEERDVNRDTVGAFNADIPLPENDGIIGDKRKAYEQAQAEKQQAEKVRSLEDFAFSEESDMDGVEMELPDSEPEREPFRDYSDNGGGSRSSVTAYRDINRQLGSFYEEPKVDGEKEELKRQVEELTAKLEERERQAGGIDDQVALMEKSYELAAKYMGQNGKDGAAVQNDNSPRQPAVAVQVARERTVSGLQQPLSDAEFMRRYSQPRNYGFNTAVGSGYTMGKNTIRACIHGDQTIMDGQTVKLRLLEPLQAGNLVIPQNTLVAGTGKVQGERLDIVVSSIEYRGNLLPVELAVYDSDGQKGLSVPSSLEQEAAKEAMANIGGGLGTSISFARSAGQQVAMDITRGLMQGGSQYLAKKFRTVKVHLKAGYELMLYAKQQ

SEQ ID NO: 10124 - protein, 240 aa, B.fragilis
RAARCRSRHTSTTCWHSTSSNTGRRSRRHTPGNWRTSFKKEGGNGMILKLSLTVLLLYYLAVLWKYYRQDIAGIFGTAETDEDTDGTGKEPGQPGEPYTVMGESTYLPFGAEDGEEAVAGAVDELAAEDDGADYSDIEPEEDEEETDYEPTPEEIRELEEEEELGAYYPDGNPDFATGYSFDDLKKVRRVLVSDNADEKAEREAREVLPSVMGSDIWEAMLDEFEGARKRVARLMDNHNV

SEQ ID NO: 10125 - protein, 194 aa, B.fragilis
AMKRLLFIILLFGVCLHVNRAHAQRCLPGMRGIQLTGGLSDNMRWKNGDGFGYHAGIAVSTYTKNAHHWVVGVEYLEKRYGYRDCLYPASQFTGEGGYYLNFLSDRKKTFFAALGLSALAGYETVNWGESLLPDGSRLTDEDNFIYGGALTLELSAYVTDKIVLLVNGRQRVLFGGDCGKFHTQVGVGIRFMIR

SEQ ID NO: 10126 - protein, 155 aa, B.fragilis
LYMRTMIYRIFTGCYIVAALVLVAACNDGLDIQTKYLFTVETMPVPKELKVNETAEIRCELKREGRWEDARYTIRWFLFDGEGTLKLDDGTVLLPNDRYPLEKETFRLYYTRLSDEQSSFTVWVEDSDGQAVELEYDFNADNDKEDGDGSGTGKE

SEQ ID NO: 10127 - protein, 101 aa, B.fragilis
RQMRQKRILFTAACILAAVGAMAQGNGQAGITEATQMVTSYFEPGTKLIYAIGAVVGLIGGVKVYGKFSSGDPDTSKTAASWFGACIFLIVAATILRSFFL

SEQ ID NO: 10128 - protein, 251 aa, B.fragilis
RNPRNNRNPKRLQPKDKGQGGEIRPLLSFVSRSGKERSQRNRFLNFQIFKLMRTVQRTYTLFGIAELEDEARQKAYTDWLAKGNDYPYASENCDTLEAFCNLFRIACTNYCYDSCTYAYRFHTGHEEETERLSSVRLLAYLYNNFHAELYKPKVYWTKDRKKRRRSRISVTCECPFTGVVSDEIILQPLMDFMRSPDTRNFKELMRDCLENFFRSCRDDCEYCESEEYFTDESHKNNWEYLIDGTLFIETA

SEQ ID NO: 10129 - protein, 110 aa, B.fragilis
WRTSDMEVITKDTEEVRAYFEALEEGMRYIDTVTAHFRPAMNGEVYFTGEDVCRMLHITSRTLQGYRTQRLIPYISLPGKTLYRQSDLLRMLEENYVDMRQKRKRGKSPT

SEQ ID NO: 10130 - protein, 407 aa, B.fragilis
TRRRCASATTSSACTPSRTRKTCRARWRRTAVTSGSRPTARTAGCRSAGPGGLAAGLQPLLQPVHLHRRPRGEPETLRADRPEHALALPLLPLQPDQQGLDRGIPERGALERADLGALPLQRDGMERRQGGTQAHQERGGQPARPDGVQAEAQHGGRAHALLGGDTGQRGGLPLRGELLHVHPASPVLLHRRDELQGLALTLRHQDGGQDDGQTAASGHQRPADEERGDLEPQQVCPRSERKRQVVLHEPPRAPVLRAEQPHRADRHGQLVPRAVRADTPQDQGRGRDLLHVHGGEAHQLQPLLHGRLQVQRGEEGQHQDVAAGAVEGRGRENHEDGERRAGQCGVGVHPPDTAEPGHRPLVRHLLRVHAERLPEGAGCKGHQGEPEGLQHRQLPDHTQAVLQGRTL

SEQ ID NO: 10131 - protein, 134 aa, B.fragilis
ACSGTRHRPRGRTLSDQGWKGRSGRTSVSCRSPAQPTGTAVRAVLGTTAGCSASCCIPSGRCTSPPSSSSPWATSPARRASCRSPPCSPDMPSPGHGGTPPSPASPSAPGIGSCRRSVIRASRGSPSPRARAPC

SEQ ID NO: 10132 - protein, 476 aa, B.fragilis
RCTGCSSGCSPAASPPGPAERQPAVRAVGREPLVTAVRRHLARQVFRVREGVQAEDVVADAHLLRVQLDVLQHRRVVLREREVLLHDARRRFRPSDLVRREAAQRNKTAVVHDLLELPDGFEEPRNRLPVLYLLGDKPALAEGGERAFLTAPHLRGLCQEQVAGVREERAFVEVPLKAPAQEAQVVPVRFRPVLLLDEEVLLVYDGILRQHLHRLVPSRVDRLVLAPCNGEQFRKFHPEGDRHVRLLAHDAAVLHRQQRELAFERRRFHYVFHSCQCLKINNRGIFSRFTTYLGCLLRAAAFISPCVPYRAFSRKVSHTSSVAAATPKPMHTHWFTPAMYRMTNTTKTASRPPQKMKRYWLSSPLNSTFLPIPLLISMSIVAVLQEERTQDSGSYYQEDAGSEPARRRLRRVGVAGAELPIYFHPSDQADHRTDGVNQFRPRFKIRGDHLRGFGDTRLPVSLRHCAHGSEYAGRRE

SEQ ID NO: 10133 - protein, 286 aa, B.fragilis
GDAGFLHAPDHFPLAVPCHRHELQPMRACAQIQFLGEESPRFPLQAGAAHPRTGRVKQADFRTGGGVPEQIPRPMIAKISHGSSLYGVLAYNQLKVDERHADVLFTSRIIEPQGDNPYTIGHLSRSFGDYLTANRKTEKPVLHISLNPDPKDCLSEERFVSLAEEYMRRMGFGDQPYIVYRHNDIGREHLHIVSVRVDETGRAISDSYEHGSSMKVCRELERQFGLVPATPKQWKEGLPLSPVGYGDDNLKGQLAGVIRPLAREWRFRTLGEYRAVLSLTASRWTR

SEQ ID NO: 10134 - protein, 65 aa, B.fragilis
IMEGKKFKHKYLPYLTCVVVAATRKGYKVLETQVLGGRRKPKTKTAYYYDIDFDKERGLWQEEGK

SEQ ID NO: 10135 - protein, 69 aa, B.fragilis
WGTGQISSPACPLSKPSLSKTDWNSYFTFAVISSIRFVIFSMEYFSINLLFAASAFSLSLINFSCGKSD

SEQ ID NO: 10136 - protein, 684 aa, B.fragilis
GLQGKAHSIARTCSGKPDPKGNAPTIIWKHELTVITYFLKVIRIMPLFRNFETSNEHGYDRNILTFLNEYAEISDPQYAIMLRGAWGCGKTFFIRQWIKQLKNDKDADKLKWRPIYVSLYGLTTTQQITEQVNKEISPWLYSKGMKLAKNILKAASKIALKYDIDGDGKDEGSVTCDLDSILLLKEENSEIKGNKILIFDDLERCDVKLETLLGYINYFSEHCKCKVIIIGDENKISEKEDDKCKLKFKDFKEKTIGRTFEIKLNIGETLDFFIGEISTNNRNLLSENKELIIKIFHASKFDNLRVLRQCLNDYHRIAMALPEHYHKSPKYKLVITSLLANFVAVYCEYKGGNTRIGSLFNSLYDMFPDKEKDEEREKILSKYRFIEIGKQLDIFDRFIVNEIVCYLESGYFDTTYLQQYFAAEDASLNSWDYLYDYWRLDNGEYEKHYGETVRYYFADESVDLKELFVIISVLSVLYSDNLVHVSEEDIIAQGKHSIDRLMEGISDMEGLLNCNSKVHAGTRRNHSNIGSDRILNGLVAYFQKLFGQRLKKCPNKVSVMLENLTDETCERLNPALNDVVPVKQRLYRDTSIFQEADADKVSKSILGLSNESRNTFLHFLQFRYKYTSWGSEIEHLSKYCQSDLPQLKLINERLKAEAANRRLIEKYSIEKITNLIDEITAKVK

SEQ ID NO: 10137 - protein, 132 aa, B.fragilis
KNKGAATDEYLQQLSRQIDRLEGLKVNHSHSFNVTYSRSYLVQVTIVELFLFSLVHNAWQLKRGWRLKYRYVLMSGNADAKTLDRLENCFEWNRDRKLIWKIRKEVEDFERWTEKKVAEMLRAKRQQPGVGK

SEQ ID NO: 10138 - protein, 168 aa, B.fragilis
SPFFPRAPKQKINVSLLIFCIMNTLSFPQITVSYKDADASKRVRIHSSKESYDILKTFYEDCMQHHEECWAMYLNGAGRLLGVSCVSRSGMNSTVVDIRIVLQTALVSHASGIILSHNHPSGSTVASTPDNNLTSQLKKGCEAIGIQLLDHIILTEDAYLSYMDEGML

SEQ ID NO: 10139 - protein, 337 aa, B.fragilis
YRTMLLAIDFTNLHEILQVLYQDMMPLCEKLTGVAKGIAGLGALFYVAAKVWQALARAEPIDVYPLLRPFAIGLCILFFPTFVIGTINTVLSPVVKGCHGMLESQTFDMNRYREQKETLEREAFRRDPEKAYLASKEDFDKKLDELGWSPKDLKTMAVMYIDRTEYNMKRNIRLWFQELLELLFQSAALVIDTIRTFFLIALSILGPIAFALSVYDGFQSTLTQWITRYISIYMWLPVSDLFSSVLARIQVLMLTRDIEAMSDPTFIPDSSNTVYIIFLIIGIFGYFTIPTVANWIIMAGGVSQANRAMNQTANKVGNVAAAGAGAAVGNIAGKIIK

SEQ ID NO: 10140 - protein, 442 aa, B.fragilis
LTTFRNENFRVMKTKRSTFATSFYIKRSAVRNRDGKAPIMVKISIDGDDKVLGTKLFVTPDLWENGKAKGKSAEATEINGQLKEVSARLTNHYHRILREEDFVTAEKLRNAFLGIGVMENCILKDFENMNREFEAMVEKGQRAKSTYNKYLAVYNHFATFLWEKKKRTDMAYKELTKEIITDFDKYLRVEKGLSDNTLWIYTMPLLSLTDKAWRRGIVRSDPFGEYSLEMQETDRGYLTEEELRTLANAVFVKKQTNLVRDMFLFGCFTGLSYIDIKTLTHDKIQRMDFDGEDWIITRRTKTRVSSNVPLMEIAKELIERYKGLAGGDFVFPMPSNGTCNKHLKQIAKACGISKEIGFHLSRHTFATTVYLCNGGTIEALSKILGHKHISTTQIYAEVTNKMVSSDFRAISGNLAAMQRSVLEKRDRKQGRKKVHRSLRETA

SEQ ID NO: 10141 - protein, 104 aa, B.fragilis
IFDLMEEQTQEKATANAARDGGGCPNPGDGERKEGGQGRREKGEEDSQAAHAETVAATEEADGISADGLAVPRLDVADIRTFGGAGREPGHRGGVQRRHPPAGE

SEQ ID NO: 10142 - protein, 112 aa, B.fragilis
IHIFAGKYNEKCIRTMEIVSIEKKTFEEMKERFGCFSRHVKELCARYRPPGKMNWMDGADVCEKLGISKRTLQTYRDRGLLPYSQINHKIYYRTEDVEVFVESMSREIMEDE

SEQ ID NO: 10143 - protein, 334 aa, B.fragilis
RIVPMKLKYCILSLLFFYLNISSIQAVIPQMEVSPDERGVSSLVFQGAGNVRNYVDHGKYLGDLSLIYEVRGKSYAVSLADITPLVLSNTPDKIQIFWQLPFDVRLYQTFTIKGEEVDWEIDFFNRSHHPVKVTDMWFALPVGALDESIQAHQNLNRHFSLNGNASFFYWTPLTGQGDILLMTMHKGTAIEYATQDGKYYLHSMNAVDRTNDSWRLPSTSKNVQPYEHYMTGFNFTLTGNHEEVKTKIYDKHGVVVKVAPGMVVTPEFEVYCALQSKLPVAELVAEYPEEIQITSLGQKEGDKYIYKFRFSRLGENLITVHYGDDLIWLSRFLL

SEQ ID NO: 10144 - protein, 309 aa, B.fragilis
RHNIQLVPYKKGDFPEALMEMSYIGTNQLKFTVTDRRIPSGIRMKPNIHIFGGLANQPGNTIIESRFVACDADRAIRKYSNDAWVAAYFGLHTEQLEDFQGYSAGYKYYTFQDERSYGAFQTNDPLSRRPTEGFYKLGDMYNRDTYLQPFLDHGEKIILRQVDMYVNGRSTFVAADDSPYKYDLDGDGVLESYECELDPATGLPVHEADYTKYKGFQGDVYLSFIEMGTDEYEPWNTGVSLGSVYTTGGIQKTYKYIYTGAGDFTITAVATNVGDKDYKGIDYSEERSNSLDDYSHKRALSSVKVSVKP

SEQ ID NO: 10145 - protein, 174 aa, B.fragilis
EAVFSIPVDTTFMRLRQWEWYCQKRADSCLTENNYQGALSWLDSARIQVEHYGRPYYILARGDVYYSIHQYDSARRYFSMAVHSIHPHIAIEAWRKLAELELMEGNEKQGFYSTQKADALFRVEIGHVQSDNSEALYQEERLKNELNQLKIAKQNREIAMSSPRGWKDPRWRSP

SEQ ID NO: 10146 - protein, 425 aa, B.fragilis
ALFFHYYTKYMLFIPRKIVSFAKETKTPNTMYGKMKEHLSNTIAEIKEAGLYKEERLIESAQQAAITVKGKEVLNFCANNYLGLSNHPRLIEGAKKMMDRRGYGMSSVRFICGTQDIHKELEAAISDYFKTEDTILYAACFDANGGVFEPLFTDEDAIISDSLNHASIIDGVRLCKAKRYRYANADMADLERCLQEAQAQRFRIIVTDGVFSMDGNVAPMDKICDLAEKYDALVMVDESHSAGVVGATGHGVSEQYNTYGRVDIYTGTLGKAFGGALGGFTTGRKEIIDLLRQRSRPYLFSNSLAPGIIGASLEVFKMLKESNEIHDKLVDNVNYFRDKMTAAGFDIKPTQSAICAVMLYDAKLSQIYAARMQEEGIYVTGFYYPVVPKDQARIRVQISAGHEKEHLDKCIAAFIKVGKELGVLK

SEQ ID NO: 10147 - protein, 244 aa, B.fragilis
KSFENRLACGDIDTLLIIKMKTIMAGVTVLVLFASCGNSNKTDADPFASITHLVDSAMVNKTDSIDREKTSDEPKPIEADESFDDFIYNFASDDALQRQRVVFPLPYYNGERALKIDRKYWKHDDLFAKQSYYTLLFDREEDMDLVGDTSLTSVQVEWIFVKKRMVKKYYFERIKGAWMLEAINLRPIEENENEDFVEFFGHFATDSILQSRRIRQPLVFVTTDPDDDFSLLETTLDLNQWFCL

SEQ ID NO: 10148 - protein, 349 aa, B.fragilis
CMKRMIVYKSCSYVIMALLCTACAAGSPEEDMEDRVRIDPVAGGYYPSISPSAQTRGATPDGETLKDRPIFLLEDGSTIRLVVYDDAKNLLEEYSKAYLVRNAGTSGSSLLYPCEVDDNGAVISSSSTPLYMKAGTYYFRILSPAKALNSKGFVNIGNGEYLLATDDRYTQTAMTAVTITKIDEGGTLNNVQTLYLPPIINQTARMQFTVRAGEGVHTLEMLAEGIEISGIQQPLDNTTSFDWVNGDVLPVKVGDQSASVRITQATRNADNSLVAHTGVLPTDARSHSISVLLNLKVNGNPTQYQMLLTGLYLTAGRSYNYTATVKISNGVTVLTWQNRSWTENVVMDK

SEQ ID NO: 10149 - protein, 139 aa, B.fragilis
KNTITMEELTLTTPALLFSAVSLILLAYTNRFLSYAQLVRILRDRYMEDPSDINVAQIENLRKRLNLTRMMQVFGIASLFFCVVTMFLIYIGLLLLSIYIFGLALLLLIASLGVSLREIQISTRALDIYLSTMEGKLKH

SEQ ID NO: 10150 - protein, 309 aa, B.fragilis
NKQIRVMNNNDPMKRFGYIVFSICLFALSACTSHEQMDQEEGIVKVSMGLTAASFTDDDATTRAEQPMAPDYENLISNLWILQFDREGILTGSEHKVLPTPVLNTTLEGIALRTGRGTVCVVGNLADGEIAAWPDNLSGFKSLVVDMGWLKERNTDRNVCLFGYYEGEIAAGTTAVNVVLGRLVCRLNIAVSAKTAGIFSNVRIQLQNAQTKGYLFPSDVYLSPEGGGNYTEEVVIGADKVLGTAPLYRYYYMAENVTEGTDSGERTRLQIKAKKGGAEYTKAIDLGRSDIHDYSLRRNNNYTFNIVLE

SEQ ID NO: 10151 - protein, 68 aa, B.fragilis
NCGFQLLMYILSSADETYRRHTVSTTVHHLLCTFDQAGMVRQSKVVVGTEIQHFFAFNGDSSLLCTFD

SEQ ID NO: 10152 - protein, 324 aa, B.fragilis
YTLLVKIMKNILVIGATGQIGSELTMELRKRYGNTHVVAGYIHGAEPKGELKESGPSAVVDVTDQDMIASVVREYNIDTIYNLAALLSVVAESKPKLAWKIGIDGLWNVLEVARENKCAVFTPSSIGSFGESTPHVQTPQDTIQRPRTMYGISKVTTELLSDYYFNKYGVDTRAVRFPGIISNVTPPGGGTTDYAVDIYYSAVKGEKFICPIPEGTLMDMMYMPDALNAAISLMEADPTKLVHRNAFNIASMSFAPETIYAAIKKHVPDFEMEYKVDPLKQRIANSWPDSMDDSCAREEWGWKPAYDLESMTVDMLEKLRAKLK

SEQ ID NO: 10153 - protein, 589 aa, B.fragilis
AEESCSALMFHSKKSRHIMKIKHIVSCFFVSLIGLSACSIEELPYNQLTEDELDGSYESLLSATRGNYAVFKQTAFHQGWHYAGELASDNVSLSGVSSDALMYIYNYQRITDNYHMSNMWGWAYRSIINSNKILEKAQEGESKEMDQLIGENYFLRGWLEFVLVNVFGRPYNQSPETNLGIPLKLTADINDYPMRSTVKESYEQILKDLKKAETLLNSESNIYAGPSAAKALLSRVYLYMGNNKLAAEYATEVIESSGRTLLEGEAYATANVLVPEDNPEIIFAIRCTKDKDDYGWNSIGGFYANIDGVGWGELYASEPLRDAYAEYPEDLRSRYIVPQYLKDDETGEYRKEFIYIESSEEDGVPRKYYRWNEIIEENGNYRIKDAYLSKYEYKDTLTMKQDAGGYYVESRLKSGKDNPTPGTYEKHYVTIQNLMAKRNDYPKYYVYKCSKQENQPQLWSPTVLRLGEMYLNRAEAYAKEPALGDALADLNVIRTRAHIPALSAGDMKPGKTMLEYVLEERRKELAFEGHRRFDIFRNGLTMNRTYPGTHDRGAATSVRLTISADDPAAIEFIPQREIDSYPGVLEQNP

SEQ ID NO: 10154 - protein, 1060 aa, B.fragilis
SSLSRCLEWKAEQHEDTTSSPGSDLSVVIYTGIVEVNGFLQYKMKRRYLLAGLVVSALLGVGAKVPASMDAPVREVFHTPPGMSAPIEPLLLYQASQDEKCRHWVDSVYNRMNLREKVGQLFIYTIAPVQTKRNMQLLRDAVHTYKVGGLLFSGGKIQNQATLTNEAQRMARCPLLITFDGEWGLSMRLRGTPVFPRNMVLGCIQDNRLIYEYGREMARQCREMGVQVNFAPVADVNINPDNPVINTRSFGEDPVKVADKVIAYASGLESGKVLSVCKHFPGHGDTDVDSHKALPVLPFTRERLDSVELYPFKEAIRAGVSGMMVGHLQVPVIEPIGDLPSSLSRNVVYGLLTEELAFKGLIFTDALAMKGVAGNKSVCLQALQAGNDMVLAPRRLKEEMDAVLEAVEKGELPEEEINAKCRKVLTYKYILGLERKPFVKLSGLGTRINTPQTRDLISRLNLAAITVLNNKNDVLPLHPDLKEAAILNVGKPEEIEPFDHKMKKYTSFARFQLRKDLPEAEQQKLRDSLAAYRRVIVTVTEQRLASYQSFFAKFAPESPVIYVFYTPAKSMLQIQRAVSAAEAVVLAHASRDDVQERVADLLFGKATADGRLSASIGGLFPTGSGVTITPHTPFHFVPEEYGMKSEVLRRIDTIALEGIKEGAYPGCQVLVMKDGKALYDRCFGYHTDANSEKVKPTDIYDLASLSKTTGTLLAIMKLYDKGRFNLTDKVSDYLPFLRKTNKENLTIRELLMHQSGLPSGLLFYQEAIDGKSYKGSLFKQSKDALHTVRLGVRTWGNPRFRFNKGMASKEKNGDYTLQVCDSLWLNRSFREEIRKKIAEAPLKDKSYRYSDVGFILLQMLAEELSGKPMDEYLWQEFYQPMGLEHTAYLPLRYFDKKEVVPSAVDRFLRKTTLQGFVHDESAAFQGGISGNAGLFSNAREVGRIYQMLLNGGELDGRRYLSKETCALFTTEKSKISRRGLGFDKPDVVNESKSPCAASVPVTVFGHTGFTGTCAWVDPDNGLIYVFLSNRTYPDAWVNKLSKLEIREKIQETIYEAMKEK

SEQ ID NO: 10155 - protein, 242 aa, B.fragilis
IDETVIHLKDINKTYNNGAPLHVLKGINLDIERGEFVSIMGASGSGKSTLLNILGILDNYDNGEYYLNNVLIKDLSETKSAEYRNRMIGFIFQSFNLISFKNAVENVALPLFYQGVSRKKRNALAMEYLDKLGLKDWAHHMPNEMSGGQKQRVAIARALITQPQIILADEPTGALDSKTSVEVMQILKDLHKTGMTIVVVTHESGVANQTDKIIHIKDGIIERIEENLNHDASPFGKDGYMK

SEQ ID NO: 10156 - protein, 148 aa, B.fragilis
MPEAMFSMMDNLFTGIHVLIWMVGLGTLLAGAIGVSNIMMVTVKERTPEIGNPRAIGARPKDILQQILSESMVLTTIAGMAGISFGVLILQLMEIGVNSGKDHYSHFQVSFGMAIGTCLLLVTLGLLAGLAPAYRAMAIRPIEAIRDE

SEQ ID NO: 10157 - protein, 261 aa, B.fragilis
SKILRRKKMFDNEHLTYICGHYKKGASETYDSRQYPRERSKTEILTTINPLLLFFSYLAALLDHTEKYPGTQYTRMDDLNINSFNALYTLYYRKSFLFAKSYVHDEQVAEDIAAEALIKLWEKLKTDIINSPQAMLLTILKNKSLDYLRLEQNKLNAMSELSELYVRELDIRVSSLEACDPSEIFSEEVNQIIQATLRTLPEQTRKVFKMSRFENKMNKEIAENLGITVKGVEYHISRALKEFRISLKDYLPLFYFFFYFH

SEQ ID NO: 10158 - protein, 1007 aa, B.fragilis
NTVYEIPPRQTMLKQLLTVVFLLSAGTLWAQQAAGLLPVQEDTHCKEWVEQTLSRMKLKDKVGQLFVYTLAPRADKDTEKLVGKLTRKFKVGAFLYSEGTVEDQANLTNYAQRQSKIPLMITFDGEWGLAMRLENTPVFPRNAALGCISDNTLIEAYGQEVARELREIGAHVNFAPDADVNTNPENPVIHVRSFGENPKTVAEKVIAYGRGLETGGILSVSKHFPGHGDTDVDSHQALPAVYYNRARLDSVELYPFKEAIQAGLGGVMVGHLQVPALEPDRITPSSLSHSIVTDLLRGELGFNGLVFTDALAMKGVAAESDVTVKALKAGNDMVLVQQNVEKAQESVVQAIKDGRLTMEEIDAKCRRILAYKYRLGLSRRPMIPVDGLSDRIHTPEAQALVTKLRTSAVTVLGNYFQILPLTATKGEIAVLTVGDEGSDASFIEGLRSELPLKTFRMDKNTGEEERRKIVKELGNYRRVVVCITVQDKEAGEYRSFFAGFRPQAPVVYAFFTSYRALASLEEAAARSAAVVLAHSGEEDLQRYVADVVLGKASATGRLSMRIGNTFAAGSGVDVISGSPAGIAPEDYGLKSYRLHRIDSVVAAGLAAKAFPGCQVLVLRHGQPVYDKCFGTHSVTDTTPVRATDLFDLASLTKTSATLLAVMKLYDQGRIELTDAVSKYVPALRATNKKNITIRELLLHESGLVPYIRFYRDAIDEYSVTGPFTQGFVDEWHHTRMGEYTYACSDFKFKKGLVSATKTSGHTLQIADGLWLDKKFKAAMMKSIAQSELDRKRFVYSDIGFILLQQVVEAVTGKTLDAYLVSEFYRPMGLEHTLFHPLNRYKKADIMPTAANDYLRRQDLCGYVHDEAAAFMGGVSGNAGLFSTAQELGKIYQMILNEGELDGKRYLRPETCRIFTTEKSAVSHRGLGYDKPNLKDPKANACASSAPASVYGHTGFTGTCAWVDPENDLVYIFLSNRLCPDAWNGKLNSMKIRQAVQEVIYQSLYTPE

SEQ ID NO: 10159 - protein, 466 aa, B.fragilis
TMDLSAAKLYNSQRMNRAISRKKFYFWKIILEGPGKKWEPNRRTLKDLGMVEEPYGKKTLFSLFDMTESDGGKRGLEKWLVHPLSDWKALHERQEAIRYPDFPEIRICREELDFIEFYLSQGDRPTRVSYLESAFSYIFRHFRATPERYVIRRGTKLLENVLLELKTFADHVTALSPRLIRNIAATISEIYQATELGKMVDSCGQEDSFYRTDRLDYIFRYRRNHTIAALLSIVYQLDAIRTVHRTAVTKGWCFPSFTNDSKFMLCNFYHPQVKDAVANDWEMENGNICIFTGSNMAGKSTTLKAIASAVWLAHAGFPVPASSMVCPMFDGIFTSINLPDSLRDGRSYFYAEVLRVKEVLEQINKGHHCFVLFDELFRGTNARDAFEASVAVAEVLKAKAYSRFLISTHIIELARKLDGDDACCFYYLESAIVDDELICNHKVKPGISESRVGYWIVKKELAGFEK

SEQ ID NO: 10160 - protein, 310 aa, B.fragilis
IMNQEILNRYLTGDASAEEKQMVVRWLDADPQHMREYLALRKLHDITLWQEKPAATVDKKKRLTLPYIREFIKIAAIFLIAVTSVYFLAPERGKDTPDLKAIHVPSGQRAELTLGDGTRVCLNSNTTLTFPDHFDRKERRVTLDGEGYFQVAKNDKKPFIVQAKEYEVRVLGTEFNVMMYKDQDFFETVLLKGSVEVNETTTGRKVKLQPNERLFGKAGQLRKESISEWNRALWMQGILYFDNTRMDEIIRQLGLYYDVKFILEKESLANVRFTGKFRIRDGVEHVLKVLQLKCKFTYQRDEDSNTITIN

SEQ ID NO: 10161 - protein, 1085 aa, B.fragilis
VLINTVYKCMKNTLIKTSKIVNKSISHTMKMIVLFLFVFISGVFAGNANSQETKVSISKNNKPIREILGEIERQTDYLFVYSEKEVDVNQRKTVNVSQQRVADVLSSLFRSTNVGYAMEGHNIMLMAKTTQTDAAQQKRHITGVVKDIKGETIIGANIMIKGTGTGVSTNIDGEFSIEAAAGDELIVSFIGYLTQTIKIDSQKTLNIKLLEDTKTLEEVVVVGYTVQTKSAVTGSVAVVKADKLKDVNTLEVGSMLQGKVSGVYVSGSSGEPGHASKIRIRGKGTLNSSVSPLWVVDGVIVGEDPGLNPNEIDNISVLKDGSATALYGSRAANGVIVVTTKRGEYDANKYSVSINAGVSLLSTGRLEMMNSQELYDYQKSWNNQSWFTEELLKHNTDWFKEASKPGLYTNANITYTGSSGRMRSFVMADYYREEGAIKDFTLDRFTFRSNNDVKFTDRFTMSTKISGSLSRTDSQQRSVYNTYLYLPWDFPYNEDGSIRSGQEQDWRGRDGINDMYDLQWNWSRSKKLTVDGTINFNYQITDWLRFESNNYIRYISNRSESYTDKRSRSGQSDKGSLSNSNSLLTKQFTNQMIRFEKSFGKHKVNALGAYEYTRHFYESTSAEGRGIQPGREILDVTTGIKSIGGYKDAIATQSALFNANYDYDNRYMGQVSYRMDESSCFGKNNRMGHFFTVSGGWNIQNETFFESLRESVNQLKVRVSYGSLGNTPGAYYGHYPLYSSMMYNDEVAYFPSQMGNADLSWEKCYTTNIGIDARFFDRFGVTIDLYNKNTSDLLYYAPLPNISGYTGQYKNVGAINNKGLEISLNADVIRTSKFQWTSDFNIGFNRNRVTELYGRKPELKGLKRLEERRDMDEWYLKEWAGVDPANRSPLWYTPRWEWPKAQLPDSYNKADRVYCGSAARKFTGGWMNSFSYKGFTLTANFDFVYGNLLYNQSRELLDSDGAYADYNSMKLKSGWKRWEKEGDIATHPKAINGGNKNSNKSSSRYLEKGNYFSLRNLSLGYSIPEKLCGKLGLQRVNVSCSADNLFTLTPFSGVSPQLSDSSTDGYAGTIYPLSRRIVLGLNVSF

SEQ ID NO: 10162 - protein, 343 aa, B.fragilis
FVCNKHLILTNPLNKSIMNSSMEKPYVVGIDIGGTNTVFGIVDARGTIIASGAVKTQVYPTVEEYADEVCKNLLPLIIANGGVDKIKGIGIGAPNGNYYTGTIEFAPNLPWKGVLPLASMFEERLGIPTALTNDANAAAVGEMTYGAARGMKDFIMITLGTGVGSGIVINGQVVYGHDGFAGELGHVIVRRDGRICGCGRKGCLETYCSATGVARTAREFLAARTDASLLRNIPAESIVSKDVYDAAVQGDKLAQEIFEFTGNILGEALADAIAFSSPEAIILFGGLAKSGDYIMKPIMKAMENNLLNIYKGKAKLLVSELKDSDAAVLGASALAWELKDLRD

SEQ ID NO: 10163 - protein, 368 aa, B.fragilis
NKMKKYLKITLLVVVAAIFIGTFIFLYQKSKPKTTVYETVTPEIADLEKTTVATGKVEPRDEVLIKPQISGIISEVYKEAGQTIKQGEVIAKVKVIPELGQLNSAESRVRVAEISTAQAETDHERIKKLYNDKLISREDYEKSEVEIKKAREELQTAKDALEIIKEGITKNSASFSSTLIRSTIDGLILDVPIKVGNSVIMSNTFNDGTTIATVANMNDLIFKGKIDETEVGRIHEGMPVKLTIGALQNLTFDAELEYISPKGVEENGANQFEIKAAVHAPDSVQIRSGYSANAEIVLQRAQKVLAVPEGIIEFSGDSTFVWVMTDSIPEQKFERRQIKTGMSDGIKLEIKEGLTGKEKVRASEKKDK

SEQ ID NO: 10164 - protein, 450 aa, B.fragilis
  UNSURE (83): Identity of amino acid sequences at the above locations are unknown.
GKYESPTMHNMRNKILINLLILTGLSAYTAQAQEGWTLRRCIDYAIEHNINVQQTANSAEQSKVEVNTAKWARLPNLSGSASXNWSWGRTASPVDNTYNDINSGSSSFSLGTNIPLFTGLELPNQYALTKLNLKAAIEDLNKAKEDLAINVTSAYLQVLFNQELSKVAQSQVGLSKEQLSRITRLHEVGKASPAEVAEAKARVAQDEMSAVQADNNYRLALLDLSQLLELPTPENFSLATPDTELEFSPLTSPDEIYNQAMLYKPGIKAAEYRLEGSEKNVRIAKSSYYPQLSFSAGLGTNFYTVNGNAGSNFGNQMKNNLNKYAGFSLNIPLFNRLATRNRVRTARLQQTNLALQLDNTKKVLYKEIQQAWYNAIAAESKFKSSESAVEASQESFRLMSEKFDNGKATSVEYNESKLNLTKALSDRIQAKYDYLFRTKILDFYKGQPIE

SEQ ID NO: 10165 - protein, 119 aa, B.fragilis
TTMDLIKIAEEAFATGKQHPSFKAGDTVTVAYRIIEGNKERVQLYRGVVIKIAGHGEKKRFTVRKMSGTVGVERIFPIESPAIDSIEVNKVGKVRRAKLYYLRALTGKKARIKEKRVNG

SEQ ID NO: 10166 - protein, 117 aa, B.fragilis
  UNSURE (110),(111),(112),(117): Identity of amino acid sequences at the above locations are unknown.
IHSLHIEMGKYRTKGSIALIITGSVLILVLAGLYLGRNGILCRTADKRILYAEQKYGLSICYEDLRMKGLNEIELKNLSIVPRNRDTLLTLHTLNMHLNFWKLIRGSLHXXXQQRSX

SEQ ID NO: 10167 - protein, 266 aa, B.fragilis
VLKDMKQNYAKIISGFILAGLLTFSSCQSTHEMAKTDYQIAKVEGRMIDIDAKWDTHPDADAVAILKPYKEKIDNMMYEVIGSSEQKMDKGHPESLLSNLVAEVLRQAATKVQDKPADMGLVNMGGLRNILPAGDITVGTVYEILPFENSLCVMKMKGTHLKALLTSIASLKGEGVSGIRMEITKDGKLLNATVGGQPIDDNKLYTVATIDYLADGNGSMEAFLQADDRVCPEGATLRGLFLDYVRQQTAAGKKITSALDGRITVK

SEQ ID NO: 10168 - protein, 724 aa, B.fragilis
STMLKRTFILIGLVLSFCSLPAQELIQITTRNTALVFRVANQSLRQVYYGPRLADTDVLQKQGNNFPAYSTYGMGEQNEVALHAVHADGNTSTLLNFENVKQESPEPGITLTTISLKDPLYPFQVKLFYKAYEESDLIEQWTIYQHTEKKPVTLYQFASAQLSFKSSSYRLTHFAGDWAGECNMSEVELTEGIKVIDSKLGTRATFFAHPMCLLSLNGRMTEDNGEVIGMALAWPANFKLEFEKNNNQELRVLAGMNPYASHYKLKKGDVFQTPSFLYTYSTKGNGQVSRNFHRWARKYGLRHGENSRYTLMNNWEATYFNFNEPKLKSIIEDAAGMGFELFLLDDGWFGQKHPRNNDDAGLGDWVVNKEKLPNGLGWLVKQCTDNDIKFGIWVEPEMVNPQSELFEKHPDWVIQQPGREHILFRRQLVLDLSNPEVQEFVYKSVHDILKDNPQIAFVKWDCNRAVTNPGSTYLPADEQSHIWIEYGRGLLNVFKKVRDSHPDVHFMLCSGGGGRLDYGSLRYFEEYWPSDNTDALQRILIQWGNSQFFPSIAMCCHVSASPNHQTGRTTPLKFRFDVAMQGALGMDLQPSTMNEKEVIFAKEAIKTYESIRNIVFTGDLYRILSPYEGNRTSMMYVLPDKSRAVFYAYQLKSHIGEVSAPMRFKGLSPDKKYNVKELNIYPGSRAATGSANGQSFSGDFLMNQGLPIGLSGDYSSAVIELEQQ

SEQ ID NO: 10169 - protein, 1029 aa, B.fragilis
VLIGLGISAGLLSPNYVFATSLETYENQSVAAVQQARKITGTLTDAVGEPIIGATVLEKGNPSNGTITDINGKFSLSVHPNAVISISYIGYITQNIKITNQTSLKVVMMDDTQALEEVVVVGYGSQKKANLTGAVSSVKMDEVLGDRPILNASDALQGAVPGLFVSNGGNAPGTSKSFQIRGAYSVGVKNSDGSYGNTIKPLVLIDNVEGDLDMVNPEDIESISVLKDAASAAIYGARAAGGVIVVTTKRPKGAAKFSLNYNNNFAFGTAVNLPKQAPLMDYLQAYLDCGYSDAYWSLGSPSVSKWMEYLSEYQKNPSAFNTVGDGIYMDESGVPYYLNEKDLYKNFMETSFQMTHNISASGGTDKLRYRISGGYTSNDGVLVSDRDKFERMNINTFISADVTNWFTQEVTMSYAHSLQTSPGGMGGVYNTRLVSYYPEGDLPASVNTLANEDLPLFTPRNQILLSNPVNNNNDNPRIFLKSILKPLKGLEAVFEYTFDKNIYDYHWYTGQYDYTTIQGGSSKSFVDDYLRKYKQHTNYNAINVYATYSKKFGDHNFKVMAGFNQESSYQETLDAYSYNQAVIDVPAMGSGTGTIKATDSYSEYAVRGGFFRVNYNYQDKYLLEVNGRYDGSSKFPKSSRFGFFPSVSAGWQIAQEKFMESTRNWLDGLKIRASYGVIGNQNVNPYTFTPTMSVSNKSTSWIIDNTYVTSISSLPALVSQNFTWEKVGTVNVGLDINLFNNRLNGVFEWYQRNTNGMLAPGVQLPAVVGASAPYQNTADMRTRGWELSLNWRDQIGKVGYRLGFNLSDYKSKITKYDDNATTKLLSSFYPGQVMGEIWGYIADGYYSVDDFEDTSSWKLKEGITSINGYNVRPGDVKFKNLRDDESSTNVITSGDNTFDNPGDRKVIGNTTPRYQYGINLGANYAGFDLNVILQGTGKRDYWISNVLTFPMNGDNFIPLFDGLSDYWMPKDPDNGDWTAVNPNAKYPRLYGNRGNSGSNLRQSDKYLSDASYLRIKNITLSYNVFTTGL

SEQ ID NO: 10170 - protein, 202 aa, B.fragilis
IIDIFVDYFNLKTTTSMRIKLLFLISILFCTGSYAQETVTEPDFIGEVLVLNPDNSTTPLEKATVKIKTKANASIYLVGMGKVKTKINVDGPSAQVRLHQGDDFKLIVRAVDNNTDPMSIINIFQFETGKKVRKAELSSLSTFGGASSNNLELLPYTAKKYGESSYLITLKEKPVGEYGITVRNPNSLDEKNIIVASFGIDQ

SEQ ID NO: 10171 - protein, 538 aa, B.fragilis
DRFISGSLGTESIKGETSGGPLSEYTRVYRIKRRYRDNLNSSFNKNKNDMRNIQRTILWIAGLLFCLPSSSSNPVVIGNSRFTFITDHLVRMEYAQQGKFLNDSTLFAVDRTPRCTEVKVERKEGNRYIMTTPAMRIEYYNDGFPFGQTNLFVYFRNGDSPKEKRWYIASRQSRNLLGAVTTLDDVEGPIDRQEGLLSRDGWYLINDTGKEVLKNGWVATRDRNHVQDLYLFVYGNDYKAALKSLQAVSGPSPMTRKYVHGSWYCRWWNYTDEDYRQLVREYREHDFPLDIMVFDMGWHTQNAKVGTGHAGTRGWTGYSWNRKLIPEPEKLIKDFKDDHIYVVLNEHPHDGIRPHEDSYQAFVRDLGVDTQQTGVPLFDAGNRDYMNAFMKHAHQESDSMGVAFWWLDWQQDYLYPLVRGTNMKHLPWMNRIYYNYSSGNHLRGAGFSRWAGWGDHRHPIQFSGDAVGNWDLLRFEVDLTTTSGNAGCFFWAHDLGGFYDGTDPELYTRWTQFGLLNSSLRIHSVYDENSTAVPGSGA

SEQ ID NO: 10172 - protein, 436 aa, B.fragilis
CLTIRQGWIHEIKTDINMIDIWQEIYGTIKRNKLRTLLTGFAVAWGIFMLIVLLGAGNGLIHAFEKSSSARALNSIKIYPGWTGKPYDGLKEGRRIQLDNKDLDATMEHFSDNIISVGASQWQSNVNLSYGQEYVNLSLEGVYPNFTEVESVKSTDGRFINDIDLKERRKVIVLHTKTAEILFGKSKTEPIGKFVNAGGVSYQVVGLYTDPGDQGSSEAYIPFSTLQVIYNKGDKLNNLTFTTKGLTTIETNEAFEAAYRKVMGAKHRFDPSDNSALWIWNRFTNYLQSQNAMGILRTAIWVIGIFTLLSGIVGVSNIMLITVKERTREFGIRKALGAKPFSILWLIIVESVTITTLFGYIGMVAGIAATEWMNKVAGEQTVDVGMFSETVFLNPTVDISIAIQATLTLVVAGTLAGFFPAKKAVSIRPIEALRAD

SEQ ID NO: 10173 - protein, 280 aa, B.fragilis
SRLIMRVDMDTCEEILVTITRNKTRSLLTAFGVFWGIFMLVALMGGGQGMQEMMQAEFEGFATNSGFMASQKTGEAYKGFRKGRYWDIENADIERIRKKVKDIDVITPSIARWGSTAIYGEKKYDCSVKGLYPDYAKIENQDMAYGRFINDVDVREGRKVCVIGKRVYESLFNPGEDPCGKYVRVDGIYYQVIGMCVSEGNMNIQGRASEAVVLPFSTMQQAYNMGKRIDVICYTVKPGKKVSDLEPEIEAILKEAHYISPDDKQAVMKLNAGGHVLNDG

SEQ ID NO: 10174 - protein, 183 aa, B.fragilis
EKKIATQEVWLPGGTDWYNFFTGERQEGGQVIKTKSPLEQFPLFIKGGCPLPMQPYTERMCSTPLTELIVRCYPGKEGANNTYILYEDDGLTQDYLQGKYATTRLNYQKSGGQTIITVSPVEGTYEGQPRKRAYRIELPGIPVQARVSVNGKKARTTPNQELNGVIVPIKVMDIHKPIVIKIQ

SEQ ID NO: 10175 - protein, 116 aa, B.fragilis
  UNSURE (92): Identity of amino acid sequences at the above locations are unknown.
PWRILRRNRPGTLHSLDTVRIAEFFTPHPLGVRRKLDRRPWLWGVEAEKAMHRIYHLRSQLMPYIYSSVRQCHTDMLPLNRGMYIEYPDEEXAYQYPGQFLFGDLLLGAPITAKGE

SEQ ID NO: 10176 - protein, 291 aa, B.fragilis
IMIFPINKKHTFFSKEKTLLTFFFILFISFSAFGQQDKKLILLQTSDVHSRLEPINQEGDRNYDKGGFVRRATFVKEFRKEHPDMLLFDCGDISQGTPYYNMFQGEVEVKMMNEMKYDAMTIGNHEFDFDLDNMARLFRMADFPVVCANYDVSATVLKDLVKPYVVFERDGVKIGVLGLGCQLEGMVQANKCVGVVYNDPVTVANEVAALLKEKEGCDVVVCLSHLGVQYDENQLIPKTRNIDVVLGGHSHTFMKGPKTLLNMDGKNVSLMHTGKSGIYVGQMDLTLEKKK

SEQ ID NO: 10177 - protein, 114 aa, B.fragilis
MNNSKIINVRLMKKVLVLVLSFLSVTAFAQNITVKGIVKDGTGEPIIGGSVLVKGSSIGTVTDVDGNYTLSNVPADGVLEFSYIGMKKQDVKVSGKTVINVVLQEDTQILDEVG

SEQ ID NO: 10178 - protein, 118 aa, B.fragilis
AGEPAFCDENPIDCHFDVKSYPAGTTVHNNDTNIIYLIFCMKGHARITSTFFHDEILCAGEVMFVPRGSEYSGVALSDVTLLVHKFNNTVCQTENCILSYLYSHKNIDSKIYCCQRRT

SEQ ID NO: 10179 - protein, 301 aa, B.fragilis
RRQAMMNKFLNTKVLYIFISVIIFIMVFLLVMRACSQKQPIQAVVTPSDPVVGEEIFFSDSTSGARIWYWEFGNNETSTQRSGHHRFKQKGVYKIRLTVNGNLERYFDVRVKEKTNTEDLHLVHIIAPKEAIQGENIIFRGEGHDEQWRWEFGETGMIDSREKTALYAYTEPGEYEVLLNTENTRYPIRHRINILPYYSENDSTDVMVLIGLDIKEKLQNIADGKPFNVNYNYVVDKYFNNNPNTLVVINNNKYNDFYSYCQGLHHIGRKETIIQNVIVETEDEESGYITQLTVMQIEKKK

SEQ ID NO: 10180 - protein, 311 aa, B.fragilis
TGNKPMIKTVITQLYIAFCLICFFACEKQKEEFPDIRIGKEGVVDELSLNKQTEKRLLLSGGNGKYIVNVENAQIATADISMDTLKVKGWLEGETFATIISHDKRIRLKINVVFPELGISHSVVQLLPRFRSKFISISGGGELTKLEEDDPADIMDMKWDGSTGMLEIYPKYEGEARVIAISEDAKEKKVIHIKVRPEGKLEIPGWYSTNSSSYYLIQNNNMVVKRKGVGTWIVNSARPYGGGVMYNSSYIKIAPIMNPVQGDSIDLNILRHGSLKPQITEGIHRLYVEEVRESEVMLRGRGFKFLLPYEK

SEQ ID NO: 10181 - protein, 281 aa, B.fragilis
RLCKSKKRNEMRKLFVLLISIVVLSACAPVHRFTQLRKLPREYSDNYSIEGIKAPRSAAHRKPWIVYSDRVENAAYVNPGGRVKSAEVGLLDTFLVIKTKGDYLRLIKYNPTNIKHNRMTQRKKAEYVGWMHRSRLILSPSSITDVQSGLHDKLLTAITDTTAIMQSATYFTTADSLKVFGDPELQNQTGVVGIHAIIYALKHSVDKRSVLVSKTPSLSADKIGEQVIGWVPAVMLQEIGHQVFTGTAFSRVPTLQKTLKYAPMIYPYHTDSTCSFVSGTL

SEQ ID NO: 10182 - protein, 518 aa, B.fragilis
PVIDKKDNHVFNINGKRISYTRGNQIKQELKRINILFAMEQSSRLPEQYPMLLNAIQNLGPFFAGSGESFSYQFGAAVATPRGMETIPLTADYEILIDRLVKMASYVADTENTPLPAWKAMRSALELIGNTPEAVNLIISVGETGEQQENAPSSIVKTLNEKNCRLLGWQLYASNDDKYNNYVLQLSNMIEHYAEYRTKNKRNMILYADQFCRSNLLREAGPNFLMLDYPYASMTQGGFLFPEKGETLPMELFAGAVDSIVTQIKADHQLLSESIDRAFATVGNGKDRLDSLLIATYHLPQGVKPNKEFKKIFGDVAPIWYRKTERITVPDSLMRYYLLLSDPELKQTIERLETLCAIEVDVKDMNKPKKGKVKQLCRYLRERVRPDKVETLGASPANPESKADTVYVSTGKIRRHLYRFYMSELRNCRICKNKRKEIRRYSLSYAHSQIFGVPANSPVLDDITVKELKKKKQLTDKELDGLIQYFKERKENMAKKYGEEKITMEGQSYYYIASELLP

SEQ ID NO: 10183 - protein, 179 aa, B.fragilis
NRKDMSITPKNKSSKTVSERERFIGFVYVLTLLIVITGACGFILFKYAGTRHIFSNKIMVIKKMERQKEFQNIQSVQIVSADTLFSRIEQFEPGVNASYEENDIKFLINDLAKQWEKNSFDKRNKMFWHLASVYEMWFADKKELWSKQDNIIKFKKNLEECEVGLQKKEGELKNKGGKP

SEQ ID NO: 10184 - protein, 106 aa, B.fragilis
YGDCADPSSPVVEDMGSNDRLNQVVLQKVISTRKMELIEELQIMDSKDVLLYKKLASQINVFLDTKEAIRKAVIEESLVRKDLMRCIQDNKQATRKLTLGNIIVEK

SEQ ID NO: 10185 - protein, 318 aa, B.fragilis
RNRLALPPRVKTERRPESTGVYALKIWLNGGSVFLAQPVSVKAGKQYTLSFWNKGSVGNREIVVTLFWYDNGSIKSREKILSIRTGKDEWRRVESTVTIPENIHSMGMGIRTQSYQGYMLIDDMSLVLKESGPDISAVPEAPDNLRMKAYQNEMEICWNKVSDETIKWEVVFDDHVETITFGNSYVKTKLIPGSTHHIKVRAGKGKEFSPYAERRGATERMREAENSEDRIPYLRTILPDGSCEGRFLKLYYNELANPNAKVSYKLDGVTIEPKDNTLEFPEFEGFYKRFRLEVYIDEGEGREWEILYPHLGVKRNEK

SEQ ID NO: 10186 - protein, 64 aa, B.fragilis
VMLRCWFINSITQSARQKTVSFPIFIRTRILIPKFIVAKEERKKHVYSLVLVTILIKFYCKYKT

SEQ ID NO: 10187 - protein, 624 aa, B.fragilis
GPIFLSGMNIQDAERSLRREFSKIYAAIPQKTVHIELSLGRIRTIMINVMGEVKVPGIYRLSAFASVFHALYRAGGISDIGSLRDIRVVRDGKEIVRVDVYDYIMKGKLTDNIRLSEGDVILVPPYQNLVSISGKVKRPMKYEMKSGETVATLLSYAGGFTGDAYRSAIRLFRMGGKAKQVYNVAQDDYQSYLLADGDKLSVEAVLERFSNKVEIRGAVYRAGIYQLDDSVTGTVRQLISKAEGLRGDAFLNRALLRRQQEDLTHEMIPVDLKKMMDDTSADLCLQKNDVLYIPSVKDIEKEGTLSIYGDVRVPGEFPYVKNTTIQDLIVKAGGLPESASMVRIDVSRRIKDPGSILSSNVIGKSFTVELANGLLIGEDKGFELEPYDIVFVRRSPGYRKQANVTVEGEVVFTGNYALTKSNERLSSLIARAGGLSKEAYVRGARLIRRMTADEIRRKQDVVRLLVKGSEENSISPVALETGSTYPVGIELEKALINPGSDEDMVLREGDVLFIPKYVSTVTISGAVMYPNTILYQKGSNLDYYIEQAGGFGNRALKRHIYVVYMNGMVSRLRKSAVCAIEPGCEIIVPSKENRKKTVPRDVAGMNTSIASIAAMVAAMVGMIK

SEQ ID NO: 10188 - protein, 132 aa, B.fragilis
KKCVSRKSCYGEEVSNFCSLMKSEIFVRFVSCIAKKVSCLKDMILKKTNDKGALLFALFILLAGGSRARQHMKDDHVIRGKQVAVFGRNIFTARNLSFEPSLDIPTPEKYVIRSGDELIIDVWGASEIQSGK

SEQ ID NO: 10189 - protein, 316 aa, B.fragilis
YTEPRCEDAVSAFLYYRKGYDMGADFYQVVIWSFIVLAASEAIYGLRQLYGFTSSHHSLYSLTGSFFNPGPYSGYLAMIFPLCLDQWLRLRKRENKNWMEWTGYYGAVAVLFLILCVLPAGMSRSAWVAALISGIWVYGAHKSWPVRLKRVWMRKKTKVLAVTSVLCIVVLVGGVCLFNLKKDSASGRLFMWKISSRAIAEKPFTGYGQGNFALAYGTSQEAYFAERSYSPQEELVAGSPEYAFNEYLQIALEWGIPVLLCCLAFAGFCLQRGVELKRWGPCGRGISLLVFAFSSYPMQLPAFGIAFLILLMACFA

SEQ ID NO: 10190 - protein, 508 aa, B.fragilis
DPVLLCGEPKTITMKKIYSILLASALTLSSCADFLDVDSQGKLTEDVFFSEEEGALMSINAIYTQLRAWDIIGFSWFAITELPGDNSDTGSELADGSVARLNQFNDFTYDASTSEINGWWEGNYKAIASCNVALDNLGAVKNEELRVKCVAQARFFRGFFYFNLVRAFGGVPLVTKVLQPGEYNQPRATEEAVYQQIIEDLTYAAEHLPTRQEWGAKESGRATKGTAEGLLAKVYLFRQDYANVKKYTGQVIARGEYSLHRDYRDLFNPNSYYSDEVMLADQYLWGESTERNLESEYVKWQGIRGEMGWGMFSPSEALDQAYEAGDPRRTATIFYDGETLEGKGEIHFKKEVPPRANKKTIWPTGYWNENSFAKQNCHLIFLRYADVLLMYAEACNELGESREALDKLEMVRARARRTVHPADMTVGLPEITETGKEKLREIIWNERRIELALEGHRFFDLIRADKVVPGYAEKMMKAHGKTNFSIAKHATFFIPQKQVDISQGVLKN

SEQ ID NO: 10191 - protein, 572 aa, B.fragilis
VTFTSHFNEKCMKKFLNRRNGVLLAAVLVAVAFFSFKSGDDRNFQIAKNLDTFNSIVKELDMFYVDTLDPNKTVREGIDYMLSSLDPYTEYYPEDDQAELQQMLNASFGGIGSLITYNQKLKRSMIAEPFEGTPAAKVGLKAGDILMEIDGKDLAGKNNQEVSQMLRGAVGTSFKLKVERPDEKGGTRPLEFDIVRQTIQTPMIPYDTIFNKNVGYINLSTFSGTPSKDFKKTFLKLKKEGITSLVIDLRGNGGGRLEEAVEIANFFLPRGKVIVTTKGKTKQASNTYKTLREPLDLDIPITVLVNGATASASEILSGAFQDFDRAVIVGSRTFGKGLVQTTRPLPYGGVMKLTTSKYYIPSGRCVQAIDYKHRNEDGSVGTIPDSLTTVFHTAAGREVRDGGGVMPDIEVKQEKLPNILFYLVRDNLIFDYATQYCLKHPSIPSPQEFKVTDADYNDFKAMVKKADFKYDQQSEKIMKTLKEAAKFEGYLDEASEEIKALEKKLTHNLDRDLDYFSKDIRSMIADEIIKRYYYTRGGIIQQLKDDDGLQAALKILADPVKYKETLSAPVKK

SEQ ID NO: 10192 - protein, 71 aa, B.fragilis
YRITMKQFVLFFISLFLLGVGARSQEMYQKKVFISSRGDSLNYRLLRPEVEKTGLRLHHGAGRIQRWMRFQ

SEQ ID NO: 10193 - protein, 149 aa, B.fragilis
LVQTGAVGSNAGKRVVQAEVGAVVPPVVYYPCQSFDGKVAEHGERYSPLNFKVAYGTSHQIGFAVTEKPVEISLHDVDGMNAPERCQLFVHRFVGDDGIRHVIVSVEVPPIRESDTPVHLEQIAVSTLIAGQGIILFQVRHLLQLFIET

SEQ ID NO: 10194 - protein, 772 aa, B.fragilis
IDTKTVKTMKHFVRRMQALAASLVVVAAGLQAQKAPRDMDRFIDQLMKKMTLEEKIGQLNLPVTGEITTGQAKSSDVAKRIRNGEVGGLFNLKGVERIREVQRQAVEESRLGIPLLFGMDVIHGYETIFPIPLGLSCTWDMKAIEESARIAAVEASADGISWTFSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGKLTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 10195 - protein, 948 aa, B.fragilis
LMKNLLLFLVFACTFSFSCLGSPVPFSPIVRNYSVLDYNAGNENWAVAQDERGVMYFGNNSGLLRYDGSRWKLFPLPTSGIVRAVYVASDRRIYVGSFEEFGYFEQNDLNLLEYHSLKEQVKGFDFHNDEIWTIVEQGGNIIFQSFGSYFIYDGKGTKGVRCPELPLNLFRIGDTLYSQLINGGVCTFAGDKFIPLISRQELGDSDVLAGLPYPGGMLLLTRNSGGYIHTSSGIRSWHTDSDEELKRHTVNRAVMTKDSCYVIGTISNGLYAFSKEGHLLWKENADNQLENNTVLGLYCDMDNNIWTALDNGIAYVRNNSLIYHFEPVRRKVGMVYDVLVRDKDAYIASNQGLYRLEDTRLELVPGLEEQAWTIGEWGGQVLCGHNKGTFQIKGMQARLLSDVRGAMCMRQAQINGEQLLIQGTYTFLNIYKKSAAGEWYFANSVGNFSHMAKNIEVDAHGNIWVQHMRKGLYRLRLDEELKQVTDLKQYDSLSGNQGGNCYLFKVNGRVAFSDGRNFYTYDDMADSIIPYKAMNEQLATLRGIHTVDVMKGDLYWFLSDREAYLVRCTVSDFKVERRIPFSMFGNLPIEGLARIVYDRRNDCSYLCLNNSFARIAADSTGLYKSRQKPSLWVSGFSASDEQTGERIQLPVSGTDEIASAFNNISISLAYPVYNDFALNVRYRLEGLSASGKWTEGLPDLQKEFTRLPFGSYCFRAEVYDENGVISSVDLPFRILRPWYLSYPAVAVYALSGIALLLGLLYGVYVYTKKKKDVVIERQRARHEAEIEQQEKKIMELEKEQLEADLRFKSKELSGVVMTNIAHQEFLNSLKEELQQQKLSGQYTRKNLDKLLSMINQNMVSDEENWNMFQSNFDRIHENFFRNLKEKFPDLTSGDLRLCALLRLNLPTKEIAKLMNISVRGVDAARYRLRKKLGLPPESSLTDFMIAFK

SEQ ID NO: 10196 - protein, 360 aa, B.fragilis
AKEECFVFLNCDAKVIGYFEICNIFAKKISEMDKIIGLGNALVDVLATLKDDTLLDEMGLPKGSMQLIDDAKLQQINERFSQMKTHLATGGAAANTILGLACLGAGTGFIGKIGNDAYGNFFRANLQRNGIEDKLLVSDLPSGVASTFISPDGERTFGTYLGAASTLKAEDLTLDMFKGYAYLLIEGYLVQDHDMILHAIELAKEAGLQVCLDMASYNIVAGDLEFFTLLINKYVDIVFANEEEAKAFTGKEDPKEALELISKKCSIAIVKVGGNGSYIRKGTEEIKVEAIPVKKVIDTTGAGDYFASGFLYGLTCGYSLEKCAKIGSILSGNVIQIVGTTIPGERWDEIKLNINEVLSE

SEQ ID NO: 10197 - protein, 824 aa, B.fragilis
KQIRMKNVLTGLFLLILATACSEEEPQTITPVPFNQVTLTDGFWKNRMQTEINVTVPFSVEQSAPAVERFRRCAAFLAGDSTALPETHRFISSDLYKVMEGVSYSLMIQPNKELEEFMDRVADLITASQKDDGYLYISHICGNPDPREMGEKPYSWVVHSHELYNVGHLYEAAVAYYQATGKDKLLNVAIKSAKHVNKVFFEGGDPNYNGGKPINQAPGHEEIELALCKLYRVTNDPLYLDMAKKFLEIRGVTYRPEGEGVMAPTYAQQHAPVKEQTEAVGHAVRAAYLYTAMAQVDALTGLNDYTKALNSIWTNLVTTRMHITGGLGAVEGMEGFGAPYELPNLTAYNETCAAVANVFFNYGMYLDSGDAKFLDIAELSLFNNSLAGINLHGDRFFYVNPLEADGVRRFNHGNGGRAKWFGCACCPPNISRLILQVPGYMYAYSKDRVYLTLYGGSQTTIPLEGTRVKLEQTSAYPFDGKVRLTVQPEKGSKFSVCMRIPTWARSDEFVPGGLYPYKQPKQAEVELSVNGQKTDFKMEKGFAVIKRDWKPGDVVELNIPMPVRFVDCIPEVSENIGKTAVTRGPLVYCAEEVDNAGPVQRLYLGDTNEAQAKVANISSGVLQGLERITLPGMEKKVGGITSREITMIPYYAWCNRGDNRTMLVWLNEEASTASIGQQTMAYLRNVKGVNASSVAGGKNISVRALCDGKVSESSADKLTEQWVSEGSGKQWVQVDFREPFLLNSLSVYWLDDQDKITVPSGWSVEYKSDAGWTPLELYVTDSYQMGTDRFNVVHPSGSLEVESVRILIEPQKGKSIGVSEIRFE

SEQ ID NO: 10198 - protein, 1009 aa, B.fragilis
VCSRILNQYQTMKKNLFTLCMMLLLSMLSFAQGSLTISGVVTEKKTGEPIIGASILLKGQSSGTITDFNGNYSIPNVPSGATLVFSYIGMKTQEVKVTASSKLDISLEEDNQLIDEVVVIGYGIQRKSDLTGSVGAVKSKDLTKVATPNVANALQGRVSGVYISANGAPGSSPEVRIRGIGTTNNSNPLYVVDGMFMDDISFLSTHDIESMEVLKDASATAMYGSRGANGVIIVTTKQGTEGKAVVNFTASEGFQFNNSSFEMANATEYATLLNEALVNTGGKPKFDDPASLGKGTNWFDEIFRVASVRDYQLSVSGGSEKVRYNLSAGYYQQDGIITGNTYNRFTLRANNSYKISKRLTLGHNLSASFSHKKNENSAVVKAAYTISPVKRPYNEDGSFMDSESASSANPVATLHYTNNDDWKERIVGSAFLNWNILNGLDFKTSLGIDYINGRRRNFVPKYYVSETQKNETNSLSKTWDRDFTWLWENLLTYDWKINDKNRLNLLGGITAQKRVYELLEGTGRDFFSDNENYWYLDQASAGSKSVANNGYHETMMSYLFRANYALMDRYLLTVSVRADGSSKFGPDNRWGYFPSVAAGWRVSEEAFLKDRVQWLSNLKLRGSWGQIGNDKIGNDKYRALANISPSYDAVFGGVFYPGGTITSLSNRSVHWERSEQMDLGFDLGLLNNRFSLELDYYRRDTKDMLVTVDVPASVGLTPVETNVGAVRNSGVDFTVKWEDSLKDFRYGIRLTGTTIKNEVISLGGKRIASGDIGAGKSVQMTEEGKPIKYFYGYNVIGIFQNEAQIKEYNERAAAATGNSGQQYQNNVGPGDLIYEDVDGDGYITANDRKDLGSPTPKFIGGLGISASWKGFDLSIDFQGNFGNKIFNAKQVERFSGSDNWDRSFLDRWTPENPNTMTPRMTLEGNNYQVSSRYVESGSYVKLQTVELGYTFPKSWMQKVSVQNLRVYFSGNNLAYFTGYNGFTPEVLGGIDRQIYPVTATCRFGLNVTF

SEQ ID NO: 10199 - protein, 576 aa, B.fragilis
ITTMKQLFLLLLALGAPALALAQDMRQDTYCNPLNIDYTYMIYNSDKDISYRSGADPAVVRFRGEYYMFVTRSNGYWHSKDLLDWDFIAPKDWYPQGSNAPAAHNYKDSVLYVTGDPSGSMSILYSDNPKSGEWKATPAILHNLQDPDLFIDDDGKAYMFWGSSNVYPIRGMELDKNHRFLPKGEVKELFNLDMPRHGWERFGENHSDTVLGGYIEGPWLTKYNGKYYMQYGAPGTEFNVYADGVYVADHPMGPYTYQKHNPVSYKPGGYMNGAGHGSTVQGPGGEYWHFASMALSINVNWERRLCMFPAGFDKDGIMYVDTRFGDYPRYAPAVPGKKGQFRGWMLLSYRKPVTASTAKGEFGPDALTDERTKSFWLAEANDERQWVLIDLEKPARVCAVQVNYHDYRSNLYGRIPGLRHRYVIEGSSDGETWNILVDRRSSYKDTPNDYVELEVPTTARYIRYKNIDVPTPNLAISELRVFGLGFGKAPRSPQKLALDRHTDRCDVTVRWEPVKGAQGYNVLWGIAPDKLYSSWMVYGGNELEMKSLTIDQDYYFAVEAFNENGVSLPSETKYVE

SEQ ID NO: 10200 - protein, 514 aa, B.fragilis
VRRMSFIPNKEEIASLEYYEENYVWGQLQRTDEEYPYPYGIYGSENWYQNRSGKYGGYEDGGSGKGRMWRTFDYTTHFAIYYNLYRIAEDNPEMVSYLDADGYLERAYRTAIAYFEVPYNILMGKQWAFHGWTDWAYKQGNFHERYLLDIINALQQKGRLKDAAKLRREWEKKVTYMVYEDPWPFGSEMFVDRTAFESSYYVAEYAKLNPIKPEEQFWYDKNRKKWYSYTSFDTSMIDRFMQNQLDGNLALRGLFEPGYANLGTAWSGQYVNLDYMTQMGGVALLDYAYRFSDRPDRYINYGYNSLLASWALMNTGTKKTDFGYWYRGEQNDGAVGWAFSPYQNSRTYMNYIKVGRAPWRFDGEIDHGLTGGIHGSGVYLLDDPDFGLIGYGGNVRMDKDGTVSIIPFDGVRRQVRIMTPVRFSVELMQDGFRKDYPITLRGTEELSFCIENRSDKPHNTTIRAEGMPEGKYTVMTDHKMITTFNIEAGNAHHPYYIEVPVTDKHTQVKLLKTN

SEQ ID NO: 10201 - protein, 437 aa, B.fragilis
NLELTTTMKHTLLFLLMICACTLQATATGKQPRLTDDELMTLVQKQTFRYFWDFAHPESGLARERSNDRLEIATIGGSGFGVMAIIVGVERGFITREQGAERLLKIVEFLNKADSYHGIWAHWMDGTTGKTIPFSRKDDGADLVESAFMFEGLLAAHQYFTHDNPTENRIRGLINTLWHQAEWDWFTRGGEDVLYWHWSPNNGWAMNHQLKGQNECHITYILAASSPTYPIRESVYHKGWANSITFKNGKEYYGIRLPLGTDFGGPLFFTHYSYLGLDPRGLKDSYADYGEQMKAHTLINRAYCIDNPKKYKGYGRKCWGLTASDNHQGYSAHCPQNDLGVITPTAAISSIPYTPEHSLEAMRYFYEELGDRLWGEYGFKDAFNLTENWFASSYLAIDQGPIIVMIENYRSGLIWKLFMSHPDVQRGLKRLGFGSEE

SEQ ID NO: 10202 - protein, 113 aa, B.fragilis
SLHAPQLPFHYGYPCREKYVHHTYHPTAMSHTGYNYGHYQPFRLHGPTHSDRLSSSSVNNYKYIGYNYSEYTDPRSSSGEGVDGRMREYQTTTVRRYSNHMIRFNKMFGKHSI

SEQ ID NO: 10203 - protein, 89 aa, B.fragilis
RMKNSACHCVLVRVAEKADNARNYSQCDSLLLGDKCGAHTFPYMDIHNETAVVEHEATTSKISEDQIFYCNQGGTNGFPRGLQRAALFI

SEQ ID NO: 10204 - protein, 77 aa, B.fragilis
RLIDTASVYGNERAVGMAIRKSGIPREELFITTKAWISEMGYERTLRALDTSLARLGLDYLDVYIECLPNILLKRII

SEQ ID NO: 10205 - protein, 187 aa, B.fragilis
GAAPSSPVVKTFADGFEEIEALTTIDTLRRAGLDVEIVSVTPDEIVVGAHDVSVLCDKNFENCDFFDAELLFLPGGMPGAATLDKHEGLRKLILSFAEKNKPIAAICAAPMVLGKLGLLKGRRVTCYPSFEQYLDGADCTNEPVVRDGNIITGMGPGAAMEFALTIVDTLLGKEKVNELVEAMCVRR

SEQ ID NO: 10206 - protein, 134 aa, B.fragilis
DCTHFQVFIFMEFRRDNFPFLLTKNQFMKKVLFILLGCLLSFNVMAQVKAISGLVTDVTGEPVIGASVVEVGTTNGVITDLNGKFSLKVAPNSQFLVSYIGYKQQTIKVGSESTYNIVFTTGLEGSALAIRSEN

SEQ ID NO: 10207 - protein, 70 aa, B.fragilis
SPLSVSVRFPSALSAGNGDVRGLWLGAGLVSLGAAFLLDKKYEMTSDLYPVNVCYNVMLAVEPECPDSRL

SEQ ID NO: 10208 - protein, 374 aa, B.fragilis
EDITHIPVIEDSASVSVTADSVAVKRSFFKKFLDYFNDANKEKKNKKFDFSVIGGPHYSSDTKLGLGLVAAGLYRTDRADTLLPLSTVSLYGDVSTVGFYLLGVRGSHIFPKDKYRLNYNLYFYSFPSLYWGVGYRNAVNDENESSYKRFQAQVKVDFMFRMAKNFYLGPMASFDYIDGRNFEKPELWQGMDARTSNVSAGLSLVYDSRDFLTNAYKGYYLRIDQRFSPAFLGNDYAFSSTELTTSYYRRVWKGGILAGQFHTLLTYGNPPWGLMATLGSSYSMRGYYDGRYRDKNVVDMQVELRQHVWKRNGVAVWVGAGNVFPDFSSFKVKHILPNYGFGYRWEFKKRVNVRLDLGFGKGQTGFIFNINEAF

SEQ ID NO: 10209 - protein, 69 aa, B.fragilis
LKRAPGNPPNGGKQLPQLFLQKKFFSPVSQRKKGKYRARNTLFNEKRPYITLEKKFVGYKEMEWSKAIN

SEQ ID NO: 10210 - protein, 187 aa, B.fragilis
GLEKARPDLYLISMKLFNSIKKWFGNQENLFYLFLFVLIVPNVVLCFTEPLPLVAKIANVLLPLGCYYLIMTLSRNCGKMLWILFLFVFFGAFQIVLLYLFGQSIIAVDMFLNLATTNSSEAMELLDNLLPALITIVILYIPALILGMISIVRKRTLSVGFIRRERRRAWVVAGCRSGIVGSGLPVG

SEQ ID NO: 10211 - protein, 68 aa, B.fragilis
RDFEGFHFHCRRTHPAEDREIYVLVVGETSRALNWSLYGYDRETNPKLSEVSGLTAFTNVPDPIEYNS

SEQ ID NO: 10212 - protein, 133 aa, B.fragilis
RLLRMCLTQSNTTHKMVPMLMSAVSAENFDSIYHQKGIITAFKDAGFRTAFFSNQGYNTSFIDCFGHEADHCDFIKEDPLTAGQNLSDDYLDDLVQEVLATGTRKRFSRLYPSGIHLNNRNRMLVQTSLILAE

SEQ ID NO: 10213 - protein, 107 aa, B.fragilis
  UNSURE (44),(54),(70),(83): Identity of amino acid sequences at the above locations are unknown.
PSSSQKRTFSCTLSGLYSKRLLPGILLVSLRGGKLKSEFFSPAXRIIETSSPRXIIETPPIAYFNLFIHXEKSMSGGVLVTVXIEILSSSNNFNDSSNLFGQSLEVT

SEQ ID NO: 10214 - protein, 288 aa, B.fragilis
SPIKFLFSYKPKRIFLIDLMALSDYVTSKDCPNKFEESLKLFDEDRISIFTVTNTPPDIDFSIWINKLKYAIGGVSMIKRGDEVSMILLAGEKNSDLSLPPLKETKRIPGKSRLEYSPDRVQEKVRFWDDEGYWKTIILLRFDVLTMELDAKFINKDMGNSFSVLTDYIESFLSEKGEFLFPEAENYLNEQKVKIQNYYPLFEIARTCLHLLSYVEKYTDSLSSEEHITVLGHEPIKPRFFKKDKMVPPKYELRKRDVWNLKRQRDNYSSSIITFKSSPRGWKYQRCS

SEQ ID NO: 10215 - protein, 210 aa, B.fragilis
NAYNMKEHSIKAVRLTPTVKARLDTFKGSDTVSVCIDRMITFFEITGFNPRYASRNPTALVEKRIEDVVRIIKSQERDILKPVLEKLSAINNTPQESPDYARLMNEFRDLKDENRKLKERLQADDLHTQDAAVYHDKLKRLGDLLKYQLDPEKFSTIKYSDDVRVPVNTLQLLIKKINEEYVLVNRIGRYTLRTYRITKINAPGLVDYSE

SEQ ID NO: 10216 - protein, 104 aa, B.fragilis
YPIPTCMMSALSFILYPERSKFALKNKRMKGLTELIVAGCILFGLLLTPLVFSILDFISGVRKARQRGERITSDRYRRSVKKGPVIKPAAVSPGVEDSGVRKVS

SEQ ID NO: 10217 - protein, 276 aa, B.fragilis
KSRYMNNYVKTSVPRPVGNPGNGINPKDVLTLIDIDDLVYFPPRDGAGVVLEGDIVVKPSAYSTDLYLTPGTVELSSNGEGETDAKGFTPSVKGKHPGNKQEVREFKTNWLGRHCIAILQYCNGQDPDILGSPCNPLEMSVNYTGNKDGNASEFTFTQISKGDDIGIYKGTIPHEEPVATVPASATEIPFKGRGQYQLSAGAAKIATIKGAKHGDLFTLLGVVSGVAPTIEKAGQTAFMLKNGKTFTASPGSQITFKAFDTGGGAIQCVEQSRFEV

SEQ ID NO: 10218 - protein, 61 aa, B.fragilis
NGIQKKKLIFHRRRLEIKRASWLKMGTRYLHPCDRSEAGMQARKLDNEILSCNNRLMNLYE

SEQ ID NO: 10219 - protein, 495 aa, B.fragilis
LFLHVQTLVKNSFRRPRRSEAERQLPEGQMVKYDYIKGRQAEGLGTKNRFRYFRKRSGKTRQLPFLSPRQVIESGHVGTGPAAAGLAPDGTPPGPPHHQVLEGVGEVRGEHGQFLGLQLLGLLDLVDDLLLSLVTDTRRRLLDTGDGLATVHRVNKQSGEGVVVACHQLLHEIVLFILADIGLFAAHQVDNPSRAVTVTVYLDGLLELAGVILFLLLEVIARPVVIQVQFLLLMVKEECQELVGQLPEPSGRKLVKVLVKAVQRSVLLSYYQGQLVTEVHAAVDGLAAPEETQVQAALCRFSVPCPVGILVPFPESDIEARVTAKPRTHPHYRLKEVVEFERPVEKATDVLRRKDVDVGKTRGVDEVGLPLAHLQQPRLVPGDFLLKSPAVRPCPSRFYQADAQAVQLRSRLGDTQDALRIDQTDVTEVPVILTLQHVGHVGGNGHPQKIVAASVTYGIPAQYGHGPVDFIVGGVFGFVEEQMNDRFARQKGGVV

SEQ ID NO: 10220 - protein, 115 aa, B.fragilis
IYMNNMERLPADTFFLDLELRQEVERMASLGYAPDDIASYLGLDAESFVFDAGREGTTVYSLMRRGALKAGAGVELKLQEQALSGDLDAMELLEKVRGRRSFEIIVKQIDEDEFG

SEQ ID NO: 10221 - protein, 555 aa, B.fragilis
PTDDVEVRYSHIIKVHHRLDRHHQPGCRRGPAAKSTVIQARRSADCVYDMPGAPLAFVGNTYTNLRDNIMPAVKTGWELMGLYEGVHYVSSCRPPESWRRRCSVIVDDYKNTVSFFNGCIIFLGSLDHPSLLAGKSVVHLFFDESKYAPDNKVNRAMPVLRGDAIRYGCSHYFLGVTITTDMPDVLEGEYDWYFRYVCLVDPQRILRIAQAAAELNSLRVRLVKAGRTRTDCGALKKKIAWYEAGLLKMRKGQTYFINASSFTNIDILTPEYVRRLLDGALELHDFLKSVVGMRPGLRRDTRFYIAFGERHKYTDGTRYGEPAQSCLDLRFLRRGEPIDGGVDFGNQLSLIVGQQDGPLYRLHKNFYELPPGWFRQLADQFLAFFLNHEEKELNLYYDRAGNNFEKQKEDYARKLKQAIEIDGDGNRTGWIVNLMSRKQSNIRQDEEYDFMQELMTGDNDALPTLLVDAVNCRETISSIEKAPAGIRYKGQQKIIYKVKKSEKLEPKKLPMLSTNFSDAFKYLMMRGAWRRAVRGKSGRSRSGPYMPGLDDLTGG

SEQ ID NO: 10222 - protein, 358 aa, B.fragilis
WSDIKTIPLSGNCLVFPLRGKAIAFFQSFVPQPVSGIFTAYHLKFNSMKEQIISYLEGPRDYSQGVALYEQFGPNRMLKAKFRQIGECEMTRGTLIEELRKLSGMSEAEFAGMHRKAHHIPSKAEQPVSPVPVRMYADDLLIALASRLGVTVEKLVSDDFVKERLSQSPDMEQVRGLKEELENAQSTYSEAPETVRKAIRFREEFPFLRQPDCPDELKVLVADMFSAYDLYRESHRMLVETPDDVATGETYLWAKTAVENFLENRQMWEELEYYKNNGEILGKAQAMRQAREKQEISSLTDLELSKQLGNAKSNISKGKNELEKAPDEEKRVKAMEKTRKWTERKNLLEAEMESRKKN

SEQ ID NO: 10223 - protein, 209 aa, B.fragilis
SKSMKTNLVKPSRVNFEKADIGQIGRILATGDLDSLPEEQRAYYDLMEMVRGLRARMRYNGKVITKAGIIRLLKSEVYGLSDWMARQVYADSVNFFYSQENIRPQAFANLYAEKLEKWADSMFLTGKGEEASRILERAARLRVRFACDEQEIPQELLDRKPVVIYTCDGSDMGVPDTDRKELEAFIDSIPEVPSVVRERVKEDARIKKF

SEQ ID NO: 10224 - protein, 337 aa, B.fragilis
FCGAEINISKMNAKKNLMAFILTVSSIALMVICLGLEMVKACAGGDGSEWKKKVAADTLHVVHYTRPDLPQIMTDPAERAVYYVKHYWDGYLTGDTAWVNSGDTEQLYVDFIDALKYVEPETGRKALHTMMVRMEADSTAYRRFGLLGEKYLNEPNSPMRNEDFYIAVLEQMLQSDRLQEWEKIRPADRLKQAHKNRPGMKAADFTYVTVHGDNSRMSRLKAQYTMLFFYDPDCSNCRKFEKLFAEIPAFVEMVENGTLRVLAIYPDENREEWAAKAVYMPQGWIVGWNKAGDIRTRQLYDIRATPTIYLLDGRKRVILKDTSMEQLIDYLATQAGK

SEQ ID NO: 10225 - protein, 126 aa, B.fragilis
TLKDMVEIRKIEEVWGGVDIPEITGVYDPLSGLRDGTITSQAPIVVSGYNLNRYALENIRLCLVTHAKPEQVIDIRLVYTYSEGKVVVALPELKPGEYRPAVILKGDEKKVYVLPMRWVVRGRWRR

SEQ ID NO: 10226 - protein, 71 aa, B.fragilis
TGLLLLHRQLYPFPFEVYAQYFHRDVLVNGDHFGGIGDESVGKLGEMDKPVLLDAYIDKSSEVGDVADNTG

SEQ ID NO: 10227 - protein, 708 aa, B.fragilis
FMEIFHKMISAALNLPEKQISNTLGLLAEGATIPFISRYRKEITGGLDEVQIESIKTQYDKLSELAKRKETILGTIGEQGKLTPELRQRIDATWDATALEDIYLPYKPKRKTRAEAARQKGLEPLALLLMMQRENNLGSRIPAFVKGDVKDAEDALKGARDIIAEQVSEDERARNAVRNLFARQAVISAKVVKGKDEEAAKYRDYFDFSSPLKRCTSHRLLAIRRAEAEGLLKVSITPDDDECLERLDRQFVRSNNECGRQVAEAVQDAYRRLLKPSIETEFASLSKEQADDEAIRVFAENLRQLLLAPPLGQKRVMGIDPGFRTGCKVVCLDAQGNLVHNENIYPHPPVDKKTEAASKLRKMIEAYKIEAIAIGNGTASRETENFVTHQQFDRPVQVFVVSEQGASIYSASKTARDEFPDYDVTVRGAVSIARRLMDPLAELVKIDPKSIGVGQYQHDVDQTKLKKSLDQTVENCVNQVGVNLNTASSHLLTYISGLGPQLAQNIVAYRAANGAFASRKELMKVPRMGAKAFEQCAGFLRIAGGENPLDNTAVHPESYGIVQQMAKDLSCTVPQLIADKSLRTRIEMEKYITPTVGLPTLKDILQELDKPGRDPRDTIQVFEFDRNVRTINDLREGMTLPGIVSNITNFGAFVDIGIKENGLVHLSQLANRFITDPTEVVSIHQHVTVKVLSIDLERKRIQLTMKEE

SEQ ID NO: 10228 - protein, 108 aa, B.fragilis
ATNVRNKSAITINFYYLCGHKKTDTHTLKQMNMPVSFKYILYLLLLVIGCCPPMAGHAATGEKPILMICSYNPGAYPTSANVSDFMDEYQRLGGKRGVVIEDSHHRGC

SEQ ID NO: 10229 - protein, 277 aa, B.fragilis
RHIVCVDSNQSWRIVSDKAADWVEVSEPELLQGHYDGRFTVKVHSNAGYRVRGGFPAARHTVLSLVNDTGVVRDILIYQGGYVRIRGKYWLDRNLAAGGKLAQVAIPLGLEVDTTLNRGTYFQFGCPTDRWEENFMPCRGSWYDGTAESPARINELDPSPEGWRLPSRIEMEALMNSPAAPMELQREEDRTNICLLSDDGVPVYLPLCGHRSHINGCRIVIPHGHRYWTGSSQSPVYGYSLCVEPSRQMYLMHDMKKYGFPVRSIFNDERQMVNDKL

SEQ ID NO: 10230 - protein, 304 aa, B.fragilis
  UNSURE (304): Identity of amino acid sequences at the above locations are unknown.
GKMTHRIQQESIKRRLAKLAAPIFIETLLIMMLGAVDTIMLSRHSDNSVAAVGVVNQIIMLTFLVFEVINLGTSVLCSQYLGARLEKKVVQVVGVSLLVNLLVGGIISLILFTMARTILQWMGLGPELMADGMDYMRIVGAFAFFQAISLTLSASLRSANKAIYPMLVTVVVNILNIIGNYSLIFGKFGCPELGVEGAAISTAFSRGVSMVILFVILFRKHIHRFPLAYFRPFPFIELKNLMRVGLPSAGEQLSYSSSQVVITFFINMLGVEALATRTYCVNIIMFGYIFSISMAQGGAIWIGX

SEQ ID NO: 10231 - protein, 257 aa, B.fragilis
KQKTMNKEVDLSVSCLGKVKELKYDVIILPWGATEPHNLHLPYLTDCILPHDIAVEAAELALSRSGVRCMVMPPVPFGAHNPGQRELPFCIHTRYATQQAILEDIVSSLHVQGFRKLLILSGHGGNNFKGMIRDLAFEYPDFLIAAANWFEVVSPKGYFEAEIDDHAGESETSVMMHYHPELVNLAEAGDGESKPFAIASLNEKVAWVPRHWDKATVDSGVGNPKKATAEKGERYVKPIVEKLAGLFEEMAQHDLYE

SEQ ID NO: 10232 - protein, 118 aa, B.fragilis
NNMAEELTFISGSKEEHYLSLLPQVRSLIEGEVDLVANLANVAAALKEAFDFFWVGFYLVKHDQLVLGPFQGSGACTRIPKGKGVWGTAWHEGATLLVPDVEIFPGQIALEICFPDRK

SEQ ID NO: 10233 - protein, 66 aa, B.fragilis
EFKNIFLLKGACRKKSPFILLRMTTTGMDGKATVILHNYEDKKYPAVLHGNRLWLRPYEAIAWKLT

SEQ ID NO: 10234 - protein, 152 aa, B.fragilis
KLYDMKTLTFKYLKLFLLAVAMINLTSCEIEIDDFYDDDNIGGSYYNKSLDLCSRPWADTFYDADGNYCYQELNFYLDRHGEDYIRVEYPNGRYSESVYSFTWNWEDRSQYSLRMVYGPGDVSYLDDVWIRGNVLSGYLDGHDNYVDFTGVR

SEQ ID NO: 10235 - protein, 160 aa, B.fragilis
IDHWRSPSSPVVKTTAMWFNCAGRHYRRWRCPAGNRVTGLFLRQETDSFVLQTDIQRLQQVLINLLTNAAKFTKNGTITLQFEVEKEKNRVLFAVADTGCGIPKEKQKQVFERFEKLNEYAQGTGLGLSICKLTVDKWGGDIWIDPDYEGGARFVVSHPL
